United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 14

SEQ ID NO: 585928 - DNA, 14 bp, D. melanogaster
atccctatccctat

SEQ ID NO: 585929 - DNA, 13 bp, D. melanogaster
atccctcgatggt

SEQ ID NO: 585930 - DNA, 13 bp, D. melanogaster
atcccttacagaa

SEQ ID NO: 585931 - DNA, 13 bp, D. melanogaster
atccctttgccag

SEQ ID NO: 585932 - DNA, 14 bp, D. melanogaster
atcccttttggctg

SEQ ID NO: 585933 - DNA, 13 bp, D. melanogaster
atccgaaaaaggt

SEQ ID NO: 585934 - DNA, 13 bp, D. melanogaster
atccgaaaataaa

SEQ ID NO: 585935 - DNA, 13 bp, D. melanogaster
atccgaaacaaaa

SEQ ID NO: 585936 - DNA, 13 bp, D. melanogaster
atccgaaacagtt

SEQ ID NO: 585937 - DNA, 13 bp, D. melanogaster
atccgaaaccaag

SEQ ID NO: 585938 - DNA, 13 bp, D. melanogaster
atccgaaagatac

SEQ ID NO: 585939 - DNA, 13 bp, D. melanogaster
atccgaaatccga

SEQ ID NO: 585940 - DNA, 13 bp, D. melanogaster
atccgaacccgaa

SEQ ID NO: 585941 - DNA, 13 bp, D. melanogaster
atccgaaccgaac

SEQ ID NO: 585942 - DNA, 13 bp, D. melanogaster
atccgaaggcaaa

SEQ ID NO: 585943 - DNA, 14 bp, D. melanogaster
atccgaaggcaaag

SEQ ID NO: 585944 - DNA, 13 bp, D. melanogaster
atccgaatccaat

SEQ ID NO: 585945 - DNA, 13 bp, D. melanogaster
atccgaatcccaa

SEQ ID NO: 585946 - DNA, 14 bp, D. melanogaster
atccgaatcccaat

SEQ ID NO: 585947 - DNA, 14 bp, D. melanogaster
atccgaatccgaat

SEQ ID NO: 585948 - DNA, 14 bp, D. melanogaster
atccgaatccgagt

SEQ ID NO: 585949 - DNA, 13 bp, D. melanogaster
atccgaatccgat

SEQ ID NO: 585950 - DNA, 14 bp, D. melanogaster
atccgaatccgatt

SEQ ID NO: 585951 - DNA, 13 bp, D. melanogaster
atccgaatccgca

SEQ ID NO: 585952 - DNA, 13 bp, D. melanogaster
atccgaatccgta

SEQ ID NO: 585953 - DNA, 13 bp, D. melanogaster
atccgaatcgaaa

SEQ ID NO: 585954 - DNA, 13 bp, D. melanogaster
atccgaattcgat

SEQ ID NO: 585955 - DNA, 13 bp, D. melanogaster
atccgacagatac

SEQ ID NO: 585956 - DNA, 13 bp, D. melanogaster
atccgagatccga

SEQ ID NO: 585957 - DNA, 13 bp, D. melanogaster
atccgaggagtgg

SEQ ID NO: 585958 - DNA, 13 bp, D. melanogaster
atccgatacgatc

SEQ ID NO: 585959 - DNA, 13 bp, D. melanogaster
atccgatcccatc

SEQ ID NO: 585960 - DNA, 14 bp, D. melanogaster
atccgatcccatcc

SEQ ID NO: 585961 - DNA, 13 bp, D. melanogaster
atccgatccgaac

SEQ ID NO: 585962 - DNA, 14 bp, D. melanogaster
atccgatccgatcc

SEQ ID NO: 585963 - DNA, 13 bp, D. melanogaster
atccgatcggatc

SEQ ID NO: 585964 - DNA, 13 bp, D. melanogaster
atccgatctgatc

SEQ ID NO: 585965 - DNA, 13 bp, D. melanogaster
atccgatgcgatg

SEQ ID NO: 585966 - DNA, 14 bp, D. melanogaster
atccgatgcgatgc

SEQ ID NO: 585967 - DNA, 13 bp, D. melanogaster
atccgattcgatc

SEQ ID NO: 585968 - DNA, 13 bp, D. melanogaster
atccgcaaaagaa

SEQ ID NO: 585969 - DNA, 13 bp, D. melanogaster
atccgcaatccgc

SEQ ID NO: 585970 - DNA, 13 bp, D. melanogaster
atccgcacacaca

SEQ ID NO: 585971 - DNA, 13 bp, D. melanogaster
atccgcatcagca

SEQ ID NO: 585972 - DNA, 13 bp, D. melanogaster
atccgcatccgaa

SEQ ID NO: 585973 - DNA, 14 bp, D. melanogaster
atccgcatccgaat

SEQ ID NO: 585974 - DNA, 13 bp, D. melanogaster
atccgcatccgca

SEQ ID NO: 585975 - DNA, 13 bp, D. melanogaster
atccgcatccgta

SEQ ID NO: 585976 - DNA, 14 bp, D. melanogaster
atccgcatccgtat

SEQ ID NO: 585977 - DNA, 13 bp, D. melanogaster
atccgcatctgca

SEQ ID NO: 585978 - DNA, 14 bp, D. melanogaster
atccgcatctgcat

SEQ ID NO: 585979 - DNA, 13 bp, D. melanogaster
atccgcatctgta

SEQ ID NO: 585980 - DNA, 13 bp, D. melanogaster
atccgcattcgca

SEQ ID NO: 585981 - DNA, 14 bp, D. melanogaster
atccgcattcgcat

SEQ ID NO: 585982 - DNA, 14 bp, D. melanogaster
atccgccaactcag

SEQ ID NO: 585983 - DNA, 13 bp, D. melanogaster
atccgccagatac

SEQ ID NO: 585984 - DNA, 13 bp, D. melanogaster
atccgccccgttg

SEQ ID NO: 585985 - DNA, 13 bp, D. melanogaster
atccggatccgga

SEQ ID NO: 585986 - DNA, 14 bp, D. melanogaster
atccggatccggat

SEQ ID NO: 585987 - DNA, 13 bp, D. melanogaster
atccggatcttat

SEQ ID NO: 585988 - DNA, 13 bp, D. melanogaster
atccggcagacat

SEQ ID NO: 585989 - DNA, 13 bp, D. melanogaster
atccggccgaatg

SEQ ID NO: 585990 - DNA, 13 bp, D. melanogaster
atccggctcgaag

SEQ ID NO: 585991 - DNA, 13 bp, D. melanogaster
atccggtttcttt

SEQ ID NO: 585992 - DNA, 13 bp, D. melanogaster
atccgtatccata

SEQ ID NO: 585993 - DNA, 13 bp, D. melanogaster
atccgtatccgta

SEQ ID NO: 585994 - DNA, 14 bp, D. melanogaster
atccgtatccgtat

SEQ ID NO: 585995 - DNA, 13 bp, D. melanogaster
atccgtatctgca

SEQ ID NO: 585996 - DNA, 13 bp, D. melanogaster
atccgtatctgta

SEQ ID NO: 585997 - DNA, 14 bp, D. melanogaster
atccgtatctgtgt

SEQ ID NO: 585998 - DNA, 13 bp, D. melanogaster
atccgtcagatac

SEQ ID NO: 585999 - DNA, 13 bp, D. melanogaster
atccgtccatcca

SEQ ID NO: 586000 - DNA, 13 bp, D. melanogaster
atccgtctgcaaa

SEQ ID NO: 586001 - DNA, 13 bp, D. melanogaster
atccgtctggtgg

SEQ ID NO: 586002 - DNA, 13 bp, D. melanogaster
atccgtctgtccg

SEQ ID NO: 586003 - DNA, 13 bp, D. melanogaster
atccgtgaatctg

SEQ ID NO: 586004 - DNA, 13 bp, D. melanogaster
atccgtgagatac

SEQ ID NO: 586005 - DNA, 13 bp, D. melanogaster
atccgttactcgt

SEQ ID NO: 586006 - DNA, 13 bp, D. melanogaster
atccgttcttctt

SEQ ID NO: 586007 - DNA, 13 bp, D. melanogaster
atccgtttaaaag

SEQ ID NO: 586008 - DNA, 13 bp, D. melanogaster
atccgtttccgtt

SEQ ID NO: 586009 - DNA, 13 bp, D. melanogaster
atcctaaatgaac

SEQ ID NO: 586010 - DNA, 13 bp, D. melanogaster
atcctacttcctc

SEQ ID NO: 586011 - DNA, 13 bp, D. melanogaster
atcctattatctg

SEQ ID NO: 586012 - DNA, 13 bp, D. melanogaster
atcctcaagaacc

SEQ ID NO: 586013 - DNA, 13 bp, D. melanogaster
atcctcaccccaa

SEQ ID NO: 586014 - DNA, 13 bp, D. melanogaster
atcctcatcatca

SEQ ID NO: 586015 - DNA, 13 bp, D. melanogaster
atcctcatccaca

SEQ ID NO: 586016 - DNA, 13 bp, D. melanogaster
atcctcatcctca

SEQ ID NO: 586017 - DNA, 13 bp, D. melanogaster
atcctcattccca

SEQ ID NO: 586018 - DNA, 13 bp, D. melanogaster
atcctcctgctcc

SEQ ID NO: 586019 - DNA, 13 bp, D. melanogaster
atcctcctttgta

SEQ ID NO: 586020 - DNA, 14 bp, D. melanogaster
atcctgaaaaatgt

SEQ ID NO: 586021 - DNA, 13 bp, D. melanogaster
atcctgaatcctg

SEQ ID NO: 586022 - DNA, 14 bp, D. melanogaster
atcctgatcaagaa

SEQ ID NO: 586023 - DNA, 13 bp, D. melanogaster
atcctgcaagatg

SEQ ID NO: 586024 - DNA, 13 bp, D. melanogaster
atcctgcgcagga

SEQ ID NO: 586025 - DNA, 13 bp, D. melanogaster
atcctgctgctgc

SEQ ID NO: 586026 - DNA, 13 bp, D. melanogaster
atcctggcagcca

SEQ ID NO: 586027 - DNA, 13 bp, D. melanogaster
atcctggccagaa

SEQ ID NO: 586028 - DNA, 14 bp, D. melanogaster
atcctggccagaaa

SEQ ID NO: 586029 - DNA, 13 bp, D. melanogaster
atcctggccgtcc

SEQ ID NO: 586030 - DNA, 13 bp, D. melanogaster
atcctggctgcca

SEQ ID NO: 586031 - DNA, 13 bp, D. melanogaster
atcctgtatcctg

SEQ ID NO: 586032 - DNA, 13 bp, D. melanogaster
atcctgtcctttt

SEQ ID NO: 586033 - DNA, 13 bp, D. melanogaster
atccttatcctta

SEQ ID NO: 586034 - DNA, 13 bp, D. melanogaster
atccttgcatcct

SEQ ID NO: 586035 - DNA, 13 bp, D. melanogaster
atccttgttgttg

SEQ ID NO: 586036 - DNA, 13 bp, D. melanogaster
atcctttaaagca

SEQ ID NO: 586037 - DNA, 13 bp, D. melanogaster
atcctttaataaa

SEQ ID NO: 586038 - DNA, 14 bp, D. melanogaster
atcctttatcctaa

SEQ ID NO: 586039 - DNA, 13 bp, D. melanogaster
atcctttatcctt

SEQ ID NO: 586040 - DNA, 13 bp, D. melanogaster
atcctttattatg

SEQ ID NO: 586041 - DNA, 13 bp, D. melanogaster
atcctttgtaaat

SEQ ID NO: 586042 - DNA, 13 bp, D. melanogaster
atccttttaaaaa

SEQ ID NO: 586043 - DNA, 13 bp, D. melanogaster
atcctttttggcc

SEQ ID NO: 586044 - DNA, 13 bp, D. melanogaster
atcgaaaaatatt

SEQ ID NO: 586045 - DNA, 13 bp, D. melanogaster
atcgaaaacattt

SEQ ID NO: 586046 - DNA, 13 bp, D. melanogaster
atcgaaaacgaaa

SEQ ID NO: 586047 - DNA, 13 bp, D. melanogaster
atcgaaaactgac

SEQ ID NO: 586048 - DNA, 13 bp, D. melanogaster
atcgaaaagcaaa

SEQ ID NO: 586049 - DNA, 13 bp, D. melanogaster
atcgaaaaggaaa

SEQ ID NO: 586050 - DNA, 14 bp, D. melanogaster
atcgaaaaggaaat

SEQ ID NO: 586051 - DNA, 13 bp, D. melanogaster
atcgaaaatcaat

SEQ ID NO: 586052 - DNA, 13 bp, D. melanogaster
atcgaaaatgaat

SEQ ID NO: 586053 - DNA, 13 bp, D. melanogaster
atcgaaaatgttt

SEQ ID NO: 586054 - DNA, 13 bp, D. melanogaster
atcgaaaattatt

SEQ ID NO: 586055 - DNA, 13 bp, D. melanogaster
atcgaaacaatgc

SEQ ID NO: 586056 - DNA, 13 bp, D. melanogaster
atcgaaacgaaaa

SEQ ID NO: 586057 - DNA, 13 bp, D. melanogaster
atcgaaacgaaat

SEQ ID NO: 586058 - DNA, 13 bp, D. melanogaster
atcgaaactgaaa

SEQ ID NO: 586059 - DNA, 13 bp, D. melanogaster
atcgaaagcaaga

SEQ ID NO: 586060 - DNA, 13 bp, D. melanogaster
atcgaaagcatgt

SEQ ID NO: 586061 - DNA, 13 bp, D. melanogaster
atcgaaagcgata

SEQ ID NO: 586062 - DNA, 13 bp, D. melanogaster
atcgaaagtgtag

SEQ ID NO: 586063 - DNA, 13 bp, D. melanogaster
atcgaaataaata

SEQ ID NO: 586064 - DNA, 13 bp, D. melanogaster
atcgaaataatcg

SEQ ID NO: 586065 - DNA, 14 bp, D. melanogaster
atcgaaataatcga

SEQ ID NO: 586066 - DNA, 13 bp, D. melanogaster
atcgaaatatttt

SEQ ID NO: 586067 - DNA, 13 bp, D. melanogaster
atcgaaatcaaaa

SEQ ID NO: 586068 - DNA, 13 bp, D. melanogaster
atcgaaatcgaaa

SEQ ID NO: 586069 - DNA, 14 bp, D. melanogaster
atcgaaatcgaaat

SEQ ID NO: 586070 - DNA, 13 bp, D. melanogaster
atcgaaatcggaa

SEQ ID NO: 586071 - DNA, 13 bp, D. melanogaster
atcgaaatgaact

SEQ ID NO: 586072 - DNA, 13 bp, D. melanogaster
atcgaaatgaatg

SEQ ID NO: 586073 - DNA, 13 bp, D. melanogaster
atcgaaatggaaa

SEQ ID NO: 586074 - DNA, 13 bp, D. melanogaster
atcgaaatggaat

SEQ ID NO: 586075 - DNA, 13 bp, D. melanogaster
atcgaaatggcaa

SEQ ID NO: 586076 - DNA, 13 bp, D. melanogaster
atcgaaattatat

SEQ ID NO: 586077 - DNA, 13 bp, D. melanogaster
atcgaaattattt

SEQ ID NO: 586078 - DNA, 13 bp, D. melanogaster
atcgaaattgaaa

SEQ ID NO: 586079 - DNA, 13 bp, D. melanogaster
atcgaaattgaat

SEQ ID NO: 586080 - DNA, 13 bp, D. melanogaster
atcgaaattggca

SEQ ID NO: 586081 - DNA, 13 bp, D. melanogaster
atcgaaatttatg

SEQ ID NO: 586082 - DNA, 13 bp, D. melanogaster
atcgaaatttgaa

SEQ ID NO: 586083 - DNA, 13 bp, D. melanogaster
atcgaacaataaa

SEQ ID NO: 586084 - DNA, 14 bp, D. melanogaster
atcgaacaggtcaa

SEQ ID NO: 586085 - DNA, 13 bp, D. melanogaster
atcgaaccgaaga

SEQ ID NO: 586086 - DNA, 13 bp, D. melanogaster
atcgaactactga

SEQ ID NO: 586087 - DNA, 13 bp, D. melanogaster
atcgaactgcatt

SEQ ID NO: 586088 - DNA, 14 bp, D. melanogaster
atcgaactttataa

SEQ ID NO: 586089 - DNA, 13 bp, D. melanogaster
atcgaagaaacga

SEQ ID NO: 586090 - DNA, 14 bp, D. melanogaster
atcgaagctataaa

SEQ ID NO: 586091 - DNA, 13 bp, D. melanogaster
atcgaagctggag

SEQ ID NO: 586092 - DNA, 13 bp, D. melanogaster
atcgaaggaacga

SEQ ID NO: 586093 - DNA, 13 bp, D. melanogaster
atcgaaggctctt

SEQ ID NO: 586094 - DNA, 13 bp, D. melanogaster
atcgaagggaaaa

SEQ ID NO: 586095 - DNA, 13 bp, D. melanogaster
atcgaatatcgaa

SEQ ID NO: 586096 - DNA, 13 bp, D. melanogaster
atcgaatcaaatc

SEQ ID NO: 586097 - DNA, 13 bp, D. melanogaster
atcgaatcaatca

SEQ ID NO: 586098 - DNA, 13 bp, D. melanogaster
atcgaatcgaaaa

SEQ ID NO: 586099 - DNA, 13 bp, D. melanogaster
atcgaatcgaaac

SEQ ID NO: 586100 - DNA, 14 bp, D. melanogaster
atcgaatcgaaacg

SEQ ID NO: 586101 - DNA, 13 bp, D. melanogaster
atcgaatcgaaat

SEQ ID NO: 586102 - DNA, 14 bp, D. melanogaster
atcgaatcgaaatc

SEQ ID NO: 586103 - DNA, 13 bp, D. melanogaster
atcgaatcgaact

SEQ ID NO: 586104 - DNA, 13 bp, D. melanogaster
atcgaatcgaagc

SEQ ID NO: 586105 - DNA, 13 bp, D. melanogaster
atcgaatcgaata

SEQ ID NO: 586106 - DNA, 13 bp, D. melanogaster
atcgaatcgaatc

SEQ ID NO: 586107 - DNA, 14 bp, D. melanogaster
atcgaatcgaatca

SEQ ID NO: 586108 - DNA, 14 bp, D. melanogaster
atcgaatcgaattg

SEQ ID NO: 586109 - DNA, 13 bp, D. melanogaster
atcgaatcgattc

SEQ ID NO: 586110 - DNA, 13 bp, D. melanogaster
atcgaatgaaatt

SEQ ID NO: 586111 - DNA, 13 bp, D. melanogaster
atcgaatgcattg

SEQ ID NO: 586112 - DNA, 13 bp, D. melanogaster
atcgaatgctgaa

SEQ ID NO: 586113 - DNA, 13 bp, D. melanogaster
atcgaatggaaat

SEQ ID NO: 586114 - DNA, 13 bp, D. melanogaster
atcgaatggaatt

SEQ ID NO: 586115 - DNA, 13 bp, D. melanogaster
atcgaattcgaaa

SEQ ID NO: 586116 - DNA, 13 bp, D. melanogaster
atcgaattcgatt

SEQ ID NO: 586117 - DNA, 13 bp, D. melanogaster
atcgaattgaata

SEQ ID NO: 586118 - DNA, 13 bp, D. melanogaster
atcgaattgaatc

SEQ ID NO: 586119 - DNA, 13 bp, D. melanogaster
atcgaattgaatg

SEQ ID NO: 586120 - DNA, 13 bp, D. melanogaster
atcgaattgattt

SEQ ID NO: 586121 - DNA, 13 bp, D. melanogaster
atcgaattgcatt

SEQ ID NO: 586122 - DNA, 13 bp, D. melanogaster
atcgaattggaaa

SEQ ID NO: 586123 - DNA, 13 bp, D. melanogaster
atcgaattggatc

SEQ ID NO: 586124 - DNA, 13 bp, D. melanogaster
atcgaattgtttt

SEQ ID NO: 586125 - DNA, 13 bp, D. melanogaster
atcgaatttcaaa

SEQ ID NO: 586126 - DNA, 13 bp, D. melanogaster
atcgaatttgaat

SEQ ID NO: 586127 - DNA, 13 bp, D. melanogaster
atcgaatttgtat

SEQ ID NO: 586128 - DNA, 13 bp, D. melanogaster
atcgaattttaaa

SEQ ID NO: 586129 - DNA, 13 bp, D. melanogaster
atcgaattttata

SEQ ID NO: 586130 - DNA, 13 bp, D. melanogaster
atcgaatttttat

SEQ ID NO: 586131 - DNA, 13 bp, D. melanogaster
atcgaatttttgt

SEQ ID NO: 586132 - DNA, 13 bp, D. melanogaster
atcgacaacaaca

SEQ ID NO: 586133 - DNA, 14 bp, D. melanogaster
atcgacaacaacat

SEQ ID NO: 586134 - DNA, 13 bp, D. melanogaster
atcgacaacgccg

SEQ ID NO: 586135 - DNA, 14 bp, D. melanogaster
atcgacatcgacat

SEQ ID NO: 586136 - DNA, 13 bp, D. melanogaster
atcgacattgaga

SEQ ID NO: 586137 - DNA, 13 bp, D. melanogaster
atcgaccaagtta

SEQ ID NO: 586138 - DNA, 13 bp, D. melanogaster
atcgacccaaaat

SEQ ID NO: 586139 - DNA, 13 bp, D. melanogaster
atcgacctgtatt

SEQ ID NO: 586140 - DNA, 14 bp, D. melanogaster
atcgacggagcctt

SEQ ID NO: 586141 - DNA, 13 bp, D. melanogaster
atcgactatcaga

SEQ ID NO: 586142 - DNA, 13 bp, D. melanogaster
atcgactcggcta

SEQ ID NO: 586143 - DNA, 13 bp, D. melanogaster
atcgactggtgga

SEQ ID NO: 586144 - DNA, 13 bp, D. melanogaster
atcgagaatatat

SEQ ID NO: 586145 - DNA, 13 bp, D. melanogaster
atcgagaatcgag

SEQ ID NO: 586146 - DNA, 13 bp, D. melanogaster
atcgagataacaa

SEQ ID NO: 586147 - DNA, 13 bp, D. melanogaster
atcgagggatcga

SEQ ID NO: 586148 - DNA, 13 bp, D. melanogaster
atcgagtcgaaat

SEQ ID NO: 586149 - DNA, 13 bp, D. melanogaster
atcgataaatttt

SEQ ID NO: 586150 - DNA, 14 bp, D. melanogaster
atcgataaattttc

SEQ ID NO: 586151 - DNA, 13 bp, D. melanogaster
atcgataacgata

SEQ ID NO: 586152 - DNA, 13 bp, D. melanogaster
atcgatactatcg

SEQ ID NO: 586153 - DNA, 13 bp, D. melanogaster
atcgatagaaatt

SEQ ID NO: 586154 - DNA, 14 bp, D. melanogaster
atcgatagaaattt

SEQ ID NO: 586155 - DNA, 13 bp, D. melanogaster
atcgatagatatt

SEQ ID NO: 586156 - DNA, 13 bp, D. melanogaster
atcgatataggaa

SEQ ID NO: 586157 - DNA, 13 bp, D. melanogaster
atcgatatatcga

SEQ ID NO: 586158 - DNA, 14 bp, D. melanogaster
atcgatatatcgat

SEQ ID NO: 586159 - DNA, 13 bp, D. melanogaster
atcgatatatttt

SEQ ID NO: 586160 - DNA, 13 bp, D. melanogaster
atcgatatcgaaa

SEQ ID NO: 586161 - DNA, 13 bp, D. melanogaster
atcgatatcgata

SEQ ID NO: 586162 - DNA, 13 bp, D. melanogaster
atcgatatgcaaa

SEQ ID NO: 586163 - DNA, 14 bp, D. melanogaster
atcgatatgccaga

SEQ ID NO: 586164 - DNA, 13 bp, D. melanogaster
atcgatattatcg

SEQ ID NO: 586165 - DNA, 13 bp, D. melanogaster
atcgatattttct

SEQ ID NO: 586166 - DNA, 13 bp, D. melanogaster
atcgatatttttc

SEQ ID NO: 586167 - DNA, 13 bp, D. melanogaster
atcgatcatttgg

SEQ ID NO: 586168 - DNA, 13 bp, D. melanogaster
atcgatcgatcga

SEQ ID NO: 586169 - DNA, 14 bp, D. melanogaster
atcgatcgatcgat

SEQ ID NO: 586170 - DNA, 13 bp, D. melanogaster
atcgatcgatcgc

SEQ ID NO: 586171 - DNA, 13 bp, D. melanogaster
atcgatcttcctg

SEQ ID NO: 586172 - DNA, 13 bp, D. melanogaster
atcgatgaactgc

SEQ ID NO: 586173 - DNA, 13 bp, D. melanogaster
atcgatgagggta

SEQ ID NO: 586174 - DNA, 13 bp, D. melanogaster
atcgatgctaatt

SEQ ID NO: 586175 - DNA, 13 bp, D. melanogaster
atcgatgtttttc

SEQ ID NO: 586176 - DNA, 13 bp, D. melanogaster
atcgattgaaaaa

SEQ ID NO: 586177 - DNA, 13 bp, D. melanogaster
atcgattgaaaat

SEQ ID NO: 586178 - DNA, 13 bp, D. melanogaster
atcgattgaaatt

SEQ ID NO: 586179 - DNA, 13 bp, D. melanogaster
atcgattgattga

SEQ ID NO: 586180 - DNA, 13 bp, D. melanogaster
atcgattgatttt

SEQ ID NO: 586181 - DNA, 13 bp, D. melanogaster
atcgattggaaat

SEQ ID NO: 586182 - DNA, 13 bp, D. melanogaster
atcgattggaatt

SEQ ID NO: 586183 - DNA, 13 bp, D. melanogaster
atcgattgggatt

SEQ ID NO: 586184 - DNA, 13 bp, D. melanogaster
atcgattggtttt

SEQ ID NO: 586185 - DNA, 13 bp, D. melanogaster
atcgatttaaatg

SEQ ID NO: 586186 - DNA, 13 bp, D. melanogaster
atcgatttaaatt

SEQ ID NO: 586187 - DNA, 14 bp, D. melanogaster
atcgatttgcaaaa

SEQ ID NO: 586188 - DNA, 13 bp, D. melanogaster
atcgatttgcatt

SEQ ID NO: 586189 - DNA, 14 bp, D. melanogaster
atcgatttgcattt

SEQ ID NO: 586190 - DNA, 13 bp, D. melanogaster
atcgatttgccaa

SEQ ID NO: 586191 - DNA, 14 bp, D. melanogaster
atcgatttgccaaa

SEQ ID NO: 586192 - DNA, 13 bp, D. melanogaster
atcgatttgccat

SEQ ID NO: 586193 - DNA, 13 bp, D. melanogaster
atcgatttgtcaa

SEQ ID NO: 586194 - DNA, 13 bp, D. melanogaster
atcgatttgttta

SEQ ID NO: 586195 - DNA, 13 bp, D. melanogaster
atcgattttaata

SEQ ID NO: 586196 - DNA, 13 bp, D. melanogaster
atcgattttatat

SEQ ID NO: 586197 - DNA, 13 bp, D. melanogaster
atcgattttattg

SEQ ID NO: 586198 - DNA, 13 bp, D. melanogaster
atcgattttccaa

SEQ ID NO: 586199 - DNA, 13 bp, D. melanogaster
atcgattttgcaa

SEQ ID NO: 586200 - DNA, 13 bp, D. melanogaster
atcgattttgttt

SEQ ID NO: 586201 - DNA, 13 bp, D. melanogaster
atcgatttttaat

SEQ ID NO: 586202 - DNA, 13 bp, D. melanogaster
atcgatttttgtt

SEQ ID NO: 586203 - DNA, 14 bp, D. melanogaster
atcgattttttcaa

SEQ ID NO: 586204 - DNA, 13 bp, D. melanogaster
atcgcaaaagaaa

SEQ ID NO: 586205 - DNA, 13 bp, D. melanogaster
atcgcaaagtgct

SEQ ID NO: 586206 - DNA, 13 bp, D. melanogaster
atcgcaacaacaa

SEQ ID NO: 586207 - DNA, 13 bp, D. melanogaster
atcgcaacatcaa

SEQ ID NO: 586208 - DNA, 14 bp, D. melanogaster
atcgcaagaagagg

SEQ ID NO: 586209 - DNA, 13 bp, D. melanogaster
atcgcaagcattt

SEQ ID NO: 586210 - DNA, 15 bp, D. melanogaster
atcgcaaggcagcag

SEQ ID NO: 586211 - DNA, 14 bp, D. melanogaster
atcgcaatcgcaat

SEQ ID NO: 586212 - DNA, 13 bp, D. melanogaster
atcgcaatcgcag

SEQ ID NO: 586213 - DNA, 14 bp, D. melanogaster
atcgcaatcggaat

SEQ ID NO: 586214 - DNA, 13 bp, D. melanogaster
atcgcacacacat

SEQ ID NO: 586215 - DNA, 13 bp, D. melanogaster
atcgcagatcgca

SEQ ID NO: 586216 - DNA, 13 bp, D. melanogaster
atcgcagcaaatc

SEQ ID NO: 586217 - DNA, 13 bp, D. melanogaster
atcgcataaaaca

SEQ ID NO: 586218 - DNA, 14 bp, D. melanogaster
atcgcataaaacac

SEQ ID NO: 586219 - DNA, 13 bp, D. melanogaster
atcgcatcgaatc

SEQ ID NO: 586220 - DNA, 13 bp, D. melanogaster
atcgcatcgcatc

SEQ ID NO: 586221 - DNA, 14 bp, D. melanogaster
atcgcatcgcatcg

SEQ ID NO: 586222 - DNA, 13 bp, D. melanogaster
atcgcatcgcatt

SEQ ID NO: 586223 - DNA, 14 bp, D. melanogaster
atcgcatcggatcg

SEQ ID NO: 586224 - DNA, 13 bp, D. melanogaster
atcgcatcgtatc

SEQ ID NO: 586225 - DNA, 14 bp, D. melanogaster
atcgcatcgtatcg

SEQ ID NO: 586226 - DNA, 13 bp, D. melanogaster
atcgcatcttaaa

SEQ ID NO: 586227 - DNA, 13 bp, D. melanogaster
atcgcatcttatt

SEQ ID NO: 586228 - DNA, 13 bp, D. melanogaster
atcgcatggcaga

SEQ ID NO: 586229 - DNA, 13 bp, D. melanogaster
atcgcattcacac

SEQ ID NO: 586230 - DNA, 13 bp, D. melanogaster
atcgcattgcatt

SEQ ID NO: 586231 - DNA, 13 bp, D. melanogaster
atcgcatttaaat

SEQ ID NO: 586232 - DNA, 13 bp, D. melanogaster
atcgcatttaatt

SEQ ID NO: 586233 - DNA, 13 bp, D. melanogaster
atcgccaaaaaaa

SEQ ID NO: 586234 - DNA, 14 bp, D. melanogaster
atcgccatcatcat

SEQ ID NO: 586235 - DNA, 14 bp, D. melanogaster
atcgccatcgccac

SEQ ID NO: 586236 - DNA, 13 bp, D. melanogaster
atcgccatcgccg

SEQ ID NO: 586237 - DNA, 13 bp, D. melanogaster
atcgccatcgtca

SEQ ID NO: 586238 - DNA, 13 bp, D. melanogaster
atcgccatctcca

SEQ ID NO: 586239 - DNA, 13 bp, D. melanogaster
atcgccatctctt

SEQ ID NO: 586240 - DNA, 13 bp, D. melanogaster
atcgccattagat

SEQ ID NO: 586241 - DNA, 14 bp, D. melanogaster
atcgccattgccat

SEQ ID NO: 586242 - DNA, 13 bp, D. melanogaster
atcgcccaaaaat

SEQ ID NO: 586243 - DNA, 13 bp, D. melanogaster
atcgcccatcgcc

SEQ ID NO: 586244 - DNA, 15 bp, D. melanogaster
atcgccctggaaccg

SEQ ID NO: 586245 - DNA, 13 bp, D. melanogaster
atcgccctttcaa

SEQ ID NO: 586246 - DNA, 14 bp, D. melanogaster
atcgcgaaatcgag

SEQ ID NO: 586247 - DNA, 14 bp, D. melanogaster
atcgcgcatacgcc

SEQ ID NO: 586248 - DNA, 13 bp, D. melanogaster
atcgcgtatacgc

SEQ ID NO: 586249 - DNA, 14 bp, D. melanogaster
atcgcgtatacgcc

SEQ ID NO: 586250 - DNA, 13 bp, D. melanogaster
atcgcgttcataa

SEQ ID NO: 586251 - DNA, 13 bp, D. melanogaster
atcgctatattcg

SEQ ID NO: 586252 - DNA, 13 bp, D. melanogaster
atcgctcatacgc

SEQ ID NO: 586253 - DNA, 14 bp, D. melanogaster
atcgctcatacgcc

SEQ ID NO: 586254 - DNA, 13 bp, D. melanogaster
atcgctctcaata

SEQ ID NO: 586255 - DNA, 14 bp, D. melanogaster
atcgctctcaatat

SEQ ID NO: 586256 - DNA, 13 bp, D. melanogaster
atcgctgatcacc

SEQ ID NO: 586257 - DNA, 13 bp, D. melanogaster
atcgctgatcatc

SEQ ID NO: 586258 - DNA, 13 bp, D. melanogaster
atcgctgcagaaa

SEQ ID NO: 586259 - DNA, 13 bp, D. melanogaster
atcgctgcatcca

SEQ ID NO: 586260 - DNA, 13 bp, D. melanogaster
atcgctggttttt

SEQ ID NO: 586261 - DNA, 13 bp, D. melanogaster
atcgctgtaataa

SEQ ID NO: 586262 - DNA, 13 bp, D. melanogaster
atcgctgtatata

SEQ ID NO: 586263 - DNA, 14 bp, D. melanogaster
atcgcttaccattt

SEQ ID NO: 586264 - DNA, 13 bp, D. melanogaster
atcgctttgtttt

SEQ ID NO: 586265 - DNA, 13 bp, D. melanogaster
atcgcttttttat

SEQ ID NO: 586266 - DNA, 13 bp, D. melanogaster
atcggaaaacagc

SEQ ID NO: 586267 - DNA, 13 bp, D. melanogaster
atcggaaaatcgg

SEQ ID NO: 586268 - DNA, 13 bp, D. melanogaster
atcggaaaattct

SEQ ID NO: 586269 - DNA, 13 bp, D. melanogaster
atcggaaacggaa

SEQ ID NO: 586270 - DNA, 13 bp, D. melanogaster
atcggaaatattt

SEQ ID NO: 586271 - DNA, 13 bp, D. melanogaster
atcggaacttgaa

SEQ ID NO: 586272 - DNA, 13 bp, D. melanogaster
atcggaatcagaa

SEQ ID NO: 586273 - DNA, 13 bp, D. melanogaster
atcggaatcatta

SEQ ID NO: 586274 - DNA, 13 bp, D. melanogaster
atcggaatccgaa

SEQ ID NO: 586275 - DNA, 14 bp, D. melanogaster
atcggaatccgaat

SEQ ID NO: 586276 - DNA, 13 bp, D. melanogaster
atcggaatcgaaa

SEQ ID NO: 586277 - DNA, 14 bp, D. melanogaster
atcggaatcgaaat

SEQ ID NO: 586278 - DNA, 13 bp, D. melanogaster
atcggaatcgcaa

SEQ ID NO: 586279 - DNA, 14 bp, D. melanogaster
atcggaatcggaat

SEQ ID NO: 586280 - DNA, 13 bp, D. melanogaster
atcggaatcggag

SEQ ID NO: 586281 - DNA, 13 bp, D. melanogaster
atcggaatcggga

SEQ ID NO: 586282 - DNA, 13 bp, D. melanogaster
atcggaatctgaa

SEQ ID NO: 586283 - DNA, 13 bp, D. melanogaster
atcggaattgaaa

SEQ ID NO: 586284 - DNA, 14 bp, D. melanogaster
atcggaattggaat

SEQ ID NO: 586285 - DNA, 13 bp, D. melanogaster
atcggagaaaaaa

SEQ ID NO: 586286 - DNA, 14 bp, D. melanogaster
atcggagaaaaaag

SEQ ID NO: 586287 - DNA, 13 bp, D. melanogaster
atcggagatggct

SEQ ID NO: 586288 - DNA, 13 bp, D. melanogaster
atcggataataat

SEQ ID NO: 586289 - DNA, 13 bp, D. melanogaster
atcggatcgcatc

SEQ ID NO: 586290 - DNA, 14 bp, D. melanogaster
atcggatcggatcg

SEQ ID NO: 586291 - DNA, 13 bp, D. melanogaster
atcggatcggatt

SEQ ID NO: 586292 - DNA, 13 bp, D. melanogaster
atcggatcgtatc

SEQ ID NO: 586293 - DNA, 13 bp, D. melanogaster
atcggattcggaa

SEQ ID NO: 586294 - DNA, 13 bp, D. melanogaster
atcggattggatc

SEQ ID NO: 586295 - DNA, 13 bp, D. melanogaster
atcggattgtgga

SEQ ID NO: 586296 - DNA, 13 bp, D. melanogaster
atcggattttctt

SEQ ID NO: 586297 - DNA, 13 bp, D. melanogaster
atcggcaacaaca

SEQ ID NO: 586298 - DNA, 14 bp, D. melanogaster
atcggcaactgaat

SEQ ID NO: 586299 - DNA, 13 bp, D. melanogaster
atcggcatgaagt

SEQ ID NO: 586300 - DNA, 13 bp, D. melanogaster
atcggcattggca

SEQ ID NO: 586301 - DNA, 14 bp, D. melanogaster
atcggcgagcataa

SEQ ID NO: 586302 - DNA, 13 bp, D. melanogaster
atcggcggaggtg

SEQ ID NO: 586303 - DNA, 13 bp, D. melanogaster
atcggcgttgtcg

SEQ ID NO: 586304 - DNA, 13 bp, D. melanogaster
atcggctggccag

SEQ ID NO: 586305 - DNA, 13 bp, D. melanogaster
atcggcttttgcc

SEQ ID NO: 586306 - DNA, 13 bp, D. melanogaster
atcgggaaattaa

SEQ ID NO: 586307 - DNA, 14 bp, D. melanogaster
atcgggattgggat

SEQ ID NO: 586308 - DNA, 13 bp, D. melanogaster
atcggggtcacca

SEQ ID NO: 586309 - DNA, 14 bp, D. melanogaster
atcggggtcaccaa

SEQ ID NO: 586310 - DNA, 13 bp, D. melanogaster
atcggggtcggct

SEQ ID NO: 586311 - DNA, 13 bp, D. melanogaster
atcggtccaaaaa

SEQ ID NO: 586312 - DNA, 14 bp, D. melanogaster
atcggtccttttca

SEQ ID NO: 586313 - DNA, 13 bp, D. melanogaster
atcggtctatatg

SEQ ID NO: 586314 - DNA, 13 bp, D. melanogaster
atcggtgctgcca

SEQ ID NO: 586315 - DNA, 13 bp, D. melanogaster
atcggttgtattt

SEQ ID NO: 586316 - DNA, 13 bp, D. melanogaster
atcgtaaactcga

SEQ ID NO: 586317 - DNA, 13 bp, D. melanogaster
atcgtaaataaat

SEQ ID NO: 586318 - DNA, 13 bp, D. melanogaster
atcgtaaatattt

SEQ ID NO: 586319 - DNA, 13 bp, D. melanogaster
atcgtaataaaaa

SEQ ID NO: 586320 - DNA, 14 bp, D. melanogaster
atcgtaataaaaat

SEQ ID NO: 586321 - DNA, 13 bp, D. melanogaster
atcgtatcggatc

SEQ ID NO: 586322 - DNA, 13 bp, D. melanogaster
atcgtatcgtatc

SEQ ID NO: 586323 - DNA, 13 bp, D. melanogaster
atcgtatttcatt

SEQ ID NO: 586324 - DNA, 13 bp, D. melanogaster
atcgtcaatcaaa

SEQ ID NO: 586325 - DNA, 13 bp, D. melanogaster
atcgtcatcagca

SEQ ID NO: 586326 - DNA, 17 bp, D. melanogaster
atcgtcatcatcatcat

SEQ ID NO: 586327 - DNA, 13 bp, D. melanogaster
atcgtcatcatcg

SEQ ID NO: 586328 - DNA, 13 bp, D. melanogaster
atcgtcatcatct

SEQ ID NO: 586329 - DNA, 13 bp, D. melanogaster
atcgtcatcatta

SEQ ID NO: 586330 - DNA, 13 bp, D. melanogaster
atcgtcatcgtct

SEQ ID NO: 586331 - DNA, 13 bp, D. melanogaster
atcgtcattatca

SEQ ID NO: 586332 - DNA, 14 bp, D. melanogaster
atcgtccttcgtcc

SEQ ID NO: 586333 - DNA, 14 bp, D. melanogaster
atcgtcggttcttg

SEQ ID NO: 586334 - DNA, 13 bp, D. melanogaster
atcgtcgtcgtct

SEQ ID NO: 586335 - DNA, 14 bp, D. melanogaster
atcgtgaagatctt

SEQ ID NO: 586336 - DNA, 13 bp, D. melanogaster
atcgtgctgagca

SEQ ID NO: 586337 - DNA, 13 bp, D. melanogaster
atcgtggccaaaa

SEQ ID NO: 586338 - DNA, 13 bp, D. melanogaster
atcgtgtcaataa

SEQ ID NO: 586339 - DNA, 13 bp, D. melanogaster
atcgtgtgtgtgt

SEQ ID NO: 586340 - DNA, 14 bp, D. melanogaster
atcgtgtgtgtgtg

SEQ ID NO: 586341 - DNA, 13 bp, D. melanogaster
atcgtgttgactg

SEQ ID NO: 586342 - DNA, 13 bp, D. melanogaster
atcgtgttttaat

SEQ ID NO: 586343 - DNA, 13 bp, D. melanogaster
atcgttaagcagt

SEQ ID NO: 586344 - DNA, 13 bp, D. melanogaster
atcgttagcactg

SEQ ID NO: 586345 - DNA, 13 bp, D. melanogaster
atcgttatatttt

SEQ ID NO: 586346 - DNA, 13 bp, D. melanogaster
atcgttatcgata

SEQ ID NO: 586347 - DNA, 14 bp, D. melanogaster
atcgttattcaaaa

SEQ ID NO: 586348 - DNA, 13 bp, D. melanogaster
atcgttgtaaaat

SEQ ID NO: 586349 - DNA, 13 bp, D. melanogaster
atcgttgtggaaa

SEQ ID NO: 586350 - DNA, 13 bp, D. melanogaster
atcgtttaaaata

SEQ ID NO: 586351 - DNA, 13 bp, D. melanogaster
atcgtttattgtg

SEQ ID NO: 586352 - DNA, 13 bp, D. melanogaster
atcgtttcacaag

SEQ ID NO: 586353 - DNA, 13 bp, D. melanogaster
atcgttttaatta

SEQ ID NO: 586354 - DNA, 13 bp, D. melanogaster
atcgttttattgg

SEQ ID NO: 586355 - DNA, 13 bp, D. melanogaster
atcgttttcaatt

SEQ ID NO: 586356 - DNA, 13 bp, D. melanogaster
atcgttttgattt

SEQ ID NO: 586357 - DNA, 13 bp, D. melanogaster
atcgtttttcatt

SEQ ID NO: 586358 - DNA, 13 bp, D. melanogaster
atcgtttttgatt

SEQ ID NO: 586359 - DNA, 14 bp, D. melanogaster
atctaaaaatagaa

SEQ ID NO: 586360 - DNA, 13 bp, D. melanogaster
atctaaagatcta

SEQ ID NO: 586361 - DNA, 15 bp, D. melanogaster
atctaaagatctact

SEQ ID NO: 586362 - DNA, 13 bp, D. melanogaster
atctaaagcgaaa

SEQ ID NO: 586363 - DNA, 13 bp, D. melanogaster
atctaaatcaatt

SEQ ID NO: 586364 - DNA, 13 bp, D. melanogaster
atctaaatctaaa

SEQ ID NO: 586365 - DNA, 14 bp, D. melanogaster
atctaaatcttcta

SEQ ID NO: 586366 - DNA, 13 bp, D. melanogaster
atctaaattgtat

SEQ ID NO: 586367 - DNA, 13 bp, D. melanogaster
atctaaccaagtt

SEQ ID NO: 586368 - DNA, 13 bp, D. melanogaster
atctaatagtcgg

SEQ ID NO: 586369 - DNA, 13 bp, D. melanogaster
atctaatcgaaac

SEQ ID NO: 586370 - DNA, 13 bp, D. melanogaster
atctaatctaaat

SEQ ID NO: 586371 - DNA, 13 bp, D. melanogaster
atctaatctaata

SEQ ID NO: 586372 - DNA, 13 bp, D. melanogaster
atctaatctaatc

SEQ ID NO: 586373 - DNA, 14 bp, D. melanogaster
atctaatctaatct

SEQ ID NO: 586374 - DNA, 13 bp, D. melanogaster
atctaattgattt

SEQ ID NO: 586375 - DNA, 13 bp, D. melanogaster
atctacaaaggag

SEQ ID NO: 586376 - DNA, 13 bp, D. melanogaster
atctacaagatac

SEQ ID NO: 586377 - DNA, 13 bp, D. melanogaster
atctacaatatat

SEQ ID NO: 586378 - DNA, 13 bp, D. melanogaster
atctacaatattt

SEQ ID NO: 586379 - DNA, 13 bp, D. melanogaster
atctacacacaca

SEQ ID NO: 586380 - DNA, 14 bp, D. melanogaster
atctacacacacac

SEQ ID NO: 586381 - DNA, 14 bp, D. melanogaster
atctacatacatac

SEQ ID NO: 586382 - DNA, 13 bp, D. melanogaster
atctacatatatc

SEQ ID NO: 586383 - DNA, 13 bp, D. melanogaster
atctacatatatg

SEQ ID NO: 586384 - DNA, 13 bp, D. melanogaster
atctacatctaca

SEQ ID NO: 586385 - DNA, 13 bp, D. melanogaster
atctacatttaca

SEQ ID NO: 586386 - DNA, 13 bp, D. melanogaster
atctactacaaat

SEQ ID NO: 586387 - DNA, 14 bp, D. melanogaster
atctactacaaatt

SEQ ID NO: 586388 - DNA, 13 bp, D. melanogaster
atctactgatcac

SEQ ID NO: 586389 - DNA, 13 bp, D. melanogaster
atctagatatttt

SEQ ID NO: 586390 - DNA, 13 bp, D. melanogaster
atctagccatgtc

SEQ ID NO: 586391 - DNA, 14 bp, D. melanogaster
atctagccatgtcc

SEQ ID NO: 586392 - DNA, 13 bp, D. melanogaster
atctataagattt

SEQ ID NO: 586393 - DNA, 14 bp, D. melanogaster
atctatatacatat

SEQ ID NO: 586394 - DNA, 13 bp, D. melanogaster
atctatatataca

SEQ ID NO: 586395 - DNA, 13 bp, D. melanogaster
atctatatatatc

SEQ ID NO: 586396 - DNA, 14 bp, D. melanogaster
atctatatatctat

SEQ ID NO: 586397 - DNA, 13 bp, D. melanogaster
atctatatatctg

SEQ ID NO: 586398 - DNA, 13 bp, D. melanogaster
atctatatccatg

SEQ ID NO: 586399 - DNA, 13 bp, D. melanogaster
atctatatctaca

SEQ ID NO: 586400 - DNA, 14 bp, D. melanogaster
atctatatctatat

SEQ ID NO: 586401 - DNA, 13 bp, D. melanogaster
atctatatctgta

SEQ ID NO: 586402 - DNA, 14 bp, D. melanogaster
atctatatctgtat

SEQ ID NO: 586403 - DNA, 13 bp, D. melanogaster
atctatatcttta

SEQ ID NO: 586404 - DNA, 13 bp, D. melanogaster
atctatatgacaa

SEQ ID NO: 586405 - DNA, 13 bp, D. melanogaster
atctatatgtaca

SEQ ID NO: 586406 - DNA, 14 bp, D. melanogaster
atctatatgtatat

SEQ ID NO: 586407 - DNA, 13 bp, D. melanogaster
atctatatttttg

SEQ ID NO: 586408 - DNA, 13 bp, D. melanogaster
atctatcaaaact

SEQ ID NO: 586409 - DNA, 13 bp, D. melanogaster
atctatcaacatt

SEQ ID NO: 586410 - DNA, 13 bp, D. melanogaster
atctatcaataaa

SEQ ID NO: 586411 - DNA, 13 bp, D. melanogaster
atctatcagatac

SEQ ID NO: 586412 - DNA, 13 bp, D. melanogaster
atctatcgatatc

SEQ ID NO: 586413 - DNA, 13 bp, D. melanogaster
atctatctatata

SEQ ID NO: 586414 - DNA, 14 bp, D. melanogaster
atctatctatatct

SEQ ID NO: 586415 - DNA, 13 bp, D. melanogaster
atctatctatatg

SEQ ID NO: 586416 - DNA, 13 bp, D. melanogaster
atctatctatatt

SEQ ID NO: 586417 - DNA, 13 bp, D. melanogaster
atctatctatcca

SEQ ID NO: 586418 - DNA, 14 bp, D. melanogaster
atctatctatccat

SEQ ID NO: 586419 - DNA, 14 bp, D. melanogaster
atctatctatctat

SEQ ID NO: 586420 - DNA, 13 bp, D. melanogaster
atctatctattta

SEQ ID NO: 586421 - DNA, 13 bp, D. melanogaster
atctatctctctc

SEQ ID NO: 586422 - DNA, 14 bp, D. melanogaster
atctatctgtatct

SEQ ID NO: 586423 - DNA, 13 bp, D. melanogaster
atctatgaaaatt

SEQ ID NO: 586424 - DNA, 13 bp, D. melanogaster
atctatgaatcat

SEQ ID NO: 586425 - DNA, 13 bp, D. melanogaster
atctatgagatac

SEQ ID NO: 586426 - DNA, 13 bp, D. melanogaster
atctatgtacata

SEQ ID NO: 586427 - DNA, 14 bp, D. melanogaster
atctatgtacatat

SEQ ID NO: 586428 - DNA, 13 bp, D. melanogaster
atctatgtatatc

SEQ ID NO: 586429 - DNA, 13 bp, D. melanogaster
atctatgtatcta

SEQ ID NO: 586430 - DNA, 14 bp, D. melanogaster
atctatgtatctat

SEQ ID NO: 586431 - DNA, 13 bp, D. melanogaster
atctatgtattct

SEQ ID NO: 586432 - DNA, 13 bp, D. melanogaster
atctatgtattta

SEQ ID NO: 586433 - DNA, 13 bp, D. melanogaster
atctattaaagag

SEQ ID NO: 586434 - DNA, 13 bp, D. melanogaster
atctattaagata

SEQ ID NO: 586435 - DNA, 13 bp, D. melanogaster
atctattatctat

SEQ ID NO: 586436 - DNA, 14 bp, D. melanogaster
atctattcaagttt

SEQ ID NO: 586437 - DNA, 13 bp, D. melanogaster
atctattgcccca

SEQ ID NO: 586438 - DNA, 13 bp, D. melanogaster
atctatttataca

SEQ ID NO: 586439 - DNA, 13 bp, D. melanogaster
atctatttatgta

SEQ ID NO: 586440 - DNA, 14 bp, D. melanogaster
atctatttatgtat

SEQ ID NO: 586441 - DNA, 13 bp, D. melanogaster
atctatttccatt

SEQ ID NO: 586442 - DNA, 13 bp, D. melanogaster
atctatttgaaaa

SEQ ID NO: 586443 - DNA, 13 bp, D. melanogaster
atctatttgggcc

SEQ ID NO: 586444 - DNA, 14 bp, D. melanogaster
atctatttgggcct

SEQ ID NO: 586445 - DNA, 13 bp, D. melanogaster
atctattttatgc

SEQ ID NO: 586446 - DNA, 13 bp, D. melanogaster
atctattttcaaa

SEQ ID NO: 586447 - DNA, 14 bp, D. melanogaster
atctattttcaaat

SEQ ID NO: 586448 - DNA, 13 bp, D. melanogaster
atctattttgatt

SEQ ID NO: 586449 - DNA, 14 bp, D. melanogaster
atctattttgatta

SEQ ID NO: 586450 - DNA, 13 bp, D. melanogaster
atctcaaaattat

SEQ ID NO: 586451 - DNA, 13 bp, D. melanogaster
atctcaaagatac

SEQ ID NO: 586452 - DNA, 13 bp, D. melanogaster
atctcaaatatat

SEQ ID NO: 586453 - DNA, 13 bp, D. melanogaster
atctcaacaatgt

SEQ ID NO: 586454 - DNA, 13 bp, D. melanogaster
atctcaacatatt

SEQ ID NO: 586455 - DNA, 13 bp, D. melanogaster
atctcaaccttct

SEQ ID NO: 586456 - DNA, 13 bp, D. melanogaster
atctcaacgttca

SEQ ID NO: 586457 - DNA, 14 bp, D. melanogaster
atctcaactgttgt

SEQ ID NO: 586458 - DNA, 13 bp, D. melanogaster
atctcaagaccat

SEQ ID NO: 586459 - DNA, 13 bp, D. melanogaster
atctcaattggaa

SEQ ID NO: 586460 - DNA, 13 bp, D. melanogaster
atctcacttttga

SEQ ID NO: 586461 - DNA, 14 bp, D. melanogaster
atctcagaaactat

SEQ ID NO: 586462 - DNA, 13 bp, D. melanogaster
atctcagccacta

SEQ ID NO: 586463 - DNA, 13 bp, D. melanogaster
atctcagcccgaa

SEQ ID NO: 586464 - DNA, 13 bp, D. melanogaster
atctcagctggtg

SEQ ID NO: 586465 - DNA, 13 bp, D. melanogaster
atctcatatgggg

SEQ ID NO: 586466 - DNA, 13 bp, D. melanogaster
atctcatcccaaa

SEQ ID NO: 586467 - DNA, 13 bp, D. melanogaster
atctcatctcatt

SEQ ID NO: 586468 - DNA, 13 bp, D. melanogaster
atctcattgaatc

SEQ ID NO: 586469 - DNA, 13 bp, D. melanogaster
atctccagctcca

SEQ ID NO: 586470 - DNA, 13 bp, D. melanogaster
atctccatctccg

SEQ ID NO: 586471 - DNA, 13 bp, D. melanogaster
atctccatctctg

SEQ ID NO: 586472 - DNA, 13 bp, D. melanogaster
atctccatctgca

SEQ ID NO: 586473 - DNA, 13 bp, D. melanogaster
atctccatcttca

SEQ ID NO: 586474 - DNA, 13 bp, D. melanogaster
atctccattccca

SEQ ID NO: 586475 - DNA, 13 bp, D. melanogaster
atctccgatttgg

SEQ ID NO: 586476 - DNA, 13 bp, D. melanogaster
atctcgaatctcg

SEQ ID NO: 586477 - DNA, 13 bp, D. melanogaster
atctcgacttgtg

SEQ ID NO: 586478 - DNA, 14 bp, D. melanogaster
atctcgacttgtgt

SEQ ID NO: 586479 - DNA, 13 bp, D. melanogaster
atctcgatctcga

SEQ ID NO: 586480 - DNA, 13 bp, D. melanogaster
atctcgcagatac

SEQ ID NO: 586481 - DNA, 13 bp, D. melanogaster
atctcgcagcagg

SEQ ID NO: 586482 - DNA, 13 bp, D. melanogaster
atctcgcccacca

SEQ ID NO: 586483 - DNA, 13 bp, D. melanogaster
atctcgctcgcac

SEQ ID NO: 586484 - DNA, 13 bp, D. melanogaster
atctcgctctccc

SEQ ID NO: 586485 - DNA, 13 bp, D. melanogaster
atctcgggcagca

SEQ ID NO: 586486 - DNA, 13 bp, D. melanogaster
atctctatcctaa

SEQ ID NO: 586487 - DNA, 14 bp, D. melanogaster
atctctatctctat

SEQ ID NO: 586488 - DNA, 13 bp, D. melanogaster
atctctatctgta

SEQ ID NO: 586489 - DNA, 13 bp, D. melanogaster
atctctcacttct

SEQ ID NO: 586490 - DNA, 13 bp, D. melanogaster
atctctctcgctc

SEQ ID NO: 586491 - DNA, 14 bp, D. melanogaster
atctctctcgctct

SEQ ID NO: 586492 - DNA, 13 bp, D. melanogaster
atctctgtgtgtg

SEQ ID NO: 586493 - DNA, 13 bp, D. melanogaster
atctcttaaaacc

SEQ ID NO: 586494 - DNA, 13 bp, D. melanogaster
atctcttaaattt

SEQ ID NO: 586495 - DNA, 13 bp, D. melanogaster
atctcttgatttt

SEQ ID NO: 586496 - DNA, 13 bp, D. melanogaster
atctctttaatca

SEQ ID NO: 586497 - DNA, 13 bp, D. melanogaster
atctctttgattt

SEQ ID NO: 586498 - DNA, 13 bp, D. melanogaster
atctgaaaaacaa

SEQ ID NO: 586499 - DNA, 13 bp, D. melanogaster
atctgaaaaatat

SEQ ID NO: 586500 - DNA, 13 bp, D. melanogaster
atctgaaaagaaa

SEQ ID NO: 586501 - DNA, 13 bp, D. melanogaster
atctgaaacccaa

SEQ ID NO: 586502 - DNA, 13 bp, D. melanogaster
atctgaaactgaa

SEQ ID NO: 586503 - DNA, 13 bp, D. melanogaster
atctgaaagatac

SEQ ID NO: 586504 - DNA, 13 bp, D. melanogaster
atctgaaagcgaa

SEQ ID NO: 586505 - DNA, 13 bp, D. melanogaster
atctgaaataaaa

SEQ ID NO: 586506 - DNA, 13 bp, D. melanogaster
atctgaaatccat

SEQ ID NO: 586507 - DNA, 14 bp, D. melanogaster
atctgaaatccata

SEQ ID NO: 586508 - DNA, 13 bp, D. melanogaster
atctgaaatgaaa

SEQ ID NO: 586509 - DNA, 13 bp, D. melanogaster
atctgaaattgaa

SEQ ID NO: 586510 - DNA, 13 bp, D. melanogaster
atctgaagaaaat

SEQ ID NO: 586511 - DNA, 13 bp, D. melanogaster
atctgaataattt

SEQ ID NO: 586512 - DNA, 14 bp, D. melanogaster
atctgaatcggaat

SEQ ID NO: 586513 - DNA, 13 bp, D. melanogaster
atctgaatctgaa

SEQ ID NO: 586514 - DNA, 14 bp, D. melanogaster
atctgaatctgaat

SEQ ID NO: 586515 - DNA, 13 bp, D. melanogaster
atctgaatctgag

SEQ ID NO: 586516 - DNA, 13 bp, D. melanogaster
atctgaatctgat

SEQ ID NO: 586517 - DNA, 13 bp, D. melanogaster
atctgaatctgca

SEQ ID NO: 586518 - DNA, 13 bp, D. melanogaster
atctgaatctttt

SEQ ID NO: 586519 - DNA, 13 bp, D. melanogaster
atctgaatgaact

SEQ ID NO: 586520 - DNA, 13 bp, D. melanogaster
atctgaatggcag

SEQ ID NO: 586521 - DNA, 13 bp, D. melanogaster
atctgaattaagt

SEQ ID NO: 586522 - DNA, 13 bp, D. melanogaster
atctgaccatgtc

SEQ ID NO: 586523 - DNA, 13 bp, D. melanogaster
atctgagcacaca

SEQ ID NO: 586524 - DNA, 14 bp, D. melanogaster
atctgagggaaaac

SEQ ID NO: 586525 - DNA, 13 bp, D. melanogaster
atctgagtatttt

SEQ ID NO: 586526 - DNA, 14 bp, D. melanogaster
atctgagtattttc

SEQ ID NO: 586527 - DNA, 13 bp, D. melanogaster
atctgagtgagta

SEQ ID NO: 586528 - DNA, 13 bp, D. melanogaster
atctgagtttttg

SEQ ID NO: 586529 - DNA, 13 bp, D. melanogaster
atctgatctgatc

SEQ ID NO: 586530 - DNA, 13 bp, D. melanogaster
atctgatgatgaa

SEQ ID NO: 586531 - DNA, 14 bp, D. melanogaster
atctgatgatgaag

SEQ ID NO: 586532 - DNA, 13 bp, D. melanogaster
atctgatggaatc

SEQ ID NO: 586533 - DNA, 13 bp, D. melanogaster
atctgattgattt

SEQ ID NO: 586534 - DNA, 13 bp, D. melanogaster
atctgcaactgca

SEQ ID NO: 586535 - DNA, 13 bp, D. melanogaster
atctgcaagatac

SEQ ID NO: 586536 - DNA, 14 bp, D. melanogaster
atctgcaagataca

SEQ ID NO: 586537 - DNA, 13 bp, D. melanogaster
atctgcaagttaa

SEQ ID NO: 586538 - DNA, 14 bp, D. melanogaster
atctgcaagttaat

SEQ ID NO: 586539 - DNA, 13 bp, D. melanogaster
atctgcaatatct

SEQ ID NO: 586540 - DNA, 13 bp, D. melanogaster
atctgcaatctgc

SEQ ID NO: 586541 - DNA, 13 bp, D. melanogaster
atctgcaatgacc

SEQ ID NO: 586542 - DNA, 13 bp, D. melanogaster
atctgcacgaatc

SEQ ID NO: 586543 - DNA, 13 bp, D. melanogaster
atctgcagcagca

SEQ ID NO: 586544 - DNA, 13 bp, D. melanogaster
atctgcataaata

SEQ ID NO: 586545 - DNA, 13 bp, D. melanogaster
atctgcataattt

SEQ ID NO: 586546 - DNA, 13 bp, D. melanogaster
atctgcatatgta

SEQ ID NO: 586547 - DNA, 13 bp, D. melanogaster
atctgcatatttt

SEQ ID NO: 586548 - DNA, 13 bp, D. melanogaster
atctgcatcaaca

SEQ ID NO: 586549 - DNA, 13 bp, D. melanogaster
atctgcatctcca

SEQ ID NO: 586550 - DNA, 13 bp, D. melanogaster
atctgcatctgaa

SEQ ID NO: 586551 - DNA, 13 bp, D. melanogaster
atctgcatctgca

SEQ ID NO: 586552 - DNA, 14 bp, D. melanogaster
atctgcatctgcat

SEQ ID NO: 586553 - DNA, 13 bp, D. melanogaster
atctgcatctgcg

SEQ ID NO: 586554 - DNA, 13 bp, D. melanogaster
atctgcatttaat

SEQ ID NO: 586555 - DNA, 13 bp, D. melanogaster
atctgccaaaaaa

SEQ ID NO: 586556 - DNA, 14 bp, D. melanogaster
atctgccacgccca

SEQ ID NO: 586557 - DNA, 13 bp, D. melanogaster
atctgccagatac

SEQ ID NO: 586558 - DNA, 14 bp, D. melanogaster
atctgccagataca

SEQ ID NO: 586559 - DNA, 13 bp, D. melanogaster
atctgctcaagat

SEQ ID NO: 586560 - DNA, 14 bp, D. melanogaster
atctgctgaaactt

SEQ ID NO: 586561 - DNA, 13 bp, D. melanogaster
atctggaaactat

SEQ ID NO: 586562 - DNA, 13 bp, D. melanogaster
atctggagatcaa

SEQ ID NO: 586563 - DNA, 13 bp, D. melanogaster
atctggagctgcg

SEQ ID NO: 586564 - DNA, 13 bp, D. melanogaster
atctggatatctg

SEQ ID NO: 586565 - DNA, 13 bp, D. melanogaster
atctggatctgga

SEQ ID NO: 586566 - DNA, 14 bp, D. melanogaster
atctggatctggat

SEQ ID NO: 586567 - DNA, 13 bp, D. melanogaster
atctggatgatat

SEQ ID NO: 586568 - DNA, 13 bp, D. melanogaster
atctggatgtgga

SEQ ID NO: 586569 - DNA, 13 bp, D. melanogaster
atctggcaacgcc

SEQ ID NO: 586570 - DNA, 13 bp, D. melanogaster
atctggcaacgct

SEQ ID NO: 586571 - DNA, 13 bp, D. melanogaster
atctggccatgtc

SEQ ID NO: 586572 - DNA, 13 bp, D. melanogaster
atctggccctgtc

SEQ ID NO: 586573 - DNA, 123 bp, D. melanogaster
atctggccgctgaggttctcgagttggctggcaatgctgctcgtgacaacaagaagactagaattattccgcgtcatctgcaactggccatccgcaacgacgaggagttaaacaagctgctct

SEQ ID NO: 586574 - DNA, 13 bp, D. melanogaster
atctgggatctgg

SEQ ID NO: 586575 - DNA, 13 bp, D. melanogaster
atctgggatgggg

SEQ ID NO: 586576 - DNA, 13 bp, D. melanogaster
atctggtatctgg

SEQ ID NO: 586577 - DNA, 14 bp, D. melanogaster
atctggtatctggt

SEQ ID NO: 586578 - DNA, 13 bp, D. melanogaster
atctggtcatgtc

SEQ ID NO: 586579 - DNA, 13 bp, D. melanogaster
atctggtcgtcta

SEQ ID NO: 586580 - DNA, 14 bp, D. melanogaster
atctggtcgtctaa

SEQ ID NO: 586581 - DNA, 13 bp, D. melanogaster
atctggttggtgg

SEQ ID NO: 586582 - DNA, 13 bp, D. melanogaster
atctgtaagatac

SEQ ID NO: 586583 - DNA, 13 bp, D. melanogaster
atctgtaatgaac

SEQ ID NO: 586584 - DNA, 13 bp, D. melanogaster
atctgtacaaatt

SEQ ID NO: 586585 - DNA, 13 bp, D. melanogaster
atctgtacaactg

SEQ ID NO: 586586 - DNA, 13 bp, D. melanogaster
atctgtacatata

SEQ ID NO: 586587 - DNA, 13 bp, D. melanogaster
atctgtagctgta

SEQ ID NO: 586588 - DNA, 13 bp, D. melanogaster
atctgtataaata

SEQ ID NO: 586589 - DNA, 13 bp, D. melanogaster
atctgtatccgca

SEQ ID NO: 586590 - DNA, 14 bp, D. melanogaster
atctgtatctgaat

SEQ ID NO: 586591 - DNA, 15 bp, D. melanogaster
atctgtatctgtaac

SEQ ID NO: 586592 - DNA, 13 bp, D. melanogaster
atctgtatctgtt

SEQ ID NO: 586593 - DNA, 13 bp, D. melanogaster
atctgtatctttg

SEQ ID NO: 586594 - DNA, 13 bp, D. melanogaster
atctgtatgtatg

SEQ ID NO: 586595 - DNA, 13 bp, D. melanogaster
atctgtatgtgtg

SEQ ID NO: 586596 - DNA, 13 bp, D. melanogaster
atctgtcagatac

SEQ ID NO: 586597 - DNA, 13 bp, D. melanogaster
atctgtcctttag

SEQ ID NO: 586598 - DNA, 13 bp, D. melanogaster
atctgtctattta

SEQ ID NO: 586599 - DNA, 13 bp, D. melanogaster
atctgtgcagact

SEQ ID NO: 586600 - DNA, 13 bp, D. melanogaster
atctgtgcatctg

SEQ ID NO: 586601 - DNA, 13 bp, D. melanogaster
atctgtgtaaatg

SEQ ID NO: 586602 - DNA, 13 bp, D. melanogaster
atctgtgtctgta

SEQ ID NO: 586603 - DNA, 13 bp, D. melanogaster
atctgtgtgtgag

SEQ ID NO: 586604 - DNA, 13 bp, D. melanogaster
atctgtgtgtgcg

SEQ ID NO: 586605 - DNA, 14 bp, D. melanogaster
atctgtgtgtgtgt

SEQ ID NO: 586606 - DNA, 13 bp, D. melanogaster
atctgtgtgtgtt

SEQ ID NO: 586607 - DNA, 13 bp, D. melanogaster
atctgtgtgtttg

SEQ ID NO: 586608 - DNA, 13 bp, D. melanogaster
atctgttcttctt

SEQ ID NO: 586609 - DNA, 13 bp, D. melanogaster
atctgtttgattt

SEQ ID NO: 586610 - DNA, 13 bp, D. melanogaster
atctgtttgtaaa

SEQ ID NO: 586611 - DNA, 13 bp, D. melanogaster
atctgtttgttta

SEQ ID NO: 586612 - DNA, 13 bp, D. melanogaster
atctgtttgtttg

SEQ ID NO: 586613 - DNA, 13 bp, D. melanogaster
atctgttttaatt

SEQ ID NO: 586614 - DNA, 13 bp, D. melanogaster
atctgttttgcgt

SEQ ID NO: 586615 - DNA, 14 bp, D. melanogaster
atcttaaaataaag

SEQ ID NO: 586616 - DNA, 13 bp, D. melanogaster
atcttaaacaagg

SEQ ID NO: 586617 - DNA, 13 bp, D. melanogaster
atcttaaacttaa

SEQ ID NO: 586618 - DNA, 13 bp, D. melanogaster
atcttaaagattt

SEQ ID NO: 586619 - DNA, 14 bp, D. melanogaster
atcttaaatatgag

SEQ ID NO: 586620 - DNA, 13 bp, D. melanogaster
atcttaactataa

SEQ ID NO: 586621 - DNA, 13 bp, D. melanogaster
atcttaagagact

SEQ ID NO: 586622 - DNA, 13 bp, D. melanogaster
atcttaatctgac

SEQ ID NO: 586623 - DNA, 13 bp, D. melanogaster
atcttaatcttaa

SEQ ID NO: 586624 - DNA, 14 bp, D. melanogaster
atcttaatcttaat

SEQ ID NO: 586625 - DNA, 13 bp, D. melanogaster
atcttaccaatat

SEQ ID NO: 586626 - DNA, 14 bp, D. melanogaster
atcttaccaatatc

SEQ ID NO: 586627 - DNA, 13 bp, D. melanogaster
atcttagacagat

SEQ ID NO: 586628 - DNA, 13 bp, D. melanogaster
atcttatacatat

SEQ ID NO: 586629 - DNA, 13 bp, D. melanogaster
atcttatagatac

SEQ ID NO: 586630 - DNA, 13 bp, D. melanogaster
atcttatagatat

SEQ ID NO: 586631 - DNA, 13 bp, D. melanogaster
atcttatcttatc

SEQ ID NO: 586632 - DNA, 13 bp, D. melanogaster
atcttcacgatct

SEQ ID NO: 586633 - DNA, 13 bp, D. melanogaster
atcttcagcgtgt

SEQ ID NO: 586634 - DNA, 13 bp, D. melanogaster
atcttcatttcga

SEQ ID NO: 586635 - DNA, 13 bp, D. melanogaster
atcttccaaaatc

SEQ ID NO: 586636 - DNA, 13 bp, D. melanogaster
atcttcctccaac

SEQ ID NO: 586637 - DNA, 13 bp, D. melanogaster
atcttcggtttaa

SEQ ID NO: 586638 - DNA, 13 bp, D. melanogaster
atcttctacaatg

SEQ ID NO: 586639 - DNA, 13 bp, D. melanogaster
atcttcttcttgg

SEQ ID NO: 586640 - DNA, 13 bp, D. melanogaster
atcttgaaaaata

SEQ ID NO: 586641 - DNA, 13 bp, D. melanogaster
atcttgaaaatat

SEQ ID NO: 586642 - DNA, 13 bp, D. melanogaster
atcttgagcggcg

SEQ ID NO: 586643 - DNA, 14 bp, D. melanogaster
atcttgcaataatt

SEQ ID NO: 586644 - DNA, 13 bp, D. melanogaster
atcttggccagca

SEQ ID NO: 586645 - DNA, 13 bp, D. melanogaster
atcttggccagct

SEQ ID NO: 586646 - DNA, 13 bp, D. melanogaster
atcttggcccaaa

SEQ ID NO: 586647 - DNA, 13 bp, D. melanogaster
atctttaaaaact

SEQ ID NO: 586648 - DNA, 13 bp, D. melanogaster
atctttaaacatc

SEQ ID NO: 586649 - DNA, 13 bp, D. melanogaster
atctttaagatct

SEQ ID NO: 586650 - DNA, 14 bp, D. melanogaster
atctttaattcaaa

SEQ ID NO: 586651 - DNA, 14 bp, D. melanogaster
atctttaattcaca

SEQ ID NO: 586652 - DNA, 13 bp, D. melanogaster
atctttagataca

SEQ ID NO: 586653 - DNA, 13 bp, D. melanogaster
atctttatgtact

SEQ ID NO: 586654 - DNA, 13 bp, D. melanogaster
atctttatttaca

SEQ ID NO: 586655 - DNA, 13 bp, D. melanogaster
atctttatttggt

SEQ ID NO: 586656 - DNA, 14 bp, D. melanogaster
atctttatttggtt

SEQ ID NO: 586657 - DNA, 14 bp, D. melanogaster
atctttcaatgttc

SEQ ID NO: 586658 - DNA, 13 bp, D. melanogaster
atctttcaattgt

SEQ ID NO: 586659 - DNA, 14 bp, D. melanogaster
atctttcaattgtt

SEQ ID NO: 586660 - DNA, 13 bp, D. melanogaster
atctttcggatac

SEQ ID NO: 586661 - DNA, 14 bp, D. melanogaster
atctttctatctgt

SEQ ID NO: 586662 - DNA, 14 bp, D. melanogaster
atctttctgctgga

SEQ ID NO: 586663 - DNA, 13 bp, D. melanogaster
atctttgaaatat

SEQ ID NO: 586664 - DNA, 13 bp, D. melanogaster
atctttgattgtg

SEQ ID NO: 586665 - DNA, 13 bp, D. melanogaster
atctttgctcctt

SEQ ID NO: 586666 - DNA, 13 bp, D. melanogaster
atctttggcagcg

SEQ ID NO: 586667 - DNA, 13 bp, D. melanogaster
atcttttaatctc

SEQ ID NO: 586668 - DNA, 13 bp, D. melanogaster
atcttttatctga

SEQ ID NO: 586669 - DNA, 13 bp, D. melanogaster
atcttttatgata

SEQ ID NO: 586670 - DNA, 13 bp, D. melanogaster
atcttttattgat

SEQ ID NO: 586671 - DNA, 13 bp, D. melanogaster
atcttttccaaat

SEQ ID NO: 586672 - DNA, 14 bp, D. melanogaster
atcttttcttgaaa

SEQ ID NO: 586673 - DNA, 13 bp, D. melanogaster
atcttttgcccat

SEQ ID NO: 586674 - DNA, 13 bp, D. melanogaster
atcttttgttcgt

SEQ ID NO: 586675 - DNA, 14 bp, D. melanogaster
atctttttgggcca

SEQ ID NO: 586676 - DNA, 13 bp, D. melanogaster
atcttttttaatg

SEQ ID NO: 586677 - DNA, 13 bp, D. melanogaster
atgaaaaaacatt

SEQ ID NO: 586678 - DNA, 13 bp, D. melanogaster
atgaaaaaatatc

SEQ ID NO: 586679 - DNA, 14 bp, D. melanogaster
atgaaaaaatatca

SEQ ID NO: 586680 - DNA, 13 bp, D. melanogaster
atgaaaaacaact

SEQ ID NO: 586681 - DNA, 13 bp, D. melanogaster
atgaaaaacaatg

SEQ ID NO: 586682 - DNA, 13 bp, D. melanogaster
atgaaaaacatat

SEQ ID NO: 586683 - DNA, 13 bp, D. melanogaster
atgaaaaactata

SEQ ID NO: 586684 - DNA, 13 bp, D. melanogaster
atgaaaaactcaa

SEQ ID NO: 586685 - DNA, 13 bp, D. melanogaster
atgaaaaacttaa

SEQ ID NO: 586686 - DNA, 13 bp, D. melanogaster
atgaaaaactttt

SEQ ID NO: 586687 - DNA, 14 bp, D. melanogaster
atgaaaaatacttt

SEQ ID NO: 586688 - DNA, 13 bp, D. melanogaster
atgaaaaatcaat

SEQ ID NO: 586689 - DNA, 13 bp, D. melanogaster
atgaaaaatcgaa

SEQ ID NO: 586690 - DNA, 13 bp, D. melanogaster
atgaaaaatgaca

SEQ ID NO: 586691 - DNA, 14 bp, D. melanogaster
atgaaaaatgcaaa

SEQ ID NO: 586692 - DNA, 13 bp, D. melanogaster
atgaaaaatgcat

SEQ ID NO: 586693 - DNA, 14 bp, D. melanogaster
atgaaaaatgcata

SEQ ID NO: 586694 - DNA, 13 bp, D. melanogaster
atgaaaaatgtga

SEQ ID NO: 586695 - DNA, 13 bp, D. melanogaster
atgaaaaattcaa

SEQ ID NO: 586696 - DNA, 13 bp, D. melanogaster
atgaaaaattgtt

SEQ ID NO: 586697 - DNA, 14 bp, D. melanogaster
atgaaaacaaaatg

SEQ ID NO: 586698 - DNA, 13 bp, D. melanogaster
atgaaaacaaatc

SEQ ID NO: 586699 - DNA, 13 bp, D. melanogaster
atgaaaacaaatt

SEQ ID NO: 586700 - DNA, 13 bp, D. melanogaster
atgaaaacacaat

SEQ ID NO: 586701 - DNA, 13 bp, D. melanogaster
atgaaaacagttt

SEQ ID NO: 586702 - DNA, 13 bp, D. melanogaster
atgaaaacataat

SEQ ID NO: 586703 - DNA, 13 bp, D. melanogaster
atgaaaaccaaat

SEQ ID NO: 586704 - DNA, 13 bp, D. melanogaster
atgaaaaccattt

SEQ ID NO: 586705 - DNA, 13 bp, D. melanogaster
atgaaaacccatt

SEQ ID NO: 586706 - DNA, 13 bp, D. melanogaster
atgaaaaccgaaa

SEQ ID NO: 586707 - DNA, 14 bp, D. melanogaster
atgaaaacctgaca

SEQ ID NO: 586708 - DNA, 13 bp, D. melanogaster
atgaaaacctttt

SEQ ID NO: 586709 - DNA, 13 bp, D. melanogaster
atgaaaacgaatg

SEQ ID NO: 586710 - DNA, 13 bp, D. melanogaster
atgaaaacgaatt

SEQ ID NO: 586711 - DNA, 13 bp, D. melanogaster
atgaaaacgtttt

SEQ ID NO: 586712 - DNA, 13 bp, D. melanogaster
atgaaaactattg

SEQ ID NO: 586713 - DNA, 13 bp, D. melanogaster
atgaaaactctgc

SEQ ID NO: 586714 - DNA, 13 bp, D. melanogaster
atgaaaactgcaa

SEQ ID NO: 586715 - DNA, 13 bp, D. melanogaster
atgaaaacttaaa

SEQ ID NO: 586716 - DNA, 13 bp, D. melanogaster
atgaaaactttac

SEQ ID NO: 586717 - DNA, 13 bp, D. melanogaster
atgaaaagaccat

SEQ ID NO: 586718 - DNA, 13 bp, D. melanogaster
atgaaaagcaaag

SEQ ID NO: 586719 - DNA, 13 bp, D. melanogaster
atgaaaagcaaat

SEQ ID NO: 586720 - DNA, 13 bp, D. melanogaster
atgaaaagccagc

SEQ ID NO: 586721 - DNA, 13 bp, D. melanogaster
atgaaaagcgaaa

SEQ ID NO: 586722 - DNA, 13 bp, D. melanogaster
atgaaaagctctt

SEQ ID NO: 586723 - DNA, 13 bp, D. melanogaster
atgaaaaggcaaa

SEQ ID NO: 586724 - DNA, 13 bp, D. melanogaster
atgaaaaggttgt

SEQ ID NO: 586725 - DNA, 13 bp, D. melanogaster
atgaaaaggtttt

SEQ ID NO: 586726 - DNA, 13 bp, D. melanogaster
atgaaaagtattt

SEQ ID NO: 586727 - DNA, 14 bp, D. melanogaster
atgaaaagtattta

SEQ ID NO: 586728 - DNA, 13 bp, D. melanogaster
atgaaaagtcatt

SEQ ID NO: 586729 - DNA, 13 bp, D. melanogaster
atgaaaagtggaa

SEQ ID NO: 586730 - DNA, 13 bp, D. melanogaster
atgaaaagtgttt

SEQ ID NO: 586731 - DNA, 13 bp, D. melanogaster
atgaaaagttcaa

SEQ ID NO: 586732 - DNA, 13 bp, D. melanogaster
atgaaaataaagc

SEQ ID NO: 586733 - DNA, 13 bp, D. melanogaster
atgaaaataatgt

SEQ ID NO: 586734 - DNA, 13 bp, D. melanogaster
atgaaaatacaat

SEQ ID NO: 586735 - DNA, 13 bp, D. melanogaster
atgaaaataccaa

SEQ ID NO: 586736 - DNA, 13 bp, D. melanogaster
atgaaaatactca

SEQ ID NO: 586737 - DNA, 13 bp, D. melanogaster
atgaaaatactta

SEQ ID NO: 586738 - DNA, 13 bp, D. melanogaster
atgaaaatatatc

SEQ ID NO: 586739 - DNA, 13 bp, D. melanogaster
atgaaaatatgag

SEQ ID NO: 586740 - DNA, 13 bp, D. melanogaster
atgaaaatatgca

SEQ ID NO: 586741 - DNA, 13 bp, D. melanogaster
atgaaaatatgta

SEQ ID NO: 586742 - DNA, 13 bp, D. melanogaster
atgaaaatattct

SEQ ID NO: 586743 - DNA, 13 bp, D. melanogaster
atgaaaatattga

SEQ ID NO: 586744 - DNA, 13 bp, D. melanogaster
atgaaaatattgc

SEQ ID NO: 586745 - DNA, 14 bp, D. melanogaster
atgaaaatatttca

SEQ ID NO: 586746 - DNA, 13 bp, D. melanogaster
atgaaaatatttg

SEQ ID NO: 586747 - DNA, 13 bp, D. melanogaster
atgaaaatcaaag

SEQ ID NO: 586748 - DNA, 13 bp, D. melanogaster
atgaaaatcaaat

SEQ ID NO: 586749 - DNA, 13 bp, D. melanogaster
atgaaaatcaata

SEQ ID NO: 586750 - DNA, 13 bp, D. melanogaster
atgaaaatcaatg

SEQ ID NO: 586751 - DNA, 13 bp, D. melanogaster
atgaaaatcattt

SEQ ID NO: 586752 - DNA, 13 bp, D. melanogaster
atgaaaatccaat

SEQ ID NO: 586753 - DNA, 13 bp, D. melanogaster
atgaaaatcgaaa

SEQ ID NO: 586754 - DNA, 13 bp, D. melanogaster
atgaaaatcttta

SEQ ID NO: 586755 - DNA, 14 bp, D. melanogaster
atgaaaatgaaaac

SEQ ID NO: 586756 - DNA, 13 bp, D. melanogaster
atgaaaatgaaca

SEQ ID NO: 586757 - DNA, 13 bp, D. melanogaster
atgaaaatgatcg

SEQ ID NO: 586758 - DNA, 13 bp, D. melanogaster
atgaaaatgattg

SEQ ID NO: 586759 - DNA, 13 bp, D. melanogaster
atgaaaatgcaaa

SEQ ID NO: 586760 - DNA, 14 bp, D. melanogaster
atgaaaatgcaaat

SEQ ID NO: 586761 - DNA, 13 bp, D. melanogaster
atgaaaatgcagc

SEQ ID NO: 586762 - DNA, 13 bp, D. melanogaster
atgaaaatgcata

SEQ ID NO: 586763 - DNA, 13 bp, D. melanogaster
atgaaaatgcatt

SEQ ID NO: 586764 - DNA, 14 bp, D. melanogaster
atgaaaatgcattt

SEQ ID NO: 586765 - DNA, 14 bp, D. melanogaster
atgaaaatgccaaa

SEQ ID NO: 586766 - DNA, 13 bp, D. melanogaster
atgaaaatggcaa

SEQ ID NO: 586767 - DNA, 13 bp, D. melanogaster
atgaaaatggctt

SEQ ID NO: 586768 - DNA, 14 bp, D. melanogaster
atgaaaatggctta

SEQ ID NO: 586769 - DNA, 13 bp, D. melanogaster
atgaaaatggtca

SEQ ID NO: 586770 - DNA, 13 bp, D. melanogaster
atgaaaatgtcaa

SEQ ID NO: 586771 - DNA, 13 bp, D. melanogaster
atgaaaatgtgaa

SEQ ID NO: 586772 - DNA, 13 bp, D. melanogaster
atgaaaatgtggc

SEQ ID NO: 586773 - DNA, 13 bp, D. melanogaster
atgaaaatgttaa

SEQ ID NO: 586774 - DNA, 13 bp, D. melanogaster
atgaaaatgttgc

SEQ ID NO: 586775 - DNA, 13 bp, D. melanogaster
atgaaaatgtttc

SEQ ID NO: 586776 - DNA, 13 bp, D. melanogaster
atgaaaatgtttg

SEQ ID NO: 586777 - DNA, 14 bp, D. melanogaster
atgaaaatgtttgc

SEQ ID NO: 586778 - DNA, 13 bp, D. melanogaster
atgaaaattaaac

SEQ ID NO: 586779 - DNA, 14 bp, D. melanogaster
atgaaaattcaatt

SEQ ID NO: 586780 - DNA, 13 bp, D. melanogaster
atgaaaattggaa

SEQ ID NO: 586781 - DNA, 13 bp, D. melanogaster
atgaaaattgttt

SEQ ID NO: 586782 - DNA, 14 bp, D. melanogaster
atgaaaattgtttt

SEQ ID NO: 586783 - DNA, 13 bp, D. melanogaster
atgaaacaaaagt

SEQ ID NO: 586784 - DNA, 13 bp, D. melanogaster
atgaaacaaaatt

SEQ ID NO: 586785 - DNA, 13 bp, D. melanogaster
atgaaacaaatat

SEQ ID NO: 586786 - DNA, 13 bp, D. melanogaster
atgaaacaaatga

SEQ ID NO: 586787 - DNA, 14 bp, D. melanogaster
atgaaacaaatgaa

SEQ ID NO: 586788 - DNA, 13 bp, D. melanogaster
atgaaacaattaa

SEQ ID NO: 586789 - DNA, 13 bp, D. melanogaster
atgaaacatgaaa

SEQ ID NO: 586790 - DNA, 14 bp, D. melanogaster
atgaaacatttgat

SEQ ID NO: 586791 - DNA, 13 bp, D. melanogaster
atgaaacattttg

SEQ ID NO: 586792 - DNA, 13 bp, D. melanogaster
atgaaacattttt

SEQ ID NO: 586793 - DNA, 14 bp, D. melanogaster
atgaaacatttttg

SEQ ID NO: 586794 - DNA, 13 bp, D. melanogaster
atgaaaccacaaa

SEQ ID NO: 586795 - DNA, 13 bp, D. melanogaster
atgaaacccgaac

SEQ ID NO: 586796 - DNA, 13 bp, D. melanogaster
atgaaacgaaaat

SEQ ID NO: 586797 - DNA, 13 bp, D. melanogaster
atgaaacgaaata

SEQ ID NO: 586798 - DNA, 13 bp, D. melanogaster
atgaaacgaaatt

SEQ ID NO: 586799 - DNA, 14 bp, D. melanogaster
atgaaacgaaattt

SEQ ID NO: 586800 - DNA, 13 bp, D. melanogaster
atgaaacgtttta

SEQ ID NO: 586801 - DNA, 13 bp, D. melanogaster
atgaaactataaa

SEQ ID NO: 586802 - DNA, 13 bp, D. melanogaster
atgaaactcaaaa

SEQ ID NO: 586803 - DNA, 13 bp, D. melanogaster
atgaaactgaaaa

SEQ ID NO: 586804 - DNA, 14 bp, D. melanogaster
atgaaactgttctg

SEQ ID NO: 586805 - DNA, 13 bp, D. melanogaster
atgaaacttaatt

SEQ ID NO: 586806 - DNA, 13 bp, D. melanogaster
atgaaactttaaa

SEQ ID NO: 586807 - DNA, 13 bp, D. melanogaster
atgaaactttcca

SEQ ID NO: 586808 - DNA, 13 bp, D. melanogaster
atgaaagcaaaat

SEQ ID NO: 586809 - DNA, 13 bp, D. melanogaster
atgaaagcaaaca

SEQ ID NO: 586810 - DNA, 14 bp, D. melanogaster
atgaaagccatgtt

SEQ ID NO: 586811 - DNA, 13 bp, D. melanogaster
atgaaaggaaaac

SEQ ID NO: 586812 - DNA, 13 bp, D. melanogaster
atgaaaggaaaca

SEQ ID NO: 586813 - DNA, 13 bp, D. melanogaster
atgaaagtatctt

SEQ ID NO: 586814 - DNA, 13 bp, D. melanogaster
atgaaagtcaatt

SEQ ID NO: 586815 - DNA, 13 bp, D. melanogaster
atgaaagtgaaat

SEQ ID NO: 586816 - DNA, 13 bp, D. melanogaster
atgaaataaaact

SEQ ID NO: 586817 - DNA, 13 bp, D. melanogaster
atgaaataaaagc

SEQ ID NO: 586818 - DNA, 13 bp, D. melanogaster
atgaaataaagtt

SEQ ID NO: 586819 - DNA, 13 bp, D. melanogaster
atgaaataaatca

SEQ ID NO: 586820 - DNA, 13 bp, D. melanogaster
atgaaataaattc

SEQ ID NO: 586821 - DNA, 13 bp, D. melanogaster
atgaaataatgtt

SEQ ID NO: 586822 - DNA, 13 bp, D. melanogaster
atgaaatacaata

SEQ ID NO: 586823 - DNA, 13 bp, D. melanogaster
atgaaatacaatt

SEQ ID NO: 586824 - DNA, 13 bp, D. melanogaster
atgaaatacattt

SEQ ID NO: 586825 - DNA, 14 bp, D. melanogaster
atgaaatacatttt

SEQ ID NO: 586826 - DNA, 14 bp, D. melanogaster
atgaaatatatgta

SEQ ID NO: 586827 - DNA, 13 bp, D. melanogaster
atgaaatatttag

SEQ ID NO: 586828 - DNA, 13 bp, D. melanogaster
atgaaatatttcg

SEQ ID NO: 586829 - DNA, 13 bp, D. melanogaster
atgaaatatttgc

SEQ ID NO: 586830 - DNA, 13 bp, D. melanogaster
atgaaatattttg

SEQ ID NO: 586831 - DNA, 13 bp, D. melanogaster
atgaaatcaaaat

SEQ ID NO: 586832 - DNA, 13 bp, D. melanogaster
atgaaatcaaaca

SEQ ID NO: 586833 - DNA, 14 bp, D. melanogaster
atgaaatcaataaa

SEQ ID NO: 586834 - DNA, 13 bp, D. melanogaster
atgaaatcaattt

SEQ ID NO: 586835 - DNA, 13 bp, D. melanogaster
atgaaatcagaaa

SEQ ID NO: 586836 - DNA, 13 bp, D. melanogaster
atgaaatcataaa

SEQ ID NO: 586837 - DNA, 13 bp, D. melanogaster
atgaaatcataat

SEQ ID NO: 586838 - DNA, 13 bp, D. melanogaster
atgaaatcatttg

SEQ ID NO: 586839 - DNA, 13 bp, D. melanogaster
atgaaatccattt

SEQ ID NO: 586840 - DNA, 13 bp, D. melanogaster
atgaaatcgaaat

SEQ ID NO: 586841 - DNA, 13 bp, D. melanogaster
atgaaatcgaatt

SEQ ID NO: 586842 - DNA, 13 bp, D. melanogaster
atgaaatctattc

SEQ ID NO: 586843 - DNA, 14 bp, D. melanogaster
atgaaatgaaacaa

SEQ ID NO: 586844 - DNA, 13 bp, D. melanogaster
atgaaatgaaacg

SEQ ID NO: 586845 - DNA, 14 bp, D. melanogaster
atgaaatgaaacga

SEQ ID NO: 586846 - DNA, 13 bp, D. melanogaster
atgaaatgaaact

SEQ ID NO: 586847 - DNA, 13 bp, D. melanogaster
atgaaatgaaagc

SEQ ID NO: 586848 - DNA, 14 bp, D. melanogaster
atgaaatgaaatta

SEQ ID NO: 586849 - DNA, 13 bp, D. melanogaster
atgaaatgaatat

SEQ ID NO: 586850 - DNA, 13 bp, D. melanogaster
atgaaatgaatga

SEQ ID NO: 586851 - DNA, 23 bp, D. melanogaster
atgaaatgaatgaaatgaatgaa

SEQ ID NO: 586852 - DNA, 13 bp, D. melanogaster
atgaaatgaatgc

SEQ ID NO: 586853 - DNA, 13 bp, D. melanogaster
atgaaatgaattg

SEQ ID NO: 586854 - DNA, 13 bp, D. melanogaster
atgaaatgagatg

SEQ ID NO: 586855 - DNA, 13 bp, D. melanogaster
atgaaatgagcaa

SEQ ID NO: 586856 - DNA, 13 bp, D. melanogaster
atgaaatgcaaaa

SEQ ID NO: 586857 - DNA, 13 bp, D. melanogaster
atgaaatgcaaac

SEQ ID NO: 586858 - DNA, 13 bp, D. melanogaster
atgaaatgcaatc

SEQ ID NO: 586859 - DNA, 13 bp, D. melanogaster
atgaaatgcacaa

SEQ ID NO: 586860 - DNA, 13 bp, D. melanogaster
atgaaatgcattg

SEQ ID NO: 586861 - DNA, 13 bp, D. melanogaster
atgaaatgccagc

SEQ ID NO: 586862 - DNA, 13 bp, D. melanogaster
atgaaatgcgcaa

SEQ ID NO: 586863 - DNA, 13 bp, D. melanogaster
atgaaatgctaaa

SEQ ID NO: 586864 - DNA, 13 bp, D. melanogaster
atgaaatgcttaa

SEQ ID NO: 586865 - DNA, 13 bp, D. melanogaster
atgaaatggaaag

SEQ ID NO: 586866 - DNA, 13 bp, D. melanogaster
atgaaatggaaat

SEQ ID NO: 586867 - DNA, 13 bp, D. melanogaster
atgaaatggaatg

SEQ ID NO: 586868 - DNA, 13 bp, D. melanogaster
atgaaatggaatt

SEQ ID NO: 586869 - DNA, 13 bp, D. melanogaster
atgaaatggccat

SEQ ID NO: 586870 - DNA, 13 bp, D. melanogaster
atgaaatgggttt

SEQ ID NO: 586871 - DNA, 13 bp, D. melanogaster
atgaaatgtgtaa

SEQ ID NO: 586872 - DNA, 13 bp, D. melanogaster
atgaaatgtgttt

SEQ ID NO: 586873 - DNA, 13 bp, D. melanogaster
atgaaatgttatt

SEQ ID NO: 586874 - DNA, 13 bp, D. melanogaster
atgaaatgtttac

SEQ ID NO: 586875 - DNA, 13 bp, D. melanogaster
atgaaatgtttgt

SEQ ID NO: 586876 - DNA, 13 bp, D. melanogaster
atgaaatgtttta

SEQ ID NO: 586877 - DNA, 13 bp, D. melanogaster
atgaaattaaacg

SEQ ID NO: 586878 - DNA, 13 bp, D. melanogaster
atgaaattaacaa

SEQ ID NO: 586879 - DNA, 13 bp, D. melanogaster
atgaaattacagt

SEQ ID NO: 586880 - DNA, 13 bp, D. melanogaster
atgaaattatgca

SEQ ID NO: 586881 - DNA, 13 bp, D. melanogaster
atgaaattatgtg

SEQ ID NO: 586882 - DNA, 13 bp, D. melanogaster
atgaaattcaaaa

SEQ ID NO: 586883 - DNA, 13 bp, D. melanogaster
atgaaattcaaat

SEQ ID NO: 586884 - DNA, 13 bp, D. melanogaster
atgaaattcaata

SEQ ID NO: 586885 - DNA, 13 bp, D. melanogaster
atgaaattcatgt

SEQ ID NO: 586886 - DNA, 13 bp, D. melanogaster
atgaaattcatta

SEQ ID NO: 586887 - DNA, 13 bp, D. melanogaster
atgaaattccatt

SEQ ID NO: 586888 - DNA, 13 bp, D. melanogaster
atgaaattcgatt

SEQ ID NO: 586889 - DNA, 13 bp, D. melanogaster
atgaaattcgttt

SEQ ID NO: 586890 - DNA, 13 bp, D. melanogaster
atgaaattctttg

SEQ ID NO: 586891 - DNA, 14 bp, D. melanogaster
atgaaattgaaaac

SEQ ID NO: 586892 - DNA, 13 bp, D. melanogaster
atgaaattgaaac

SEQ ID NO: 586893 - DNA, 14 bp, D. melanogaster
atgaaattgaaatt

SEQ ID NO: 586894 - DNA, 13 bp, D. melanogaster
atgaaattgaagt

SEQ ID NO: 586895 - DNA, 13 bp, D. melanogaster
atgaaattgaatt

SEQ ID NO: 586896 - DNA, 13 bp, D. melanogaster
atgaaattgattt

SEQ ID NO: 586897 - DNA, 14 bp, D. melanogaster
atgaaattgattta

SEQ ID NO: 586898 - DNA, 13 bp, D. melanogaster
atgaaattgcaat

SEQ ID NO: 586899 - DNA, 14 bp, D. melanogaster
atgaaattgcattt

SEQ ID NO: 586900 - DNA, 13 bp, D. melanogaster
atgaaattgttaa

SEQ ID NO: 586901 - DNA, 13 bp, D. melanogaster
atgaaattgttat

SEQ ID NO: 586902 - DNA, 13 bp, D. melanogaster
atgaaattgttta

SEQ ID NO: 586903 - DNA, 13 bp, D. melanogaster
atgaaatttaagt

SEQ ID NO: 586904 - DNA, 14 bp, D. melanogaster
atgaaatttatgaa

SEQ ID NO: 586905 - DNA, 13 bp, D. melanogaster
atgaaatttcata

SEQ ID NO: 586906 - DNA, 14 bp, D. melanogaster
atgaaatttcattt

SEQ ID NO: 586907 - DNA, 13 bp, D. melanogaster
atgaaatttccaa

SEQ ID NO: 586908 - DNA, 13 bp, D. melanogaster
atgaaatttcgcg

SEQ ID NO: 586909 - DNA, 13 bp, D. melanogaster
atgaaatttctca

SEQ ID NO: 586910 - DNA, 13 bp, D. melanogaster
atgaaatttgata

SEQ ID NO: 586911 - DNA, 13 bp, D. melanogaster
atgaaatttgcaa

SEQ ID NO: 586912 - DNA, 13 bp, D. melanogaster
atgaaattttcaa

SEQ ID NO: 586913 - DNA, 13 bp, D. melanogaster
atgaaattttctt

SEQ ID NO: 586914 - DNA, 15 bp, D. melanogaster
atgaacaaagcaaag

SEQ ID NO: 586915 - DNA, 13 bp, D. melanogaster
atgaacaaagtat

SEQ ID NO: 586916 - DNA, 14 bp, D. melanogaster
atgaacaaatttct

SEQ ID NO: 586917 - DNA, 13 bp, D. melanogaster
atgaacaaatttt

SEQ ID NO: 586918 - DNA, 14 bp, D. melanogaster
atgaacaaattttg

SEQ ID NO: 586919 - DNA, 13 bp, D. melanogaster
atgaacaacaaca

SEQ ID NO: 586920 - DNA, 14 bp, D. melanogaster
atgaacacacacac

SEQ ID NO: 586921 - DNA, 14 bp, D. melanogaster
atgaacacagctgt

SEQ ID NO: 586922 - DNA, 13 bp, D. melanogaster
atgaacacctgca

SEQ ID NO: 586923 - DNA, 13 bp, D. melanogaster
atgaacacgaaat

SEQ ID NO: 586924 - DNA, 13 bp, D. melanogaster
atgaacacgaata

SEQ ID NO: 586925 - DNA, 13 bp, D. melanogaster
atgaacagtggaa

SEQ ID NO: 586926 - DNA, 13 bp, D. melanogaster
atgaacccaatgg

SEQ ID NO: 586927 - DNA, 13 bp, D. melanogaster
atgaacgaaaaag

SEQ ID NO: 586928 - DNA, 13 bp, D. melanogaster
atgaacgagatga

SEQ ID NO: 586929 - DNA, 13 bp, D. melanogaster
atgaacgcgatcg

SEQ ID NO: 586930 - DNA, 13 bp, D. melanogaster
atgaacgtcaaga

SEQ ID NO: 586931 - DNA, 14 bp, D. melanogaster
atgaacgtcaagat

SEQ ID NO: 586932 - DNA, 13 bp, D. melanogaster
atgaacgttgaga

SEQ ID NO: 586933 - DNA, 13 bp, D. melanogaster
atgaacgttggct

SEQ ID NO: 586934 - DNA, 13 bp, D. melanogaster
atgaacgtttcaa

SEQ ID NO: 586935 - DNA, 13 bp, D. melanogaster
atgaactaccgat

SEQ ID NO: 586936 - DNA, 13 bp, D. melanogaster
atgaactatttgt

SEQ ID NO: 586937 - DNA, 13 bp, D. melanogaster
atgaactgctgca

SEQ ID NO: 586938 - DNA, 13 bp, D. melanogaster
atgaactgtgtga

SEQ ID NO: 586939 - DNA, 13 bp, D. melanogaster
atgaacttcatac

SEQ ID NO: 586940 - DNA, 14 bp, D. melanogaster
atgaacttcataca

SEQ ID NO: 586941 - DNA, 13 bp, D. melanogaster
atgaacttggaaa

SEQ ID NO: 586942 - DNA, 13 bp, D. melanogaster
atgaacttttaca

SEQ ID NO: 586943 - DNA, 13 bp, D. melanogaster
atgaagaaaaact

SEQ ID NO: 586944 - DNA, 13 bp, D. melanogaster
atgaagaaagatt

SEQ ID NO: 586945 - DNA, 13 bp, D. melanogaster
atgaagaacttga

SEQ ID NO: 586946 - DNA, 13 bp, D. melanogaster
atgaagaatatat

SEQ ID NO: 586947 - DNA, 13 bp, D. melanogaster
atgaagactgcaa

SEQ ID NO: 586948 - DNA, 13 bp, D. melanogaster
atgaagaggaatc

SEQ ID NO: 586949 - DNA, 14 bp, D. melanogaster
atgaagatgaagat

SEQ ID NO: 586950 - DNA, 14 bp, D. melanogaster
atgaagatgataga

SEQ ID NO: 586951 - DNA, 13 bp, D. melanogaster
atgaagatggaaa

SEQ ID NO: 586952 - DNA, 13 bp, D. melanogaster
atgaagccacttg

SEQ ID NO: 586953 - DNA, 13 bp, D. melanogaster
atgaagccatcta

SEQ ID NO: 586954 - DNA, 13 bp, D. melanogaster
atgaagctacaaa

SEQ ID NO: 586955 - DNA, 13 bp, D. melanogaster
atgaagctgaaaa

SEQ ID NO: 586956 - DNA, 13 bp, D. melanogaster
atgaagctgtggc

SEQ ID NO: 586957 - DNA, 13 bp, D. melanogaster
atgaaggcaaata

SEQ ID NO: 586958 - DNA, 13 bp, D. melanogaster
atgaagtagaggc

SEQ ID NO: 586959 - DNA, 13 bp, D. melanogaster
atgaagtatatat

SEQ ID NO: 586960 - DNA, 13 bp, D. melanogaster
atgaagtcacatt

SEQ ID NO: 586961 - DNA, 13 bp, D. melanogaster
atgaagtgaagtg

SEQ ID NO: 586962 - DNA, 13 bp, D. melanogaster
atgaagtgcaaat

SEQ ID NO: 586963 - DNA, 13 bp, D. melanogaster
atgaagtggcaaa

SEQ ID NO: 586964 - DNA, 13 bp, D. melanogaster
atgaagttatttt

SEQ ID NO: 586965 - DNA, 13 bp, D. melanogaster
atgaagttgaaat

SEQ ID NO: 586966 - DNA, 13 bp, D. melanogaster
atgaagttggcca

SEQ ID NO: 586967 - DNA, 13 bp, D. melanogaster
atgaagtttattg

SEQ ID NO: 586968 - DNA, 13 bp, D. melanogaster
atgaataaacatt

SEQ ID NO: 586969 - DNA, 13 bp, D. melanogaster
atgaataaatatc

SEQ ID NO: 586970 - DNA, 13 bp, D. melanogaster
atgaataaattca

SEQ ID NO: 586971 - DNA, 13 bp, D. melanogaster
atgaataacaaat

SEQ ID NO: 586972 - DNA, 13 bp, D. melanogaster
atgaataactttt

SEQ ID NO: 586973 - DNA, 13 bp, D. melanogaster
atgaataataatg

SEQ ID NO: 586974 - DNA, 13 bp, D. melanogaster
atgaataatgaat

SEQ ID NO: 586975 - DNA, 13 bp, D. melanogaster
atgaataatgttt

SEQ ID NO: 586976 - DNA, 13 bp, D. melanogaster
atgaatacaaata

SEQ ID NO: 586977 - DNA, 13 bp, D. melanogaster
atgaatacaattt

SEQ ID NO: 586978 - DNA, 13 bp, D. melanogaster
atgaatacattcg

SEQ ID NO: 586979 - DNA, 13 bp, D. melanogaster
atgaatacatttt

SEQ ID NO: 586980 - DNA, 13 bp, D. melanogaster
atgaatataaatg

SEQ ID NO: 586981 - DNA, 13 bp, D. melanogaster
atgaatatatacg

SEQ ID NO: 586982 - DNA, 13 bp, D. melanogaster
atgaatatatgta

SEQ ID NO: 586983 - DNA, 13 bp, D. melanogaster
atgaatatctaaa

SEQ ID NO: 586984 - DNA, 13 bp, D. melanogaster
atgaatatgaaat

SEQ ID NO: 586985 - DNA, 14 bp, D. melanogaster
atgaatatgaatat

SEQ ID NO: 586986 - DNA, 13 bp, D. melanogaster
atgaatatgattt

SEQ ID NO: 586987 - DNA, 13 bp, D. melanogaster
atgaatatgcaat

SEQ ID NO: 586988 - DNA, 13 bp, D. melanogaster
atgaatatgccaa

SEQ ID NO: 586989 - DNA, 13 bp, D. melanogaster
atgaatatgtaaa

SEQ ID NO: 586990 - DNA, 13 bp, D. melanogaster
atgaatatgtatt

SEQ ID NO: 586991 - DNA, 13 bp, D. melanogaster
atgaatatgtttg

SEQ ID NO: 586992 - DNA, 13 bp, D. melanogaster
atgaatattattc

SEQ ID NO: 586993 - DNA, 13 bp, D. melanogaster
atgaatattcata

SEQ ID NO: 586994 - DNA, 13 bp, D. melanogaster
atgaatattcatt

SEQ ID NO: 586995 - DNA, 13 bp, D. melanogaster
atgaatattgata

SEQ ID NO: 586996 - DNA, 13 bp, D. melanogaster
atgaatatttatg

SEQ ID NO: 586997 - DNA, 13 bp, D. melanogaster
atgaatatttcaa

SEQ ID NO: 586998 - DNA, 13 bp, D. melanogaster
atgaatatttcat

SEQ ID NO: 586999 - DNA, 13 bp, D. melanogaster
atgaatatttgcg

SEQ ID NO: 587000 - DNA, 15 bp, D. melanogaster
atgaatattttaacg

SEQ ID NO: 587001 - DNA, 13 bp, D. melanogaster
atgaatcaaaaat

SEQ ID NO: 587002 - DNA, 13 bp, D. melanogaster
atgaatctgaatc

SEQ ID NO: 587003 - DNA, 13 bp, D. melanogaster
atgaatgaaaagc

SEQ ID NO: 587004 - DNA, 13 bp, D. melanogaster
atgaatgaaaatg

SEQ ID NO: 587005 - DNA, 13 bp, D. melanogaster
atgaatgaaatat

SEQ ID NO: 587006 - DNA, 13 bp, D. melanogaster
atgaatgaaatga

SEQ ID NO: 587007 - DNA, 13 bp, D. melanogaster
atgaatgaaatgc

SEQ ID NO: 587008 - DNA, 13 bp, D. melanogaster
atgaatgaaatgg

SEQ ID NO: 587009 - DNA, 13 bp, D. melanogaster
atgaatgaaattt

SEQ ID NO: 587010 - DNA, 13 bp, D. melanogaster
atgaatgaataca

SEQ ID NO: 587011 - DNA, 14 bp, D. melanogaster
atgaatgaatgaat

SEQ ID NO: 587012 - DNA, 13 bp, D. melanogaster
atgaatgaatgag

SEQ ID NO: 587013 - DNA, 13 bp, D. melanogaster
atgaatgaatgta

SEQ ID NO: 587014 - DNA, 13 bp, D. melanogaster
atgaatgaatttg

SEQ ID NO: 587015 - DNA, 13 bp, D. melanogaster
atgaatgcaaata

SEQ ID NO: 587016 - DNA, 13 bp, D. melanogaster
atgaatgcaattt

SEQ ID NO: 587017 - DNA, 13 bp, D. melanogaster
atgaatgcgaatt

SEQ ID NO: 587018 - DNA, 13 bp, D. melanogaster
atgaatggaagcc

SEQ ID NO: 587019 - DNA, 13 bp, D. melanogaster
atgaatggaatgg

SEQ ID NO: 587020 - DNA, 13 bp, D. melanogaster
atgaatgggaaaa

SEQ ID NO: 587021 - DNA, 13 bp, D. melanogaster
atgaatgtataaa

SEQ ID NO: 587022 - DNA, 13 bp, D. melanogaster
atgaatgtcaaaa

SEQ ID NO: 587023 - DNA, 13 bp, D. melanogaster
atgaatgtgaaat

SEQ ID NO: 587024 - DNA, 13 bp, D. melanogaster
atgaattacaaat

SEQ ID NO: 587025 - DNA, 13 bp, D. melanogaster
atgaattacaatt

SEQ ID NO: 587026 - DNA, 13 bp, D. melanogaster
atgaattatgaaa

SEQ ID NO: 587027 - DNA, 14 bp, D. melanogaster
atgaattatgaatt

SEQ ID NO: 587028 - DNA, 13 bp, D. melanogaster
atgaattatgcag

SEQ ID NO: 587029 - DNA, 13 bp, D. melanogaster
atgaattatttac

SEQ ID NO: 587030 - DNA, 13 bp, D. melanogaster
atgaattcaaaaa

SEQ ID NO: 587031 - DNA, 13 bp, D. melanogaster
atgaattcaaatg

SEQ ID NO: 587032 - DNA, 13 bp, D. melanogaster
atgaattcattat

SEQ ID NO: 587033 - DNA, 13 bp, D. melanogaster
atgaattccatat

SEQ ID NO: 587034 - DNA, 13 bp, D. melanogaster
atgaattgaaatt

SEQ ID NO: 587035 - DNA, 13 bp, D. melanogaster
atgaattgaatga

SEQ ID NO: 587036 - DNA, 13 bp, D. melanogaster
atgaattgatttt

SEQ ID NO: 587037 - DNA, 13 bp, D. melanogaster
atgaattgcaaat

SEQ ID NO: 587038 - DNA, 14 bp, D. melanogaster
atgaattgcagaaa

SEQ ID NO: 587039 - DNA, 13 bp, D. melanogaster
atgaattgcataa

SEQ ID NO: 587040 - DNA, 13 bp, D. melanogaster
atgaattgcattt

SEQ ID NO: 587041 - DNA, 13 bp, D. melanogaster
atgaatttaacaa

SEQ ID NO: 587042 - DNA, 13 bp, D. melanogaster
atgaatttagtgt

SEQ ID NO: 587043 - DNA, 13 bp, D. melanogaster
atgaatttattgt

SEQ ID NO: 587044 - DNA, 13 bp, D. melanogaster
atgaatttcaaat

SEQ ID NO: 587045 - DNA, 13 bp, D. melanogaster
atgaatttcaatg

SEQ ID NO: 587046 - DNA, 13 bp, D. melanogaster
atgaatttcaatt

SEQ ID NO: 587047 - DNA, 13 bp, D. melanogaster
atgaatttcagtt

SEQ ID NO: 587048 - DNA, 13 bp, D. melanogaster
atgaatttcatgt

SEQ ID NO: 587049 - DNA, 13 bp, D. melanogaster
atgaatttcattt

SEQ ID NO: 587050 - DNA, 14 bp, D. melanogaster
atgaatttcatttg

SEQ ID NO: 587051 - DNA, 13 bp, D. melanogaster
atgaatttccaaa

SEQ ID NO: 587052 - DNA, 13 bp, D. melanogaster
atgaatttcgaaa

SEQ ID NO: 587053 - DNA, 13 bp, D. melanogaster
atgaatttctttt

SEQ ID NO: 587054 - DNA, 13 bp, D. melanogaster
atgaatttgaata

SEQ ID NO: 587055 - DNA, 13 bp, D. melanogaster
atgaatttgcagc

SEQ ID NO: 587056 - DNA, 13 bp, D. melanogaster
atgaatttggtgc

SEQ ID NO: 587057 - DNA, 14 bp, D. melanogaster
atgaattttaaaac

SEQ ID NO: 587058 - DNA, 13 bp, D. melanogaster
atgaattttaaag

SEQ ID NO: 587059 - DNA, 13 bp, D. melanogaster
atgaattttaatg

SEQ ID NO: 587060 - DNA, 13 bp, D. melanogaster
atgaattttcatt

SEQ ID NO: 587061 - DNA, 14 bp, D. melanogaster
atgaattttcattt

SEQ ID NO: 587062 - DNA, 13 bp, D. melanogaster
atgaattttgatt

SEQ ID NO: 587063 - DNA, 13 bp, D. melanogaster
atgaattttgtat

SEQ ID NO: 587064 - DNA, 14 bp, D. melanogaster
atgaattttgttct

SEQ ID NO: 587065 - DNA, 13 bp, D. melanogaster
atgaatttttaag

SEQ ID NO: 587066 - DNA, 13 bp, D. melanogaster
atgaatttttcat

SEQ ID NO: 587067 - DNA, 13 bp, D. melanogaster
atgaatttttcgc

SEQ ID NO: 587068 - DNA, 13 bp, D. melanogaster
atgacaaaaatgt

SEQ ID NO: 587069 - DNA, 13 bp, D. melanogaster
atgacaaaattat

SEQ ID NO: 587070 - DNA, 13 bp, D. melanogaster
atgacaaagtttt

SEQ ID NO: 587071 - DNA, 13 bp, D. melanogaster
atgacaaatgttt

SEQ ID NO: 587072 - DNA, 13 bp, D. melanogaster
atgacaaattttt

SEQ ID NO: 587073 - DNA, 13 bp, D. melanogaster
atgacaacaaatt

SEQ ID NO: 587074 - DNA, 13 bp, D. melanogaster
atgacaacaacaa

SEQ ID NO: 587075 - DNA, 14 bp, D. melanogaster
atgacaacaacaaa

SEQ ID NO: 587076 - DNA, 13 bp, D. melanogaster
atgacaacagcga

SEQ ID NO: 587077 - DNA, 13 bp, D. melanogaster
atgacaacgacaa

SEQ ID NO: 587078 - DNA, 13 bp, D. melanogaster
atgacaagaaata

SEQ ID NO: 587079 - DNA, 13 bp, D. melanogaster
atgacaataaaat

SEQ ID NO: 587080 - DNA, 13 bp, D. melanogaster
atgacaataataa

SEQ ID NO: 587081 - DNA, 13 bp, D. melanogaster
atgacaatataaa

SEQ ID NO: 587082 - DNA, 14 bp, D. melanogaster
atgacaatataaat

SEQ ID NO: 587083 - DNA, 13 bp, D. melanogaster
atgacaatgaaag

SEQ ID NO: 587084 - DNA, 13 bp, D. melanogaster
atgacaatgacaa

SEQ ID NO: 587085 - DNA, 13 bp, D. melanogaster
atgacaatggact

SEQ ID NO: 587086 - DNA, 13 bp, D. melanogaster
atgacaatgttgt

SEQ ID NO: 587087 - DNA, 14 bp, D. melanogaster
atgacaatgttgtg

SEQ ID NO: 587088 - DNA, 13 bp, D. melanogaster
atgacacaaagaa

SEQ ID NO: 587089 - DNA, 13 bp, D. melanogaster
atgacacacaaaa

SEQ ID NO: 587090 - DNA, 13 bp, D. melanogaster
atgacaccaaata

SEQ ID NO: 587091 - DNA, 13 bp, D. melanogaster
atgacagcaaaat

SEQ ID NO: 587092 - DNA, 14 bp, D. melanogaster
atgacagcagcagc

SEQ ID NO: 587093 - DNA, 13 bp, D. melanogaster
atgacatcatatt

SEQ ID NO: 587094 - DNA, 13 bp, D. melanogaster
atgacatctgttt

SEQ ID NO: 587095 - DNA, 13 bp, D. melanogaster
atgacattaattt

SEQ ID NO: 587096 - DNA, 13 bp, D. melanogaster
atgacattcagtc

SEQ ID NO: 587097 - DNA, 13 bp, D. melanogaster
atgacattccatt

SEQ ID NO: 587098 - DNA, 13 bp, D. melanogaster
atgacattttaga

SEQ ID NO: 587099 - DNA, 13 bp, D. melanogaster
atgacattttcat

SEQ ID NO: 587100 - DNA, 13 bp, D. melanogaster
atgacatttttac

SEQ ID NO: 587101 - DNA, 13 bp, D. melanogaster
atgacatttttat

SEQ ID NO: 587102 - DNA, 13 bp, D. melanogaster
atgaccagatcga

SEQ ID NO: 587103 - DNA, 13 bp, D. melanogaster
atgaccccaaaaa

SEQ ID NO: 587104 - DNA, 13 bp, D. melanogaster
atgaccggcaatt

SEQ ID NO: 587105 - DNA, 13 bp, D. melanogaster
atgacctgcaaaa

SEQ ID NO: 587106 - DNA, 13 bp, D. melanogaster
atgacgaaaattc

SEQ ID NO: 587107 - DNA, 13 bp, D. melanogaster
atgacgacaacaa

SEQ ID NO: 587108 - DNA, 13 bp, D. melanogaster
atgacgacaacga

SEQ ID NO: 587109 - DNA, 14 bp, D. melanogaster
atgacgacgatgac

SEQ ID NO: 587110 - DNA, 13 bp, D. melanogaster
atgacgataatga

SEQ ID NO: 587111 - DNA, 13 bp, D. melanogaster
atgacgatccaat

SEQ ID NO: 587112 - DNA, 13 bp, D. melanogaster
atgacgatcgtaa

SEQ ID NO: 587113 - DNA, 13 bp, D. melanogaster
atgacgatgacaa

SEQ ID NO: 587114 - DNA, 13 bp, D. melanogaster
atgacgatgacga

SEQ ID NO: 587115 - DNA, 13 bp, D. melanogaster
atgacgatgacgt

SEQ ID NO: 587116 - DNA, 14 bp, D. melanogaster
atgacgatgatgac

SEQ ID NO: 587117 - DNA, 13 bp, D. melanogaster
atgacgatggcga

SEQ ID NO: 587118 - DNA, 13 bp, D. melanogaster
atgacgcctccaa

SEQ ID NO: 587119 - DNA, 13 bp, D. melanogaster
atgacgtcatccc

SEQ ID NO: 587120 - DNA, 13 bp, D. melanogaster
atgacgttcggca

SEQ ID NO: 587121 - DNA, 13 bp, D. melanogaster
atgactaattatt

SEQ ID NO: 587122 - DNA, 13 bp, D. melanogaster
atgactatgacta

SEQ ID NO: 587123 - DNA, 13 bp, D. melanogaster
atgactattttta

SEQ ID NO: 587124 - DNA, 13 bp, D. melanogaster
atgactcaaaaat

SEQ ID NO: 587125 - DNA, 13 bp, D. melanogaster
atgactcaaccaa

SEQ ID NO: 587126 - DNA, 13 bp, D. melanogaster
atgactgcagagc

SEQ ID NO: 587127 - DNA, 13 bp, D. melanogaster
atgactgctagga

SEQ ID NO: 587128 - DNA, 13 bp, D. melanogaster
atgacttaaaagt

SEQ ID NO: 587129 - DNA, 13 bp, D. melanogaster
atgacttcggtga

SEQ ID NO: 587130 - DNA, 14 bp, D. melanogaster
atgacttgattaaa

SEQ ID NO: 587131 - DNA, 13 bp, D. melanogaster
atgactttactgt

SEQ ID NO: 587132 - DNA, 13 bp, D. melanogaster
atgactttatata

SEQ ID NO: 587133 - DNA, 13 bp, D. melanogaster
atgactttgattt

SEQ ID NO: 587134 - DNA, 13 bp, D. melanogaster
atgacttttctat

SEQ ID NO: 587135 - DNA, 14 bp, D. melanogaster
atgacttttctatg

SEQ ID NO: 587136 - DNA, 13 bp, D. melanogaster
atgacttttgcaa

SEQ ID NO: 587137 - DNA, 13 bp, D. melanogaster
atgagaaaaaact

SEQ ID NO: 587138 - DNA, 13 bp, D. melanogaster
atgagaaaacatt

SEQ ID NO: 587139 - DNA, 13 bp, D. melanogaster
atgagaaaatatt

SEQ ID NO: 587140 - DNA, 13 bp, D. melanogaster
atgagaaacattt

SEQ ID NO: 587141 - DNA, 13 bp, D. melanogaster
atgagaaacccca

SEQ ID NO: 587142 - DNA, 13 bp, D. melanogaster
atgagaaatgtta

SEQ ID NO: 587143 - DNA, 13 bp, D. melanogaster
atgagaacaagag

SEQ ID NO: 587144 - DNA, 13 bp, D. melanogaster
atgagaatcgcat

SEQ ID NO: 587145 - DNA, 13 bp, D. melanogaster
atgagaatgagga

SEQ ID NO: 587146 - DNA, 13 bp, D. melanogaster
atgagacaatttt

SEQ ID NO: 587147 - DNA, 13 bp, D. melanogaster
atgagacccactg

SEQ ID NO: 587148 - DNA, 13 bp, D. melanogaster
atgagacgataat

SEQ ID NO: 587149 - DNA, 13 bp, D. melanogaster
atgagatactttt

SEQ ID NO: 587150 - DNA, 13 bp, D. melanogaster
atgagatgagaca

SEQ ID NO: 587151 - DNA, 13 bp, D. melanogaster
atgagatgagatg

SEQ ID NO: 587152 - DNA, 13 bp, D. melanogaster
atgagcaacaaca

SEQ ID NO: 587153 - DNA, 13 bp, D. melanogaster
atgagcaacagaa

SEQ ID NO: 587154 - DNA, 13 bp, D. melanogaster
atgagcaatttgc

SEQ ID NO: 587155 - DNA, 13 bp, D. melanogaster
atgagcacaaaaa

SEQ ID NO: 587156 - DNA, 13 bp, D. melanogaster
atgagcagcagca

SEQ ID NO: 587157 - DNA, 13 bp, D. melanogaster
atgagcataaatt

SEQ ID NO: 587158 - DNA, 13 bp, D. melanogaster
atgagcatcatca

SEQ ID NO: 587159 - DNA, 13 bp, D. melanogaster
atgagcatcgaag

SEQ ID NO: 587160 - DNA, 13 bp, D. melanogaster
atgagccagtata

SEQ ID NO: 587161 - DNA, 14 bp, D. melanogaster
atgagccagtggag

SEQ ID NO: 587162 - DNA, 13 bp, D. melanogaster
atgagccattggc

SEQ ID NO: 587163 - DNA, 13 bp, D. melanogaster
atgagcgcccaga

SEQ ID NO: 587164 - DNA, 14 bp, D. melanogaster
atgagctctgtaaa

SEQ ID NO: 587165 - DNA, 13 bp, D. melanogaster
atgagctggcaaa

SEQ ID NO: 587166 - DNA, 13 bp, D. melanogaster
atgagctgggaaa

SEQ ID NO: 587167 - DNA, 13 bp, D. melanogaster
atgagcttcaaaa

SEQ ID NO: 587168 - DNA, 13 bp, D. melanogaster
atgaggaaatcat

SEQ ID NO: 587169 - DNA, 14 bp, D. melanogaster
atgaggaaatcatc

SEQ ID NO: 587170 - DNA, 13 bp, D. melanogaster
atgaggacttcta

SEQ ID NO: 587171 - DNA, 13 bp, D. melanogaster
atgaggagtgata

SEQ ID NO: 587172 - DNA, 13 bp, D. melanogaster
atgaggatgatga

SEQ ID NO: 587173 - DNA, 14 bp, D. melanogaster
atgaggatgtggat

SEQ ID NO: 587174 - DNA, 13 bp, D. melanogaster
atgaggctgacca

SEQ ID NO: 587175 - DNA, 13 bp, D. melanogaster
atgagtaatgtgc

SEQ ID NO: 587176 - DNA, 13 bp, D. melanogaster
atgagtacaaaaa

SEQ ID NO: 587177 - DNA, 14 bp, D. melanogaster
atgagtacaacaaa

SEQ ID NO: 587178 - DNA, 13 bp, D. melanogaster
atgagtatataaa

SEQ ID NO: 587179 - DNA, 13 bp, D. melanogaster
atgagtatatatt

SEQ ID NO: 587180 - DNA, 13 bp, D. melanogaster
atgagtcgaacta

SEQ ID NO: 587181 - DNA, 13 bp, D. melanogaster
atgagtggaaaaa

SEQ ID NO: 587182 - DNA, 13 bp, D. melanogaster
atgagtgtgtgtg

SEQ ID NO: 587183 - DNA, 13 bp, D. melanogaster
atgagttcttaaa

SEQ ID NO: 587184 - DNA, 13 bp, D. melanogaster
atgagttgaaaat

SEQ ID NO: 587185 - DNA, 13 bp, D. melanogaster
atgagttggcaaa

SEQ ID NO: 587186 - DNA, 13 bp, D. melanogaster
atgataaaaatgc

SEQ ID NO: 587187 - DNA, 14 bp, D. melanogaster
atgataaatcattt

SEQ ID NO: 587188 - DNA, 13 bp, D. melanogaster
atgataaattaca

SEQ ID NO: 587189 - DNA, 13 bp, D. melanogaster
atgataacaataa

SEQ ID NO: 587190 - DNA, 13 bp, D. melanogaster
atgataacaattt

SEQ ID NO: 587191 - DNA, 13 bp, D. melanogaster
atgataacatttt

SEQ ID NO: 587192 - DNA, 13 bp, D. melanogaster
atgataactgttt

SEQ ID NO: 587193 - DNA, 13 bp, D. melanogaster
atgataataatgt

SEQ ID NO: 587194 - DNA, 13 bp, D. melanogaster
atgataatatgat

SEQ ID NO: 587195 - DNA, 13 bp, D. melanogaster
atgataatgaaat

SEQ ID NO: 587196 - DNA, 14 bp, D. melanogaster
atgataatgataat

SEQ ID NO: 587197 - DNA, 13 bp, D. melanogaster
atgataatgatat

SEQ ID NO: 587198 - DNA, 13 bp, D. melanogaster
atgataatgatga

SEQ ID NO: 587199 - DNA, 14 bp, D. melanogaster
atgataatgatgat

SEQ ID NO: 587200 - DNA, 13 bp, D. melanogaster
atgataatgcatg

SEQ ID NO: 587201 - DNA, 13 bp, D. melanogaster
atgataatttcca

SEQ ID NO: 587202 - DNA, 13 bp, D. melanogaster
atgatacatttta

SEQ ID NO: 587203 - DNA, 13 bp, D. melanogaster
atgatactattaa

SEQ ID NO: 587204 - DNA, 14 bp, D. melanogaster
atgatactattaat

SEQ ID NO: 587205 - DNA, 13 bp, D. melanogaster
atgatagtggcct

SEQ ID NO: 587206 - DNA, 13 bp, D. melanogaster
atgatatatatga

SEQ ID NO: 587207 - DNA, 13 bp, D. melanogaster
atgatatatatgt

SEQ ID NO: 587208 - DNA, 13 bp, D. melanogaster
atgatatcaaaaa

SEQ ID NO: 587209 - DNA, 13 bp, D. melanogaster
atgatatcatatt

SEQ ID NO: 587210 - DNA, 13 bp, D. melanogaster
atgatatgataat

SEQ ID NO: 587211 - DNA, 13 bp, D. melanogaster
atgatatgatgat

SEQ ID NO: 587212 - DNA, 13 bp, D. melanogaster
atgatatgcatat

SEQ ID NO: 587213 - DNA, 13 bp, D. melanogaster
atgatatggatct

SEQ ID NO: 587214 - DNA, 13 bp, D. melanogaster
atgatattgaaat

SEQ ID NO: 587215 - DNA, 13 bp, D. melanogaster
atgatatttacat

SEQ ID NO: 587216 - DNA, 13 bp, D. melanogaster
atgatcaaaaaat

SEQ ID NO: 587217 - DNA, 13 bp, D. melanogaster
atgatcaaaagga

SEQ ID NO: 587218 - DNA, 13 bp, D. melanogaster
atgatcaaaatac

SEQ ID NO: 587219 - DNA, 13 bp, D. melanogaster
atgatcaaataaa

SEQ ID NO: 587220 - DNA, 13 bp, D. melanogaster
atgatcaggatca

SEQ ID NO: 587221 - DNA, 13 bp, D. melanogaster
atgatcatgatca

SEQ ID NO: 587222 - DNA, 14 bp, D. melanogaster
atgatcatgatcat

SEQ ID NO: 587223 - DNA, 13 bp, D. melanogaster
atgatcatgatga

SEQ ID NO: 587224 - DNA, 13 bp, D. melanogaster
atgatctgagaat

SEQ ID NO: 587225 - DNA, 13 bp, D. melanogaster
atgatcttcatca

SEQ ID NO: 587226 - DNA, 14 bp, D. melanogaster
atgatgaaaacaaa

SEQ ID NO: 587227 - DNA, 13 bp, D. melanogaster
atgatgaaatcgt

SEQ ID NO: 587228 - DNA, 13 bp, D. melanogaster
atgatgaaattat

SEQ ID NO: 587229 - DNA, 13 bp, D. melanogaster
atgatgaagaagt

SEQ ID NO: 587230 - DNA, 14 bp, D. melanogaster
atgatgaagaagta

SEQ ID NO: 587231 - DNA, 13 bp, D. melanogaster
atgatgaagatca

SEQ ID NO: 587232 - DNA, 13 bp, D. melanogaster
atgatgaagatga

SEQ ID NO: 587233 - DNA, 13 bp, D. melanogaster
atgatgaattcaa

SEQ ID NO: 587234 - DNA, 13 bp, D. melanogaster
atgatgacacttg

SEQ ID NO: 587235 - DNA, 13 bp, D. melanogaster
atgatgacgacaa

SEQ ID NO: 587236 - DNA, 14 bp, D. melanogaster
atgatgacgatgat

SEQ ID NO: 587237 - DNA, 13 bp, D. melanogaster
atgatgacgatgg

SEQ ID NO: 587238 - DNA, 13 bp, D. melanogaster
atgatgagtcgct

SEQ ID NO: 587239 - DNA, 13 bp, D. melanogaster
atgatgataatgc

SEQ ID NO: 587240 - DNA, 13 bp, D. melanogaster
atgatgatataga

SEQ ID NO: 587241 - DNA, 13 bp, D. melanogaster
atgatgatatata

SEQ ID NO: 587242 - DNA, 13 bp, D. melanogaster
atgatgatatttt

SEQ ID NO: 587243 - DNA, 13 bp, D. melanogaster
atgatgatcatga

SEQ ID NO: 587244 - DNA, 14 bp, D. melanogaster
atgatgatcatgat

SEQ ID NO: 587245 - DNA, 13 bp, D. melanogaster
atgatgatccatc

SEQ ID NO: 587246 - DNA, 14 bp, D. melanogaster
atgatgatccatca

SEQ ID NO: 587247 - DNA, 14 bp, D. melanogaster
atgatgatgaagat

SEQ ID NO: 587248 - DNA, 13 bp, D. melanogaster
atgatgatgaagc

SEQ ID NO: 587249 - DNA, 13 bp, D. melanogaster
atgatgatgaagt

SEQ ID NO: 587250 - DNA, 13 bp, D. melanogaster
atgatgatgacat

SEQ ID NO: 587251 - DNA, 13 bp, D. melanogaster
atgatgatgactg

SEQ ID NO: 587252 - DNA, 13 bp, D. melanogaster
atgatgatgatag

SEQ ID NO: 587253 - DNA, 13 bp, D. melanogaster
atgatgatgatat

SEQ ID NO: 587254 - DNA, 13 bp, D. melanogaster
atgatgatgatca

SEQ ID NO: 587255 - DNA, 14 bp, D. melanogaster
atgatgatgatcag

SEQ ID NO: 587256 - DNA, 13 bp, D. melanogaster
atgatgatgatcg

SEQ ID NO: 587257 - DNA, 14 bp, D. melanogaster
atgatgatgatgag

SEQ ID NO: 587258 - DNA, 14 bp, D. melanogaster
atgatgatgatgcc

SEQ ID NO: 587259 - DNA, 14 bp, D. melanogaster
atgatgatgatggc

SEQ ID NO: 587260 - DNA, 14 bp, D. melanogaster
atgatgatgatgtt

SEQ ID NO: 587261 - DNA, 13 bp, D. melanogaster
atgatgatgattg

SEQ ID NO: 587262 - DNA, 14 bp, D. melanogaster
atgatgatgctgat

SEQ ID NO: 587263 - DNA, 13 bp, D. melanogaster
atgatgatgctgc

SEQ ID NO: 587264 - DNA, 13 bp, D. melanogaster
atgatgatggaga

SEQ ID NO: 587265 - DNA, 13 bp, D. melanogaster
atgatgatggcaa

SEQ ID NO: 587266 - DNA, 13 bp, D. melanogaster
atgatgatggcca

SEQ ID NO: 587267 - DNA, 13 bp, D. melanogaster
atgatgatgggga

SEQ ID NO: 587268 - DNA, 13 bp, D. melanogaster
atgatgatggggc

SEQ ID NO: 587269 - DNA, 13 bp, D. melanogaster
atgatgatggtaa

SEQ ID NO: 587270 - DNA, 13 bp, D. melanogaster
atgatgatgtggc

SEQ ID NO: 587271 - DNA, 14 bp, D. melanogaster
atgatgatgttgat

SEQ ID NO: 587272 - DNA, 14 bp, D. melanogaster
atgatgattatgat

SEQ ID NO: 587273 - DNA, 13 bp, D. melanogaster
atgatgatttaaa

SEQ ID NO: 587274 - DNA, 13 bp, D. melanogaster
atgatgatttcct

SEQ ID NO: 587275 - DNA, 13 bp, D. melanogaster
atgatgattttgt

SEQ ID NO: 587276 - DNA, 14 bp, D. melanogaster
atgatgcattttta

SEQ ID NO: 587277 - DNA, 13 bp, D. melanogaster
atgatgccgatga

SEQ ID NO: 587278 - DNA, 13 bp, D. melanogaster
atgatgccgctgc

SEQ ID NO: 587279 - DNA, 13 bp, D. melanogaster
atgatgcggacag

SEQ ID NO: 587280 - DNA, 13 bp, D. melanogaster
atgatgctctttt

SEQ ID NO: 587281 - DNA, 13 bp, D. melanogaster
atgatgctgatga

SEQ ID NO: 587282 - DNA, 13 bp, D. melanogaster
atgatgctgatgc

SEQ ID NO: 587283 - DNA, 13 bp, D. melanogaster
atgatgctgatgt

SEQ ID NO: 587284 - DNA, 13 bp, D. melanogaster
atgatgctggtaa

SEQ ID NO: 587285 - DNA, 13 bp, D. melanogaster
atgatgctgtatg

SEQ ID NO: 587286 - DNA, 13 bp, D. melanogaster
atgatggaatagt

SEQ ID NO: 587287 - DNA, 13 bp, D. melanogaster
atgatggagaaaa

SEQ ID NO: 587288 - DNA, 13 bp, D. melanogaster
atgatggcaaaaa

SEQ ID NO: 587289 - DNA, 13 bp, D. melanogaster
atgatggcagatg

SEQ ID NO: 587290 - DNA, 13 bp, D. melanogaster
atgatggccaaaa

SEQ ID NO: 587291 - DNA, 14 bp, D. melanogaster
atgatggtgatggt

SEQ ID NO: 587292 - DNA, 13 bp, D. melanogaster
atgatggtggtga

SEQ ID NO: 587293 - DNA, 13 bp, D. melanogaster
atgatggtgtggt

SEQ ID NO: 587294 - DNA, 13 bp, D. melanogaster
atgatgtacatat

SEQ ID NO: 587295 - DNA, 13 bp, D. melanogaster
atgatgtatgtaa

SEQ ID NO: 587296 - DNA, 13 bp, D. melanogaster
atgatgtcattca

SEQ ID NO: 587297 - DNA, 13 bp, D. melanogaster
atgatgtgaaaat

SEQ ID NO: 587298 - DNA, 13 bp, D. melanogaster
atgatgtgtaaat

SEQ ID NO: 587299 - DNA, 13 bp, D. melanogaster
atgatgttacccc

SEQ ID NO: 587300 - DNA, 13 bp, D. melanogaster
atgatgttgaaat

SEQ ID NO: 587301 - DNA, 13 bp, D. melanogaster
atgatgttgatga

SEQ ID NO: 587302 - DNA, 14 bp, D. melanogaster
atgatgttgatgat

SEQ ID NO: 587303 - DNA, 14 bp, D. melanogaster
atgatgttgctgct

SEQ ID NO: 587304 - DNA, 13 bp, D. melanogaster
atgatgttgttgc

SEQ ID NO: 587305 - DNA, 13 bp, D. melanogaster
atgatgttttaaa

SEQ ID NO: 587306 - DNA, 13 bp, D. melanogaster
atgatgttttcaa

SEQ ID NO: 587307 - DNA, 13 bp, D. melanogaster
atgattaatactt

SEQ ID NO: 587308 - DNA, 13 bp, D. melanogaster
atgattaattgtt

SEQ ID NO: 587309 - DNA, 13 bp, D. melanogaster
atgattaatttgc

SEQ ID NO: 587310 - DNA, 13 bp, D. melanogaster
atgattacgaaac

SEQ ID NO: 587311 - DNA, 14 bp, D. melanogaster
atgattagcaatga

SEQ ID NO: 587312 - DNA, 13 bp, D. melanogaster
atgattatgatga

SEQ ID NO: 587313 - DNA, 14 bp, D. melanogaster
atgattatgattat

SEQ ID NO: 587314 - DNA, 15 bp, D. melanogaster
atgattattatgatt

SEQ ID NO: 587315 - DNA, 13 bp, D. melanogaster
atgattattattg

SEQ ID NO: 587316 - DNA, 13 bp, D. melanogaster
atgattcatcaaa

SEQ ID NO: 587317 - DNA, 13 bp, D. melanogaster
atgattccattca

SEQ ID NO: 587318 - DNA, 14 bp, D. melanogaster
atgattccattcag

SEQ ID NO: 587319 - DNA, 13 bp, D. melanogaster
atgattcgctttt

SEQ ID NO: 587320 - DNA, 13 bp, D. melanogaster
atgattgaaaaat

SEQ ID NO: 587321 - DNA, 13 bp, D. melanogaster
atgattgattatt

SEQ ID NO: 587322 - DNA, 13 bp, D. melanogaster
atgattgcagcaa

SEQ ID NO: 587323 - DNA, 14 bp, D. melanogaster
atgattgtcggaaa

SEQ ID NO: 587324 - DNA, 13 bp, D. melanogaster
atgattgtgatga

SEQ ID NO: 587325 - DNA, 13 bp, D. melanogaster
atgatttaagttt

SEQ ID NO: 587326 - DNA, 13 bp, D. melanogaster
atgatttaatatg

SEQ ID NO: 587327 - DNA, 13 bp, D. melanogaster
atgatttaatcaa

SEQ ID NO: 587328 - DNA, 13 bp, D. melanogaster
atgatttaattgc

SEQ ID NO: 587329 - DNA, 13 bp, D. melanogaster
atgatttacttat

SEQ ID NO: 587330 - DNA, 13 bp, D. melanogaster
atgatttatatga

SEQ ID NO: 587331 - DNA, 13 bp, D. melanogaster
atgatttatgaat

SEQ ID NO: 587332 - DNA, 13 bp, D. melanogaster
atgatttatgtat

SEQ ID NO: 587333 - DNA, 13 bp, D. melanogaster
atgatttatttgc

SEQ ID NO: 587334 - DNA, 13 bp, D. melanogaster
atgatttcaaaat

SEQ ID NO: 587335 - DNA, 13 bp, D. melanogaster
atgatttcaaatg

SEQ ID NO: 587336 - DNA, 13 bp, D. melanogaster
atgatttcaataa

SEQ ID NO: 587337 - DNA, 13 bp, D. melanogaster
atgatttcagttt

SEQ ID NO: 587338 - DNA, 13 bp, D. melanogaster
atgatttcattaa

SEQ ID NO: 587339 - DNA, 13 bp, D. melanogaster
atgatttcatttc

SEQ ID NO: 587340 - DNA, 13 bp, D. melanogaster
atgatttcatttt

SEQ ID NO: 587341 - DNA, 13 bp, D. melanogaster
atgatttccattt

SEQ ID NO: 587342 - DNA, 13 bp, D. melanogaster
atgatttcgtttt

SEQ ID NO: 587343 - DNA, 13 bp, D. melanogaster
atgatttctgttt

SEQ ID NO: 587344 - DNA, 13 bp, D. melanogaster
atgatttctttga

SEQ ID NO: 587345 - DNA, 13 bp, D. melanogaster
atgatttgaaaac

SEQ ID NO: 587346 - DNA, 13 bp, D. melanogaster
atgatttgaataa

SEQ ID NO: 587347 - DNA, 13 bp, D. melanogaster
atgatttgcaaaa

SEQ ID NO: 587348 - DNA, 13 bp, D. melanogaster
atgatttggttaa

SEQ ID NO: 587349 - DNA, 13 bp, D. melanogaster
atgatttgtcttc

SEQ ID NO: 587350 - DNA, 13 bp, D. melanogaster
atgattttaaaag

SEQ ID NO: 587351 - DNA, 13 bp, D. melanogaster
atgattttatgac

SEQ ID NO: 587352 - DNA, 13 bp, D. melanogaster
atgattttatgat

SEQ ID NO: 587353 - DNA, 13 bp, D. melanogaster
atgattttcacac

SEQ ID NO: 587354 - DNA, 13 bp, D. melanogaster
atgattttcactt

SEQ ID NO: 587355 - DNA, 13 bp, D. melanogaster
atgattttcattt

SEQ ID NO: 587356 - DNA, 13 bp, D. melanogaster
atgattttccgca

SEQ ID NO: 587357 - DNA, 14 bp, D. melanogaster
atgattttcttcaa

SEQ ID NO: 587358 - DNA, 13 bp, D. melanogaster
atgattttgaaat

SEQ ID NO: 587359 - DNA, 13 bp, D. melanogaster
atgatttttaaga

SEQ ID NO: 587360 - DNA, 13 bp, D. melanogaster
atgatttttatgc

SEQ ID NO: 587361 - DNA, 13 bp, D. melanogaster
atgatttttccat

SEQ ID NO: 587362 - DNA, 13 bp, D. melanogaster
atgatttttgctt

SEQ ID NO: 587363 - DNA, 13 bp, D. melanogaster
atgcaaaaaaagg

SEQ ID NO: 587364 - DNA, 14 bp, D. melanogaster
atgcaaaaaataca

SEQ ID NO: 587365 - DNA, 13 bp, D. melanogaster
atgcaaaaacaag

SEQ ID NO: 587366 - DNA, 13 bp, D. melanogaster
atgcaaaaagcaa

SEQ ID NO: 587367 - DNA, 13 bp, D. melanogaster
atgcaaaaaggaa

SEQ ID NO: 587368 - DNA, 13 bp, D. melanogaster
atgcaaaaataac

SEQ ID NO: 587369 - DNA, 14 bp, D. melanogaster
atgcaaaaatatat

SEQ ID NO: 587370 - DNA, 13 bp, D. melanogaster
atgcaaaaatatc

SEQ ID NO: 587371 - DNA, 13 bp, D. melanogaster
atgcaaaaatcat

SEQ ID NO: 587372 - DNA, 14 bp, D. melanogaster
atgcaaaaatgatt

SEQ ID NO: 587373 - DNA, 13 bp, D. melanogaster
atgcaaaaattat

SEQ ID NO: 587374 - DNA, 13 bp, D. melanogaster
atgcaaaaattga

SEQ ID NO: 587375 - DNA, 13 bp, D. melanogaster
atgcaaaacaaac

SEQ ID NO: 587376 - DNA, 14 bp, D. melanogaster
atgcaaaacaaatt

SEQ ID NO: 587377 - DNA, 13 bp, D. melanogaster
atgcaaaacaaca

SEQ ID NO: 587378 - DNA, 13 bp, D. melanogaster
atgcaaaacaaga

SEQ ID NO: 587379 - DNA, 14 bp, D. melanogaster
atgcaaaacaagaa

SEQ ID NO: 587380 - DNA, 13 bp, D. melanogaster
atgcaaaacaagc

SEQ ID NO: 587381 - DNA, 13 bp, D. melanogaster
atgcaaaacaatg

SEQ ID NO: 587382 - DNA, 14 bp, D. melanogaster
atgcaaaacacaca

SEQ ID NO: 587383 - DNA, 13 bp, D. melanogaster
atgcaaaacattt

SEQ ID NO: 587384 - DNA, 14 bp, D. melanogaster
atgcaaaacatttt

SEQ ID NO: 587385 - DNA, 13 bp, D. melanogaster
atgcaaaaccaaa

SEQ ID NO: 587386 - DNA, 14 bp, D. melanogaster
atgcaaaaccaaac

SEQ ID NO: 587387 - DNA, 13 bp, D. melanogaster
atgcaaaacgaaa

SEQ ID NO: 587388 - DNA, 13 bp, D. melanogaster
atgcaaaacgaga

SEQ ID NO: 587389 - DNA, 13 bp, D. melanogaster
atgcaaaactaaa

SEQ ID NO: 587390 - DNA, 13 bp, D. melanogaster
atgcaaaactgaa

SEQ ID NO: 587391 - DNA, 13 bp, D. melanogaster
atgcaaaacttaa

SEQ ID NO: 587392 - DNA, 13 bp, D. melanogaster
atgcaaaactttg

SEQ ID NO: 587393 - DNA, 13 bp, D. melanogaster
atgcaaaagaaat

SEQ ID NO: 587394 - DNA, 13 bp, D. melanogaster
atgcaaaaggata

SEQ ID NO: 587395 - DNA, 14 bp, D. melanogaster
atgcaaaaggcaaa

SEQ ID NO: 587396 - DNA, 13 bp, D. melanogaster
atgcaaaagtaat

SEQ ID NO: 587397 - DNA, 13 bp, D. melanogaster
atgcaaaagttat

SEQ ID NO: 587398 - DNA, 14 bp, D. melanogaster
atgcaaaataaaat

SEQ ID NO: 587399 - DNA, 13 bp, D. melanogaster
atgcaaaataata

SEQ ID NO: 587400 - DNA, 13 bp, D. melanogaster
atgcaaaatattt

SEQ ID NO: 587401 - DNA, 13 bp, D. melanogaster
atgcaaaatgaaa

SEQ ID NO: 587402 - DNA, 13 bp, D. melanogaster
atgcaaaatgatg

SEQ ID NO: 587403 - DNA, 14 bp, D. melanogaster
atgcaaaatgcaaa

SEQ ID NO: 587404 - DNA, 13 bp, D. melanogaster
atgcaaaatgcag

SEQ ID NO: 587405 - DNA, 14 bp, D. melanogaster
atgcaaaatgcgaa

SEQ ID NO: 587406 - DNA, 13 bp, D. melanogaster
atgcaaaatgtga

SEQ ID NO: 587407 - DNA, 13 bp, D. melanogaster
atgcaaaatgttg

SEQ ID NO: 587408 - DNA, 13 bp, D. melanogaster
atgcaaaattctt

SEQ ID NO: 587409 - DNA, 13 bp, D. melanogaster
atgcaaaatttta

SEQ ID NO: 587410 - DNA, 13 bp, D. melanogaster
atgcaaacaaaat

SEQ ID NO: 587411 - DNA, 13 bp, D. melanogaster
atgcaaacaaatc

SEQ ID NO: 587412 - DNA, 13 bp, D. melanogaster
atgcaaacaacaa

SEQ ID NO: 587413 - DNA, 13 bp, D. melanogaster
atgcaaacaagaa

SEQ ID NO: 587414 - DNA, 13 bp, D. melanogaster
atgcaaacaagtt

SEQ ID NO: 587415 - DNA, 14 bp, D. melanogaster
atgcaaacacacac

SEQ ID NO: 587416 - DNA, 13 bp, D. melanogaster
atgcaaacacatt

SEQ ID NO: 587417 - DNA, 13 bp, D. melanogaster
atgcaaacagcaa

SEQ ID NO: 587418 - DNA, 13 bp, D. melanogaster
atgcaaacatgca

SEQ ID NO: 587419 - DNA, 13 bp, D. melanogaster
atgcaaacattta

SEQ ID NO: 587420 - DNA, 13 bp, D. melanogaster
atgcaaacatttg

SEQ ID NO: 587421 - DNA, 14 bp, D. melanogaster
atgcaaacattttt

SEQ ID NO: 587422 - DNA, 13 bp, D. melanogaster
atgcaaaccgaaa

SEQ ID NO: 587423 - DNA, 13 bp, D. melanogaster
atgcaaagaattt

SEQ ID NO: 587424 - DNA, 13 bp, D. melanogaster
atgcaaagcaaaa

SEQ ID NO: 587425 - DNA, 13 bp, D. melanogaster
atgcaaagcaaag

SEQ ID NO: 587426 - DNA, 14 bp, D. melanogaster
atgcaaagcaattt

SEQ ID NO: 587427 - DNA, 13 bp, D. melanogaster
atgcaaagcagcc

SEQ ID NO: 587428 - DNA, 13 bp, D. melanogaster
atgcaaagcattt

SEQ ID NO: 587429 - DNA, 13 bp, D. melanogaster
atgcaaagccaaa

SEQ ID NO: 587430 - DNA, 13 bp, D. melanogaster
atgcaaagcgaaa

SEQ ID NO: 587431 - DNA, 13 bp, D. melanogaster
atgcaaagtcagt

SEQ ID NO: 587432 - DNA, 13 bp, D. melanogaster
atgcaaagtgcag

SEQ ID NO: 587433 - DNA, 14 bp, D. melanogaster
atgcaaataaaaat

SEQ ID NO: 587434 - DNA, 13 bp, D. melanogaster
atgcaaataaagc

SEQ ID NO: 587435 - DNA, 13 bp, D. melanogaster
atgcaaataaatg

SEQ ID NO: 587436 - DNA, 13 bp, D. melanogaster
atgcaaataagaa

SEQ ID NO: 587437 - DNA, 13 bp, D. melanogaster
atgcaaataagcc

SEQ ID NO: 587438 - DNA, 13 bp, D. melanogaster
atgcaaataagta

SEQ ID NO: 587439 - DNA, 13 bp, D. melanogaster
atgcaaatacaaa

SEQ ID NO: 587440 - DNA, 13 bp, D. melanogaster
atgcaaatacata

SEQ ID NO: 587441 - DNA, 13 bp, D. melanogaster
atgcaaatagcaa

SEQ ID NO: 587442 - DNA, 13 bp, D. melanogaster
atgcaaatatatc

SEQ ID NO: 587443 - DNA, 13 bp, D. melanogaster
atgcaaatatgca

SEQ ID NO: 587444 - DNA, 14 bp, D. melanogaster
atgcaaatatgcaa

SEQ ID NO: 587445 - DNA, 13 bp, D. melanogaster
atgcaaatatgcg

SEQ ID NO: 587446 - DNA, 14 bp, D. melanogaster
atgcaaatatgtat

SEQ ID NO: 587447 - DNA, 13 bp, D. melanogaster
atgcaaatatgtg

SEQ ID NO: 587448 - DNA, 13 bp, D. melanogaster
atgcaaatattcc

SEQ ID NO: 587449 - DNA, 13 bp, D. melanogaster
atgcaaatattgg

SEQ ID NO: 587450 - DNA, 13 bp, D. melanogaster
atgcaaatatttc

SEQ ID NO: 587451 - DNA, 13 bp, D. melanogaster
atgcaaatcaaaa

SEQ ID NO: 587452 - DNA, 13 bp, D. melanogaster
atgcaaatcaaac

SEQ ID NO: 587453 - DNA, 13 bp, D. melanogaster
atgcaaatcaaag

SEQ ID NO: 587454 - DNA, 14 bp, D. melanogaster
atgcaaatcaaatt

SEQ ID NO: 587455 - DNA, 13 bp, D. melanogaster
atgcaaatcacat

SEQ ID NO: 587456 - DNA, 13 bp, D. melanogaster
atgcaaatcatat

SEQ ID NO: 587457 - DNA, 13 bp, D. melanogaster
atgcaaatccatt

SEQ ID NO: 587458 - DNA, 13 bp, D. melanogaster
atgcaaatcgaaa

SEQ ID NO: 587459 - DNA, 13 bp, D. melanogaster
atgcaaatcgaat

SEQ ID NO: 587460 - DNA, 13 bp, D. melanogaster
atgcaaatcgatg

SEQ ID NO: 587461 - DNA, 13 bp, D. melanogaster
atgcaaatcgctt

SEQ ID NO: 587462 - DNA, 13 bp, D. melanogaster
atgcaaatctcgg

SEQ ID NO: 587463 - DNA, 14 bp, D. melanogaster
atgcaaatgaaaaa

SEQ ID NO: 587464 - DNA, 14 bp, D. melanogaster
atgcaaatgaaaac

SEQ ID NO: 587465 - DNA, 13 bp, D. melanogaster
atgcaaatgaaat

SEQ ID NO: 587466 - DNA, 14 bp, D. melanogaster
atgcaaatgaaatt

SEQ ID NO: 587467 - DNA, 13 bp, D. melanogaster
atgcaaatgagcc

SEQ ID NO: 587468 - DNA, 14 bp, D. melanogaster
atgcaaatgagttt

SEQ ID NO: 587469 - DNA, 13 bp, D. melanogaster
atgcaaatgatgc

SEQ ID NO: 587470 - DNA, 13 bp, D. melanogaster
atgcaaatgattt

SEQ ID NO: 587471 - DNA, 13 bp, D. melanogaster
atgcaaatgcaaa

SEQ ID NO: 587472 - DNA, 14 bp, D. melanogaster
atgcaaatgcaaaa

SEQ ID NO: 587473 - DNA, 14 bp, D. melanogaster
atgcaaatgcaaac

SEQ ID NO: 587474 - DNA, 14 bp, D. melanogaster
atgcaaatgcaaat

SEQ ID NO: 587475 - DNA, 13 bp, D. melanogaster
atgcaaatgcaac

SEQ ID NO: 587476 - DNA, 14 bp, D. melanogaster
atgcaaatgcaatg

SEQ ID NO: 587477 - DNA, 13 bp, D. melanogaster
atgcaaatgcaca

SEQ ID NO: 587478 - DNA, 13 bp, D. melanogaster
atgcaaatgcaga

SEQ ID NO: 587479 - DNA, 13 bp, D. melanogaster
atgcaaatgcagt

SEQ ID NO: 587480 - DNA, 14 bp, D. melanogaster
atgcaaatgcagtt

SEQ ID NO: 587481 - DNA, 13 bp, D. melanogaster
atgcaaatgcata

SEQ ID NO: 587482 - DNA, 13 bp, D. melanogaster
atgcaaatgcatt

SEQ ID NO: 587483 - DNA, 14 bp, D. melanogaster
atgcaaatgcattt

SEQ ID NO: 587484 - DNA, 13 bp, D. melanogaster
atgcaaatgccca

SEQ ID NO: 587485 - DNA, 13 bp, D. melanogaster
atgcaaatgcccc

SEQ ID NO: 587486 - DNA, 14 bp, D. melanogaster
atgcaaatgcgaaa

SEQ ID NO: 587487 - DNA, 13 bp, D. melanogaster
atgcaaatgcgat

SEQ ID NO: 587488 - DNA, 13 bp, D. melanogaster
atgcaaatgcggc

SEQ ID NO: 587489 - DNA, 13 bp, D. melanogaster
atgcaaatgcgtt

SEQ ID NO: 587490 - DNA, 13 bp, D. melanogaster
atgcaaatgctga

SEQ ID NO: 587491 - DNA, 13 bp, D. melanogaster
atgcaaatgctgg

SEQ ID NO: 587492 - DNA, 13 bp, D. melanogaster
atgcaaatgctgt

SEQ ID NO: 587493 - DNA, 14 bp, D. melanogaster
atgcaaatggaaaa

SEQ ID NO: 587494 - DNA, 14 bp, D. melanogaster
atgcaaatggcaaa

SEQ ID NO: 587495 - DNA, 13 bp, D. melanogaster
atgcaaatggcga

SEQ ID NO: 587496 - DNA, 13 bp, D. melanogaster
atgcaaatgggaa

SEQ ID NO: 587497 - DNA, 13 bp, D. melanogaster
atgcaaatgtatg

SEQ ID NO: 587498 - DNA, 13 bp, D. melanogaster
atgcaaatgtatt

SEQ ID NO: 587499 - DNA, 13 bp, D. melanogaster
atgcaaatgtcaa

SEQ ID NO: 587500 - DNA, 13 bp, D. melanogaster
atgcaaatgtcac

SEQ ID NO: 587501 - DNA, 13 bp, D. melanogaster
atgcaaatgtgca

SEQ ID NO: 587502 - DNA, 13 bp, D. melanogaster
atgcaaatgtgcc

SEQ ID NO: 587503 - DNA, 13 bp, D. melanogaster
atgcaaatgtggc

SEQ ID NO: 587504 - DNA, 13 bp, D. melanogaster
atgcaaatgttgc

SEQ ID NO: 587505 - DNA, 13 bp, D. melanogaster
atgcaaatgtttt

SEQ ID NO: 587506 - DNA, 13 bp, D. melanogaster
atgcaaattaaaa

SEQ ID NO: 587507 - DNA, 13 bp, D. melanogaster
atgcaaattaaac

SEQ ID NO: 587508 - DNA, 13 bp, D. melanogaster
atgcaaattaatt

SEQ ID NO: 587509 - DNA, 13 bp, D. melanogaster
atgcaaattactt

SEQ ID NO: 587510 - DNA, 13 bp, D. melanogaster
atgcaaattatat

SEQ ID NO: 587511 - DNA, 13 bp, D. melanogaster
atgcaaattcaaa

SEQ ID NO: 587512 - DNA, 14 bp, D. melanogaster
atgcaaattcaatt

SEQ ID NO: 587513 - DNA, 13 bp, D. melanogaster
atgcaaattcgat

SEQ ID NO: 587514 - DNA, 13 bp, D. melanogaster
atgcaaattgcac

SEQ ID NO: 587515 - DNA, 13 bp, D. melanogaster
atgcaaattgcca

SEQ ID NO: 587516 - DNA, 13 bp, D. melanogaster
atgcaaattgctc

SEQ ID NO: 587517 - DNA, 13 bp, D. melanogaster
atgcaaattgctg

SEQ ID NO: 587518 - DNA, 14 bp, D. melanogaster
atgcaaattgcttt

SEQ ID NO: 587519 - DNA, 13 bp, D. melanogaster
atgcaaattggat

SEQ ID NO: 587520 - DNA, 13 bp, D. melanogaster
atgcaaattggtt

SEQ ID NO: 587521 - DNA, 13 bp, D. melanogaster
atgcaaattgtat

SEQ ID NO: 587522 - DNA, 13 bp, D. melanogaster
atgcaaattgtgc

SEQ ID NO: 587523 - DNA, 14 bp, D. melanogaster
atgcaaattgtgca

SEQ ID NO: 587524 - DNA, 13 bp, D. melanogaster
atgcaaattgtgt

SEQ ID NO: 587525 - DNA, 13 bp, D. melanogaster
atgcaaattgttt

SEQ ID NO: 587526 - DNA, 13 bp, D. melanogaster
atgcaaatttaat

SEQ ID NO: 587527 - DNA, 14 bp, D. melanogaster
atgcaaatttaatt

SEQ ID NO: 587528 - DNA, 13 bp, D. melanogaster
atgcaaatttata

SEQ ID NO: 587529 - DNA, 13 bp, D. melanogaster
atgcaaatttatg

SEQ ID NO: 587530 - DNA, 14 bp, D. melanogaster
atgcaaatttatgc

SEQ ID NO: 587531 - DNA, 13 bp, D. melanogaster
atgcaaatttgct

SEQ ID NO: 587532 - DNA, 14 bp, D. melanogaster
atgcaaattttaat

SEQ ID NO: 587533 - DNA, 14 bp, D. melanogaster
atgcaaattttatg

SEQ ID NO: 587534 - DNA, 13 bp, D. melanogaster
atgcaaattttca

SEQ ID NO: 587535 - DNA, 13 bp, D. melanogaster
atgcaaattttcg

SEQ ID NO: 587536 - DNA, 13 bp, D. melanogaster
atgcaaattttct

SEQ ID NO: 587537 - DNA, 13 bp, D. melanogaster
atgcaaatttttc

SEQ ID NO: 587538 - DNA, 13 bp, D. melanogaster
atgcaacaaaaac

SEQ ID NO: 587539 - DNA, 13 bp, D. melanogaster
atgcaacaaaata

SEQ ID NO: 587540 - DNA, 13 bp, D. melanogaster
atgcaacaaaatt

SEQ ID NO: 587541 - DNA, 14 bp, D. melanogaster
atgcaacaaataaa

SEQ ID NO: 587542 - DNA, 13 bp, D. melanogaster
atgcaacaacaac

SEQ ID NO: 587543 - DNA, 13 bp, D. melanogaster
atgcaacaacttc

SEQ ID NO: 587544 - DNA, 13 bp, D. melanogaster
atgcaacaataaa

SEQ ID NO: 587545 - DNA, 13 bp, D. melanogaster
atgcaacaattaa

SEQ ID NO: 587546 - DNA, 13 bp, D. melanogaster
atgcaacacaaaa

SEQ ID NO: 587547 - DNA, 13 bp, D. melanogaster
atgcaacacaatt

SEQ ID NO: 587548 - DNA, 13 bp, D. melanogaster
atgcaacacattt

SEQ ID NO: 587549 - DNA, 14 bp, D. melanogaster
atgcaacagcaaca

SEQ ID NO: 587550 - DNA, 13 bp, D. melanogaster
atgcaacagcagc

SEQ ID NO: 587551 - DNA, 14 bp, D. melanogaster
atgcaacagcagca

SEQ ID NO: 587552 - DNA, 13 bp, D. melanogaster
atgcaacataatt

SEQ ID NO: 587553 - DNA, 14 bp, D. melanogaster
atgcaacatgttgc

SEQ ID NO: 587554 - DNA, 13 bp, D. melanogaster
atgcaacattgaa

SEQ ID NO: 587555 - DNA, 13 bp, D. melanogaster
atgcaacatttat

SEQ ID NO: 587556 - DNA, 13 bp, D. melanogaster
atgcaaccaaaaa

SEQ ID NO: 587557 - DNA, 13 bp, D. melanogaster
atgcaactaatat

SEQ ID NO: 587558 - DNA, 13 bp, D. melanogaster
atgcaactcaaat

SEQ ID NO: 587559 - DNA, 13 bp, D. melanogaster
atgcaactgaaac

SEQ ID NO: 587560 - DNA, 13 bp, D. melanogaster
atgcaactgcagc

SEQ ID NO: 587561 - DNA, 13 bp, D. melanogaster
atgcaactgctgc

SEQ ID NO: 587562 - DNA, 13 bp, D. melanogaster
atgcaactggcaa

SEQ ID NO: 587563 - DNA, 13 bp, D. melanogaster
atgcaactttaat

SEQ ID NO: 587564 - DNA, 13 bp, D. melanogaster
atgcaactttatt

SEQ ID NO: 587565 - DNA, 14 bp, D. melanogaster
atgcaagcaagcaa

SEQ ID NO: 587566 - DNA, 13 bp, D. melanogaster
atgcaataaaaag

SEQ ID NO: 587567 - DNA, 13 bp, D. melanogaster
atgcaataaacac

SEQ ID NO: 587568 - DNA, 13 bp, D. melanogaster
atgcaataaagtt

SEQ ID NO: 587569 - DNA, 13 bp, D. melanogaster
atgcaataaataa

SEQ ID NO: 587570 - DNA, 13 bp, D. melanogaster
atgcaataaatat

SEQ ID NO: 587571 - DNA, 13 bp, D. melanogaster
atgcaataaatta

SEQ ID NO: 587572 - DNA, 14 bp, D. melanogaster
atgcaataaattaa

SEQ ID NO: 587573 - DNA, 13 bp, D. melanogaster
atgcaataaattt

SEQ ID NO: 587574 - DNA, 13 bp, D. melanogaster
atgcaataactgt

SEQ ID NO: 587575 - DNA, 13 bp, D. melanogaster
atgcaataataaa

SEQ ID NO: 587576 - DNA, 13 bp, D. melanogaster
atgcaatacaaga

SEQ ID NO: 587577 - DNA, 13 bp, D. melanogaster
atgcaatataata

SEQ ID NO: 587578 - DNA, 13 bp, D. melanogaster
atgcaatatatat

SEQ ID NO: 587579 - DNA, 14 bp, D. melanogaster
atgcaatatatata

SEQ ID NO: 587580 - DNA, 13 bp, D. melanogaster
atgcaatatgcaa

SEQ ID NO: 587581 - DNA, 13 bp, D. melanogaster
atgcaatatgttt

SEQ ID NO: 587582 - DNA, 13 bp, D. melanogaster
atgcaatattaag

SEQ ID NO: 587583 - DNA, 13 bp, D. melanogaster
atgcaatattttc

SEQ ID NO: 587584 - DNA, 13 bp, D. melanogaster
atgcaatgcaaac

SEQ ID NO: 587585 - DNA, 13 bp, D. melanogaster
atgcaatgcaaat

SEQ ID NO: 587586 - DNA, 14 bp, D. melanogaster
atgcaatgcaatgc

SEQ ID NO: 587587 - DNA, 14 bp, D. melanogaster
atgcaatgcatttt

SEQ ID NO: 587588 - DNA, 13 bp, D. melanogaster
atgcaatggaaat

SEQ ID NO: 587589 - DNA, 13 bp, D. melanogaster
atgcaatggcaaa

SEQ ID NO: 587590 - DNA, 13 bp, D. melanogaster
atgcaatggcaat

SEQ ID NO: 587591 - DNA, 13 bp, D. melanogaster
atgcaatgtaatt

SEQ ID NO: 587592 - DNA, 13 bp, D. melanogaster
atgcaatgttttt

SEQ ID NO: 587593 - DNA, 13 bp, D. melanogaster
atgcaattaaaaa

SEQ ID NO: 587594 - DNA, 13 bp, D. melanogaster
atgcaattaaaac

SEQ ID NO: 587595 - DNA, 13 bp, D. melanogaster
atgcaattaaaat

SEQ ID NO: 587596 - DNA, 13 bp, D. melanogaster
atgcaattaaaca

SEQ ID NO: 587597 - DNA, 13 bp, D. melanogaster
atgcaattaaagt

SEQ ID NO: 587598 - DNA, 13 bp, D. melanogaster
atgcaattaaatt

SEQ ID NO: 587599 - DNA, 13 bp, D. melanogaster
atgcaattaatat

SEQ ID NO: 587600 - DNA, 14 bp, D. melanogaster
atgcaattaattaa

SEQ ID NO: 587601 - DNA, 13 bp, D. melanogaster
atgcaattagttg

SEQ ID NO: 587602 - DNA, 13 bp, D. melanogaster
atgcaattcaaaa

SEQ ID NO: 587603 - DNA, 13 bp, D. melanogaster
atgcaattcaatt

SEQ ID NO: 587604 - DNA, 13 bp, D. melanogaster
atgcaattgaaac

SEQ ID NO: 587605 - DNA, 14 bp, D. melanogaster
atgcaattgcaatt

SEQ ID NO: 587606 - DNA, 14 bp, D. melanogaster
atgcaattgcagtt

SEQ ID NO: 587607 - DNA, 13 bp, D. melanogaster
atgcaattgccat

SEQ ID NO: 587608 - DNA, 13 bp, D. melanogaster
atgcaattggaaa

SEQ ID NO: 587609 - DNA, 13 bp, D. melanogaster
atgcaattgttgt

SEQ ID NO: 587610 - DNA, 13 bp, D. melanogaster
atgcaatttaaaa

SEQ ID NO: 587611 - DNA, 13 bp, D. melanogaster
atgcaatttaaat

SEQ ID NO: 587612 - DNA, 13 bp, D. melanogaster
atgcaatttaatt

SEQ ID NO: 587613 - DNA, 13 bp, D. melanogaster
atgcaatttatta

SEQ ID NO: 587614 - DNA, 13 bp, D. melanogaster
atgcaatttattg

SEQ ID NO: 587615 - DNA, 13 bp, D. melanogaster
atgcaatttgatg

SEQ ID NO: 587616 - DNA, 14 bp, D. melanogaster
atgcaatttggcca

SEQ ID NO: 587617 - DNA, 13 bp, D. melanogaster
atgcaatttgtat

SEQ ID NO: 587618 - DNA, 13 bp, D. melanogaster
atgcaatttgtgt

SEQ ID NO: 587619 - DNA, 13 bp, D. melanogaster
atgcaatttgttg

SEQ ID NO: 587620 - DNA, 13 bp, D. melanogaster
atgcaattttaaa

SEQ ID NO: 587621 - DNA, 13 bp, D. melanogaster
atgcaattttaat

SEQ ID NO: 587622 - DNA, 14 bp, D. melanogaster
atgcaattttaatt

SEQ ID NO: 587623 - DNA, 13 bp, D. melanogaster
atgcaattttcaa

SEQ ID NO: 587624 - DNA, 14 bp, D. melanogaster
atgcaattttcatt

SEQ ID NO: 587625 - DNA, 13 bp, D. melanogaster
atgcaattttccc

SEQ ID NO: 587626 - DNA, 13 bp, D. melanogaster
atgcaattttccg

SEQ ID NO: 587627 - DNA, 13 bp, D. melanogaster
atgcaattttgtt

SEQ ID NO: 587628 - DNA, 13 bp, D. melanogaster
atgcaatttttca

SEQ ID NO: 587629 - DNA, 14 bp, D. melanogaster
atgcacaaataaat

SEQ ID NO: 587630 - DNA, 13 bp, D. melanogaster
atgcacaaatgca

SEQ ID NO: 587631 - DNA, 13 bp, D. melanogaster
atgcacaacaaat

SEQ ID NO: 587632 - DNA, 13 bp, D. melanogaster
atgcacaacaaca

SEQ ID NO: 587633 - DNA, 13 bp, D. melanogaster
atgcacaagtttt

SEQ ID NO: 587634 - DNA, 13 bp, D. melanogaster
atgcacacaaatt

SEQ ID NO: 587635 - DNA, 13 bp, D. melanogaster
atgcacacacacc

SEQ ID NO: 587636 - DNA, 13 bp, D. melanogaster
atgcacacacata

SEQ ID NO: 587637 - DNA, 14 bp, D. melanogaster
atgcacacacatat

SEQ ID NO: 587638 - DNA, 13 bp, D. melanogaster
atgcacacacgca

SEQ ID NO: 587639 - DNA, 13 bp, D. melanogaster
atgcacacataca

SEQ ID NO: 587640 - DNA, 14 bp, D. melanogaster
atgcacacatacac

SEQ ID NO: 587641 - DNA, 13 bp, D. melanogaster
atgcacacatgca

SEQ ID NO: 587642 - DNA, 13 bp, D. melanogaster
atgcacacgcaca

SEQ ID NO: 587643 - DNA, 13 bp, D. melanogaster
atgcacagaaaat

SEQ ID NO: 587644 - DNA, 13 bp, D. melanogaster
atgcacagcgaaa

SEQ ID NO: 587645 - DNA, 13 bp, D. melanogaster
atgcacagcgaga

SEQ ID NO: 587646 - DNA, 13 bp, D. melanogaster
atgcacagggaaa

SEQ ID NO: 587647 - DNA, 13 bp, D. melanogaster
atgcacataaaca

SEQ ID NO: 587648 - DNA, 13 bp, D. melanogaster
atgcacataaata

SEQ ID NO: 587649 - DNA, 13 bp, D. melanogaster
atgcacatacaca

SEQ ID NO: 587650 - DNA, 13 bp, D. melanogaster
atgcacatacata

SEQ ID NO: 587651 - DNA, 13 bp, D. melanogaster
atgcacatatatt

SEQ ID NO: 587652 - DNA, 13 bp, D. melanogaster
atgcacatatttt

SEQ ID NO: 587653 - DNA, 13 bp, D. melanogaster
atgcacatccaca

SEQ ID NO: 587654 - DNA, 13 bp, D. melanogaster
atgcacatgcaaa

SEQ ID NO: 587655 - DNA, 13 bp, D. melanogaster
atgcaccatgcac

SEQ ID NO: 587656 - DNA, 13 bp, D. melanogaster
atgcacccatgtc

SEQ ID NO: 587657 - DNA, 13 bp, D. melanogaster
atgcaccttttcc

SEQ ID NO: 587658 - DNA, 14 bp, D. melanogaster
atgcactgagaaaa

SEQ ID NO: 587659 - DNA, 13 bp, D. melanogaster
atgcactgcaaaa

SEQ ID NO: 587660 - DNA, 14 bp, D. melanogaster
atgcactgcaagaa

SEQ ID NO: 587661 - DNA, 13 bp, D. melanogaster
atgcactgcgaaa

SEQ ID NO: 587662 - DNA, 14 bp, D. melanogaster
atgcactgcgctgc

SEQ ID NO: 587663 - DNA, 13 bp, D. melanogaster
atgcactgctcca

SEQ ID NO: 587664 - DNA, 14 bp, D. melanogaster
atgcactgctccag

SEQ ID NO: 587665 - DNA, 13 bp, D. melanogaster
atgcactggcaga

SEQ ID NO: 587666 - DNA, 13 bp, D. melanogaster
atgcactgggaaa

SEQ ID NO: 587667 - DNA, 13 bp, D. melanogaster
atgcactgggaga

SEQ ID NO: 587668 - DNA, 13 bp, D. melanogaster
atgcacttaatta

SEQ ID NO: 587669 - DNA, 13 bp, D. melanogaster
atgcacttacata

SEQ ID NO: 587670 - DNA, 13 bp, D. melanogaster
atgcacttagaaa

SEQ ID NO: 587671 - DNA, 13 bp, D. melanogaster
atgcacttatact

SEQ ID NO: 587672 - DNA, 13 bp, D. melanogaster
atgcactttttaa

SEQ ID NO: 587673 - DNA, 13 bp, D. melanogaster
atgcagaaaatat

SEQ ID NO: 587674 - DNA, 13 bp, D. melanogaster
atgcagaaaatgc

SEQ ID NO: 587675 - DNA, 13 bp, D. melanogaster
atgcagaaaatgt

SEQ ID NO: 587676 - DNA, 13 bp, D. melanogaster
atgcagaaacaaa

SEQ ID NO: 587677 - DNA, 13 bp, D. melanogaster
atgcagaatgcaa

SEQ ID NO: 587678 - DNA, 13 bp, D. melanogaster
atgcagaatgcag

SEQ ID NO: 587679 - DNA, 14 bp, D. melanogaster
atgcagaatgcaga

SEQ ID NO: 587680 - DNA, 13 bp, D. melanogaster
atgcagatacatt

SEQ ID NO: 587681 - DNA, 14 bp, D. melanogaster
atgcagatacattt

SEQ ID NO: 587682 - DNA, 13 bp, D. melanogaster
atgcagatatata

SEQ ID NO: 587683 - DNA, 13 bp, D. melanogaster
atgcagatgcaaa

SEQ ID NO: 587684 - DNA, 14 bp, D. melanogaster
atgcagatgcagat

SEQ ID NO: 587685 - DNA, 13 bp, D. melanogaster
atgcagatggaaa

SEQ ID NO: 587686 - DNA, 13 bp, D. melanogaster
atgcagattggct

SEQ ID NO: 587687 - DNA, 14 bp, D. melanogaster
atgcagattggctt

SEQ ID NO: 587688 - DNA, 13 bp, D. melanogaster
atgcagattttta

SEQ ID NO: 587689 - DNA, 13 bp, D. melanogaster
atgcagcaaaaaa

SEQ ID NO: 587690 - DNA, 13 bp, D. melanogaster
atgcagcaaattg

SEQ ID NO: 587691 - DNA, 13 bp, D. melanogaster
atgcagcaacaaa

SEQ ID NO: 587692 - DNA, 13 bp, D. melanogaster
atgcagcaacaac

SEQ ID NO: 587693 - DNA, 13 bp, D. melanogaster
atgcagcaacaat

SEQ ID NO: 587694 - DNA, 14 bp, D. melanogaster
atgcagcaacagca

SEQ ID NO: 587695 - DNA, 13 bp, D. melanogaster
atgcagcaataaa

SEQ ID NO: 587696 - DNA, 13 bp, D. melanogaster
atgcagcacaaaa

SEQ ID NO: 587697 - DNA, 13 bp, D. melanogaster
atgcagcacacac

SEQ ID NO: 587698 - DNA, 13 bp, D. melanogaster
atgcagcagcatc

SEQ ID NO: 587699 - DNA, 13 bp, D. melanogaster
atgcagcagccaa

SEQ ID NO: 587700 - DNA, 13 bp, D. melanogaster
atgcagcagcggc

SEQ ID NO: 587701 - DNA, 13 bp, D. melanogaster
atgcagcaggcag

SEQ ID NO: 587702 - DNA, 14 bp, D. melanogaster
atgcagcatgcagc

SEQ ID NO: 587703 - DNA, 13 bp, D. melanogaster
atgcagccacttt

SEQ ID NO: 587704 - DNA, 14 bp, D. melanogaster
atgcagcgataagc

SEQ ID NO: 587705 - DNA, 13 bp, D. melanogaster
atgcagcgcagtg

SEQ ID NO: 587706 - DNA, 13 bp, D. melanogaster
atgcagcggcagc

SEQ ID NO: 587707 - DNA, 15 bp, D. melanogaster
atgcagctaactatc

SEQ ID NO: 587708 - DNA, 13 bp, D. melanogaster
atgcagctatata

SEQ ID NO: 587709 - DNA, 13 bp, D. melanogaster
atgcagctgcaac

SEQ ID NO: 587710 - DNA, 13 bp, D. melanogaster
atgcagctgcaat

SEQ ID NO: 587711 - DNA, 13 bp, D. melanogaster
atgcagctgcatt

SEQ ID NO: 587712 - DNA, 13 bp, D. melanogaster
atgcagctttcca

SEQ ID NO: 587713 - DNA, 13 bp, D. melanogaster
atgcaggaagata

SEQ ID NO: 587714 - DNA, 13 bp, D. melanogaster
atgcaggcagttg

SEQ ID NO: 587715 - DNA, 13 bp, D. melanogaster
atgcagtcaaagc

SEQ ID NO: 587716 - DNA, 13 bp, D. melanogaster
atgcagtgaagaa

SEQ ID NO: 587717 - DNA, 13 bp, D. melanogaster
atgcagttaaaaa

SEQ ID NO: 587718 - DNA, 13 bp, D. melanogaster
atgcagttacaat

SEQ ID NO: 587719 - DNA, 13 bp, D. melanogaster
atgcagttgcagc

SEQ ID NO: 587720 - DNA, 13 bp, D. melanogaster
atgcagttttcaa

SEQ ID NO: 587721 - DNA, 13 bp, D. melanogaster
atgcataaatatt

SEQ ID NO: 587722 - DNA, 13 bp, D. melanogaster
atgcataaattaa

SEQ ID NO: 587723 - DNA, 13 bp, D. melanogaster
atgcataaattat

SEQ ID NO: 587724 - DNA, 14 bp, D. melanogaster
atgcataagcaact

SEQ ID NO: 587725 - DNA, 13 bp, D. melanogaster
atgcataatgaaa

SEQ ID NO: 587726 - DNA, 13 bp, D. melanogaster
atgcatacataat

SEQ ID NO: 587727 - DNA, 13 bp, D. melanogaster
atgcatacatata

SEQ ID NO: 587728 - DNA, 13 bp, D. melanogaster
atgcatacatgca

SEQ ID NO: 587729 - DNA, 13 bp, D. melanogaster
atgcatacgaaat

SEQ ID NO: 587730 - DNA, 13 bp, D. melanogaster
atgcatataaata

SEQ ID NO: 587731 - DNA, 13 bp, D. melanogaster
atgcatatataca

SEQ ID NO: 587732 - DNA, 13 bp, D. melanogaster
atgcatatatatg

SEQ ID NO: 587733 - DNA, 14 bp, D. melanogaster
atgcatatatattt

SEQ ID NO: 587734 - DNA, 13 bp, D. melanogaster
atgcatatatgca

SEQ ID NO: 587735 - DNA, 14 bp, D. melanogaster
atgcatatatgtat

SEQ ID NO: 587736 - DNA, 14 bp, D. melanogaster
atgcatatatttat

SEQ ID NO: 587737 - DNA, 13 bp, D. melanogaster
atgcatatgaatt

SEQ ID NO: 587738 - DNA, 13 bp, D. melanogaster
atgcatatgcata

SEQ ID NO: 587739 - DNA, 14 bp, D. melanogaster
atgcatatgcatat

SEQ ID NO: 587740 - DNA, 13 bp, D. melanogaster
atgcatatgcatt

SEQ ID NO: 587741 - DNA, 13 bp, D. melanogaster
atgcatatgcttt

SEQ ID NO: 587742 - DNA, 13 bp, D. melanogaster
atgcatatgtatg

SEQ ID NO: 587743 - DNA, 13 bp, D. melanogaster
atgcatatgtatt

SEQ ID NO: 587744 - DNA, 14 bp, D. melanogaster
atgcatatgtgtgt

SEQ ID NO: 587745 - DNA, 13 bp, D. melanogaster
atgcatatgttat

SEQ ID NO: 587746 - DNA, 13 bp, D. melanogaster
atgcatatgttta

SEQ ID NO: 587747 - DNA, 13 bp, D. melanogaster
atgcatattatta

SEQ ID NO: 587748 - DNA, 13 bp, D. melanogaster
atgcatatttatg

SEQ ID NO: 587749 - DNA, 13 bp, D. melanogaster
atgcatatttgaa

SEQ ID NO: 587750 - DNA, 13 bp, D. melanogaster
atgcatatttgca

SEQ ID NO: 587751 - DNA, 13 bp, D. melanogaster
atgcatatttgtt

SEQ ID NO: 587752 - DNA, 13 bp, D. melanogaster
atgcatattttat

SEQ ID NO: 587753 - DNA, 13 bp, D. melanogaster
atgcatattttgt

SEQ ID NO: 587754 - DNA, 13 bp, D. melanogaster
atgcatatttttt

SEQ ID NO: 587755 - DNA, 13 bp, D. melanogaster
atgcatctgtatc

SEQ ID NO: 587756 - DNA, 13 bp, D. melanogaster
atgcatgagcttc

SEQ ID NO: 587757 - DNA, 13 bp, D. melanogaster
atgcatgcaattt

SEQ ID NO: 587758 - DNA, 14 bp, D. melanogaster
atgcatgcatacat

SEQ ID NO: 587759 - DNA, 13 bp, D. melanogaster
atgcatgcatgca

SEQ ID NO: 587760 - DNA, 14 bp, D. melanogaster
atgcatgcatgcat

SEQ ID NO: 587761 - DNA, 13 bp, D. melanogaster
atgcatgtacata

SEQ ID NO: 587762 - DNA, 14 bp, D. melanogaster
atgcatgtacatac

SEQ ID NO: 587763 - DNA, 13 bp, D. melanogaster
atgcatgtattta

SEQ ID NO: 587764 - DNA, 13 bp, D. melanogaster
atgcatgtgtata

SEQ ID NO: 587765 - DNA, 13 bp, D. melanogaster
atgcatgtgtatg

SEQ ID NO: 587766 - DNA, 13 bp, D. melanogaster
atgcatgtgtgcg

SEQ ID NO: 587767 - DNA, 13 bp, D. melanogaster
atgcatgtttata

SEQ ID NO: 587768 - DNA, 13 bp, D. melanogaster
atgcattaaaaat

SEQ ID NO: 587769 - DNA, 13 bp, D. melanogaster
atgcattaaacaa

SEQ ID NO: 587770 - DNA, 13 bp, D. melanogaster
atgcattaaattc

SEQ ID NO: 587771 - DNA, 13 bp, D. melanogaster
atgcattaaattt

SEQ ID NO: 587772 - DNA, 13 bp, D. melanogaster
atgcattaacatt

SEQ ID NO: 587773 - DNA, 14 bp, D. melanogaster
atgcattaataaaa

SEQ ID NO: 587774 - DNA, 13 bp, D. melanogaster
atgcattacattt

SEQ ID NO: 587775 - DNA, 13 bp, D. melanogaster
atgcattatcatt

SEQ ID NO: 587776 - DNA, 13 bp, D. melanogaster
atgcattattatt

SEQ ID NO: 587777 - DNA, 13 bp, D. melanogaster
atgcattcaaaat

SEQ ID NO: 587778 - DNA, 13 bp, D. melanogaster
atgcattcataaa

SEQ ID NO: 587779 - DNA, 13 bp, D. melanogaster
atgcattccacaa

SEQ ID NO: 587780 - DNA, 14 bp, D. melanogaster
atgcattccagcaa

SEQ ID NO: 587781 - DNA, 15 bp, D. melanogaster
atgcattccggcttt

SEQ ID NO: 587782 - DNA, 13 bp, D. melanogaster
atgcattcgaata

SEQ ID NO: 587783 - DNA, 13 bp, D. melanogaster
atgcattgaaaat

SEQ ID NO: 587784 - DNA, 13 bp, D. melanogaster
atgcattgcactt

SEQ ID NO: 587785 - DNA, 13 bp, D. melanogaster
atgcattgtaaat

SEQ ID NO: 587786 - DNA, 13 bp, D. melanogaster
atgcattgtgaaa

SEQ ID NO: 587787 - DNA, 14 bp, D. melanogaster
atgcattgttgcgt

SEQ ID NO: 587788 - DNA, 14 bp, D. melanogaster
atgcatttaaaatt

SEQ ID NO: 587789 - DNA, 13 bp, D. melanogaster
atgcatttaaact

SEQ ID NO: 587790 - DNA, 13 bp, D. melanogaster
atgcatttaaatg

SEQ ID NO: 587791 - DNA, 14 bp, D. melanogaster
atgcatttaaatgc

SEQ ID NO: 587792 - DNA, 13 bp, D. melanogaster
atgcatttaacaa

SEQ ID NO: 587793 - DNA, 13 bp, D. melanogaster
atgcatttaactt

SEQ ID NO: 587794 - DNA, 13 bp, D. melanogaster
atgcatttaatta

SEQ ID NO: 587795 - DNA, 14 bp, D. melanogaster
atgcatttaattat

SEQ ID NO: 587796 - DNA, 13 bp, D. melanogaster
atgcatttagttt

SEQ ID NO: 587797 - DNA, 13 bp, D. melanogaster
atgcatttataat

SEQ ID NO: 587798 - DNA, 13 bp, D. melanogaster
atgcatttatgta

SEQ ID NO: 587799 - DNA, 13 bp, D. melanogaster
atgcatttattaa

SEQ ID NO: 587800 - DNA, 13 bp, D. melanogaster
atgcatttattat

SEQ ID NO: 587801 - DNA, 13 bp, D. melanogaster
atgcatttatttc

SEQ ID NO: 587802 - DNA, 13 bp, D. melanogaster
atgcatttatttg

SEQ ID NO: 587803 - DNA, 13 bp, D. melanogaster
atgcatttcaatt

SEQ ID NO: 587804 - DNA, 14 bp, D. melanogaster
atgcatttcaatta

SEQ ID NO: 587805 - DNA, 13 bp, D. melanogaster
atgcatttcgaaa

SEQ ID NO: 587806 - DNA, 13 bp, D. melanogaster
atgcatttgatat

SEQ ID NO: 587807 - DNA, 13 bp, D. melanogaster
atgcatttgattt

SEQ ID NO: 587808 - DNA, 13 bp, D. melanogaster
atgcatttgcata

SEQ ID NO: 587809 - DNA, 14 bp, D. melanogaster
atgcatttgcataa

SEQ ID NO: 587810 - DNA, 13 bp, D. melanogaster
atgcatttgctta

SEQ ID NO: 587811 - DNA, 13 bp, D. melanogaster
atgcatttggaat

SEQ ID NO: 587812 - DNA, 13 bp, D. melanogaster
atgcatttggttt

SEQ ID NO: 587813 - DNA, 13 bp, D. melanogaster
atgcatttgtatc

SEQ ID NO: 587814 - DNA, 13 bp, D. melanogaster
atgcatttgttat

SEQ ID NO: 587815 - DNA, 13 bp, D. melanogaster
atgcatttgtttt

SEQ ID NO: 587816 - DNA, 13 bp, D. melanogaster
atgcattttaatg

SEQ ID NO: 587817 - DNA, 13 bp, D. melanogaster
atgcattttaatt

SEQ ID NO: 587818 - DNA, 14 bp, D. melanogaster
atgcattttaattg

SEQ ID NO: 587819 - DNA, 13 bp, D. melanogaster
atgcattttatat

SEQ ID NO: 587820 - DNA, 13 bp, D. melanogaster
atgcattttatta

SEQ ID NO: 587821 - DNA, 13 bp, D. melanogaster
atgcattttccaa

SEQ ID NO: 587822 - DNA, 13 bp, D. melanogaster
atgcattttccac

SEQ ID NO: 587823 - DNA, 13 bp, D. melanogaster
atgcattttcccc

SEQ ID NO: 587824 - DNA, 13 bp, D. melanogaster
atgcattttgatg

SEQ ID NO: 587825 - DNA, 13 bp, D. melanogaster
atgcattttgcag

SEQ ID NO: 587826 - DNA, 13 bp, D. melanogaster
atgcattttggcc

SEQ ID NO: 587827 - DNA, 13 bp, D. melanogaster
atgcattttgtgc

SEQ ID NO: 587828 - DNA, 13 bp, D. melanogaster
atgcatttttgat

SEQ ID NO: 587829 - DNA, 13 bp, D. melanogaster
atgcattttttcc

SEQ ID NO: 587830 - DNA, 13 bp, D. melanogaster
atgccaaaaaaag

SEQ ID NO: 587831 - DNA, 13 bp, D. melanogaster
atgccaaaaaaga

SEQ ID NO: 587832 - DNA, 13 bp, D. melanogaster
atgccaaaaacca

SEQ ID NO: 587833 - DNA, 13 bp, D. melanogaster
atgccaaaaagca

SEQ ID NO: 587834 - DNA, 13 bp, D. melanogaster
atgccaaaaagga

SEQ ID NO: 587835 - DNA, 13 bp, D. melanogaster
atgccaaaaagta

SEQ ID NO: 587836 - DNA, 13 bp, D. melanogaster
atgccaaaacaag

SEQ ID NO: 587837 - DNA, 13 bp, D. melanogaster
atgccaaaagaaa

SEQ ID NO: 587838 - DNA, 13 bp, D. melanogaster
atgccaaaagagc

SEQ ID NO: 587839 - DNA, 13 bp, D. melanogaster
atgccaaaataat

SEQ ID NO: 587840 - DNA, 13 bp, D. melanogaster
atgccaaaatgca

SEQ ID NO: 587841 - DNA, 13 bp, D. melanogaster
atgccaaaattaa

SEQ ID NO: 587842 - DNA, 13 bp, D. melanogaster
atgccaaacaaaa

SEQ ID NO: 587843 - DNA, 13 bp, D. melanogaster
atgccaaacaaat

SEQ ID NO: 587844 - DNA, 13 bp, D. melanogaster
atgccaaacaatg

SEQ ID NO: 587845 - DNA, 13 bp, D. melanogaster
atgccaaacaatt

SEQ ID NO: 587846 - DNA, 13 bp, D. melanogaster
atgccaaacattt

SEQ ID NO: 587847 - DNA, 13 bp, D. melanogaster
atgccaaacgaaa

SEQ ID NO: 587848 - DNA, 13 bp, D. melanogaster
atgccaaacggaa

SEQ ID NO: 587849 - DNA, 13 bp, D. melanogaster
atgccaaagaaat

SEQ ID NO: 587850 - DNA, 13 bp, D. melanogaster
atgccaaaggaaa

SEQ ID NO: 587851 - DNA, 13 bp, D. melanogaster
atgccaaataaaa

SEQ ID NO: 587852 - DNA, 13 bp, D. melanogaster
atgccaaataaat

SEQ ID NO: 587853 - DNA, 13 bp, D. melanogaster
atgccaaatcaaa

SEQ ID NO: 587854 - DNA, 13 bp, D. melanogaster
atgccaaatcgaa

SEQ ID NO: 587855 - DNA, 13 bp, D. melanogaster
atgccaaatgcca

SEQ ID NO: 587856 - DNA, 13 bp, D. melanogaster
atgccaaatgtca

SEQ ID NO: 587857 - DNA, 13 bp, D. melanogaster
atgccaaatgttt

SEQ ID NO: 587858 - DNA, 13 bp, D. melanogaster
atgccaaattaaa

SEQ ID NO: 587859 - DNA, 14 bp, D. melanogaster
atgccaaattaaaa

SEQ ID NO: 587860 - DNA, 14 bp, D. melanogaster
atgccaaattaaat

SEQ ID NO: 587861 - DNA, 13 bp, D. melanogaster
atgccaaattgaa

SEQ ID NO: 587862 - DNA, 13 bp, D. melanogaster
atgccaaatttaa

SEQ ID NO: 587863 - DNA, 13 bp, D. melanogaster
atgccaaattttt

SEQ ID NO: 587864 - DNA, 14 bp, D. melanogaster
atgccaaatttttg

SEQ ID NO: 587865 - DNA, 13 bp, D. melanogaster
atgccaacaaatt

SEQ ID NO: 587866 - DNA, 13 bp, D. melanogaster
atgccaacaacaa

SEQ ID NO: 587867 - DNA, 13 bp, D. melanogaster
atgccaacagcaa

SEQ ID NO: 587868 - DNA, 14 bp, D. melanogaster
atgccaacgacaat

SEQ ID NO: 587869 - DNA, 13 bp, D. melanogaster
atgccaacgaggc

SEQ ID NO: 587870 - DNA, 15 bp, D. melanogaster
atgccaacgaggcgg

SEQ ID NO: 587871 - DNA, 13 bp, D. melanogaster
atgccaacgccag

SEQ ID NO: 587872 - DNA, 13 bp, D. melanogaster
atgccaagaaaaa

SEQ ID NO: 587873 - DNA, 13 bp, D. melanogaster
atgccaaggaaaa

SEQ ID NO: 587874 - DNA, 13 bp, D. melanogaster
atgccaagtattt

SEQ ID NO: 587875 - DNA, 13 bp, D. melanogaster
atgccaagtgcca

SEQ ID NO: 587876 - DNA, 13 bp, D. melanogaster
atgccaagtggca

SEQ ID NO: 587877 - DNA, 13 bp, D. melanogaster
atgccaataaaaa

SEQ ID NO: 587878 - DNA, 13 bp, D. melanogaster
atgccaataaatt

SEQ ID NO: 587879 - DNA, 13 bp, D. melanogaster
atgccaatcaatc

SEQ ID NO: 587880 - DNA, 13 bp, D. melanogaster
atgccaatcgatt

SEQ ID NO: 587881 - DNA, 13 bp, D. melanogaster
atgccaatgaaaa

SEQ ID NO: 587882 - DNA, 13 bp, D. melanogaster
atgccaatgccaa

SEQ ID NO: 587883 - DNA, 13 bp, D. melanogaster
atgccaatggaat

SEQ ID NO: 587884 - DNA, 13 bp, D. melanogaster
atgccaatggcaa

SEQ ID NO: 587885 - DNA, 13 bp, D. melanogaster
atgccaattggca

SEQ ID NO: 587886 - DNA, 13 bp, D. melanogaster
atgccaatttaat

SEQ ID NO: 587887 - DNA, 13 bp, D. melanogaster
atgccaatttatt

SEQ ID NO: 587888 - DNA, 13 bp, D. melanogaster
atgccaatttgtt

SEQ ID NO: 587889 - DNA, 13 bp, D. melanogaster
atgccacaaaaga

SEQ ID NO: 587890 - DNA, 13 bp, D. melanogaster
atgccacaaaagc

SEQ ID NO: 587891 - DNA, 13 bp, D. melanogaster
atgccacacacac

SEQ ID NO: 587892 - DNA, 13 bp, D. melanogaster
atgccacatgcaa

SEQ ID NO: 587893 - DNA, 13 bp, D. melanogaster
atgccacatgcca

SEQ ID NO: 587894 - DNA, 13 bp, D. melanogaster
atgccacattatt

SEQ ID NO: 587895 - DNA, 13 bp, D. melanogaster
atgccacattttt

SEQ ID NO: 587896 - DNA, 13 bp, D. melanogaster
atgccaccaaaat

SEQ ID NO: 587897 - DNA, 13 bp, D. melanogaster
atgccaccaaata

SEQ ID NO: 587898 - DNA, 13 bp, D. melanogaster
atgccacccactt

SEQ ID NO: 587899 - DNA, 13 bp, D. melanogaster
atgccaccccaaa

SEQ ID NO: 587900 - DNA, 14 bp, D. melanogaster
atgccacgcccacc

SEQ ID NO: 587901 - DNA, 13 bp, D. melanogaster
atgccacgccccc

SEQ ID NO: 587902 - DNA, 14 bp, D. melanogaster
atgccacgcccccg

SEQ ID NO: 587903 - DNA, 13 bp, D. melanogaster
atgccacgcccct

SEQ ID NO: 587904 - DNA, 13 bp, D. melanogaster
atgccactccgaa

SEQ ID NO: 587905 - DNA, 13 bp, D. melanogaster
atgccactgccac

SEQ ID NO: 587906 - DNA, 13 bp, D. melanogaster
atgccactggcag

SEQ ID NO: 587907 - DNA, 13 bp, D. melanogaster
atgccactttgaa

SEQ ID NO: 587908 - DNA, 13 bp, D. melanogaster
atgccactttgtt

SEQ ID NO: 587909 - DNA, 13 bp, D. melanogaster
atgccagaaaaaa

SEQ ID NO: 587910 - DNA, 13 bp, D. melanogaster
atgccagaaaaat

SEQ ID NO: 587911 - DNA, 13 bp, D. melanogaster
atgccagaaagtg

SEQ ID NO: 587912 - DNA, 13 bp, D. melanogaster
atgccagaaatat

SEQ ID NO: 587913 - DNA, 13 bp, D. melanogaster
atgccagcaaaaa

SEQ ID NO: 587914 - DNA, 13 bp, D. melanogaster
atgccagcaaaca

SEQ ID NO: 587915 - DNA, 13 bp, D. melanogaster
atgccagcaattg

SEQ ID NO: 587916 - DNA, 13 bp, D. melanogaster
atgccagcgaaaa

SEQ ID NO: 587917 - DNA, 13 bp, D. melanogaster
atgccaggcattt

SEQ ID NO: 587918 - DNA, 13 bp, D. melanogaster
atgccagtctgca

SEQ ID NO: 587919 - DNA, 13 bp, D. melanogaster
atgccataaaaca

SEQ ID NO: 587920 - DNA, 14 bp, D. melanogaster
atgccataaaacat

SEQ ID NO: 587921 - DNA, 13 bp, D. melanogaster
atgccataaaatg

SEQ ID NO: 587922 - DNA, 13 bp, D. melanogaster
atgccataaacga

SEQ ID NO: 587923 - DNA, 14 bp, D. melanogaster
atgccataaacgaa

SEQ ID NO: 587924 - DNA, 13 bp, D. melanogaster
atgccataaattt

SEQ ID NO: 587925 - DNA, 13 bp, D. melanogaster
atgccatatgcca

SEQ ID NO: 587926 - DNA, 13 bp, D. melanogaster
atgccatcaccaa

SEQ ID NO: 587927 - DNA, 14 bp, D. melanogaster
atgccatcattttt

SEQ ID NO: 587928 - DNA, 13 bp, D. melanogaster
atgccattaaaag

SEQ ID NO: 587929 - DNA, 13 bp, D. melanogaster
atgccattaaata

SEQ ID NO: 587930 - DNA, 14 bp, D. melanogaster
atgccattaaatat

SEQ ID NO: 587931 - DNA, 13 bp, D. melanogaster
atgccattaatat

SEQ ID NO: 587932 - DNA, 13 bp, D. melanogaster
atgccattcaagg

SEQ ID NO: 587933 - DNA, 15 bp, D. melanogaster
atgccattcaagggt

SEQ ID NO: 587934 - DNA, 13 bp, D. melanogaster
atgccattccata

SEQ ID NO: 587935 - DNA, 13 bp, D. melanogaster
atgccatttcatt

SEQ ID NO: 587936 - DNA, 13 bp, D. melanogaster
atgccatttgttt

SEQ ID NO: 587937 - DNA, 13 bp, D. melanogaster
atgccattttcaa

SEQ ID NO: 587938 - DNA, 13 bp, D. melanogaster
atgcccaaaacaa

SEQ ID NO: 587939 - DNA, 13 bp, D. melanogaster
atgcccaagatcc

SEQ ID NO: 587940 - DNA, 13 bp, D. melanogaster
atgcccaataaaa

SEQ ID NO: 587941 - DNA, 13 bp, D. melanogaster
atgcccacaatgt

SEQ ID NO: 587942 - DNA, 14 bp, D. melanogaster
atgcccacaatgtc

SEQ ID NO: 587943 - DNA, 13 bp, D. melanogaster
atgcccacacttt

SEQ ID NO: 587944 - DNA, 13 bp, D. melanogaster
atgcccaccactg

SEQ ID NO: 587945 - DNA, 13 bp, D. melanogaster
atgcccataccca

SEQ ID NO: 587946 - DNA, 14 bp, D. melanogaster
atgcccatacccat

SEQ ID NO: 587947 - DNA, 13 bp, D. melanogaster
atgcccatccctc

SEQ ID NO: 587948 - DNA, 13 bp, D. melanogaster
atgcccatgccca

SEQ ID NO: 587949 - DNA, 13 bp, D. melanogaster
atgcccatgcccc

SEQ ID NO: 587950 - DNA, 13 bp, D. melanogaster
atgcccattaaaa

SEQ ID NO: 587951 - DNA, 14 bp, D. melanogaster
atgcccattcccat

SEQ ID NO: 587952 - DNA, 13 bp, D. melanogaster
atgcccgatgtcc

SEQ ID NO: 587953 - DNA, 13 bp, D. melanogaster
atgccctggaaaa

SEQ ID NO: 587954 - DNA, 13 bp, D. melanogaster
atgcccttcagga

SEQ ID NO: 587955 - DNA, 13 bp, D. melanogaster
atgcccttcttcc

SEQ ID NO: 587956 - DNA, 13 bp, D. melanogaster
atgcccttttttt

SEQ ID NO: 587957 - DNA, 14 bp, D. melanogaster
atgccgaaaaaaaa

SEQ ID NO: 587958 - DNA, 13 bp, D. melanogaster
atgccgatgatga

SEQ ID NO: 587959 - DNA, 13 bp, D. melanogaster
atgccgatttctc

SEQ ID NO: 587960 - DNA, 13 bp, D. melanogaster
atgccggccgtgt

SEQ ID NO: 587961 - DNA, 13 bp, D. melanogaster
atgcctcactgct

SEQ ID NO: 587962 - DNA, 13 bp, D. melanogaster
atgcctcagctgg

SEQ ID NO: 587963 - DNA, 13 bp, D. melanogaster
atgcctctatgta

SEQ ID NO: 587964 - DNA, 13 bp, D. melanogaster
atgcctgctaaac

SEQ ID NO: 587965 - DNA, 13 bp, D. melanogaster
atgcctgctgatc

SEQ ID NO: 587966 - DNA, 13 bp, D. melanogaster
atgcctggaacac

SEQ ID NO: 587967 - DNA, 13 bp, D. melanogaster
atgccttctgcat

SEQ ID NO: 587968 - DNA, 14 bp, D. melanogaster
atgccttgaatgtt

SEQ ID NO: 587969 - DNA, 13 bp, D. melanogaster
atgcctttggtgg

SEQ ID NO: 587970 - DNA, 14 bp, D. melanogaster
atgcctttggtgga

SEQ ID NO: 587971 - DNA, 14 bp, D. melanogaster
atgcctttttttgg

SEQ ID NO: 587972 - DNA, 13 bp, D. melanogaster
atgcgaaaaacaa

SEQ ID NO: 587973 - DNA, 13 bp, D. melanogaster
atgcgaaaaacga

SEQ ID NO: 587974 - DNA, 13 bp, D. melanogaster
atgcgaaaaataa

SEQ ID NO: 587975 - DNA, 13 bp, D. melanogaster
atgcgaaaaattc

SEQ ID NO: 587976 - DNA, 13 bp, D. melanogaster
atgcgaaaagttt

SEQ ID NO: 587977 - DNA, 13 bp, D. melanogaster
atgcgaaaatcga

SEQ ID NO: 587978 - DNA, 13 bp, D. melanogaster
atgcgaaaatgtg

SEQ ID NO: 587979 - DNA, 13 bp, D. melanogaster
atgcgaaaattga

SEQ ID NO: 587980 - DNA, 13 bp, D. melanogaster
atgcgaaaattgg

SEQ ID NO: 587981 - DNA, 13 bp, D. melanogaster
atgcgaaaattta

SEQ ID NO: 587982 - DNA, 13 bp, D. melanogaster
atgcgaaagcgaa

SEQ ID NO: 587983 - DNA, 13 bp, D. melanogaster
atgcgaaataaaa

SEQ ID NO: 587984 - DNA, 13 bp, D. melanogaster
atgcgaaataaat

SEQ ID NO: 587985 - DNA, 13 bp, D. melanogaster
atgcgaaatacaa

SEQ ID NO: 587986 - DNA, 13 bp, D. melanogaster
atgcgaaatgaaa

SEQ ID NO: 587987 - DNA, 13 bp, D. melanogaster
atgcgaaatgagt

SEQ ID NO: 587988 - DNA, 13 bp, D. melanogaster
atgcgaaatgcca

SEQ ID NO: 587989 - DNA, 13 bp, D. melanogaster
atgcgaaatggca

SEQ ID NO: 587990 - DNA, 13 bp, D. melanogaster
atgcgaaatgtga

SEQ ID NO: 587991 - DNA, 13 bp, D. melanogaster
atgcgaaatgtgc

SEQ ID NO: 587992 - DNA, 13 bp, D. melanogaster
atgcgaaatgttt

SEQ ID NO: 587993 - DNA, 13 bp, D. melanogaster
atgcgaacgcaaa

SEQ ID NO: 587994 - DNA, 14 bp, D. melanogaster
atgcgaacgcaaaa

SEQ ID NO: 587995 - DNA, 13 bp, D. melanogaster
atgcgaacgcgaa

SEQ ID NO: 587996 - DNA, 13 bp, D. melanogaster
atgcgaataaata

SEQ ID NO: 587997 - DNA, 13 bp, D. melanogaster
atgcgaatatcac

SEQ ID NO: 587998 - DNA, 14 bp, D. melanogaster
atgcgaatatcacc

SEQ ID NO: 587999 - DNA, 13 bp, D. melanogaster
atgcgaatatttt

SEQ ID NO: 588000 - DNA, 13 bp, D. melanogaster
atgcgaatgcaaa

SEQ ID NO: 588001 - DNA, 13 bp, D. melanogaster
atgcgaatgccaa

SEQ ID NO: 588002 - DNA, 13 bp, D. melanogaster
atgcgaatgcgat

SEQ ID NO: 588003 - DNA, 13 bp, D. melanogaster
atgcgaatggaaa

SEQ ID NO: 588004 - DNA, 13 bp, D. melanogaster
atgcgaatgggaa

SEQ ID NO: 588005 - DNA, 13 bp, D. melanogaster
atgcgaattcagc

SEQ ID NO: 588006 - DNA, 14 bp, D. melanogaster
atgcgaattcagca

SEQ ID NO: 588007 - DNA, 13 bp, D. melanogaster
atgcgaatttttt

SEQ ID NO: 588008 - DNA, 13 bp, D. melanogaster
atgcgactggcaa

SEQ ID NO: 588009 - DNA, 13 bp, D. melanogaster
atgcgagaaaaaa

SEQ ID NO: 588010 - DNA, 13 bp, D. melanogaster
atgcgagacaagg

SEQ ID NO: 588011 - DNA, 13 bp, D. melanogaster
atgcgagtgcgag

SEQ ID NO: 588012 - DNA, 13 bp, D. melanogaster
atgcgagtgtgtg

SEQ ID NO: 588013 - DNA, 14 bp, D. melanogaster
atgcgagtgtgtgt

SEQ ID NO: 588014 - DNA, 14 bp, D. melanogaster
atgcgagttaattt

SEQ ID NO: 588015 - DNA, 13 bp, D. melanogaster
atgcgatgtgatg

SEQ ID NO: 588016 - DNA, 13 bp, D. melanogaster
atgcgattgttgt

SEQ ID NO: 588017 - DNA, 13 bp, D. melanogaster
atgcgatttattt

SEQ ID NO: 588018 - DNA, 13 bp, D. melanogaster
atgcgattttttt

SEQ ID NO: 588019 - DNA, 13 bp, D. melanogaster
atgcgcaaatatt

SEQ ID NO: 588020 - DNA, 13 bp, D. melanogaster
atgcgcaatattt

SEQ ID NO: 588021 - DNA, 13 bp, D. melanogaster
atgcgcaatgtgc

SEQ ID NO: 588022 - DNA, 13 bp, D. melanogaster
atgcgcacacaca

SEQ ID NO: 588023 - DNA, 13 bp, D. melanogaster
atgcgcagatact

SEQ ID NO: 588024 - DNA, 13 bp, D. melanogaster
atgcgcatatatg

SEQ ID NO: 588025 - DNA, 13 bp, D. melanogaster
atgcgcggtattt

SEQ ID NO: 588026 - DNA, 13 bp, D. melanogaster
atgcgcgtgtgtg

SEQ ID NO: 588027 - DNA, 13 bp, D. melanogaster
atgcgcttaattt

SEQ ID NO: 588028 - DNA, 13 bp, D. melanogaster
atgcgcttcacac

SEQ ID NO: 588029 - DNA, 13 bp, D. melanogaster
atgcggaaaaggg

SEQ ID NO: 588030 - DNA, 13 bp, D. melanogaster
atgcggaaatatt

SEQ ID NO: 588031 - DNA, 13 bp, D. melanogaster
atgcggacaataa

SEQ ID NO: 588032 - DNA, 13 bp, D. melanogaster
atgcggagtggcg

SEQ ID NO: 588033 - DNA, 13 bp, D. melanogaster
atgcggatacgga

SEQ ID NO: 588034 - DNA, 14 bp, D. melanogaster
atgcggatacggat

SEQ ID NO: 588035 - DNA, 13 bp, D. melanogaster
atgcggatgagga

SEQ ID NO: 588036 - DNA, 13 bp, D. melanogaster
atgcggcagcgag

SEQ ID NO: 588037 - DNA, 13 bp, D. melanogaster
atgcggctgcgga

SEQ ID NO: 588038 - DNA, 13 bp, D. melanogaster
atgcgggctgcag

SEQ ID NO: 588039 - DNA, 14 bp, D. melanogaster
atgcggttgactgt

SEQ ID NO: 588040 - DNA, 13 bp, D. melanogaster
atgcgtaacgatc

SEQ ID NO: 588041 - DNA, 13 bp, D. melanogaster
atgcgtaatattt

SEQ ID NO: 588042 - DNA, 13 bp, D. melanogaster
atgcgtaatcaaa

SEQ ID NO: 588043 - DNA, 14 bp, D. melanogaster
atgcgtaatcaaaa

SEQ ID NO: 588044 - DNA, 13 bp, D. melanogaster
atgcgtaatttat

SEQ ID NO: 588045 - DNA, 13 bp, D. melanogaster
atgcgtataaaaa

SEQ ID NO: 588046 - DNA, 13 bp, D. melanogaster
atgcgtatgtcaa

SEQ ID NO: 588047 - DNA, 13 bp, D. melanogaster
atgcgtgtgtgcg

SEQ ID NO: 588048 - DNA, 13 bp, D. melanogaster
atgcgtgtgtgta

SEQ ID NO: 588049 - DNA, 14 bp, D. melanogaster
atgcgtgtgtgtgt

SEQ ID NO: 588050 - DNA, 13 bp, D. melanogaster
atgcgtgtgtgtt

SEQ ID NO: 588051 - DNA, 13 bp, D. melanogaster
atgcgttgaattt

SEQ ID NO: 588052 - DNA, 14 bp, D. melanogaster
atgcgttggccatg

SEQ ID NO: 588053 - DNA, 13 bp, D. melanogaster
atgcgttttcaaa

SEQ ID NO: 588054 - DNA, 13 bp, D. melanogaster
atgctaaaaattt

SEQ ID NO: 588055 - DNA, 13 bp, D. melanogaster
atgctaaataatg

SEQ ID NO: 588056 - DNA, 13 bp, D. melanogaster
atgctaaatatat

SEQ ID NO: 588057 - DNA, 13 bp, D. melanogaster
atgctaaatattt

SEQ ID NO: 588058 - DNA, 13 bp, D. melanogaster
atgctaaatgcaa

SEQ ID NO: 588059 - DNA, 13 bp, D. melanogaster
atgctaaatgcta

SEQ ID NO: 588060 - DNA, 13 bp, D. melanogaster
atgctaactcgcc

SEQ ID NO: 588061 - DNA, 13 bp, D. melanogaster
atgctaataataa

SEQ ID NO: 588062 - DNA, 13 bp, D. melanogaster
atgctaatatttt

SEQ ID NO: 588063 - DNA, 13 bp, D. melanogaster
atgctaatcccga

SEQ ID NO: 588064 - DNA, 13 bp, D. melanogaster
atgctaatgcaaa

SEQ ID NO: 588065 - DNA, 14 bp, D. melanogaster
atgctaatgctaat

SEQ ID NO: 588066 - DNA, 13 bp, D. melanogaster
atgctaatgttcc

SEQ ID NO: 588067 - DNA, 13 bp, D. melanogaster
atgctaattatgc

SEQ ID NO: 588068 - DNA, 13 bp, D. melanogaster
atgctaattgaac

SEQ ID NO: 588069 - DNA, 13 bp, D. melanogaster
atgctactgctgc

SEQ ID NO: 588070 - DNA, 13 bp, D. melanogaster
atgctagaacagg

SEQ ID NO: 588071 - DNA, 13 bp, D. melanogaster
atgctagcttata

SEQ ID NO: 588072 - DNA, 13 bp, D. melanogaster
atgctatatatgc

SEQ ID NO: 588073 - DNA, 13 bp, D. melanogaster
atgctatgcaaat

SEQ ID NO: 588074 - DNA, 13 bp, D. melanogaster
atgctatggaaat

SEQ ID NO: 588075 - DNA, 13 bp, D. melanogaster
atgctatgggaat

SEQ ID NO: 588076 - DNA, 13 bp, D. melanogaster
atgctattaaaaa

SEQ ID NO: 588077 - DNA, 13 bp, D. melanogaster
atgctatttattc

SEQ ID NO: 588078 - DNA, 13 bp, D. melanogaster
atgctatttattt

SEQ ID NO: 588079 - DNA, 13 bp, D. melanogaster
atgctattttatt

SEQ ID NO: 588080 - DNA, 13 bp, D. melanogaster
atgctcaacaaat

SEQ ID NO: 588081 - DNA, 13 bp, D. melanogaster
atgctcataagga

SEQ ID NO: 588082 - DNA, 13 bp, D. melanogaster
atgctcatccacc

SEQ ID NO: 588083 - DNA, 14 bp, D. melanogaster
atgctcatcgcctt

SEQ ID NO: 588084 - DNA, 13 bp, D. melanogaster
atgctcatttaat

SEQ ID NO: 588085 - DNA, 13 bp, D. melanogaster
atgctccaaccca

SEQ ID NO: 588086 - DNA, 13 bp, D. melanogaster
atgctcctgctgc

SEQ ID NO: 588087 - DNA, 13 bp, D. melanogaster
atgctcgatgctc

SEQ ID NO: 588088 - DNA, 13 bp, D. melanogaster
atgctcgccgatt

SEQ ID NO: 588089 - DNA, 13 bp, D. melanogaster
atgctcttttata

SEQ ID NO: 588090 - DNA, 13 bp, D. melanogaster
atgctcttttggc

SEQ ID NO: 588091 - DNA, 13 bp, D. melanogaster
atgctgaaatgct

SEQ ID NO: 588092 - DNA, 13 bp, D. melanogaster
atgctgaaattag

SEQ ID NO: 588093 - DNA, 13 bp, D. melanogaster
atgctgaaattat

SEQ ID NO: 588094 - DNA, 13 bp, D. melanogaster
atgctgaagaacg

SEQ ID NO: 588095 - DNA, 13 bp, D. melanogaster
atgctgaataatt

SEQ ID NO: 588096 - DNA, 13 bp, D. melanogaster
atgctgaatattt

SEQ ID NO: 588097 - DNA, 14 bp, D. melanogaster
atgctgaatctcaa

SEQ ID NO: 588098 - DNA, 13 bp, D. melanogaster
atgctgaatgaaa

SEQ ID NO: 588099 - DNA, 14 bp, D. melanogaster
atgctgaatgaaat

SEQ ID NO: 588100 - DNA, 13 bp, D. melanogaster
atgctgaatgctg

SEQ ID NO: 588101 - DNA, 13 bp, D. melanogaster
atgctgacattcc

SEQ ID NO: 588102 - DNA, 13 bp, D. melanogaster
atgctgatattgc

SEQ ID NO: 588103 - DNA, 13 bp, D. melanogaster
atgctgatgatgg

SEQ ID NO: 588104 - DNA, 13 bp, D. melanogaster
atgctgatgctgc

SEQ ID NO: 588105 - DNA, 13 bp, D. melanogaster
atgctgcatactt

SEQ ID NO: 588106 - DNA, 13 bp, D. melanogaster
atgctgcatattt

SEQ ID NO: 588107 - DNA, 13 bp, D. melanogaster
atgctgcatgctg

SEQ ID NO: 588108 - DNA, 13 bp, D. melanogaster
atgctgcatgttg

SEQ ID NO: 588109 - DNA, 13 bp, D. melanogaster
atgctgcatttaa

SEQ ID NO: 588110 - DNA, 13 bp, D. melanogaster
atgctgccacgcc

SEQ ID NO: 588111 - DNA, 13 bp, D. melanogaster
atgctgctcctgc

SEQ ID NO: 588112 - DNA, 13 bp, D. melanogaster
atgctgctgccac

SEQ ID NO: 588113 - DNA, 13 bp, D. melanogaster
atgctgctgccgt

SEQ ID NO: 588114 - DNA, 13 bp, D. melanogaster
atgctgctgctga

SEQ ID NO: 588115 - DNA, 13 bp, D. melanogaster
atgctgctgctgt

SEQ ID NO: 588116 - DNA, 14 bp, D. melanogaster
atgctgctgctgtt

SEQ ID NO: 588117 - DNA, 13 bp, D. melanogaster
atgctggcaattt

SEQ ID NO: 588118 - DNA, 13 bp, D. melanogaster
atgctggtaaaaa

SEQ ID NO: 588119 - DNA, 13 bp, D. melanogaster
atgctggtgctgg

SEQ ID NO: 588120 - DNA, 14 bp, D. melanogaster
atgctgtaaatgaa

SEQ ID NO: 588121 - DNA, 14 bp, D. melanogaster
atgctgttcaacaa

SEQ ID NO: 588122 - DNA, 13 bp, D. melanogaster
atgcttaaaaaat

SEQ ID NO: 588123 - DNA, 13 bp, D. melanogaster
atgcttaaaactc

SEQ ID NO: 588124 - DNA, 14 bp, D. melanogaster
atgcttaaattcaa

SEQ ID NO: 588125 - DNA, 13 bp, D. melanogaster
atgcttaacttaa

SEQ ID NO: 588126 - DNA, 13 bp, D. melanogaster
atgcttaattatt

SEQ ID NO: 588127 - DNA, 13 bp, D. melanogaster
atgcttaatttaa

SEQ ID NO: 588128 - DNA, 13 bp, D. melanogaster
atgcttatataaa

SEQ ID NO: 588129 - DNA, 13 bp, D. melanogaster
atgcttatatatg

SEQ ID NO: 588130 - DNA, 13 bp, D. melanogaster
atgcttattaaat

SEQ ID NO: 588131 - DNA, 13 bp, D. melanogaster
atgcttattttta

SEQ ID NO: 588132 - DNA, 13 bp, D. melanogaster
atgcttcagcaaa

SEQ ID NO: 588133 - DNA, 14 bp, D. melanogaster
atgcttctatttga

SEQ ID NO: 588134 - DNA, 13 bp, D. melanogaster
atgcttctggcgt

SEQ ID NO: 588135 - DNA, 13 bp, D. melanogaster
atgcttgaaaatt

SEQ ID NO: 588136 - DNA, 14 bp, D. melanogaster
atgcttggactacc

SEQ ID NO: 588137 - DNA, 13 bp, D. melanogaster
atgcttgtttgtt

SEQ ID NO: 588138 - DNA, 13 bp, D. melanogaster
atgctttaaaaaa

SEQ ID NO: 588139 - DNA, 13 bp, D. melanogaster
atgctttaaaaat

SEQ ID NO: 588140 - DNA, 13 bp, D. melanogaster
atgctttaaaata

SEQ ID NO: 588141 - DNA, 13 bp, D. melanogaster
atgctttaaatat

SEQ ID NO: 588142 - DNA, 13 bp, D. melanogaster
atgctttaaatta

SEQ ID NO: 588143 - DNA, 14 bp, D. melanogaster
atgctttaagctaa

SEQ ID NO: 588144 - DNA, 13 bp, D. melanogaster
atgctttaataaa

SEQ ID NO: 588145 - DNA, 13 bp, D. melanogaster
atgctttaatatt

SEQ ID NO: 588146 - DNA, 13 bp, D. melanogaster
atgctttctatct

SEQ ID NO: 588147 - DNA, 13 bp, D. melanogaster
atgctttgcattt

SEQ ID NO: 588148 - DNA, 13 bp, D. melanogaster
atgcttttaataa

SEQ ID NO: 588149 - DNA, 13 bp, D. melanogaster
atgcttttccttt

SEQ ID NO: 588150 - DNA, 13 bp, D. melanogaster
atgcttttgattt

SEQ ID NO: 588151 - DNA, 13 bp, D. melanogaster
atgctttttaata

SEQ ID NO: 588152 - DNA, 13 bp, D. melanogaster
atgctttttatat

SEQ ID NO: 588153 - DNA, 13 bp, D. melanogaster
atggaaaaaatgt

SEQ ID NO: 588154 - DNA, 13 bp, D. melanogaster
atggaaaaacttt

SEQ ID NO: 588155 - DNA, 14 bp, D. melanogaster
atggaaaaagtcga

SEQ ID NO: 588156 - DNA, 13 bp, D. melanogaster
atggaaaacaagg

SEQ ID NO: 588157 - DNA, 13 bp, D. melanogaster
atggaaaacaatg

SEQ ID NO: 588158 - DNA, 13 bp, D. melanogaster
atggaaaaccaaa

SEQ ID NO: 588159 - DNA, 13 bp, D. melanogaster
atggaaaacccaa

SEQ ID NO: 588160 - DNA, 13 bp, D. melanogaster
atggaaaacggaa

SEQ ID NO: 588161 - DNA, 13 bp, D. melanogaster
atggaaaacgttt

SEQ ID NO: 588162 - DNA, 13 bp, D. melanogaster
atggaaaactcat

SEQ ID NO: 588163 - DNA, 13 bp, D. melanogaster
atggaaaactgaa

SEQ ID NO: 588164 - DNA, 13 bp, D. melanogaster
atggaaaactttc

SEQ ID NO: 588165 - DNA, 13 bp, D. melanogaster
atggaaaactttg

SEQ ID NO: 588166 - DNA, 13 bp, D. melanogaster
atggaaaactttt

SEQ ID NO: 588167 - DNA, 13 bp, D. melanogaster
atggaaaagcatt

SEQ ID NO: 588168 - DNA, 13 bp, D. melanogaster
atggaaaagcttt

SEQ ID NO: 588169 - DNA, 13 bp, D. melanogaster
atggaaaagtatt

SEQ ID NO: 588170 - DNA, 13 bp, D. melanogaster
atggaaaagtgca

SEQ ID NO: 588171 - DNA, 13 bp, D. melanogaster
atggaaaagttgg

SEQ ID NO: 588172 - DNA, 13 bp, D. melanogaster
atggaaaagttta

SEQ ID NO: 588173 - DNA, 13 bp, D. melanogaster
atggaaaataatt

SEQ ID NO: 588174 - DNA, 14 bp, D. melanogaster
atggaaaataattt

SEQ ID NO: 588175 - DNA, 13 bp, D. melanogaster
atggaaaatactt

SEQ ID NO: 588176 - DNA, 13 bp, D. melanogaster
atggaaaatatct

SEQ ID NO: 588177 - DNA, 13 bp, D. melanogaster
atggaaaatatgc

SEQ ID NO: 588178 - DNA, 13 bp, D. melanogaster
atggaaaatattc

SEQ ID NO: 588179 - DNA, 13 bp, D. melanogaster
atggaaaatattg

SEQ ID NO: 588180 - DNA, 13 bp, D. melanogaster
atggaaaatattt

SEQ ID NO: 588181 - DNA, 14 bp, D. melanogaster
atggaaaatatttg

SEQ ID NO: 588182 - DNA, 14 bp, D. melanogaster
atggaaaatcaaat

SEQ ID NO: 588183 - DNA, 13 bp, D. melanogaster
atggaaaatcgaa

SEQ ID NO: 588184 - DNA, 14 bp, D. melanogaster
atggaaaatcgaaa

SEQ ID NO: 588185 - DNA, 13 bp, D. melanogaster
atggaaaatgcag

SEQ ID NO: 588186 - DNA, 13 bp, D. melanogaster
atggaaaatgctt

SEQ ID NO: 588187 - DNA, 13 bp, D. melanogaster
atggaaaatggtg

SEQ ID NO: 588188 - DNA, 13 bp, D. melanogaster
atggaaaatgtaa

SEQ ID NO: 588189 - DNA, 13 bp, D. melanogaster
atggaaaattctg

SEQ ID NO: 588190 - DNA, 13 bp, D. melanogaster
atggaaaatttaa

SEQ ID NO: 588191 - DNA, 13 bp, D. melanogaster
atggaaaatttat

SEQ ID NO: 588192 - DNA, 13 bp, D. melanogaster
atggaaacaattt

SEQ ID NO: 588193 - DNA, 13 bp, D. melanogaster
atggaaacagagg

SEQ ID NO: 588194 - DNA, 13 bp, D. melanogaster
atggaaacctgac

SEQ ID NO: 588195 - DNA, 13 bp, D. melanogaster
atggaaactcatt

SEQ ID NO: 588196 - DNA, 13 bp, D. melanogaster
atggaaagcaaaa

SEQ ID NO: 588197 - DNA, 13 bp, D. melanogaster
atggaaagtcaaa

SEQ ID NO: 588198 - DNA, 13 bp, D. melanogaster
atggaaagtggaa

SEQ ID NO: 588199 - DNA, 13 bp, D. melanogaster
atggaaagtgggc

SEQ ID NO: 588200 - DNA, 13 bp, D. melanogaster
atggaaagtgggt

SEQ ID NO: 588201 - DNA, 13 bp, D. melanogaster
atggaaagtttca

SEQ ID NO: 588202 - DNA, 13 bp, D. melanogaster
atggaaataaatt

SEQ ID NO: 588203 - DNA, 13 bp, D. melanogaster
atggaaataattg

SEQ ID NO: 588204 - DNA, 13 bp, D. melanogaster
atggaaatacttt

SEQ ID NO: 588205 - DNA, 14 bp, D. melanogaster
atggaaatagaaat

SEQ ID NO: 588206 - DNA, 13 bp, D. melanogaster
atggaaatatgta

SEQ ID NO: 588207 - DNA, 13 bp, D. melanogaster
atggaaatcaata

SEQ ID NO: 588208 - DNA, 13 bp, D. melanogaster
atggaaatcaatt

SEQ ID NO: 588209 - DNA, 13 bp, D. melanogaster
atggaaatcattt

SEQ ID NO: 588210 - DNA, 13 bp, D. melanogaster
atggaaatcgaaa

SEQ ID NO: 588211 - DNA, 13 bp, D. melanogaster
atggaaatcgaag

SEQ ID NO: 588212 - DNA, 13 bp, D. melanogaster
atggaaatcttaa

SEQ ID NO: 588213 - DNA, 13 bp, D. melanogaster
atggaaatctttg

SEQ ID NO: 588214 - DNA, 14 bp, D. melanogaster
atggaaatgaaaat

SEQ ID NO: 588215 - DNA, 13 bp, D. melanogaster
atggaaatgaaga

SEQ ID NO: 588216 - DNA, 13 bp, D. melanogaster
atggaaatgaatg

SEQ ID NO: 588217 - DNA, 13 bp, D. melanogaster
atggaaatgattt

SEQ ID NO: 588218 - DNA, 13 bp, D. melanogaster
atggaaatgcatt

SEQ ID NO: 588219 - DNA, 13 bp, D. melanogaster
atggaaatgcgaa

SEQ ID NO: 588220 - DNA, 13 bp, D. melanogaster
atggaaatggaaa

SEQ ID NO: 588221 - DNA, 13 bp, D. melanogaster
atggaaatggaag

SEQ ID NO: 588222 - DNA, 13 bp, D. melanogaster
atggaaatggaat

SEQ ID NO: 588223 - DNA, 14 bp, D. melanogaster
atggaaatggaatt

SEQ ID NO: 588224 - DNA, 13 bp, D. melanogaster
atggaaatggaca

SEQ ID NO: 588225 - DNA, 13 bp, D. melanogaster
atggaaatggaga

SEQ ID NO: 588226 - DNA, 13 bp, D. melanogaster
atggaaatggagg

SEQ ID NO: 588227 - DNA, 13 bp, D. melanogaster
atggaaatggatg

SEQ ID NO: 588228 - DNA, 13 bp, D. melanogaster
atggaaatggatt

SEQ ID NO: 588229 - DNA, 13 bp, D. melanogaster
atggaaatggcaa

SEQ ID NO: 588230 - DNA, 13 bp, D. melanogaster
atggaaatgggga

SEQ ID NO: 588231 - DNA, 13 bp, D. melanogaster
atggaaatgtaaa

SEQ ID NO: 588232 - DNA, 13 bp, D. melanogaster
atggaaatgtatt

SEQ ID NO: 588233 - DNA, 13 bp, D. melanogaster
atggaaatgtgaa

SEQ ID NO: 588234 - DNA, 13 bp, D. melanogaster
atggaaatgtgga

SEQ ID NO: 588235 - DNA, 13 bp, D. melanogaster
atggaaatgtttg

SEQ ID NO: 588236 - DNA, 13 bp, D. melanogaster
atggaaatgtttt

SEQ ID NO: 588237 - DNA, 13 bp, D. melanogaster
atggaaattaaac

SEQ ID NO: 588238 - DNA, 14 bp, D. melanogaster
atggaaattaattt

SEQ ID NO: 588239 - DNA, 13 bp, D. melanogaster
atggaaattgaat

SEQ ID NO: 588240 - DNA, 13 bp, D. melanogaster
atggaaattgtat

SEQ ID NO: 588241 - DNA, 13 bp, D. melanogaster
atggaaattgttg

SEQ ID NO: 588242 - DNA, 13 bp, D. melanogaster
atggaaattgttt

SEQ ID NO: 588243 - DNA, 13 bp, D. melanogaster
atggaaatttaaa

SEQ ID NO: 588244 - DNA, 13 bp, D. melanogaster
atggaaatttata

SEQ ID NO: 588245 - DNA, 13 bp, D. melanogaster
atggaaatttttg

SEQ ID NO: 588246 - DNA, 13 bp, D. melanogaster
atggaacatggaa

SEQ ID NO: 588247 - DNA, 13 bp, D. melanogaster
atggaaccatcga

SEQ ID NO: 588248 - DNA, 13 bp, D. melanogaster
atggaagatgaaa

SEQ ID NO: 588249 - DNA, 14 bp, D. melanogaster
atggaagatgatga

SEQ ID NO: 588250 - DNA, 13 bp, D. melanogaster
atggaataaaatg

SEQ ID NO: 588251 - DNA, 14 bp, D. melanogaster
atggaatatatttt

SEQ ID NO: 588252 - DNA, 13 bp, D. melanogaster
atggaatattttt

SEQ ID NO: 588253 - DNA, 13 bp, D. melanogaster
atggaatcaaacg

SEQ ID NO: 588254 - DNA, 14 bp, D. melanogaster
atggaatcaaacgc

SEQ ID NO: 588255 - DNA, 13 bp, D. melanogaster
atggaatccactt

SEQ ID NO: 588256 - DNA, 13 bp, D. melanogaster
atggaatcgaatc

SEQ ID NO: 588257 - DNA, 13 bp, D. melanogaster
atggaatgcaaat

SEQ ID NO: 588258 - DNA, 13 bp, D. melanogaster
atggaatggaaaa

SEQ ID NO: 588259 - DNA, 13 bp, D. melanogaster
atggaatggaaac

SEQ ID NO: 588260 - DNA, 13 bp, D. melanogaster
atggaatggaatc

SEQ ID NO: 588261 - DNA, 14 bp, D. melanogaster
atggaatggaatgg

SEQ ID NO: 588262 - DNA, 13 bp, D. melanogaster
atggaatggatat

SEQ ID NO: 588263 - DNA, 13 bp, D. melanogaster
atggaatggatgg

SEQ ID NO: 588264 - DNA, 13 bp, D. melanogaster
atggaatggattg

SEQ ID NO: 588265 - DNA, 13 bp, D. melanogaster
atggaatggcatg

SEQ ID NO: 588266 - DNA, 13 bp, D. melanogaster
atggaatgggtgg

SEQ ID NO: 588267 - DNA, 13 bp, D. melanogaster
atggaatggtatg

SEQ ID NO: 588268 - DNA, 13 bp, D. melanogaster
atggaatgtaaat

SEQ ID NO: 588269 - DNA, 13 bp, D. melanogaster
atggaatgtcata

SEQ ID NO: 588270 - DNA, 13 bp, D. melanogaster
atggaattcttga

SEQ ID NO: 588271 - DNA, 13 bp, D. melanogaster
atggaattcttta

SEQ ID NO: 588272 - DNA, 14 bp, D. melanogaster
atggaattctttaa

SEQ ID NO: 588273 - DNA, 13 bp, D. melanogaster
atggaattgaaaa

SEQ ID NO: 588274 - DNA, 13 bp, D. melanogaster
atggaattgaatt

SEQ ID NO: 588275 - DNA, 13 bp, D. melanogaster
atggaattgcatt

SEQ ID NO: 588276 - DNA, 13 bp, D. melanogaster
atggaatttattt

SEQ ID NO: 588277 - DNA, 13 bp, D. melanogaster
atggaatttcaat

SEQ ID NO: 588278 - DNA, 13 bp, D. melanogaster
atggaatttcatt

SEQ ID NO: 588279 - DNA, 13 bp, D. melanogaster
atggaatttgatt

SEQ ID NO: 588280 - DNA, 14 bp, D. melanogaster
atggaattttaatt

SEQ ID NO: 588281 - DNA, 13 bp, D. melanogaster
atggacaaatgga

SEQ ID NO: 588282 - DNA, 13 bp, D. melanogaster
atggacaacaaat

SEQ ID NO: 588283 - DNA, 13 bp, D. melanogaster
atggacaaggcta

SEQ ID NO: 588284 - DNA, 13 bp, D. melanogaster
atggacaataatt

SEQ ID NO: 588285 - DNA, 13 bp, D. melanogaster
atggacatggaaa

SEQ ID NO: 588286 - DNA, 13 bp, D. melanogaster
atggaccacgccc

SEQ ID NO: 588287 - DNA, 14 bp, D. melanogaster
atggaccacgccca

SEQ ID NO: 588288 - DNA, 13 bp, D. melanogaster
atggacgatggac

SEQ ID NO: 588289 - DNA, 13 bp, D. melanogaster
atggacggacgga

SEQ ID NO: 588290 - DNA, 13 bp, D. melanogaster
atggactatctgt

SEQ ID NO: 588291 - DNA, 13 bp, D. melanogaster
atggactattata

SEQ ID NO: 588292 - DNA, 14 bp, D. melanogaster
atggactcaatggg

SEQ ID NO: 588293 - DNA, 13 bp, D. melanogaster
atggactcgggaa

SEQ ID NO: 588294 - DNA, 13 bp, D. melanogaster
atggactgggaaa

SEQ ID NO: 588295 - DNA, 14 bp, D. melanogaster
atggactgggaaaa

SEQ ID NO: 588296 - DNA, 14 bp, D. melanogaster
atggactttcaagt

SEQ ID NO: 588297 - DNA, 13 bp, D. melanogaster
atggagaaaaccc

SEQ ID NO: 588298 - DNA, 14 bp, D. melanogaster
atggagaaaatggg

SEQ ID NO: 588299 - DNA, 13 bp, D. melanogaster
atggagaaattct

SEQ ID NO: 588300 - DNA, 13 bp, D. melanogaster
atggagaacggag

SEQ ID NO: 588301 - DNA, 13 bp, D. melanogaster
atggagaagaagt

SEQ ID NO: 588302 - DNA, 13 bp, D. melanogaster
atggagatctatg

SEQ ID NO: 588303 - DNA, 13 bp, D. melanogaster
atggagatgatga

SEQ ID NO: 588304 - DNA, 13 bp, D. melanogaster
atggagatgcaga

SEQ ID NO: 588305 - DNA, 13 bp, D. melanogaster
atggagatggaaa

SEQ ID NO: 588306 - DNA, 14 bp, D. melanogaster
atggagatggagat

SEQ ID NO: 588307 - DNA, 13 bp, D. melanogaster
atggagatggagg

SEQ ID NO: 588308 - DNA, 13 bp, D. melanogaster
atggagatggagt

SEQ ID NO: 588309 - DNA, 13 bp, D. melanogaster
atggagatggtga

SEQ ID NO: 588310 - DNA, 13 bp, D. melanogaster
atggaggagcagc

SEQ ID NO: 588311 - DNA, 13 bp, D. melanogaster
atggaggaggtgc

SEQ ID NO: 588312 - DNA, 13 bp, D. melanogaster
atggaggctttga

SEQ ID NO: 588313 - DNA, 13 bp, D. melanogaster
atggagtggagtg

SEQ ID NO: 588314 - DNA, 13 bp, D. melanogaster
atggagttggagt

SEQ ID NO: 588315 - DNA, 13 bp, D. melanogaster
atggagttttatt

SEQ ID NO: 588316 - DNA, 13 bp, D. melanogaster
atggataaagtga

SEQ ID NO: 588317 - DNA, 13 bp, D. melanogaster
atggataaatgga

SEQ ID NO: 588318 - DNA, 13 bp, D. melanogaster
atggataatggat

SEQ ID NO: 588319 - DNA, 14 bp, D. melanogaster
atggataattcctg

SEQ ID NO: 588320 - DNA, 13 bp, D. melanogaster
atggatacaatat

SEQ ID NO: 588321 - DNA, 13 bp, D. melanogaster
atggatacggata

SEQ ID NO: 588322 - DNA, 14 bp, D. melanogaster
atggatatacatat

SEQ ID NO: 588323 - DNA, 13 bp, D. melanogaster
atggatatatttt

SEQ ID NO: 588324 - DNA, 13 bp, D. melanogaster
atggatatggaaa

SEQ ID NO: 588325 - DNA, 14 bp, D. melanogaster
atggatatggaaat

SEQ ID NO: 588326 - DNA, 14 bp, D. melanogaster
atggatatggatat

SEQ ID NO: 588327 - DNA, 13 bp, D. melanogaster
atggatatggatt

SEQ ID NO: 588328 - DNA, 13 bp, D. melanogaster
atggatatggcca

SEQ ID NO: 588329 - DNA, 13 bp, D. melanogaster
atggatatggtta

SEQ ID NO: 588330 - DNA, 17 bp, D. melanogaster
atggatatggttaagtt

SEQ ID NO: 588331 - DNA, 13 bp, D. melanogaster
atggatatgtgtg

SEQ ID NO: 588332 - DNA, 13 bp, D. melanogaster
atggatatttaaa

SEQ ID NO: 588333 - DNA, 13 bp, D. melanogaster
atggatatttata

SEQ ID NO: 588334 - DNA, 13 bp, D. melanogaster
atggatcaacaaa

SEQ ID NO: 588335 - DNA, 13 bp, D. melanogaster
atggatcagacaa

SEQ ID NO: 588336 - DNA, 13 bp, D. melanogaster
atggatccatgga

SEQ ID NO: 588337 - DNA, 13 bp, D. melanogaster
atggatcttttgc

SEQ ID NO: 588338 - DNA, 14 bp, D. melanogaster
atggatgaagatga

SEQ ID NO: 588339 - DNA, 13 bp, D. melanogaster
atggatgaatgga

SEQ ID NO: 588340 - DNA, 14 bp, D. melanogaster
atggatgaatggat

SEQ ID NO: 588341 - DNA, 13 bp, D. melanogaster
atggatgacttaa

SEQ ID NO: 588342 - DNA, 13 bp, D. melanogaster
atggatgccaacg

SEQ ID NO: 588343 - DNA, 14 bp, D. melanogaster
atggatgccaacga

SEQ ID NO: 588344 - DNA, 13 bp, D. melanogaster
atggatgcctgct

SEQ ID NO: 588345 - DNA, 13 bp, D. melanogaster
atggatggaaatg

SEQ ID NO: 588346 - DNA, 13 bp, D. melanogaster
atggatggatatg

SEQ ID NO: 588347 - DNA, 14 bp, D. melanogaster
atggatggatggat

SEQ ID NO: 588348 - DNA, 13 bp, D. melanogaster
atggatggatggt

SEQ ID NO: 588349 - DNA, 14 bp, D. melanogaster
atggatggatggtc

SEQ ID NO: 588350 - DNA, 13 bp, D. melanogaster
atggatggatgta

SEQ ID NO: 588351 - DNA, 13 bp, D. melanogaster
atggatggatgtg

SEQ ID NO: 588352 - DNA, 13 bp, D. melanogaster
atggatgtacata

SEQ ID NO: 588353 - DNA, 13 bp, D. melanogaster
atggatgtggatg

SEQ ID NO: 588354 - DNA, 14 bp, D. melanogaster
atggattcaatgac

SEQ ID NO: 588355 - DNA, 13 bp, D. melanogaster
atggattgcaatg

SEQ ID NO: 588356 - DNA, 13 bp, D. melanogaster
atggattggatgg

SEQ ID NO: 588357 - DNA, 13 bp, D. melanogaster
atggatttatcta

SEQ ID NO: 588358 - DNA, 13 bp, D. melanogaster
atggatttcaaat

SEQ ID NO: 588359 - DNA, 13 bp, D. melanogaster
atggatttgaagt

SEQ ID NO: 588360 - DNA, 13 bp, D. melanogaster
atggattttaatt

SEQ ID NO: 588361 - DNA, 13 bp, D. melanogaster
atggattttataa

SEQ ID NO: 588362 - DNA, 13 bp, D. melanogaster
atggatttttaat

SEQ ID NO: 588363 - DNA, 13 bp, D. melanogaster
atggatttttatg

SEQ ID NO: 588364 - DNA, 14 bp, D. melanogaster
atggcaaaaaaatt

SEQ ID NO: 588365 - DNA, 13 bp, D. melanogaster
atggcaaaaaata

SEQ ID NO: 588366 - DNA, 13 bp, D. melanogaster
atggcaaaaacaa

SEQ ID NO: 588367 - DNA, 13 bp, D. melanogaster
atggcaaaaacat

SEQ ID NO: 588368 - DNA, 13 bp, D. melanogaster
atggcaaaaactt

SEQ ID NO: 588369 - DNA, 14 bp, D. melanogaster
atggcaaaaagaaa

SEQ ID NO: 588370 - DNA, 13 bp, D. melanogaster
atggcaaaaagca

SEQ ID NO: 588371 - DNA, 13 bp, D. melanogaster
atggcaaaaaggg

SEQ ID NO: 588372 - DNA, 13 bp, D. melanogaster
atggcaaaaagtt

SEQ ID NO: 588373 - DNA, 13 bp, D. melanogaster
atggcaaaaattg

SEQ ID NO: 588374 - DNA, 14 bp, D. melanogaster
atggcaaaacaaaa

SEQ ID NO: 588375 - DNA, 13 bp, D. melanogaster
atggcaaaaccaa

SEQ ID NO: 588376 - DNA, 13 bp, D. melanogaster
atggcaaaagcaa

SEQ ID NO: 588377 - DNA, 13 bp, D. melanogaster
atggcaaaagttg

SEQ ID NO: 588378 - DNA, 13 bp, D. melanogaster
atggcaaaatgga

SEQ ID NO: 588379 - DNA, 13 bp, D. melanogaster
atggcaaaatggc

SEQ ID NO: 588380 - DNA, 13 bp, D. melanogaster
atggcaaaatgtg

SEQ ID NO: 588381 - DNA, 13 bp, D. melanogaster
atggcaaacaaaa

SEQ ID NO: 588382 - DNA, 13 bp, D. melanogaster
atggcaaacaaat

SEQ ID NO: 588383 - DNA, 13 bp, D. melanogaster
atggcaaacaatt

SEQ ID NO: 588384 - DNA, 13 bp, D. melanogaster
atggcaaacagaa

SEQ ID NO: 588385 - DNA, 13 bp, D. melanogaster
atggcaaacagca

SEQ ID NO: 588386 - DNA, 13 bp, D. melanogaster
atggcaaacattt

SEQ ID NO: 588387 - DNA, 13 bp, D. melanogaster
atggcaaacggaa

SEQ ID NO: 588388 - DNA, 14 bp, D. melanogaster
atggcaaacgtcgc

SEQ ID NO: 588389 - DNA, 13 bp, D. melanogaster
atggcaaactttt

SEQ ID NO: 588390 - DNA, 13 bp, D. melanogaster
atggcaaagaaaa

SEQ ID NO: 588391 - DNA, 13 bp, D. melanogaster
atggcaaagcaaa

SEQ ID NO: 588392 - DNA, 13 bp, D. melanogaster
atggcaaagccaa

SEQ ID NO: 588393 - DNA, 13 bp, D. melanogaster
atggcaaagtaaa

SEQ ID NO: 588394 - DNA, 13 bp, D. melanogaster
atggcaaataaaa

SEQ ID NO: 588395 - DNA, 13 bp, D. melanogaster
atggcaaataata

SEQ ID NO: 588396 - DNA, 13 bp, D. melanogaster
atggcaaataatt

SEQ ID NO: 588397 - DNA, 13 bp, D. melanogaster
atggcaaatatat

SEQ ID NO: 588398 - DNA, 14 bp, D. melanogaster
atggcaaatggcaa

SEQ ID NO: 588399 - DNA, 13 bp, D. melanogaster
atggcaaatggcg

SEQ ID NO: 588400 - DNA, 14 bp, D. melanogaster
atggcaaatggcga

SEQ ID NO: 588401 - DNA, 13 bp, D. melanogaster
atggcaaatggga

SEQ ID NO: 588402 - DNA, 13 bp, D. melanogaster
atggcaaatggta

SEQ ID NO: 588403 - DNA, 13 bp, D. melanogaster
atggcaaattatg

SEQ ID NO: 588404 - DNA, 13 bp, D. melanogaster
atggcaaattgca

SEQ ID NO: 588405 - DNA, 13 bp, D. melanogaster
atggcaacaaata

SEQ ID NO: 588406 - DNA, 13 bp, D. melanogaster
atggcaacaaatg

SEQ ID NO: 588407 - DNA, 13 bp, D. melanogaster
atggcaacaattt

SEQ ID NO: 588408 - DNA, 13 bp, D. melanogaster
atggcaacagcaa

SEQ ID NO: 588409 - DNA, 14 bp, D. melanogaster
atggcaacagcaac

SEQ ID NO: 588410 - DNA, 13 bp, D. melanogaster
atggcaacgaaaa

SEQ ID NO: 588411 - DNA, 13 bp, D. melanogaster
atggcaactggca

SEQ ID NO: 588412 - DNA, 13 bp, D. melanogaster
atggcaagaatgc

SEQ ID NO: 588413 - DNA, 13 bp, D. melanogaster
atggcaagcaaat

SEQ ID NO: 588414 - DNA, 13 bp, D. melanogaster
atggcaaggcaaa

SEQ ID NO: 588415 - DNA, 13 bp, D. melanogaster
atggcaataaatt

SEQ ID NO: 588416 - DNA, 13 bp, D. melanogaster
atggcaatatatt

SEQ ID NO: 588417 - DNA, 13 bp, D. melanogaster
atggcaatcaatt

SEQ ID NO: 588418 - DNA, 13 bp, D. melanogaster
atggcaatgcaaa

SEQ ID NO: 588419 - DNA, 13 bp, D. melanogaster
atggcaatgcaat

SEQ ID NO: 588420 - DNA, 13 bp, D. melanogaster
atggcaatgccaa

SEQ ID NO: 588421 - DNA, 13 bp, D. melanogaster
atggcaatggaat

SEQ ID NO: 588422 - DNA, 13 bp, D. melanogaster
atggcaatggcaa

SEQ ID NO: 588423 - DNA, 14 bp, D. melanogaster
atggcaatggcaaa

SEQ ID NO: 588424 - DNA, 13 bp, D. melanogaster
atggcaatggcga

SEQ ID NO: 588425 - DNA, 13 bp, D. melanogaster
atggcaattaaaa

SEQ ID NO: 588426 - DNA, 13 bp, D. melanogaster
atggcaattattt

SEQ ID NO: 588427 - DNA, 13 bp, D. melanogaster
atggcaatttgct

SEQ ID NO: 588428 - DNA, 13 bp, D. melanogaster
atggcaattttaa

SEQ ID NO: 588429 - DNA, 13 bp, D. melanogaster
atggcacacaagt

SEQ ID NO: 588430 - DNA, 13 bp, D. melanogaster
atggcacacattt

SEQ ID NO: 588431 - DNA, 13 bp, D. melanogaster
atggcacatatgc

SEQ ID NO: 588432 - DNA, 13 bp, D. melanogaster
atggcacatggca

SEQ ID NO: 588433 - DNA, 14 bp, D. melanogaster
atggcagaagcggc

SEQ ID NO: 588434 - DNA, 13 bp, D. melanogaster
atggcagcaaaaa

SEQ ID NO: 588435 - DNA, 13 bp, D. melanogaster
atggcagcaaatg

SEQ ID NO: 588436 - DNA, 13 bp, D. melanogaster
atggcagcagaaa

SEQ ID NO: 588437 - DNA, 13 bp, D. melanogaster
atggcagcagcca

SEQ ID NO: 588438 - DNA, 13 bp, D. melanogaster
atggcagccaaaa

SEQ ID NO: 588439 - DNA, 13 bp, D. melanogaster
atggcagccgcaa

SEQ ID NO: 588440 - DNA, 13 bp, D. melanogaster
atggcagcggaaa

SEQ ID NO: 588441 - DNA, 13 bp, D. melanogaster
atggcagcggaga

SEQ ID NO: 588442 - DNA, 13 bp, D. melanogaster
atggcagcggcag

SEQ ID NO: 588443 - DNA, 13 bp, D. melanogaster
atggcaggcaaat

SEQ ID NO: 588444 - DNA, 13 bp, D. melanogaster
atggcagggaaaa

SEQ ID NO: 588445 - DNA, 13 bp, D. melanogaster
atggcagtgtgcg

SEQ ID NO: 588446 - DNA, 13 bp, D. melanogaster
atggcataaaaaa

SEQ ID NO: 588447 - DNA, 13 bp, D. melanogaster
atggcataaaata

SEQ ID NO: 588448 - DNA, 13 bp, D. melanogaster
atggcatacagta

SEQ ID NO: 588449 - DNA, 14 bp, D. melanogaster
atggcatagaaatt

SEQ ID NO: 588450 - DNA, 13 bp, D. melanogaster
atggcatataaat

SEQ ID NO: 588451 - DNA, 13 bp, D. melanogaster
atggcatatatat

SEQ ID NO: 588452 - DNA, 13 bp, D. melanogaster
atggcatatggca

SEQ ID NO: 588453 - DNA, 14 bp, D. melanogaster
atggcatatggcat

SEQ ID NO: 588454 - DNA, 13 bp, D. melanogaster
atggcatatttat

SEQ ID NO: 588455 - DNA, 13 bp, D. melanogaster
atggcatcttttt

SEQ ID NO: 588456 - DNA, 13 bp, D. melanogaster
atggcatgagagg

SEQ ID NO: 588457 - DNA, 13 bp, D. melanogaster
atggcatggaaat

SEQ ID NO: 588458 - DNA, 13 bp, D. melanogaster
atggcatggaatg

SEQ ID NO: 588459 - DNA, 13 bp, D. melanogaster
atggcatggcatg

SEQ ID NO: 588460 - DNA, 13 bp, D. melanogaster
atggcattaaggc

SEQ ID NO: 588461 - DNA, 13 bp, D. melanogaster
atggcattatata

SEQ ID NO: 588462 - DNA, 13 bp, D. melanogaster
atggcattattaa

SEQ ID NO: 588463 - DNA, 14 bp, D. melanogaster
atggcattccacat

SEQ ID NO: 588464 - DNA, 13 bp, D. melanogaster
atggcattgaaat

SEQ ID NO: 588465 - DNA, 13 bp, D. melanogaster
atggcattgaatt

SEQ ID NO: 588466 - DNA, 13 bp, D. melanogaster
atggcattgcatt

SEQ ID NO: 588467 - DNA, 13 bp, D. melanogaster
atggcattggcaa

SEQ ID NO: 588468 - DNA, 13 bp, D. melanogaster
atggcatttcaaa

SEQ ID NO: 588469 - DNA, 13 bp, D. melanogaster
atggcatttcaat

SEQ ID NO: 588470 - DNA, 13 bp, D. melanogaster
atggcattttcat

SEQ ID NO: 588471 - DNA, 13 bp, D. melanogaster
atggcattttcca

SEQ ID NO: 588472 - DNA, 13 bp, D. melanogaster
atggcatttttgt

SEQ ID NO: 588473 - DNA, 14 bp, D. melanogaster
atggccaaaaaaaa

SEQ ID NO: 588474 - DNA, 13 bp, D. melanogaster
atggccaaaaaat

SEQ ID NO: 588475 - DNA, 13 bp, D. melanogaster
atggccaaaaata

SEQ ID NO: 588476 - DNA, 13 bp, D. melanogaster
atggccaaaagag

SEQ ID NO: 588477 - DNA, 14 bp, D. melanogaster
atggccaaaagcaa

SEQ ID NO: 588478 - DNA, 14 bp, D. melanogaster
atggccaaaagcca

SEQ ID NO: 588479 - DNA, 13 bp, D. melanogaster
atggccaaaaggg

SEQ ID NO: 588480 - DNA, 13 bp, D. melanogaster
atggccaaaagtc

SEQ ID NO: 588481 - DNA, 13 bp, D. melanogaster
atggccaaaatgt

SEQ ID NO: 588482 - DNA, 13 bp, D. melanogaster
atggccaaacatt

SEQ ID NO: 588483 - DNA, 13 bp, D. melanogaster
atggccaaagcaa

SEQ ID NO: 588484 - DNA, 13 bp, D. melanogaster
atggccaaagttt

SEQ ID NO: 588485 - DNA, 13 bp, D. melanogaster
atggccaaatgcc

SEQ ID NO: 588486 - DNA, 13 bp, D. melanogaster
atggccaaattga

SEQ ID NO: 588487 - DNA, 13 bp, D. melanogaster
atggccaacaaaa

SEQ ID NO: 588488 - DNA, 13 bp, D. melanogaster
atggccaacaaat

SEQ ID NO: 588489 - DNA, 13 bp, D. melanogaster
atggccaacaatt

SEQ ID NO: 588490 - DNA, 13 bp, D. melanogaster
atggccaacagaa

SEQ ID NO: 588491 - DNA, 13 bp, D. melanogaster
atggccaacagag

SEQ ID NO: 588492 - DNA, 13 bp, D. melanogaster
atggccaacagct

SEQ ID NO: 588493 - DNA, 13 bp, D. melanogaster
atggccaacgcat

SEQ ID NO: 588494 - DNA, 14 bp, D. melanogaster
atggccaacgcatt

SEQ ID NO: 588495 - DNA, 13 bp, D. melanogaster
atggccaactggg

SEQ ID NO: 588496 - DNA, 13 bp, D. melanogaster
atggccaacttca

SEQ ID NO: 588497 - DNA, 13 bp, D. melanogaster
atggccaagacaa

SEQ ID NO: 588498 - DNA, 13 bp, D. melanogaster
atggccaagatat

SEQ ID NO: 588499 - DNA, 13 bp, D. melanogaster
atggccaagtcaa

SEQ ID NO: 588500 - DNA, 13 bp, D. melanogaster
atggccaagtggc

SEQ ID NO: 588501 - DNA, 13 bp, D. melanogaster
atggccaataaaa

SEQ ID NO: 588502 - DNA, 13 bp, D. melanogaster
atggccaatgcca

SEQ ID NO: 588503 - DNA, 13 bp, D. melanogaster
atggccaatggaa

SEQ ID NO: 588504 - DNA, 14 bp, D. melanogaster
atggccaatggcca

SEQ ID NO: 588505 - DNA, 13 bp, D. melanogaster
atggccacaaaag

SEQ ID NO: 588506 - DNA, 13 bp, D. melanogaster
atggccacaaatg

SEQ ID NO: 588507 - DNA, 13 bp, D. melanogaster
atggccacaattt

SEQ ID NO: 588508 - DNA, 13 bp, D. melanogaster
atggccaccaaaa

SEQ ID NO: 588509 - DNA, 13 bp, D. melanogaster
atggccaccaaag

SEQ ID NO: 588510 - DNA, 14 bp, D. melanogaster
atggccaccaactc

SEQ ID NO: 588511 - DNA, 14 bp, D. melanogaster
atggccacgcccac

SEQ ID NO: 588512 - DNA, 14 bp, D. melanogaster
atggccacgccccc

SEQ ID NO: 588513 - DNA, 13 bp, D. melanogaster
atggccagaaaat

SEQ ID NO: 588514 - DNA, 13 bp, D. melanogaster
atggccagacaaa

SEQ ID NO: 588515 - DNA, 13 bp, D. melanogaster
atggccagcattt

SEQ ID NO: 588516 - DNA, 13 bp, D. melanogaster
atggccagccaaa

SEQ ID NO: 588517 - DNA, 13 bp, D. melanogaster
atggccagccagc

SEQ ID NO: 588518 - DNA, 13 bp, D. melanogaster
atggccagcggcc

SEQ ID NO: 588519 - DNA, 13 bp, D. melanogaster
atggccaggaatc

SEQ ID NO: 588520 - DNA, 13 bp, D. melanogaster
atggccaggacat

SEQ ID NO: 588521 - DNA, 14 bp, D. melanogaster
atggccagttcgac

SEQ ID NO: 588522 - DNA, 14 bp, D. melanogaster
atggccataaaaaa

SEQ ID NO: 588523 - DNA, 13 bp, D. melanogaster
atggccatataaa

SEQ ID NO: 588524 - DNA, 13 bp, D. melanogaster
atggccatcaaaa

SEQ ID NO: 588525 - DNA, 13 bp, D. melanogaster
atggccatcattt

SEQ ID NO: 588526 - DNA, 13 bp, D. melanogaster
atggccatggaaa

SEQ ID NO: 588527 - DNA, 14 bp, D. melanogaster
atggccatggccaa

SEQ ID NO: 588528 - DNA, 13 bp, D. melanogaster
atggccattaaaa

SEQ ID NO: 588529 - DNA, 13 bp, D. melanogaster
atggccattaaat

SEQ ID NO: 588530 - DNA, 13 bp, D. melanogaster
atggccattggcc

SEQ ID NO: 588531 - DNA, 13 bp, D. melanogaster
atggccatttcat

SEQ ID NO: 588532 - DNA, 13 bp, D. melanogaster
atggccatttcca

SEQ ID NO: 588533 - DNA, 13 bp, D. melanogaster
atggcccaaaaag

SEQ ID NO: 588534 - DNA, 13 bp, D. melanogaster
atggcccagttag

SEQ ID NO: 588535 - DNA, 13 bp, D. melanogaster
atggccctattac

SEQ ID NO: 588536 - DNA, 13 bp, D. melanogaster
atggccgaggaaa

SEQ ID NO: 588537 - DNA, 14 bp, D. melanogaster
atggcctttaagtt

SEQ ID NO: 588538 - DNA, 13 bp, D. melanogaster
atggcgaaaaaca

SEQ ID NO: 588539 - DNA, 13 bp, D. melanogaster
atggcgaatggag

SEQ ID NO: 588540 - DNA, 13 bp, D. melanogaster
atggcgaatggca

SEQ ID NO: 588541 - DNA, 13 bp, D. melanogaster
atggcgaatggcg

SEQ ID NO: 588542 - DNA, 13 bp, D. melanogaster
atggcgaccgtga

SEQ ID NO: 588543 - DNA, 14 bp, D. melanogaster
atggcgaccgtgac

SEQ ID NO: 588544 - DNA, 13 bp, D. melanogaster
atggcgacggcga

SEQ ID NO: 588545 - DNA, 13 bp, D. melanogaster
atggcgagtgagc

SEQ ID NO: 588546 - DNA, 13 bp, D. melanogaster
atggcgatgatgg

SEQ ID NO: 588547 - DNA, 14 bp, D. melanogaster
atggcgatgccggc

SEQ ID NO: 588548 - DNA, 14 bp, D. melanogaster
atggcgatggcaat

SEQ ID NO: 588549 - DNA, 13 bp, D. melanogaster
atggcgatggcta

SEQ ID NO: 588550 - DNA, 13 bp, D. melanogaster
atggcgattgttt

SEQ ID NO: 588551 - DNA, 13 bp, D. melanogaster
atggcgccatttg

SEQ ID NO: 588552 - DNA, 14 bp, D. melanogaster
atggcgccatttga

SEQ ID NO: 588553 - DNA, 13 bp, D. melanogaster
atggcgcgtgcca

SEQ ID NO: 588554 - DNA, 13 bp, D. melanogaster
atggcggcttaaa

SEQ ID NO: 588555 - DNA, 13 bp, D. melanogaster
atggcgggataaa

SEQ ID NO: 588556 - DNA, 13 bp, D. melanogaster
atggcggtgccac

SEQ ID NO: 588557 - DNA, 13 bp, D. melanogaster
atggcgtatgctt

SEQ ID NO: 588558 - DNA, 13 bp, D. melanogaster
atggctaaaaaac

SEQ ID NO: 588559 - DNA, 13 bp, D. melanogaster
atggctaaaatat

SEQ ID NO: 588560 - DNA, 13 bp, D. melanogaster
atggctaaataaa

SEQ ID NO: 588561 - DNA, 13 bp, D. melanogaster
atggctatgcagc

SEQ ID NO: 588562 - DNA, 13 bp, D. melanogaster
atggctcacagtt

SEQ ID NO: 588563 - DNA, 13 bp, D. melanogaster
atggctcatggct

SEQ ID NO: 588564 - DNA, 13 bp, D. melanogaster
atggctcccagta

SEQ ID NO: 588565 - DNA, 13 bp, D. melanogaster
atggctccgagct

SEQ ID NO: 588566 - DNA, 14 bp, D. melanogaster
atggctccgagctg

SEQ ID NO: 588567 - DNA, 13 bp, D. melanogaster
atggctgaaaatt

SEQ ID NO: 588568 - DNA, 13 bp, D. melanogaster
atggctgaaatgg

SEQ ID NO: 588569 - DNA, 13 bp, D. melanogaster
atggctgcaaaaa

SEQ ID NO: 588570 - DNA, 13 bp, D. melanogaster
atggctgcaaggc

SEQ ID NO: 588571 - DNA, 13 bp, D. melanogaster
atggctgcatttt

SEQ ID NO: 588572 - DNA, 13 bp, D. melanogaster
atggctgctgctg

SEQ ID NO: 588573 - DNA, 14 bp, D. melanogaster
atggctggatggat

SEQ ID NO: 588574 - DNA, 13 bp, D. melanogaster
atggctgtgaaaa

SEQ ID NO: 588575 - DNA, 13 bp, D. melanogaster
atggctgttcgga

SEQ ID NO: 588576 - DNA, 13 bp, D. melanogaster
atggcttaaattt

SEQ ID NO: 588577 - DNA, 13 bp, D. melanogaster
atggcttcaatat

SEQ ID NO: 588578 - DNA, 13 bp, D. melanogaster
atggcttccggaa

SEQ ID NO: 588579 - DNA, 13 bp, D. melanogaster
atggcttgccgac

SEQ ID NO: 588580 - DNA, 13 bp, D. melanogaster
atggctttaaaaa

SEQ ID NO: 588581 - DNA, 13 bp, D. melanogaster
atggctttcaaat

SEQ ID NO: 588582 - DNA, 14 bp, D. melanogaster
atggctttggtggc

SEQ ID NO: 588583 - DNA, 13 bp, D. melanogaster
atggctttgtttg

SEQ ID NO: 588584 - DNA, 13 bp, D. melanogaster
atggcttttcaat

SEQ ID NO: 588585 - DNA, 13 bp, D. melanogaster
atggctttttatt

SEQ ID NO: 588586 - DNA, 13 bp, D. melanogaster
atgggaaaaaaac

SEQ ID NO: 588587 - DNA, 13 bp, D. melanogaster
atgggaaaaaaca

SEQ ID NO: 588588 - DNA, 14 bp, D. melanogaster
atgggaaaaaacac

SEQ ID NO: 588589 - DNA, 13 bp, D. melanogaster
atgggaaaaaatc

SEQ ID NO: 588590 - DNA, 13 bp, D. melanogaster
atgggaaaagtgt

SEQ ID NO: 588591 - DNA, 13 bp, D. melanogaster
atgggaaaatgaa

SEQ ID NO: 588592 - DNA, 13 bp, D. melanogaster
atgggaaaattat

SEQ ID NO: 588593 - DNA, 13 bp, D. melanogaster
atgggaaacaaaa

SEQ ID NO: 588594 - DNA, 13 bp, D. melanogaster
atgggaaataaat

SEQ ID NO: 588595 - DNA, 13 bp, D. melanogaster
atgggaaatcaaa

SEQ ID NO: 588596 - DNA, 13 bp, D. melanogaster
atgggaaatgaaa

SEQ ID NO: 588597 - DNA, 13 bp, D. melanogaster
atgggaaatgcaa

SEQ ID NO: 588598 - DNA, 13 bp, D. melanogaster
atgggaaatggaa

SEQ ID NO: 588599 - DNA, 14 bp, D. melanogaster
atgggaaatggaaa

SEQ ID NO: 588600 - DNA, 13 bp, D. melanogaster
atgggaaattgaa

SEQ ID NO: 588601 - DNA, 13 bp, D. melanogaster
atgggaaatttaa

SEQ ID NO: 588602 - DNA, 13 bp, D. melanogaster
atgggaaatttgt

SEQ ID NO: 588603 - DNA, 13 bp, D. melanogaster
atgggaataggaa

SEQ ID NO: 588604 - DNA, 13 bp, D. melanogaster
atgggaatatttt

SEQ ID NO: 588605 - DNA, 13 bp, D. melanogaster
atgggaatgagga

SEQ ID NO: 588606 - DNA, 13 bp, D. melanogaster
atgggaatgctgg

SEQ ID NO: 588607 - DNA, 14 bp, D. melanogaster
atgggaatggcaat

SEQ ID NO: 588608 - DNA, 13 bp, D. melanogaster
atgggaatgggga

SEQ ID NO: 588609 - DNA, 14 bp, D. melanogaster
atgggaatggggat

SEQ ID NO: 588610 - DNA, 13 bp, D. melanogaster
atgggaatgtgga

SEQ ID NO: 588611 - DNA, 13 bp, D. melanogaster
atgggatatttaa

SEQ ID NO: 588612 - DNA, 14 bp, D. melanogaster
atgggatatttaag

SEQ ID NO: 588613 - DNA, 14 bp, D. melanogaster
atgggatcggatcg

SEQ ID NO: 588614 - DNA, 13 bp, D. melanogaster
atgggatgagatg

SEQ ID NO: 588615 - DNA, 13 bp, D. melanogaster
atgggatgcccag

SEQ ID NO: 588616 - DNA, 13 bp, D. melanogaster
atgggatgggatc

SEQ ID NO: 588617 - DNA, 13 bp, D. melanogaster
atgggatgggatg

SEQ ID NO: 588618 - DNA, 14 bp, D. melanogaster
atgggatgggatgg

SEQ ID NO: 588619 - DNA, 13 bp, D. melanogaster
atgggatgggatt

SEQ ID NO: 588620 - DNA, 13 bp, D. melanogaster
atgggattgggaa

SEQ ID NO: 588621 - DNA, 13 bp, D. melanogaster
atgggatttattt

SEQ ID NO: 588622 - DNA, 13 bp, D. melanogaster
atgggcaaaagat

SEQ ID NO: 588623 - DNA, 13 bp, D. melanogaster
atgggcaaacatt

SEQ ID NO: 588624 - DNA, 14 bp, D. melanogaster
atgggcaaacgaaa

SEQ ID NO: 588625 - DNA, 13 bp, D. melanogaster
atgggcaaacgat

SEQ ID NO: 588626 - DNA, 13 bp, D. melanogaster
atgggcaacggca

SEQ ID NO: 588627 - DNA, 13 bp, D. melanogaster
atgggcaatacca

SEQ ID NO: 588628 - DNA, 13 bp, D. melanogaster
atgggcaggaaaa

SEQ ID NO: 588629 - DNA, 13 bp, D. melanogaster
atgggcatgagtt

SEQ ID NO: 588630 - DNA, 13 bp, D. melanogaster
atgggcatgggga

SEQ ID NO: 588631 - DNA, 14 bp, D. melanogaster
atgggcatgggtat

SEQ ID NO: 588632 - DNA, 13 bp, D. melanogaster
atgggcatgtatt

SEQ ID NO: 588633 - DNA, 13 bp, D. melanogaster
atgggcatttaaa

SEQ ID NO: 588634 - DNA, 13 bp, D. melanogaster
atgggccaaaagc

SEQ ID NO: 588635 - DNA, 13 bp, D. melanogaster
atgggccacgccc

SEQ ID NO: 588636 - DNA, 13 bp, D. melanogaster
atgggcgacgtgg

SEQ ID NO: 588637 - DNA, 14 bp, D. melanogaster
atgggcgtggcaaa

SEQ ID NO: 588638 - DNA, 13 bp, D. melanogaster
atgggcgtggcag

SEQ ID NO: 588639 - DNA, 13 bp, D. melanogaster
atggggaaaaata

SEQ ID NO: 588640 - DNA, 13 bp, D. melanogaster
atggggaaaacaa

SEQ ID NO: 588641 - DNA, 13 bp, D. melanogaster
atggggaaataaa

SEQ ID NO: 588642 - DNA, 13 bp, D. melanogaster
atggggatggaga

SEQ ID NO: 588643 - DNA, 13 bp, D. melanogaster
atggggatggggc

SEQ ID NO: 588644 - DNA, 13 bp, D. melanogaster
atggggattggga

SEQ ID NO: 588645 - DNA, 14 bp, D. melanogaster
atgggggcgtggca

SEQ ID NO: 588646 - DNA, 13 bp, D. melanogaster
atggggggaaaat

SEQ ID NO: 588647 - DNA, 13 bp, D. melanogaster
atgggtagctgga

SEQ ID NO: 588648 - DNA, 14 bp, D. melanogaster
atgggtatggggat

SEQ ID NO: 588649 - DNA, 13 bp, D. melanogaster
atgggtatggtat

SEQ ID NO: 588650 - DNA, 13 bp, D. melanogaster
atgggtctttaat

SEQ ID NO: 588651 - DNA, 13 bp, D. melanogaster
atgggtgaatggg

SEQ ID NO: 588652 - DNA, 13 bp, D. melanogaster
atgggtgagtgga

SEQ ID NO: 588653 - DNA, 13 bp, D. melanogaster
atgggtggaaaaa

SEQ ID NO: 588654 - DNA, 13 bp, D. melanogaster
atgggtggaaaat

SEQ ID NO: 588655 - DNA, 13 bp, D. melanogaster
atgggtgtttcca

SEQ ID NO: 588656 - DNA, 13 bp, D. melanogaster
atgggttaaataa

SEQ ID NO: 588657 - DNA, 13 bp, D. melanogaster
atgggttaagggg

SEQ ID NO: 588658 - DNA, 13 bp, D. melanogaster
atgggttgtccaa

SEQ ID NO: 588659 - DNA, 13 bp, D. melanogaster
atgggtttaaaat

SEQ ID NO: 588660 - DNA, 13 bp, D. melanogaster
atgggtttccttt

SEQ ID NO: 588661 - DNA, 13 bp, D. melanogaster
atgggttttgaat

SEQ ID NO: 588662 - DNA, 13 bp, D. melanogaster
atggtaaaacaaa

SEQ ID NO: 588663 - DNA, 14 bp, D. melanogaster
atggtaaaacaaaa

SEQ ID NO: 588664 - DNA, 13 bp, D. melanogaster
atggtaaaataat

SEQ ID NO: 588665 - DNA, 13 bp, D. melanogaster
atggtaaagctca

SEQ ID NO: 588666 - DNA, 13 bp, D. melanogaster
atggtaaatggca

SEQ ID NO: 588667 - DNA, 13 bp, D. melanogaster
atggtaaccaaat

SEQ ID NO: 588668 - DNA, 13 bp, D. melanogaster
atggtaatcgcgt

SEQ ID NO: 588669 - DNA, 13 bp, D. melanogaster
atggtaatggtaa

SEQ ID NO: 588670 - DNA, 13 bp, D. melanogaster
atggtacaaaaac

SEQ ID NO: 588671 - DNA, 14 bp, D. melanogaster
atggtacaaaaaca

SEQ ID NO: 588672 - DNA, 13 bp, D. melanogaster
atggtatataaat

SEQ ID NO: 588673 - DNA, 13 bp, D. melanogaster
atggtatcaatta

SEQ ID NO: 588674 - DNA, 13 bp, D. melanogaster
atggtatctatca

SEQ ID NO: 588675 - DNA, 13 bp, D. melanogaster
atggtattataga

SEQ ID NO: 588676 - DNA, 13 bp, D. melanogaster
atggtattgaaaa

SEQ ID NO: 588677 - DNA, 14 bp, D. melanogaster
atggtattgctgca

SEQ ID NO: 588678 - DNA, 13 bp, D. melanogaster
atggtatttttaa

SEQ ID NO: 588679 - DNA, 14 bp, D. melanogaster
atggtcaagtcgag

SEQ ID NO: 588680 - DNA, 13 bp, D. melanogaster
atggtcagcgaaa

SEQ ID NO: 588681 - DNA, 13 bp, D. melanogaster
atggtcctaaata

SEQ ID NO: 588682 - DNA, 13 bp, D. melanogaster
atggtcgaaaaaa

SEQ ID NO: 588683 - DNA, 13 bp, D. melanogaster
atggtcgatggtc

SEQ ID NO: 588684 - DNA, 13 bp, D. melanogaster
atggtcggaaaag

SEQ ID NO: 588685 - DNA, 13 bp, D. melanogaster
atggtgacgatga

SEQ ID NO: 588686 - DNA, 14 bp, D. melanogaster
atggtgacgatgat

SEQ ID NO: 588687 - DNA, 13 bp, D. melanogaster
atggtgatgatgg

SEQ ID NO: 588688 - DNA, 13 bp, D. melanogaster
atggtgatgggga

SEQ ID NO: 588689 - DNA, 13 bp, D. melanogaster
atggtgcagatgc

SEQ ID NO: 588690 - DNA, 13 bp, D. melanogaster
atggtggaaaaaa

SEQ ID NO: 588691 - DNA, 13 bp, D. melanogaster
atggtggccaaaa

SEQ ID NO: 588692 - DNA, 14 bp, D. melanogaster
atggtggcggatga

SEQ ID NO: 588693 - DNA, 13 bp, D. melanogaster
atggtggtcactt

SEQ ID NO: 588694 - DNA, 13 bp, D. melanogaster
atggtgtctgatc

SEQ ID NO: 588695 - DNA, 13 bp, D. melanogaster
atggtgtgctgtt

SEQ ID NO: 588696 - DNA, 13 bp, D. melanogaster
atggtgtggttat

SEQ ID NO: 588697 - DNA, 13 bp, D. melanogaster
atggttaagttat

SEQ ID NO: 588698 - DNA, 13 bp, D. melanogaster
atggttaatattt

SEQ ID NO: 588699 - DNA, 13 bp, D. melanogaster
atggttagtggtg

SEQ ID NO: 588700 - DNA, 14 bp, D. melanogaster
atggttatggttat

SEQ ID NO: 588701 - DNA, 13 bp, D. melanogaster
atggttattcttg

SEQ ID NO: 588702 - DNA, 13 bp, D. melanogaster
atggttatttcat

SEQ ID NO: 588703 - DNA, 14 bp, D. melanogaster
atggttcaacgact

SEQ ID NO: 588704 - DNA, 13 bp, D. melanogaster
atggttccttgcc

SEQ ID NO: 588705 - DNA, 13 bp, D. melanogaster
atggttcgagctt

SEQ ID NO: 588706 - DNA, 13 bp, D. melanogaster
atggttcggtttt

SEQ ID NO: 588707 - DNA, 13 bp, D. melanogaster
atggttggaaaaa

SEQ ID NO: 588708 - DNA, 13 bp, D. melanogaster
atggttggatggt

SEQ ID NO: 588709 - DNA, 13 bp, D. melanogaster
atggttgggcaaa

SEQ ID NO: 588710 - DNA, 13 bp, D. melanogaster
atggtttaaaatt

SEQ ID NO: 588711 - DNA, 13 bp, D. melanogaster
atggtttaaatat

SEQ ID NO: 588712 - DNA, 13 bp, D. melanogaster
atggtttataaat

SEQ ID NO: 588713 - DNA, 13 bp, D. melanogaster
atggtttccattt

SEQ ID NO: 588714 - DNA, 13 bp, D. melanogaster
atggttttctggt

SEQ ID NO: 588715 - DNA, 13 bp, D. melanogaster
atggtttttaaaa

SEQ ID NO: 588716 - DNA, 13 bp, D. melanogaster
atggtttttcatt

SEQ ID NO: 588717 - DNA, 13 bp, D. melanogaster
atgtaaaaaatcc

SEQ ID NO: 588718 - DNA, 13 bp, D. melanogaster
atgtaaaaacagc

SEQ ID NO: 588719 - DNA, 13 bp, D. melanogaster
atgtaaaaacata

SEQ ID NO: 588720 - DNA, 13 bp, D. melanogaster
atgtaaaaacatt

SEQ ID NO: 588721 - DNA, 13 bp, D. melanogaster
atgtaaaaaccaa

SEQ ID NO: 588722 - DNA, 14 bp, D. melanogaster
atgtaaaaagaatg

SEQ ID NO: 588723 - DNA, 13 bp, D. melanogaster
atgtaaaaagttt

SEQ ID NO: 588724 - DNA, 13 bp, D. melanogaster
atgtaaaaatgta

SEQ ID NO: 588725 - DNA, 13 bp, D. melanogaster
atgtaaaaatgtt

SEQ ID NO: 588726 - DNA, 13 bp, D. melanogaster
atgtaaaactaaa

SEQ ID NO: 588727 - DNA, 13 bp, D. melanogaster
atgtaaaatacaa

SEQ ID NO: 588728 - DNA, 14 bp, D. melanogaster
atgtaaaatacaat

SEQ ID NO: 588729 - DNA, 13 bp, D. melanogaster
atgtaaaatcaaa

SEQ ID NO: 588730 - DNA, 13 bp, D. melanogaster
atgtaaaatgcat

SEQ ID NO: 588731 - DNA, 13 bp, D. melanogaster
atgtaaaattcag

SEQ ID NO: 588732 - DNA, 13 bp, D. melanogaster
atgtaaaattctt

SEQ ID NO: 588733 - DNA, 13 bp, D. melanogaster
atgtaaacaaagt

SEQ ID NO: 588734 - DNA, 13 bp, D. melanogaster
atgtaaacaatgc

SEQ ID NO: 588735 - DNA, 13 bp, D. melanogaster
atgtaaacaattc

SEQ ID NO: 588736 - DNA, 13 bp, D. melanogaster
atgtaaacatata

SEQ ID NO: 588737 - DNA, 13 bp, D. melanogaster
atgtaaacttata

SEQ ID NO: 588738 - DNA, 13 bp, D. melanogaster
atgtaaagtatat

SEQ ID NO: 588739 - DNA, 14 bp, D. melanogaster
atgtaaagtatata

SEQ ID NO: 588740 - DNA, 13 bp, D. melanogaster
atgtaaataaatg

SEQ ID NO: 588741 - DNA, 13 bp, D. melanogaster
atgtaaatacaaa

SEQ ID NO: 588742 - DNA, 13 bp, D. melanogaster
atgtaaatacaat

SEQ ID NO: 588743 - DNA, 13 bp, D. melanogaster
atgtaaatagttt

SEQ ID NO: 588744 - DNA, 13 bp, D. melanogaster
atgtaaatatgat

SEQ ID NO: 588745 - DNA, 13 bp, D. melanogaster
atgtaaatatgtt

SEQ ID NO: 588746 - DNA, 13 bp, D. melanogaster
atgtaaatatttc

SEQ ID NO: 588747 - DNA, 13 bp, D. melanogaster
atgtaaatatttg

SEQ ID NO: 588748 - DNA, 13 bp, D. melanogaster
atgtaaatcattt

SEQ ID NO: 588749 - DNA, 13 bp, D. melanogaster
atgtaaatgcaaa

SEQ ID NO: 588750 - DNA, 14 bp, D. melanogaster
atgtaaatgcaaat

SEQ ID NO: 588751 - DNA, 14 bp, D. melanogaster
atgtaaatgcattt

SEQ ID NO: 588752 - DNA, 13 bp, D. melanogaster
atgtaaatgtaaa

SEQ ID NO: 588753 - DNA, 14 bp, D. melanogaster
atgtaaatgtaaat

SEQ ID NO: 588754 - DNA, 15 bp, D. melanogaster
atgtaaatgtaaatg

SEQ ID NO: 588755 - DNA, 13 bp, D. melanogaster
atgtaaatgtaat

SEQ ID NO: 588756 - DNA, 14 bp, D. melanogaster
atgtaaatgttaat

SEQ ID NO: 588757 - DNA, 13 bp, D. melanogaster
atgtaaattatgt

SEQ ID NO: 588758 - DNA, 13 bp, D. melanogaster
atgtaaattgaat

SEQ ID NO: 588759 - DNA, 13 bp, D. melanogaster
atgtaaattgcca

SEQ ID NO: 588760 - DNA, 13 bp, D. melanogaster
atgtaaattgtaa

SEQ ID NO: 588761 - DNA, 13 bp, D. melanogaster
atgtaaatttatg

SEQ ID NO: 588762 - DNA, 13 bp, D. melanogaster
atgtaaatttttc

SEQ ID NO: 588763 - DNA, 13 bp, D. melanogaster
atgtaacaggcag

SEQ ID NO: 588764 - DNA, 13 bp, D. melanogaster
atgtaacattttt

SEQ ID NO: 588765 - DNA, 13 bp, D. melanogaster
atgtaagattgtt

SEQ ID NO: 588766 - DNA, 13 bp, D. melanogaster
atgtaataaaaac

SEQ ID NO: 588767 - DNA, 13 bp, D. melanogaster
atgtaataaacca

SEQ ID NO: 588768 - DNA, 13 bp, D. melanogaster
atgtaataattgt

SEQ ID NO: 588769 - DNA, 14 bp, D. melanogaster
atgtaatatgtatt

SEQ ID NO: 588770 - DNA, 14 bp, D. melanogaster
atgtaatgatgaac

SEQ ID NO: 588771 - DNA, 13 bp, D. melanogaster
atgtaatgtaaat

SEQ ID NO: 588772 - DNA, 13 bp, D. melanogaster
atgtaatgtaatt

SEQ ID NO: 588773 - DNA, 13 bp, D. melanogaster
atgtaattcaatt

SEQ ID NO: 588774 - DNA, 13 bp, D. melanogaster
atgtaattgccaa

SEQ ID NO: 588775 - DNA, 13 bp, D. melanogaster
atgtaattgctga

SEQ ID NO: 588776 - DNA, 13 bp, D. melanogaster
atgtaattgtagt

SEQ ID NO: 588777 - DNA, 14 bp, D. melanogaster
atgtaatttaaatg

SEQ ID NO: 588778 - DNA, 13 bp, D. melanogaster
atgtaatttaatc

SEQ ID NO: 588779 - DNA, 13 bp, D. melanogaster
atgtaatttattc

SEQ ID NO: 588780 - DNA, 13 bp, D. melanogaster
atgtaatttcaat

SEQ ID NO: 588781 - DNA, 13 bp, D. melanogaster
atgtaattttact

SEQ ID NO: 588782 - DNA, 14 bp, D. melanogaster
atgtaattttactg

SEQ ID NO: 588783 - DNA, 13 bp, D. melanogaster
atgtaatttttca

SEQ ID NO: 588784 - DNA, 13 bp, D. melanogaster
atgtaatttttga

SEQ ID NO: 588785 - DNA, 13 bp, D. melanogaster
atgtacaaacaaa

SEQ ID NO: 588786 - DNA, 13 bp, D. melanogaster
atgtacaaacata

SEQ ID NO: 588787 - DNA, 13 bp, D. melanogaster
atgtacaaactct

SEQ ID NO: 588788 - DNA, 13 bp, D. melanogaster
atgtacaaataaa

SEQ ID NO: 588789 - DNA, 13 bp, D. melanogaster
atgtacaaataca

SEQ ID NO: 588790 - DNA, 13 bp, D. melanogaster
atgtacaaatatt

SEQ ID NO: 588791 - DNA, 13 bp, D. melanogaster
atgtacaatacat

SEQ ID NO: 588792 - DNA, 14 bp, D. melanogaster
atgtacaatacata

SEQ ID NO: 588793 - DNA, 13 bp, D. melanogaster
atgtacaatataa

SEQ ID NO: 588794 - DNA, 14 bp, D. melanogaster
atgtacaatatatt

SEQ ID NO: 588795 - DNA, 14 bp, D. melanogaster
atgtacaatatgta

SEQ ID NO: 588796 - DNA, 13 bp, D. melanogaster
atgtacaatgtac

SEQ ID NO: 588797 - DNA, 13 bp, D. melanogaster
atgtacacaaaat

SEQ ID NO: 588798 - DNA, 13 bp, D. melanogaster
atgtacacacatg

SEQ ID NO: 588799 - DNA, 13 bp, D. melanogaster
atgtacacatata

SEQ ID NO: 588800 - DNA, 14 bp, D. melanogaster
atgtacacatatat

SEQ ID NO: 588801 - DNA, 13 bp, D. melanogaster
atgtacacatatt

SEQ ID NO: 588802 - DNA, 13 bp, D. melanogaster
atgtacacatgta

SEQ ID NO: 588803 - DNA, 13 bp, D. melanogaster
atgtacacattta

SEQ ID NO: 588804 - DNA, 13 bp, D. melanogaster
atgtacagtatat

SEQ ID NO: 588805 - DNA, 15 bp, D. melanogaster
atgtacataaatatg

SEQ ID NO: 588806 - DNA, 13 bp, D. melanogaster
atgtacataaatg

SEQ ID NO: 588807 - DNA, 13 bp, D. melanogaster
atgtacataagta

SEQ ID NO: 588808 - DNA, 13 bp, D. melanogaster
atgtacataagtg

SEQ ID NO: 588809 - DNA, 13 bp, D. melanogaster
atgtacataattt

SEQ ID NO: 588810 - DNA, 14 bp, D. melanogaster
atgtacatacacac

SEQ ID NO: 588811 - DNA, 13 bp, D. melanogaster
atgtacatacata

SEQ ID NO: 588812 - DNA, 14 bp, D. melanogaster
atgtacatacataa

SEQ ID NO: 588813 - DNA, 14 bp, D. melanogaster
atgtacatacatag

SEQ ID NO: 588814 - DNA, 14 bp, D. melanogaster
atgtacatacatat

SEQ ID NO: 588815 - DNA, 17 bp, D. melanogaster
atgtacatacatatata

SEQ ID NO: 588816 - DNA, 13 bp, D. melanogaster
atgtacatacatc

SEQ ID NO: 588817 - DNA, 14 bp, D. melanogaster
atgtacatacatgt

SEQ ID NO: 588818 - DNA, 13 bp, D. melanogaster
atgtacatacatt

SEQ ID NO: 588819 - DNA, 14 bp, D. melanogaster
atgtacatacattt

SEQ ID NO: 588820 - DNA, 13 bp, D. melanogaster
atgtacatacgaa

SEQ ID NO: 588821 - DNA, 13 bp, D. melanogaster
atgtacatacgtt

SEQ ID NO: 588822 - DNA, 13 bp, D. melanogaster
atgtacatactta

SEQ ID NO: 588823 - DNA, 13 bp, D. melanogaster
atgtacatagata

SEQ ID NO: 588824 - DNA, 13 bp, D. melanogaster
atgtacatagatg

SEQ ID NO: 588825 - DNA, 13 bp, D. melanogaster
atgtacatagatt

SEQ ID NO: 588826 - DNA, 14 bp, D. melanogaster
atgtacatagattt

SEQ ID NO: 588827 - DNA, 14 bp, D. melanogaster
atgtacatatacat

SEQ ID NO: 588828 - DNA, 13 bp, D. melanogaster
atgtacatatacc

SEQ ID NO: 588829 - DNA, 13 bp, D. melanogaster
atgtacatatagc

SEQ ID NO: 588830 - DNA, 13 bp, D. melanogaster
atgtacatatagt

SEQ ID NO: 588831 - DNA, 14 bp, D. melanogaster
atgtacatatataa

SEQ ID NO: 588832 - DNA, 14 bp, D. melanogaster
atgtacatatatac

SEQ ID NO: 588833 - DNA, 14 bp, D. melanogaster
atgtacatatatag

SEQ ID NO: 588834 - DNA, 14 bp, D. melanogaster
atgtacatatatat

SEQ ID NO: 588835 - DNA, 13 bp, D. melanogaster
atgtacatatatc

SEQ ID NO: 588836 - DNA, 13 bp, D. melanogaster
atgtacatatatg

SEQ ID NO: 588837 - DNA, 14 bp, D. melanogaster
atgtacatatatga

SEQ ID NO: 588838 - DNA, 14 bp, D. melanogaster
atgtacatatatgg

SEQ ID NO: 588839 - DNA, 13 bp, D. melanogaster
atgtacatatatt

SEQ ID NO: 588840 - DNA, 13 bp, D. melanogaster
atgtacatatcta

SEQ ID NO: 588841 - DNA, 13 bp, D. melanogaster
atgtacatatgca

SEQ ID NO: 588842 - DNA, 14 bp, D. melanogaster
atgtacatatgcat

SEQ ID NO: 588843 - DNA, 14 bp, D. melanogaster
atgtacatatgtac

SEQ ID NO: 588844 - DNA, 15 bp, D. melanogaster
atgtacatatgtatc

SEQ ID NO: 588845 - DNA, 13 bp, D. melanogaster
atgtacatatgtc

SEQ ID NO: 588846 - DNA, 13 bp, D. melanogaster
atgtacatatgtg

SEQ ID NO: 588847 - DNA, 14 bp, D. melanogaster
atgtacatatgtgc

SEQ ID NO: 588848 - DNA, 14 bp, D. melanogaster
atgtacatatgtgt

SEQ ID NO: 588849 - DNA, 15 bp, D. melanogaster
atgtacatatgtgta

SEQ ID NO: 588850 - DNA, 13 bp, D. melanogaster
atgtacatatgtt

SEQ ID NO: 588851 - DNA, 14 bp, D. melanogaster
atgtacatatgtta

SEQ ID NO: 588852 - DNA, 13 bp, D. melanogaster
atgtacatattca

SEQ ID NO: 588853 - DNA, 13 bp, D. melanogaster
atgtacatatttc

SEQ ID NO: 588854 - DNA, 13 bp, D. melanogaster
atgtacatatttg

SEQ ID NO: 588855 - DNA, 13 bp, D. melanogaster
atgtacatatttt

SEQ ID NO: 588856 - DNA, 14 bp, D. melanogaster
atgtacatattttt

SEQ ID NO: 588857 - DNA, 13 bp, D. melanogaster
atgtacatgtatg

SEQ ID NO: 588858 - DNA, 13 bp, D. melanogaster
atgtacatgtgca

SEQ ID NO: 588859 - DNA, 13 bp, D. melanogaster
atgtacatgtgtg

SEQ ID NO: 588860 - DNA, 13 bp, D. melanogaster
atgtacatgtgtt

SEQ ID NO: 588861 - DNA, 14 bp, D. melanogaster
atgtacatttatat

SEQ ID NO: 588862 - DNA, 13 bp, D. melanogaster
atgtacatttgta

SEQ ID NO: 588863 - DNA, 13 bp, D. melanogaster
atgtacattttat

SEQ ID NO: 588864 - DNA, 13 bp, D. melanogaster
atgtacattttta

SEQ ID NO: 588865 - DNA, 14 bp, D. melanogaster
atgtacatttttat

SEQ ID NO: 588866 - DNA, 13 bp, D. melanogaster
atgtaccatgtaa

SEQ ID NO: 588867 - DNA, 13 bp, D. melanogaster
atgtacctatgta

SEQ ID NO: 588868 - DNA, 13 bp, D. melanogaster
atgtacgaacaaa

SEQ ID NO: 588869 - DNA, 13 bp, D. melanogaster
atgtacgagtaat

SEQ ID NO: 588870 - DNA, 14 bp, D. melanogaster
atgtacgagtatgt

SEQ ID NO: 588871 - DNA, 13 bp, D. melanogaster
atgtacgccttta

SEQ ID NO: 588872 - DNA, 13 bp, D. melanogaster
atgtacgtatgca

SEQ ID NO: 588873 - DNA, 13 bp, D. melanogaster
atgtacgtatgta

SEQ ID NO: 588874 - DNA, 13 bp, D. melanogaster
atgtactaaaata

SEQ ID NO: 588875 - DNA, 13 bp, D. melanogaster
atgtactaaagaa

SEQ ID NO: 588876 - DNA, 14 bp, D. melanogaster
atgtactaaagaag

SEQ ID NO: 588877 - DNA, 14 bp, D. melanogaster
atgtactaaatgta

SEQ ID NO: 588878 - DNA, 13 bp, D. melanogaster
atgtactacatac

SEQ ID NO: 588879 - DNA, 13 bp, D. melanogaster
atgtactatatac

SEQ ID NO: 588880 - DNA, 13 bp, D. melanogaster
atgtactatttgt

SEQ ID NO: 588881 - DNA, 15 bp, D. melanogaster
atgtactcttttgta

SEQ ID NO: 588882 - DNA, 13 bp, D. melanogaster
atgtactggctct

SEQ ID NO: 588883 - DNA, 13 bp, D. melanogaster
atgtacttattta

SEQ ID NO: 588884 - DNA, 13 bp, D. melanogaster
atgtactttaaaa

SEQ ID NO: 588885 - DNA, 13 bp, D. melanogaster
atgtactttaaat

SEQ ID NO: 588886 - DNA, 13 bp, D. melanogaster
atgtagaatattt

SEQ ID NO: 588887 - DNA, 13 bp, D. melanogaster
atgtagacgacat

SEQ ID NO: 588888 - DNA, 13 bp, D. melanogaster
atgtagatagata

SEQ ID NO: 588889 - DNA, 13 bp, D. melanogaster
atgtagatggcat

SEQ ID NO: 588890 - DNA, 13 bp, D. melanogaster
atgtagattttga

SEQ ID NO: 588891 - DNA, 13 bp, D. melanogaster
atgtagtttcaaa

SEQ ID NO: 588892 - DNA, 13 bp, D. melanogaster
atgtagtttttaa

SEQ ID NO: 588893 - DNA, 13 bp, D. melanogaster
atgtataaaatac

SEQ ID NO: 588894 - DNA, 13 bp, D. melanogaster
atgtataaacaaa

SEQ ID NO: 588895 - DNA, 13 bp, D. melanogaster
atgtataaacatt

SEQ ID NO: 588896 - DNA, 13 bp, D. melanogaster
atgtataaagtat

SEQ ID NO: 588897 - DNA, 13 bp, D. melanogaster
atgtataaatatc

SEQ ID NO: 588898 - DNA, 13 bp, D. melanogaster
atgtataaatatg

SEQ ID NO: 588899 - DNA, 13 bp, D. melanogaster
atgtataaatcta

SEQ ID NO: 588900 - DNA, 13 bp, D. melanogaster
atgtataaatgta

SEQ ID NO: 588901 - DNA, 14 bp, D. melanogaster
atgtataaatgtat

SEQ ID NO: 588902 - DNA, 13 bp, D. melanogaster
atgtataaattga

SEQ ID NO: 588903 - DNA, 13 bp, D. melanogaster
atgtataatattg

SEQ ID NO: 588904 - DNA, 13 bp, D. melanogaster
atgtatacaaaat

SEQ ID NO: 588905 - DNA, 14 bp, D. melanogaster
atgtatacaaaata

SEQ ID NO: 588906 - DNA, 13 bp, D. melanogaster
atgtatacaaatg

SEQ ID NO: 588907 - DNA, 13 bp, D. melanogaster
atgtatacaaatt

SEQ ID NO: 588908 - DNA, 13 bp, D. melanogaster
atgtatacaatat

SEQ ID NO: 588909 - DNA, 13 bp, D. melanogaster
atgtatacacaca

SEQ ID NO: 588910 - DNA, 13 bp, D. melanogaster
atgtatacataat

SEQ ID NO: 588911 - DNA, 13 bp, D. melanogaster
atgtatacattta

SEQ ID NO: 588912 - DNA, 13 bp, D. melanogaster
atgtatacatttt

SEQ ID NO: 588913 - DNA, 14 bp, D. melanogaster
atgtatacattttt

SEQ ID NO: 588914 - DNA, 13 bp, D. melanogaster
atgtatactatat

SEQ ID NO: 588915 - DNA, 13 bp, D. melanogaster
atgtatataaact

SEQ ID NO: 588916 - DNA, 13 bp, D. melanogaster
atgtatataaaga

SEQ ID NO: 588917 - DNA, 14 bp, D. melanogaster
atgtatatacaaaa

SEQ ID NO: 588918 - DNA, 13 bp, D. melanogaster
atgtatatacaga

SEQ ID NO: 588919 - DNA, 14 bp, D. melanogaster
atgtatatacatac

SEQ ID NO: 588920 - DNA, 14 bp, D. melanogaster
atgtatatacttta

SEQ ID NO: 588921 - DNA, 14 bp, D. melanogaster
atgtatatatacac

SEQ ID NO: 588922 - DNA, 13 bp, D. melanogaster
atgtatatatacc

SEQ ID NO: 588923 - DNA, 13 bp, D. melanogaster
atgtatatatact

SEQ ID NO: 588924 - DNA, 13 bp, D. melanogaster
atgtatatatagt

SEQ ID NO: 588925 - DNA, 14 bp, D. melanogaster
atgtatatatatac

SEQ ID NO: 588926 - DNA, 13 bp, D. melanogaster
atgtatatatatc

SEQ ID NO: 588927 - DNA, 14 bp, D. melanogaster
atgtatatatatgg

SEQ ID NO: 588928 - DNA, 13 bp, D. melanogaster
atgtatatatctt

SEQ ID NO: 588929 - DNA, 14 bp, D. melanogaster
atgtatatatgtac

SEQ ID NO: 588930 - DNA, 13 bp, D. melanogaster
atgtatatatgtg

SEQ ID NO: 588931 - DNA, 14 bp, D. melanogaster
atgtatatatgtgt

SEQ ID NO: 588932 - DNA, 13 bp, D. melanogaster
atgtatatatgtt

SEQ ID NO: 588933 - DNA, 14 bp, D. melanogaster
atgtatatattttc

SEQ ID NO: 588934 - DNA, 13 bp, D. melanogaster
atgtatatctatt

SEQ ID NO: 588935 - DNA, 13 bp, D. melanogaster
atgtatatgaaca

SEQ ID NO: 588936 - DNA, 13 bp, D. melanogaster
atgtatatgcaat

SEQ ID NO: 588937 - DNA, 13 bp, D. melanogaster
atgtatatgcatg

SEQ ID NO: 588938 - DNA, 13 bp, D. melanogaster
atgtatatggaaa

SEQ ID NO: 588939 - DNA, 15 bp, D. melanogaster
atgtatatgtacata

SEQ ID NO: 588940 - DNA, 13 bp, D. melanogaster
atgtatatgtact

SEQ ID NO: 588941 - DNA, 13 bp, D. melanogaster
atgtatatgtaga

SEQ ID NO: 588942 - DNA, 14 bp, D. melanogaster
atgtatatgtataa

SEQ ID NO: 588943 - DNA, 13 bp, D. melanogaster
atgtatatgtatc

SEQ ID NO: 588944 - DNA, 14 bp, D. melanogaster
atgtatatgtatct

SEQ ID NO: 588945 - DNA, 13 bp, D. melanogaster
atgtatatgttgt

SEQ ID NO: 588946 - DNA, 13 bp, D. melanogaster
atgtatatttatc

SEQ ID NO: 588947 - DNA, 13 bp, D. melanogaster
atgtatatttcta

SEQ ID NO: 588948 - DNA, 13 bp, D. melanogaster
atgtatattttca

SEQ ID NO: 588949 - DNA, 13 bp, D. melanogaster
atgtatccaataa

SEQ ID NO: 588950 - DNA, 13 bp, D. melanogaster
atgtatctatatc

SEQ ID NO: 588951 - DNA, 13 bp, D. melanogaster
atgtatctatgta

SEQ ID NO: 588952 - DNA, 13 bp, D. melanogaster
atgtatctgatga

SEQ ID NO: 588953 - DNA, 13 bp, D. melanogaster
atgtatctgcatc

SEQ ID NO: 588954 - DNA, 14 bp, D. melanogaster
atgtatctgcatct

SEQ ID NO: 588955 - DNA, 14 bp, D. melanogaster
atgtatctgtatct

SEQ ID NO: 588956 - DNA, 13 bp, D. melanogaster
atgtatcttgcag

SEQ ID NO: 588957 - DNA, 13 bp, D. melanogaster
atgtatcttgtat

SEQ ID NO: 588958 - DNA, 13 bp, D. melanogaster
atgtatgagtgtg

SEQ ID NO: 588959 - DNA, 13 bp, D. melanogaster
atgtatgcagaag

SEQ ID NO: 588960 - DNA, 14 bp, D. melanogaster
atgtatgcatgtgt

SEQ ID NO: 588961 - DNA, 13 bp, D. melanogaster
atgtatgcattta

SEQ ID NO: 588962 - DNA, 13 bp, D. melanogaster
atgtatgcgctta

SEQ ID NO: 588963 - DNA, 13 bp, D. melanogaster
atgtatggatgta

SEQ ID NO: 588964 - DNA, 14 bp, D. melanogaster
atgtatgtaaatat

SEQ ID NO: 588965 - DNA, 13 bp, D. melanogaster
atgtatgtaagtt

SEQ ID NO: 588966 - DNA, 13 bp, D. melanogaster
atgtatgtacaac

SEQ ID NO: 588967 - DNA, 13 bp, D. melanogaster
atgtatgtacaat

SEQ ID NO: 588968 - DNA, 13 bp, D. melanogaster
atgtatgtacaca

SEQ ID NO: 588969 - DNA, 14 bp, D. melanogaster
atgtatgtacacat

SEQ ID NO: 588970 - DNA, 15 bp, D. melanogaster
atgtatgtacatatg

SEQ ID NO: 588971 - DNA, 13 bp, D. melanogaster
atgtatgtacatt

SEQ ID NO: 588972 - DNA, 13 bp, D. melanogaster
atgtatgtactta

SEQ ID NO: 588973 - DNA, 13 bp, D. melanogaster
atgtatgtacttt

SEQ ID NO: 588974 - DNA, 14 bp, D. melanogaster
atgtatgtataaat

SEQ ID NO: 588975 - DNA, 14 bp, D. melanogaster
atgtatgtataata

SEQ ID NO: 588976 - DNA, 14 bp, D. melanogaster
atgtatgtatatta

SEQ ID NO: 588977 - DNA, 14 bp, D. melanogaster
atgtatgtatattc

SEQ ID NO: 588978 - DNA, 13 bp, D. melanogaster
atgtatgtatgcg

SEQ ID NO: 588979 - DNA, 14 bp, D. melanogaster
atgtatgtatgctt

SEQ ID NO: 588980 - DNA, 14 bp, D. melanogaster
atgtatgtatgtta

SEQ ID NO: 588981 - DNA, 13 bp, D. melanogaster
atgtatgtattaa

SEQ ID NO: 588982 - DNA, 14 bp, D. melanogaster
atgtatgtattttg

SEQ ID NO: 588983 - DNA, 13 bp, D. melanogaster
atgtatgtgaata

SEQ ID NO: 588984 - DNA, 13 bp, D. melanogaster
atgtatgtgcata

SEQ ID NO: 588985 - DNA, 13 bp, D. melanogaster
atgtatgtgtaca

SEQ ID NO: 588986 - DNA, 13 bp, D. melanogaster
atgtatgtgtacc

SEQ ID NO: 588987 - DNA, 13 bp, D. melanogaster
atgtatgtgtata

SEQ ID NO: 588988 - DNA, 14 bp, D. melanogaster
atgtatgtgtatct

SEQ ID NO: 588989 - DNA, 13 bp, D. melanogaster
atgtatgtgtatg

SEQ ID NO: 588990 - DNA, 14 bp, D. melanogaster
atgtatgtgtatgc

SEQ ID NO: 588991 - DNA, 14 bp, D. melanogaster
atgtatgtgtatgt

SEQ ID NO: 588992 - DNA, 14 bp, D. melanogaster
atgtatgtgtgtat

SEQ ID NO: 588993 - DNA, 14 bp, D. melanogaster
atgtatgtgtgtgc

SEQ ID NO: 588994 - DNA, 13 bp, D. melanogaster
atgtatgtttaaa

SEQ ID NO: 588995 - DNA, 13 bp, D. melanogaster
atgtatgtttaat

SEQ ID NO: 588996 - DNA, 14 bp, D. melanogaster
atgtatgtttgtat

SEQ ID NO: 588997 - DNA, 13 bp, D. melanogaster
atgtatgttttaa

SEQ ID NO: 588998 - DNA, 13 bp, D. melanogaster
atgtattaaaagt

SEQ ID NO: 588999 - DNA, 13 bp, D. melanogaster
atgtattatgtat

SEQ ID NO: 589000 - DNA, 13 bp, D. melanogaster
atgtattcaatta

SEQ ID NO: 589001 - DNA, 13 bp, D. melanogaster
atgtattgtagta

SEQ ID NO: 589002 - DNA, 13 bp, D. melanogaster
atgtattgtatat

SEQ ID NO: 589003 - DNA, 13 bp, D. melanogaster
atgtattgtatgt

SEQ ID NO: 589004 - DNA, 13 bp, D. melanogaster
atgtatttaagcg

SEQ ID NO: 589005 - DNA, 13 bp, D. melanogaster
atgtatttactca

SEQ ID NO: 589006 - DNA, 13 bp, D. melanogaster
atgtatttacttt

SEQ ID NO: 589007 - DNA, 13 bp, D. melanogaster
atgtatttataca

SEQ ID NO: 589008 - DNA, 13 bp, D. melanogaster
atgtatttatact

SEQ ID NO: 589009 - DNA, 14 bp, D. melanogaster
atgtatttatactg

SEQ ID NO: 589010 - DNA, 13 bp, D. melanogaster
atgtatttatatc

SEQ ID NO: 589011 - DNA, 13 bp, D. melanogaster
atgtatttcgaaa

SEQ ID NO: 589012 - DNA, 13 bp, D. melanogaster
atgtatttcttta

SEQ ID NO: 589013 - DNA, 14 bp, D. melanogaster
atgtatttgcatat

SEQ ID NO: 589014 - DNA, 14 bp, D. melanogaster
atgtatttgtatct

SEQ ID NO: 589015 - DNA, 13 bp, D. melanogaster
atgtattttaaag

SEQ ID NO: 589016 - DNA, 13 bp, D. melanogaster
atgtattttctta

SEQ ID NO: 589017 - DNA, 13 bp, D. melanogaster
atgtattttgcat

SEQ ID NO: 589018 - DNA, 14 bp, D. melanogaster
atgtatttttcaat

SEQ ID NO: 589019 - DNA, 13 bp, D. melanogaster
atgtcaaaaaagt

SEQ ID NO: 589020 - DNA, 14 bp, D. melanogaster
atgtcaaaatattt

SEQ ID NO: 589021 - DNA, 13 bp, D. melanogaster
atgtcaaaatcaa

SEQ ID NO: 589022 - DNA, 13 bp, D. melanogaster
atgtcaaaatgtt

SEQ ID NO: 589023 - DNA, 13 bp, D. melanogaster
atgtcaaacattt

SEQ ID NO: 589024 - DNA, 13 bp, D. melanogaster
atgtcaaagcaaa

SEQ ID NO: 589025 - DNA, 13 bp, D. melanogaster
atgtcaaagcagt

SEQ ID NO: 589026 - DNA, 13 bp, D. melanogaster
atgtcaaatagaa

SEQ ID NO: 589027 - DNA, 13 bp, D. melanogaster
atgtcaaatcaaa

SEQ ID NO: 589028 - DNA, 13 bp, D. melanogaster
atgtcaaatgtca

SEQ ID NO: 589029 - DNA, 13 bp, D. melanogaster
atgtcaaattttc

SEQ ID NO: 589030 - DNA, 13 bp, D. melanogaster
atgtcaacaaaat

SEQ ID NO: 589031 - DNA, 14 bp, D. melanogaster
atgtcaactctttt

SEQ ID NO: 589032 - DNA, 13 bp, D. melanogaster
atgtcaatgtcaa

SEQ ID NO: 589033 - DNA, 13 bp, D. melanogaster
atgtcaattgaaa

SEQ ID NO: 589034 - DNA, 14 bp, D. melanogaster
atgtcacctattta

SEQ ID NO: 589035 - DNA, 13 bp, D. melanogaster
atgtcagaaatgg

SEQ ID NO: 589036 - DNA, 14 bp, D. melanogaster
atgtcagccagttg

SEQ ID NO: 589037 - DNA, 13 bp, D. melanogaster
atgtcaggtttcc

SEQ ID NO: 589038 - DNA, 13 bp, D. melanogaster
atgtcatcaaagc

SEQ ID NO: 589039 - DNA, 13 bp, D. melanogaster
atgtcatcgtcac

SEQ ID NO: 589040 - DNA, 13 bp, D. melanogaster
atgtcattaaatt

SEQ ID NO: 589041 - DNA, 13 bp, D. melanogaster
atgtccaccaaag

SEQ ID NO: 589042 - DNA, 13 bp, D. melanogaster
atgtccattattt

SEQ ID NO: 589043 - DNA, 13 bp, D. melanogaster
atgtcccaaattc

SEQ ID NO: 589044 - DNA, 14 bp, D. melanogaster
atgtccggaaatat

SEQ ID NO: 589045 - DNA, 13 bp, D. melanogaster
atgtccgtggaga

SEQ ID NO: 589046 - DNA, 13 bp, D. melanogaster
atgtcctgattta

SEQ ID NO: 589047 - DNA, 13 bp, D. melanogaster
atgtcctgccagc

SEQ ID NO: 589048 - DNA, 13 bp, D. melanogaster
atgtcctgcgtcc

SEQ ID NO: 589049 - DNA, 13 bp, D. melanogaster
atgtcctgctgcc

SEQ ID NO: 589050 - DNA, 13 bp, D. melanogaster
atgtcctggcaaa

SEQ ID NO: 589051 - DNA, 13 bp, D. melanogaster
atgtcctggccat

SEQ ID NO: 589052 - DNA, 13 bp, D. melanogaster
atgtcctttgtcc

SEQ ID NO: 589053 - DNA, 13 bp, D. melanogaster
atgtcctttttgc

SEQ ID NO: 589054 - DNA, 13 bp, D. melanogaster
atgtcgaaaagtt

SEQ ID NO: 589055 - DNA, 14 bp, D. melanogaster
atgtcgaaaagttt

SEQ ID NO: 589056 - DNA, 13 bp, D. melanogaster
atgtcgacttctt

SEQ ID NO: 589057 - DNA, 13 bp, D. melanogaster
atgtcgatgaggt

SEQ ID NO: 589058 - DNA, 13 bp, D. melanogaster
atgtcgatgtcga

SEQ ID NO: 589059 - DNA, 14 bp, D. melanogaster
atgtcgatgtcgat

SEQ ID NO: 589060 - DNA, 13 bp, D. melanogaster
atgtcgatgtgaa

SEQ ID NO: 589061 - DNA, 14 bp, D. melanogaster
atgtcgcttgttgc

SEQ ID NO: 589062 - DNA, 13 bp, D. melanogaster
atgtcgtctacat

SEQ ID NO: 589063 - DNA, 13 bp, D. melanogaster
atgtctaaaagta

SEQ ID NO: 589064 - DNA, 13 bp, D. melanogaster
atgtctataaata

SEQ ID NO: 589065 - DNA, 13 bp, D. melanogaster
atgtctatatgta

SEQ ID NO: 589066 - DNA, 13 bp, D. melanogaster
atgtctctatcgc

SEQ ID NO: 589067 - DNA, 14 bp, D. melanogaster
atgtctgaatataa

SEQ ID NO: 589068 - DNA, 13 bp, D. melanogaster
atgtctgcaaagt

SEQ ID NO: 589069 - DNA, 13 bp, D. melanogaster
atgtctgccggat

SEQ ID NO: 589070 - DNA, 13 bp, D. melanogaster
atgtctggattcc

SEQ ID NO: 589071 - DNA, 13 bp, D. melanogaster
atgtctgtgtata

SEQ ID NO: 589072 - DNA, 13 bp, D. melanogaster
atgtctgtgtgtt

SEQ ID NO: 589073 - DNA, 13 bp, D. melanogaster
atgtctttgagtt

SEQ ID NO: 589074 - DNA, 13 bp, D. melanogaster
atgtcttttaatt

SEQ ID NO: 589075 - DNA, 14 bp, D. melanogaster
atgtgaaaaacaaa

SEQ ID NO: 589076 - DNA, 13 bp, D. melanogaster
atgtgaaaaatgt

SEQ ID NO: 589077 - DNA, 13 bp, D. melanogaster
atgtgaaaaattt

SEQ ID NO: 589078 - DNA, 13 bp, D. melanogaster
atgtgaaaagttt

SEQ ID NO: 589079 - DNA, 13 bp, D. melanogaster
atgtgaaaatgaa

SEQ ID NO: 589080 - DNA, 13 bp, D. melanogaster
atgtgaaaattgt

SEQ ID NO: 589081 - DNA, 13 bp, D. melanogaster
atgtgaaagccac

SEQ ID NO: 589082 - DNA, 13 bp, D. melanogaster
atgtgaaatatga

SEQ ID NO: 589083 - DNA, 13 bp, D. melanogaster
atgtgaaatattt

SEQ ID NO: 589084 - DNA, 13 bp, D. melanogaster
atgtgaaatgtga

SEQ ID NO: 589085 - DNA, 13 bp, D. melanogaster
atgtgaaatgtgt

SEQ ID NO: 589086 - DNA, 13 bp, D. melanogaster
atgtgaaatttgt

SEQ ID NO: 589087 - DNA, 13 bp, D. melanogaster
atgtgaaattttt

SEQ ID NO: 589088 - DNA, 13 bp, D. melanogaster
atgtgaaggtgct

SEQ ID NO: 589089 - DNA, 13 bp, D. melanogaster
atgtgaagtttta

SEQ ID NO: 589090 - DNA, 13 bp, D. melanogaster
atgtgaataaatt

SEQ ID NO: 589091 - DNA, 13 bp, D. melanogaster
atgtgaatatata

SEQ ID NO: 589092 - DNA, 13 bp, D. melanogaster
atgtgaatatgaa

SEQ ID NO: 589093 - DNA, 13 bp, D. melanogaster
atgtgaatgaatt

SEQ ID NO: 589094 - DNA, 13 bp, D. melanogaster
atgtgaatgcgaa

SEQ ID NO: 589095 - DNA, 13 bp, D. melanogaster
atgtgaatgtgat

SEQ ID NO: 589096 - DNA, 14 bp, D. melanogaster
atgtgacattttaa

SEQ ID NO: 589097 - DNA, 13 bp, D. melanogaster
atgtgaccaagaa

SEQ ID NO: 589098 - DNA, 13 bp, D. melanogaster
atgtgagcgaaaa

SEQ ID NO: 589099 - DNA, 14 bp, D. melanogaster
atgtgagcgaaaat

SEQ ID NO: 589100 - DNA, 13 bp, D. melanogaster
atgtgatatatat

SEQ ID NO: 589101 - DNA, 13 bp, D. melanogaster
atgtgatgcgatg

SEQ ID NO: 589102 - DNA, 13 bp, D. melanogaster
atgtgatggaata

SEQ ID NO: 589103 - DNA, 13 bp, D. melanogaster
atgtgattaaaat

SEQ ID NO: 589104 - DNA, 13 bp, D. melanogaster
atgtgattgaagt

SEQ ID NO: 589105 - DNA, 13 bp, D. melanogaster
atgtgattgtgtg

SEQ ID NO: 589106 - DNA, 13 bp, D. melanogaster
atgtgatttgtct

SEQ ID NO: 589107 - DNA, 13 bp, D. melanogaster
atgtgcaaaaata

SEQ ID NO: 589108 - DNA, 13 bp, D. melanogaster
atgtgcaaaataa

SEQ ID NO: 589109 - DNA, 13 bp, D. melanogaster
atgtgcaaaatga

SEQ ID NO: 589110 - DNA, 13 bp, D. melanogaster
atgtgcaaaatgc

SEQ ID NO: 589111 - DNA, 13 bp, D. melanogaster
atgtgcaaattaa

SEQ ID NO: 589112 - DNA, 14 bp, D. melanogaster
atgtgcaacaaaaa

SEQ ID NO: 589113 - DNA, 13 bp, D. melanogaster
atgtgcaacaact

SEQ ID NO: 589114 - DNA, 13 bp, D. melanogaster
atgtgcaacattt

SEQ ID NO: 589115 - DNA, 13 bp, D. melanogaster
atgtgcaatgtgc

SEQ ID NO: 589116 - DNA, 13 bp, D. melanogaster
atgtgcaattaaa

SEQ ID NO: 589117 - DNA, 13 bp, D. melanogaster
atgtgcaatttaa

SEQ ID NO: 589118 - DNA, 13 bp, D. melanogaster
atgtgcaatttat

SEQ ID NO: 589119 - DNA, 13 bp, D. melanogaster
atgtgcaattttt

SEQ ID NO: 589120 - DNA, 13 bp, D. melanogaster
atgtgcacagatt

SEQ ID NO: 589121 - DNA, 13 bp, D. melanogaster
atgtgcacataca

SEQ ID NO: 589122 - DNA, 13 bp, D. melanogaster
atgtgcacatatt

SEQ ID NO: 589123 - DNA, 13 bp, D. melanogaster
atgtgcacatttt

SEQ ID NO: 589124 - DNA, 13 bp, D. melanogaster
atgtgcactttaa

SEQ ID NO: 589125 - DNA, 13 bp, D. melanogaster
atgtgcagaaaat

SEQ ID NO: 589126 - DNA, 13 bp, D. melanogaster
atgtgcagcattt

SEQ ID NO: 589127 - DNA, 13 bp, D. melanogaster
atgtgcatatata

SEQ ID NO: 589128 - DNA, 14 bp, D. melanogaster
atgtgcatatatat

SEQ ID NO: 589129 - DNA, 14 bp, D. melanogaster
atgtgcatatgtat

SEQ ID NO: 589130 - DNA, 13 bp, D. melanogaster
atgtgcatattta

SEQ ID NO: 589131 - DNA, 13 bp, D. melanogaster
atgtgcatgtgaa

SEQ ID NO: 589132 - DNA, 13 bp, D. melanogaster
atgtgcatgtgca

SEQ ID NO: 589133 - DNA, 14 bp, D. melanogaster
atgtgcatgtgcat

SEQ ID NO: 589134 - DNA, 13 bp, D. melanogaster
atgtgcatgtgtg

SEQ ID NO: 589135 - DNA, 14 bp, D. melanogaster
atgtgcatgtgtgt

SEQ ID NO: 589136 - DNA, 13 bp, D. melanogaster
atgtgcattaatt

SEQ ID NO: 589137 - DNA, 13 bp, D. melanogaster
atgtgcattattt

SEQ ID NO: 589138 - DNA, 13 bp, D. melanogaster
atgtgccaaaaac

SEQ ID NO: 589139 - DNA, 13 bp, D. melanogaster
atgtgccaaaaat

SEQ ID NO: 589140 - DNA, 13 bp, D. melanogaster
atgtgccacactc

SEQ ID NO: 589141 - DNA, 13 bp, D. melanogaster
atgtgccacgccc

SEQ ID NO: 589142 - DNA, 14 bp, D. melanogaster
atgtgccacgcccc

SEQ ID NO: 589143 - DNA, 13 bp, D. melanogaster
atgtgccataaaa

SEQ ID NO: 589144 - DNA, 13 bp, D. melanogaster
atgtgccatattt

SEQ ID NO: 589145 - DNA, 13 bp, D. melanogaster
atgtgccatgtgc

SEQ ID NO: 589146 - DNA, 13 bp, D. melanogaster
atgtgcccgagcg

SEQ ID NO: 589147 - DNA, 13 bp, D. melanogaster
atgtgcctgtgtg

SEQ ID NO: 589148 - DNA, 13 bp, D. melanogaster
atgtgcgaaaaat

SEQ ID NO: 589149 - DNA, 13 bp, D. melanogaster
atgtgcgaaaatt

SEQ ID NO: 589150 - DNA, 13 bp, D. melanogaster
atgtgcgcatcaa

SEQ ID NO: 589151 - DNA, 13 bp, D. melanogaster
atgtgcgtggcga

SEQ ID NO: 589152 - DNA, 13 bp, D. melanogaster
atgtgcgtgtgcg

SEQ ID NO: 589153 - DNA, 14 bp, D. melanogaster
atgtgcgtgtgtgc

SEQ ID NO: 589154 - DNA, 13 bp, D. melanogaster
atgtgctgcattt

SEQ ID NO: 589155 - DNA, 13 bp, D. melanogaster
atgtgctgctgct

SEQ ID NO: 589156 - DNA, 13 bp, D. melanogaster
atgtgctggaaaa

SEQ ID NO: 589157 - DNA, 13 bp, D. melanogaster
atgtgcttaaagt

SEQ ID NO: 589158 - DNA, 13 bp, D. melanogaster
atgtgcttgtgtg

SEQ ID NO: 589159 - DNA, 13 bp, D. melanogaster
atgtgcttttgtt

SEQ ID NO: 589160 - DNA, 13 bp, D. melanogaster
atgtggaaaatat

SEQ ID NO: 589161 - DNA, 13 bp, D. melanogaster
atgtggaaaatta

SEQ ID NO: 589162 - DNA, 13 bp, D. melanogaster
atgtggaaaattc

SEQ ID NO: 589163 - DNA, 13 bp, D. melanogaster
atgtggaactggg

SEQ ID NO: 589164 - DNA, 13 bp, D. melanogaster
atgtggaacttgc

SEQ ID NO: 589165 - DNA, 13 bp, D. melanogaster
atgtggacgatgt

SEQ ID NO: 589166 - DNA, 14 bp, D. melanogaster
atgtggacgatgtg

SEQ ID NO: 589167 - DNA, 13 bp, D. melanogaster
atgtggacgtgga

SEQ ID NO: 589168 - DNA, 13 bp, D. melanogaster
atgtggacttaga

SEQ ID NO: 589169 - DNA, 15 bp, D. melanogaster
atgtggagcggtact

SEQ ID NO: 589170 - DNA, 13 bp, D. melanogaster
atgtggagttcgg

SEQ ID NO: 589171 - DNA, 13 bp, D. melanogaster
atgtggatatata

SEQ ID NO: 589172 - DNA, 13 bp, D. melanogaster
atgtggatgcaat

SEQ ID NO: 589173 - DNA, 14 bp, D. melanogaster
atgtggatgcaatt

SEQ ID NO: 589174 - DNA, 13 bp, D. melanogaster
atgtggatgggga

SEQ ID NO: 589175 - DNA, 13 bp, D. melanogaster
atgtggatgtaga

SEQ ID NO: 589176 - DNA, 13 bp, D. melanogaster
atgtggatgtgca

SEQ ID NO: 589177 - DNA, 14 bp, D. melanogaster
atgtggatgtggac

SEQ ID NO: 589178 - DNA, 13 bp, D. melanogaster
atgtggatgtggc

SEQ ID NO: 589179 - DNA, 13 bp, D. melanogaster
atgtggatgtggg

SEQ ID NO: 589180 - DNA, 13 bp, D. melanogaster
atgtggatgtgtg

SEQ ID NO: 589181 - DNA, 13 bp, D. melanogaster
atgtggcaaatgt

SEQ ID NO: 589182 - DNA, 13 bp, D. melanogaster
atgtggcaaattt

SEQ ID NO: 589183 - DNA, 13 bp, D. melanogaster
atgtggcaacaaa

SEQ ID NO: 589184 - DNA, 14 bp, D. melanogaster
atgtggcaaggaaa

SEQ ID NO: 589185 - DNA, 14 bp, D. melanogaster
atgtggcacaataa

SEQ ID NO: 589186 - DNA, 13 bp, D. melanogaster
atgtggcacacac

SEQ ID NO: 589187 - DNA, 13 bp, D. melanogaster
atgtggcacacat

SEQ ID NO: 589188 - DNA, 13 bp, D. melanogaster
atgtggcacgcac

SEQ ID NO: 589189 - DNA, 13 bp, D. melanogaster
atgtggcactgtt

SEQ ID NO: 589190 - DNA, 13 bp, D. melanogaster
atgtggcagctgg

SEQ ID NO: 589191 - DNA, 14 bp, D. melanogaster
atgtggcagctgga

SEQ ID NO: 589192 - DNA, 13 bp, D. melanogaster
atgtggcatattt

SEQ ID NO: 589193 - DNA, 13 bp, D. melanogaster
atgtggccaagga

SEQ ID NO: 589194 - DNA, 13 bp, D. melanogaster
atgtggccataaa

SEQ ID NO: 589195 - DNA, 13 bp, D. melanogaster
atgtggctggcta

SEQ ID NO: 589196 - DNA, 13 bp, D. melanogaster
atgtggctgtgtg

SEQ ID NO: 589197 - DNA, 13 bp, D. melanogaster
atgtgggtgtgga

SEQ ID NO: 589198 - DNA, 13 bp, D. melanogaster
atgtggtggagct

SEQ ID NO: 589199 - DNA, 14 bp, D. melanogaster
atgtggtggagctg

SEQ ID NO: 589200 - DNA, 13 bp, D. melanogaster
atgtggttatagc

SEQ ID NO: 589201 - DNA, 13 bp, D. melanogaster
atgtgtaaaaaat

SEQ ID NO: 589202 - DNA, 13 bp, D. melanogaster
atgtgtaaaaagt

SEQ ID NO: 589203 - DNA, 13 bp, D. melanogaster
atgtgtaaaatat

SEQ ID NO: 589204 - DNA, 13 bp, D. melanogaster
atgtgtaaaatgt

SEQ ID NO: 589205 - DNA, 13 bp, D. melanogaster
atgtgtaaacaaa

SEQ ID NO: 589206 - DNA, 13 bp, D. melanogaster
atgtgtaaactga

SEQ ID NO: 589207 - DNA, 14 bp, D. melanogaster
atgtgtaaatatat

SEQ ID NO: 589208 - DNA, 13 bp, D. melanogaster
atgtgtaaatatg

SEQ ID NO: 589209 - DNA, 14 bp, D. melanogaster
atgtgtaaatatgt

SEQ ID NO: 589210 - DNA, 13 bp, D. melanogaster
atgtgtaaatttt

SEQ ID NO: 589211 - DNA, 13 bp, D. melanogaster
atgtgtaagcaaa

SEQ ID NO: 589212 - DNA, 13 bp, D. melanogaster
atgtgtaataaaa

SEQ ID NO: 589213 - DNA, 13 bp, D. melanogaster
atgtgtaatattt

SEQ ID NO: 589214 - DNA, 13 bp, D. melanogaster
atgtgtaattatt

SEQ ID NO: 589215 - DNA, 13 bp, D. melanogaster
atgtgtaatttaa

SEQ ID NO: 589216 - DNA, 14 bp, D. melanogaster
atgtgtacatatat

SEQ ID NO: 589217 - DNA, 13 bp, D. melanogaster
atgtgtacatatg

SEQ ID NO: 589218 - DNA, 14 bp, D. melanogaster
atgtgtacatatgt

SEQ ID NO: 589219 - DNA, 13 bp, D. melanogaster
atgtgtatataaa

SEQ ID NO: 589220 - DNA, 13 bp, D. melanogaster
atgtgtatataat

SEQ ID NO: 589221 - DNA, 13 bp, D. melanogaster
atgtgtatatatg

SEQ ID NO: 589222 - DNA, 13 bp, D. melanogaster
atgtgtatatatt

SEQ ID NO: 589223 - DNA, 13 bp, D. melanogaster
atgtgtatatgta

SEQ ID NO: 589224 - DNA, 14 bp, D. melanogaster
atgtgtatatgtgt

SEQ ID NO: 589225 - DNA, 13 bp, D. melanogaster
atgtgtatatttg

SEQ ID NO: 589226 - DNA, 13 bp, D. melanogaster
atgtgtatgaaaa

SEQ ID NO: 589227 - DNA, 13 bp, D. melanogaster
atgtgtatgcata

SEQ ID NO: 589228 - DNA, 13 bp, D. melanogaster
atgtgtatgcgtg

SEQ ID NO: 589229 - DNA, 14 bp, D. melanogaster
atgtgtatgtacat

SEQ ID NO: 589230 - DNA, 13 bp, D. melanogaster
atgtgtatgtacg

SEQ ID NO: 589231 - DNA, 13 bp, D. melanogaster
atgtgtatgtatg

SEQ ID NO: 589232 - DNA, 13 bp, D. melanogaster
atgtgtatgtgaa

SEQ ID NO: 589233 - DNA, 13 bp, D. melanogaster
atgtgtatgtgcg

SEQ ID NO: 589234 - DNA, 13 bp, D. melanogaster
atgtgtattgcta

SEQ ID NO: 589235 - DNA, 13 bp, D. melanogaster
atgtgtatttaaa

SEQ ID NO: 589236 - DNA, 13 bp, D. melanogaster
atgtgtcaaaaaa

SEQ ID NO: 589237 - DNA, 13 bp, D. melanogaster
atgtgtctgtgtg

SEQ ID NO: 589238 - DNA, 13 bp, D. melanogaster
atgtgtgagtgag

SEQ ID NO: 589239 - DNA, 13 bp, D. melanogaster
atgtgtgagtgtg

SEQ ID NO: 589240 - DNA, 14 bp, D. melanogaster
atgtgtgagtgtgt

SEQ ID NO: 589241 - DNA, 13 bp, D. melanogaster
atgtgtgcaaatt

SEQ ID NO: 589242 - DNA, 13 bp, D. melanogaster
atgtgtgcatgca

SEQ ID NO: 589243 - DNA, 13 bp, D. melanogaster
atgtgtgcatgtg

SEQ ID NO: 589244 - DNA, 14 bp, D. melanogaster
atgtgtgcatgtgt

SEQ ID NO: 589245 - DNA, 13 bp, D. melanogaster
atgtgtgccatgt

SEQ ID NO: 589246 - DNA, 13 bp, D. melanogaster
atgtgtgcgtatg

SEQ ID NO: 589247 - DNA, 14 bp, D. melanogaster
atgtgtgcgtgcgt

SEQ ID NO: 589248 - DNA, 13 bp, D. melanogaster
atgtgtgcgtggg

SEQ ID NO: 589249 - DNA, 13 bp, D. melanogaster
atgtgtgctcttt

SEQ ID NO: 589250 - DNA, 13 bp, D. melanogaster
atgtgtgtaaatt

SEQ ID NO: 589251 - DNA, 13 bp, D. melanogaster
atgtgtgtacata

SEQ ID NO: 589252 - DNA, 13 bp, D. melanogaster
atgtgtgtatgta

SEQ ID NO: 589253 - DNA, 13 bp, D. melanogaster
atgtgtgtatgtg

SEQ ID NO: 589254 - DNA, 14 bp, D. melanogaster
atgtgtgtatgtgc

SEQ ID NO: 589255 - DNA, 14 bp, D. melanogaster
atgtgtgtatgtgt

SEQ ID NO: 589256 - DNA, 13 bp, D. melanogaster
atgtgtgtccttt

SEQ ID NO: 589257 - DNA, 14 bp, D. melanogaster
atgtgtgtctgtgt

SEQ ID NO: 589258 - DNA, 13 bp, D. melanogaster
atgtgtgtgcatg

SEQ ID NO: 589259 - DNA, 14 bp, D. melanogaster
atgtgtgtgcctgt

SEQ ID NO: 589260 - DNA, 13 bp, D. melanogaster
atgtgtgtgcgaa

SEQ ID NO: 589261 - DNA, 13 bp, D. melanogaster
atgtgtgtgcgag

SEQ ID NO: 589262 - DNA, 14 bp, D. melanogaster
atgtgtgtgcgagt

SEQ ID NO: 589263 - DNA, 13 bp, D. melanogaster
atgtgtgtgcgct

SEQ ID NO: 589264 - DNA, 13 bp, D. melanogaster
atgtgtgtgcgtg

SEQ ID NO: 589265 - DNA, 14 bp, D. melanogaster
atgtgtgtgcgtgt

SEQ ID NO: 589266 - DNA, 13 bp, D. melanogaster
atgtgtgtgcgtt

SEQ ID NO: 589267 - DNA, 13 bp, D. melanogaster
atgtgtgtgctgc

SEQ ID NO: 589268 - DNA, 13 bp, D. melanogaster
atgtgtgtggaaa

SEQ ID NO: 589269 - DNA, 13 bp, D. melanogaster
atgtgtgtggctg

SEQ ID NO: 589270 - DNA, 14 bp, D. melanogaster
atgtgtgtgtacat

SEQ ID NO: 589271 - DNA, 13 bp, D. melanogaster
atgtgtgtgtacg

SEQ ID NO: 589272 - DNA, 13 bp, D. melanogaster
atgtgtgtgtatg

SEQ ID NO: 589273 - DNA, 14 bp, D. melanogaster
atgtgtgtgtatgt

SEQ ID NO: 589274 - DNA, 13 bp, D. melanogaster
atgtgtgtgtatt

SEQ ID NO: 589275 - DNA, 13 bp, D. melanogaster
atgtgtgtgtctg

SEQ ID NO: 589276 - DNA, 14 bp, D. melanogaster
atgtgtgtgtctgt

SEQ ID NO: 589277 - DNA, 13 bp, D. melanogaster
atgtgtgtgtgcg

SEQ ID NO: 589278 - DNA, 14 bp, D. melanogaster
atgtgtgtgtgcgt

SEQ ID NO: 589279 - DNA, 13 bp, D. melanogaster
atgtgtgtgtgta

SEQ ID NO: 589280 - DNA, 14 bp, D. melanogaster
atgtgtgtgtgtaa

SEQ ID NO: 589281 - DNA, 14 bp, D. melanogaster
atgtgtgtgtgtga

SEQ ID NO: 589282 - DNA, 14 bp, D. melanogaster
atgtgtgtgtgtgc

SEQ ID NO: 589283 - DNA, 13 bp, D. melanogaster
atgtgtgtttgta

SEQ ID NO: 589284 - DNA, 13 bp, D. melanogaster
atgtgttaaaaat

SEQ ID NO: 589285 - DNA, 14 bp, D. melanogaster
atgtgttaaaattt

SEQ ID NO: 589286 - DNA, 13 bp, D. melanogaster
atgtgttatacca

SEQ ID NO: 589287 - DNA, 13 bp, D. melanogaster
atgtgttatgtgt

SEQ ID NO: 589288 - DNA, 13 bp, D. melanogaster
atgtgttcttcat

SEQ ID NO: 589289 - DNA, 13 bp, D. melanogaster
atgtgttggccaa

SEQ ID NO: 589290 - DNA, 14 bp, D. melanogaster
atgtgttggtagag

SEQ ID NO: 589291 - DNA, 13 bp, D. melanogaster
atgtgttgtctgt

SEQ ID NO: 589292 - DNA, 13 bp, D. melanogaster
atgtgtttaaaaa

SEQ ID NO: 589293 - DNA, 13 bp, D. melanogaster
atgtgtttacttt

SEQ ID NO: 589294 - DNA, 13 bp, D. melanogaster
atgtgtttagcat

SEQ ID NO: 589295 - DNA, 14 bp, D. melanogaster
atgtgtttagcatg

SEQ ID NO: 589296 - DNA, 13 bp, D. melanogaster
atgtgtttataaa

SEQ ID NO: 589297 - DNA, 13 bp, D. melanogaster
atgtgtttgaaaa

SEQ ID NO: 589298 - DNA, 13 bp, D. melanogaster
atgtgtttgcctt

SEQ ID NO: 589299 - DNA, 13 bp, D. melanogaster
atgtgtttgtaaa

SEQ ID NO: 589300 - DNA, 13 bp, D. melanogaster
atgtgttttaaat

SEQ ID NO: 589301 - DNA, 14 bp, D. melanogaster
atgtgtttttcgga

SEQ ID NO: 589302 - DNA, 13 bp, D. melanogaster
atgttaaaaagac

SEQ ID NO: 589303 - DNA, 13 bp, D. melanogaster
atgttaaaacaaa

SEQ ID NO: 589304 - DNA, 13 bp, D. melanogaster
atgttaaacatcc

SEQ ID NO: 589305 - DNA, 13 bp, D. melanogaster
atgttaaagagtc

SEQ ID NO: 589306 - DNA, 13 bp, D. melanogaster
atgttaaatgttc

SEQ ID NO: 589307 - DNA, 13 bp, D. melanogaster
atgttaaattgtt

SEQ ID NO: 589308 - DNA, 13 bp, D. melanogaster
atgttaactccaa

SEQ ID NO: 589309 - DNA, 13 bp, D. melanogaster
atgttaacttttt

SEQ ID NO: 589310 - DNA, 13 bp, D. melanogaster
atgttaagtattt

SEQ ID NO: 589311 - DNA, 13 bp, D. melanogaster
atgttaatacttt

SEQ ID NO: 589312 - DNA, 13 bp, D. melanogaster
atgttaatgaact

SEQ ID NO: 589313 - DNA, 13 bp, D. melanogaster
atgttaattactt

SEQ ID NO: 589314 - DNA, 13 bp, D. melanogaster
atgttacagaaat

SEQ ID NO: 589315 - DNA, 13 bp, D. melanogaster
atgttacatattt

SEQ ID NO: 589316 - DNA, 13 bp, D. melanogaster
atgttaccgtagt

SEQ ID NO: 589317 - DNA, 13 bp, D. melanogaster
atgttacctttgt

SEQ ID NO: 589318 - DNA, 13 bp, D. melanogaster
atgttacttcttt

SEQ ID NO: 589319 - DNA, 13 bp, D. melanogaster
atgttagcaattt

SEQ ID NO: 589320 - DNA, 13 bp, D. melanogaster
atgttatactcaa

SEQ ID NO: 589321 - DNA, 13 bp, D. melanogaster
atgttatatatgt

SEQ ID NO: 589322 - DNA, 13 bp, D. melanogaster
atgttatatattc

SEQ ID NO: 589323 - DNA, 13 bp, D. melanogaster
atgttatcatcat

SEQ ID NO: 589324 - DNA, 13 bp, D. melanogaster
atgttatgatcaa

SEQ ID NO: 589325 - DNA, 13 bp, D. melanogaster
atgttatgttaat

SEQ ID NO: 589326 - DNA, 13 bp, D. melanogaster
atgttattgaaaa

SEQ ID NO: 589327 - DNA, 13 bp, D. melanogaster
atgttcaaaaatg

SEQ ID NO: 589328 - DNA, 13 bp, D. melanogaster
atgttcaaaagca

SEQ ID NO: 589329 - DNA, 14 bp, D. melanogaster
atgttcaaaatgtt

SEQ ID NO: 589330 - DNA, 14 bp, D. melanogaster
atgttcaaataaat

SEQ ID NO: 589331 - DNA, 13 bp, D. melanogaster
atgttcaaatgtt

SEQ ID NO: 589332 - DNA, 13 bp, D. melanogaster
atgttcaactttt

SEQ ID NO: 589333 - DNA, 13 bp, D. melanogaster
atgttcaattcga

SEQ ID NO: 589334 - DNA, 13 bp, D. melanogaster
atgttcacaattt

SEQ ID NO: 589335 - DNA, 13 bp, D. melanogaster
atgttcataaatt

SEQ ID NO: 589336 - DNA, 13 bp, D. melanogaster
atgttcatttttc

SEQ ID NO: 589337 - DNA, 13 bp, D. melanogaster
atgttccattcga

SEQ ID NO: 589338 - DNA, 13 bp, D. melanogaster
atgttcctgaaat

SEQ ID NO: 589339 - DNA, 13 bp, D. melanogaster
atgttcgaatttt

SEQ ID NO: 589340 - DNA, 14 bp, D. melanogaster
atgttcggaatgag

SEQ ID NO: 589341 - DNA, 13 bp, D. melanogaster
atgttcgttttcc

SEQ ID NO: 589342 - DNA, 13 bp, D. melanogaster
atgttctcaattc

SEQ ID NO: 589343 - DNA, 13 bp, D. melanogaster
atgttctggagct

SEQ ID NO: 589344 - DNA, 14 bp, D. melanogaster
atgttctggagctt

SEQ ID NO: 589345 - DNA, 13 bp, D. melanogaster
atgttcttcattt

SEQ ID NO: 589346 - DNA, 13 bp, D. melanogaster
atgttcttgattt

SEQ ID NO: 589347 - DNA, 14 bp, D. melanogaster
atgttgaaaaaatt

SEQ ID NO: 589348 - DNA, 13 bp, D. melanogaster
atgttgaaaaatg

SEQ ID NO: 589349 - DNA, 13 bp, D. melanogaster
atgttgaacattt

SEQ ID NO: 589350 - DNA, 13 bp, D. melanogaster
atgttgaataaaa

SEQ ID NO: 589351 - DNA, 13 bp, D. melanogaster
atgttgaatgttg

SEQ ID NO: 589352 - DNA, 14 bp, D. melanogaster
atgttgaattttca

SEQ ID NO: 589353 - DNA, 13 bp, D. melanogaster
atgttgacatttt

SEQ ID NO: 589354 - DNA, 13 bp, D. melanogaster
atgttgagattgt

SEQ ID NO: 589355 - DNA, 13 bp, D. melanogaster
atgttgatatatt

SEQ ID NO: 589356 - DNA, 13 bp, D. melanogaster
atgttgatgatga

SEQ ID NO: 589357 - DNA, 14 bp, D. melanogaster
atgttgatgatgat

SEQ ID NO: 589358 - DNA, 14 bp, D. melanogaster
atgttgatgttgat

SEQ ID NO: 589359 - DNA, 13 bp, D. melanogaster
atgttgatgttgc

SEQ ID NO: 589360 - DNA, 13 bp, D. melanogaster
atgttgattgaat

SEQ ID NO: 589361 - DNA, 14 bp, D. melanogaster
atgttgcaaataca

SEQ ID NO: 589362 - DNA, 13 bp, D. melanogaster
atgttgcaacaat

SEQ ID NO: 589363 - DNA, 13 bp, D. melanogaster
atgttgcacattt

SEQ ID NO: 589364 - DNA, 13 bp, D. melanogaster
atgttgcagcaac

SEQ ID NO: 589365 - DNA, 13 bp, D. melanogaster
atgttgcaggagt

SEQ ID NO: 589366 - DNA, 13 bp, D. melanogaster
atgttgcagtttg

SEQ ID NO: 589367 - DNA, 13 bp, D. melanogaster
atgttgcatgctg

SEQ ID NO: 589368 - DNA, 13 bp, D. melanogaster
atgttgcatgtgg

SEQ ID NO: 589369 - DNA, 14 bp, D. melanogaster
atgttgcatgttgc

SEQ ID NO: 589370 - DNA, 13 bp, D. melanogaster
atgttgccaaatg

SEQ ID NO: 589371 - DNA, 13 bp, D. melanogaster
atgttgccacgcc

SEQ ID NO: 589372 - DNA, 13 bp, D. melanogaster
atgttgccatttt

SEQ ID NO: 589373 - DNA, 14 bp, D. melanogaster
atgttgccgctgct

SEQ ID NO: 589374 - DNA, 13 bp, D. melanogaster
atgttgccggtaa

SEQ ID NO: 589375 - DNA, 13 bp, D. melanogaster
atgttgcctactt

SEQ ID NO: 589376 - DNA, 13 bp, D. melanogaster
atgttgccttttc

SEQ ID NO: 589377 - DNA, 13 bp, D. melanogaster
atgttgcgtttta

SEQ ID NO: 589378 - DNA, 13 bp, D. melanogaster
atgttgctgcaac

SEQ ID NO: 589379 - DNA, 13 bp, D. melanogaster
atgttgctgccgc

SEQ ID NO: 589380 - DNA, 14 bp, D. melanogaster
atgttgctgccgtg

SEQ ID NO: 589381 - DNA, 14 bp, D. melanogaster
atgttgctgctcaa

SEQ ID NO: 589382 - DNA, 13 bp, D. melanogaster
atgttgctgctgc

SEQ ID NO: 589383 - DNA, 13 bp, D. melanogaster
atgttgctgctgg

SEQ ID NO: 589384 - DNA, 14 bp, D. melanogaster
atgttgctgctggc

SEQ ID NO: 589385 - DNA, 13 bp, D. melanogaster
atgttgctgctgt

SEQ ID NO: 589386 - DNA, 13 bp, D. melanogaster
atgttgctggcaa

SEQ ID NO: 589387 - DNA, 13 bp, D. melanogaster
atgttgctgttgt

SEQ ID NO: 589388 - DNA, 13 bp, D. melanogaster
atgttggatgttg

SEQ ID NO: 589389 - DNA, 13 bp, D. melanogaster
atgttggcaaatt

SEQ ID NO: 589390 - DNA, 13 bp, D. melanogaster
atgttggccaaaa

SEQ ID NO: 589391 - DNA, 14 bp, D. melanogaster
atgttggccaaaaa

SEQ ID NO: 589392 - DNA, 14 bp, D. melanogaster
atgttggccaaaag

SEQ ID NO: 589393 - DNA, 13 bp, D. melanogaster
atgttggccaaat

SEQ ID NO: 589394 - DNA, 13 bp, D. melanogaster
atgttggccaatt

SEQ ID NO: 589395 - DNA, 13 bp, D. melanogaster
atgttggccacat

SEQ ID NO: 589396 - DNA, 14 bp, D. melanogaster
atgttggccacatt

SEQ ID NO: 589397 - DNA, 13 bp, D. melanogaster
atgttggccattt

SEQ ID NO: 589398 - DNA, 13 bp, D. melanogaster
atgttggcccaaa

SEQ ID NO: 589399 - DNA, 13 bp, D. melanogaster
atgttgtaaataa

SEQ ID NO: 589400 - DNA, 13 bp, D. melanogaster
atgttgtaaatat

SEQ ID NO: 589401 - DNA, 13 bp, D. melanogaster
atgttgtaaatgt

SEQ ID NO: 589402 - DNA, 13 bp, D. melanogaster
atgttgtaattgt

SEQ ID NO: 589403 - DNA, 13 bp, D. melanogaster
atgttgtcgcatt

SEQ ID NO: 589404 - DNA, 13 bp, D. melanogaster
atgttgtgctaaa

SEQ ID NO: 589405 - DNA, 13 bp, D. melanogaster
atgttgtgcttaa

SEQ ID NO: 589406 - DNA, 13 bp, D. melanogaster
atgttgtggcagt

SEQ ID NO: 589407 - DNA, 14 bp, D. melanogaster
atgttgtgtacgct

SEQ ID NO: 589408 - DNA, 13 bp, D. melanogaster
atgttgttgctgc

SEQ ID NO: 589409 - DNA, 14 bp, D. melanogaster
atgttgttgctgct

SEQ ID NO: 589410 - DNA, 13 bp, D. melanogaster
atgttgttgctgt

SEQ ID NO: 589411 - DNA, 13 bp, D. melanogaster
atgtttaaaaatg

SEQ ID NO: 589412 - DNA, 13 bp, D. melanogaster
atgtttaaaactt

SEQ ID NO: 589413 - DNA, 14 bp, D. melanogaster
atgtttaaaataag

SEQ ID NO: 589414 - DNA, 13 bp, D. melanogaster
atgtttaaacaaa

SEQ ID NO: 589415 - DNA, 13 bp, D. melanogaster
atgtttaaacggc

SEQ ID NO: 589416 - DNA, 14 bp, D. melanogaster
atgtttaaagatga

SEQ ID NO: 589417 - DNA, 13 bp, D. melanogaster
atgtttaaagatt

SEQ ID NO: 589418 - DNA, 13 bp, D. melanogaster
atgtttaaagtta

SEQ ID NO: 589419 - DNA, 14 bp, D. melanogaster
atgtttaaataaac

SEQ ID NO: 589420 - DNA, 13 bp, D. melanogaster
atgtttaaatatc

SEQ ID NO: 589421 - DNA, 13 bp, D. melanogaster
atgtttaaatatg

SEQ ID NO: 589422 - DNA, 13 bp, D. melanogaster
atgtttaacaaca

SEQ ID NO: 589423 - DNA, 14 bp, D. melanogaster
atgtttaacaacag

SEQ ID NO: 589424 - DNA, 14 bp, D. melanogaster
atgtttaacattaa

SEQ ID NO: 589425 - DNA, 13 bp, D. melanogaster
atgtttaacattg

SEQ ID NO: 589426 - DNA, 13 bp, D. melanogaster
atgtttacaaaaa

SEQ ID NO: 589427 - DNA, 13 bp, D. melanogaster
atgtttacaaaat

SEQ ID NO: 589428 - DNA, 13 bp, D. melanogaster
atgtttacaaaca

SEQ ID NO: 589429 - DNA, 13 bp, D. melanogaster
atgtttacaaatt

SEQ ID NO: 589430 - DNA, 13 bp, D. melanogaster
atgtttacaagaa

SEQ ID NO: 589431 - DNA, 13 bp, D. melanogaster
atgtttacaatat

SEQ ID NO: 589432 - DNA, 13 bp, D. melanogaster
atgtttacatttt

SEQ ID NO: 589433 - DNA, 13 bp, D. melanogaster
atgtttactttta

SEQ ID NO: 589434 - DNA, 13 bp, D. melanogaster
atgtttacttttc

SEQ ID NO: 589435 - DNA, 13 bp, D. melanogaster
atgtttataagga

SEQ ID NO: 589436 - DNA, 13 bp, D. melanogaster
atgtttatcaaat

SEQ ID NO: 589437 - DNA, 13 bp, D. melanogaster
atgtttatcaaca

SEQ ID NO: 589438 - DNA, 13 bp, D. melanogaster
atgtttatcaatt

SEQ ID NO: 589439 - DNA, 13 bp, D. melanogaster
atgtttatgctta

SEQ ID NO: 589440 - DNA, 13 bp, D. melanogaster
atgtttatgtaaa

SEQ ID NO: 589441 - DNA, 13 bp, D. melanogaster
atgtttatgtctg

SEQ ID NO: 589442 - DNA, 13 bp, D. melanogaster
atgtttatgttcc

SEQ ID NO: 589443 - DNA, 14 bp, D. melanogaster
atgtttatgttttc

SEQ ID NO: 589444 - DNA, 13 bp, D. melanogaster
atgtttattagca

SEQ ID NO: 589445 - DNA, 13 bp, D. melanogaster
atgtttattgttc

SEQ ID NO: 589446 - DNA, 13 bp, D. melanogaster
atgtttcaaaaaa

SEQ ID NO: 589447 - DNA, 13 bp, D. melanogaster
atgtttcatatat

SEQ ID NO: 589448 - DNA, 13 bp, D. melanogaster
atgtttcatgttt

SEQ ID NO: 589449 - DNA, 13 bp, D. melanogaster
atgtttccttatg

SEQ ID NO: 589450 - DNA, 13 bp, D. melanogaster
atgtttcgatttg

SEQ ID NO: 589451 - DNA, 14 bp, D. melanogaster
atgtttcgatttgg

SEQ ID NO: 589452 - DNA, 13 bp, D. melanogaster
atgtttcgatttt

SEQ ID NO: 589453 - DNA, 13 bp, D. melanogaster
atgtttctatgga

SEQ ID NO: 589454 - DNA, 13 bp, D. melanogaster
atgtttctatgtt

SEQ ID NO: 589455 - DNA, 13 bp, D. melanogaster
atgtttctattta

SEQ ID NO: 589456 - DNA, 13 bp, D. melanogaster
atgtttgaataat

SEQ ID NO: 589457 - DNA, 13 bp, D. melanogaster
atgtttgaatgtt

SEQ ID NO: 589458 - DNA, 14 bp, D. melanogaster
atgtttgagtttta

SEQ ID NO: 589459 - DNA, 13 bp, D. melanogaster
atgtttgatcttc

SEQ ID NO: 589460 - DNA, 13 bp, D. melanogaster
atgtttgattttc

SEQ ID NO: 589461 - DNA, 13 bp, D. melanogaster
atgtttgcaaact

SEQ ID NO: 589462 - DNA, 13 bp, D. melanogaster
atgtttgcaattt

SEQ ID NO: 589463 - DNA, 13 bp, D. melanogaster
atgtttgcacttt

SEQ ID NO: 589464 - DNA, 13 bp, D. melanogaster
atgtttgccattt

SEQ ID NO: 589465 - DNA, 13 bp, D. melanogaster
atgtttgcgccaa

SEQ ID NO: 589466 - DNA, 13 bp, D. melanogaster
atgtttgctaaat

SEQ ID NO: 589467 - DNA, 13 bp, D. melanogaster
atgtttggaaata

SEQ ID NO: 589468 - DNA, 13 bp, D. melanogaster
atgtttggcaaat

SEQ ID NO: 589469 - DNA, 13 bp, D. melanogaster
atgtttggcaatt

SEQ ID NO: 589470 - DNA, 13 bp, D. melanogaster
atgtttgtagtgc

SEQ ID NO: 589471 - DNA, 13 bp, D. melanogaster
atgtttgtatgtg

SEQ ID NO: 589472 - DNA, 13 bp, D. melanogaster
atgtttgttgctt

SEQ ID NO: 589473 - DNA, 13 bp, D. melanogaster
atgtttgtttgca

SEQ ID NO: 589474 - DNA, 13 bp, D. melanogaster
atgttttaaaaag

SEQ ID NO: 589475 - DNA, 14 bp, D. melanogaster
atgttttaaaacaa

SEQ ID NO: 589476 - DNA, 13 bp, D. melanogaster
atgttttaaatgc

SEQ ID NO: 589477 - DNA, 14 bp, D. melanogaster
atgttttaaggctt

SEQ ID NO: 589478 - DNA, 13 bp, D. melanogaster
atgttttaatcaa

SEQ ID NO: 589479 - DNA, 14 bp, D. melanogaster
atgttttaatgttc

SEQ ID NO: 589480 - DNA, 13 bp, D. melanogaster
atgttttatgtgc

SEQ ID NO: 589481 - DNA, 13 bp, D. melanogaster
atgttttcaaaaa

SEQ ID NO: 589482 - DNA, 13 bp, D. melanogaster
atgttttcaaaac

SEQ ID NO: 589483 - DNA, 13 bp, D. melanogaster
atgttttcactcc

SEQ ID NO: 589484 - DNA, 13 bp, D. melanogaster
atgttttcagctt

SEQ ID NO: 589485 - DNA, 14 bp, D. melanogaster
atgttttcattgat

SEQ ID NO: 589486 - DNA, 14 bp, D. melanogaster
atgttttccatttc

SEQ ID NO: 589487 - DNA, 13 bp, D. melanogaster
atgttttcgaaaa

SEQ ID NO: 589488 - DNA, 13 bp, D. melanogaster
atgttttcgcatt

SEQ ID NO: 589489 - DNA, 13 bp, D. melanogaster
atgttttctaatt

SEQ ID NO: 589490 - DNA, 13 bp, D. melanogaster
atgttttgaaatt

SEQ ID NO: 589491 - DNA, 13 bp, D. melanogaster
atgttttgaatat

SEQ ID NO: 589492 - DNA, 13 bp, D. melanogaster
atgttttgacatt

SEQ ID NO: 589493 - DNA, 14 bp, D. melanogaster
atgttttgattaaa

SEQ ID NO: 589494 - DNA, 13 bp, D. melanogaster
atgttttgcatat

SEQ ID NO: 589495 - DNA, 13 bp, D. melanogaster
atgttttgccaat

SEQ ID NO: 589496 - DNA, 13 bp, D. melanogaster
atgttttggctgt

SEQ ID NO: 589497 - DNA, 13 bp, D. melanogaster
atgttttgtttgc

SEQ ID NO: 589498 - DNA, 13 bp, D. melanogaster
atgtttttaaaag

SEQ ID NO: 589499 - DNA, 13 bp, D. melanogaster
atgtttttcaaaa

SEQ ID NO: 589500 - DNA, 13 bp, D. melanogaster
atgtttttcaaat

SEQ ID NO: 589501 - DNA, 13 bp, D. melanogaster
atgtttttcaacc

SEQ ID NO: 589502 - DNA, 13 bp, D. melanogaster
atgtttttcactt

SEQ ID NO: 589503 - DNA, 13 bp, D. melanogaster
atgtttttccatc

SEQ ID NO: 589504 - DNA, 13 bp, D. melanogaster
atgtttttccatt

SEQ ID NO: 589505 - DNA, 13 bp, D. melanogaster
atgtttttgaaaa

SEQ ID NO: 589506 - DNA, 13 bp, D. melanogaster
atgtttttgaagt

SEQ ID NO: 589507 - DNA, 13 bp, D. melanogaster
atgtttttgagca

SEQ ID NO: 589508 - DNA, 13 bp, D. melanogaster
atgttttttaaca

SEQ ID NO: 589509 - DNA, 14 bp, D. melanogaster
atgtttttttcgta

SEQ ID NO: 589510 - DNA, 13 bp, D. melanogaster
attaaaaaacatg

SEQ ID NO: 589511 - DNA, 13 bp, D. melanogaster
attaaaaaagttc

SEQ ID NO: 589512 - DNA, 13 bp, D. melanogaster
attaaaaaatcga

SEQ ID NO: 589513 - DNA, 14 bp, D. melanogaster
attaaaaaatggtt

SEQ ID NO: 589514 - DNA, 13 bp, D. melanogaster
attaaaaaattgc

SEQ ID NO: 589515 - DNA, 13 bp, D. melanogaster
attaaaaacaagt

SEQ ID NO: 589516 - DNA, 13 bp, D. melanogaster
attaaaaacagat

SEQ ID NO: 589517 - DNA, 13 bp, D. melanogaster
attaaaaaccaag

SEQ ID NO: 589518 - DNA, 14 bp, D. melanogaster
attaaaaaccattt

SEQ ID NO: 589519 - DNA, 13 bp, D. melanogaster
attaaaaacgcaa

SEQ ID NO: 589520 - DNA, 13 bp, D. melanogaster
attaaaaacggaa

SEQ ID NO: 589521 - DNA, 13 bp, D. melanogaster
attaaaaacgtaa

SEQ ID NO: 589522 - DNA, 13 bp, D. melanogaster
attaaaaactgca

SEQ ID NO: 589523 - DNA, 13 bp, D. melanogaster
attaaaaacttca

SEQ ID NO: 589524 - DNA, 13 bp, D. melanogaster
attaaaaacttct

SEQ ID NO: 589525 - DNA, 13 bp, D. melanogaster
attaaaaagatcc

SEQ ID NO: 589526 - DNA, 13 bp, D. melanogaster
attaaaaagcata

SEQ ID NO: 589527 - DNA, 13 bp, D. melanogaster
attaaaaagcatt

SEQ ID NO: 589528 - DNA, 13 bp, D. melanogaster
attaaaaagccat

SEQ ID NO: 589529 - DNA, 13 bp, D. melanogaster
attaaaaagcgtg

SEQ ID NO: 589530 - DNA, 13 bp, D. melanogaster
attaaaaagcgtt

SEQ ID NO: 589531 - DNA, 13 bp, D. melanogaster
attaaaaagcttt

SEQ ID NO: 589532 - DNA, 13 bp, D. melanogaster
attaaaaaggatt

SEQ ID NO: 589533 - DNA, 13 bp, D. melanogaster
attaaaaagtgca

SEQ ID NO: 589534 - DNA, 13 bp, D. melanogaster
attaaaaagttca

SEQ ID NO: 589535 - DNA, 13 bp, D. melanogaster
attaaaaagttga

SEQ ID NO: 589536 - DNA, 13 bp, D. melanogaster
attaaaaagttgc

SEQ ID NO: 589537 - DNA, 14 bp, D. melanogaster
attaaaaatcgaaa

SEQ ID NO: 589538 - DNA, 13 bp, D. melanogaster
attaaaaatcgat

SEQ ID NO: 589539 - DNA, 13 bp, D. melanogaster
attaaaaatgcaa

SEQ ID NO: 589540 - DNA, 14 bp, D. melanogaster
attaaaaatgcaaa

SEQ ID NO: 589541 - DNA, 13 bp, D. melanogaster
attaaaaatgcat

SEQ ID NO: 589542 - DNA, 14 bp, D. melanogaster
attaaaaatgcatt

SEQ ID NO: 589543 - DNA, 13 bp, D. melanogaster
attaaaaatgcta

SEQ ID NO: 589544 - DNA, 13 bp, D. melanogaster
attaaaaatggta

SEQ ID NO: 589545 - DNA, 13 bp, D. melanogaster
attaaaaatgtag

SEQ ID NO: 589546 - DNA, 14 bp, D. melanogaster
attaaaaatgtatg

SEQ ID NO: 589547 - DNA, 13 bp, D. melanogaster
attaaaaattcac

SEQ ID NO: 589548 - DNA, 13 bp, D. melanogaster
attaaaaattcca

SEQ ID NO: 589549 - DNA, 13 bp, D. melanogaster
attaaaacaagag

SEQ ID NO: 589550 - DNA, 14 bp, D. melanogaster
attaaaacaggaag

SEQ ID NO: 589551 - DNA, 13 bp, D. melanogaster
attaaaacatctt

SEQ ID NO: 589552 - DNA, 13 bp, D. melanogaster
attaaaaccaaag

SEQ ID NO: 589553 - DNA, 13 bp, D. melanogaster
attaaaaccaatt

SEQ ID NO: 589554 - DNA, 13 bp, D. melanogaster
attaaaaccgaaa

SEQ ID NO: 589555 - DNA, 13 bp, D. melanogaster
attaaaacgaaag

SEQ ID NO: 589556 - DNA, 13 bp, D. melanogaster
attaaaacgaaat

SEQ ID NO: 589557 - DNA, 14 bp, D. melanogaster
attaaaacgaaatt

SEQ ID NO: 589558 - DNA, 13 bp, D. melanogaster
attaaaacgaatc

SEQ ID NO: 589559 - DNA, 13 bp, D. melanogaster
attaaaacgaatt

SEQ ID NO: 589560 - DNA, 14 bp, D. melanogaster
attaaaacgatttt

SEQ ID NO: 589561 - DNA, 13 bp, D. melanogaster
attaaaacgcaat

SEQ ID NO: 589562 - DNA, 13 bp, D. melanogaster
attaaaacgtaaa

SEQ ID NO: 589563 - DNA, 13 bp, D. melanogaster
attaaaactagaa

SEQ ID NO: 589564 - DNA, 13 bp, D. melanogaster
attaaaactcatt

SEQ ID NO: 589565 - DNA, 13 bp, D. melanogaster
attaaaactgttt

SEQ ID NO: 589566 - DNA, 13 bp, D. melanogaster
attaaaacttctt

SEQ ID NO: 589567 - DNA, 13 bp, D. melanogaster
attaaaactttgt

SEQ ID NO: 589568 - DNA, 14 bp, D. melanogaster
attaaaagaaatca

SEQ ID NO: 589569 - DNA, 13 bp, D. melanogaster
attaaaagagcca

SEQ ID NO: 589570 - DNA, 13 bp, D. melanogaster
attaaaagatgat

SEQ ID NO: 589571 - DNA, 14 bp, D. melanogaster
attaaaagcaaaca

SEQ ID NO: 589572 - DNA, 13 bp, D. melanogaster
attaaaagcaaat

SEQ ID NO: 589573 - DNA, 14 bp, D. melanogaster
attaaaagcaaata

SEQ ID NO: 589574 - DNA, 14 bp, D. melanogaster
attaaaagcaaatt

SEQ ID NO: 589575 - DNA, 13 bp, D. melanogaster
attaaaagcaatc

SEQ ID NO: 589576 - DNA, 14 bp, D. melanogaster
attaaaagcaatct

SEQ ID NO: 589577 - DNA, 13 bp, D. melanogaster
attaaaagcaatt

SEQ ID NO: 589578 - DNA, 14 bp, D. melanogaster
attaaaagcaattt

SEQ ID NO: 589579 - DNA, 13 bp, D. melanogaster
attaaaagcagaa

SEQ ID NO: 589580 - DNA, 13 bp, D. melanogaster
attaaaagcataa

SEQ ID NO: 589581 - DNA, 13 bp, D. melanogaster
attaaaagcatca

SEQ ID NO: 589582 - DNA, 14 bp, D. melanogaster
attaaaagcatttt

SEQ ID NO: 589583 - DNA, 14 bp, D. melanogaster
attaaaagccaaaa

SEQ ID NO: 589584 - DNA, 13 bp, D. melanogaster
attaaaagccaac

SEQ ID NO: 589585 - DNA, 13 bp, D. melanogaster
attaaaagcgaaa

SEQ ID NO: 589586 - DNA, 13 bp, D. melanogaster
attaaaagctttt

SEQ ID NO: 589587 - DNA, 14 bp, D. melanogaster
attaaaagctttta

SEQ ID NO: 589588 - DNA, 13 bp, D. melanogaster
attaaaaggcaaa

SEQ ID NO: 589589 - DNA, 13 bp, D. melanogaster
attaaaagtaatc

SEQ ID NO: 589590 - DNA, 14 bp, D. melanogaster
attaaaagtaattg

SEQ ID NO: 589591 - DNA, 13 bp, D. melanogaster
attaaaagtagtc

SEQ ID NO: 589592 - DNA, 13 bp, D. melanogaster
attaaaagtcatt

SEQ ID NO: 589593 - DNA, 13 bp, D. melanogaster
attaaaagtgcca

SEQ ID NO: 589594 - DNA, 13 bp, D. melanogaster
attaaaagtggat

SEQ ID NO: 589595 - DNA, 13 bp, D. melanogaster
attaaaagtgtta

SEQ ID NO: 589596 - DNA, 13 bp, D. melanogaster
attaaaagtgttt

SEQ ID NO: 589597 - DNA, 14 bp, D. melanogaster
attaaaagtgttta

SEQ ID NO: 589598 - DNA, 13 bp, D. melanogaster
attaaaagttcaa

SEQ ID NO: 589599 - DNA, 13 bp, D. melanogaster
attaaaatatcca

SEQ ID NO: 589600 - DNA, 13 bp, D. melanogaster
attaaaatcactt

SEQ ID NO: 589601 - DNA, 14 bp, D. melanogaster
attaaaatcgaatt

SEQ ID NO: 589602 - DNA, 13 bp, D. melanogaster
attaaaatcgatt

SEQ ID NO: 589603 - DNA, 13 bp, D. melanogaster
attaaaatctaag

SEQ ID NO: 589604 - DNA, 13 bp, D. melanogaster
attaaaatgcaaa

SEQ ID NO: 589605 - DNA, 14 bp, D. melanogaster
attaaaatgcaaaa

SEQ ID NO: 589606 - DNA, 14 bp, D. melanogaster
attaaaatgcaatt

SEQ ID NO: 589607 - DNA, 13 bp, D. melanogaster
attaaaatgcaca

SEQ ID NO: 589608 - DNA, 14 bp, D. melanogaster
attaaaatgcactt

SEQ ID NO: 589609 - DNA, 14 bp, D. melanogaster
attaaaatgcataa

SEQ ID NO: 589610 - DNA, 14 bp, D. melanogaster
attaaaatgcattt

SEQ ID NO: 589611 - DNA, 13 bp, D. melanogaster
attaaaatgccaa

SEQ ID NO: 589612 - DNA, 14 bp, D. melanogaster
attaaaatgccatt

SEQ ID NO: 589613 - DNA, 13 bp, D. melanogaster
attaaaatgcgat

SEQ ID NO: 589614 - DNA, 14 bp, D. melanogaster
attaaaatgctttt

SEQ ID NO: 589615 - DNA, 14 bp, D. melanogaster
attaaaatggaatt

SEQ ID NO: 589616 - DNA, 13 bp, D. melanogaster
attaaaatggata

SEQ ID NO: 589617 - DNA, 13 bp, D. melanogaster
attaaaatggttt

SEQ ID NO: 589618 - DNA, 13 bp, D. melanogaster
attaaaatgtact

SEQ ID NO: 589619 - DNA, 13 bp, D. melanogaster
attaaaatgtcaa

SEQ ID NO: 589620 - DNA, 13 bp, D. melanogaster
attaaaatgtttg

SEQ ID NO: 589621 - DNA, 14 bp, D. melanogaster
attaaaatgtttgc

SEQ ID NO: 589622 - DNA, 13 bp, D. melanogaster
attaaaattaacc

SEQ ID NO: 589623 - DNA, 13 bp, D. melanogaster
attaaaattaggt

SEQ ID NO: 589624 - DNA, 13 bp, D. melanogaster
attaaaattccca

SEQ ID NO: 589625 - DNA, 13 bp, D. melanogaster
attaaaattcgca

SEQ ID NO: 589626 - DNA, 13 bp, D. melanogaster
attaaaattgaag

SEQ ID NO: 589627 - DNA, 13 bp, D. melanogaster
attaaaattgagc

SEQ ID NO: 589628 - DNA, 14 bp, D. melanogaster
attaaaattgattg

SEQ ID NO: 589629 - DNA, 14 bp, D. melanogaster
attaaaattgcaaa

SEQ ID NO: 589630 - DNA, 13 bp, D. melanogaster
attaaaattggca

SEQ ID NO: 589631 - DNA, 13 bp, D. melanogaster
attaaaattgtga

SEQ ID NO: 589632 - DNA, 14 bp, D. melanogaster
attaaaattgtgaa

SEQ ID NO: 589633 - DNA, 14 bp, D. melanogaster
attaaaatttacga

SEQ ID NO: 589634 - DNA, 13 bp, D. melanogaster
attaaaatttctg

SEQ ID NO: 589635 - DNA, 14 bp, D. melanogaster
attaaaatttgcaa

SEQ ID NO: 589636 - DNA, 13 bp, D. melanogaster
attaaacaaaagt

SEQ ID NO: 589637 - DNA, 13 bp, D. melanogaster
attaaacaaggtg

SEQ ID NO: 589638 - DNA, 13 bp, D. melanogaster
attaaacaattgc

SEQ ID NO: 589639 - DNA, 13 bp, D. melanogaster
attaaacaatttc

SEQ ID NO: 589640 - DNA, 13 bp, D. melanogaster
attaaacacgaaa

SEQ ID NO: 589641 - DNA, 13 bp, D. melanogaster
attaaacagcaat

SEQ ID NO: 589642 - DNA, 13 bp, D. melanogaster
attaaacatcttt

SEQ ID NO: 589643 - DNA, 13 bp, D. melanogaster
attaaacatgcat

SEQ ID NO: 589644 - DNA, 13 bp, D. melanogaster
attaaacatttag

SEQ ID NO: 589645 - DNA, 13 bp, D. melanogaster
attaaaccaagga

SEQ ID NO: 589646 - DNA, 13 bp, D. melanogaster
attaaaccatcaa

SEQ ID NO: 589647 - DNA, 14 bp, D. melanogaster
attaaaccatcaac

SEQ ID NO: 589648 - DNA, 13 bp, D. melanogaster
attaaacgaaaat

SEQ ID NO: 589649 - DNA, 13 bp, D. melanogaster
attaaacgaaatt

SEQ ID NO: 589650 - DNA, 13 bp, D. melanogaster
attaaacgattta

SEQ ID NO: 589651 - DNA, 13 bp, D. melanogaster
attaaacgcattt

SEQ ID NO: 589652 - DNA, 13 bp, D. melanogaster
attaaacggaaat

SEQ ID NO: 589653 - DNA, 13 bp, D. melanogaster
attaaacgttttt

SEQ ID NO: 589654 - DNA, 13 bp, D. melanogaster
attaaactaaact

SEQ ID NO: 589655 - DNA, 13 bp, D. melanogaster
attaaactacaat

SEQ ID NO: 589656 - DNA, 13 bp, D. melanogaster
attaaactagaaa

SEQ ID NO: 589657 - DNA, 13 bp, D. melanogaster
attaaactgcaaa

SEQ ID NO: 589658 - DNA, 13 bp, D. melanogaster
attaaactgtttt

SEQ ID NO: 589659 - DNA, 13 bp, D. melanogaster
attaaacttaaag

SEQ ID NO: 589660 - DNA, 13 bp, D. melanogaster
attaaagaaaact

SEQ ID NO: 589661 - DNA, 13 bp, D. melanogaster
attaaagaaattg

SEQ ID NO: 589662 - DNA, 13 bp, D. melanogaster
attaaagaacgtt

SEQ ID NO: 589663 - DNA, 13 bp, D. melanogaster
attaaagaagagg

SEQ ID NO: 589664 - DNA, 13 bp, D. melanogaster
attaaagacccat

SEQ ID NO: 589665 - DNA, 13 bp, D. melanogaster
attaaagacgaaa

SEQ ID NO: 589666 - DNA, 13 bp, D. melanogaster
attaaagagaaca

SEQ ID NO: 589667 - DNA, 13 bp, D. melanogaster
attaaagcaaact

SEQ ID NO: 589668 - DNA, 13 bp, D. melanogaster
attaaagcaaagc

SEQ ID NO: 589669 - DNA, 13 bp, D. melanogaster
attaaagcaagaa

SEQ ID NO: 589670 - DNA, 13 bp, D. melanogaster
attaaagcaattg

SEQ ID NO: 589671 - DNA, 13 bp, D. melanogaster
attaaagcacaaa

SEQ ID NO: 589672 - DNA, 13 bp, D. melanogaster
attaaagcagaaa

SEQ ID NO: 589673 - DNA, 14 bp, D. melanogaster
attaaagcatttaa

SEQ ID NO: 589674 - DNA, 13 bp, D. melanogaster
attaaagcatttt

SEQ ID NO: 589675 - DNA, 13 bp, D. melanogaster
attaaagccaaaa

SEQ ID NO: 589676 - DNA, 13 bp, D. melanogaster
attaaagccaagc

SEQ ID NO: 589677 - DNA, 13 bp, D. melanogaster
attaaagccagct

SEQ ID NO: 589678 - DNA, 14 bp, D. melanogaster
attaaagccagcta

SEQ ID NO: 589679 - DNA, 13 bp, D. melanogaster
attaaagccattt

SEQ ID NO: 589680 - DNA, 13 bp, D. melanogaster
attaaagcgattt

SEQ ID NO: 589681 - DNA, 13 bp, D. melanogaster
attaaagctgaaa

SEQ ID NO: 589682 - DNA, 13 bp, D. melanogaster
attaaagctttaa

SEQ ID NO: 589683 - DNA, 13 bp, D. melanogaster
attaaaggacttt

SEQ ID NO: 589684 - DNA, 13 bp, D. melanogaster
attaaaggatgag

SEQ ID NO: 589685 - DNA, 13 bp, D. melanogaster
attaaaggcaaac

SEQ ID NO: 589686 - DNA, 13 bp, D. melanogaster
attaaagggaaat

SEQ ID NO: 589687 - DNA, 13 bp, D. melanogaster
attaaaggtattt

SEQ ID NO: 589688 - DNA, 13 bp, D. melanogaster
attaaagtaaaca

SEQ ID NO: 589689 - DNA, 13 bp, D. melanogaster
attaaagtcaaaa

SEQ ID NO: 589690 - DNA, 13 bp, D. melanogaster
attaaagtcaaca

SEQ ID NO: 589691 - DNA, 13 bp, D. melanogaster
attaaagtcattt

SEQ ID NO: 589692 - DNA, 13 bp, D. melanogaster
attaaagtgaaac

SEQ ID NO: 589693 - DNA, 13 bp, D. melanogaster
attaaagtgaaat

SEQ ID NO: 589694 - DNA, 14 bp, D. melanogaster
attaaagtgaaatt

SEQ ID NO: 589695 - DNA, 13 bp, D. melanogaster
attaaagtgcaaa

SEQ ID NO: 589696 - DNA, 13 bp, D. melanogaster
attaaagtgctaa

SEQ ID NO: 589697 - DNA, 13 bp, D. melanogaster
attaaagtgtaaa

SEQ ID NO: 589698 - DNA, 13 bp, D. melanogaster
attaaagtgtatt

SEQ ID NO: 589699 - DNA, 13 bp, D. melanogaster
attaaagtgttaa

SEQ ID NO: 589700 - DNA, 13 bp, D. melanogaster
attaaagtgtttc

SEQ ID NO: 589701 - DNA, 13 bp, D. melanogaster
attaaagttaaac

SEQ ID NO: 589702 - DNA, 14 bp, D. melanogaster
attaaagttaaagc

SEQ ID NO: 589703 - DNA, 13 bp, D. melanogaster
attaaagttcaat

SEQ ID NO: 589704 - DNA, 13 bp, D. melanogaster
attaaagtttcaa

SEQ ID NO: 589705 - DNA, 13 bp, D. melanogaster
attaaagtttgtt

SEQ ID NO: 589706 - DNA, 13 bp, D. melanogaster
attaaagttttac

SEQ ID NO: 589707 - DNA, 13 bp, D. melanogaster
attaaagttttgc

SEQ ID NO: 589708 - DNA, 14 bp, D. melanogaster
attaaataaaatgc

SEQ ID NO: 589709 - DNA, 13 bp, D. melanogaster
attaaataatgca

SEQ ID NO: 589710 - DNA, 13 bp, D. melanogaster
attaaataatgcc

SEQ ID NO: 589711 - DNA, 13 bp, D. melanogaster
attaaatacaaag

SEQ ID NO: 589712 - DNA, 13 bp, D. melanogaster
attaaatacattc

SEQ ID NO: 589713 - DNA, 13 bp, D. melanogaster
attaaataccaat

SEQ ID NO: 589714 - DNA, 13 bp, D. melanogaster
attaaatacgaaa

SEQ ID NO: 589715 - DNA, 13 bp, D. melanogaster
attaaatacgttt

SEQ ID NO: 589716 - DNA, 13 bp, D. melanogaster
attaaatagcaat

SEQ ID NO: 589717 - DNA, 13 bp, D. melanogaster
attaaatagcatt

SEQ ID NO: 589718 - DNA, 13 bp, D. melanogaster
attaaatatgcaa

SEQ ID NO: 589719 - DNA, 14 bp, D. melanogaster
attaaatatgcaaa

SEQ ID NO: 589720 - DNA, 13 bp, D. melanogaster
attaaatattcag

SEQ ID NO: 589721 - DNA, 13 bp, D. melanogaster
attaaatcaaaag

SEQ ID NO: 589722 - DNA, 13 bp, D. melanogaster
attaaatcaaggc

SEQ ID NO: 589723 - DNA, 13 bp, D. melanogaster
attaaatcaatgt

SEQ ID NO: 589724 - DNA, 13 bp, D. melanogaster
attaaatcagttt

SEQ ID NO: 589725 - DNA, 13 bp, D. melanogaster
attaaatcatact

SEQ ID NO: 589726 - DNA, 14 bp, D. melanogaster
attaaatcatactg

SEQ ID NO: 589727 - DNA, 13 bp, D. melanogaster
attaaatcatttg

SEQ ID NO: 589728 - DNA, 13 bp, D. melanogaster
attaaatccaatt

SEQ ID NO: 589729 - DNA, 13 bp, D. melanogaster
attaaatcgaaac

SEQ ID NO: 589730 - DNA, 13 bp, D. melanogaster
attaaatcgaaat

SEQ ID NO: 589731 - DNA, 13 bp, D. melanogaster
attaaatcgattt

SEQ ID NO: 589732 - DNA, 13 bp, D. melanogaster
attaaatcgcaaa

SEQ ID NO: 589733 - DNA, 13 bp, D. melanogaster
attaaatcgcaat

SEQ ID NO: 589734 - DNA, 13 bp, D. melanogaster
attaaatctgcaa

SEQ ID NO: 589735 - DNA, 13 bp, D. melanogaster
attaaatgaaaac

SEQ ID NO: 589736 - DNA, 14 bp, D. melanogaster
attaaatgaaaatc

SEQ ID NO: 589737 - DNA, 13 bp, D. melanogaster
attaaatgaaagt

SEQ ID NO: 589738 - DNA, 14 bp, D. melanogaster
attaaatgaaatgc

SEQ ID NO: 589739 - DNA, 13 bp, D. melanogaster
attaaatgacaaa

SEQ ID NO: 589740 - DNA, 14 bp, D. melanogaster
attaaatgacaaaa

SEQ ID NO: 589741 - DNA, 13 bp, D. melanogaster
attaaatgagatt

SEQ ID NO: 589742 - DNA, 13 bp, D. melanogaster
attaaatgcaaat

SEQ ID NO: 589743 - DNA, 14 bp, D. melanogaster
attaaatgcaaata

SEQ ID NO: 589744 - DNA, 13 bp, D. melanogaster
attaaatgcaatt

SEQ ID NO: 589745 - DNA, 14 bp, D. melanogaster
attaaatgcaattt

SEQ ID NO: 589746 - DNA, 13 bp, D. melanogaster
attaaatgcactt

SEQ ID NO: 589747 - DNA, 14 bp, D. melanogaster
attaaatgcacttt

SEQ ID NO: 589748 - DNA, 13 bp, D. melanogaster
attaaatgcagtt

SEQ ID NO: 589749 - DNA, 13 bp, D. melanogaster
attaaatgcattc

SEQ ID NO: 589750 - DNA, 13 bp, D. melanogaster
attaaatgcattt

SEQ ID NO: 589751 - DNA, 13 bp, D. melanogaster
attaaatgccatt

SEQ ID NO: 589752 - DNA, 13 bp, D. melanogaster
attaaatgcgatt

SEQ ID NO: 589753 - DNA, 13 bp, D. melanogaster
attaaatgctatt

SEQ ID NO: 589754 - DNA, 14 bp, D. melanogaster
attaaatgcttaaa

SEQ ID NO: 589755 - DNA, 13 bp, D. melanogaster
attaaatgctttt

SEQ ID NO: 589756 - DNA, 13 bp, D. melanogaster
attaaatggaact

SEQ ID NO: 589757 - DNA, 13 bp, D. melanogaster
attaaatggagaa

SEQ ID NO: 589758 - DNA, 13 bp, D. melanogaster
attaaatggcaac

SEQ ID NO: 589759 - DNA, 13 bp, D. melanogaster
attaaatggcaat

SEQ ID NO: 589760 - DNA, 13 bp, D. melanogaster
attaaatggcata

SEQ ID NO: 589761 - DNA, 13 bp, D. melanogaster
attaaatgtgaaa

SEQ ID NO: 589762 - DNA, 13 bp, D. melanogaster
attaaatgtgaat

SEQ ID NO: 589763 - DNA, 13 bp, D. melanogaster
attaaatgtgcag

SEQ ID NO: 589764 - DNA, 13 bp, D. melanogaster
attaaatgtggaa

SEQ ID NO: 589765 - DNA, 13 bp, D. melanogaster
attaaatgtgtgc

SEQ ID NO: 589766 - DNA, 13 bp, D. melanogaster
attaaatgttcat

SEQ ID NO: 589767 - DNA, 13 bp, D. melanogaster
attaaatgttctt

SEQ ID NO: 589768 - DNA, 13 bp, D. melanogaster
attaaatgttgtg

SEQ ID NO: 589769 - DNA, 13 bp, D. melanogaster
attaaatgtttac

SEQ ID NO: 589770 - DNA, 14 bp, D. melanogaster
attaaattaagcaa

SEQ ID NO: 589771 - DNA, 13 bp, D. melanogaster
attaaattaagct

SEQ ID NO: 589772 - DNA, 13 bp, D. melanogaster
attaaattaccaa

SEQ ID NO: 589773 - DNA, 13 bp, D. melanogaster
attaaattactca

SEQ ID NO: 589774 - DNA, 13 bp, D. melanogaster
attaaattcaaca

SEQ ID NO: 589775 - DNA, 13 bp, D. melanogaster
attaaattcagaa

SEQ ID NO: 589776 - DNA, 13 bp, D. melanogaster
attaaattcagca

SEQ ID NO: 589777 - DNA, 13 bp, D. melanogaster
attaaattcagtt

SEQ ID NO: 589778 - DNA, 13 bp, D. melanogaster
attaaattcctat

SEQ ID NO: 589779 - DNA, 13 bp, D. melanogaster
attaaattcgaat

SEQ ID NO: 589780 - DNA, 13 bp, D. melanogaster
attaaattcgatt

SEQ ID NO: 589781 - DNA, 13 bp, D. melanogaster
attaaattcttca

SEQ ID NO: 589782 - DNA, 14 bp, D. melanogaster
attaaattgaaaac

SEQ ID NO: 589783 - DNA, 14 bp, D. melanogaster
attaaattgcaatt

SEQ ID NO: 589784 - DNA, 13 bp, D. melanogaster
attaaattgcata

SEQ ID NO: 589785 - DNA, 14 bp, D. melanogaster
attaaattgcattt

SEQ ID NO: 589786 - DNA, 13 bp, D. melanogaster
attaaattggaat

SEQ ID NO: 589787 - DNA, 13 bp, D. melanogaster
attaaattggcaa

SEQ ID NO: 589788 - DNA, 13 bp, D. melanogaster
attaaattggtaa

SEQ ID NO: 589789 - DNA, 13 bp, D. melanogaster
attaaattggtta

SEQ ID NO: 589790 - DNA, 13 bp, D. melanogaster
attaaattgtaag

SEQ ID NO: 589791 - DNA, 13 bp, D. melanogaster
attaaattgtgca

SEQ ID NO: 589792 - DNA, 13 bp, D. melanogaster
attaaattgttga

SEQ ID NO: 589793 - DNA, 14 bp, D. melanogaster
attaaatttatgca

SEQ ID NO: 589794 - DNA, 14 bp, D. melanogaster
attaaatttccatt

SEQ ID NO: 589795 - DNA, 13 bp, D. melanogaster
attaaatttcgca

SEQ ID NO: 589796 - DNA, 13 bp, D. melanogaster
attaaatttcgct

SEQ ID NO: 589797 - DNA, 13 bp, D. melanogaster
attaaatttcgtt

SEQ ID NO: 589798 - DNA, 13 bp, D. melanogaster
attaaatttcttc

SEQ ID NO: 589799 - DNA, 13 bp, D. melanogaster
attaaatttgcaa

SEQ ID NO: 589800 - DNA, 14 bp, D. melanogaster
attaaatttgcaaa

SEQ ID NO: 589801 - DNA, 13 bp, D. melanogaster
attaaatttgcca

SEQ ID NO: 589802 - DNA, 13 bp, D. melanogaster
attaaatttgtgg

SEQ ID NO: 589803 - DNA, 13 bp, D. melanogaster
attaaattttagc

SEQ ID NO: 589804 - DNA, 13 bp, D. melanogaster
attaaattttcga

SEQ ID NO: 589805 - DNA, 13 bp, D. melanogaster
attaaattttcgt

SEQ ID NO: 589806 - DNA, 13 bp, D. melanogaster
attaacaaaactc

SEQ ID NO: 589807 - DNA, 13 bp, D. melanogaster
attaacaaaatgg

SEQ ID NO: 589808 - DNA, 13 bp, D. melanogaster
attaacaacaatt

SEQ ID NO: 589809 - DNA, 13 bp, D. melanogaster
attaacaacagaa

SEQ ID NO: 589810 - DNA, 13 bp, D. melanogaster
attaacaatcaat

SEQ ID NO: 589811 - DNA, 13 bp, D. melanogaster
attaacaatggaa

SEQ ID NO: 589812 - DNA, 13 bp, D. melanogaster
attaacaattaac

SEQ ID NO: 589813 - DNA, 13 bp, D. melanogaster
attaacaattgta

SEQ ID NO: 589814 - DNA, 13 bp, D. melanogaster
attaacaattgtt

SEQ ID NO: 589815 - DNA, 13 bp, D. melanogaster
attaacaattttc

SEQ ID NO: 589816 - DNA, 13 bp, D. melanogaster
attaacactttaa

SEQ ID NO: 589817 - DNA, 13 bp, D. melanogaster
attaacactttta

SEQ ID NO: 589818 - DNA, 13 bp, D. melanogaster
attaacagcaatt

SEQ ID NO: 589819 - DNA, 13 bp, D. melanogaster
attaacagcagca

SEQ ID NO: 589820 - DNA, 13 bp, D. melanogaster
attaacatgaaaa

SEQ ID NO: 589821 - DNA, 13 bp, D. melanogaster
attaacatgtttt

SEQ ID NO: 589822 - DNA, 13 bp, D. melanogaster
attaacattaact

SEQ ID NO: 589823 - DNA, 13 bp, D. melanogaster
attaacattgaaa

SEQ ID NO: 589824 - DNA, 13 bp, D. melanogaster
attaacattgtgg

SEQ ID NO: 589825 - DNA, 13 bp, D. melanogaster
attaacattgttt

SEQ ID NO: 589826 - DNA, 13 bp, D. melanogaster
attaacattttct

SEQ ID NO: 589827 - DNA, 13 bp, D. melanogaster
attaacattttga

SEQ ID NO: 589828 - DNA, 13 bp, D. melanogaster
attaacatttttc

SEQ ID NO: 589829 - DNA, 13 bp, D. melanogaster
attaaccaaatat

SEQ ID NO: 589830 - DNA, 13 bp, D. melanogaster
attaaccaagtta

SEQ ID NO: 589831 - DNA, 13 bp, D. melanogaster
attaaccacagtc

SEQ ID NO: 589832 - DNA, 13 bp, D. melanogaster
attaaccagaatg

SEQ ID NO: 589833 - DNA, 13 bp, D. melanogaster
attaaccataaat

SEQ ID NO: 589834 - DNA, 13 bp, D. melanogaster
attaaccattaac

SEQ ID NO: 589835 - DNA, 13 bp, D. melanogaster
attaaccattatt

SEQ ID NO: 589836 - DNA, 13 bp, D. melanogaster
attaacccattaa

SEQ ID NO: 589837 - DNA, 13 bp, D. melanogaster
attaacgaaataa

SEQ ID NO: 589838 - DNA, 13 bp, D. melanogaster
attaacgattatt

SEQ ID NO: 589839 - DNA, 13 bp, D. melanogaster
attaacgttaatt

SEQ ID NO: 589840 - DNA, 13 bp, D. melanogaster
attaactaactaa

SEQ ID NO: 589841 - DNA, 13 bp, D. melanogaster
attaactacaatg

SEQ ID NO: 589842 - DNA, 13 bp, D. melanogaster
attaactcaatta

SEQ ID NO: 589843 - DNA, 13 bp, D. melanogaster
attaactgaaatt

SEQ ID NO: 589844 - DNA, 13 bp, D. melanogaster
attaactgagtta

SEQ ID NO: 589845 - DNA, 13 bp, D. melanogaster
attaactgccgaa

SEQ ID NO: 589846 - DNA, 14 bp, D. melanogaster
attaactgccgaat

SEQ ID NO: 589847 - DNA, 13 bp, D. melanogaster
attaacttaaact

SEQ ID NO: 589848 - DNA, 13 bp, D. melanogaster
attaacttaactt

SEQ ID NO: 589849 - DNA, 13 bp, D. melanogaster
attaacttatggc

SEQ ID NO: 589850 - DNA, 13 bp, D. melanogaster
attaacttgatta

SEQ ID NO: 589851 - DNA, 14 bp, D. melanogaster
attaacttgcagat

SEQ ID NO: 589852 - DNA, 13 bp, D. melanogaster
attaacttgctaa

SEQ ID NO: 589853 - DNA, 13 bp, D. melanogaster
attaacttggcca

SEQ ID NO: 589854 - DNA, 13 bp, D. melanogaster
attaactttaaag

SEQ ID NO: 589855 - DNA, 13 bp, D. melanogaster
attaactttgcaa

SEQ ID NO: 589856 - DNA, 13 bp, D. melanogaster
attaactttgttt

SEQ ID NO: 589857 - DNA, 13 bp, D. melanogaster
attaacttttaag

SEQ ID NO: 589858 - DNA, 13 bp, D. melanogaster
attaacttttaca

SEQ ID NO: 589859 - DNA, 13 bp, D. melanogaster
attaacttttatg

SEQ ID NO: 589860 - DNA, 13 bp, D. melanogaster
attaacttttgtt

SEQ ID NO: 589861 - DNA, 14 bp, D. melanogaster
attaagaaacaaca

SEQ ID NO: 589862 - DNA, 13 bp, D. melanogaster
attaagaaatcat

SEQ ID NO: 589863 - DNA, 13 bp, D. melanogaster
attaagaaatgtg

SEQ ID NO: 589864 - DNA, 13 bp, D. melanogaster
attaagaactttt

SEQ ID NO: 589865 - DNA, 13 bp, D. melanogaster
attaagacgacca

SEQ ID NO: 589866 - DNA, 14 bp, D. melanogaster
attaagattaagat

SEQ ID NO: 589867 - DNA, 13 bp, D. melanogaster
attaagcaaaaat

SEQ ID NO: 589868 - DNA, 13 bp, D. melanogaster
attaagcaaaatg

SEQ ID NO: 589869 - DNA, 13 bp, D. melanogaster
attaagcaagata

SEQ ID NO: 589870 - DNA, 13 bp, D. melanogaster
attaagcaataat

SEQ ID NO: 589871 - DNA, 13 bp, D. melanogaster
attaagcaatttc

SEQ ID NO: 589872 - DNA, 13 bp, D. melanogaster
attaagcagaaaa

SEQ ID NO: 589873 - DNA, 13 bp, D. melanogaster
attaagcatacgc

SEQ ID NO: 589874 - DNA, 14 bp, D. melanogaster
attaagcatacgcc

SEQ ID NO: 589875 - DNA, 13 bp, D. melanogaster
attaagcatatta

SEQ ID NO: 589876 - DNA, 13 bp, D. melanogaster
attaagccaaaaa

SEQ ID NO: 589877 - DNA, 13 bp, D. melanogaster
attaagccaaatg

SEQ ID NO: 589878 - DNA, 13 bp, D. melanogaster
attaagccaactt

SEQ ID NO: 589879 - DNA, 13 bp, D. melanogaster
attaagccataaa

SEQ ID NO: 589880 - DNA, 14 bp, D. melanogaster
attaagcctttgaa

SEQ ID NO: 589881 - DNA, 13 bp, D. melanogaster
attaagcgaattt

SEQ ID NO: 589882 - DNA, 13 bp, D. melanogaster
attaagctaattt

SEQ ID NO: 589883 - DNA, 13 bp, D. melanogaster
attaagctgaaat

SEQ ID NO: 589884 - DNA, 13 bp, D. melanogaster
attaagctggaga

SEQ ID NO: 589885 - DNA, 13 bp, D. melanogaster
attaagcttaaaa

SEQ ID NO: 589886 - DNA, 13 bp, D. melanogaster
attaaggcaaatt

SEQ ID NO: 589887 - DNA, 14 bp, D. melanogaster
attaaggcaatcaa

SEQ ID NO: 589888 - DNA, 13 bp, D. melanogaster
attaaggggaggt

SEQ ID NO: 589889 - DNA, 13 bp, D. melanogaster
attaagtacttaa

SEQ ID NO: 589890 - DNA, 13 bp, D. melanogaster
attaagtatacgc

SEQ ID NO: 589891 - DNA, 14 bp, D. melanogaster
attaagtatacgcc

SEQ ID NO: 589892 - DNA, 13 bp, D. melanogaster
attaagtcaaatg

SEQ ID NO: 589893 - DNA, 13 bp, D. melanogaster
attaagtgaaaat

SEQ ID NO: 589894 - DNA, 13 bp, D. melanogaster
attaagtgaataa

SEQ ID NO: 589895 - DNA, 13 bp, D. melanogaster
attaagtgaattt

SEQ ID NO: 589896 - DNA, 13 bp, D. melanogaster
attaagtgagttt

SEQ ID NO: 589897 - DNA, 13 bp, D. melanogaster
attaagtgcaaaa

SEQ ID NO: 589898 - DNA, 13 bp, D. melanogaster
attaagtgcaatt

SEQ ID NO: 589899 - DNA, 13 bp, D. melanogaster
attaagtgctttg

SEQ ID NO: 589900 - DNA, 13 bp, D. melanogaster
attaagtggatta

SEQ ID NO: 589901 - DNA, 13 bp, D. melanogaster
attaagtggcagc

SEQ ID NO: 589902 - DNA, 13 bp, D. melanogaster
attaagtggctat

SEQ ID NO: 589903 - DNA, 13 bp, D. melanogaster
attaagttaaatg

SEQ ID NO: 589904 - DNA, 13 bp, D. melanogaster
attaagttaagtt

SEQ ID NO: 589905 - DNA, 13 bp, D. melanogaster
attaagttatgtt

SEQ ID NO: 589906 - DNA, 13 bp, D. melanogaster
attaagttatttc

SEQ ID NO: 589907 - DNA, 13 bp, D. melanogaster
attaagttcaatt

SEQ ID NO: 589908 - DNA, 13 bp, D. melanogaster
attaagttgattg

SEQ ID NO: 589909 - DNA, 13 bp, D. melanogaster
attaagttgcaat

SEQ ID NO: 589910 - DNA, 13 bp, D. melanogaster
attaagttgccgc

SEQ ID NO: 589911 - DNA, 13 bp, D. melanogaster
attaagttgttta

SEQ ID NO: 589912 - DNA, 13 bp, D. melanogaster
attaagtttaagt

SEQ ID NO: 589913 - DNA, 13 bp, D. melanogaster
attaagtttactt

SEQ ID NO: 589914 - DNA, 13 bp, D. melanogaster
attaagtttagtt

SEQ ID NO: 589915 - DNA, 13 bp, D. melanogaster
attaagtttattg

SEQ ID NO: 589916 - DNA, 13 bp, D. melanogaster
attaagtttcaac

SEQ ID NO: 589917 - DNA, 13 bp, D. melanogaster
attaagtttgaat

SEQ ID NO: 589918 - DNA, 13 bp, D. melanogaster
attaagttttatg

SEQ ID NO: 589919 - DNA, 13 bp, D. melanogaster
attaagtttttgc

SEQ ID NO: 589920 - DNA, 13 bp, D. melanogaster
attaataaaaacg

SEQ ID NO: 589921 - DNA, 13 bp, D. melanogaster
attaataaaaccg

SEQ ID NO: 589922 - DNA, 13 bp, D. melanogaster
attaataaagcaa

SEQ ID NO: 589923 - DNA, 13 bp, D. melanogaster
attaataaattcc

SEQ ID NO: 589924 - DNA, 13 bp, D. melanogaster
attaataacaagc

SEQ ID NO: 589925 - DNA, 13 bp, D. melanogaster
attaataacgaat

SEQ ID NO: 589926 - DNA, 14 bp, D. melanogaster
attaataactgatt

SEQ ID NO: 589927 - DNA, 14 bp, D. melanogaster
attaataagaaact

SEQ ID NO: 589928 - DNA, 13 bp, D. melanogaster
attaataagcttg

SEQ ID NO: 589929 - DNA, 13 bp, D. melanogaster
attaataagttag

SEQ ID NO: 589930 - DNA, 13 bp, D. melanogaster
attaataatgagt

SEQ ID NO: 589931 - DNA, 13 bp, D. melanogaster
attaataattcga

SEQ ID NO: 589932 - DNA, 13 bp, D. melanogaster
attaataattgct

SEQ ID NO: 589933 - DNA, 13 bp, D. melanogaster
attaatagataag

SEQ ID NO: 589934 - DNA, 13 bp, D. melanogaster
attaatagcatta

SEQ ID NO: 589935 - DNA, 13 bp, D. melanogaster
attaatatgaact

SEQ ID NO: 589936 - DNA, 14 bp, D. melanogaster
attaatatgatcaa

SEQ ID NO: 589937 - DNA, 13 bp, D. melanogaster
attaatatgatga

SEQ ID NO: 589938 - DNA, 13 bp, D. melanogaster
attaatattgatg

SEQ ID NO: 589939 - DNA, 13 bp, D. melanogaster
attaatattggat

SEQ ID NO: 589940 - DNA, 13 bp, D. melanogaster
attaatcaacatt

SEQ ID NO: 589941 - DNA, 13 bp, D. melanogaster
attaatcaacttt

SEQ ID NO: 589942 - DNA, 13 bp, D. melanogaster
attaatcaagcga

SEQ ID NO: 589943 - DNA, 13 bp, D. melanogaster
attaatcaatttc

SEQ ID NO: 589944 - DNA, 13 bp, D. melanogaster
attaatcagtttt

SEQ ID NO: 589945 - DNA, 13 bp, D. melanogaster
attaatcatacgc

SEQ ID NO: 589946 - DNA, 14 bp, D. melanogaster
attaatcatacgcc

SEQ ID NO: 589947 - DNA, 13 bp, D. melanogaster
attaatcattttc

SEQ ID NO: 589948 - DNA, 13 bp, D. melanogaster
attaatccaaaga

SEQ ID NO: 589949 - DNA, 13 bp, D. melanogaster
attaatccattaa

SEQ ID NO: 589950 - DNA, 13 bp, D. melanogaster
attaatctcaatt

SEQ ID NO: 589951 - DNA, 13 bp, D. melanogaster
attaatcttcatt

SEQ ID NO: 589952 - DNA, 13 bp, D. melanogaster
attaatgaaacaa

SEQ ID NO: 589953 - DNA, 13 bp, D. melanogaster
attaatgaaattg

SEQ ID NO: 589954 - DNA, 13 bp, D. melanogaster
attaatgaacttt

SEQ ID NO: 589955 - DNA, 13 bp, D. melanogaster
attaatgacaaat

SEQ ID NO: 589956 - DNA, 13 bp, D. melanogaster
attaatgcaaaat

SEQ ID NO: 589957 - DNA, 13 bp, D. melanogaster
attaatgcaaatc

SEQ ID NO: 589958 - DNA, 13 bp, D. melanogaster
attaatgcaaatt

SEQ ID NO: 589959 - DNA, 13 bp, D. melanogaster
attaatgcaatta

SEQ ID NO: 589960 - DNA, 13 bp, D. melanogaster
attaatgcgaaat

SEQ ID NO: 589961 - DNA, 13 bp, D. melanogaster
attaatgcgtttc

SEQ ID NO: 589962 - DNA, 13 bp, D. melanogaster
attaatgctaatg

SEQ ID NO: 589963 - DNA, 13 bp, D. melanogaster
attaatgctctga

SEQ ID NO: 589964 - DNA, 13 bp, D. melanogaster
attaatggataac

SEQ ID NO: 589965 - DNA, 13 bp, D. melanogaster
attaatggcaaat

SEQ ID NO: 589966 - DNA, 13 bp, D. melanogaster
attaatggcattt

SEQ ID NO: 589967 - DNA, 13 bp, D. melanogaster
attaatgggttaa

SEQ ID NO: 589968 - DNA, 13 bp, D. melanogaster
attaatggtaaat

SEQ ID NO: 589969 - DNA, 14 bp, D. melanogaster
attaatgtacattt

SEQ ID NO: 589970 - DNA, 13 bp, D. melanogaster
attaatgtgcaaa

SEQ ID NO: 589971 - DNA, 13 bp, D. melanogaster
attaatgtgtatt

SEQ ID NO: 589972 - DNA, 13 bp, D. melanogaster
attaatgtgtttg

SEQ ID NO: 589973 - DNA, 14 bp, D. melanogaster
attaatgtgttttc

SEQ ID NO: 589974 - DNA, 13 bp, D. melanogaster
attaatgttgatc

SEQ ID NO: 589975 - DNA, 14 bp, D. melanogaster
attaatgttgatca

SEQ ID NO: 589976 - DNA, 13 bp, D. melanogaster
attaatgttgtcg

SEQ ID NO: 589977 - DNA, 13 bp, D. melanogaster
attaattaaccaa

SEQ ID NO: 589978 - DNA, 13 bp, D. melanogaster
attaattaagctt

SEQ ID NO: 589979 - DNA, 13 bp, D. melanogaster
attaattaagtgt

SEQ ID NO: 589980 - DNA, 13 bp, D. melanogaster
attaattaatgcg

SEQ ID NO: 589981 - DNA, 14 bp, D. melanogaster
attaattaatttcc

SEQ ID NO: 589982 - DNA, 13 bp, D. melanogaster
attaattacacaa

SEQ ID NO: 589983 - DNA, 14 bp, D. melanogaster
attaattacacaat

SEQ ID NO: 589984 - DNA, 13 bp, D. melanogaster
attaattagccat

SEQ ID NO: 589985 - DNA, 13 bp, D. melanogaster
attaattagctaa

SEQ ID NO: 589986 - DNA, 13 bp, D. melanogaster
attaattatacgc

SEQ ID NO: 589987 - DNA, 13 bp, D. melanogaster
attaattatgtct

SEQ ID NO: 589988 - DNA, 13 bp, D. melanogaster
attaattcaaaca

SEQ ID NO: 589989 - DNA, 13 bp, D. melanogaster
attaattcactta

SEQ ID NO: 589990 - DNA, 13 bp, D. melanogaster
attaattcacttt

SEQ ID NO: 589991 - DNA, 13 bp, D. melanogaster
attaattcgatat

SEQ ID NO: 589992 - DNA, 13 bp, D. melanogaster
attaattcgtaaa

SEQ ID NO: 589993 - DNA, 13 bp, D. melanogaster
attaattctgttt

SEQ ID NO: 589994 - DNA, 14 bp, D. melanogaster
attaattgaaaatg

SEQ ID NO: 589995 - DNA, 13 bp, D. melanogaster
attaattgaaatc

SEQ ID NO: 589996 - DNA, 13 bp, D. melanogaster
attaattgattga

SEQ ID NO: 589997 - DNA, 13 bp, D. melanogaster
attaattgattgt

SEQ ID NO: 589998 - DNA, 13 bp, D. melanogaster
attaattgcaaaa

SEQ ID NO: 589999 - DNA, 13 bp, D. melanogaster
attaattgcaatc

SEQ ID NO: 590000 - DNA, 13 bp, D. melanogaster
attaattgcaatg

SEQ ID NO: 590001 - DNA, 13 bp, D. melanogaster
attaattgcaatt

SEQ ID NO: 590002 - DNA, 13 bp, D. melanogaster
attaattgcattt

SEQ ID NO: 590003 - DNA, 13 bp, D. melanogaster
attaattgccaca

SEQ ID NO: 590004 - DNA, 13 bp, D. melanogaster
attaattgccatt

SEQ ID NO: 590005 - DNA, 13 bp, D. melanogaster
attaattgctttg

SEQ ID NO: 590006 - DNA, 13 bp, D. melanogaster
attaattggaatg

SEQ ID NO: 590007 - DNA, 13 bp, D. melanogaster
attaattggattt

SEQ ID NO: 590008 - DNA, 13 bp, D. melanogaster
attaattggccaa

SEQ ID NO: 590009 - DNA, 13 bp, D. melanogaster
attaattgtaaac

SEQ ID NO: 590010 - DNA, 13 bp, D. melanogaster
attaattgtttac

SEQ ID NO: 590011 - DNA, 13 bp, D. melanogaster
attaatttacaca

SEQ ID NO: 590012 - DNA, 13 bp, D. melanogaster
attaatttacaga

SEQ ID NO: 590013 - DNA, 13 bp, D. melanogaster
attaatttccaca

SEQ ID NO: 590014 - DNA, 13 bp, D. melanogaster
attaatttcgtat

SEQ ID NO: 590015 - DNA, 13 bp, D. melanogaster
attaatttctttg

SEQ ID NO: 590016 - DNA, 13 bp, D. melanogaster
attaatttgacag

SEQ ID NO: 590017 - DNA, 13 bp, D. melanogaster
attaatttgccat

SEQ ID NO: 590018 - DNA, 13 bp, D. melanogaster
attaatttgcctt

SEQ ID NO: 590019 - DNA, 13 bp, D. melanogaster
attaatttgcttt

SEQ ID NO: 590020 - DNA, 13 bp, D. melanogaster
attaatttggaaa

SEQ ID NO: 590021 - DNA, 13 bp, D. melanogaster
attaatttggcca

SEQ ID NO: 590022 - DNA, 13 bp, D. melanogaster
attaatttggcga

SEQ ID NO: 590023 - DNA, 14 bp, D. melanogaster
attaatttgtacag

SEQ ID NO: 590024 - DNA, 13 bp, D. melanogaster
attaattttaagc

SEQ ID NO: 590025 - DNA, 14 bp, D. melanogaster
attaattttaatgc

SEQ ID NO: 590026 - DNA, 13 bp, D. melanogaster
attaattttgcaa

SEQ ID NO: 590027 - DNA, 13 bp, D. melanogaster
attaattttgtgc

SEQ ID NO: 590028 - DNA, 13 bp, D. melanogaster
attaatttttggg

SEQ ID NO: 590029 - DNA, 13 bp, D. melanogaster
attacaaaaatga

SEQ ID NO: 590030 - DNA, 13 bp, D. melanogaster
attacaaaactat

SEQ ID NO: 590031 - DNA, 13 bp, D. melanogaster
attacaaaacttt

SEQ ID NO: 590032 - DNA, 13 bp, D. melanogaster
attacaaaatgat

SEQ ID NO: 590033 - DNA, 13 bp, D. melanogaster
attacaaacaatt

SEQ ID NO: 590034 - DNA, 13 bp, D. melanogaster
attacaaacattt

SEQ ID NO: 590035 - DNA, 13 bp, D. melanogaster
attacaaagtaat

SEQ ID NO: 590036 - DNA, 13 bp, D. melanogaster
attacaaatacat

SEQ ID NO: 590037 - DNA, 13 bp, D. melanogaster
attacaaatgcaa

SEQ ID NO: 590038 - DNA, 13 bp, D. melanogaster
attacaaatggaa

SEQ ID NO: 590039 - DNA, 13 bp, D. melanogaster
attacaaattgaa

SEQ ID NO: 590040 - DNA, 13 bp, D. melanogaster
attacaaattgca

SEQ ID NO: 590041 - DNA, 13 bp, D. melanogaster
attacaaatttgc

SEQ ID NO: 590042 - DNA, 14 bp, D. melanogaster
attacaaatttgca

SEQ ID NO: 590043 - DNA, 13 bp, D. melanogaster
attacaaatttgt

SEQ ID NO: 590044 - DNA, 13 bp, D. melanogaster
attacaacaaaag

SEQ ID NO: 590045 - DNA, 13 bp, D. melanogaster
attacaacaaatt

SEQ ID NO: 590046 - DNA, 14 bp, D. melanogaster
attacaacaacaat

SEQ ID NO: 590047 - DNA, 13 bp, D. melanogaster
attacaacaattt

SEQ ID NO: 590048 - DNA, 13 bp, D. melanogaster
attacaacaggtt

SEQ ID NO: 590049 - DNA, 13 bp, D. melanogaster
attacaacggaaa

SEQ ID NO: 590050 - DNA, 13 bp, D. melanogaster
attacaacttttt

SEQ ID NO: 590051 - DNA, 13 bp, D. melanogaster
attacaagaacgc

SEQ ID NO: 590052 - DNA, 13 bp, D. melanogaster
attacaagcacaa

SEQ ID NO: 590053 - DNA, 14 bp, D. melanogaster
attacaataaagcg

SEQ ID NO: 590054 - DNA, 13 bp, D. melanogaster
attacaatccatt

SEQ ID NO: 590055 - DNA, 13 bp, D. melanogaster
attacaatcgaaa

SEQ ID NO: 590056 - DNA, 13 bp, D. melanogaster
attacaatgaaaa

SEQ ID NO: 590057 - DNA, 13 bp, D. melanogaster
attacaatgccaa

SEQ ID NO: 590058 - DNA, 13 bp, D. melanogaster
attacaatgtttt

SEQ ID NO: 590059 - DNA, 13 bp, D. melanogaster
attacaattacaa

SEQ ID NO: 590060 - DNA, 13 bp, D. melanogaster
attacaattgtaa

SEQ ID NO: 590061 - DNA, 13 bp, D. melanogaster
attacaatttacg

SEQ ID NO: 590062 - DNA, 13 bp, D. melanogaster
attacaatttgat

SEQ ID NO: 590063 - DNA, 13 bp, D. melanogaster
attacaatttgtt

SEQ ID NO: 590064 - DNA, 13 bp, D. melanogaster
attacaatttttc

SEQ ID NO: 590065 - DNA, 13 bp, D. melanogaster
attacaatttttg

SEQ ID NO: 590066 - DNA, 13 bp, D. melanogaster
attacacaaatac

SEQ ID NO: 590067 - DNA, 13 bp, D. melanogaster
attacacaaatat

SEQ ID NO: 590068 - DNA, 13 bp, D. melanogaster
attacacaaattg

SEQ ID NO: 590069 - DNA, 13 bp, D. melanogaster
attacacaattat

SEQ ID NO: 590070 - DNA, 13 bp, D. melanogaster
attacacaattta

SEQ ID NO: 590071 - DNA, 14 bp, D. melanogaster
attacacacacaca

SEQ ID NO: 590072 - DNA, 13 bp, D. melanogaster
attacacacattt

SEQ ID NO: 590073 - DNA, 13 bp, D. melanogaster
attacacagacac

SEQ ID NO: 590074 - DNA, 13 bp, D. melanogaster
attacacataact

SEQ ID NO: 590075 - DNA, 13 bp, D. melanogaster
attacacatatta

SEQ ID NO: 590076 - DNA, 13 bp, D. melanogaster
attacacattaaa

SEQ ID NO: 590077 - DNA, 13 bp, D. melanogaster
attacacatttat

SEQ ID NO: 590078 - DNA, 13 bp, D. melanogaster
attacacattttc

SEQ ID NO: 590079 - DNA, 13 bp, D. melanogaster
attacactttaca

SEQ ID NO: 590080 - DNA, 13 bp, D. melanogaster
attacactttatt

SEQ ID NO: 590081 - DNA, 13 bp, D. melanogaster
attacagaaaaat

SEQ ID NO: 590082 - DNA, 13 bp, D. melanogaster
attacagaaaagg

SEQ ID NO: 590083 - DNA, 13 bp, D. melanogaster
attacagaaaatt

SEQ ID NO: 590084 - DNA, 13 bp, D. melanogaster
attacagataata

SEQ ID NO: 590085 - DNA, 14 bp, D. melanogaster
attacagataatag

SEQ ID NO: 590086 - DNA, 13 bp, D. melanogaster
attacagtgctat

SEQ ID NO: 590087 - DNA, 13 bp, D. melanogaster
attacatacatat

SEQ ID NO: 590088 - DNA, 13 bp, D. melanogaster
attacatactttt

SEQ ID NO: 590089 - DNA, 14 bp, D. melanogaster
attacatatatgta

SEQ ID NO: 590090 - DNA, 14 bp, D. melanogaster
attacatatgtata

SEQ ID NO: 590091 - DNA, 13 bp, D. melanogaster
attacatattcaa

SEQ ID NO: 590092 - DNA, 13 bp, D. melanogaster
attacatggaaaa

SEQ ID NO: 590093 - DNA, 13 bp, D. melanogaster
attacatggcgac

SEQ ID NO: 590094 - DNA, 13 bp, D. melanogaster
attacattaaaca

SEQ ID NO: 590095 - DNA, 13 bp, D. melanogaster
attacattacaaa

SEQ ID NO: 590096 - DNA, 13 bp, D. melanogaster
attacattacatt

SEQ ID NO: 590097 - DNA, 14 bp, D. melanogaster
attacattacatta

SEQ ID NO: 590098 - DNA, 14 bp, D. melanogaster
attacattacattt

SEQ ID NO: 590099 - DNA, 13 bp, D. melanogaster
attacattcaaat

SEQ ID NO: 590100 - DNA, 13 bp, D. melanogaster
attacattccatt

SEQ ID NO: 590101 - DNA, 13 bp, D. melanogaster
attacattctgca

SEQ ID NO: 590102 - DNA, 13 bp, D. melanogaster
attacattgatga

SEQ ID NO: 590103 - DNA, 13 bp, D. melanogaster
attacatttaaac

SEQ ID NO: 590104 - DNA, 13 bp, D. melanogaster
attacatttaagt

SEQ ID NO: 590105 - DNA, 13 bp, D. melanogaster
attacatttacat

SEQ ID NO: 590106 - DNA, 13 bp, D. melanogaster
attacatttactt

SEQ ID NO: 590107 - DNA, 13 bp, D. melanogaster
attacatttcaaa

SEQ ID NO: 590108 - DNA, 13 bp, D. melanogaster
attacatttgtat

SEQ ID NO: 590109 - DNA, 13 bp, D. melanogaster
attacattttaag

SEQ ID NO: 590110 - DNA, 13 bp, D. melanogaster
attacattttaca

SEQ ID NO: 590111 - DNA, 13 bp, D. melanogaster
attacattttact

SEQ ID NO: 590112 - DNA, 13 bp, D. melanogaster
attacattttagt

SEQ ID NO: 590113 - DNA, 13 bp, D. melanogaster
attacattttatg

SEQ ID NO: 590114 - DNA, 13 bp, D. melanogaster
attacattttcaa

SEQ ID NO: 590115 - DNA, 13 bp, D. melanogaster
attacattttgaa

SEQ ID NO: 590116 - DNA, 13 bp, D. melanogaster
attaccaaaatga

SEQ ID NO: 590117 - DNA, 13 bp, D. melanogaster
attaccaaagaat

SEQ ID NO: 590118 - DNA, 13 bp, D. melanogaster
attaccaaatatt

SEQ ID NO: 590119 - DNA, 13 bp, D. melanogaster
attaccaaattat

SEQ ID NO: 590120 - DNA, 13 bp, D. melanogaster
attaccaaattca

SEQ ID NO: 590121 - DNA, 13 bp, D. melanogaster
attaccaacattt

SEQ ID NO: 590122 - DNA, 13 bp, D. melanogaster
attaccaagacag

SEQ ID NO: 590123 - DNA, 13 bp, D. melanogaster
attaccaataaat

SEQ ID NO: 590124 - DNA, 13 bp, D. melanogaster
attaccagaacaa

SEQ ID NO: 590125 - DNA, 13 bp, D. melanogaster
attaccagcaaga

SEQ ID NO: 590126 - DNA, 13 bp, D. melanogaster
attaccagtgcta

SEQ ID NO: 590127 - DNA, 13 bp, D. melanogaster
attaccataaaat

SEQ ID NO: 590128 - DNA, 13 bp, D. melanogaster
attaccatgcacc

SEQ ID NO: 590129 - DNA, 13 bp, D. melanogaster
attaccattacca

SEQ ID NO: 590130 - DNA, 13 bp, D. melanogaster
attaccatttatt

SEQ ID NO: 590131 - DNA, 13 bp, D. melanogaster
attaccatttggt

SEQ ID NO: 590132 - DNA, 14 bp, D. melanogaster
attaccatttggtt

SEQ ID NO: 590133 - DNA, 13 bp, D. melanogaster
attaccatttgtt

SEQ ID NO: 590134 - DNA, 13 bp, D. melanogaster
attaccattttat

SEQ ID NO: 590135 - DNA, 13 bp, D. melanogaster
attacccaaatat

SEQ ID NO: 590136 - DNA, 13 bp, D. melanogaster
attacccaattac

SEQ ID NO: 590137 - DNA, 13 bp, D. melanogaster
attacccatacgc

SEQ ID NO: 590138 - DNA, 14 bp, D. melanogaster
attacccatacgcc

SEQ ID NO: 590139 - DNA, 13 bp, D. melanogaster
attacccatttta

SEQ ID NO: 590140 - DNA, 13 bp, D. melanogaster
attaccccaaaaa

SEQ ID NO: 590141 - DNA, 13 bp, D. melanogaster
attacccgctgcc

SEQ ID NO: 590142 - DNA, 13 bp, D. melanogaster
attacctaaagat

SEQ ID NO: 590143 - DNA, 13 bp, D. melanogaster
attacctaattaa

SEQ ID NO: 590144 - DNA, 13 bp, D. melanogaster
attacctttttcg

SEQ ID NO: 590145 - DNA, 13 bp, D. melanogaster
attacgaaatatt

SEQ ID NO: 590146 - DNA, 13 bp, D. melanogaster
attacgaaattat

SEQ ID NO: 590147 - DNA, 13 bp, D. melanogaster
attacgaattacg

SEQ ID NO: 590148 - DNA, 13 bp, D. melanogaster
attacgacaaaaa

SEQ ID NO: 590149 - DNA, 13 bp, D. melanogaster
attacgagcaaca

SEQ ID NO: 590150 - DNA, 13 bp, D. melanogaster
attacgatattct

SEQ ID NO: 590151 - DNA, 13 bp, D. melanogaster
attacgatgatgt

SEQ ID NO: 590152 - DNA, 13 bp, D. melanogaster
attacgattatta

SEQ ID NO: 590153 - DNA, 13 bp, D. melanogaster
attacgatttttt

SEQ ID NO: 590154 - DNA, 13 bp, D. melanogaster
attacgcagacaa

SEQ ID NO: 590155 - DNA, 13 bp, D. melanogaster
attacgcatacgc

SEQ ID NO: 590156 - DNA, 14 bp, D. melanogaster
attacgcatacgca

SEQ ID NO: 590157 - DNA, 14 bp, D. melanogaster
attacgcatacgcc

SEQ ID NO: 590158 - DNA, 13 bp, D. melanogaster
attacggaaaaag

SEQ ID NO: 590159 - DNA, 14 bp, D. melanogaster
attacggcatgcat

SEQ ID NO: 590160 - DNA, 13 bp, D. melanogaster
attacgtatacga

SEQ ID NO: 590161 - DNA, 14 bp, D. melanogaster
attacgtatacgac

SEQ ID NO: 590162 - DNA, 13 bp, D. melanogaster
attacgtatacgc

SEQ ID NO: 590163 - DNA, 14 bp, D. melanogaster
attacgtatacgcc

SEQ ID NO: 590164 - DNA, 13 bp, D. melanogaster
attacgtatacgt

SEQ ID NO: 590165 - DNA, 13 bp, D. melanogaster
attacgtcgatat

SEQ ID NO: 590166 - DNA, 13 bp, D. melanogaster
attacgtcgatgt

SEQ ID NO: 590167 - DNA, 13 bp, D. melanogaster
attacgtttttat

SEQ ID NO: 590168 - DNA, 14 bp, D. melanogaster
attacgtttttgtt

SEQ ID NO: 590169 - DNA, 13 bp, D. melanogaster
attactaaactac

SEQ ID NO: 590170 - DNA, 13 bp, D. melanogaster
attactcactgtg

SEQ ID NO: 590171 - DNA, 13 bp, D. melanogaster
attactcatacgc

SEQ ID NO: 590172 - DNA, 14 bp, D. melanogaster
attactcatacgca

SEQ ID NO: 590173 - DNA, 14 bp, D. melanogaster
attactcatacgcc

SEQ ID NO: 590174 - DNA, 13 bp, D. melanogaster
attactcgtacat

SEQ ID NO: 590175 - DNA, 14 bp, D. melanogaster
attactcgtacatt

SEQ ID NO: 590176 - DNA, 13 bp, D. melanogaster
attactctctttc

SEQ ID NO: 590177 - DNA, 14 bp, D. melanogaster
attacttaaaaacg

SEQ ID NO: 590178 - DNA, 13 bp, D. melanogaster
attacttatgtat

SEQ ID NO: 590179 - DNA, 14 bp, D. melanogaster
attacttcaggatt

SEQ ID NO: 590180 - DNA, 13 bp, D. melanogaster
attacttcgatta

SEQ ID NO: 590181 - DNA, 13 bp, D. melanogaster
attactttatgtg

SEQ ID NO: 590182 - DNA, 13 bp, D. melanogaster
attactttcaaat

SEQ ID NO: 590183 - DNA, 14 bp, D. melanogaster
attactttcacctt

SEQ ID NO: 590184 - DNA, 13 bp, D. melanogaster
attactttcgttt

SEQ ID NO: 590185 - DNA, 13 bp, D. melanogaster
attactttgaaat

SEQ ID NO: 590186 - DNA, 13 bp, D. melanogaster
attactttgcata

SEQ ID NO: 590187 - DNA, 13 bp, D. melanogaster
attactttgttta

SEQ ID NO: 590188 - DNA, 13 bp, D. melanogaster
attacttttaaag

SEQ ID NO: 590189 - DNA, 13 bp, D. melanogaster
attacttttcaaa

SEQ ID NO: 590190 - DNA, 13 bp, D. melanogaster
attacttttgaaa

SEQ ID NO: 590191 - DNA, 13 bp, D. melanogaster
attacttttggtt

SEQ ID NO: 590192 - DNA, 13 bp, D. melanogaster
attagaaaaatgt

SEQ ID NO: 590193 - DNA, 13 bp, D. melanogaster
attagaaaagttg

SEQ ID NO: 590194 - DNA, 13 bp, D. melanogaster
attagaaaatcat

SEQ ID NO: 590195 - DNA, 13 bp, D. melanogaster
attagaaaatctg

SEQ ID NO: 590196 - DNA, 13 bp, D. melanogaster
attagaaacaaat

SEQ ID NO: 590197 - DNA, 13 bp, D. melanogaster
attagaaacattt

SEQ ID NO: 590198 - DNA, 13 bp, D. melanogaster
attagaagctcaa

SEQ ID NO: 590199 - DNA, 13 bp, D. melanogaster
attagaagttgaa

SEQ ID NO: 590200 - DNA, 13 bp, D. melanogaster
attagaattagaa

SEQ ID NO: 590201 - DNA, 13 bp, D. melanogaster
attagaatttatg

SEQ ID NO: 590202 - DNA, 13 bp, D. melanogaster
attagacagaaaa

SEQ ID NO: 590203 - DNA, 13 bp, D. melanogaster
attagagattcaa

SEQ ID NO: 590204 - DNA, 13 bp, D. melanogaster
attagagcattta

SEQ ID NO: 590205 - DNA, 13 bp, D. melanogaster
attagaggtaata

SEQ ID NO: 590206 - DNA, 13 bp, D. melanogaster
attagatattaga

SEQ ID NO: 590207 - DNA, 13 bp, D. melanogaster
attagattcgact

SEQ ID NO: 590208 - DNA, 13 bp, D. melanogaster
attagatttatgt

SEQ ID NO: 590209 - DNA, 13 bp, D. melanogaster
attagatttcatt

SEQ ID NO: 590210 - DNA, 13 bp, D. melanogaster
attagatttccca

SEQ ID NO: 590211 - DNA, 13 bp, D. melanogaster
attagatttttca

SEQ ID NO: 590212 - DNA, 13 bp, D. melanogaster
attagcaaaatgc

SEQ ID NO: 590213 - DNA, 13 bp, D. melanogaster
attagcaaacaaa

SEQ ID NO: 590214 - DNA, 14 bp, D. melanogaster
attagcaaacaaat

SEQ ID NO: 590215 - DNA, 13 bp, D. melanogaster
attagcaaatgtt

SEQ ID NO: 590216 - DNA, 13 bp, D. melanogaster
attagcaacattt

SEQ ID NO: 590217 - DNA, 13 bp, D. melanogaster
attagcaagaaaa

SEQ ID NO: 590218 - DNA, 13 bp, D. melanogaster
attagcaagttaa

SEQ ID NO: 590219 - DNA, 13 bp, D. melanogaster
attagcaataaaa

SEQ ID NO: 590220 - DNA, 13 bp, D. melanogaster
attagcaattaat

SEQ ID NO: 590221 - DNA, 13 bp, D. melanogaster
attagcacaaatt

SEQ ID NO: 590222 - DNA, 13 bp, D. melanogaster
attagcacacaaa

SEQ ID NO: 590223 - DNA, 13 bp, D. melanogaster
attagcacatttt

SEQ ID NO: 590224 - DNA, 13 bp, D. melanogaster
attagcagcattt

SEQ ID NO: 590225 - DNA, 14 bp, D. melanogaster
attagcagcatttc

SEQ ID NO: 590226 - DNA, 13 bp, D. melanogaster
attagcataatta

SEQ ID NO: 590227 - DNA, 13 bp, D. melanogaster
attagcattaatt

SEQ ID NO: 590228 - DNA, 13 bp, D. melanogaster
attagcattagca

SEQ ID NO: 590229 - DNA, 13 bp, D. melanogaster
attagcattttaa

SEQ ID NO: 590230 - DNA, 14 bp, D. melanogaster
attagcattttaaa

SEQ ID NO: 590231 - DNA, 13 bp, D. melanogaster
attagcattttta

SEQ ID NO: 590232 - DNA, 14 bp, D. melanogaster
attagcatttttat

SEQ ID NO: 590233 - DNA, 13 bp, D. melanogaster
attagccaaattg

SEQ ID NO: 590234 - DNA, 13 bp, D. melanogaster
attagccacaaaa

SEQ ID NO: 590235 - DNA, 13 bp, D. melanogaster
attagccataatt

SEQ ID NO: 590236 - DNA, 13 bp, D. melanogaster
attagcgaaatgc

SEQ ID NO: 590237 - DNA, 13 bp, D. melanogaster
attagctatattt

SEQ ID NO: 590238 - DNA, 13 bp, D. melanogaster
attagctgagatt

SEQ ID NO: 590239 - DNA, 13 bp, D. melanogaster
attagctgccaca

SEQ ID NO: 590240 - DNA, 13 bp, D. melanogaster
attagctgttttt

SEQ ID NO: 590241 - DNA, 13 bp, D. melanogaster
attagcttaaatt

SEQ ID NO: 590242 - DNA, 13 bp, D. melanogaster
attagcttcaatt

SEQ ID NO: 590243 - DNA, 13 bp, D. melanogaster
attagctttattt

SEQ ID NO: 590244 - DNA, 13 bp, D. melanogaster
attagcttttaat

SEQ ID NO: 590245 - DNA, 13 bp, D. melanogaster
attaggaaattaa

SEQ ID NO: 590246 - DNA, 14 bp, D. melanogaster
attaggaatgattt

SEQ ID NO: 590247 - DNA, 13 bp, D. melanogaster
attaggcaaatta

SEQ ID NO: 590248 - DNA, 13 bp, D. melanogaster
attaggggaaaaa

SEQ ID NO: 590249 - DNA, 13 bp, D. melanogaster
attaggtatttaa

SEQ ID NO: 590250 - DNA, 14 bp, D. melanogaster
attaggtatttaat

SEQ ID NO: 590251 - DNA, 13 bp, D. melanogaster
attaggtttaaat

SEQ ID NO: 590252 - DNA, 13 bp, D. melanogaster
attaggttttaaa

SEQ ID NO: 590253 - DNA, 14 bp, D. melanogaster
attaggttttgtaa

SEQ ID NO: 590254 - DNA, 13 bp, D. melanogaster
attagtaaggctt

SEQ ID NO: 590255 - DNA, 13 bp, D. melanogaster
attagtacaggcg

SEQ ID NO: 590256 - DNA, 13 bp, D. melanogaster
attagtacatttt

SEQ ID NO: 590257 - DNA, 13 bp, D. melanogaster
attagtagtagta

SEQ ID NO: 590258 - DNA, 13 bp, D. melanogaster
attagtcgataag

SEQ ID NO: 590259 - DNA, 13 bp, D. melanogaster
attagtgaaaggt

SEQ ID NO: 590260 - DNA, 13 bp, D. melanogaster
attagtgcgatta

SEQ ID NO: 590261 - DNA, 13 bp, D. melanogaster
attagtggaaaat

SEQ ID NO: 590262 - DNA, 13 bp, D. melanogaster
attagttaatttg

SEQ ID NO: 590263 - DNA, 13 bp, D. melanogaster
attagttaccaaa

SEQ ID NO: 590264 - DNA, 13 bp, D. melanogaster
attagttagttag

SEQ ID NO: 590265 - DNA, 14 bp, D. melanogaster
attagttctttagt

SEQ ID NO: 590266 - DNA, 13 bp, D. melanogaster
attagttgaaaaa

SEQ ID NO: 590267 - DNA, 13 bp, D. melanogaster
attagttgaaaat

SEQ ID NO: 590268 - DNA, 14 bp, D. melanogaster
attagttgaaaata

SEQ ID NO: 590269 - DNA, 13 bp, D. melanogaster
attagttgactta

SEQ ID NO: 590270 - DNA, 13 bp, D. melanogaster
attagttgattta

SEQ ID NO: 590271 - DNA, 13 bp, D. melanogaster
attagttgcattt

SEQ ID NO: 590272 - DNA, 14 bp, D. melanogaster
attagttgcattta

SEQ ID NO: 590273 - DNA, 13 bp, D. melanogaster
attagttggcatt

SEQ ID NO: 590274 - DNA, 13 bp, D. melanogaster
attagttgtaatt

SEQ ID NO: 590275 - DNA, 13 bp, D. melanogaster
attagttgttaat

SEQ ID NO: 590276 - DNA, 13 bp, D. melanogaster
attagtttaattc

SEQ ID NO: 590277 - DNA, 13 bp, D. melanogaster
attagtttcagtt

SEQ ID NO: 590278 - DNA, 13 bp, D. melanogaster
attagtttccatt

SEQ ID NO: 590279 - DNA, 13 bp, D. melanogaster
attagtttctatt

SEQ ID NO: 590280 - DNA, 13 bp, D. melanogaster
attagttttcatt

SEQ ID NO: 590281 - DNA, 14 bp, D. melanogaster
attagttttcattt

SEQ ID NO: 590282 - DNA, 13 bp, D. melanogaster
attagttttcggt

SEQ ID NO: 590283 - DNA, 13 bp, D. melanogaster
attagttttcttg

SEQ ID NO: 590284 - DNA, 14 bp, D. melanogaster
attagttttgtaaa

SEQ ID NO: 590285 - DNA, 13 bp, D. melanogaster
attagtttttaca

SEQ ID NO: 590286 - DNA, 13 bp, D. melanogaster
attataaaaagtc

SEQ ID NO: 590287 - DNA, 14 bp, D. melanogaster
attataaaactgtt

SEQ ID NO: 590288 - DNA, 14 bp, D. melanogaster
attataaaagcaaa

SEQ ID NO: 590289 - DNA, 13 bp, D. melanogaster
attataaagcaat

SEQ ID NO: 590290 - DNA, 13 bp, D. melanogaster
attataaatgcaa

SEQ ID NO: 590291 - DNA, 13 bp, D. melanogaster
attataaattgca

SEQ ID NO: 590292 - DNA, 13 bp, D. melanogaster
attataaccagaa

SEQ ID NO: 590293 - DNA, 13 bp, D. melanogaster
attataagcatat

SEQ ID NO: 590294 - DNA, 13 bp, D. melanogaster
attataatactgt

SEQ ID NO: 590295 - DNA, 13 bp, D. melanogaster
attataatagaag

SEQ ID NO: 590296 - DNA, 14 bp, D. melanogaster
attataatagaagt

SEQ ID NO: 590297 - DNA, 14 bp, D. melanogaster
attataatagttga

SEQ ID NO: 590298 - DNA, 13 bp, D. melanogaster
attataatccaag

SEQ ID NO: 590299 - DNA, 13 bp, D. melanogaster
attataatcgaaa

SEQ ID NO: 590300 - DNA, 13 bp, D. melanogaster
attataatgcata

SEQ ID NO: 590301 - DNA, 13 bp, D. melanogaster
attataattacca

SEQ ID NO: 590302 - DNA, 13 bp, D. melanogaster
attataattgcca

SEQ ID NO: 590303 - DNA, 13 bp, D. melanogaster
attataatttcca

SEQ ID NO: 590304 - DNA, 13 bp, D. melanogaster
attatacaaacat

SEQ ID NO: 590305 - DNA, 13 bp, D. melanogaster
attatacaataca

SEQ ID NO: 590306 - DNA, 13 bp, D. melanogaster
attatacacattt

SEQ ID NO: 590307 - DNA, 13 bp, D. melanogaster
attatacagaaat

SEQ ID NO: 590308 - DNA, 14 bp, D. melanogaster
attatacatacata

SEQ ID NO: 590309 - DNA, 15 bp, D. melanogaster
attatacatacatat

SEQ ID NO: 590310 - DNA, 13 bp, D. melanogaster
attataccaaata

SEQ ID NO: 590311 - DNA, 13 bp, D. melanogaster
attatacccatta

SEQ ID NO: 590312 - DNA, 13 bp, D. melanogaster
attatacccgtta

SEQ ID NO: 590313 - DNA, 13 bp, D. melanogaster
attatacgtataa

SEQ ID NO: 590314 - DNA, 13 bp, D. melanogaster
attatacgtttta

SEQ ID NO: 590315 - DNA, 13 bp, D. melanogaster
attatactttcta

SEQ ID NO: 590316 - DNA, 13 bp, D. melanogaster
attatagaaagct

SEQ ID NO: 590317 - DNA, 13 bp, D. melanogaster
attatagaataag

SEQ ID NO: 590318 - DNA, 13 bp, D. melanogaster
attatagctttta

SEQ ID NO: 590319 - DNA, 13 bp, D. melanogaster
attataggatatc

SEQ ID NO: 590320 - DNA, 13 bp, D. melanogaster
attatagtgacaa

SEQ ID NO: 590321 - DNA, 14 bp, D. melanogaster
attatagtttatac

SEQ ID NO: 590322 - DNA, 13 bp, D. melanogaster
attatataaacga

SEQ ID NO: 590323 - DNA, 13 bp, D. melanogaster
attatatagcata

SEQ ID NO: 590324 - DNA, 13 bp, D. melanogaster
attatatatgcat

SEQ ID NO: 590325 - DNA, 14 bp, D. melanogaster
attatatcatctag

SEQ ID NO: 590326 - DNA, 13 bp, D. melanogaster
attatatgcactt

SEQ ID NO: 590327 - DNA, 13 bp, D. melanogaster
attatatgcatat

SEQ ID NO: 590328 - DNA, 13 bp, D. melanogaster
attatatggaaaa

SEQ ID NO: 590329 - DNA, 13 bp, D. melanogaster
attatatggcaaa

SEQ ID NO: 590330 - DNA, 13 bp, D. melanogaster
attatatgtagat

SEQ ID NO: 590331 - DNA, 13 bp, D. melanogaster
attatatgtatct

SEQ ID NO: 590332 - DNA, 13 bp, D. melanogaster
attatatgtgtat

SEQ ID NO: 590333 - DNA, 13 bp, D. melanogaster
attatattcagtt

SEQ ID NO: 590334 - DNA, 14 bp, D. melanogaster
attatatttagctt

SEQ ID NO: 590335 - DNA, 13 bp, D. melanogaster
attatatttcatc

SEQ ID NO: 590336 - DNA, 13 bp, D. melanogaster
attatatttgaag

SEQ ID NO: 590337 - DNA, 13 bp, D. melanogaster
attatatttgcat

SEQ ID NO: 590338 - DNA, 13 bp, D. melanogaster
attatattttcgt

SEQ ID NO: 590339 - DNA, 13 bp, D. melanogaster
attatattttgca

SEQ ID NO: 590340 - DNA, 13 bp, D. melanogaster
attatattttgtc

SEQ ID NO: 590341 - DNA, 13 bp, D. melanogaster
attatcaaaagtt

SEQ ID NO: 590342 - DNA, 13 bp, D. melanogaster
attatcaaacaat

SEQ ID NO: 590343 - DNA, 13 bp, D. melanogaster
attatcaaatcca

SEQ ID NO: 590344 - DNA, 13 bp, D. melanogaster
attatcaacaatt

SEQ ID NO: 590345 - DNA, 13 bp, D. melanogaster
attatcaagaaga

SEQ ID NO: 590346 - DNA, 13 bp, D. melanogaster
attatcaagaatt

SEQ ID NO: 590347 - DNA, 14 bp, D. melanogaster
attatcaattccaa

SEQ ID NO: 590348 - DNA, 13 bp, D. melanogaster
attatcaattgca

SEQ ID NO: 590349 - DNA, 13 bp, D. melanogaster
attatcacatttt

SEQ ID NO: 590350 - DNA, 13 bp, D. melanogaster
attatcatatttg

SEQ ID NO: 590351 - DNA, 13 bp, D. melanogaster
attatcatcaaaa

SEQ ID NO: 590352 - DNA, 13 bp, D. melanogaster
attatcatcatcg

SEQ ID NO: 590353 - DNA, 13 bp, D. melanogaster
attatcattacca

SEQ ID NO: 590354 - DNA, 13 bp, D. melanogaster
attatcattagaa

SEQ ID NO: 590355 - DNA, 13 bp, D. melanogaster
attatcattatca

SEQ ID NO: 590356 - DNA, 13 bp, D. melanogaster
attatcattatga

SEQ ID NO: 590357 - DNA, 13 bp, D. melanogaster
attatccaaaaat

SEQ ID NO: 590358 - DNA, 13 bp, D. melanogaster
attatccaactta

SEQ ID NO: 590359 - DNA, 13 bp, D. melanogaster
attatccatagaa

SEQ ID NO: 590360 - DNA, 13 bp, D. melanogaster
attatcccactta

SEQ ID NO: 590361 - DNA, 13 bp, D. melanogaster
attatccgatctt

SEQ ID NO: 590362 - DNA, 13 bp, D. melanogaster
attatcctcttca

SEQ ID NO: 590363 - DNA, 13 bp, D. melanogaster
attatcgctgcag

SEQ ID NO: 590364 - DNA, 13 bp, D. melanogaster
attatctgaagaa

SEQ ID NO: 590365 - DNA, 13 bp, D. melanogaster
attatctgagtga

SEQ ID NO: 590366 - DNA, 14 bp, D. melanogaster
attatctttatgaa

SEQ ID NO: 590367 - DNA, 13 bp, D. melanogaster
attatctttgatt

SEQ ID NO: 590368 - DNA, 13 bp, D. melanogaster
attatgaaaaaca

SEQ ID NO: 590369 - DNA, 13 bp, D. melanogaster
attatgaaaaatg

SEQ ID NO: 590370 - DNA, 13 bp, D. melanogaster
attatgaaatgaa

SEQ ID NO: 590371 - DNA, 13 bp, D. melanogaster
attatgaatttga

SEQ ID NO: 590372 - DNA, 13 bp, D. melanogaster
attatgacaaaaa

SEQ ID NO: 590373 - DNA, 13 bp, D. melanogaster
attatgacaaatt

SEQ ID NO: 590374 - DNA, 13 bp, D. melanogaster
attatgataaatg

SEQ ID NO: 590375 - DNA, 13 bp, D. melanogaster
attatgataatga

SEQ ID NO: 590376 - DNA, 13 bp, D. melanogaster
attatgatgatta

SEQ ID NO: 590377 - DNA, 13 bp, D. melanogaster
attatgattatga

SEQ ID NO: 590378 - DNA, 14 bp, D. melanogaster
attatgattatgat

SEQ ID NO: 590379 - DNA, 13 bp, D. melanogaster
attatgattatgg

SEQ ID NO: 590380 - DNA, 13 bp, D. melanogaster
attatgatttcat

SEQ ID NO: 590381 - DNA, 13 bp, D. melanogaster
attatgattttct

SEQ ID NO: 590382 - DNA, 13 bp, D. melanogaster
attatgcaaaaat

SEQ ID NO: 590383 - DNA, 13 bp, D. melanogaster
attatgcaaacaa

SEQ ID NO: 590384 - DNA, 14 bp, D. melanogaster
attatgcaaatatt

SEQ ID NO: 590385 - DNA, 14 bp, D. melanogaster
attatgcaaatgca

SEQ ID NO: 590386 - DNA, 13 bp, D. melanogaster
attatgcaaatta

SEQ ID NO: 590387 - DNA, 14 bp, D. melanogaster
attatgcaaattgc

SEQ ID NO: 590388 - DNA, 13 bp, D. melanogaster
attatgcaacaat

SEQ ID NO: 590389 - DNA, 13 bp, D. melanogaster
attatgcaactgc

SEQ ID NO: 590390 - DNA, 13 bp, D. melanogaster
attatgcaagtaa

SEQ ID NO: 590391 - DNA, 13 bp, D. melanogaster
attatgcaataaa

SEQ ID NO: 590392 - DNA, 13 bp, D. melanogaster
attatgcaatatt

SEQ ID NO: 590393 - DNA, 13 bp, D. melanogaster
attatgcaatttt

SEQ ID NO: 590394 - DNA, 13 bp, D. melanogaster
attatgcacacag

SEQ ID NO: 590395 - DNA, 13 bp, D. melanogaster
attatgcagatga

SEQ ID NO: 590396 - DNA, 13 bp, D. melanogaster
attatgcatacaa

SEQ ID NO: 590397 - DNA, 13 bp, D. melanogaster
attatgcattatt

SEQ ID NO: 590398 - DNA, 13 bp, D. melanogaster
attatgccaaaaa

SEQ ID NO: 590399 - DNA, 13 bp, D. melanogaster
attatgccactcc

SEQ ID NO: 590400 - DNA, 13 bp, D. melanogaster
attatgccattat

SEQ ID NO: 590401 - DNA, 13 bp, D. melanogaster
attatgccgtttt

SEQ ID NO: 590402 - DNA, 13 bp, D. melanogaster
attatgctaaata

SEQ ID NO: 590403 - DNA, 13 bp, D. melanogaster
attatgctaaatg

SEQ ID NO: 590404 - DNA, 13 bp, D. melanogaster
attatgctaatca

SEQ ID NO: 590405 - DNA, 13 bp, D. melanogaster
attatgctgatga

SEQ ID NO: 590406 - DNA, 13 bp, D. melanogaster
attatgctgattt

SEQ ID NO: 590407 - DNA, 13 bp, D. melanogaster
attatgctgcatt

SEQ ID NO: 590408 - DNA, 13 bp, D. melanogaster
attatgcttacaa

SEQ ID NO: 590409 - DNA, 13 bp, D. melanogaster
attatgctttaaa

SEQ ID NO: 590410 - DNA, 13 bp, D. melanogaster
attatggaaaaat

SEQ ID NO: 590411 - DNA, 13 bp, D. melanogaster
attatggaattat

SEQ ID NO: 590412 - DNA, 13 bp, D. melanogaster
attatggagtgca

SEQ ID NO: 590413 - DNA, 14 bp, D. melanogaster
attatggcagaact

SEQ ID NO: 590414 - DNA, 13 bp, D. melanogaster
attatggccacaa

SEQ ID NO: 590415 - DNA, 13 bp, D. melanogaster
attatggtaattt

SEQ ID NO: 590416 - DNA, 13 bp, D. melanogaster
attatgtaaatgt

SEQ ID NO: 590417 - DNA, 13 bp, D. melanogaster
attatgtacatta

SEQ ID NO: 590418 - DNA, 13 bp, D. melanogaster
attatgtagattt

SEQ ID NO: 590419 - DNA, 13 bp, D. melanogaster
attatgtagtctt

SEQ ID NO: 590420 - DNA, 13 bp, D. melanogaster
attatgtatgcaa

SEQ ID NO: 590421 - DNA, 14 bp, D. melanogaster
attatgtatgtaca

SEQ ID NO: 590422 - DNA, 13 bp, D. melanogaster
attatgtcatttg

SEQ ID NO: 590423 - DNA, 13 bp, D. melanogaster
attatgtgcacaa

SEQ ID NO: 590424 - DNA, 13 bp, D. melanogaster
attatgtgtatat

SEQ ID NO: 590425 - DNA, 13 bp, D. melanogaster
attatgttgaaat

SEQ ID NO: 590426 - DNA, 13 bp, D. melanogaster
attatgtttatgc

SEQ ID NO: 590427 - DNA, 13 bp, D. melanogaster
attatgtttgctt

SEQ ID NO: 590428 - DNA, 13 bp, D. melanogaster
attatgttttcat

SEQ ID NO: 590429 - DNA, 13 bp, D. melanogaster
attattaaaactg

SEQ ID NO: 590430 - DNA, 13 bp, D. melanogaster
attattaaaatgc

SEQ ID NO: 590431 - DNA, 13 bp, D. melanogaster
attattaaaggca

SEQ ID NO: 590432 - DNA, 13 bp, D. melanogaster
attattaaagtca

SEQ ID NO: 590433 - DNA, 13 bp, D. melanogaster
attattaaatgga

SEQ ID NO: 590434 - DNA, 13 bp, D. melanogaster
attattaacactt

SEQ ID NO: 590435 - DNA, 13 bp, D. melanogaster
attattaagcaaa

SEQ ID NO: 590436 - DNA, 13 bp, D. melanogaster
attattaagttgc

SEQ ID NO: 590437 - DNA, 13 bp, D. melanogaster
attattaatgcaa

SEQ ID NO: 590438 - DNA, 13 bp, D. melanogaster
attattacagcga

SEQ ID NO: 590439 - DNA, 14 bp, D. melanogaster
attattacagcgat

SEQ ID NO: 590440 - DNA, 13 bp, D. melanogaster
attattacatttg

SEQ ID NO: 590441 - DNA, 13 bp, D. melanogaster
attattaccaaag

SEQ ID NO: 590442 - DNA, 14 bp, D. melanogaster
attattaccaaaga

SEQ ID NO: 590443 - DNA, 13 bp, D. melanogaster
attattacgaaaa

SEQ ID NO: 590444 - DNA, 13 bp, D. melanogaster
attattactttgt

SEQ ID NO: 590445 - DNA, 13 bp, D. melanogaster
attattagcaaat

SEQ ID NO: 590446 - DNA, 13 bp, D. melanogaster
attattagtcatc

SEQ ID NO: 590447 - DNA, 13 bp, D. melanogaster
attattatattgc

SEQ ID NO: 590448 - DNA, 13 bp, D. melanogaster
attattatcaaca

SEQ ID NO: 590449 - DNA, 13 bp, D. melanogaster
attattatccgat

SEQ ID NO: 590450 - DNA, 13 bp, D. melanogaster
attattatgatga

SEQ ID NO: 590451 - DNA, 13 bp, D. melanogaster
attattatgcaaa

SEQ ID NO: 590452 - DNA, 13 bp, D. melanogaster
attattatggcca

SEQ ID NO: 590453 - DNA, 13 bp, D. melanogaster
attattattacac

SEQ ID NO: 590454 - DNA, 14 bp, D. melanogaster
attattattaccat

SEQ ID NO: 590455 - DNA, 13 bp, D. melanogaster
attattattacga

SEQ ID NO: 590456 - DNA, 13 bp, D. melanogaster
attattattatgc

SEQ ID NO: 590457 - DNA, 13 bp, D. melanogaster
attattattccaa

SEQ ID NO: 590458 - DNA, 13 bp, D. melanogaster
attattattggcc

SEQ ID NO: 590459 - DNA, 13 bp, D. melanogaster
attattattttcg

SEQ ID NO: 590460 - DNA, 13 bp, D. melanogaster
attattcaaaagt

SEQ ID NO: 590461 - DNA, 13 bp, D. melanogaster
attattcaaagag

SEQ ID NO: 590462 - DNA, 13 bp, D. melanogaster
attattcaaatca

SEQ ID NO: 590463 - DNA, 13 bp, D. melanogaster
attattcaaatcg

SEQ ID NO: 590464 - DNA, 13 bp, D. melanogaster
attattcagaaaa

SEQ ID NO: 590465 - DNA, 13 bp, D. melanogaster
attattcagatta

SEQ ID NO: 590466 - DNA, 13 bp, D. melanogaster
attattcataact

SEQ ID NO: 590467 - DNA, 13 bp, D. melanogaster
attattcatgcac

SEQ ID NO: 590468 - DNA, 13 bp, D. melanogaster
attattcattgtt

SEQ ID NO: 590469 - DNA, 13 bp, D. melanogaster
attattcgattaa

SEQ ID NO: 590470 - DNA, 13 bp, D. melanogaster
attattctgactt

SEQ ID NO: 590471 - DNA, 13 bp, D. melanogaster
attattgaaattg

SEQ ID NO: 590472 - DNA, 14 bp, D. melanogaster
attattgacaactt

SEQ ID NO: 590473 - DNA, 13 bp, D. melanogaster
attattgattgca

SEQ ID NO: 590474 - DNA, 13 bp, D. melanogaster
attattgattttc

SEQ ID NO: 590475 - DNA, 13 bp, D. melanogaster
attattgcaaaaa

SEQ ID NO: 590476 - DNA, 13 bp, D. melanogaster
attattgcaaaac

SEQ ID NO: 590477 - DNA, 13 bp, D. melanogaster
attattgcaaaat

SEQ ID NO: 590478 - DNA, 13 bp, D. melanogaster
attattgcaaata

SEQ ID NO: 590479 - DNA, 13 bp, D. melanogaster
attattgcattat

SEQ ID NO: 590480 - DNA, 14 bp, D. melanogaster
attattgcattttt

SEQ ID NO: 590481 - DNA, 13 bp, D. melanogaster
attattgccaaaa

SEQ ID NO: 590482 - DNA, 13 bp, D. melanogaster
attattgcccaat

SEQ ID NO: 590483 - DNA, 13 bp, D. melanogaster
attattgcgctga

SEQ ID NO: 590484 - DNA, 13 bp, D. melanogaster
attattgctttta

SEQ ID NO: 590485 - DNA, 13 bp, D. melanogaster
attattggaaaaa

SEQ ID NO: 590486 - DNA, 13 bp, D. melanogaster
attattggaaaat

SEQ ID NO: 590487 - DNA, 13 bp, D. melanogaster
attattggttatg

SEQ ID NO: 590488 - DNA, 13 bp, D. melanogaster
attattggttttc

SEQ ID NO: 590489 - DNA, 13 bp, D. melanogaster
attattgtacttt

SEQ ID NO: 590490 - DNA, 13 bp, D. melanogaster
attattgtcaaaa

SEQ ID NO: 590491 - DNA, 14 bp, D. melanogaster
attattgtcaagtt

SEQ ID NO: 590492 - DNA, 13 bp, D. melanogaster
attattgtgaaaa

SEQ ID NO: 590493 - DNA, 13 bp, D. melanogaster
attattgttgcaa

SEQ ID NO: 590494 - DNA, 13 bp, D. melanogaster
attattgttgcca

SEQ ID NO: 590495 - DNA, 13 bp, D. melanogaster
attattgttgcct

SEQ ID NO: 590496 - DNA, 13 bp, D. melanogaster
attattgtttcta

SEQ ID NO: 590497 - DNA, 13 bp, D. melanogaster
attattgtttgca

SEQ ID NO: 590498 - DNA, 13 bp, D. melanogaster
attattgtttgct

SEQ ID NO: 590499 - DNA, 13 bp, D. melanogaster
attattgttttcc

SEQ ID NO: 590500 - DNA, 13 bp, D. melanogaster
attatttaaacac

SEQ ID NO: 590501 - DNA, 13 bp, D. melanogaster
attatttaagcca

SEQ ID NO: 590502 - DNA, 13 bp, D. melanogaster
attatttacagct

SEQ ID NO: 590503 - DNA, 13 bp, D. melanogaster
attatttactgca

SEQ ID NO: 590504 - DNA, 13 bp, D. melanogaster
attatttatctgt

SEQ ID NO: 590505 - DNA, 13 bp, D. melanogaster
attatttatgcat

SEQ ID NO: 590506 - DNA, 14 bp, D. melanogaster
attatttatgcata

SEQ ID NO: 590507 - DNA, 13 bp, D. melanogaster
attatttattcga

SEQ ID NO: 590508 - DNA, 13 bp, D. melanogaster
attatttcaaaac

SEQ ID NO: 590509 - DNA, 13 bp, D. melanogaster
attatttcaaaga

SEQ ID NO: 590510 - DNA, 13 bp, D. melanogaster
attatttcaatca

SEQ ID NO: 590511 - DNA, 13 bp, D. melanogaster
attatttcaatgt

SEQ ID NO: 590512 - DNA, 13 bp, D. melanogaster
attatttccaatg

SEQ ID NO: 590513 - DNA, 14 bp, D. melanogaster
attatttccaatgt

SEQ ID NO: 590514 - DNA, 13 bp, D. melanogaster
attatttccattg

SEQ ID NO: 590515 - DNA, 13 bp, D. melanogaster
attatttcgattt

SEQ ID NO: 590516 - DNA, 13 bp, D. melanogaster
attatttcgttcg

SEQ ID NO: 590517 - DNA, 13 bp, D. melanogaster
attatttcgtttg

SEQ ID NO: 590518 - DNA, 14 bp, D. melanogaster
attatttcgtttgc

SEQ ID NO: 590519 - DNA, 13 bp, D. melanogaster
attatttctgcct

SEQ ID NO: 590520 - DNA, 13 bp, D. melanogaster
attatttgaatgt

SEQ ID NO: 590521 - DNA, 13 bp, D. melanogaster
attatttgacttt

SEQ ID NO: 590522 - DNA, 13 bp, D. melanogaster
attatttgatcaa

SEQ ID NO: 590523 - DNA, 13 bp, D. melanogaster
attatttgatgac

SEQ ID NO: 590524 - DNA, 14 bp, D. melanogaster
attatttgcaatta

SEQ ID NO: 590525 - DNA, 13 bp, D. melanogaster
attatttgcataa

SEQ ID NO: 590526 - DNA, 13 bp, D. melanogaster
attatttgcattc

SEQ ID NO: 590527 - DNA, 13 bp, D. melanogaster
attatttgcattt

SEQ ID NO: 590528 - DNA, 14 bp, D. melanogaster
attatttgcattta

SEQ ID NO: 590529 - DNA, 13 bp, D. melanogaster
attatttgccaaa

SEQ ID NO: 590530 - DNA, 13 bp, D. melanogaster
attatttgccatt

SEQ ID NO: 590531 - DNA, 13 bp, D. melanogaster
attatttgcccat

SEQ ID NO: 590532 - DNA, 13 bp, D. melanogaster
attatttgctaaa

SEQ ID NO: 590533 - DNA, 13 bp, D. melanogaster
attatttgctgag

SEQ ID NO: 590534 - DNA, 13 bp, D. melanogaster
attatttgcttaa

SEQ ID NO: 590535 - DNA, 13 bp, D. melanogaster
attatttggaaaa

SEQ ID NO: 590536 - DNA, 13 bp, D. melanogaster
attatttggaagc

SEQ ID NO: 590537 - DNA, 13 bp, D. melanogaster
attatttggagaa

SEQ ID NO: 590538 - DNA, 14 bp, D. melanogaster
attatttggagaac

SEQ ID NO: 590539 - DNA, 13 bp, D. melanogaster
attattttaatgc

SEQ ID NO: 590540 - DNA, 13 bp, D. melanogaster
attattttacaac

SEQ ID NO: 590541 - DNA, 13 bp, D. melanogaster
attattttagcat

SEQ ID NO: 590542 - DNA, 13 bp, D. melanogaster
attattttatgct

SEQ ID NO: 590543 - DNA, 13 bp, D. melanogaster
attattttcaact

SEQ ID NO: 590544 - DNA, 13 bp, D. melanogaster
attattttcaatc

SEQ ID NO: 590545 - DNA, 13 bp, D. melanogaster
attattttcaatg

SEQ ID NO: 590546 - DNA, 13 bp, D. melanogaster
attattttccatg

SEQ ID NO: 590547 - DNA, 13 bp, D. melanogaster
attattttcccaa

SEQ ID NO: 590548 - DNA, 13 bp, D. melanogaster
attattttcctac

SEQ ID NO: 590549 - DNA, 14 bp, D. melanogaster
attattttcgaatt

SEQ ID NO: 590550 - DNA, 13 bp, D. melanogaster
attattttcgcaa

SEQ ID NO: 590551 - DNA, 13 bp, D. melanogaster
attattttgcaac

SEQ ID NO: 590552 - DNA, 14 bp, D. melanogaster
attattttgcaatt

SEQ ID NO: 590553 - DNA, 14 bp, D. melanogaster
attattttgcattt

SEQ ID NO: 590554 - DNA, 13 bp, D. melanogaster
attattttgccat

SEQ ID NO: 590555 - DNA, 13 bp, D. melanogaster
attattttgctta

SEQ ID NO: 590556 - DNA, 13 bp, D. melanogaster
attattttggcaa

SEQ ID NO: 590557 - DNA, 13 bp, D. melanogaster
attattttgttgc

SEQ ID NO: 590558 - DNA, 13 bp, D. melanogaster
attatttttccaa

SEQ ID NO: 590559 - DNA, 13 bp, D. melanogaster
attatttttcgca

SEQ ID NO: 590560 - DNA, 13 bp, D. melanogaster
attatttttctga

SEQ ID NO: 590561 - DNA, 13 bp, D. melanogaster
attatttttctgc

SEQ ID NO: 590562 - DNA, 13 bp, D. melanogaster
attatttttctgg

SEQ ID NO: 590563 - DNA, 14 bp, D. melanogaster
attatttttgaaac

SEQ ID NO: 590564 - DNA, 13 bp, D. melanogaster
attatttttgatc

SEQ ID NO: 590565 - DNA, 13 bp, D. melanogaster
attatttttggca

SEQ ID NO: 590566 - DNA, 13 bp, D. melanogaster
attatttttgggg

SEQ ID NO: 590567 - DNA, 13 bp, D. melanogaster
attattttttacg

SEQ ID NO: 590568 - DNA, 13 bp, D. melanogaster
attcaaaaaacga

SEQ ID NO: 590569 - DNA, 13 bp, D. melanogaster
attcaaaaaatgt

SEQ ID NO: 590570 - DNA, 13 bp, D. melanogaster
attcaaaaaattc

SEQ ID NO: 590571 - DNA, 13 bp, D. melanogaster
attcaaaaaattg

SEQ ID NO: 590572 - DNA, 13 bp, D. melanogaster
attcaaaaacttt

SEQ ID NO: 590573 - DNA, 14 bp, D. melanogaster
attcaaaaactttg

SEQ ID NO: 590574 - DNA, 13 bp, D. melanogaster
attcaaaaagtta

SEQ ID NO: 590575 - DNA, 13 bp, D. melanogaster
attcaaaaagttt

SEQ ID NO: 590576 - DNA, 13 bp, D. melanogaster
attcaaaaatgca

SEQ ID NO: 590577 - DNA, 14 bp, D. melanogaster
attcaaaaatgttt

SEQ ID NO: 590578 - DNA, 13 bp, D. melanogaster
attcaaaaccatt

SEQ ID NO: 590579 - DNA, 13 bp, D. melanogaster
attcaaaactcaa

SEQ ID NO: 590580 - DNA, 13 bp, D. melanogaster
attcaaaagaaag

SEQ ID NO: 590581 - DNA, 13 bp, D. melanogaster
attcaaaagattt

SEQ ID NO: 590582 - DNA, 13 bp, D. melanogaster
attcaaaagcaaa

SEQ ID NO: 590583 - DNA, 13 bp, D. melanogaster
attcaaaagcatt

SEQ ID NO: 590584 - DNA, 13 bp, D. melanogaster
attcaaaagccaa

SEQ ID NO: 590585 - DNA, 13 bp, D. melanogaster
attcaaaataagg

SEQ ID NO: 590586 - DNA, 13 bp, D. melanogaster
attcaaaatactt

SEQ ID NO: 590587 - DNA, 13 bp, D. melanogaster
attcaaaatagaa

SEQ ID NO: 590588 - DNA, 13 bp, D. melanogaster
attcaaaatagta

SEQ ID NO: 590589 - DNA, 13 bp, D. melanogaster
attcaaaatatca

SEQ ID NO: 590590 - DNA, 13 bp, D. melanogaster
attcaaaatatgc

SEQ ID NO: 590591 - DNA, 13 bp, D. melanogaster
attcaaaatattc

SEQ ID NO: 590592 - DNA, 13 bp, D. melanogaster
attcaaaatcata

SEQ ID NO: 590593 - DNA, 13 bp, D. melanogaster
attcaaaatcgaa

SEQ ID NO: 590594 - DNA, 13 bp, D. melanogaster
attcaaaatgaaa

SEQ ID NO: 590595 - DNA, 14 bp, D. melanogaster
attcaaaatgaaaa

SEQ ID NO: 590596 - DNA, 13 bp, D. melanogaster
attcaaaatgatt

SEQ ID NO: 590597 - DNA, 13 bp, D. melanogaster
attcaaaatgcaa

SEQ ID NO: 590598 - DNA, 13 bp, D. melanogaster
attcaaaatgcat

SEQ ID NO: 590599 - DNA, 13 bp, D. melanogaster
attcaaaatggaa

SEQ ID NO: 590600 - DNA, 13 bp, D. melanogaster
attcaaaattcaa

SEQ ID NO: 590601 - DNA, 13 bp, D. melanogaster
attcaaaattcta

SEQ ID NO: 590602 - DNA, 13 bp, D. melanogaster
attcaaaattgaa

SEQ ID NO: 590603 - DNA, 13 bp, D. melanogaster
attcaaaattgta

SEQ ID NO: 590604 - DNA, 13 bp, D. melanogaster
attcaaacacaat

SEQ ID NO: 590605 - DNA, 14 bp, D. melanogaster
attcaaacacaatt

SEQ ID NO: 590606 - DNA, 13 bp, D. melanogaster
attcaaacacagg

SEQ ID NO: 590607 - DNA, 13 bp, D. melanogaster
attcaaacaccaa

SEQ ID NO: 590608 - DNA, 13 bp, D. melanogaster
attcaaacagttc

SEQ ID NO: 590609 - DNA, 13 bp, D. melanogaster
attcaaacattca

SEQ ID NO: 590610 - DNA, 13 bp, D. melanogaster
attcaaacatttt

SEQ ID NO: 590611 - DNA, 13 bp, D. melanogaster
attcaaaccgata

SEQ ID NO: 590612 - DNA, 13 bp, D. melanogaster
attcaaactcaaa

SEQ ID NO: 590613 - DNA, 13 bp, D. melanogaster
attcaaagaaatc

SEQ ID NO: 590614 - DNA, 14 bp, D. melanogaster
attcaaagaaatca

SEQ ID NO: 590615 - DNA, 13 bp, D. melanogaster
attcaaaggaaaa

SEQ ID NO: 590616 - DNA, 14 bp, D. melanogaster
attcaaaggaaaac

SEQ ID NO: 590617 - DNA, 13 bp, D. melanogaster
attcaaaggaaat

SEQ ID NO: 590618 - DNA, 13 bp, D. melanogaster
attcaaaggcaaa

SEQ ID NO: 590619 - DNA, 14 bp, D. melanogaster
attcaaaggccttt

SEQ ID NO: 590620 - DNA, 13 bp, D. melanogaster
attcaaagtcaaa

SEQ ID NO: 590621 - DNA, 13 bp, D. melanogaster
attcaaagttatt

SEQ ID NO: 590622 - DNA, 13 bp, D. melanogaster
attcaaagttcaa

SEQ ID NO: 590623 - DNA, 13 bp, D. melanogaster
attcaaataacat

SEQ ID NO: 590624 - DNA, 13 bp, D. melanogaster
attcaaataagtt

SEQ ID NO: 590625 - DNA, 13 bp, D. melanogaster
attcaaataatca

SEQ ID NO: 590626 - DNA, 13 bp, D. melanogaster
attcaaatagatt

SEQ ID NO: 590627 - DNA, 13 bp, D. melanogaster
attcaaatagtta

SEQ ID NO: 590628 - DNA, 13 bp, D. melanogaster
attcaaatatagc

SEQ ID NO: 590629 - DNA, 13 bp, D. melanogaster
attcaaatatttc

SEQ ID NO: 590630 - DNA, 14 bp, D. melanogaster
attcaaatatttgc

SEQ ID NO: 590631 - DNA, 13 bp, D. melanogaster
attcaaatcaatt

SEQ ID NO: 590632 - DNA, 13 bp, D. melanogaster
attcaaatccaaa

SEQ ID NO: 590633 - DNA, 13 bp, D. melanogaster
attcaaatgaaaa

SEQ ID NO: 590634 - DNA, 13 bp, D. melanogaster
attcaaatgaaat

SEQ ID NO: 590635 - DNA, 14 bp, D. melanogaster
attcaaatgaaatc

SEQ ID NO: 590636 - DNA, 14 bp, D. melanogaster
attcaaatgaaatg

SEQ ID NO: 590637 - DNA, 14 bp, D. melanogaster
attcaaatgaaatt

SEQ ID NO: 590638 - DNA, 14 bp, D. melanogaster
attcaaatgaattt

SEQ ID NO: 590639 - DNA, 13 bp, D. melanogaster
attcaaatgacaa

SEQ ID NO: 590640 - DNA, 13 bp, D. melanogaster
attcaaatgcaaa

SEQ ID NO: 590641 - DNA, 14 bp, D. melanogaster
attcaaatgcaaat

SEQ ID NO: 590642 - DNA, 13 bp, D. melanogaster
attcaaatgcaac

SEQ ID NO: 590643 - DNA, 14 bp, D. melanogaster
attcaaatgcagtt

SEQ ID NO: 590644 - DNA, 14 bp, D. melanogaster
attcaaatgcattt

SEQ ID NO: 590645 - DNA, 13 bp, D. melanogaster
attcaaatgcgaa

SEQ ID NO: 590646 - DNA, 14 bp, D. melanogaster
attcaaatggaaat

SEQ ID NO: 590647 - DNA, 13 bp, D. melanogaster
attcaaatggaac

SEQ ID NO: 590648 - DNA, 13 bp, D. melanogaster
attcaaatgtaaa

SEQ ID NO: 590649 - DNA, 13 bp, D. melanogaster
attcaaatgtgtt

SEQ ID NO: 590650 - DNA, 13 bp, D. melanogaster
attcaaattaatg

SEQ ID NO: 590651 - DNA, 14 bp, D. melanogaster
attcaaattaattg

SEQ ID NO: 590652 - DNA, 13 bp, D. melanogaster
attcaaattatgt

SEQ ID NO: 590653 - DNA, 14 bp, D. melanogaster
attcaaattcaaat

SEQ ID NO: 590654 - DNA, 13 bp, D. melanogaster
attcaaattcgtt

SEQ ID NO: 590655 - DNA, 14 bp, D. melanogaster
attcaaattcttgg

SEQ ID NO: 590656 - DNA, 13 bp, D. melanogaster
attcaaattgaac

SEQ ID NO: 590657 - DNA, 14 bp, D. melanogaster
attcaaattgaatt

SEQ ID NO: 590658 - DNA, 13 bp, D. melanogaster
attcaaattgtaa

SEQ ID NO: 590659 - DNA, 13 bp, D. melanogaster
attcaaatttcca

SEQ ID NO: 590660 - DNA, 13 bp, D. melanogaster
attcaaatttgaa

SEQ ID NO: 590661 - DNA, 13 bp, D. melanogaster
attcaaattttct

SEQ ID NO: 590662 - DNA, 13 bp, D. melanogaster
attcaacaacttt

SEQ ID NO: 590663 - DNA, 13 bp, D. melanogaster
attcaacaatttg

SEQ ID NO: 590664 - DNA, 13 bp, D. melanogaster
attcaacactaac

SEQ ID NO: 590665 - DNA, 13 bp, D. melanogaster
attcaacagaaaa

SEQ ID NO: 590666 - DNA, 13 bp, D. melanogaster
attcaacagattt

SEQ ID NO: 590667 - DNA, 13 bp, D. melanogaster
attcaacataaat

SEQ ID NO: 590668 - DNA, 13 bp, D. melanogaster
attcaacatacat

SEQ ID NO: 590669 - DNA, 13 bp, D. melanogaster
attcaacattcaa

SEQ ID NO: 590670 - DNA, 14 bp, D. melanogaster
attcaacatttatt

SEQ ID NO: 590671 - DNA, 13 bp, D. melanogaster
attcaacattttc

SEQ ID NO: 590672 - DNA, 13 bp, D. melanogaster
attcaacattttt

SEQ ID NO: 590673 - DNA, 13 bp, D. melanogaster
attcaactaacat

SEQ ID NO: 590674 - DNA, 13 bp, D. melanogaster
attcaactattta

SEQ ID NO: 590675 - DNA, 13 bp, D. melanogaster
attcaactgcatt

SEQ ID NO: 590676 - DNA, 13 bp, D. melanogaster
attcaacttcttg

SEQ ID NO: 590677 - DNA, 13 bp, D. melanogaster
attcaactttaaa

SEQ ID NO: 590678 - DNA, 13 bp, D. melanogaster
attcaacttttgt

SEQ ID NO: 590679 - DNA, 13 bp, D. melanogaster
attcaagaaattc

SEQ ID NO: 590680 - DNA, 13 bp, D. melanogaster
attcaagaaattt

SEQ ID NO: 590681 - DNA, 13 bp, D. melanogaster
attcaagaagaaa

SEQ ID NO: 590682 - DNA, 13 bp, D. melanogaster
attcaagaatata

SEQ ID NO: 590683 - DNA, 13 bp, D. melanogaster
attcaagatattt

SEQ ID NO: 590684 - DNA, 13 bp, D. melanogaster
attcaagattttt

SEQ ID NO: 590685 - DNA, 13 bp, D. melanogaster
attcaagccttac

SEQ ID NO: 590686 - DNA, 14 bp, D. melanogaster
attcaaggaggatg

SEQ ID NO: 590687 - DNA, 13 bp, D. melanogaster
attcaagggaaat

SEQ ID NO: 590688 - DNA, 13 bp, D. melanogaster
attcaagtaaaaa

SEQ ID NO: 590689 - DNA, 13 bp, D. melanogaster
attcaagtaaagt

SEQ ID NO: 590690 - DNA, 13 bp, D. melanogaster
attcaagtgattt

SEQ ID NO: 590691 - DNA, 13 bp, D. melanogaster
attcaagtgcatt

SEQ ID NO: 590692 - DNA, 13 bp, D. melanogaster
attcaagtttggg

SEQ ID NO: 590693 - DNA, 13 bp, D. melanogaster
attcaagttttgc

SEQ ID NO: 590694 - DNA, 13 bp, D. melanogaster
attcaagttttta

SEQ ID NO: 590695 - DNA, 13 bp, D. melanogaster
attcaataaacat

SEQ ID NO: 590696 - DNA, 13 bp, D. melanogaster
attcaataaactt

SEQ ID NO: 590697 - DNA, 13 bp, D. melanogaster
attcaataaagaa

SEQ ID NO: 590698 - DNA, 13 bp, D. melanogaster
attcaataaatca

SEQ ID NO: 590699 - DNA, 13 bp, D. melanogaster
attcaataaattg

SEQ ID NO: 590700 - DNA, 13 bp, D. melanogaster
attcaatacaatt

SEQ ID NO: 590701 - DNA, 13 bp, D. melanogaster
attcaataccaac

SEQ ID NO: 590702 - DNA, 13 bp, D. melanogaster
attcaatagaaaa

SEQ ID NO: 590703 - DNA, 13 bp, D. melanogaster
attcaatatctat

SEQ ID NO: 590704 - DNA, 13 bp, D. melanogaster
attcaatatgttt

SEQ ID NO: 590705 - DNA, 13 bp, D. melanogaster
attcaatatttac

SEQ ID NO: 590706 - DNA, 13 bp, D. melanogaster
attcaatcaaaag

SEQ ID NO: 590707 - DNA, 13 bp, D. melanogaster
attcaatcaaaat

SEQ ID NO: 590708 - DNA, 13 bp, D. melanogaster
attcaatcaatca

SEQ ID NO: 590709 - DNA, 13 bp, D. melanogaster
attcaatcatgaa

SEQ ID NO: 590710 - DNA, 13 bp, D. melanogaster
attcaatccaatt

SEQ ID NO: 590711 - DNA, 14 bp, D. melanogaster
attcaatcgttcaa

SEQ ID NO: 590712 - DNA, 13 bp, D. melanogaster
attcaatgaaatt

SEQ ID NO: 590713 - DNA, 13 bp, D. melanogaster
attcaatgcaaat

SEQ ID NO: 590714 - DNA, 13 bp, D. melanogaster
attcaatgcaatt

SEQ ID NO: 590715 - DNA, 14 bp, D. melanogaster
attcaatgccataa

SEQ ID NO: 590716 - DNA, 13 bp, D. melanogaster
attcaatgcgatt

SEQ ID NO: 590717 - DNA, 13 bp, D. melanogaster
attcaatgcggtc

SEQ ID NO: 590718 - DNA, 13 bp, D. melanogaster
attcaatggaatt

SEQ ID NO: 590719 - DNA, 13 bp, D. melanogaster
attcaatggcaaa

SEQ ID NO: 590720 - DNA, 13 bp, D. melanogaster
attcaatggcatt

SEQ ID NO: 590721 - DNA, 14 bp, D. melanogaster
attcaatgtactta

SEQ ID NO: 590722 - DNA, 13 bp, D. melanogaster
attcaattaaaag

SEQ ID NO: 590723 - DNA, 13 bp, D. melanogaster
attcaattaaaca

SEQ ID NO: 590724 - DNA, 13 bp, D. melanogaster
attcaattaaact

SEQ ID NO: 590725 - DNA, 13 bp, D. melanogaster
attcaattaaagc

SEQ ID NO: 590726 - DNA, 13 bp, D. melanogaster
attcaattaaatg

SEQ ID NO: 590727 - DNA, 14 bp, D. melanogaster
attcaattaaatgt

SEQ ID NO: 590728 - DNA, 13 bp, D. melanogaster
attcaattaacaa

SEQ ID NO: 590729 - DNA, 14 bp, D. melanogaster
attcaattaatttg

SEQ ID NO: 590730 - DNA, 13 bp, D. melanogaster
attcaattacaat

SEQ ID NO: 590731 - DNA, 13 bp, D. melanogaster
attcaattacttt

SEQ ID NO: 590732 - DNA, 13 bp, D. melanogaster
attcaattagatt

SEQ ID NO: 590733 - DNA, 13 bp, D. melanogaster
attcaattatgca

SEQ ID NO: 590734 - DNA, 13 bp, D. melanogaster
attcaattatttc

SEQ ID NO: 590735 - DNA, 13 bp, D. melanogaster
attcaattcaaaa

SEQ ID NO: 590736 - DNA, 13 bp, D. melanogaster
attcaattcaaac

SEQ ID NO: 590737 - DNA, 13 bp, D. melanogaster
attcaattcaaat

SEQ ID NO: 590738 - DNA, 13 bp, D. melanogaster
attcaattcaatg

SEQ ID NO: 590739 - DNA, 13 bp, D. melanogaster
attcaattcaatt

SEQ ID NO: 590740 - DNA, 14 bp, D. melanogaster
attcaattcaattc

SEQ ID NO: 590741 - DNA, 14 bp, D. melanogaster
attcaattcaattt

SEQ ID NO: 590742 - DNA, 14 bp, D. melanogaster
attcaattcagttt

SEQ ID NO: 590743 - DNA, 13 bp, D. melanogaster
attcaattcgaaa

SEQ ID NO: 590744 - DNA, 13 bp, D. melanogaster
attcaattcgatt

SEQ ID NO: 590745 - DNA, 13 bp, D. melanogaster
attcaattgaaac

SEQ ID NO: 590746 - DNA, 13 bp, D. melanogaster
attcaattgaatc

SEQ ID NO: 590747 - DNA, 13 bp, D. melanogaster
attcaattgatta

SEQ ID NO: 590748 - DNA, 13 bp, D. melanogaster
attcaattgattt

SEQ ID NO: 590749 - DNA, 14 bp, D. melanogaster
attcaattgatttt

SEQ ID NO: 590750 - DNA, 13 bp, D. melanogaster
attcaattgcagc

SEQ ID NO: 590751 - DNA, 14 bp, D. melanogaster
attcaattgcattt

SEQ ID NO: 590752 - DNA, 13 bp, D. melanogaster
attcaattgcttg

SEQ ID NO: 590753 - DNA, 13 bp, D. melanogaster
attcaattgcttt

SEQ ID NO: 590754 - DNA, 13 bp, D. melanogaster
attcaattggaat

SEQ ID NO: 590755 - DNA, 13 bp, D. melanogaster
attcaattgtata

SEQ ID NO: 590756 - DNA, 13 bp, D. melanogaster
attcaattgtgtt

SEQ ID NO: 590757 - DNA, 14 bp, D. melanogaster
attcaattgttttt

SEQ ID NO: 590758 - DNA, 13 bp, D. melanogaster
attcaatttacac

SEQ ID NO: 590759 - DNA, 14 bp, D. melanogaster
attcaatttacaca

SEQ ID NO: 590760 - DNA, 13 bp, D. melanogaster
attcaatttactt

SEQ ID NO: 590761 - DNA, 13 bp, D. melanogaster
attcaatttcaaa

SEQ ID NO: 590762 - DNA, 13 bp, D. melanogaster
attcaatttcaat

SEQ ID NO: 590763 - DNA, 13 bp, D. melanogaster
attcaatttccat

SEQ ID NO: 590764 - DNA, 14 bp, D. melanogaster
attcaatttcttct

SEQ ID NO: 590765 - DNA, 13 bp, D. melanogaster
attcaatttgaat

SEQ ID NO: 590766 - DNA, 13 bp, D. melanogaster
attcaatttgagt

SEQ ID NO: 590767 - DNA, 14 bp, D. melanogaster
attcaatttgattt

SEQ ID NO: 590768 - DNA, 13 bp, D. melanogaster
attcaatttgcaa

SEQ ID NO: 590769 - DNA, 13 bp, D. melanogaster
attcaatttgcag

SEQ ID NO: 590770 - DNA, 13 bp, D. melanogaster
attcaatttgccc

SEQ ID NO: 590771 - DNA, 13 bp, D. melanogaster
attcaatttggag

SEQ ID NO: 590772 - DNA, 14 bp, D. melanogaster
attcaatttggcca

SEQ ID NO: 590773 - DNA, 13 bp, D. melanogaster
attcaatttgtag

SEQ ID NO: 590774 - DNA, 13 bp, D. melanogaster
attcaatttgtca

SEQ ID NO: 590775 - DNA, 13 bp, D. melanogaster
attcaatttgtgg

SEQ ID NO: 590776 - DNA, 13 bp, D. melanogaster
attcaattttaag

SEQ ID NO: 590777 - DNA, 13 bp, D. melanogaster
attcaattttatg

SEQ ID NO: 590778 - DNA, 13 bp, D. melanogaster
attcaattttgat

SEQ ID NO: 590779 - DNA, 13 bp, D. melanogaster
attcaattttgtg

SEQ ID NO: 590780 - DNA, 13 bp, D. melanogaster
attcacaaagtca

SEQ ID NO: 590781 - DNA, 13 bp, D. melanogaster
attcacaaatatt

SEQ ID NO: 590782 - DNA, 13 bp, D. melanogaster
attcacaatattt

SEQ ID NO: 590783 - DNA, 13 bp, D. melanogaster
attcacacaaatt

SEQ ID NO: 590784 - DNA, 13 bp, D. melanogaster
attcacacacaca

SEQ ID NO: 590785 - DNA, 14 bp, D. melanogaster
attcacacacacac

SEQ ID NO: 590786 - DNA, 13 bp, D. melanogaster
attcacacgccga

SEQ ID NO: 590787 - DNA, 13 bp, D. melanogaster
attcacactagct

SEQ ID NO: 590788 - DNA, 13 bp, D. melanogaster
attcacagtttaa

SEQ ID NO: 590789 - DNA, 13 bp, D. melanogaster
attcacataaaat

SEQ ID NO: 590790 - DNA, 13 bp, D. melanogaster
attcacatacaaa

SEQ ID NO: 590791 - DNA, 13 bp, D. melanogaster
attcacatacaca

SEQ ID NO: 590792 - DNA, 13 bp, D. melanogaster
attcacatgcaaa

SEQ ID NO: 590793 - DNA, 13 bp, D. melanogaster
attcacatgcatt

SEQ ID NO: 590794 - DNA, 13 bp, D. melanogaster
attcacattcaca

SEQ ID NO: 590795 - DNA, 14 bp, D. melanogaster
attcacattcacat

SEQ ID NO: 590796 - DNA, 13 bp, D. melanogaster
attcacattcaga

SEQ ID NO: 590797 - DNA, 13 bp, D. melanogaster
attcacatttatt

SEQ ID NO: 590798 - DNA, 13 bp, D. melanogaster
attcaccaatatc

SEQ ID NO: 590799 - DNA, 13 bp, D. melanogaster
attcaccattcac

SEQ ID NO: 590800 - DNA, 14 bp, D. melanogaster
attcaccattcacc

SEQ ID NO: 590801 - DNA, 13 bp, D. melanogaster
attcacccacaca

SEQ ID NO: 590802 - DNA, 13 bp, D. melanogaster
attcacccagcca

SEQ ID NO: 590803 - DNA, 13 bp, D. melanogaster
attcacctccgcc

SEQ ID NO: 590804 - DNA, 13 bp, D. melanogaster
attcacctgttca

SEQ ID NO: 590805 - DNA, 13 bp, D. melanogaster
attcactatttta

SEQ ID NO: 590806 - DNA, 13 bp, D. melanogaster
attcactcaaaaa

SEQ ID NO: 590807 - DNA, 14 bp, D. melanogaster
attcactcactcac

SEQ ID NO: 590808 - DNA, 13 bp, D. melanogaster
attcactcattca

SEQ ID NO: 590809 - DNA, 13 bp, D. melanogaster
attcacttgaatt

SEQ ID NO: 590810 - DNA, 13 bp, D. melanogaster
attcacttgactt

SEQ ID NO: 590811 - DNA, 13 bp, D. melanogaster
attcacttgattt

SEQ ID NO: 590812 - DNA, 13 bp, D. melanogaster
attcacttggcca

SEQ ID NO: 590813 - DNA, 13 bp, D. melanogaster
attcacttggctt

SEQ ID NO: 590814 - DNA, 13 bp, D. melanogaster
attcactttatat

SEQ ID NO: 590815 - DNA, 13 bp, D. melanogaster
attcacttttaaa

SEQ ID NO: 590816 - DNA, 13 bp, D. melanogaster
attcacttttcac

SEQ ID NO: 590817 - DNA, 13 bp, D. melanogaster
attcacttttcca

SEQ ID NO: 590818 - DNA, 13 bp, D. melanogaster
attcagaaataat

SEQ ID NO: 590819 - DNA, 13 bp, D. melanogaster
attcagaaatatt

SEQ ID NO: 590820 - DNA, 13 bp, D. melanogaster
attcagaactacc

SEQ ID NO: 590821 - DNA, 13 bp, D. melanogaster
attcagatacaga

SEQ ID NO: 590822 - DNA, 14 bp, D. melanogaster
attcagatacagat

SEQ ID NO: 590823 - DNA, 13 bp, D. melanogaster
attcagatacata

SEQ ID NO: 590824 - DNA, 13 bp, D. melanogaster
attcagatattca

SEQ ID NO: 590825 - DNA, 14 bp, D. melanogaster
attcagatattttt

SEQ ID NO: 590826 - DNA, 13 bp, D. melanogaster
attcagatccaga

SEQ ID NO: 590827 - DNA, 14 bp, D. melanogaster
attcagatccagat

SEQ ID NO: 590828 - DNA, 13 bp, D. melanogaster
attcagatgcaga

SEQ ID NO: 590829 - DNA, 13 bp, D. melanogaster
attcagattcacg

SEQ ID NO: 590830 - DNA, 14 bp, D. melanogaster
attcagattcagat

SEQ ID NO: 590831 - DNA, 14 bp, D. melanogaster
attcagattcagtt

SEQ ID NO: 590832 - DNA, 13 bp, D. melanogaster
attcagattcatt

SEQ ID NO: 590833 - DNA, 14 bp, D. melanogaster
attcagattccgat

SEQ ID NO: 590834 - DNA, 13 bp, D. melanogaster
attcagcaaattt

SEQ ID NO: 590835 - DNA, 13 bp, D. melanogaster
attcagcatgtac

SEQ ID NO: 590836 - DNA, 13 bp, D. melanogaster
attcagcattcag

SEQ ID NO: 590837 - DNA, 13 bp, D. melanogaster
attcagccattca

SEQ ID NO: 590838 - DNA, 13 bp, D. melanogaster
attcagctgcaaa

SEQ ID NO: 590839 - DNA, 13 bp, D. melanogaster
attcagctggcca

SEQ ID NO: 590840 - DNA, 13 bp, D. melanogaster
attcagctttaac

SEQ ID NO: 590841 - DNA, 13 bp, D. melanogaster
attcaggaatttc

SEQ ID NO: 590842 - DNA, 13 bp, D. melanogaster
attcaggattcag

SEQ ID NO: 590843 - DNA, 13 bp, D. melanogaster
attcagtattatt

SEQ ID NO: 590844 - DNA, 14 bp, D. melanogaster
attcagtattattt

SEQ ID NO: 590845 - DNA, 13 bp, D. melanogaster
attcagttaaatt

SEQ ID NO: 590846 - DNA, 13 bp, D. melanogaster
attcagttcaatt

SEQ ID NO: 590847 - DNA, 13 bp, D. melanogaster
attcagttcagtt

SEQ ID NO: 590848 - DNA, 13 bp, D. melanogaster
attcagttcattt

SEQ ID NO: 590849 - DNA, 13 bp, D. melanogaster
attcagttggcca

SEQ ID NO: 590850 - DNA, 13 bp, D. melanogaster
attcagtttcagt

SEQ ID NO: 590851 - DNA, 13 bp, D. melanogaster
attcagttttata

SEQ ID NO: 590852 - DNA, 13 bp, D. melanogaster
attcagttttcgt

SEQ ID NO: 590853 - DNA, 13 bp, D. melanogaster
attcagttttctt

SEQ ID NO: 590854 - DNA, 13 bp, D. melanogaster
attcagtttttca

SEQ ID NO: 590855 - DNA, 13 bp, D. melanogaster
attcataaaatgt

SEQ ID NO: 590856 - DNA, 13 bp, D. melanogaster
attcataaatcaa

SEQ ID NO: 590857 - DNA, 13 bp, D. melanogaster
attcataaatgca

SEQ ID NO: 590858 - DNA, 13 bp, D. melanogaster
attcataaattca

SEQ ID NO: 590859 - DNA, 13 bp, D. melanogaster
attcataattcat

SEQ ID NO: 590860 - DNA, 14 bp, D. melanogaster
attcataattcata

SEQ ID NO: 590861 - DNA, 13 bp, D. melanogaster
attcataattgaa

SEQ ID NO: 590862 - DNA, 13 bp, D. melanogaster
attcatacaattt

SEQ ID NO: 590863 - DNA, 13 bp, D. melanogaster
attcatatacata

SEQ ID NO: 590864 - DNA, 13 bp, D. melanogaster
attcatatatgca

SEQ ID NO: 590865 - DNA, 14 bp, D. melanogaster
attcatatgcaaat

SEQ ID NO: 590866 - DNA, 13 bp, D. melanogaster
attcatatgtata

SEQ ID NO: 590867 - DNA, 13 bp, D. melanogaster
attcatatgtatt

SEQ ID NO: 590868 - DNA, 13 bp, D. melanogaster
attcatattcaaa

SEQ ID NO: 590869 - DNA, 14 bp, D. melanogaster
attcatattcatat

SEQ ID NO: 590870 - DNA, 13 bp, D. melanogaster
attcatattcatg

SEQ ID NO: 590871 - DNA, 13 bp, D. melanogaster
attcatattcatt

SEQ ID NO: 590872 - DNA, 13 bp, D. melanogaster
attcatattgttt

SEQ ID NO: 590873 - DNA, 13 bp, D. melanogaster
attcatatttatg

SEQ ID NO: 590874 - DNA, 13 bp, D. melanogaster
attcatatttgta

SEQ ID NO: 590875 - DNA, 13 bp, D. melanogaster
attcatatttgtt

SEQ ID NO: 590876 - DNA, 13 bp, D. melanogaster
attcatattttcc

SEQ ID NO: 590877 - DNA, 13 bp, D. melanogaster
attcatatttttg

SEQ ID NO: 590878 - DNA, 14 bp, D. melanogaster
attcatcaattatt

SEQ ID NO: 590879 - DNA, 13 bp, D. melanogaster
attcatcatcatc

SEQ ID NO: 590880 - DNA, 13 bp, D. melanogaster
attcatccatcca

SEQ ID NO: 590881 - DNA, 13 bp, D. melanogaster
attcatcgcttct

SEQ ID NO: 590882 - DNA, 13 bp, D. melanogaster
attcatctgatga

SEQ ID NO: 590883 - DNA, 13 bp, D. melanogaster
attcatctgtcca

SEQ ID NO: 590884 - DNA, 13 bp, D. melanogaster
attcatgaaaatg

SEQ ID NO: 590885 - DNA, 13 bp, D. melanogaster
attcatgatcgac

SEQ ID NO: 590886 - DNA, 13 bp, D. melanogaster
attcatgtggcac

SEQ ID NO: 590887 - DNA, 13 bp, D. melanogaster
attcatgttttta

SEQ ID NO: 590888 - DNA, 13 bp, D. melanogaster
attcattagcatt

SEQ ID NO: 590889 - DNA, 13 bp, D. melanogaster
attcattatgaaa

SEQ ID NO: 590890 - DNA, 13 bp, D. melanogaster
attcattcaactc

SEQ ID NO: 590891 - DNA, 13 bp, D. melanogaster
attcattcaatta

SEQ ID NO: 590892 - DNA, 13 bp, D. melanogaster
attcattcagcca

SEQ ID NO: 590893 - DNA, 13 bp, D. melanogaster
attcattcagttt

SEQ ID NO: 590894 - DNA, 14 bp, D. melanogaster
attcattcataaaa

SEQ ID NO: 590895 - DNA, 13 bp, D. melanogaster
attcattcataag

SEQ ID NO: 590896 - DNA, 13 bp, D. melanogaster
attcattcattca

SEQ ID NO: 590897 - DNA, 13 bp, D. melanogaster
attcattcattga

SEQ ID NO: 590898 - DNA, 13 bp, D. melanogaster
attcattcattta

SEQ ID NO: 590899 - DNA, 13 bp, D. melanogaster
attcattcatttg

SEQ ID NO: 590900 - DNA, 13 bp, D. melanogaster
attcattccaaag

SEQ ID NO: 590901 - DNA, 13 bp, D. melanogaster
attcattccattc

SEQ ID NO: 590902 - DNA, 13 bp, D. melanogaster
attcattcgattt

SEQ ID NO: 590903 - DNA, 13 bp, D. melanogaster
attcattcgcatt

SEQ ID NO: 590904 - DNA, 13 bp, D. melanogaster
attcattctgcaa

SEQ ID NO: 590905 - DNA, 15 bp, D. melanogaster
attcattctgcaact

SEQ ID NO: 590906 - DNA, 14 bp, D. melanogaster
attcattgaaaagt

SEQ ID NO: 590907 - DNA, 14 bp, D. melanogaster
attcattgaaattg

SEQ ID NO: 590908 - DNA, 13 bp, D. melanogaster
attcattgaatgt

SEQ ID NO: 590909 - DNA, 13 bp, D. melanogaster
attcattgatttt

SEQ ID NO: 590910 - DNA, 13 bp, D. melanogaster
attcattggaaat

SEQ ID NO: 590911 - DNA, 13 bp, D. melanogaster
attcatttaaaga

SEQ ID NO: 590912 - DNA, 13 bp, D. melanogaster
attcatttaaagt

SEQ ID NO: 590913 - DNA, 13 bp, D. melanogaster
attcatttaagta

SEQ ID NO: 590914 - DNA, 13 bp, D. melanogaster
attcatttatgca

SEQ ID NO: 590915 - DNA, 13 bp, D. melanogaster
attcatttatgta

SEQ ID NO: 590916 - DNA, 13 bp, D. melanogaster
attcatttcaaat

SEQ ID NO: 590917 - DNA, 14 bp, D. melanogaster
attcatttcaaata

SEQ ID NO: 590918 - DNA, 13 bp, D. melanogaster
attcatttcgaaa

SEQ ID NO: 590919 - DNA, 14 bp, D. melanogaster
attcatttgaaatt

SEQ ID NO: 590920 - DNA, 13 bp, D. melanogaster
attcatttgattt

SEQ ID NO: 590921 - DNA, 13 bp, D. melanogaster
attcatttgcaca

SEQ ID NO: 590922 - DNA, 13 bp, D. melanogaster
attcatttgccat

SEQ ID NO: 590923 - DNA, 13 bp, D. melanogaster
attcatttggaaa

SEQ ID NO: 590924 - DNA, 13 bp, D. melanogaster
attcatttggctt

SEQ ID NO: 590925 - DNA, 13 bp, D. melanogaster
attcatttggttt

SEQ ID NO: 590926 - DNA, 14 bp, D. melanogaster
attcatttgtattt

SEQ ID NO: 590927 - DNA, 13 bp, D. melanogaster
attcatttgtgtg

SEQ ID NO: 590928 - DNA, 13 bp, D. melanogaster
attcatttgttat

SEQ ID NO: 590929 - DNA, 13 bp, D. melanogaster
attcatttgttgc

SEQ ID NO: 590930 - DNA, 14 bp, D. melanogaster
attcatttgttgtt

SEQ ID NO: 590931 - DNA, 13 bp, D. melanogaster
attcattttccat

SEQ ID NO: 590932 - DNA, 13 bp, D. melanogaster
attcattttcgat

SEQ ID NO: 590933 - DNA, 13 bp, D. melanogaster
attcattttgaat

SEQ ID NO: 590934 - DNA, 13 bp, D. melanogaster
attcattttgcat

SEQ ID NO: 590935 - DNA, 13 bp, D. melanogaster
attcattttggct

SEQ ID NO: 590936 - DNA, 13 bp, D. melanogaster
attcattttggtt

SEQ ID NO: 590937 - DNA, 13 bp, D. melanogaster
attcattttgtaa

SEQ ID NO: 590938 - DNA, 13 bp, D. melanogaster
attcattttgttg

SEQ ID NO: 590939 - DNA, 13 bp, D. melanogaster
attcatttttaac

SEQ ID NO: 590940 - DNA, 13 bp, D. melanogaster
attcatttttgta

SEQ ID NO: 590941 - DNA, 13 bp, D. melanogaster
attccaaaaaatg

SEQ ID NO: 590942 - DNA, 13 bp, D. melanogaster
attccaaaaggca

SEQ ID NO: 590943 - DNA, 13 bp, D. melanogaster
attccaaaataat

SEQ ID NO: 590944 - DNA, 13 bp, D. melanogaster
attccaaaatatt

SEQ ID NO: 590945 - DNA, 13 bp, D. melanogaster
attccaaaatgca

SEQ ID NO: 590946 - DNA, 13 bp, D. melanogaster
attccaaaatgtt

SEQ ID NO: 590947 - DNA, 13 bp, D. melanogaster
attccaaacaaat

SEQ ID NO: 590948 - DNA, 13 bp, D. melanogaster
attccaaagaaat

SEQ ID NO: 590949 - DNA, 13 bp, D. melanogaster
attccaaagaatg

SEQ ID NO: 590950 - DNA, 13 bp, D. melanogaster
attccaaagccag

SEQ ID NO: 590951 - DNA, 13 bp, D. melanogaster
attccaaagcctg

SEQ ID NO: 590952 - DNA, 13 bp, D. melanogaster
attccaaagggtg

SEQ ID NO: 590953 - DNA, 13 bp, D. melanogaster
attccaaataaac

SEQ ID NO: 590954 - DNA, 13 bp, D. melanogaster
attccaaataaat

SEQ ID NO: 590955 - DNA, 13 bp, D. melanogaster
attccaaatatat

SEQ ID NO: 590956 - DNA, 13 bp, D. melanogaster
attccaaatcaat

SEQ ID NO: 590957 - DNA, 13 bp, D. melanogaster
attccaaatcgaa

SEQ ID NO: 590958 - DNA, 13 bp, D. melanogaster
attccaaatgaaa

SEQ ID NO: 590959 - DNA, 13 bp, D. melanogaster
attccaaatgcac

SEQ ID NO: 590960 - DNA, 13 bp, D. melanogaster
attccaaatgcat

SEQ ID NO: 590961 - DNA, 13 bp, D. melanogaster
attccaaattcaa

SEQ ID NO: 590962 - DNA, 13 bp, D. melanogaster
attccaaattgtt

SEQ ID NO: 590963 - DNA, 13 bp, D. melanogaster
attccaacaaatg

SEQ ID NO: 590964 - DNA, 13 bp, D. melanogaster
attccaacaatgc

SEQ ID NO: 590965 - DNA, 13 bp, D. melanogaster
attccaagaaatt

SEQ ID NO: 590966 - DNA, 13 bp, D. melanogaster
attccaagaagta

SEQ ID NO: 590967 - DNA, 13 bp, D. melanogaster
attccaataaatt

SEQ ID NO: 590968 - DNA, 13 bp, D. melanogaster
attccaataccaa

SEQ ID NO: 590969 - DNA, 13 bp, D. melanogaster
attccaatatttt

SEQ ID NO: 590970 - DNA, 13 bp, D. melanogaster
attccaatgccaa

SEQ ID NO: 590971 - DNA, 13 bp, D. melanogaster
attccaattaata

SEQ ID NO: 590972 - DNA, 14 bp, D. melanogaster
attccaattccaat

SEQ ID NO: 590973 - DNA, 13 bp, D. melanogaster
attccaattccat

SEQ ID NO: 590974 - DNA, 13 bp, D. melanogaster
attccaattccga

SEQ ID NO: 590975 - DNA, 13 bp, D. melanogaster
attccaattgaat

SEQ ID NO: 590976 - DNA, 13 bp, D. melanogaster
attccaattgatt

SEQ ID NO: 590977 - DNA, 13 bp, D. melanogaster
attccaattgcaa

SEQ ID NO: 590978 - DNA, 13 bp, D. melanogaster
attccaattggaa

SEQ ID NO: 590979 - DNA, 13 bp, D. melanogaster
attccaatttatt

SEQ ID NO: 590980 - DNA, 14 bp, D. melanogaster
attccaatttcaat

SEQ ID NO: 590981 - DNA, 13 bp, D. melanogaster
attccaatttcga

SEQ ID NO: 590982 - DNA, 13 bp, D. melanogaster
attccaatttgat

SEQ ID NO: 590983 - DNA, 13 bp, D. melanogaster
attccaattttaa

SEQ ID NO: 590984 - DNA, 13 bp, D. melanogaster
attccaatttttg

SEQ ID NO: 590985 - DNA, 13 bp, D. melanogaster
attccacaaaaat

SEQ ID NO: 590986 - DNA, 13 bp, D. melanogaster
attccacaacagc

SEQ ID NO: 590987 - DNA, 14 bp, D. melanogaster
attccacaccactt

SEQ ID NO: 590988 - DNA, 13 bp, D. melanogaster
attccaccagata

SEQ ID NO: 590989 - DNA, 13 bp, D. melanogaster
attccacgaccaa

SEQ ID NO: 590990 - DNA, 13 bp, D. melanogaster
attccacgattac

SEQ ID NO: 590991 - DNA, 13 bp, D. melanogaster
attccacgttgac

SEQ ID NO: 590992 - DNA, 13 bp, D. melanogaster
attccagaaaaat

SEQ ID NO: 590993 - DNA, 13 bp, D. melanogaster
attccagcaaaaa

SEQ ID NO: 590994 - DNA, 13 bp, D. melanogaster
attccagcaatta

SEQ ID NO: 590995 - DNA, 14 bp, D. melanogaster
attccagcaattat

SEQ ID NO: 590996 - DNA, 13 bp, D. melanogaster
attccagttccag

SEQ ID NO: 590997 - DNA, 13 bp, D. melanogaster
attccagttctca

SEQ ID NO: 590998 - DNA, 13 bp, D. melanogaster
attccataaaaat

SEQ ID NO: 590999 - DNA, 13 bp, D. melanogaster
attccatatatat

SEQ ID NO: 591000 - DNA, 13 bp, D. melanogaster
attccatatattc

SEQ ID NO: 591001 - DNA, 13 bp, D. melanogaster
attccatatcgta

SEQ ID NO: 591002 - DNA, 13 bp, D. melanogaster
attccatattcca

SEQ ID NO: 591003 - DNA, 14 bp, D. melanogaster
attccatattccat

SEQ ID NO: 591004 - DNA, 13 bp, D. melanogaster
attccatcaaatc

SEQ ID NO: 591005 - DNA, 14 bp, D. melanogaster
attccatcaaatcc

SEQ ID NO: 591006 - DNA, 13 bp, D. melanogaster
attccatcaatta

SEQ ID NO: 591007 - DNA, 13 bp, D. melanogaster
attccatcacacg

SEQ ID NO: 591008 - DNA, 13 bp, D. melanogaster
attccatcagata

SEQ ID NO: 591009 - DNA, 13 bp, D. melanogaster
attccatcccatc

SEQ ID NO: 591010 - DNA, 14 bp, D. melanogaster
attccatcgtatat

SEQ ID NO: 591011 - DNA, 13 bp, D. melanogaster
attccatgccaac

SEQ ID NO: 591012 - DNA, 13 bp, D. melanogaster
attccatgccata

SEQ ID NO: 591013 - DNA, 13 bp, D. melanogaster
attccattaataa

SEQ ID NO: 591014 - DNA, 13 bp, D. melanogaster
attccattaatca

SEQ ID NO: 591015 - DNA, 13 bp, D. melanogaster
attccattaattt

SEQ ID NO: 591016 - DNA, 13 bp, D. melanogaster
attccattatatt

SEQ ID NO: 591017 - DNA, 13 bp, D. melanogaster
attccattcaatt

SEQ ID NO: 591018 - DNA, 14 bp, D. melanogaster
attccattcagtat

SEQ ID NO: 591019 - DNA, 13 bp, D. melanogaster
attccattccaca

SEQ ID NO: 591020 - DNA, 13 bp, D. melanogaster
attccattccact

SEQ ID NO: 591021 - DNA, 13 bp, D. melanogaster
attccattccatt

SEQ ID NO: 591022 - DNA, 14 bp, D. melanogaster
attccattccattc

SEQ ID NO: 591023 - DNA, 14 bp, D. melanogaster
attccattccattt

SEQ ID NO: 591024 - DNA, 13 bp, D. melanogaster
attccattccgtt

SEQ ID NO: 591025 - DNA, 14 bp, D. melanogaster
attccattctattc

SEQ ID NO: 591026 - DNA, 13 bp, D. melanogaster
attccattgccat

SEQ ID NO: 591027 - DNA, 13 bp, D. melanogaster
attccattgcggc

SEQ ID NO: 591028 - DNA, 14 bp, D. melanogaster
attccattgcggca

SEQ ID NO: 591029 - DNA, 13 bp, D. melanogaster
attccattgtttt

SEQ ID NO: 591030 - DNA, 13 bp, D. melanogaster
attccatttatta

SEQ ID NO: 591031 - DNA, 13 bp, D. melanogaster
attccatttcgat

SEQ ID NO: 591032 - DNA, 14 bp, D. melanogaster
attccatttcgttt

SEQ ID NO: 591033 - DNA, 13 bp, D. melanogaster
attccatttgcca

SEQ ID NO: 591034 - DNA, 13 bp, D. melanogaster
attccatttgctt

SEQ ID NO: 591035 - DNA, 13 bp, D. melanogaster
attccatttggcc

SEQ ID NO: 591036 - DNA, 13 bp, D. melanogaster
attccattttaca

SEQ ID NO: 591037 - DNA, 13 bp, D. melanogaster
attcccaaaatga

SEQ ID NO: 591038 - DNA, 13 bp, D. melanogaster
attcccaaccaaa

SEQ ID NO: 591039 - DNA, 13 bp, D. melanogaster
attcccaagttca

SEQ ID NO: 591040 - DNA, 13 bp, D. melanogaster
attcccaatccca

SEQ ID NO: 591041 - DNA, 14 bp, D. melanogaster
attcccaatcccat

SEQ ID NO: 591042 - DNA, 13 bp, D. melanogaster
attcccaatcccc

SEQ ID NO: 591043 - DNA, 13 bp, D. melanogaster
attcccacaaaaa

SEQ ID NO: 591044 - DNA, 13 bp, D. melanogaster
attcccacacaca

SEQ ID NO: 591045 - DNA, 13 bp, D. melanogaster
attcccaccttct

SEQ ID NO: 591046 - DNA, 13 bp, D. melanogaster
attcccactccca

SEQ ID NO: 591047 - DNA, 13 bp, D. melanogaster
attcccactccct

SEQ ID NO: 591048 - DNA, 13 bp, D. melanogaster
attcccacttcca

SEQ ID NO: 591049 - DNA, 14 bp, D. melanogaster
attcccacttccaa

SEQ ID NO: 591050 - DNA, 13 bp, D. melanogaster
attcccatgcaaa

SEQ ID NO: 591051 - DNA, 14 bp, D. melanogaster
attcccattcccag

SEQ ID NO: 591052 - DNA, 14 bp, D. melanogaster
attcccattgccat

SEQ ID NO: 591053 - DNA, 13 bp, D. melanogaster
attcccatttatt

SEQ ID NO: 591054 - DNA, 13 bp, D. melanogaster
attcccatttctt

SEQ ID NO: 591055 - DNA, 13 bp, D. melanogaster
attccccagcagc

SEQ ID NO: 591056 - DNA, 13 bp, D. melanogaster
attccccatcgac

SEQ ID NO: 591057 - DNA, 13 bp, D. melanogaster
attccccattctg

SEQ ID NO: 591058 - DNA, 13 bp, D. melanogaster
attcccccaaaaa

SEQ ID NO: 591059 - DNA, 13 bp, D. melanogaster
attccccgtggag

SEQ ID NO: 591060 - DNA, 13 bp, D. melanogaster
attcccgattccc

SEQ ID NO: 591061 - DNA, 13 bp, D. melanogaster
attccctaaacaa

SEQ ID NO: 591062 - DNA, 14 bp, D. melanogaster
attccctaaacaat

SEQ ID NO: 591063 - DNA, 13 bp, D. melanogaster
attccctttgttt

SEQ ID NO: 591064 - DNA, 13 bp, D. melanogaster
attccgaatcgga

SEQ ID NO: 591065 - DNA, 13 bp, D. melanogaster
attccgaccatgt

SEQ ID NO: 591066 - DNA, 13 bp, D. melanogaster
attccgatcccga

SEQ ID NO: 591067 - DNA, 13 bp, D. melanogaster
attccgatgccaa

SEQ ID NO: 591068 - DNA, 13 bp, D. melanogaster
attccgattattc

SEQ ID NO: 591069 - DNA, 13 bp, D. melanogaster
attccgattcaga

SEQ ID NO: 591070 - DNA, 13 bp, D. melanogaster
attccgattccga

SEQ ID NO: 591071 - DNA, 14 bp, D. melanogaster
attccgattccgag

SEQ ID NO: 591072 - DNA, 14 bp, D. melanogaster
attccgattccgat

SEQ ID NO: 591073 - DNA, 13 bp, D. melanogaster
attccgattccgg

SEQ ID NO: 591074 - DNA, 13 bp, D. melanogaster
attccgattcgga

SEQ ID NO: 591075 - DNA, 14 bp, D. melanogaster
attccgattcggat

SEQ ID NO: 591076 - DNA, 13 bp, D. melanogaster
attccgattgcga

SEQ ID NO: 591077 - DNA, 14 bp, D. melanogaster
attccgattgcgat

SEQ ID NO: 591078 - DNA, 13 bp, D. melanogaster
attccgatttcga

SEQ ID NO: 591079 - DNA, 14 bp, D. melanogaster
attccgatttcgat

SEQ ID NO: 591080 - DNA, 14 bp, D. melanogaster
attccgcaacaaaa

SEQ ID NO: 591081 - DNA, 13 bp, D. melanogaster
attccgctgataa

SEQ ID NO: 591082 - DNA, 13 bp, D. melanogaster
attccgttcccat

SEQ ID NO: 591083 - DNA, 13 bp, D. melanogaster
attccgttccgtt

SEQ ID NO: 591084 - DNA, 13 bp, D. melanogaster
attccgtttcatt

SEQ ID NO: 591085 - DNA, 13 bp, D. melanogaster
attcctaaaaata

SEQ ID NO: 591086 - DNA, 13 bp, D. melanogaster
attcctaaggcca

SEQ ID NO: 591087 - DNA, 13 bp, D. melanogaster
attcctataaata

SEQ ID NO: 591088 - DNA, 14 bp, D. melanogaster
attcctattataca

SEQ ID NO: 591089 - DNA, 13 bp, D. melanogaster
attcctattccca

SEQ ID NO: 591090 - DNA, 13 bp, D. melanogaster
attcctattgatt

SEQ ID NO: 591091 - DNA, 13 bp, D. melanogaster
attcctcaaaatg

SEQ ID NO: 591092 - DNA, 13 bp, D. melanogaster
attcctcagcgat

SEQ ID NO: 591093 - DNA, 13 bp, D. melanogaster
attcctgaaagat

SEQ ID NO: 591094 - DNA, 13 bp, D. melanogaster
attcctgaatggc

SEQ ID NO: 591095 - DNA, 13 bp, D. melanogaster
attcctggcattt

SEQ ID NO: 591096 - DNA, 13 bp, D. melanogaster
attcctggccatt

SEQ ID NO: 591097 - DNA, 13 bp, D. melanogaster
attcctggttttt

SEQ ID NO: 591098 - DNA, 13 bp, D. melanogaster
attccttaaaaat

SEQ ID NO: 591099 - DNA, 13 bp, D. melanogaster
attccttaaatat

SEQ ID NO: 591100 - DNA, 13 bp, D. melanogaster
attccttaagaag

SEQ ID NO: 591101 - DNA, 13 bp, D. melanogaster
attccttataaac

SEQ ID NO: 591102 - DNA, 13 bp, D. melanogaster
attccttatcggc

SEQ ID NO: 591103 - DNA, 13 bp, D. melanogaster
attccttccaagg

SEQ ID NO: 591104 - DNA, 13 bp, D. melanogaster
attccttctatta

SEQ ID NO: 591105 - DNA, 13 bp, D. melanogaster
attcctttcaatt

SEQ ID NO: 591106 - DNA, 13 bp, D. melanogaster
attcctttcgatt

SEQ ID NO: 591107 - DNA, 13 bp, D. melanogaster
attcctttttaaa

SEQ ID NO: 591108 - DNA, 14 bp, D. melanogaster
attcgaaaaaaaat

SEQ ID NO: 591109 - DNA, 13 bp, D. melanogaster
attcgaaaaacag

SEQ ID NO: 591110 - DNA, 13 bp, D. melanogaster
attcgaaaaactt

SEQ ID NO: 591111 - DNA, 14 bp, D. melanogaster
attcgaaaaactta

SEQ ID NO: 591112 - DNA, 13 bp, D. melanogaster
attcgaaaaatat

SEQ ID NO: 591113 - DNA, 13 bp, D. melanogaster
attcgaaaaatga

SEQ ID NO: 591114 - DNA, 13 bp, D. melanogaster
attcgaaaaatgc

SEQ ID NO: 591115 - DNA, 13 bp, D. melanogaster
attcgaaaacaca

SEQ ID NO: 591116 - DNA, 13 bp, D. melanogaster
attcgaaaacgaa

SEQ ID NO: 591117 - DNA, 13 bp, D. melanogaster
attcgaaaagaaa

SEQ ID NO: 591118 - DNA, 14 bp, D. melanogaster
attcgaaaataatt

SEQ ID NO: 591119 - DNA, 14 bp, D. melanogaster
attcgaaaatattt

SEQ ID NO: 591120 - DNA, 13 bp, D. melanogaster
attcgaaaattaa

SEQ ID NO: 591121 - DNA, 13 bp, D. melanogaster
attcgaaacaata

SEQ ID NO: 591122 - DNA, 13 bp, D. melanogaster
attcgaaagaaaa

SEQ ID NO: 591123 - DNA, 13 bp, D. melanogaster
attcgaaatcaaa

SEQ ID NO: 591124 - DNA, 13 bp, D. melanogaster
attcgaaatctac

SEQ ID NO: 591125 - DNA, 13 bp, D. melanogaster
attcgaaatgcaa

SEQ ID NO: 591126 - DNA, 14 bp, D. melanogaster
attcgaaattattt

SEQ ID NO: 591127 - DNA, 13 bp, D. melanogaster
attcgaaattcaa

SEQ ID NO: 591128 - DNA, 13 bp, D. melanogaster
attcgaaatttaa

SEQ ID NO: 591129 - DNA, 13 bp, D. melanogaster
attcgaaatttgt

SEQ ID NO: 591130 - DNA, 13 bp, D. melanogaster
attcgaagaaaaa

SEQ ID NO: 591131 - DNA, 13 bp, D. melanogaster
attcgaataaaaa

SEQ ID NO: 591132 - DNA, 13 bp, D. melanogaster
attcgaataaaca

SEQ ID NO: 591133 - DNA, 13 bp, D. melanogaster
attcgaataattt

SEQ ID NO: 591134 - DNA, 13 bp, D. melanogaster
attcgaatatatt

SEQ ID NO: 591135 - DNA, 13 bp, D. melanogaster
attcgaatcaatt

SEQ ID NO: 591136 - DNA, 13 bp, D. melanogaster
attcgaatcccaa

SEQ ID NO: 591137 - DNA, 13 bp, D. melanogaster
attcgaatccgaa

SEQ ID NO: 591138 - DNA, 13 bp, D. melanogaster
attcgaatcgaat

SEQ ID NO: 591139 - DNA, 13 bp, D. melanogaster
attcgaatgaaaa

SEQ ID NO: 591140 - DNA, 13 bp, D. melanogaster
attcgaatgaaat

SEQ ID NO: 591141 - DNA, 13 bp, D. melanogaster
attcgaatgcaaa

SEQ ID NO: 591142 - DNA, 13 bp, D. melanogaster
attcgaatgcatc

SEQ ID NO: 591143 - DNA, 13 bp, D. melanogaster
attcgaatgcatt

SEQ ID NO: 591144 - DNA, 13 bp, D. melanogaster
attcgaatgcgaa

SEQ ID NO: 591145 - DNA, 13 bp, D. melanogaster
attcgaatgcgtt

SEQ ID NO: 591146 - DNA, 13 bp, D. melanogaster
attcgaattcgaa

SEQ ID NO: 591147 - DNA, 14 bp, D. melanogaster
attcgaattcgaat

SEQ ID NO: 591148 - DNA, 13 bp, D. melanogaster
attcgaattcgat

SEQ ID NO: 591149 - DNA, 13 bp, D. melanogaster
attcgaattcgga

SEQ ID NO: 591150 - DNA, 13 bp, D. melanogaster
attcgaattgaaa

SEQ ID NO: 591151 - DNA, 14 bp, D. melanogaster
attcgaattgaaca

SEQ ID NO: 591152 - DNA, 13 bp, D. melanogaster
attcgaattgttt

SEQ ID NO: 591153 - DNA, 13 bp, D. melanogaster
attcgaatttaaa

SEQ ID NO: 591154 - DNA, 13 bp, D. melanogaster
attcgaatttaat

SEQ ID NO: 591155 - DNA, 13 bp, D. melanogaster
attcgaatttcaa

SEQ ID NO: 591156 - DNA, 13 bp, D. melanogaster
attcgaatttcga

SEQ ID NO: 591157 - DNA, 13 bp, D. melanogaster
attcgaatttcgc

SEQ ID NO: 591158 - DNA, 13 bp, D. melanogaster
attcgaatttgca

SEQ ID NO: 591159 - DNA, 13 bp, D. melanogaster
attcgaatttgtt

SEQ ID NO: 591160 - DNA, 13 bp, D. melanogaster
attcgaattttat

SEQ ID NO: 591161 - DNA, 13 bp, D. melanogaster
attcgaatttttt

SEQ ID NO: 591162 - DNA, 13 bp, D. melanogaster
attcgacttcttc

SEQ ID NO: 591163 - DNA, 13 bp, D. melanogaster
attcgagaaaaaa

SEQ ID NO: 591164 - DNA, 13 bp, D. melanogaster
attcgagagagcc

SEQ ID NO: 591165 - DNA, 13 bp, D. melanogaster
attcgagcggcga

SEQ ID NO: 591166 - DNA, 13 bp, D. melanogaster
attcgatatcgct

SEQ ID NO: 591167 - DNA, 14 bp, D. melanogaster
attcgatatcgctt

SEQ ID NO: 591168 - DNA, 13 bp, D. melanogaster
attcgatgcgatg

SEQ ID NO: 591169 - DNA, 13 bp, D. melanogaster
attcgattatatc

SEQ ID NO: 591170 - DNA, 13 bp, D. melanogaster
attcgattcaagt

SEQ ID NO: 591171 - DNA, 13 bp, D. melanogaster
attcgattcaatt

SEQ ID NO: 591172 - DNA, 14 bp, D. melanogaster
attcgattcaattt

SEQ ID NO: 591173 - DNA, 13 bp, D. melanogaster
attcgattcattc

SEQ ID NO: 591174 - DNA, 13 bp, D. melanogaster
attcgattcgaat

SEQ ID NO: 591175 - DNA, 13 bp, D. melanogaster
attcgattcgatt

SEQ ID NO: 591176 - DNA, 14 bp, D. melanogaster
attcgattcgattg

SEQ ID NO: 591177 - DNA, 14 bp, D. melanogaster
attcgattcgattt

SEQ ID NO: 591178 - DNA, 13 bp, D. melanogaster
attcgattcggtt

SEQ ID NO: 591179 - DNA, 13 bp, D. melanogaster
attcgattcgttt

SEQ ID NO: 591180 - DNA, 13 bp, D. melanogaster
attcgattgattt

SEQ ID NO: 591181 - DNA, 13 bp, D. melanogaster
attcgattgcaaa

SEQ ID NO: 591182 - DNA, 13 bp, D. melanogaster
attcgattggatt

SEQ ID NO: 591183 - DNA, 14 bp, D. melanogaster
attcgatttcaatt

SEQ ID NO: 591184 - DNA, 13 bp, D. melanogaster
attcgatttcatt

SEQ ID NO: 591185 - DNA, 13 bp, D. melanogaster
attcgatttcgat

SEQ ID NO: 591186 - DNA, 13 bp, D. melanogaster
attcgatttgaat

SEQ ID NO: 591187 - DNA, 13 bp, D. melanogaster
attcgatttgata

SEQ ID NO: 591188 - DNA, 13 bp, D. melanogaster
attcgatttgatt

SEQ ID NO: 591189 - DNA, 14 bp, D. melanogaster
attcgatttgattc

SEQ ID NO: 591190 - DNA, 14 bp, D. melanogaster
attcgatttgattt

SEQ ID NO: 591191 - DNA, 13 bp, D. melanogaster
attcgatttgcat

SEQ ID NO: 591192 - DNA, 13 bp, D. melanogaster
attcgatttgctg

SEQ ID NO: 591193 - DNA, 13 bp, D. melanogaster
attcgatttggcc

SEQ ID NO: 591194 - DNA, 13 bp, D. melanogaster
attcgatttggct

SEQ ID NO: 591195 - DNA, 13 bp, D. melanogaster
attcgatttgttt

SEQ ID NO: 591196 - DNA, 13 bp, D. melanogaster
attcgattttatt

SEQ ID NO: 591197 - DNA, 13 bp, D. melanogaster
attcgattttcaa

SEQ ID NO: 591198 - DNA, 13 bp, D. melanogaster
attcgattttcat

SEQ ID NO: 591199 - DNA, 13 bp, D. melanogaster
attcgattttctt

SEQ ID NO: 591200 - DNA, 13 bp, D. melanogaster
attcgatttttca

SEQ ID NO: 591201 - DNA, 13 bp, D. melanogaster
attcgcaaaaaat

SEQ ID NO: 591202 - DNA, 13 bp, D. melanogaster
attcgcaattcgc

SEQ ID NO: 591203 - DNA, 13 bp, D. melanogaster
attcgcaattgtt

SEQ ID NO: 591204 - DNA, 13 bp, D. melanogaster
attcgcacacacg

SEQ ID NO: 591205 - DNA, 13 bp, D. melanogaster
attcgcactcgca

SEQ ID NO: 591206 - DNA, 13 bp, D. melanogaster
attcgcataaaat

SEQ ID NO: 591207 - DNA, 13 bp, D. melanogaster
attcgcatgcaaa

SEQ ID NO: 591208 - DNA, 13 bp, D. melanogaster
attcgcattcaca

SEQ ID NO: 591209 - DNA, 13 bp, D. melanogaster
attcgcattccca

SEQ ID NO: 591210 - DNA, 13 bp, D. melanogaster
attcgcattcgca

SEQ ID NO: 591211 - DNA, 14 bp, D. melanogaster
attcgcattcgcac

SEQ ID NO: 591212 - DNA, 13 bp, D. melanogaster
attcgcattcgcc

SEQ ID NO: 591213 - DNA, 14 bp, D. melanogaster
attcgcattcgtat

SEQ ID NO: 591214 - DNA, 13 bp, D. melanogaster
attcgcatttaat

SEQ ID NO: 591215 - DNA, 13 bp, D. melanogaster
attcgcatttatt

SEQ ID NO: 591216 - DNA, 13 bp, D. melanogaster
attcgcatttcca

SEQ ID NO: 591217 - DNA, 13 bp, D. melanogaster
attcgcatttccc

SEQ ID NO: 591218 - DNA, 13 bp, D. melanogaster
attcgcatttcgc

SEQ ID NO: 591219 - DNA, 13 bp, D. melanogaster
attcgcatttgat

SEQ ID NO: 591220 - DNA, 14 bp, D. melanogaster
attcgcatttgatc

SEQ ID NO: 591221 - DNA, 13 bp, D. melanogaster
attcgcatttgca

SEQ ID NO: 591222 - DNA, 13 bp, D. melanogaster
attcgcatttttg

SEQ ID NO: 591223 - DNA, 13 bp, D. melanogaster
attcgccattcgc

SEQ ID NO: 591224 - DNA, 14 bp, D. melanogaster
attcgccattcgcc

SEQ ID NO: 591225 - DNA, 14 bp, D. melanogaster
attcgcgagaagat

SEQ ID NO: 591226 - DNA, 13 bp, D. melanogaster
attcgcgagtgca

SEQ ID NO: 591227 - DNA, 13 bp, D. melanogaster
attcgcgatattc

SEQ ID NO: 591228 - DNA, 16 bp, D. melanogaster
attcgcggcgagcgtg

SEQ ID NO: 591229 - DNA, 13 bp, D. melanogaster
attcgctcgaaaa

SEQ ID NO: 591230 - DNA, 13 bp, D. melanogaster
attcgctggcaaa

SEQ ID NO: 591231 - DNA, 13 bp, D. melanogaster
attcgcttaatct

SEQ ID NO: 591232 - DNA, 13 bp, D. melanogaster
attcgcttcaatt

SEQ ID NO: 591233 - DNA, 13 bp, D. melanogaster
attcgcttcgttt

SEQ ID NO: 591234 - DNA, 13 bp, D. melanogaster
attcgcttgtttg

SEQ ID NO: 591235 - DNA, 13 bp, D. melanogaster
attcgctttaagc

SEQ ID NO: 591236 - DNA, 14 bp, D. melanogaster
attcgctttaagca

SEQ ID NO: 591237 - DNA, 13 bp, D. melanogaster
attcgctttcatt

SEQ ID NO: 591238 - DNA, 13 bp, D. melanogaster
attcgctttgatt

SEQ ID NO: 591239 - DNA, 13 bp, D. melanogaster
attcgcttttgtt

SEQ ID NO: 591240 - DNA, 13 bp, D. melanogaster
attcggaaaattt

SEQ ID NO: 591241 - DNA, 13 bp, D. melanogaster
attcggaagtggt

SEQ ID NO: 591242 - DNA, 14 bp, D. melanogaster
attcggattcggag

SEQ ID NO: 591243 - DNA, 13 bp, D. melanogaster
attcggattcggg

SEQ ID NO: 591244 - DNA, 13 bp, D. melanogaster
attcggattggga

SEQ ID NO: 591245 - DNA, 13 bp, D. melanogaster
attcggatttgga

SEQ ID NO: 591246 - DNA, 14 bp, D. melanogaster
attcggcagttaat

SEQ ID NO: 591247 - DNA, 13 bp, D. melanogaster
attcggccggatg

SEQ ID NO: 591248 - DNA, 13 bp, D. melanogaster
attcggcttgtca

SEQ ID NO: 591249 - DNA, 13 bp, D. melanogaster
attcgggaactct

SEQ ID NO: 591250 - DNA, 13 bp, D. melanogaster
attcgggccatca

SEQ ID NO: 591251 - DNA, 14 bp, D. melanogaster
attcggggaaattt

SEQ ID NO: 591252 - DNA, 15 bp, D. melanogaster
attcggtattttgat

SEQ ID NO: 591253 - DNA, 13 bp, D. melanogaster
attcggtttgaag

SEQ ID NO: 591254 - DNA, 13 bp, D. melanogaster
attcggttttgtt

SEQ ID NO: 591255 - DNA, 13 bp, D. melanogaster
attcggtttttgt

SEQ ID NO: 591256 - DNA, 13 bp, D. melanogaster
attcgtaaagtaa

SEQ ID NO: 591257 - DNA, 13 bp, D. melanogaster
attcgtaacaaaa

SEQ ID NO: 591258 - DNA, 13 bp, D. melanogaster
attcgtaatgttt

SEQ ID NO: 591259 - DNA, 13 bp, D. melanogaster
attcgtacatata

SEQ ID NO: 591260 - DNA, 13 bp, D. melanogaster
attcgtagttttt

SEQ ID NO: 591261 - DNA, 13 bp, D. melanogaster
attcgtatatata

SEQ ID NO: 591262 - DNA, 14 bp, D. melanogaster
attcgtatcaatta

SEQ ID NO: 591263 - DNA, 13 bp, D. melanogaster
attcgtattcgaa

SEQ ID NO: 591264 - DNA, 14 bp, D. melanogaster
attcgtattcgtat

SEQ ID NO: 591265 - DNA, 13 bp, D. melanogaster
attcgtattcgtt

SEQ ID NO: 591266 - DNA, 13 bp, D. melanogaster
attcgtatttaaa

SEQ ID NO: 591267 - DNA, 13 bp, D. melanogaster
attcgtatttgtt

SEQ ID NO: 591268 - DNA, 13 bp, D. melanogaster
attcgttaaaaag

SEQ ID NO: 591269 - DNA, 13 bp, D. melanogaster
attcgttaaattt

SEQ ID NO: 591270 - DNA, 13 bp, D. melanogaster
attcgttattact

SEQ ID NO: 591271 - DNA, 13 bp, D. melanogaster
attcgttcgttcg

SEQ ID NO: 591272 - DNA, 13 bp, D. melanogaster
attcgttgaaaaa

SEQ ID NO: 591273 - DNA, 14 bp, D. melanogaster
attcgttgaaaagt

SEQ ID NO: 591274 - DNA, 13 bp, D. melanogaster
attcgttggaaaa

SEQ ID NO: 591275 - DNA, 13 bp, D. melanogaster
attcgtttaaaag

SEQ ID NO: 591276 - DNA, 13 bp, D. melanogaster
attcgtttaatta

SEQ ID NO: 591277 - DNA, 13 bp, D. melanogaster
attcgtttacttt

SEQ ID NO: 591278 - DNA, 13 bp, D. melanogaster
attcgtttcaatt

SEQ ID NO: 591279 - DNA, 14 bp, D. melanogaster
attcgtttcgattc

SEQ ID NO: 591280 - DNA, 13 bp, D. melanogaster
attcgtttcgttt

SEQ ID NO: 591281 - DNA, 13 bp, D. melanogaster
attcgtttgcttt

SEQ ID NO: 591282 - DNA, 13 bp, D. melanogaster
attcgtttggttt

SEQ ID NO: 591283 - DNA, 13 bp, D. melanogaster
attcgttttaaaa

SEQ ID NO: 591284 - DNA, 13 bp, D. melanogaster
attcgttttgaaa

SEQ ID NO: 591285 - DNA, 13 bp, D. melanogaster
attcgtttttaaa

SEQ ID NO: 591286 - DNA, 14 bp, D. melanogaster
attcgtttttaatt

SEQ ID NO: 591287 - DNA, 14 bp, D. melanogaster
attctaaaatagtt

SEQ ID NO: 591288 - DNA, 13 bp, D. melanogaster
attctaaaattga

SEQ ID NO: 591289 - DNA, 13 bp, D. melanogaster
attctaaagcaaa

SEQ ID NO: 591290 - DNA, 13 bp, D. melanogaster
attctaaagtacg

SEQ ID NO: 591291 - DNA, 13 bp, D. melanogaster
attctaaatttcc

SEQ ID NO: 591292 - DNA, 13 bp, D. melanogaster
attctaatgaaat

SEQ ID NO: 591293 - DNA, 14 bp, D. melanogaster
attctaatgcaaat

SEQ ID NO: 591294 - DNA, 13 bp, D. melanogaster
attctagagacat

SEQ ID NO: 591295 - DNA, 14 bp, D. melanogaster
attctagagacata

SEQ ID NO: 591296 - DNA, 13 bp, D. melanogaster
attctagtgtctt

SEQ ID NO: 591297 - DNA, 15 bp, D. melanogaster
attctagtgtctttg

SEQ ID NO: 591298 - DNA, 13 bp, D. melanogaster
attctatagtttt

SEQ ID NO: 591299 - DNA, 13 bp, D. melanogaster
attctatatcata

SEQ ID NO: 591300 - DNA, 13 bp, D. melanogaster
attctatatctat

SEQ ID NO: 591301 - DNA, 13 bp, D. melanogaster
attctatattcta

SEQ ID NO: 591302 - DNA, 14 bp, D. melanogaster
attctatctatcat

SEQ ID NO: 591303 - DNA, 13 bp, D. melanogaster
attctattcaatt

SEQ ID NO: 591304 - DNA, 13 bp, D. melanogaster
attctattgtctt

SEQ ID NO: 591305 - DNA, 13 bp, D. melanogaster
attctatttgaaa

SEQ ID NO: 591306 - DNA, 13 bp, D. melanogaster
attctatttgcat

SEQ ID NO: 591307 - DNA, 13 bp, D. melanogaster
attctcaacttca

SEQ ID NO: 591308 - DNA, 13 bp, D. melanogaster
attctcaattaaa

SEQ ID NO: 591309 - DNA, 13 bp, D. melanogaster
attctcaattctc

SEQ ID NO: 591310 - DNA, 13 bp, D. melanogaster
attctcagatcat

SEQ ID NO: 591311 - DNA, 13 bp, D. melanogaster
attctcaggccaa

SEQ ID NO: 591312 - DNA, 13 bp, D. melanogaster
attctccagtcgg

SEQ ID NO: 591313 - DNA, 13 bp, D. melanogaster
attctccattctc

SEQ ID NO: 591314 - DNA, 13 bp, D. melanogaster
attctcccaaaac

SEQ ID NO: 591315 - DNA, 13 bp, D. melanogaster
attctcgatgttc

SEQ ID NO: 591316 - DNA, 13 bp, D. melanogaster
attctcgattccc

SEQ ID NO: 591317 - DNA, 13 bp, D. melanogaster
attctcgattctc

SEQ ID NO: 591318 - DNA, 13 bp, D. melanogaster
attctctaaaaat

SEQ ID NO: 591319 - DNA, 14 bp, D. melanogaster
attctctatgaaaa

SEQ ID NO: 591320 - DNA, 14 bp, D. melanogaster
attctctgctttgc

SEQ ID NO: 591321 - DNA, 13 bp, D. melanogaster
attctgaaaaaaa

SEQ ID NO: 591322 - DNA, 13 bp, D. melanogaster
attctgaactaaa

SEQ ID NO: 591323 - DNA, 14 bp, D. melanogaster
attctgaactaaac

SEQ ID NO: 591324 - DNA, 13 bp, D. melanogaster
attctgaatattt

SEQ ID NO: 591325 - DNA, 13 bp, D. melanogaster
attctgaatctga

SEQ ID NO: 591326 - DNA, 13 bp, D. melanogaster
attctgataaaaa

SEQ ID NO: 591327 - DNA, 13 bp, D. melanogaster
attctgatattct

SEQ ID NO: 591328 - DNA, 14 bp, D. melanogaster
attctgatattttt

SEQ ID NO: 591329 - DNA, 14 bp, D. melanogaster
attctgatcaagaa

SEQ ID NO: 591330 - DNA, 13 bp, D. melanogaster
attctgatcgaag

SEQ ID NO: 591331 - DNA, 13 bp, D. melanogaster
attctgattcaga

SEQ ID NO: 591332 - DNA, 13 bp, D. melanogaster
attctgattgggc

SEQ ID NO: 591333 - DNA, 13 bp, D. melanogaster
attctgattttga

SEQ ID NO: 591334 - DNA, 13 bp, D. melanogaster
attctgcaaaatg

SEQ ID NO: 591335 - DNA, 13 bp, D. melanogaster
attctgcaactat

SEQ ID NO: 591336 - DNA, 13 bp, D. melanogaster
attctgcccgccc

SEQ ID NO: 591337 - DNA, 13 bp, D. melanogaster
attctgcgaagaa

SEQ ID NO: 591338 - DNA, 13 bp, D. melanogaster
attctgctccctg

SEQ ID NO: 591339 - DNA, 14 bp, D. melanogaster
attctggattctgg

SEQ ID NO: 591340 - DNA, 13 bp, D. melanogaster
attctggcactgt

SEQ ID NO: 591341 - DNA, 13 bp, D. melanogaster
attctgggaattc

SEQ ID NO: 591342 - DNA, 13 bp, D. melanogaster
attctgtaaatat

SEQ ID NO: 591343 - DNA, 13 bp, D. melanogaster
attctgtgcggaa

SEQ ID NO: 591344 - DNA, 13 bp, D. melanogaster
attctgttcaact

SEQ ID NO: 591345 - DNA, 13 bp, D. melanogaster
attctgtttgctt

SEQ ID NO: 591346 - DNA, 13 bp, D. melanogaster
attcttaaaaatg

SEQ ID NO: 591347 - DNA, 13 bp, D. melanogaster
attcttaagctaa

SEQ ID NO: 591348 - DNA, 13 bp, D. melanogaster
attcttaagtgga

SEQ ID NO: 591349 - DNA, 13 bp, D. melanogaster
attcttagaaaat

SEQ ID NO: 591350 - DNA, 13 bp, D. melanogaster
attcttcaacctg

SEQ ID NO: 591351 - DNA, 13 bp, D. melanogaster
attcttcttaagg

SEQ ID NO: 591352 - DNA, 14 bp, D. melanogaster
attcttgagaattt

SEQ ID NO: 591353 - DNA, 13 bp, D. melanogaster
attcttgatcagt

SEQ ID NO: 591354 - DNA, 13 bp, D. melanogaster
attcttgattagg

SEQ ID NO: 591355 - DNA, 13 bp, D. melanogaster
attcttggccaaa

SEQ ID NO: 591356 - DNA, 13 bp, D. melanogaster
attcttggccatc

SEQ ID NO: 591357 - DNA, 13 bp, D. melanogaster
attcttgggaaaa

SEQ ID NO: 591358 - DNA, 13 bp, D. melanogaster
attcttgtcatat

SEQ ID NO: 591359 - DNA, 14 bp, D. melanogaster
attcttgtgaaata

SEQ ID NO: 591360 - DNA, 13 bp, D. melanogaster
attcttgttaaaa

SEQ ID NO: 591361 - DNA, 13 bp, D. melanogaster
attcttgttctgt

SEQ ID NO: 591362 - DNA, 13 bp, D. melanogaster
attcttgttttga

SEQ ID NO: 591363 - DNA, 13 bp, D. melanogaster
attcttgttttgc

SEQ ID NO: 591364 - DNA, 13 bp, D. melanogaster
attctttaaaaag

SEQ ID NO: 591365 - DNA, 13 bp, D. melanogaster
attctttaaacat

SEQ ID NO: 591366 - DNA, 13 bp, D. melanogaster
attctttaagcaa

SEQ ID NO: 591367 - DNA, 13 bp, D. melanogaster
attctttaatacc

SEQ ID NO: 591368 - DNA, 13 bp, D. melanogaster
attctttattgaa

SEQ ID NO: 591369 - DNA, 14 bp, D. melanogaster
attctttgaaaagt

SEQ ID NO: 591370 - DNA, 13 bp, D. melanogaster
attctttgaaatt

SEQ ID NO: 591371 - DNA, 13 bp, D. melanogaster
attctttgaattt

SEQ ID NO: 591372 - DNA, 13 bp, D. melanogaster
attctttgccatt

SEQ ID NO: 591373 - DNA, 13 bp, D. melanogaster
attctttggaaat

SEQ ID NO: 591374 - DNA, 13 bp, D. melanogaster
attctttggcttg

SEQ ID NO: 591375 - DNA, 13 bp, D. melanogaster
attctttgggttt

SEQ ID NO: 591376 - DNA, 13 bp, D. melanogaster
attctttgtgtgt

SEQ ID NO: 591377 - DNA, 13 bp, D. melanogaster
attctttgttaaa

SEQ ID NO: 591378 - DNA, 13 bp, D. melanogaster
attcttttaaagt

SEQ ID NO: 591379 - DNA, 13 bp, D. melanogaster
attcttttcaaaa

SEQ ID NO: 591380 - DNA, 13 bp, D. melanogaster
attcttttcgaaa

SEQ ID NO: 591381 - DNA, 13 bp, D. melanogaster
attcttttcgatt

SEQ ID NO: 591382 - DNA, 13 bp, D. melanogaster
attcttttgaatt

SEQ ID NO: 591383 - DNA, 13 bp, D. melanogaster
attcttttgttga

SEQ ID NO: 591384 - DNA, 13 bp, D. melanogaster
attctttttacaa

SEQ ID NO: 591385 - DNA, 13 bp, D. melanogaster
attgaaaaaatac

SEQ ID NO: 591386 - DNA, 13 bp, D. melanogaster
attgaaaaaatca

SEQ ID NO: 591387 - DNA, 13 bp, D. melanogaster
attgaaaaacaat

SEQ ID NO: 591388 - DNA, 14 bp, D. melanogaster
attgaaaaacattt

SEQ ID NO: 591389 - DNA, 13 bp, D. melanogaster
attgaaaaaccaa

SEQ ID NO: 591390 - DNA, 13 bp, D. melanogaster
attgaaaaaccat

SEQ ID NO: 591391 - DNA, 13 bp, D. melanogaster
attgaaaaacgca

SEQ ID NO: 591392 - DNA, 13 bp, D. melanogaster
attgaaaaactaa

SEQ ID NO: 591393 - DNA, 13 bp, D. melanogaster
attgaaaaactat

SEQ ID NO: 591394 - DNA, 13 bp, D. melanogaster
attgaaaaacttt

SEQ ID NO: 591395 - DNA, 13 bp, D. melanogaster
attgaaaaagaac

SEQ ID NO: 591396 - DNA, 13 bp, D. melanogaster
attgaaaaataca

SEQ ID NO: 591397 - DNA, 13 bp, D. melanogaster
attgaaaaatcct

SEQ ID NO: 591398 - DNA, 13 bp, D. melanogaster
attgaaaaatgat

SEQ ID NO: 591399 - DNA, 13 bp, D. melanogaster
attgaaaaatgtt

SEQ ID NO: 591400 - DNA, 13 bp, D. melanogaster
attgaaaaattgc

SEQ ID NO: 591401 - DNA, 13 bp, D. melanogaster
attgaaaaatttc

SEQ ID NO: 591402 - DNA, 13 bp, D. melanogaster
attgaaaacaaag

SEQ ID NO: 591403 - DNA, 13 bp, D. melanogaster
attgaaaacaaat

SEQ ID NO: 591404 - DNA, 14 bp, D. melanogaster
attgaaaacaaatt

SEQ ID NO: 591405 - DNA, 13 bp, D. melanogaster
attgaaaacaagt

SEQ ID NO: 591406 - DNA, 13 bp, D. melanogaster
attgaaaacagtt

SEQ ID NO: 591407 - DNA, 14 bp, D. melanogaster
attgaaaacatttt

SEQ ID NO: 591408 - DNA, 13 bp, D. melanogaster
attgaaaaccaaa

SEQ ID NO: 591409 - DNA, 13 bp, D. melanogaster
attgaaaacccat

SEQ ID NO: 591410 - DNA, 13 bp, D. melanogaster
attgaaaacgaaa

SEQ ID NO: 591411 - DNA, 13 bp, D. melanogaster
attgaaaactcaa

SEQ ID NO: 591412 - DNA, 13 bp, D. melanogaster
attgaaaacttaa

SEQ ID NO: 591413 - DNA, 13 bp, D. melanogaster
attgaaaactttt

SEQ ID NO: 591414 - DNA, 13 bp, D. melanogaster
attgaaaagcaaa

SEQ ID NO: 591415 - DNA, 14 bp, D. melanogaster
attgaaaagcattt

SEQ ID NO: 591416 - DNA, 13 bp, D. melanogaster
attgaaaagccgc

SEQ ID NO: 591417 - DNA, 13 bp, D. melanogaster
attgaaaagcgaa

SEQ ID NO: 591418 - DNA, 13 bp, D. melanogaster
attgaaaagctaa

SEQ ID NO: 591419 - DNA, 13 bp, D. melanogaster
attgaaaagctgc

SEQ ID NO: 591420 - DNA, 13 bp, D. melanogaster
attgaaaagcttt

SEQ ID NO: 591421 - DNA, 13 bp, D. melanogaster
attgaaaagtata

SEQ ID NO: 591422 - DNA, 13 bp, D. melanogaster
attgaaaagtatt

SEQ ID NO: 591423 - DNA, 14 bp, D. melanogaster
attgaaaagtgaaa

SEQ ID NO: 591424 - DNA, 13 bp, D. melanogaster
attgaaaagtgca

SEQ ID NO: 591425 - DNA, 13 bp, D. melanogaster
attgaaaagttca

SEQ ID NO: 591426 - DNA, 13 bp, D. melanogaster
attgaaaagttgc

SEQ ID NO: 591427 - DNA, 13 bp, D. melanogaster
attgaaaagtttg

SEQ ID NO: 591428 - DNA, 13 bp, D. melanogaster
attgaaaataaac

SEQ ID NO: 591429 - DNA, 13 bp, D. melanogaster
attgaaaatacaa

SEQ ID NO: 591430 - DNA, 13 bp, D. melanogaster
attgaaaatagtt

SEQ ID NO: 591431 - DNA, 14 bp, D. melanogaster
attgaaaatcaaaa

SEQ ID NO: 591432 - DNA, 13 bp, D. melanogaster
attgaaaatcatt

SEQ ID NO: 591433 - DNA, 14 bp, D. melanogaster
attgaaaatcattt

SEQ ID NO: 591434 - DNA, 13 bp, D. melanogaster
attgaaaatccaa

SEQ ID NO: 591435 - DNA, 14 bp, D. melanogaster
attgaaaatcgaaa

SEQ ID NO: 591436 - DNA, 13 bp, D. melanogaster
attgaaaatgaag

SEQ ID NO: 591437 - DNA, 13 bp, D. melanogaster
attgaaaatgatt

SEQ ID NO: 591438 - DNA, 13 bp, D. melanogaster
attgaaaatgcat

SEQ ID NO: 591439 - DNA, 14 bp, D. melanogaster
attgaaaatgcatt

SEQ ID NO: 591440 - DNA, 13 bp, D. melanogaster
attgaaaatgcca

SEQ ID NO: 591441 - DNA, 13 bp, D. melanogaster
attgaaaatgctt

SEQ ID NO: 591442 - DNA, 13 bp, D. melanogaster
attgaaaatggaa

SEQ ID NO: 591443 - DNA, 13 bp, D. melanogaster
attgaaaatgtaa

SEQ ID NO: 591444 - DNA, 14 bp, D. melanogaster
attgaaaatgtaat

SEQ ID NO: 591445 - DNA, 13 bp, D. melanogaster
attgaaaattcct

SEQ ID NO: 591446 - DNA, 13 bp, D. melanogaster
attgaaaattgat

SEQ ID NO: 591447 - DNA, 14 bp, D. melanogaster
attgaaaattgatt

SEQ ID NO: 591448 - DNA, 13 bp, D. melanogaster
attgaaaattgta

SEQ ID NO: 591449 - DNA, 13 bp, D. melanogaster
attgaaacaaatg

SEQ ID NO: 591450 - DNA, 13 bp, D. melanogaster
attgaaacaaatt

SEQ ID NO: 591451 - DNA, 13 bp, D. melanogaster
attgaaacaattt

SEQ ID NO: 591452 - DNA, 13 bp, D. melanogaster
attgaaaccaaaa

SEQ ID NO: 591453 - DNA, 13 bp, D. melanogaster
attgaaacgtgtt

SEQ ID NO: 591454 - DNA, 13 bp, D. melanogaster
attgaaacgttca

SEQ ID NO: 591455 - DNA, 13 bp, D. melanogaster
attgaaactttat

SEQ ID NO: 591456 - DNA, 13 bp, D. melanogaster
attgaaagattta

SEQ ID NO: 591457 - DNA, 13 bp, D. melanogaster
attgaaagatttt

SEQ ID NO: 591458 - DNA, 14 bp, D. melanogaster
attgaaagatttta

SEQ ID NO: 591459 - DNA, 13 bp, D. melanogaster
attgaaagcaatt

SEQ ID NO: 591460 - DNA, 13 bp, D. melanogaster
attgaaagctttt

SEQ ID NO: 591461 - DNA, 13 bp, D. melanogaster
attgaaagtaaat

SEQ ID NO: 591462 - DNA, 13 bp, D. melanogaster
attgaaagtaatt

SEQ ID NO: 591463 - DNA, 13 bp, D. melanogaster
attgaaagtgaaa

SEQ ID NO: 591464 - DNA, 14 bp, D. melanogaster
attgaaagtgaaaa

SEQ ID NO: 591465 - DNA, 13 bp, D. melanogaster
attgaaagtgaat

SEQ ID NO: 591466 - DNA, 13 bp, D. melanogaster
attgaaagtgcaa

SEQ ID NO: 591467 - DNA, 13 bp, D. melanogaster
attgaaagttaat

SEQ ID NO: 591468 - DNA, 13 bp, D. melanogaster
attgaaagttttt

SEQ ID NO: 591469 - DNA, 13 bp, D. melanogaster
attgaaatacata

SEQ ID NO: 591470 - DNA, 13 bp, D. melanogaster
attgaaatacttt

SEQ ID NO: 591471 - DNA, 13 bp, D. melanogaster
attgaaatagata

SEQ ID NO: 591472 - DNA, 13 bp, D. melanogaster
attgaaatatgaa

SEQ ID NO: 591473 - DNA, 13 bp, D. melanogaster
attgaaatcaaaa

SEQ ID NO: 591474 - DNA, 13 bp, D. melanogaster
attgaaatcaaat

SEQ ID NO: 591475 - DNA, 13 bp, D. melanogaster
attgaaatcaata

SEQ ID NO: 591476 - DNA, 13 bp, D. melanogaster
attgaaatcgaaa

SEQ ID NO: 591477 - DNA, 14 bp, D. melanogaster
attgaaatcgaaaa

SEQ ID NO: 591478 - DNA, 14 bp, D. melanogaster
attgaaatcgaaat

SEQ ID NO: 591479 - DNA, 13 bp, D. melanogaster
attgaaatcgaat

SEQ ID NO: 591480 - DNA, 13 bp, D. melanogaster
attgaaatcgata

SEQ ID NO: 591481 - DNA, 13 bp, D. melanogaster
attgaaatcgcag

SEQ ID NO: 591482 - DNA, 13 bp, D. melanogaster
attgaaatcggaa

SEQ ID NO: 591483 - DNA, 13 bp, D. melanogaster
attgaaatcttaa

SEQ ID NO: 591484 - DNA, 13 bp, D. melanogaster
attgaaatgaaac

SEQ ID NO: 591485 - DNA, 13 bp, D. melanogaster
attgaaatgaaat

SEQ ID NO: 591486 - DNA, 14 bp, D. melanogaster
attgaaatgaaatt

SEQ ID NO: 591487 - DNA, 13 bp, D. melanogaster
attgaaatgaagc

SEQ ID NO: 591488 - DNA, 13 bp, D. melanogaster
attgaaatgaatg

SEQ ID NO: 591489 - DNA, 13 bp, D. melanogaster
attgaaatgaatt

SEQ ID NO: 591490 - DNA, 13 bp, D. melanogaster
attgaaatgattt

SEQ ID NO: 591491 - DNA, 13 bp, D. melanogaster
attgaaatgcaaa

SEQ ID NO: 591492 - DNA, 14 bp, D. melanogaster
attgaaatgcaaaa

SEQ ID NO: 591493 - DNA, 14 bp, D. melanogaster
attgaaatgcaatt

SEQ ID NO: 591494 - DNA, 13 bp, D. melanogaster
attgaaatgccaa

SEQ ID NO: 591495 - DNA, 14 bp, D. melanogaster
attgaaatgccaaa

SEQ ID NO: 591496 - DNA, 13 bp, D. melanogaster
attgaaatgccac

SEQ ID NO: 591497 - DNA, 13 bp, D. melanogaster
attgaaatgcgat

SEQ ID NO: 591498 - DNA, 13 bp, D. melanogaster
attgaaatgctgc

SEQ ID NO: 591499 - DNA, 14 bp, D. melanogaster
attgaaatggaaaa

SEQ ID NO: 591500 - DNA, 13 bp, D. melanogaster
attgaaatggaag

SEQ ID NO: 591501 - DNA, 13 bp, D. melanogaster
attgaaatgtatt

SEQ ID NO: 591502 - DNA, 13 bp, D. melanogaster
attgaaatgtcaa

SEQ ID NO: 591503 - DNA, 13 bp, D. melanogaster
attgaaattaaag

SEQ ID NO: 591504 - DNA, 13 bp, D. melanogaster
attgaaattaatg

SEQ ID NO: 591505 - DNA, 13 bp, D. melanogaster
attgaaattatga

SEQ ID NO: 591506 - DNA, 13 bp, D. melanogaster
attgaaattcaaa

SEQ ID NO: 591507 - DNA, 14 bp, D. melanogaster
attgaaattcaaat

SEQ ID NO: 591508 - DNA, 13 bp, D. melanogaster
attgaaattcaat

SEQ ID NO: 591509 - DNA, 13 bp, D. melanogaster
attgaaattcttt

SEQ ID NO: 591510 - DNA, 14 bp, D. melanogaster
attgaaattgaaac

SEQ ID NO: 591511 - DNA, 13 bp, D. melanogaster
attgaaattgaac

SEQ ID NO: 591512 - DNA, 13 bp, D. melanogaster
attgaaattgaat

SEQ ID NO: 591513 - DNA, 14 bp, D. melanogaster
attgaaattgaatt

SEQ ID NO: 591514 - DNA, 14 bp, D. melanogaster
attgaaattgatat

SEQ ID NO: 591515 - DNA, 14 bp, D. melanogaster
attgaaattgattt

SEQ ID NO: 591516 - DNA, 13 bp, D. melanogaster
attgaaattgcaa

SEQ ID NO: 591517 - DNA, 13 bp, D. melanogaster
attgaaattgcca

SEQ ID NO: 591518 - DNA, 14 bp, D. melanogaster
attgaaattgcttt

SEQ ID NO: 591519 - DNA, 13 bp, D. melanogaster
attgaaattggaa

SEQ ID NO: 591520 - DNA, 13 bp, D. melanogaster
attgaaattggca

SEQ ID NO: 591521 - DNA, 13 bp, D. melanogaster
attgaaattggtt

SEQ ID NO: 591522 - DNA, 14 bp, D. melanogaster
attgaaattggttt

SEQ ID NO: 591523 - DNA, 13 bp, D. melanogaster
attgaaattgtta

SEQ ID NO: 591524 - DNA, 13 bp, D. melanogaster
attgaaattgttg

SEQ ID NO: 591525 - DNA, 13 bp, D. melanogaster
attgaaatttaag

SEQ ID NO: 591526 - DNA, 14 bp, D. melanogaster
attgaaatttacaa

SEQ ID NO: 591527 - DNA, 13 bp, D. melanogaster
attgaaatttacg

SEQ ID NO: 591528 - DNA, 13 bp, D. melanogaster
attgaaatttatg

SEQ ID NO: 591529 - DNA, 14 bp, D. melanogaster
attgaaatttatgc

SEQ ID NO: 591530 - DNA, 13 bp, D. melanogaster
attgaaatttcaa

SEQ ID NO: 591531 - DNA, 13 bp, D. melanogaster
attgaaatttctg

SEQ ID NO: 591532 - DNA, 14 bp, D. melanogaster
attgaaatttctgt

SEQ ID NO: 591533 - DNA, 13 bp, D. melanogaster
attgaaatttgat

SEQ ID NO: 591534 - DNA, 14 bp, D. melanogaster
attgaaatttgcat

SEQ ID NO: 591535 - DNA, 13 bp, D. melanogaster
attgaaattttca

SEQ ID NO: 591536 - DNA, 13 bp, D. melanogaster
attgaaatttttc

SEQ ID NO: 591537 - DNA, 13 bp, D. melanogaster
attgaacaaatat

SEQ ID NO: 591538 - DNA, 13 bp, D. melanogaster
attgaacaaattg

SEQ ID NO: 591539 - DNA, 13 bp, D. melanogaster
attgaacaaattt

SEQ ID NO: 591540 - DNA, 13 bp, D. melanogaster
attgaacaacatt

SEQ ID NO: 591541 - DNA, 13 bp, D. melanogaster
attgaacaatttc

SEQ ID NO: 591542 - DNA, 13 bp, D. melanogaster
attgaacacattt

SEQ ID NO: 591543 - DNA, 14 bp, D. melanogaster
attgaacaggtgaa

SEQ ID NO: 591544 - DNA, 13 bp, D. melanogaster
attgaacattgaa

SEQ ID NO: 591545 - DNA, 13 bp, D. melanogaster
attgaactcccaa

SEQ ID NO: 591546 - DNA, 13 bp, D. melanogaster
attgaactgaaat

SEQ ID NO: 591547 - DNA, 13 bp, D. melanogaster
attgaactgaact

SEQ ID NO: 591548 - DNA, 13 bp, D. melanogaster
attgaactgattt

SEQ ID NO: 591549 - DNA, 13 bp, D. melanogaster
attgaactggatt

SEQ ID NO: 591550 - DNA, 13 bp, D. melanogaster
attgaacttgaaa

SEQ ID NO: 591551 - DNA, 13 bp, D. melanogaster
attgaacttgaat

SEQ ID NO: 591552 - DNA, 13 bp, D. melanogaster
attgaactttaaa

SEQ ID NO: 591553 - DNA, 13 bp, D. melanogaster
attgaacttttat

SEQ ID NO: 591554 - DNA, 13 bp, D. melanogaster
attgaagaaaatc

SEQ ID NO: 591555 - DNA, 13 bp, D. melanogaster
attgaagaaggcg

SEQ ID NO: 591556 - DNA, 13 bp, D. melanogaster
attgaagaatttt

SEQ ID NO: 591557 - DNA, 13 bp, D. melanogaster
attgaagactctg

SEQ ID NO: 591558 - DNA, 13 bp, D. melanogaster
attgaagcaacag

SEQ ID NO: 591559 - DNA, 13 bp, D. melanogaster
attgaagcaatta

SEQ ID NO: 591560 - DNA, 13 bp, D. melanogaster
attgaagtaatca

SEQ ID NO: 591561 - DNA, 13 bp, D. melanogaster
attgaagtgtttt

SEQ ID NO: 591562 - DNA, 13 bp, D. melanogaster
attgaagttaaat

SEQ ID NO: 591563 - DNA, 13 bp, D. melanogaster
attgaagttaatt

SEQ ID NO: 591564 - DNA, 13 bp, D. melanogaster
attgaagttgatt

SEQ ID NO: 591565 - DNA, 13 bp, D. melanogaster
attgaagtttatt

SEQ ID NO: 591566 - DNA, 13 bp, D. melanogaster
attgaagttttat

SEQ ID NO: 591567 - DNA, 13 bp, D. melanogaster
attgaataaaaac

SEQ ID NO: 591568 - DNA, 14 bp, D. melanogaster
attgaataaacaaa

SEQ ID NO: 591569 - DNA, 13 bp, D. melanogaster
attgaataaagtt

SEQ ID NO: 591570 - DNA, 13 bp, D. melanogaster
attgaataaattg

SEQ ID NO: 591571 - DNA, 13 bp, D. melanogaster
attgaataacttt

SEQ ID NO: 591572 - DNA, 13 bp, D. melanogaster
attgaatacaaaa

SEQ ID NO: 591573 - DNA, 13 bp, D. melanogaster
attgaatacaaat

SEQ ID NO: 591574 - DNA, 13 bp, D. melanogaster
attgaatagattt

SEQ ID NO: 591575 - DNA, 13 bp, D. melanogaster
attgaatatcaat

SEQ ID NO: 591576 - DNA, 13 bp, D. melanogaster
attgaatatgaaa

SEQ ID NO: 591577 - DNA, 13 bp, D. melanogaster
attgaatattcaa

SEQ ID NO: 591578 - DNA, 13 bp, D. melanogaster
attgaatattcat

SEQ ID NO: 591579 - DNA, 14 bp, D. melanogaster
attgaatattgaat

SEQ ID NO: 591580 - DNA, 13 bp, D. melanogaster
attgaatatttca

SEQ ID NO: 591581 - DNA, 13 bp, D. melanogaster
attgaatatttgc

SEQ ID NO: 591582 - DNA, 13 bp, D. melanogaster
attgaatcaaaat

SEQ ID NO: 591583 - DNA, 13 bp, D. melanogaster
attgaatcaaatt

SEQ ID NO: 591584 - DNA, 13 bp, D. melanogaster
attgaatcaattt

SEQ ID NO: 591585 - DNA, 13 bp, D. melanogaster
attgaatcatttt

SEQ ID NO: 591586 - DNA, 13 bp, D. melanogaster
attgaatccattt

SEQ ID NO: 591587 - DNA, 13 bp, D. melanogaster
attgaatccgaaa

SEQ ID NO: 591588 - DNA, 13 bp, D. melanogaster
attgaatcgaaat

SEQ ID NO: 591589 - DNA, 13 bp, D. melanogaster
attgaatcgaatc

SEQ ID NO: 591590 - DNA, 14 bp, D. melanogaster
attgaatcgaatcg

SEQ ID NO: 591591 - DNA, 13 bp, D. melanogaster
attgaatcgaatg

SEQ ID NO: 591592 - DNA, 13 bp, D. melanogaster
attgaatgaaaac

SEQ ID NO: 591593 - DNA, 13 bp, D. melanogaster
attgaatgaatgt

SEQ ID NO: 591594 - DNA, 13 bp, D. melanogaster
attgaatgaattg

SEQ ID NO: 591595 - DNA, 13 bp, D. melanogaster
attgaatgattga

SEQ ID NO: 591596 - DNA, 13 bp, D. melanogaster
attgaatgcaaat

SEQ ID NO: 591597 - DNA, 13 bp, D. melanogaster
attgaatgcattt

SEQ ID NO: 591598 - DNA, 13 bp, D. melanogaster
attgaatgctttt

SEQ ID NO: 591599 - DNA, 13 bp, D. melanogaster
attgaatggattt

SEQ ID NO: 591600 - DNA, 13 bp, D. melanogaster
attgaatggcaat

SEQ ID NO: 591601 - DNA, 13 bp, D. melanogaster
attgaatggtttt

SEQ ID NO: 591602 - DNA, 13 bp, D. melanogaster
attgaattaaaga

SEQ ID NO: 591603 - DNA, 14 bp, D. melanogaster
attgaattaaatgc

SEQ ID NO: 591604 - DNA, 13 bp, D. melanogaster
attgaattaagca

SEQ ID NO: 591605 - DNA, 13 bp, D. melanogaster
attgaattaattc

SEQ ID NO: 591606 - DNA, 13 bp, D. melanogaster
attgaattatgaa

SEQ ID NO: 591607 - DNA, 13 bp, D. melanogaster
attgaattcaatt

SEQ ID NO: 591608 - DNA, 14 bp, D. melanogaster
attgaattcaatta

SEQ ID NO: 591609 - DNA, 14 bp, D. melanogaster
attgaattcgattt

SEQ ID NO: 591610 - DNA, 13 bp, D. melanogaster
attgaattcgttt

SEQ ID NO: 591611 - DNA, 13 bp, D. melanogaster
attgaattctttt

SEQ ID NO: 591612 - DNA, 13 bp, D. melanogaster
attgaattgaaaa

SEQ ID NO: 591613 - DNA, 13 bp, D. melanogaster
attgaattgaaat

SEQ ID NO: 591614 - DNA, 14 bp, D. melanogaster
attgaattgaaatg

SEQ ID NO: 591615 - DNA, 13 bp, D. melanogaster
attgaattgaatg

SEQ ID NO: 591616 - DNA, 14 bp, D. melanogaster
attgaattgaattg

SEQ ID NO: 591617 - DNA, 13 bp, D. melanogaster
attgaattgatat

SEQ ID NO: 591618 - DNA, 13 bp, D. melanogaster
attgaattgcaaa

SEQ ID NO: 591619 - DNA, 13 bp, D. melanogaster
attgaattgcata

SEQ ID NO: 591620 - DNA, 13 bp, D. melanogaster
attgaattgcatt

SEQ ID NO: 591621 - DNA, 13 bp, D. melanogaster
attgaattggaaa

SEQ ID NO: 591622 - DNA, 13 bp, D. melanogaster
attgaattggaat

SEQ ID NO: 591623 - DNA, 13 bp, D. melanogaster
attgaattggatt

SEQ ID NO: 591624 - DNA, 14 bp, D. melanogaster
attgaattggattg

SEQ ID NO: 591625 - DNA, 13 bp, D. melanogaster
attgaattggcca

SEQ ID NO: 591626 - DNA, 13 bp, D. melanogaster
attgaattggttt

SEQ ID NO: 591627 - DNA, 13 bp, D. melanogaster
attgaattgttaa

SEQ ID NO: 591628 - DNA, 13 bp, D. melanogaster
attgaattgttta

SEQ ID NO: 591629 - DNA, 13 bp, D. melanogaster
attgaatttaaac

SEQ ID NO: 591630 - DNA, 13 bp, D. melanogaster
attgaatttaaca

SEQ ID NO: 591631 - DNA, 13 bp, D. melanogaster
attgaatttaagt

SEQ ID NO: 591632 - DNA, 13 bp, D. melanogaster
attgaatttactt

SEQ ID NO: 591633 - DNA, 14 bp, D. melanogaster
attgaatttcaaat

SEQ ID NO: 591634 - DNA, 13 bp, D. melanogaster
attgaatttccca

SEQ ID NO: 591635 - DNA, 13 bp, D. melanogaster
attgaatttccga

SEQ ID NO: 591636 - DNA, 13 bp, D. melanogaster
attgaatttcgca

SEQ ID NO: 591637 - DNA, 13 bp, D. melanogaster
attgaatttcttg

SEQ ID NO: 591638 - DNA, 13 bp, D. melanogaster
attgaatttcttt

SEQ ID NO: 591639 - DNA, 13 bp, D. melanogaster
attgaatttgaaa

SEQ ID NO: 591640 - DNA, 14 bp, D. melanogaster
attgaatttgaaat

SEQ ID NO: 591641 - DNA, 13 bp, D. melanogaster
attgaatttgaat

SEQ ID NO: 591642 - DNA, 13 bp, D. melanogaster
attgaatttgata

SEQ ID NO: 591643 - DNA, 13 bp, D. melanogaster
attgaatttgcac

SEQ ID NO: 591644 - DNA, 13 bp, D. melanogaster
attgaatttgcca

SEQ ID NO: 591645 - DNA, 13 bp, D. melanogaster
attgaatttgctg

SEQ ID NO: 591646 - DNA, 14 bp, D. melanogaster
attgaatttgcttt

SEQ ID NO: 591647 - DNA, 13 bp, D. melanogaster
attgaatttggat

SEQ ID NO: 591648 - DNA, 13 bp, D. melanogaster
attgaatttggtt

SEQ ID NO: 591649 - DNA, 13 bp, D. melanogaster
attgaatttgtaa

SEQ ID NO: 591650 - DNA, 13 bp, D. melanogaster
attgaatttgtat

SEQ ID NO: 591651 - DNA, 13 bp, D. melanogaster
attgaatttgtga

SEQ ID NO: 591652 - DNA, 13 bp, D. melanogaster
attgaattttcaa

SEQ ID NO: 591653 - DNA, 13 bp, D. melanogaster
attgaattttcac

SEQ ID NO: 591654 - DNA, 13 bp, D. melanogaster
attgaattttcat

SEQ ID NO: 591655 - DNA, 13 bp, D. melanogaster
attgaattttcta

SEQ ID NO: 591656 - DNA, 13 bp, D. melanogaster
attgaattttctg

SEQ ID NO: 591657 - DNA, 13 bp, D. melanogaster
attgaattttgat

SEQ ID NO: 591658 - DNA, 13 bp, D. melanogaster
attgaatttttgc

SEQ ID NO: 591659 - DNA, 13 bp, D. melanogaster
attgacaaaatgt

SEQ ID NO: 591660 - DNA, 13 bp, D. melanogaster
attgacaaaattt

SEQ ID NO: 591661 - DNA, 13 bp, D. melanogaster
attgacaaataaa

SEQ ID NO: 591662 - DNA, 13 bp, D. melanogaster
attgacaaatgca

SEQ ID NO: 591663 - DNA, 13 bp, D. melanogaster
attgacaaatgga

SEQ ID NO: 591664 - DNA, 13 bp, D. melanogaster
attgacaaattaa

SEQ ID NO: 591665 - DNA, 14 bp, D. melanogaster
attgacaacttcat

SEQ ID NO: 591666 - DNA, 13 bp, D. melanogaster
attgacaatttaa

SEQ ID NO: 591667 - DNA, 13 bp, D. melanogaster
attgacaatttta

SEQ ID NO: 591668 - DNA, 13 bp, D. melanogaster
attgacaccaacc

SEQ ID NO: 591669 - DNA, 13 bp, D. melanogaster
attgacacgatta

SEQ ID NO: 591670 - DNA, 14 bp, D. melanogaster
attgacactaatta

SEQ ID NO: 591671 - DNA, 13 bp, D. melanogaster
attgacataaatt

SEQ ID NO: 591672 - DNA, 13 bp, D. melanogaster
attgacattaaaa

SEQ ID NO: 591673 - DNA, 13 bp, D. melanogaster
attgacattgaaa

SEQ ID NO: 591674 - DNA, 13 bp, D. melanogaster
attgacattgaca

SEQ ID NO: 591675 - DNA, 13 bp, D. melanogaster
attgacatttatt

SEQ ID NO: 591676 - DNA, 13 bp, D. melanogaster
attgaccaaatgt

SEQ ID NO: 591677 - DNA, 13 bp, D. melanogaster
attgaccacaaaa

SEQ ID NO: 591678 - DNA, 13 bp, D. melanogaster
attgactggctga

SEQ ID NO: 591679 - DNA, 13 bp, D. melanogaster
attgacttgattt

SEQ ID NO: 591680 - DNA, 13 bp, D. melanogaster
attgactttaaat

SEQ ID NO: 591681 - DNA, 14 bp, D. melanogaster
attgactttgattt

SEQ ID NO: 591682 - DNA, 13 bp, D. melanogaster
attgactttgcca

SEQ ID NO: 591683 - DNA, 13 bp, D. melanogaster
attgactttgttg

SEQ ID NO: 591684 - DNA, 13 bp, D. melanogaster
attgacttttaaa

SEQ ID NO: 591685 - DNA, 13 bp, D. melanogaster
attgacttttatt

SEQ ID NO: 591686 - DNA, 13 bp, D. melanogaster
attgacttttgat

SEQ ID NO: 591687 - DNA, 13 bp, D. melanogaster
attgacttttgtt

SEQ ID NO: 591688 - DNA, 13 bp, D. melanogaster
attgagacgtggc

SEQ ID NO: 591689 - DNA, 13 bp, D. melanogaster
attgagaggtaca

SEQ ID NO: 591690 - DNA, 13 bp, D. melanogaster
attgagatacatt

SEQ ID NO: 591691 - DNA, 13 bp, D. melanogaster
attgagattaatt

SEQ ID NO: 591692 - DNA, 13 bp, D. melanogaster
attgagatttatg

SEQ ID NO: 591693 - DNA, 13 bp, D. melanogaster
attgagatttatt

SEQ ID NO: 591694 - DNA, 13 bp, D. melanogaster
attgagcaaatat

SEQ ID NO: 591695 - DNA, 13 bp, D. melanogaster
attgagcaattta

SEQ ID NO: 591696 - DNA, 13 bp, D. melanogaster
attgagcattttt

SEQ ID NO: 591697 - DNA, 13 bp, D. melanogaster
attgagctaagcc

SEQ ID NO: 591698 - DNA, 13 bp, D. melanogaster
attgagcttctaa

SEQ ID NO: 591699 - DNA, 13 bp, D. melanogaster
attgaggaaattc

SEQ ID NO: 591700 - DNA, 13 bp, D. melanogaster
attgagggtgttg

SEQ ID NO: 591701 - DNA, 13 bp, D. melanogaster
attgagtttttca

SEQ ID NO: 591702 - DNA, 14 bp, D. melanogaster
attgataaaaacaa

SEQ ID NO: 591703 - DNA, 13 bp, D. melanogaster
attgataaaatgt

SEQ ID NO: 591704 - DNA, 13 bp, D. melanogaster
attgataaacaaa

SEQ ID NO: 591705 - DNA, 13 bp, D. melanogaster
attgataaacaat

SEQ ID NO: 591706 - DNA, 13 bp, D. melanogaster
attgataaacatt

SEQ ID NO: 591707 - DNA, 13 bp, D. melanogaster
attgataaatgtt

SEQ ID NO: 591708 - DNA, 13 bp, D. melanogaster
attgataaattga

SEQ ID NO: 591709 - DNA, 13 bp, D. melanogaster
attgataacaaat

SEQ ID NO: 591710 - DNA, 13 bp, D. melanogaster
attgataacattt

SEQ ID NO: 591711 - DNA, 13 bp, D. melanogaster
attgataactgct

SEQ ID NO: 591712 - DNA, 13 bp, D. melanogaster
attgataatattg

SEQ ID NO: 591713 - DNA, 13 bp, D. melanogaster
attgatacaattt

SEQ ID NO: 591714 - DNA, 13 bp, D. melanogaster
attgataccattg

SEQ ID NO: 591715 - DNA, 14 bp, D. melanogaster
attgataccattgg

SEQ ID NO: 591716 - DNA, 13 bp, D. melanogaster
attgatacgtttg

SEQ ID NO: 591717 - DNA, 13 bp, D. melanogaster
attgatatatgta

SEQ ID NO: 591718 - DNA, 13 bp, D. melanogaster
attgatatggaaa

SEQ ID NO: 591719 - DNA, 14 bp, D. melanogaster
attgatattgatat

SEQ ID NO: 591720 - DNA, 13 bp, D. melanogaster
attgatattgatt

SEQ ID NO: 591721 - DNA, 13 bp, D. melanogaster
attgatattttct

SEQ ID NO: 591722 - DNA, 13 bp, D. melanogaster
attgatcatatta

SEQ ID NO: 591723 - DNA, 13 bp, D. melanogaster
attgatcggattg

SEQ ID NO: 591724 - DNA, 13 bp, D. melanogaster
attgatctacaaa

SEQ ID NO: 591725 - DNA, 15 bp, D. melanogaster
attgatctggagatc

SEQ ID NO: 591726 - DNA, 14 bp, D. melanogaster
attgatgacatttt

SEQ ID NO: 591727 - DNA, 13 bp, D. melanogaster
attgatgacggca

SEQ ID NO: 591728 - DNA, 13 bp, D. melanogaster
attgatgatgatg

SEQ ID NO: 591729 - DNA, 14 bp, D. melanogaster
attgatgatgatga

SEQ ID NO: 591730 - DNA, 13 bp, D. melanogaster
attgatgattgat

SEQ ID NO: 591731 - DNA, 13 bp, D. melanogaster
attgatgccattt

SEQ ID NO: 591732 - DNA, 13 bp, D. melanogaster
attgatggaaaaa

SEQ ID NO: 591733 - DNA, 13 bp, D. melanogaster
attgatgtgtgtg

SEQ ID NO: 591734 - DNA, 13 bp, D. melanogaster
attgattaaactt

SEQ ID NO: 591735 - DNA, 13 bp, D. melanogaster
attgattaattgc

SEQ ID NO: 591736 - DNA, 13 bp, D. melanogaster
attgattcatatt

SEQ ID NO: 591737 - DNA, 13 bp, D. melanogaster
attgattcatcgc

SEQ ID NO: 591738 - DNA, 13 bp, D. melanogaster
attgattcattga

SEQ ID NO: 591739 - DNA, 13 bp, D. melanogaster
attgattccaatt

SEQ ID NO: 591740 - DNA, 13 bp, D. melanogaster
attgattccattt

SEQ ID NO: 591741 - DNA, 13 bp, D. melanogaster
attgattccttat

SEQ ID NO: 591742 - DNA, 13 bp, D. melanogaster
attgattcgaatt

SEQ ID NO: 591743 - DNA, 13 bp, D. melanogaster
attgattcgattt

SEQ ID NO: 591744 - DNA, 13 bp, D. melanogaster
attgattcgcatt

SEQ ID NO: 591745 - DNA, 14 bp, D. melanogaster
attgattcgcattt

SEQ ID NO: 591746 - DNA, 13 bp, D. melanogaster
attgattctgatc

SEQ ID NO: 591747 - DNA, 13 bp, D. melanogaster
attgattgacatt

SEQ ID NO: 591748 - DNA, 13 bp, D. melanogaster
attgattgagaaa

SEQ ID NO: 591749 - DNA, 13 bp, D. melanogaster
attgattgatgat

SEQ ID NO: 591750 - DNA, 13 bp, D. melanogaster
attgattgattga

SEQ ID NO: 591751 - DNA, 13 bp, D. melanogaster
attgattgattgt

SEQ ID NO: 591752 - DNA, 14 bp, D. melanogaster
attgattgattgtt

SEQ ID NO: 591753 - DNA, 13 bp, D. melanogaster
attgattgatttg

SEQ ID NO: 591754 - DNA, 13 bp, D. melanogaster
attgattgcaaaa

SEQ ID NO: 591755 - DNA, 13 bp, D. melanogaster
attgattgcagtt

SEQ ID NO: 591756 - DNA, 13 bp, D. melanogaster
attgattgcattg

SEQ ID NO: 591757 - DNA, 13 bp, D. melanogaster
attgattgcattt

SEQ ID NO: 591758 - DNA, 13 bp, D. melanogaster
attgattgccaaa

SEQ ID NO: 591759 - DNA, 13 bp, D. melanogaster
attgattgccatt

SEQ ID NO: 591760 - DNA, 14 bp, D. melanogaster
attgattgcccttt

SEQ ID NO: 591761 - DNA, 13 bp, D. melanogaster
attgattgctatt

SEQ ID NO: 591762 - DNA, 14 bp, D. melanogaster
attgattggcattt

SEQ ID NO: 591763 - DNA, 13 bp, D. melanogaster
attgatttaaatg

SEQ ID NO: 591764 - DNA, 13 bp, D. melanogaster
attgatttaatca

SEQ ID NO: 591765 - DNA, 14 bp, D. melanogaster
attgatttaatcat

SEQ ID NO: 591766 - DNA, 13 bp, D. melanogaster
attgatttaatgt

SEQ ID NO: 591767 - DNA, 13 bp, D. melanogaster
attgatttacaat

SEQ ID NO: 591768 - DNA, 13 bp, D. melanogaster
attgatttacttt

SEQ ID NO: 591769 - DNA, 13 bp, D. melanogaster
attgatttatgta

SEQ ID NO: 591770 - DNA, 13 bp, D. melanogaster
attgatttattga

SEQ ID NO: 591771 - DNA, 13 bp, D. melanogaster
attgatttcattc

SEQ ID NO: 591772 - DNA, 13 bp, D. melanogaster
attgatttcattt

SEQ ID NO: 591773 - DNA, 13 bp, D. melanogaster
attgatttccatt

SEQ ID NO: 591774 - DNA, 14 bp, D. melanogaster
attgatttccattt

SEQ ID NO: 591775 - DNA, 13 bp, D. melanogaster
attgatttccttt

SEQ ID NO: 591776 - DNA, 13 bp, D. melanogaster
attgatttcgaaa

SEQ ID NO: 591777 - DNA, 13 bp, D. melanogaster
attgatttcgaat

SEQ ID NO: 591778 - DNA, 13 bp, D. melanogaster
attgatttcggcc

SEQ ID NO: 591779 - DNA, 13 bp, D. melanogaster
attgatttcgtta

SEQ ID NO: 591780 - DNA, 13 bp, D. melanogaster
attgatttctttg

SEQ ID NO: 591781 - DNA, 13 bp, D. melanogaster
attgatttgaaaa

SEQ ID NO: 591782 - DNA, 14 bp, D. melanogaster
attgatttgaaaat

SEQ ID NO: 591783 - DNA, 13 bp, D. melanogaster
attgatttgattg

SEQ ID NO: 591784 - DNA, 13 bp, D. melanogaster
attgatttgcaat

SEQ ID NO: 591785 - DNA, 13 bp, D. melanogaster
attgatttgctta

SEQ ID NO: 591786 - DNA, 13 bp, D. melanogaster
attgatttggaaa

SEQ ID NO: 591787 - DNA, 13 bp, D. melanogaster
attgatttggcca

SEQ ID NO: 591788 - DNA, 13 bp, D. melanogaster
attgattttaatg

SEQ ID NO: 591789 - DNA, 13 bp, D. melanogaster
attgattttcaaa

SEQ ID NO: 591790 - DNA, 13 bp, D. melanogaster
attgattttcagc

SEQ ID NO: 591791 - DNA, 13 bp, D. melanogaster
attgattttccac

SEQ ID NO: 591792 - DNA, 13 bp, D. melanogaster
attgattttccat

SEQ ID NO: 591793 - DNA, 13 bp, D. melanogaster
attgattttccct

SEQ ID NO: 591794 - DNA, 13 bp, D. melanogaster
attgattttccta

SEQ ID NO: 591795 - DNA, 13 bp, D. melanogaster
attgattttctgc

SEQ ID NO: 591796 - DNA, 13 bp, D. melanogaster
attgattttctgt

SEQ ID NO: 591797 - DNA, 13 bp, D. melanogaster
attgattttgaat

SEQ ID NO: 591798 - DNA, 13 bp, D. melanogaster
attgattttggcc

SEQ ID NO: 591799 - DNA, 13 bp, D. melanogaster
attgattttggct

SEQ ID NO: 591800 - DNA, 13 bp, D. melanogaster
attgattttgggt

SEQ ID NO: 591801 - DNA, 13 bp, D. melanogaster
attgattttggtc

SEQ ID NO: 591802 - DNA, 13 bp, D. melanogaster
attgatttttcgc

SEQ ID NO: 591803 - DNA, 13 bp, D. melanogaster
attgatttttctc

SEQ ID NO: 591804 - DNA, 13 bp, D. melanogaster
attgatttttgca

SEQ ID NO: 591805 - DNA, 13 bp, D. melanogaster
attgcaaaaacaa

SEQ ID NO: 591806 - DNA, 13 bp, D. melanogaster
attgcaaaaagaa

SEQ ID NO: 591807 - DNA, 13 bp, D. melanogaster
attgcaaaaagtt

SEQ ID NO: 591808 - DNA, 13 bp, D. melanogaster
attgcaaaaataa

SEQ ID NO: 591809 - DNA, 14 bp, D. melanogaster
attgcaaaaataaa

SEQ ID NO: 591810 - DNA, 13 bp, D. melanogaster
attgcaaaaatat

SEQ ID NO: 591811 - DNA, 13 bp, D. melanogaster
attgcaaaacatt

SEQ ID NO: 591812 - DNA, 13 bp, D. melanogaster
attgcaaaacttt

SEQ ID NO: 591813 - DNA, 13 bp, D. melanogaster
attgcaaaagcca

SEQ ID NO: 591814 - DNA, 14 bp, D. melanogaster
attgcaaaagtaat

SEQ ID NO: 591815 - DNA, 13 bp, D. melanogaster
attgcaaaagtca

SEQ ID NO: 591816 - DNA, 14 bp, D. melanogaster
attgcaaaagtttt

SEQ ID NO: 591817 - DNA, 13 bp, D. melanogaster
attgcaaaataaa

SEQ ID NO: 591818 - DNA, 13 bp, D. melanogaster
attgcaaaatcga

SEQ ID NO: 591819 - DNA, 13 bp, D. melanogaster
attgcaaaatgct

SEQ ID NO: 591820 - DNA, 13 bp, D. melanogaster
attgcaaaatgtt

SEQ ID NO: 591821 - DNA, 13 bp, D. melanogaster
attgcaaaattat

SEQ ID NO: 591822 - DNA, 13 bp, D. melanogaster
attgcaaaattcc

SEQ ID NO: 591823 - DNA, 13 bp, D. melanogaster
attgcaaaatttt

SEQ ID NO: 591824 - DNA, 13 bp, D. melanogaster
attgcaaacattt

SEQ ID NO: 591825 - DNA, 13 bp, D. melanogaster
attgcaaaggtgg

SEQ ID NO: 591826 - DNA, 13 bp, D. melanogaster
attgcaaagtaaa

SEQ ID NO: 591827 - DNA, 13 bp, D. melanogaster
attgcaaataata

SEQ ID NO: 591828 - DNA, 13 bp, D. melanogaster
attgcaaatatat

SEQ ID NO: 591829 - DNA, 13 bp, D. melanogaster
attgcaaatattg

SEQ ID NO: 591830 - DNA, 13 bp, D. melanogaster
attgcaaatattt

SEQ ID NO: 591831 - DNA, 14 bp, D. melanogaster
attgcaaatattta

SEQ ID NO: 591832 - DNA, 13 bp, D. melanogaster
attgcaaatcgaa

SEQ ID NO: 591833 - DNA, 13 bp, D. melanogaster
attgcaaatgaaa

SEQ ID NO: 591834 - DNA, 13 bp, D. melanogaster
attgcaaatggaa

SEQ ID NO: 591835 - DNA, 13 bp, D. melanogaster
attgcaaatggct

SEQ ID NO: 591836 - DNA, 13 bp, D. melanogaster
attgcaaatgtgt

SEQ ID NO: 591837 - DNA, 13 bp, D. melanogaster
attgcaaattaaa

SEQ ID NO: 591838 - DNA, 13 bp, D. melanogaster
attgcaaattaat

SEQ ID NO: 591839 - DNA, 13 bp, D. melanogaster
attgcaaattaca

SEQ ID NO: 591840 - DNA, 13 bp, D. melanogaster
attgcaaattagc

SEQ ID NO: 591841 - DNA, 13 bp, D. melanogaster
attgcaaattgat

SEQ ID NO: 591842 - DNA, 13 bp, D. melanogaster
attgcaaattgcg

SEQ ID NO: 591843 - DNA, 13 bp, D. melanogaster
attgcaaattgct

SEQ ID NO: 591844 - DNA, 13 bp, D. melanogaster
attgcaacaaaga

SEQ ID NO: 591845 - DNA, 13 bp, D. melanogaster
attgcaacaataa

SEQ ID NO: 591846 - DNA, 13 bp, D. melanogaster
attgcaacaatta

SEQ ID NO: 591847 - DNA, 13 bp, D. melanogaster
attgcaaccagat

SEQ ID NO: 591848 - DNA, 13 bp, D. melanogaster
attgcaactattt

SEQ ID NO: 591849 - DNA, 13 bp, D. melanogaster
attgcaactgcaa

SEQ ID NO: 591850 - DNA, 14 bp, D. melanogaster
attgcaactgcaac

SEQ ID NO: 591851 - DNA, 13 bp, D. melanogaster
attgcaactgcca

SEQ ID NO: 591852 - DNA, 13 bp, D. melanogaster
attgcaactttta

SEQ ID NO: 591853 - DNA, 13 bp, D. melanogaster
attgcaagcaatt

SEQ ID NO: 591854 - DNA, 13 bp, D. melanogaster
attgcaagtattg

SEQ ID NO: 591855 - DNA, 13 bp, D. melanogaster
attgcaagtgcaa

SEQ ID NO: 591856 - DNA, 13 bp, D. melanogaster
attgcaagttgca

SEQ ID NO: 591857 - DNA, 13 bp, D. melanogaster
attgcaataaaac

SEQ ID NO: 591858 - DNA, 13 bp, D. melanogaster
attgcaataaacg

SEQ ID NO: 591859 - DNA, 13 bp, D. melanogaster
attgcaataataa

SEQ ID NO: 591860 - DNA, 13 bp, D. melanogaster
attgcaatataaa

SEQ ID NO: 591861 - DNA, 13 bp, D. melanogaster
attgcaatataat

SEQ ID NO: 591862 - DNA, 13 bp, D. melanogaster
attgcaatatatt

SEQ ID NO: 591863 - DNA, 13 bp, D. melanogaster
attgcaatcaaaa

SEQ ID NO: 591864 - DNA, 13 bp, D. melanogaster
attgcaatcaaat

SEQ ID NO: 591865 - DNA, 13 bp, D. melanogaster
attgcaatcattt

SEQ ID NO: 591866 - DNA, 13 bp, D. melanogaster
attgcaatcgaaa

SEQ ID NO: 591867 - DNA, 13 bp, D. melanogaster
attgcaatgcaat

SEQ ID NO: 591868 - DNA, 13 bp, D. melanogaster
attgcaatgcgaa

SEQ ID NO: 591869 - DNA, 14 bp, D. melanogaster
attgcaattaaaaa

SEQ ID NO: 591870 - DNA, 13 bp, D. melanogaster
attgcaattaaag

SEQ ID NO: 591871 - DNA, 14 bp, D. melanogaster
attgcaattaaaga

SEQ ID NO: 591872 - DNA, 14 bp, D. melanogaster
attgcaattaaatt

SEQ ID NO: 591873 - DNA, 13 bp, D. melanogaster
attgcaattattg

SEQ ID NO: 591874 - DNA, 14 bp, D. melanogaster
attgcaattcaatt

SEQ ID NO: 591875 - DNA, 13 bp, D. melanogaster
attgcaattgaaa

SEQ ID NO: 591876 - DNA, 14 bp, D. melanogaster
attgcaattgaatg

SEQ ID NO: 591877 - DNA, 13 bp, D. melanogaster
attgcaattgatt

SEQ ID NO: 591878 - DNA, 14 bp, D. melanogaster
attgcaattgattt

SEQ ID NO: 591879 - DNA, 13 bp, D. melanogaster
attgcaattgcaa

SEQ ID NO: 591880 - DNA, 14 bp, D. melanogaster
attgcaattgcaaa

SEQ ID NO: 591881 - DNA, 14 bp, D. melanogaster
attgcaattgcaac

SEQ ID NO: 591882 - DNA, 13 bp, D. melanogaster
attgcaattgcac

SEQ ID NO: 591883 - DNA, 13 bp, D. melanogaster
attgcaattggca

SEQ ID NO: 591884 - DNA, 13 bp, D. melanogaster
attgcaattgttg

SEQ ID NO: 591885 - DNA, 14 bp, D. melanogaster
attgcaatttaatt

SEQ ID NO: 591886 - DNA, 14 bp, D. melanogaster
attgcaatttatca

SEQ ID NO: 591887 - DNA, 13 bp, D. melanogaster
attgcaatttgca

SEQ ID NO: 591888 - DNA, 13 bp, D. melanogaster
attgcaatttgtt

SEQ ID NO: 591889 - DNA, 14 bp, D. melanogaster
attgcaatttgttg

SEQ ID NO: 591890 - DNA, 14 bp, D. melanogaster
attgcaattttaat

SEQ ID NO: 591891 - DNA, 13 bp, D. melanogaster
attgcaattttca

SEQ ID NO: 591892 - DNA, 13 bp, D. melanogaster
attgcaattttgt

SEQ ID NO: 591893 - DNA, 13 bp, D. melanogaster
attgcaatttttt

SEQ ID NO: 591894 - DNA, 13 bp, D. melanogaster
attgcacaaaaat

SEQ ID NO: 591895 - DNA, 13 bp, D. melanogaster
attgcacaaaagc

SEQ ID NO: 591896 - DNA, 13 bp, D. melanogaster
attgcacaaaagt

SEQ ID NO: 591897 - DNA, 13 bp, D. melanogaster
attgcacacaatt

SEQ ID NO: 591898 - DNA, 13 bp, D. melanogaster
attgcacacacac

SEQ ID NO: 591899 - DNA, 13 bp, D. melanogaster
attgcacagaaaa

SEQ ID NO: 591900 - DNA, 13 bp, D. melanogaster
attgcacagattt

SEQ ID NO: 591901 - DNA, 13 bp, D. melanogaster
attgcacattcaa

SEQ ID NO: 591902 - DNA, 13 bp, D. melanogaster
attgcacatttgc

SEQ ID NO: 591903 - DNA, 13 bp, D. melanogaster
attgcacattttt

SEQ ID NO: 591904 - DNA, 13 bp, D. melanogaster
attgcacggcatt

SEQ ID NO: 591905 - DNA, 13 bp, D. melanogaster
attgcactgcatt

SEQ ID NO: 591906 - DNA, 13 bp, D. melanogaster
attgcactttaag

SEQ ID NO: 591907 - DNA, 13 bp, D. melanogaster
attgcacttttgt

SEQ ID NO: 591908 - DNA, 13 bp, D. melanogaster
attgcagaaaaaa

SEQ ID NO: 591909 - DNA, 13 bp, D. melanogaster
attgcagaaagta

SEQ ID NO: 591910 - DNA, 13 bp, D. melanogaster
attgcagaatgta

SEQ ID NO: 591911 - DNA, 13 bp, D. melanogaster
attgcagaatttg

SEQ ID NO: 591912 - DNA, 14 bp, D. melanogaster
attgcagacggact

SEQ ID NO: 591913 - DNA, 13 bp, D. melanogaster
attgcagataaat

SEQ ID NO: 591914 - DNA, 14 bp, D. melanogaster
attgcagataaatg

SEQ ID NO: 591915 - DNA, 13 bp, D. melanogaster
attgcagatatgg

SEQ ID NO: 591916 - DNA, 13 bp, D. melanogaster
attgcagattgca

SEQ ID NO: 591917 - DNA, 14 bp, D. melanogaster
attgcagattgcag

SEQ ID NO: 591918 - DNA, 13 bp, D. melanogaster
attgcagcaaaaa

SEQ ID NO: 591919 - DNA, 13 bp, D. melanogaster
attgcagcaaatt

SEQ ID NO: 591920 - DNA, 14 bp, D. melanogaster
attgcagcagcagc

SEQ ID NO: 591921 - DNA, 13 bp, D. melanogaster
attgcagcagttt

SEQ ID NO: 591922 - DNA, 13 bp, D. melanogaster
attgcagccaaaa

SEQ ID NO: 591923 - DNA, 13 bp, D. melanogaster
attgcagcgcagc

SEQ ID NO: 591924 - DNA, 13 bp, D. melanogaster
attgcagctcatt

SEQ ID NO: 591925 - DNA, 13 bp, D. melanogaster
attgcagctccac

SEQ ID NO: 591926 - DNA, 13 bp, D. melanogaster
attgcagctgaaa

SEQ ID NO: 591927 - DNA, 13 bp, D. melanogaster
attgcagctgcca

SEQ ID NO: 591928 - DNA, 13 bp, D. melanogaster
attgcagctgctg

SEQ ID NO: 591929 - DNA, 13 bp, D. melanogaster
attgcaggcaaac

SEQ ID NO: 591930 - DNA, 13 bp, D. melanogaster
attgcaggtgcat

SEQ ID NO: 591931 - DNA, 13 bp, D. melanogaster
attgcagtgcaaa

SEQ ID NO: 591932 - DNA, 13 bp, D. melanogaster
attgcagtggcca

SEQ ID NO: 591933 - DNA, 14 bp, D. melanogaster
attgcagtggccaa

SEQ ID NO: 591934 - DNA, 13 bp, D. melanogaster
attgcagttgagg

SEQ ID NO: 591935 - DNA, 14 bp, D. melanogaster
attgcagttgcagt

SEQ ID NO: 591936 - DNA, 13 bp, D. melanogaster
attgcagttgcat

SEQ ID NO: 591937 - DNA, 13 bp, D. melanogaster
attgcagttggca

SEQ ID NO: 591938 - DNA, 13 bp, D. melanogaster
attgcagttgttg

SEQ ID NO: 591939 - DNA, 13 bp, D. melanogaster
attgcagttttat

SEQ ID NO: 591940 - DNA, 13 bp, D. melanogaster
attgcagtttttt

SEQ ID NO: 591941 - DNA, 13 bp, D. melanogaster
attgcataaaatt

SEQ ID NO: 591942 - DNA, 13 bp, D. melanogaster
attgcataaatca

SEQ ID NO: 591943 - DNA, 13 bp, D. melanogaster
attgcataataaa

SEQ ID NO: 591944 - DNA, 13 bp, D. melanogaster
attgcataatatt

SEQ ID NO: 591945 - DNA, 13 bp, D. melanogaster
attgcataattca

SEQ ID NO: 591946 - DNA, 13 bp, D. melanogaster
attgcatactttt

SEQ ID NO: 591947 - DNA, 14 bp, D. melanogaster
attgcatacttttg

SEQ ID NO: 591948 - DNA, 14 bp, D. melanogaster
attgcatatacata

SEQ ID NO: 591949 - DNA, 13 bp, D. melanogaster
attgcatattaaa

SEQ ID NO: 591950 - DNA, 13 bp, D. melanogaster
attgcatattcaa

SEQ ID NO: 591951 - DNA, 13 bp, D. melanogaster
attgcatattgca

SEQ ID NO: 591952 - DNA, 14 bp, D. melanogaster
attgcatatttaat

SEQ ID NO: 591953 - DNA, 14 bp, D. melanogaster
attgcatatttatt

SEQ ID NO: 591954 - DNA, 13 bp, D. melanogaster
attgcatatttca

SEQ ID NO: 591955 - DNA, 13 bp, D. melanogaster
attgcatattttg

SEQ ID NO: 591956 - DNA, 13 bp, D. melanogaster
attgcatgaaaat

SEQ ID NO: 591957 - DNA, 13 bp, D. melanogaster
attgcatgaaatt

SEQ ID NO: 591958 - DNA, 13 bp, D. melanogaster
attgcatgcaatt

SEQ ID NO: 591959 - DNA, 13 bp, D. melanogaster
attgcattaaaaa

SEQ ID NO: 591960 - DNA, 13 bp, D. melanogaster
attgcattaaaag

SEQ ID NO: 591961 - DNA, 13 bp, D. melanogaster
attgcattaaata

SEQ ID NO: 591962 - DNA, 14 bp, D. melanogaster
attgcattaaataa

SEQ ID NO: 591963 - DNA, 13 bp, D. melanogaster
attgcattagttt

SEQ ID NO: 591964 - DNA, 13 bp, D. melanogaster
attgcattataaa

SEQ ID NO: 591965 - DNA, 13 bp, D. melanogaster
attgcattatttc

SEQ ID NO: 591966 - DNA, 14 bp, D. melanogaster
attgcattcaattt

SEQ ID NO: 591967 - DNA, 13 bp, D. melanogaster
attgcattcattt

SEQ ID NO: 591968 - DNA, 13 bp, D. melanogaster
attgcattcgatt

SEQ ID NO: 591969 - DNA, 14 bp, D. melanogaster
attgcattcgcttg

SEQ ID NO: 591970 - DNA, 13 bp, D. melanogaster
attgcattctttt

SEQ ID NO: 591971 - DNA, 13 bp, D. melanogaster
attgcattgaatt

SEQ ID NO: 591972 - DNA, 13 bp, D. melanogaster
attgcattgagaa

SEQ ID NO: 591973 - DNA, 13 bp, D. melanogaster
attgcattgattt

SEQ ID NO: 591974 - DNA, 13 bp, D. melanogaster
attgcattgcaaa

SEQ ID NO: 591975 - DNA, 13 bp, D. melanogaster
attgcattgcagt

SEQ ID NO: 591976 - DNA, 13 bp, D. melanogaster
attgcattgcata

SEQ ID NO: 591977 - DNA, 13 bp, D. melanogaster
attgcattgcatg

SEQ ID NO: 591978 - DNA, 13 bp, D. melanogaster
attgcattgcatt

SEQ ID NO: 591979 - DNA, 13 bp, D. melanogaster
attgcattgccat

SEQ ID NO: 591980 - DNA, 13 bp, D. melanogaster
attgcattgcttt

SEQ ID NO: 591981 - DNA, 13 bp, D. melanogaster
attgcattggatt

SEQ ID NO: 591982 - DNA, 14 bp, D. melanogaster
attgcattgtattg

SEQ ID NO: 591983 - DNA, 13 bp, D. melanogaster
attgcattgttat

SEQ ID NO: 591984 - DNA, 14 bp, D. melanogaster
attgcatttaaagt

SEQ ID NO: 591985 - DNA, 13 bp, D. melanogaster
attgcatttaaat

SEQ ID NO: 591986 - DNA, 14 bp, D. melanogaster
attgcatttaaatt

SEQ ID NO: 591987 - DNA, 13 bp, D. melanogaster
attgcatttaatg

SEQ ID NO: 591988 - DNA, 14 bp, D. melanogaster
attgcatttaattg

SEQ ID NO: 591989 - DNA, 13 bp, D. melanogaster
attgcatttagtt

SEQ ID NO: 591990 - DNA, 13 bp, D. melanogaster
attgcatttataa

SEQ ID NO: 591991 - DNA, 13 bp, D. melanogaster
attgcatttatca

SEQ ID NO: 591992 - DNA, 13 bp, D. melanogaster
attgcatttattg

SEQ ID NO: 591993 - DNA, 13 bp, D. melanogaster
attgcatttcaaa

SEQ ID NO: 591994 - DNA, 13 bp, D. melanogaster
attgcatttcgag

SEQ ID NO: 591995 - DNA, 13 bp, D. melanogaster
attgcatttcgca

SEQ ID NO: 591996 - DNA, 13 bp, D. melanogaster
attgcatttcgtt

SEQ ID NO: 591997 - DNA, 13 bp, D. melanogaster
attgcatttctta

SEQ ID NO: 591998 - DNA, 13 bp, D. melanogaster
attgcatttgaat

SEQ ID NO: 591999 - DNA, 13 bp, D. melanogaster
attgcatttgcaa

SEQ ID NO: 592000 - DNA, 14 bp, D. melanogaster
attgcatttgcatt

SEQ ID NO: 592001 - DNA, 13 bp, D. melanogaster
attgcatttggtt

SEQ ID NO: 592002 - DNA, 13 bp, D. melanogaster
attgcatttgtat

SEQ ID NO: 592003 - DNA, 13 bp, D. melanogaster
attgcatttgtca

SEQ ID NO: 592004 - DNA, 14 bp, D. melanogaster
attgcattttaaat

SEQ ID NO: 592005 - DNA, 14 bp, D. melanogaster
attgcattttaatt

SEQ ID NO: 592006 - DNA, 13 bp, D. melanogaster
attgcattttact

SEQ ID NO: 592007 - DNA, 13 bp, D. melanogaster
attgcattttatg

SEQ ID NO: 592008 - DNA, 13 bp, D. melanogaster
attgcattttatt

SEQ ID NO: 592009 - DNA, 13 bp, D. melanogaster
attgcattttcaa

SEQ ID NO: 592010 - DNA, 13 bp, D. melanogaster
attgcattttccc

SEQ ID NO: 592011 - DNA, 13 bp, D. melanogaster
attgcattttctc

SEQ ID NO: 592012 - DNA, 13 bp, D. melanogaster
attgcattttctt

SEQ ID NO: 592013 - DNA, 13 bp, D. melanogaster
attgcatttttat

SEQ ID NO: 592014 - DNA, 13 bp, D. melanogaster
attgcatttttca

SEQ ID NO: 592015 - DNA, 13 bp, D. melanogaster
attgcatttttgc

SEQ ID NO: 592016 - DNA, 13 bp, D. melanogaster
attgcattttttc

SEQ ID NO: 592017 - DNA, 13 bp, D. melanogaster
attgccaaaaaaa

SEQ ID NO: 592018 - DNA, 13 bp, D. melanogaster
attgccaaaaact

SEQ ID NO: 592019 - DNA, 13 bp, D. melanogaster
attgccaaaagtt

SEQ ID NO: 592020 - DNA, 13 bp, D. melanogaster
attgccaaaatat

SEQ ID NO: 592021 - DNA, 14 bp, D. melanogaster
attgccaaaattaa

SEQ ID NO: 592022 - DNA, 13 bp, D. melanogaster
attgccaaaattc

SEQ ID NO: 592023 - DNA, 13 bp, D. melanogaster
attgccaaacaaa

SEQ ID NO: 592024 - DNA, 13 bp, D. melanogaster
attgccaaacaat

SEQ ID NO: 592025 - DNA, 13 bp, D. melanogaster
attgccaaacagc

SEQ ID NO: 592026 - DNA, 13 bp, D. melanogaster
attgccaaacatt

SEQ ID NO: 592027 - DNA, 13 bp, D. melanogaster
attgccaaagcca

SEQ ID NO: 592028 - DNA, 13 bp, D. melanogaster
attgccaaagttt

SEQ ID NO: 592029 - DNA, 13 bp, D. melanogaster
attgccaaatatt

SEQ ID NO: 592030 - DNA, 13 bp, D. melanogaster
attgccaaatgca

SEQ ID NO: 592031 - DNA, 13 bp, D. melanogaster
attgccaacaaaa

SEQ ID NO: 592032 - DNA, 13 bp, D. melanogaster
attgccaagaaaa

SEQ ID NO: 592033 - DNA, 13 bp, D. melanogaster
attgccaagaaat

SEQ ID NO: 592034 - DNA, 13 bp, D. melanogaster
attgccaagctaa

SEQ ID NO: 592035 - DNA, 14 bp, D. melanogaster
attgccaagctaaa

SEQ ID NO: 592036 - DNA, 13 bp, D. melanogaster
attgccaaggctg

SEQ ID NO: 592037 - DNA, 13 bp, D. melanogaster
attgccaataatt

SEQ ID NO: 592038 - DNA, 13 bp, D. melanogaster
attgccaatattt

SEQ ID NO: 592039 - DNA, 13 bp, D. melanogaster
attgccaatcgat

SEQ ID NO: 592040 - DNA, 13 bp, D. melanogaster
attgccaatggca

SEQ ID NO: 592041 - DNA, 13 bp, D. melanogaster
attgccaattaaa

SEQ ID NO: 592042 - DNA, 13 bp, D. melanogaster
attgccaattgca

SEQ ID NO: 592043 - DNA, 13 bp, D. melanogaster
attgccaatttgc

SEQ ID NO: 592044 - DNA, 13 bp, D. melanogaster
attgccacacaaa

SEQ ID NO: 592045 - DNA, 13 bp, D. melanogaster
attgccacactca

SEQ ID NO: 592046 - DNA, 14 bp, D. melanogaster
attgccacagcaca

SEQ ID NO: 592047 - DNA, 13 bp, D. melanogaster
attgccaccaaca

SEQ ID NO: 592048 - DNA, 13 bp, D. melanogaster
attgccacctcga

SEQ ID NO: 592049 - DNA, 14 bp, D. melanogaster
attgccacgcccac

SEQ ID NO: 592050 - DNA, 13 bp, D. melanogaster
attgccacgcccc

SEQ ID NO: 592051 - DNA, 13 bp, D. melanogaster
attgccactgcca

SEQ ID NO: 592052 - DNA, 13 bp, D. melanogaster
attgccagaaaat

SEQ ID NO: 592053 - DNA, 13 bp, D. melanogaster
attgccagatgac

SEQ ID NO: 592054 - DNA, 13 bp, D. melanogaster
attgccagcaaaa

SEQ ID NO: 592055 - DNA, 13 bp, D. melanogaster
attgccagcaatt

SEQ ID NO: 592056 - DNA, 13 bp, D. melanogaster
attgccagccaac

SEQ ID NO: 592057 - DNA, 14 bp, D. melanogaster
attgccagccaact

SEQ ID NO: 592058 - DNA, 13 bp, D. melanogaster
attgccagccagc

SEQ ID NO: 592059 - DNA, 13 bp, D. melanogaster
attgccaggcatt

SEQ ID NO: 592060 - DNA, 13 bp, D. melanogaster
attgccagtgacc

SEQ ID NO: 592061 - DNA, 13 bp, D. melanogaster
attgccagtggca

SEQ ID NO: 592062 - DNA, 13 bp, D. melanogaster
attgccataaaat

SEQ ID NO: 592063 - DNA, 13 bp, D. melanogaster
attgccatattta

SEQ ID NO: 592064 - DNA, 13 bp, D. melanogaster
attgccatatttg

SEQ ID NO: 592065 - DNA, 13 bp, D. melanogaster
attgccatcgcca

SEQ ID NO: 592066 - DNA, 13 bp, D. melanogaster
attgccatgaaaa

SEQ ID NO: 592067 - DNA, 13 bp, D. melanogaster
attgccatgcaaa

SEQ ID NO: 592068 - DNA, 13 bp, D. melanogaster
attgccatggcaa

SEQ ID NO: 592069 - DNA, 13 bp, D. melanogaster
attgccattcaat

SEQ ID NO: 592070 - DNA, 13 bp, D. melanogaster
attgccattccca

SEQ ID NO: 592071 - DNA, 13 bp, D. melanogaster
attgccattcgat

SEQ ID NO: 592072 - DNA, 13 bp, D. melanogaster
attgccattgatt

SEQ ID NO: 592073 - DNA, 13 bp, D. melanogaster
attgccattgcaa

SEQ ID NO: 592074 - DNA, 13 bp, D. melanogaster
attgccattgcag

SEQ ID NO: 592075 - DNA, 14 bp, D. melanogaster
attgccattgccac

SEQ ID NO: 592076 - DNA, 13 bp, D. melanogaster
attgccattgccg

SEQ ID NO: 592077 - DNA, 13 bp, D. melanogaster
attgccattgcct

SEQ ID NO: 592078 - DNA, 13 bp, D. melanogaster
attgccattgctg

SEQ ID NO: 592079 - DNA, 13 bp, D. melanogaster
attgccatttgca

SEQ ID NO: 592080 - DNA, 13 bp, D. melanogaster
attgccatttgct

SEQ ID NO: 592081 - DNA, 13 bp, D. melanogaster
attgccatttggc

SEQ ID NO: 592082 - DNA, 13 bp, D. melanogaster
attgccattttat

SEQ ID NO: 592083 - DNA, 13 bp, D. melanogaster
attgccattttgc

SEQ ID NO: 592084 - DNA, 13 bp, D. melanogaster
attgccattttta

SEQ ID NO: 592085 - DNA, 13 bp, D. melanogaster
attgcccactcga

SEQ ID NO: 592086 - DNA, 13 bp, D. melanogaster
attgcccagtgaa

SEQ ID NO: 592087 - DNA, 13 bp, D. melanogaster
attgccccttttt

SEQ ID NO: 592088 - DNA, 13 bp, D. melanogaster
attgccggccatt

SEQ ID NO: 592089 - DNA, 13 bp, D. melanogaster
attgccgtcatca

SEQ ID NO: 592090 - DNA, 14 bp, D. melanogaster
attgccgtcatcaa

SEQ ID NO: 592091 - DNA, 13 bp, D. melanogaster
attgcctactttt

SEQ ID NO: 592092 - DNA, 13 bp, D. melanogaster
attgcctgaatat

SEQ ID NO: 592093 - DNA, 13 bp, D. melanogaster
attgcctgcagaa

SEQ ID NO: 592094 - DNA, 13 bp, D. melanogaster
attgcctgcattt

SEQ ID NO: 592095 - DNA, 13 bp, D. melanogaster
attgccttaaaat

SEQ ID NO: 592096 - DNA, 13 bp, D. melanogaster
attgccttgtttt

SEQ ID NO: 592097 - DNA, 13 bp, D. melanogaster
attgcctttaaat

SEQ ID NO: 592098 - DNA, 13 bp, D. melanogaster
attgcctttggct

SEQ ID NO: 592099 - DNA, 13 bp, D. melanogaster
attgcctttgtca

SEQ ID NO: 592100 - DNA, 13 bp, D. melanogaster
attgcgaaaatat

SEQ ID NO: 592101 - DNA, 13 bp, D. melanogaster
attgcgaaaattg

SEQ ID NO: 592102 - DNA, 13 bp, D. melanogaster
attgcgaaatatt

SEQ ID NO: 592103 - DNA, 13 bp, D. melanogaster
attgcgaatgaaa

SEQ ID NO: 592104 - DNA, 13 bp, D. melanogaster
attgcgaatgcaa

SEQ ID NO: 592105 - DNA, 13 bp, D. melanogaster
attgcgaatgcga

SEQ ID NO: 592106 - DNA, 13 bp, D. melanogaster
attgcgattgcca

SEQ ID NO: 592107 - DNA, 13 bp, D. melanogaster
attgcgattgcga

SEQ ID NO: 592108 - DNA, 14 bp, D. melanogaster
attgcgattgcgat

SEQ ID NO: 592109 - DNA, 13 bp, D. melanogaster
attgcgatttaaa

SEQ ID NO: 592110 - DNA, 14 bp, D. melanogaster
attgcgatttaaaa

SEQ ID NO: 592111 - DNA, 13 bp, D. melanogaster
attgcgatttaat

SEQ ID NO: 592112 - DNA, 13 bp, D. melanogaster
attgcgatttgaa

SEQ ID NO: 592113 - DNA, 13 bp, D. melanogaster
attgcgcaatcgc

SEQ ID NO: 592114 - DNA, 14 bp, D. melanogaster
attgcgcatacgac

SEQ ID NO: 592115 - DNA, 13 bp, D. melanogaster
attgcgcatacgc

SEQ ID NO: 592116 - DNA, 14 bp, D. melanogaster
attgcgcatacgcc

SEQ ID NO: 592117 - DNA, 13 bp, D. melanogaster
attgcgcatacgt

SEQ ID NO: 592118 - DNA, 14 bp, D. melanogaster
attgcgcatacgtc

SEQ ID NO: 592119 - DNA, 13 bp, D. melanogaster
attgcgccatatt

SEQ ID NO: 592120 - DNA, 13 bp, D. melanogaster
attgcgcccagga

SEQ ID NO: 592121 - DNA, 13 bp, D. melanogaster
attgcggcagctg

SEQ ID NO: 592122 - DNA, 14 bp, D. melanogaster
attgcggcagctgt

SEQ ID NO: 592123 - DNA, 13 bp, D. melanogaster
attgcgtatacgc

SEQ ID NO: 592124 - DNA, 14 bp, D. melanogaster
attgcgtatacgca

SEQ ID NO: 592125 - DNA, 13 bp, D. melanogaster
attgcgtattaga

SEQ ID NO: 592126 - DNA, 13 bp, D. melanogaster
attgcgtcgttga

SEQ ID NO: 592127 - DNA, 13 bp, D. melanogaster
attgcgtttaaat

SEQ ID NO: 592128 - DNA, 13 bp, D. melanogaster
attgcgtttaatt

SEQ ID NO: 592129 - DNA, 13 bp, D. melanogaster
attgcgtttgttt

SEQ ID NO: 592130 - DNA, 13 bp, D. melanogaster
attgctaaaaaaa

SEQ ID NO: 592131 - DNA, 13 bp, D. melanogaster
attgctaaacaaa

SEQ ID NO: 592132 - DNA, 13 bp, D. melanogaster
attgctatatata

SEQ ID NO: 592133 - DNA, 13 bp, D. melanogaster
attgctatttata

SEQ ID NO: 592134 - DNA, 13 bp, D. melanogaster
attgctatttatt

SEQ ID NO: 592135 - DNA, 13 bp, D. melanogaster
attgctattttaa

SEQ ID NO: 592136 - DNA, 13 bp, D. melanogaster
attgctcaattat

SEQ ID NO: 592137 - DNA, 13 bp, D. melanogaster
attgctcatacgc

SEQ ID NO: 592138 - DNA, 14 bp, D. melanogaster
attgctcatacgcc

SEQ ID NO: 592139 - DNA, 13 bp, D. melanogaster
attgctccattga

SEQ ID NO: 592140 - DNA, 13 bp, D. melanogaster
attgctctaattg

SEQ ID NO: 592141 - DNA, 13 bp, D. melanogaster
attgctctctatc

SEQ ID NO: 592142 - DNA, 14 bp, D. melanogaster
attgctcttcaaag

SEQ ID NO: 592143 - DNA, 13 bp, D. melanogaster
attgctgaaaaag

SEQ ID NO: 592144 - DNA, 13 bp, D. melanogaster
attgctgaaaata

SEQ ID NO: 592145 - DNA, 13 bp, D. melanogaster
attgctgaccaag

SEQ ID NO: 592146 - DNA, 13 bp, D. melanogaster
attgctgcaaaaa

SEQ ID NO: 592147 - DNA, 13 bp, D. melanogaster
attgctgcaatca

SEQ ID NO: 592148 - DNA, 13 bp, D. melanogaster
attgctgcaattg

SEQ ID NO: 592149 - DNA, 13 bp, D. melanogaster
attgctgcaggag

SEQ ID NO: 592150 - DNA, 14 bp, D. melanogaster
attgctgcaggagc

SEQ ID NO: 592151 - DNA, 13 bp, D. melanogaster
attgctgccaaat

SEQ ID NO: 592152 - DNA, 13 bp, D. melanogaster
attgctgccattt

SEQ ID NO: 592153 - DNA, 13 bp, D. melanogaster
attgctggaaaaa

SEQ ID NO: 592154 - DNA, 13 bp, D. melanogaster
attgctggaatgc

SEQ ID NO: 592155 - DNA, 13 bp, D. melanogaster
attgctggaattg

SEQ ID NO: 592156 - DNA, 13 bp, D. melanogaster
attgctggatcaa

SEQ ID NO: 592157 - DNA, 13 bp, D. melanogaster
attgctggattat

SEQ ID NO: 592158 - DNA, 13 bp, D. melanogaster
attgctggcattt

SEQ ID NO: 592159 - DNA, 13 bp, D. melanogaster
attgctgggcaaa

SEQ ID NO: 592160 - DNA, 13 bp, D. melanogaster
attgctggtggtg

SEQ ID NO: 592161 - DNA, 14 bp, D. melanogaster
attgctggtggtga

SEQ ID NO: 592162 - DNA, 13 bp, D. melanogaster
attgctgtaattt

SEQ ID NO: 592163 - DNA, 13 bp, D. melanogaster
attgctgtatttt

SEQ ID NO: 592164 - DNA, 13 bp, D. melanogaster
attgctgttattg

SEQ ID NO: 592165 - DNA, 13 bp, D. melanogaster
attgctgttgata

SEQ ID NO: 592166 - DNA, 13 bp, D. melanogaster
attgctgttgatt

SEQ ID NO: 592167 - DNA, 13 bp, D. melanogaster
attgctgttgcag

SEQ ID NO: 592168 - DNA, 13 bp, D. melanogaster
attgctgttgctg

SEQ ID NO: 592169 - DNA, 13 bp, D. melanogaster
attgctgttgttg

SEQ ID NO: 592170 - DNA, 13 bp, D. melanogaster
attgctgtttaat

SEQ ID NO: 592171 - DNA, 13 bp, D. melanogaster
attgcttaaaaat

SEQ ID NO: 592172 - DNA, 14 bp, D. melanogaster
attgcttaaataaa

SEQ ID NO: 592173 - DNA, 13 bp, D. melanogaster
attgcttaattac

SEQ ID NO: 592174 - DNA, 13 bp, D. melanogaster
attgcttaattat

SEQ ID NO: 592175 - DNA, 13 bp, D. melanogaster
attgcttacattt

SEQ ID NO: 592176 - DNA, 13 bp, D. melanogaster
attgcttattaaa

SEQ ID NO: 592177 - DNA, 13 bp, D. melanogaster
attgcttatttaa

SEQ ID NO: 592178 - DNA, 13 bp, D. melanogaster
attgcttgcattc

SEQ ID NO: 592179 - DNA, 13 bp, D. melanogaster
attgcttgccaaa

SEQ ID NO: 592180 - DNA, 13 bp, D. melanogaster
attgctttaaaat

SEQ ID NO: 592181 - DNA, 13 bp, D. melanogaster
attgctttaagtt

SEQ ID NO: 592182 - DNA, 14 bp, D. melanogaster
attgctttaagttc

SEQ ID NO: 592183 - DNA, 13 bp, D. melanogaster
attgctttaatac

SEQ ID NO: 592184 - DNA, 13 bp, D. melanogaster
attgctttcattt

SEQ ID NO: 592185 - DNA, 13 bp, D. melanogaster
attgctttctttg

SEQ ID NO: 592186 - DNA, 13 bp, D. melanogaster
attgctttgaaaa

SEQ ID NO: 592187 - DNA, 13 bp, D. melanogaster
attgctttgattt

SEQ ID NO: 592188 - DNA, 13 bp, D. melanogaster
attgctttggcaa

SEQ ID NO: 592189 - DNA, 13 bp, D. melanogaster
attgctttgttta

SEQ ID NO: 592190 - DNA, 13 bp, D. melanogaster
attgcttttaaaa

SEQ ID NO: 592191 - DNA, 13 bp, D. melanogaster
attgcttttaata

SEQ ID NO: 592192 - DNA, 13 bp, D. melanogaster
attgcttttgctg

SEQ ID NO: 592193 - DNA, 14 bp, D. melanogaster
attgcttttgttgt

SEQ ID NO: 592194 - DNA, 13 bp, D. melanogaster
attgctttttaaa

SEQ ID NO: 592195 - DNA, 14 bp, D. melanogaster
attgctttttattc

SEQ ID NO: 592196 - DNA, 13 bp, D. melanogaster
attggaaaaatat

SEQ ID NO: 592197 - DNA, 13 bp, D. melanogaster
attggaaaacaag

SEQ ID NO: 592198 - DNA, 13 bp, D. melanogaster
attggaaaacaat

SEQ ID NO: 592199 - DNA, 13 bp, D. melanogaster
attggaaaacatt

SEQ ID NO: 592200 - DNA, 13 bp, D. melanogaster
attggaaaacttt

SEQ ID NO: 592201 - DNA, 13 bp, D. melanogaster
attggaaaagcaa

SEQ ID NO: 592202 - DNA, 13 bp, D. melanogaster
attggaaaatata

SEQ ID NO: 592203 - DNA, 13 bp, D. melanogaster
attggaaaatgta

SEQ ID NO: 592204 - DNA, 13 bp, D. melanogaster
attggaaaatgtg

SEQ ID NO: 592205 - DNA, 13 bp, D. melanogaster
attggaaaattga

SEQ ID NO: 592206 - DNA, 13 bp, D. melanogaster
attggaaacgaaa

SEQ ID NO: 592207 - DNA, 13 bp, D. melanogaster
attggaaagcgcg

SEQ ID NO: 592208 - DNA, 13 bp, D. melanogaster
attggaaagtttt

SEQ ID NO: 592209 - DNA, 14 bp, D. melanogaster
attggaaagttttt

SEQ ID NO: 592210 - DNA, 13 bp, D. melanogaster
attggaaataatt

SEQ ID NO: 592211 - DNA, 13 bp, D. melanogaster
attggaaatcaaa

SEQ ID NO: 592212 - DNA, 13 bp, D. melanogaster
attggaaatcttc

SEQ ID NO: 592213 - DNA, 13 bp, D. melanogaster
attggaaatgtga

SEQ ID NO: 592214 - DNA, 13 bp, D. melanogaster
attggaaattaca

SEQ ID NO: 592215 - DNA, 13 bp, D. melanogaster
attggaaattata

SEQ ID NO: 592216 - DNA, 13 bp, D. melanogaster
attggaaattatt

SEQ ID NO: 592217 - DNA, 13 bp, D. melanogaster
attggaaattgga

SEQ ID NO: 592218 - DNA, 13 bp, D. melanogaster
attggaaattgta

SEQ ID NO: 592219 - DNA, 13 bp, D. melanogaster
attggaaatttaa

SEQ ID NO: 592220 - DNA, 14 bp, D. melanogaster
attggaaatttaaa

SEQ ID NO: 592221 - DNA, 13 bp, D. melanogaster
attggaacatctg

SEQ ID NO: 592222 - DNA, 13 bp, D. melanogaster
attggaacatttt

SEQ ID NO: 592223 - DNA, 13 bp, D. melanogaster
attggaagctgga

SEQ ID NO: 592224 - DNA, 13 bp, D. melanogaster
attggaatatata

SEQ ID NO: 592225 - DNA, 14 bp, D. melanogaster
attggaatatatat

SEQ ID NO: 592226 - DNA, 13 bp, D. melanogaster
attggaatcattt

SEQ ID NO: 592227 - DNA, 13 bp, D. melanogaster
attggaatcggaa

SEQ ID NO: 592228 - DNA, 14 bp, D. melanogaster
attggaatcggaat

SEQ ID NO: 592229 - DNA, 13 bp, D. melanogaster
attggaatggaaa

SEQ ID NO: 592230 - DNA, 13 bp, D. melanogaster
attggaatgggaa

SEQ ID NO: 592231 - DNA, 13 bp, D. melanogaster
attggaattagga

SEQ ID NO: 592232 - DNA, 14 bp, D. melanogaster
attggaattgaaat

SEQ ID NO: 592233 - DNA, 15 bp, D. melanogaster
attggaattggaatt

SEQ ID NO: 592234 - DNA, 13 bp, D. melanogaster
attggaattggga

SEQ ID NO: 592235 - DNA, 13 bp, D. melanogaster
attggaatttaaa

SEQ ID NO: 592236 - DNA, 13 bp, D. melanogaster
attggaatttgtt

SEQ ID NO: 592237 - DNA, 13 bp, D. melanogaster
attggaattttat

SEQ ID NO: 592238 - DNA, 13 bp, D. melanogaster
attggaattttct

SEQ ID NO: 592239 - DNA, 13 bp, D. melanogaster
attggaattttgc

SEQ ID NO: 592240 - DNA, 13 bp, D. melanogaster
attggaatttttg

SEQ ID NO: 592241 - DNA, 13 bp, D. melanogaster
attggacaatctt

SEQ ID NO: 592242 - DNA, 13 bp, D. melanogaster
attggaccgccca

SEQ ID NO: 592243 - DNA, 13 bp, D. melanogaster
attggagattcaa

SEQ ID NO: 592244 - DNA, 13 bp, D. melanogaster
attggagcagacg

SEQ ID NO: 592245 - DNA, 13 bp, D. melanogaster
attggaggattgg

SEQ ID NO: 592246 - DNA, 14 bp, D. melanogaster
attggaggattggg

SEQ ID NO: 592247 - DNA, 13 bp, D. melanogaster
attggaggtgttt

SEQ ID NO: 592248 - DNA, 13 bp, D. melanogaster
attggagtcttta

SEQ ID NO: 592249 - DNA, 13 bp, D. melanogaster
attggagtctttg

SEQ ID NO: 592250 - DNA, 13 bp, D. melanogaster
attggagtggagt

SEQ ID NO: 592251 - DNA, 13 bp, D. melanogaster
attggatacatga

SEQ ID NO: 592252 - DNA, 13 bp, D. melanogaster
attggataccatt

SEQ ID NO: 592253 - DNA, 13 bp, D. melanogaster
attggatattaat

SEQ ID NO: 592254 - DNA, 13 bp, D. melanogaster
attggatattgat

SEQ ID NO: 592255 - DNA, 13 bp, D. melanogaster
attggatattgga

SEQ ID NO: 592256 - DNA, 13 bp, D. melanogaster
attggatatttat

SEQ ID NO: 592257 - DNA, 13 bp, D. melanogaster
attggatcatcat

SEQ ID NO: 592258 - DNA, 13 bp, D. melanogaster
attggatcggatc

SEQ ID NO: 592259 - DNA, 13 bp, D. melanogaster
attggatcggatt

SEQ ID NO: 592260 - DNA, 13 bp, D. melanogaster
attggatggatgg

SEQ ID NO: 592261 - DNA, 13 bp, D. melanogaster
attggatgtttaa

SEQ ID NO: 592262 - DNA, 13 bp, D. melanogaster
attggattaaaat

SEQ ID NO: 592263 - DNA, 13 bp, D. melanogaster
attggattaaatt

SEQ ID NO: 592264 - DNA, 13 bp, D. melanogaster
attggattacaat

SEQ ID NO: 592265 - DNA, 13 bp, D. melanogaster
attggattccatt

SEQ ID NO: 592266 - DNA, 13 bp, D. melanogaster
attggattcgatt

SEQ ID NO: 592267 - DNA, 13 bp, D. melanogaster
attggattggatc

SEQ ID NO: 592268 - DNA, 14 bp, D. melanogaster
attggattggattg

SEQ ID NO: 592269 - DNA, 13 bp, D. melanogaster
attggattggttt

SEQ ID NO: 592270 - DNA, 13 bp, D. melanogaster
attggatttaagt

SEQ ID NO: 592271 - DNA, 13 bp, D. melanogaster
attggatttaatt

SEQ ID NO: 592272 - DNA, 13 bp, D. melanogaster
attggatttattg

SEQ ID NO: 592273 - DNA, 13 bp, D. melanogaster
attggatttcaat

SEQ ID NO: 592274 - DNA, 13 bp, D. melanogaster
attggatttcttt

SEQ ID NO: 592275 - DNA, 13 bp, D. melanogaster
attggatttgatt

SEQ ID NO: 592276 - DNA, 14 bp, D. melanogaster
attggatttgcaaa

SEQ ID NO: 592277 - DNA, 13 bp, D. melanogaster
attggatttgcca

SEQ ID NO: 592278 - DNA, 13 bp, D. melanogaster
attggatttggtt

SEQ ID NO: 592279 - DNA, 13 bp, D. melanogaster
attggattttaag

SEQ ID NO: 592280 - DNA, 13 bp, D. melanogaster
attggcaaaacaa

SEQ ID NO: 592281 - DNA, 13 bp, D. melanogaster
attggcaaaacat

SEQ ID NO: 592282 - DNA, 14 bp, D. melanogaster
attggcaaacattt

SEQ ID NO: 592283 - DNA, 14 bp, D. melanogaster
attggcaaatattt

SEQ ID NO: 592284 - DNA, 13 bp, D. melanogaster
attggcaacaaaa

SEQ ID NO: 592285 - DNA, 13 bp, D. melanogaster
attggcaacaaat

SEQ ID NO: 592286 - DNA, 13 bp, D. melanogaster
attggcaactggc

SEQ ID NO: 592287 - DNA, 13 bp, D. melanogaster
attggcaataaaa

SEQ ID NO: 592288 - DNA, 13 bp, D. melanogaster
attggcaatgcaa

SEQ ID NO: 592289 - DNA, 13 bp, D. melanogaster
attggcaattatt

SEQ ID NO: 592290 - DNA, 13 bp, D. melanogaster
attggcaattgca

SEQ ID NO: 592291 - DNA, 13 bp, D. melanogaster
attggcaatttcc

SEQ ID NO: 592292 - DNA, 13 bp, D. melanogaster
attggcaatttgc

SEQ ID NO: 592293 - DNA, 13 bp, D. melanogaster
attggcaccatgc

SEQ ID NO: 592294 - DNA, 14 bp, D. melanogaster
attggcagaaaatt

SEQ ID NO: 592295 - DNA, 13 bp, D. melanogaster
attggcatcggca

SEQ ID NO: 592296 - DNA, 13 bp, D. melanogaster
attggcatgcaaa

SEQ ID NO: 592297 - DNA, 13 bp, D. melanogaster
attggcattaaat

SEQ ID NO: 592298 - DNA, 13 bp, D. melanogaster
attggcattgaaa

SEQ ID NO: 592299 - DNA, 13 bp, D. melanogaster
attggcattgttg

SEQ ID NO: 592300 - DNA, 13 bp, D. melanogaster
attggcattgttt

SEQ ID NO: 592301 - DNA, 13 bp, D. melanogaster
attggcatttacc

SEQ ID NO: 592302 - DNA, 13 bp, D. melanogaster
attggcatttatt

SEQ ID NO: 592303 - DNA, 14 bp, D. melanogaster
attggcattttatt

SEQ ID NO: 592304 - DNA, 13 bp, D. melanogaster
attggcattttta

SEQ ID NO: 592305 - DNA, 13 bp, D. melanogaster
attggcatttttt

SEQ ID NO: 592306 - DNA, 13 bp, D. melanogaster
attggccaaaaat

SEQ ID NO: 592307 - DNA, 13 bp, D. melanogaster
attggccaaaatg

SEQ ID NO: 592308 - DNA, 13 bp, D. melanogaster
attggccaaacgg

SEQ ID NO: 592309 - DNA, 13 bp, D. melanogaster
attggccaaatta

SEQ ID NO: 592310 - DNA, 13 bp, D. melanogaster
attggccaacatt

SEQ ID NO: 592311 - DNA, 15 bp, D. melanogaster
attggccaacattat

SEQ ID NO: 592312 - DNA, 13 bp, D. melanogaster
attggccaagtgc

SEQ ID NO: 592313 - DNA, 13 bp, D. melanogaster
attggccaataaa

SEQ ID NO: 592314 - DNA, 13 bp, D. melanogaster
attggccaatatt

SEQ ID NO: 592315 - DNA, 13 bp, D. melanogaster
attggccaattga

SEQ ID NO: 592316 - DNA, 13 bp, D. melanogaster
attggccaattgg

SEQ ID NO: 592317 - DNA, 13 bp, D. melanogaster
attggccaattgt

SEQ ID NO: 592318 - DNA, 13 bp, D. melanogaster
attggccaatttg

SEQ ID NO: 592319 - DNA, 13 bp, D. melanogaster
attggccacaaat

SEQ ID NO: 592320 - DNA, 13 bp, D. melanogaster
attggccaggcca

SEQ ID NO: 592321 - DNA, 13 bp, D. melanogaster
attggccataaat

SEQ ID NO: 592322 - DNA, 13 bp, D. melanogaster
attggccatttgg

SEQ ID NO: 592323 - DNA, 13 bp, D. melanogaster
attggccattttt

SEQ ID NO: 592324 - DNA, 13 bp, D. melanogaster
attggccccaaat

SEQ ID NO: 592325 - DNA, 13 bp, D. melanogaster
attggcctggcca

SEQ ID NO: 592326 - DNA, 13 bp, D. melanogaster
attggcgcccaaa

SEQ ID NO: 592327 - DNA, 13 bp, D. melanogaster
attggcggaggct

SEQ ID NO: 592328 - DNA, 13 bp, D. melanogaster
attggctacaaat

SEQ ID NO: 592329 - DNA, 14 bp, D. melanogaster
attggctacaaatc

SEQ ID NO: 592330 - DNA, 13 bp, D. melanogaster
attggctatgtat

SEQ ID NO: 592331 - DNA, 13 bp, D. melanogaster
attggctgctatt

SEQ ID NO: 592332 - DNA, 13 bp, D. melanogaster
attggcttataaa

SEQ ID NO: 592333 - DNA, 14 bp, D. melanogaster
attggcttggattt

SEQ ID NO: 592334 - DNA, 13 bp, D. melanogaster
attgggaaaaata

SEQ ID NO: 592335 - DNA, 13 bp, D. melanogaster
attgggaaaatat

SEQ ID NO: 592336 - DNA, 13 bp, D. melanogaster
attgggaattatt

SEQ ID NO: 592337 - DNA, 13 bp, D. melanogaster
attgggaatttaa

SEQ ID NO: 592338 - DNA, 13 bp, D. melanogaster
attgggaatttta

SEQ ID NO: 592339 - DNA, 13 bp, D. melanogaster
attgggaattttt

SEQ ID NO: 592340 - DNA, 14 bp, D. melanogaster
attgggactttgat

SEQ ID NO: 592341 - DNA, 13 bp, D. melanogaster
attgggagtggga

SEQ ID NO: 592342 - DNA, 13 bp, D. melanogaster
attgggatcggga

SEQ ID NO: 592343 - DNA, 13 bp, D. melanogaster
attgggattcgga

SEQ ID NO: 592344 - DNA, 13 bp, D. melanogaster
attgggattggaa

SEQ ID NO: 592345 - DNA, 13 bp, D. melanogaster
attgggattggga

SEQ ID NO: 592346 - DNA, 13 bp, D. melanogaster
attgggattgggc

SEQ ID NO: 592347 - DNA, 14 bp, D. melanogaster
attgggattgggtt

SEQ ID NO: 592348 - DNA, 14 bp, D. melanogaster
attgggatttggcc

SEQ ID NO: 592349 - DNA, 13 bp, D. melanogaster
attgggcaaggaa

SEQ ID NO: 592350 - DNA, 13 bp, D. melanogaster
attgggcaataat

SEQ ID NO: 592351 - DNA, 13 bp, D. melanogaster
attgggcaattac

SEQ ID NO: 592352 - DNA, 13 bp, D. melanogaster
attgggcatttcg

SEQ ID NO: 592353 - DNA, 13 bp, D. melanogaster
attgggcattttt

SEQ ID NO: 592354 - DNA, 13 bp, D. melanogaster
attgggctttgtt

SEQ ID NO: 592355 - DNA, 13 bp, D. melanogaster
attggggaaaatg

SEQ ID NO: 592356 - DNA, 13 bp, D. melanogaster
attggggcattgg

SEQ ID NO: 592357 - DNA, 13 bp, D. melanogaster
attgggggattgg

SEQ ID NO: 592358 - DNA, 13 bp, D. melanogaster
attgggtaaataa

SEQ ID NO: 592359 - DNA, 14 bp, D. melanogaster
attgggtcgtgttg

SEQ ID NO: 592360 - DNA, 13 bp, D. melanogaster
attgggtgcactt

SEQ ID NO: 592361 - DNA, 13 bp, D. melanogaster
attggtaaaaagt

SEQ ID NO: 592362 - DNA, 13 bp, D. melanogaster
attggtaaaataa

SEQ ID NO: 592363 - DNA, 13 bp, D. melanogaster
attggtaaataaa

SEQ ID NO: 592364 - DNA, 13 bp, D. melanogaster
attggtaaatatt

SEQ ID NO: 592365 - DNA, 13 bp, D. melanogaster
attggtaagatgc

SEQ ID NO: 592366 - DNA, 13 bp, D. melanogaster
attggtaataaaa

SEQ ID NO: 592367 - DNA, 13 bp, D. melanogaster
attggtatataaa

SEQ ID NO: 592368 - DNA, 13 bp, D. melanogaster
attggtatatatt

SEQ ID NO: 592369 - DNA, 13 bp, D. melanogaster
attggtattggta

SEQ ID NO: 592370 - DNA, 14 bp, D. melanogaster
attggtattggtat

SEQ ID NO: 592371 - DNA, 14 bp, D. melanogaster
attggtcaacgaaa

SEQ ID NO: 592372 - DNA, 13 bp, D. melanogaster
attggtccgatct

SEQ ID NO: 592373 - DNA, 14 bp, D. melanogaster
attggtgaataaaa

SEQ ID NO: 592374 - DNA, 13 bp, D. melanogaster
attggtggcatat

SEQ ID NO: 592375 - DNA, 13 bp, D. melanogaster
attggtgggcaaa

SEQ ID NO: 592376 - DNA, 13 bp, D. melanogaster
attggttattaaa

SEQ ID NO: 592377 - DNA, 14 bp, D. melanogaster
attggttgggtctg

SEQ ID NO: 592378 - DNA, 13 bp, D. melanogaster
attggtttaaaat

SEQ ID NO: 592379 - DNA, 13 bp, D. melanogaster
attggtttataaa

SEQ ID NO: 592380 - DNA, 14 bp, D. melanogaster
attggtttcatcga

SEQ ID NO: 592381 - DNA, 13 bp, D. melanogaster
attggtttccaaa

SEQ ID NO: 592382 - DNA, 13 bp, D. melanogaster
attggtttcgatt

SEQ ID NO: 592383 - DNA, 13 bp, D. melanogaster
attggttttaaaa

SEQ ID NO: 592384 - DNA, 13 bp, D. melanogaster
attggttttgaaa

SEQ ID NO: 592385 - DNA, 13 bp, D. melanogaster
attgtaaaatgaa

SEQ ID NO: 592386 - DNA, 13 bp, D. melanogaster
attgtaaaattgc

SEQ ID NO: 592387 - DNA, 13 bp, D. melanogaster
attgtaaaattgg

SEQ ID NO: 592388 - DNA, 13 bp, D. melanogaster
attgtaaacaaaa

SEQ ID NO: 592389 - DNA, 13 bp, D. melanogaster
attgtaaacaaat

SEQ ID NO: 592390 - DNA, 13 bp, D. melanogaster
attgtaaacaatt

SEQ ID NO: 592391 - DNA, 13 bp, D. melanogaster
attgtaaacattt

SEQ ID NO: 592392 - DNA, 13 bp, D. melanogaster
attgtaaactaaa

SEQ ID NO: 592393 - DNA, 13 bp, D. melanogaster
attgtaaagaaat

SEQ ID NO: 592394 - DNA, 13 bp, D. melanogaster
attgtaaagatat

SEQ ID NO: 592395 - DNA, 13 bp, D. melanogaster
attgtaaataaag

SEQ ID NO: 592396 - DNA, 13 bp, D. melanogaster
attgtaaataagt

SEQ ID NO: 592397 - DNA, 13 bp, D. melanogaster
attgtaaatactt

SEQ ID NO: 592398 - DNA, 13 bp, D. melanogaster
attgtaaatcaat

SEQ ID NO: 592399 - DNA, 13 bp, D. melanogaster
attgtaaatgcaa

SEQ ID NO: 592400 - DNA, 13 bp, D. melanogaster
attgtaaatggaa

SEQ ID NO: 592401 - DNA, 13 bp, D. melanogaster
attgtaaatgtat

SEQ ID NO: 592402 - DNA, 13 bp, D. melanogaster
attgtaaattatg

SEQ ID NO: 592403 - DNA, 13 bp, D. melanogaster
attgtaaatttct

SEQ ID NO: 592404 - DNA, 13 bp, D. melanogaster
attgtaaatttga

SEQ ID NO: 592405 - DNA, 14 bp, D. melanogaster
attgtaaatttgac

SEQ ID NO: 592406 - DNA, 13 bp, D. melanogaster
attgtaaatttgt

SEQ ID NO: 592407 - DNA, 14 bp, D. melanogaster
attgtaacaaaata

SEQ ID NO: 592408 - DNA, 13 bp, D. melanogaster
attgtaacattga

SEQ ID NO: 592409 - DNA, 13 bp, D. melanogaster
attgtaacattta

SEQ ID NO: 592410 - DNA, 13 bp, D. melanogaster
attgtaactgcat

SEQ ID NO: 592411 - DNA, 13 bp, D. melanogaster
attgtaacttaaa

SEQ ID NO: 592412 - DNA, 15 bp, D. melanogaster
attgtaagcataatg

SEQ ID NO: 592413 - DNA, 14 bp, D. melanogaster
attgtaagtccaaa

SEQ ID NO: 592414 - DNA, 13 bp, D. melanogaster
attgtaataatcg

SEQ ID NO: 592415 - DNA, 13 bp, D. melanogaster
attgtaatcaaat

SEQ ID NO: 592416 - DNA, 13 bp, D. melanogaster
attgtaatcacca

SEQ ID NO: 592417 - DNA, 13 bp, D. melanogaster
attgtaatcattt

SEQ ID NO: 592418 - DNA, 13 bp, D. melanogaster
attgtaatgcaat

SEQ ID NO: 592419 - DNA, 13 bp, D. melanogaster
attgtaattgaaa

SEQ ID NO: 592420 - DNA, 13 bp, D. melanogaster
attgtaattgaat

SEQ ID NO: 592421 - DNA, 13 bp, D. melanogaster
attgtaattgatt

SEQ ID NO: 592422 - DNA, 14 bp, D. melanogaster
attgtaattgcatt

SEQ ID NO: 592423 - DNA, 13 bp, D. melanogaster
attgtaattgctt

SEQ ID NO: 592424 - DNA, 13 bp, D. melanogaster
attgtaatttaag

SEQ ID NO: 592425 - DNA, 13 bp, D. melanogaster
attgtaatttgca

SEQ ID NO: 592426 - DNA, 13 bp, D. melanogaster
attgtaattttct

SEQ ID NO: 592427 - DNA, 13 bp, D. melanogaster
attgtacaaaaaa

SEQ ID NO: 592428 - DNA, 13 bp, D. melanogaster
attgtacaataca

SEQ ID NO: 592429 - DNA, 13 bp, D. melanogaster
attgtacaatttc

SEQ ID NO: 592430 - DNA, 13 bp, D. melanogaster
attgtacaatttt

SEQ ID NO: 592431 - DNA, 13 bp, D. melanogaster
attgtacactcaa

SEQ ID NO: 592432 - DNA, 13 bp, D. melanogaster
attgtacatacat

SEQ ID NO: 592433 - DNA, 14 bp, D. melanogaster
attgtacatacata

SEQ ID NO: 592434 - DNA, 13 bp, D. melanogaster
attgtacatatgt

SEQ ID NO: 592435 - DNA, 13 bp, D. melanogaster
attgtacatatta

SEQ ID NO: 592436 - DNA, 13 bp, D. melanogaster
attgtacatgaaa

SEQ ID NO: 592437 - DNA, 13 bp, D. melanogaster
attgtacgagtat

SEQ ID NO: 592438 - DNA, 13 bp, D. melanogaster
attgtactttaaa

SEQ ID NO: 592439 - DNA, 13 bp, D. melanogaster
attgtactttttg

SEQ ID NO: 592440 - DNA, 13 bp, D. melanogaster
attgtagaatatt

SEQ ID NO: 592441 - DNA, 13 bp, D. melanogaster
attgtagatagca

SEQ ID NO: 592442 - DNA, 13 bp, D. melanogaster
attgtagatatat

SEQ ID NO: 592443 - DNA, 13 bp, D. melanogaster
attgtagatctaa

SEQ ID NO: 592444 - DNA, 13 bp, D. melanogaster
attgtagttgttg

SEQ ID NO: 592445 - DNA, 13 bp, D. melanogaster
attgtataatttc

SEQ ID NO: 592446 - DNA, 13 bp, D. melanogaster
attgtatactata

SEQ ID NO: 592447 - DNA, 13 bp, D. melanogaster
attgtatatacaa

SEQ ID NO: 592448 - DNA, 13 bp, D. melanogaster
attgtatatatct

SEQ ID NO: 592449 - DNA, 13 bp, D. melanogaster
attgtatatattc

SEQ ID NO: 592450 - DNA, 13 bp, D. melanogaster
attgtatatttca

SEQ ID NO: 592451 - DNA, 13 bp, D. melanogaster
attgtatatttcc

SEQ ID NO: 592452 - DNA, 13 bp, D. melanogaster
attgtatattttc

SEQ ID NO: 592453 - DNA, 13 bp, D. melanogaster
attgtatctatat

SEQ ID NO: 592454 - DNA, 13 bp, D. melanogaster
attgtatctattt

SEQ ID NO: 592455 - DNA, 13 bp, D. melanogaster
attgtatgaaaat

SEQ ID NO: 592456 - DNA, 13 bp, D. melanogaster
attgtatgaacag

SEQ ID NO: 592457 - DNA, 13 bp, D. melanogaster
attgtatgcaaaa

SEQ ID NO: 592458 - DNA, 13 bp, D. melanogaster
attgtatgcaatt

SEQ ID NO: 592459 - DNA, 13 bp, D. melanogaster
attgtatgtactt

SEQ ID NO: 592460 - DNA, 14 bp, D. melanogaster
attgtatgtatata

SEQ ID NO: 592461 - DNA, 13 bp, D. melanogaster
attgtatgtgtat

SEQ ID NO: 592462 - DNA, 13 bp, D. melanogaster
attgtattaaaag

SEQ ID NO: 592463 - DNA, 13 bp, D. melanogaster
attgtattattca

SEQ ID NO: 592464 - DNA, 13 bp, D. melanogaster
attgtattgattc

SEQ ID NO: 592465 - DNA, 13 bp, D. melanogaster
attgtattgcatt

SEQ ID NO: 592466 - DNA, 13 bp, D. melanogaster
attgtattgcttt

SEQ ID NO: 592467 - DNA, 13 bp, D. melanogaster
attgtattgtaat

SEQ ID NO: 592468 - DNA, 13 bp, D. melanogaster
attgtattgtatg

SEQ ID NO: 592469 - DNA, 14 bp, D. melanogaster
attgtattgtgata

SEQ ID NO: 592470 - DNA, 13 bp, D. melanogaster
attgtatttactt

SEQ ID NO: 592471 - DNA, 13 bp, D. melanogaster
attgtatttcaaa

SEQ ID NO: 592472 - DNA, 13 bp, D. melanogaster
attgtatttcatt

SEQ ID NO: 592473 - DNA, 13 bp, D. melanogaster
attgtatttgcaa

SEQ ID NO: 592474 - DNA, 13 bp, D. melanogaster
attgtatttgtaa

SEQ ID NO: 592475 - DNA, 14 bp, D. melanogaster
attgtatttgtaaa

SEQ ID NO: 592476 - DNA, 13 bp, D. melanogaster
attgtattttact

SEQ ID NO: 592477 - DNA, 13 bp, D. melanogaster
attgtattttcat

SEQ ID NO: 592478 - DNA, 13 bp, D. melanogaster
attgtattttctg

SEQ ID NO: 592479 - DNA, 13 bp, D. melanogaster
attgtcaaaataa

SEQ ID NO: 592480 - DNA, 13 bp, D. melanogaster
attgtcaaaatta

SEQ ID NO: 592481 - DNA, 13 bp, D. melanogaster
attgtcaaattga

SEQ ID NO: 592482 - DNA, 13 bp, D. melanogaster
attgtcaacaaaa

SEQ ID NO: 592483 - DNA, 13 bp, D. melanogaster
attgtcaagttta

SEQ ID NO: 592484 - DNA, 13 bp, D. melanogaster
attgtcaatcaat

SEQ ID NO: 592485 - DNA, 13 bp, D. melanogaster
attgtcaattgtt

SEQ ID NO: 592486 - DNA, 13 bp, D. melanogaster
attgtcagctcaa

SEQ ID NO: 592487 - DNA, 13 bp, D. melanogaster
attgtcagcttgt

SEQ ID NO: 592488 - DNA, 13 bp, D. melanogaster
attgtcataatta

SEQ ID NO: 592489 - DNA, 13 bp, D. melanogaster
attgtcatcctgc

SEQ ID NO: 592490 - DNA, 13 bp, D. melanogaster
attgtcattgatt

SEQ ID NO: 592491 - DNA, 13 bp, D. melanogaster
attgtcattttaa

SEQ ID NO: 592492 - DNA, 13 bp, D. melanogaster
attgtccatatga

SEQ ID NO: 592493 - DNA, 13 bp, D. melanogaster
attgtccatcacc

SEQ ID NO: 592494 - DNA, 13 bp, D. melanogaster
attgtcgcaagag

SEQ ID NO: 592495 - DNA, 13 bp, D. melanogaster
attgtcgctcaag

SEQ ID NO: 592496 - DNA, 13 bp, D. melanogaster
attgtcggaaatc

SEQ ID NO: 592497 - DNA, 13 bp, D. melanogaster
attgtctaaaaat

SEQ ID NO: 592498 - DNA, 13 bp, D. melanogaster
attgtcttggtca

SEQ ID NO: 592499 - DNA, 13 bp, D. melanogaster
attgtgaaaaata

SEQ ID NO: 592500 - DNA, 13 bp, D. melanogaster
attgtgaaactaa

SEQ ID NO: 592501 - DNA, 14 bp, D. melanogaster
attgtgaaactaaa

SEQ ID NO: 592502 - DNA, 13 bp, D. melanogaster
attgtgaaatagc

SEQ ID NO: 592503 - DNA, 13 bp, D. melanogaster
attgtgaaatatg

SEQ ID NO: 592504 - DNA, 13 bp, D. melanogaster
attgtgaaatgaa

SEQ ID NO: 592505 - DNA, 13 bp, D. melanogaster
attgtgaaatgtt

SEQ ID NO: 592506 - DNA, 13 bp, D. melanogaster
attgtgaaattca

SEQ ID NO: 592507 - DNA, 13 bp, D. melanogaster
attgtgaaattcc

SEQ ID NO: 592508 - DNA, 13 bp, D. melanogaster
attgtgaaattgt

SEQ ID NO: 592509 - DNA, 13 bp, D. melanogaster
attgtgaaccagt

SEQ ID NO: 592510 - DNA, 13 bp, D. melanogaster
attgtgaatgaaa

SEQ ID NO: 592511 - DNA, 13 bp, D. melanogaster
attgtgaattaaa

SEQ ID NO: 592512 - DNA, 13 bp, D. melanogaster
attgtgaattgtg

SEQ ID NO: 592513 - DNA, 13 bp, D. melanogaster
attgtgatattta

SEQ ID NO: 592514 - DNA, 13 bp, D. melanogaster
attgtgatcttgt

SEQ ID NO: 592515 - DNA, 13 bp, D. melanogaster
attgtgatggacg

SEQ ID NO: 592516 - DNA, 13 bp, D. melanogaster
attgtgattaatt

SEQ ID NO: 592517 - DNA, 13 bp, D. melanogaster
attgtgattgtga

SEQ ID NO: 592518 - DNA, 13 bp, D. melanogaster
attgtgattttaa

SEQ ID NO: 592519 - DNA, 13 bp, D. melanogaster
attgtgcaaaaaa

SEQ ID NO: 592520 - DNA, 13 bp, D. melanogaster
attgtgcaaagta

SEQ ID NO: 592521 - DNA, 13 bp, D. melanogaster
attgtgcaaataa

SEQ ID NO: 592522 - DNA, 13 bp, D. melanogaster
attgtgcaaatat

SEQ ID NO: 592523 - DNA, 13 bp, D. melanogaster
attgtgcaaatgt

SEQ ID NO: 592524 - DNA, 13 bp, D. melanogaster
attgtgcaataat

SEQ ID NO: 592525 - DNA, 13 bp, D. melanogaster
attgtgcaattta

SEQ ID NO: 592526 - DNA, 13 bp, D. melanogaster
attgtgcatatat

SEQ ID NO: 592527 - DNA, 13 bp, D. melanogaster
attgtgcgcactc

SEQ ID NO: 592528 - DNA, 13 bp, D. melanogaster
attgtgctcgctg

SEQ ID NO: 592529 - DNA, 13 bp, D. melanogaster
attgtgctctttg

SEQ ID NO: 592530 - DNA, 13 bp, D. melanogaster
attgtgctgtatt

SEQ ID NO: 592531 - DNA, 13 bp, D. melanogaster
attgtgcttatta

SEQ ID NO: 592532 - DNA, 13 bp, D. melanogaster
attgtggaaaaga

SEQ ID NO: 592533 - DNA, 13 bp, D. melanogaster
attgtggaaaatg

SEQ ID NO: 592534 - DNA, 13 bp, D. melanogaster
attgtggaatatt

SEQ ID NO: 592535 - DNA, 13 bp, D. melanogaster
attgtggactcca

SEQ ID NO: 592536 - DNA, 13 bp, D. melanogaster
attgtggcaacaa

SEQ ID NO: 592537 - DNA, 13 bp, D. melanogaster
attgtgggttcag

SEQ ID NO: 592538 - DNA, 13 bp, D. melanogaster
attgtggtaatgg

SEQ ID NO: 592539 - DNA, 13 bp, D. melanogaster
attgtggtgcaac

SEQ ID NO: 592540 - DNA, 13 bp, D. melanogaster
attgtgtaaaatg

SEQ ID NO: 592541 - DNA, 13 bp, D. melanogaster
attgtgtaaacaa

SEQ ID NO: 592542 - DNA, 13 bp, D. melanogaster
attgtgtaaatat

SEQ ID NO: 592543 - DNA, 14 bp, D. melanogaster
attgtgtataataa

SEQ ID NO: 592544 - DNA, 13 bp, D. melanogaster
attgtgtccacaa

SEQ ID NO: 592545 - DNA, 13 bp, D. melanogaster
attgtgtgcattt

SEQ ID NO: 592546 - DNA, 14 bp, D. melanogaster
attgtgtgccaaaa

SEQ ID NO: 592547 - DNA, 13 bp, D. melanogaster
attgtgtgcgttt

SEQ ID NO: 592548 - DNA, 13 bp, D. melanogaster
attgtgtggaaaa

SEQ ID NO: 592549 - DNA, 13 bp, D. melanogaster
attgtgtgggcgt

SEQ ID NO: 592550 - DNA, 13 bp, D. melanogaster
attgtgtgtaatt

SEQ ID NO: 592551 - DNA, 13 bp, D. melanogaster
attgtgtgtgtat

SEQ ID NO: 592552 - DNA, 13 bp, D. melanogaster
attgtgttaaata

SEQ ID NO: 592553 - DNA, 13 bp, D. melanogaster
attgtgttaaatt

SEQ ID NO: 592554 - DNA, 13 bp, D. melanogaster
attgtgtttaaaa

SEQ ID NO: 592555 - DNA, 13 bp, D. melanogaster
attgtgtttgtga

SEQ ID NO: 592556 - DNA, 14 bp, D. melanogaster
attgtgttttcatt

SEQ ID NO: 592557 - DNA, 13 bp, D. melanogaster
attgtgttttcca

SEQ ID NO: 592558 - DNA, 13 bp, D. melanogaster
attgttaaagaaa

SEQ ID NO: 592559 - DNA, 13 bp, D. melanogaster
attgttaaagttt

SEQ ID NO: 592560 - DNA, 13 bp, D. melanogaster
attgttaaatcaa

SEQ ID NO: 592561 - DNA, 13 bp, D. melanogaster
attgttaacaaaa

SEQ ID NO: 592562 - DNA, 13 bp, D. melanogaster
attgttaagaaat

SEQ ID NO: 592563 - DNA, 13 bp, D. melanogaster
attgttaagcaaa

SEQ ID NO: 592564 - DNA, 13 bp, D. melanogaster
attgttatacatt

SEQ ID NO: 592565 - DNA, 13 bp, D. melanogaster
attgttatagaaa

SEQ ID NO: 592566 - DNA, 13 bp, D. melanogaster
attgttatgcaat

SEQ ID NO: 592567 - DNA, 13 bp, D. melanogaster
attgttattaatc

SEQ ID NO: 592568 - DNA, 13 bp, D. melanogaster
attgttattatct

SEQ ID NO: 592569 - DNA, 13 bp, D. melanogaster
attgttattgctt

SEQ ID NO: 592570 - DNA, 13 bp, D. melanogaster
attgttattggca

SEQ ID NO: 592571 - DNA, 13 bp, D. melanogaster
attgttatttgca

SEQ ID NO: 592572 - DNA, 13 bp, D. melanogaster
attgttattttca

SEQ ID NO: 592573 - DNA, 13 bp, D. melanogaster
attgttcaaaagt

SEQ ID NO: 592574 - DNA, 13 bp, D. melanogaster
attgttcaaatac

SEQ ID NO: 592575 - DNA, 13 bp, D. melanogaster
attgttcataaaa

SEQ ID NO: 592576 - DNA, 13 bp, D. melanogaster
attgttcattgtt

SEQ ID NO: 592577 - DNA, 13 bp, D. melanogaster
attgttcatttga

SEQ ID NO: 592578 - DNA, 13 bp, D. melanogaster
attgttcctaaag

SEQ ID NO: 592579 - DNA, 13 bp, D. melanogaster
attgttcctaatg

SEQ ID NO: 592580 - DNA, 13 bp, D. melanogaster
attgttcgatttt

SEQ ID NO: 592581 - DNA, 13 bp, D. melanogaster
attgttcttaata

SEQ ID NO: 592582 - DNA, 13 bp, D. melanogaster
attgttgaaaaat

SEQ ID NO: 592583 - DNA, 14 bp, D. melanogaster
attgttgaaaaatg

SEQ ID NO: 592584 - DNA, 13 bp, D. melanogaster
attgttgaaaatt

SEQ ID NO: 592585 - DNA, 13 bp, D. melanogaster
attgttgaaataa

SEQ ID NO: 592586 - DNA, 13 bp, D. melanogaster
attgttgaaatta

SEQ ID NO: 592587 - DNA, 14 bp, D. melanogaster
attgttgaattaaa

SEQ ID NO: 592588 - DNA, 14 bp, D. melanogaster
attgttgagtgctt

SEQ ID NO: 592589 - DNA, 13 bp, D. melanogaster
attgttgatcctg

SEQ ID NO: 592590 - DNA, 13 bp, D. melanogaster
attgttgcaattt

SEQ ID NO: 592591 - DNA, 13 bp, D. melanogaster
attgttgcacaaa

SEQ ID NO: 592592 - DNA, 13 bp, D. melanogaster
attgttgcagctg

SEQ ID NO: 592593 - DNA, 13 bp, D. melanogaster
attgttgcagttg

SEQ ID NO: 592594 - DNA, 13 bp, D. melanogaster
attgttgcataaa

SEQ ID NO: 592595 - DNA, 13 bp, D. melanogaster
attgttgcataat

SEQ ID NO: 592596 - DNA, 13 bp, D. melanogaster
attgttgcatact

SEQ ID NO: 592597 - DNA, 13 bp, D. melanogaster
attgttgcatgca

SEQ ID NO: 592598 - DNA, 13 bp, D. melanogaster
attgttgccattt

SEQ ID NO: 592599 - DNA, 14 bp, D. melanogaster
attgttgccatttc

SEQ ID NO: 592600 - DNA, 13 bp, D. melanogaster
attgttgccgctg

SEQ ID NO: 592601 - DNA, 13 bp, D. melanogaster
attgttgctgcga

SEQ ID NO: 592602 - DNA, 13 bp, D. melanogaster
attgttgctgttg

SEQ ID NO: 592603 - DNA, 14 bp, D. melanogaster
attgttgctgttgt

SEQ ID NO: 592604 - DNA, 13 bp, D. melanogaster
attgttgcttatt

SEQ ID NO: 592605 - DNA, 13 bp, D. melanogaster
attgttggaaatg

SEQ ID NO: 592606 - DNA, 13 bp, D. melanogaster
attgttggaattt

SEQ ID NO: 592607 - DNA, 14 bp, D. melanogaster
attgttggcagctg

SEQ ID NO: 592608 - DNA, 13 bp, D. melanogaster
attgttggccaag

SEQ ID NO: 592609 - DNA, 13 bp, D. melanogaster
attgttggccatg

SEQ ID NO: 592610 - DNA, 13 bp, D. melanogaster
attgttgggaaaa

SEQ ID NO: 592611 - DNA, 13 bp, D. melanogaster
attgttgtaaaaa

SEQ ID NO: 592612 - DNA, 13 bp, D. melanogaster
attgttgtacaat

SEQ ID NO: 592613 - DNA, 13 bp, D. melanogaster
attgttgtcattt

SEQ ID NO: 592614 - DNA, 13 bp, D. melanogaster
attgttgtcgttg

SEQ ID NO: 592615 - DNA, 13 bp, D. melanogaster
attgttgtgcacg

SEQ ID NO: 592616 - DNA, 13 bp, D. melanogaster
attgttgtggcta

SEQ ID NO: 592617 - DNA, 14 bp, D. melanogaster
attgttgtggctac

SEQ ID NO: 592618 - DNA, 13 bp, D. melanogaster
attgttgttaact

SEQ ID NO: 592619 - DNA, 13 bp, D. melanogaster
attgttgttcaaa

SEQ ID NO: 592620 - DNA, 13 bp, D. melanogaster
attgttgttcctg

SEQ ID NO: 592621 - DNA, 13 bp, D. melanogaster
attgttgttcttg

SEQ ID NO: 592622 - DNA, 13 bp, D. melanogaster
attgttgttgcaa

SEQ ID NO: 592623 - DNA, 14 bp, D. melanogaster
attgttgttgcaaa

SEQ ID NO: 592624 - DNA, 13 bp, D. melanogaster
attgttgttgcca

SEQ ID NO: 592625 - DNA, 14 bp, D. melanogaster
attgttgttgccat

SEQ ID NO: 592626 - DNA, 13 bp, D. melanogaster
attgttgttgccg

SEQ ID NO: 592627 - DNA, 14 bp, D. melanogaster
attgttgttgccgt

SEQ ID NO: 592628 - DNA, 13 bp, D. melanogaster
attgttgttgctc

SEQ ID NO: 592629 - DNA, 13 bp, D. melanogaster
attgttgttgctg

SEQ ID NO: 592630 - DNA, 14 bp, D. melanogaster
attgttgttgctgc

SEQ ID NO: 592631 - DNA, 13 bp, D. melanogaster
attgttgttgctt

SEQ ID NO: 592632 - DNA, 14 bp, D. melanogaster
attgttgttgcttt

SEQ ID NO: 592633 - DNA, 13 bp, D. melanogaster
attgttgttgtgc

SEQ ID NO: 592634 - DNA, 13 bp, D. melanogaster
attgttgttgttc

SEQ ID NO: 592635 - DNA, 14 bp, D. melanogaster
attgttgttgttct

SEQ ID NO: 592636 - DNA, 13 bp, D. melanogaster
attgttgtttaca

SEQ ID NO: 592637 - DNA, 13 bp, D. melanogaster
attgtttaaaagg

SEQ ID NO: 592638 - DNA, 14 bp, D. melanogaster
attgtttaaacaaa

SEQ ID NO: 592639 - DNA, 13 bp, D. melanogaster
attgtttaaactt

SEQ ID NO: 592640 - DNA, 13 bp, D. melanogaster
attgtttaaagaa

SEQ ID NO: 592641 - DNA, 13 bp, D. melanogaster
attgtttaaatca

SEQ ID NO: 592642 - DNA, 13 bp, D. melanogaster
attgtttaacttt

SEQ ID NO: 592643 - DNA, 13 bp, D. melanogaster
attgtttaagtgg

SEQ ID NO: 592644 - DNA, 13 bp, D. melanogaster
attgtttaagtta

SEQ ID NO: 592645 - DNA, 13 bp, D. melanogaster
attgtttacaata

SEQ ID NO: 592646 - DNA, 13 bp, D. melanogaster
attgtttacattg

SEQ ID NO: 592647 - DNA, 13 bp, D. melanogaster
attgtttacgtat

SEQ ID NO: 592648 - DNA, 13 bp, D. melanogaster
attgtttacttta

SEQ ID NO: 592649 - DNA, 13 bp, D. melanogaster
attgtttagcaaa

SEQ ID NO: 592650 - DNA, 13 bp, D. melanogaster
attgtttataaac

SEQ ID NO: 592651 - DNA, 13 bp, D. melanogaster
attgtttatactg

SEQ ID NO: 592652 - DNA, 14 bp, D. melanogaster
attgtttatactga

SEQ ID NO: 592653 - DNA, 13 bp, D. melanogaster
attgtttatggcc

SEQ ID NO: 592654 - DNA, 13 bp, D. melanogaster
attgtttatgtgc

SEQ ID NO: 592655 - DNA, 13 bp, D. melanogaster
attgtttattaac

SEQ ID NO: 592656 - DNA, 13 bp, D. melanogaster
attgtttattaag

SEQ ID NO: 592657 - DNA, 13 bp, D. melanogaster
attgtttattagg

SEQ ID NO: 592658 - DNA, 13 bp, D. melanogaster
attgtttcaaaaa

SEQ ID NO: 592659 - DNA, 13 bp, D. melanogaster
attgtttcaaaat

SEQ ID NO: 592660 - DNA, 13 bp, D. melanogaster
attgtttccatta

SEQ ID NO: 592661 - DNA, 14 bp, D. melanogaster
attgtttccattat

SEQ ID NO: 592662 - DNA, 13 bp, D. melanogaster
attgtttcccctt

SEQ ID NO: 592663 - DNA, 13 bp, D. melanogaster
attgtttcgaaat

SEQ ID NO: 592664 - DNA, 13 bp, D. melanogaster
attgtttcgattt

SEQ ID NO: 592665 - DNA, 13 bp, D. melanogaster
attgtttcgcttt

SEQ ID NO: 592666 - DNA, 13 bp, D. melanogaster
attgtttcggaaa

SEQ ID NO: 592667 - DNA, 14 bp, D. melanogaster
attgtttcggaaaa

SEQ ID NO: 592668 - DNA, 13 bp, D. melanogaster
attgtttcgtaat

SEQ ID NO: 592669 - DNA, 14 bp, D. melanogaster
attgtttctgcatt

SEQ ID NO: 592670 - DNA, 13 bp, D. melanogaster
attgtttctgttg

SEQ ID NO: 592671 - DNA, 13 bp, D. melanogaster
attgtttgacttg

SEQ ID NO: 592672 - DNA, 13 bp, D. melanogaster
attgtttgcactg

SEQ ID NO: 592673 - DNA, 13 bp, D. melanogaster
attgtttgcactt

SEQ ID NO: 592674 - DNA, 13 bp, D. melanogaster
attgtttgcatat

SEQ ID NO: 592675 - DNA, 13 bp, D. melanogaster
attgtttgcattg

SEQ ID NO: 592676 - DNA, 13 bp, D. melanogaster
attgtttgccaag

SEQ ID NO: 592677 - DNA, 13 bp, D. melanogaster
attgtttgccaat

SEQ ID NO: 592678 - DNA, 13 bp, D. melanogaster
attgtttgccagc

SEQ ID NO: 592679 - DNA, 13 bp, D. melanogaster
attgtttgccatc

SEQ ID NO: 592680 - DNA, 14 bp, D. melanogaster
attgtttgccattt

SEQ ID NO: 592681 - DNA, 13 bp, D. melanogaster
attgtttgctata

SEQ ID NO: 592682 - DNA, 13 bp, D. melanogaster
attgtttgctctg

SEQ ID NO: 592683 - DNA, 13 bp, D. melanogaster
attgtttgctgca

SEQ ID NO: 592684 - DNA, 13 bp, D. melanogaster
attgtttgctttc

SEQ ID NO: 592685 - DNA, 14 bp, D. melanogaster
attgtttgcttttg

SEQ ID NO: 592686 - DNA, 13 bp, D. melanogaster
attgtttggaatt

SEQ ID NO: 592687 - DNA, 13 bp, D. melanogaster
attgtttggccaa

SEQ ID NO: 592688 - DNA, 13 bp, D. melanogaster
attgtttggccag

SEQ ID NO: 592689 - DNA, 13 bp, D. melanogaster
attgtttggccat

SEQ ID NO: 592690 - DNA, 13 bp, D. melanogaster
attgtttgtaaaa

SEQ ID NO: 592691 - DNA, 13 bp, D. melanogaster
attgtttgtaaat

SEQ ID NO: 592692 - DNA, 13 bp, D. melanogaster
attgtttgtaata

SEQ ID NO: 592693 - DNA, 13 bp, D. melanogaster
attgtttgtgaaa

SEQ ID NO: 592694 - DNA, 13 bp, D. melanogaster
attgtttgtttgc

SEQ ID NO: 592695 - DNA, 14 bp, D. melanogaster
attgtttgtttgct

SEQ ID NO: 592696 - DNA, 13 bp, D. melanogaster
attgttttaaatg

SEQ ID NO: 592697 - DNA, 14 bp, D. melanogaster
attgttttaaattc

SEQ ID NO: 592698 - DNA, 13 bp, D. melanogaster
attgttttagcca

SEQ ID NO: 592699 - DNA, 13 bp, D. melanogaster
attgttttcaaat

SEQ ID NO: 592700 - DNA, 13 bp, D. melanogaster
attgttttcaagt

SEQ ID NO: 592701 - DNA, 13 bp, D. melanogaster
attgttttcaata

SEQ ID NO: 592702 - DNA, 13 bp, D. melanogaster
attgttttcagtt

SEQ ID NO: 592703 - DNA, 13 bp, D. melanogaster
attgttttcattg

SEQ ID NO: 592704 - DNA, 14 bp, D. melanogaster
attgttttcatttg

SEQ ID NO: 592705 - DNA, 13 bp, D. melanogaster
attgttttccaaa

SEQ ID NO: 592706 - DNA, 13 bp, D. melanogaster
attgttttccatg

SEQ ID NO: 592707 - DNA, 13 bp, D. melanogaster
attgttttccatt

SEQ ID NO: 592708 - DNA, 13 bp, D. melanogaster
attgttttcccaa

SEQ ID NO: 592709 - DNA, 13 bp, D. melanogaster
attgttttcgaaa

SEQ ID NO: 592710 - DNA, 13 bp, D. melanogaster
attgttttcgatt

SEQ ID NO: 592711 - DNA, 13 bp, D. melanogaster
attgttttcgcat

SEQ ID NO: 592712 - DNA, 13 bp, D. melanogaster
attgttttctaaa

SEQ ID NO: 592713 - DNA, 13 bp, D. melanogaster
attgttttctgtg

SEQ ID NO: 592714 - DNA, 13 bp, D. melanogaster
attgttttgaaag

SEQ ID NO: 592715 - DNA, 13 bp, D. melanogaster
attgttttgaata

SEQ ID NO: 592716 - DNA, 13 bp, D. melanogaster
attgttttgaggg

SEQ ID NO: 592717 - DNA, 13 bp, D. melanogaster
attgttttgctga

SEQ ID NO: 592718 - DNA, 13 bp, D. melanogaster
attgttttgctta

SEQ ID NO: 592719 - DNA, 14 bp, D. melanogaster
attgttttgtgtaa

SEQ ID NO: 592720 - DNA, 13 bp, D. melanogaster
attgtttttacca

SEQ ID NO: 592721 - DNA, 13 bp, D. melanogaster
attgtttttagcc

SEQ ID NO: 592722 - DNA, 13 bp, D. melanogaster
attgtttttatca

SEQ ID NO: 592723 - DNA, 13 bp, D. melanogaster
attgtttttcaaa

SEQ ID NO: 592724 - DNA, 13 bp, D. melanogaster
attgtttttcatg

SEQ ID NO: 592725 - DNA, 13 bp, D. melanogaster
attgtttttcctc

SEQ ID NO: 592726 - DNA, 14 bp, D. melanogaster
attgtttttgttgc

SEQ ID NO: 592727 - DNA, 13 bp, D. melanogaster
attgttttttcca

SEQ ID NO: 592728 - DNA, 13 bp, D. melanogaster
atttaaaaaacga

SEQ ID NO: 592729 - DNA, 13 bp, D. melanogaster
atttaaaaaactc

SEQ ID NO: 592730 - DNA, 13 bp, D. melanogaster
atttaaaaaccat

SEQ ID NO: 592731 - DNA, 13 bp, D. melanogaster
atttaaaaaccca

SEQ ID NO: 592732 - DNA, 13 bp, D. melanogaster
atttaaaaacctt

SEQ ID NO: 592733 - DNA, 13 bp, D. melanogaster
atttaaaaactgt

SEQ ID NO: 592734 - DNA, 13 bp, D. melanogaster
atttaaaaagcat

SEQ ID NO: 592735 - DNA, 14 bp, D. melanogaster
atttaaaaagcttt

SEQ ID NO: 592736 - DNA, 14 bp, D. melanogaster
atttaaaaatgcat

SEQ ID NO: 592737 - DNA, 14 bp, D. melanogaster
atttaaaacacatt

SEQ ID NO: 592738 - DNA, 14 bp, D. melanogaster
atttaaaaccaatt

SEQ ID NO: 592739 - DNA, 13 bp, D. melanogaster
atttaaaagcaaa

SEQ ID NO: 592740 - DNA, 13 bp, D. melanogaster
atttaaaagcaat

SEQ ID NO: 592741 - DNA, 13 bp, D. melanogaster
atttaaaagccaa

SEQ ID NO: 592742 - DNA, 13 bp, D. melanogaster
atttaaaagccca

SEQ ID NO: 592743 - DNA, 13 bp, D. melanogaster
atttaaaaggcaa

SEQ ID NO: 592744 - DNA, 13 bp, D. melanogaster
atttaaaaggtat

SEQ ID NO: 592745 - DNA, 13 bp, D. melanogaster
atttaaaagtgaa

SEQ ID NO: 592746 - DNA, 13 bp, D. melanogaster
atttaaaagtgtg

SEQ ID NO: 592747 - DNA, 13 bp, D. melanogaster
atttaaaagttca

SEQ ID NO: 592748 - DNA, 13 bp, D. melanogaster
atttaaaatacca

SEQ ID NO: 592749 - DNA, 13 bp, D. melanogaster
atttaaaatcaca

SEQ ID NO: 592750 - DNA, 13 bp, D. melanogaster
atttaaaatctca

SEQ ID NO: 592751 - DNA, 14 bp, D. melanogaster
atttaaaatgcaaa

SEQ ID NO: 592752 - DNA, 13 bp, D. melanogaster
atttaaaatgtgc

SEQ ID NO: 592753 - DNA, 13 bp, D. melanogaster
atttaaaattcag

SEQ ID NO: 592754 - DNA, 13 bp, D. melanogaster
atttaaaattcct

SEQ ID NO: 592755 - DNA, 13 bp, D. melanogaster
atttaaacaagtt

SEQ ID NO: 592756 - DNA, 13 bp, D. melanogaster
atttaaacaatca

SEQ ID NO: 592757 - DNA, 13 bp, D. melanogaster
atttaaacaatga

SEQ ID NO: 592758 - DNA, 13 bp, D. melanogaster
atttaaacaattg

SEQ ID NO: 592759 - DNA, 13 bp, D. melanogaster
atttaaacacaat

SEQ ID NO: 592760 - DNA, 13 bp, D. melanogaster
atttaaacatcaa

SEQ ID NO: 592761 - DNA, 13 bp, D. melanogaster
atttaaaccaacc

SEQ ID NO: 592762 - DNA, 13 bp, D. melanogaster
atttaaaccaaga

SEQ ID NO: 592763 - DNA, 14 bp, D. melanogaster
atttaaaccattta

SEQ ID NO: 592764 - DNA, 13 bp, D. melanogaster
atttaaacgcaat

SEQ ID NO: 592765 - DNA, 13 bp, D. melanogaster
atttaaacgtaaa

SEQ ID NO: 592766 - DNA, 13 bp, D. melanogaster
atttaaacgtttt

SEQ ID NO: 592767 - DNA, 13 bp, D. melanogaster
atttaaactcatt

SEQ ID NO: 592768 - DNA, 13 bp, D. melanogaster
atttaaactgaat

SEQ ID NO: 592769 - DNA, 13 bp, D. melanogaster
atttaaactgatt

SEQ ID NO: 592770 - DNA, 13 bp, D. melanogaster
atttaaactttca

SEQ ID NO: 592771 - DNA, 14 bp, D. melanogaster
atttaaagaaaatc

SEQ ID NO: 592772 - DNA, 13 bp, D. melanogaster
atttaaagaaact

SEQ ID NO: 592773 - DNA, 13 bp, D. melanogaster
atttaaagaacaa

SEQ ID NO: 592774 - DNA, 13 bp, D. melanogaster
atttaaagacaaa

SEQ ID NO: 592775 - DNA, 13 bp, D. melanogaster
atttaaagacttt

SEQ ID NO: 592776 - DNA, 13 bp, D. melanogaster
atttaaagagctt

SEQ ID NO: 592777 - DNA, 13 bp, D. melanogaster
atttaaagagtaa

SEQ ID NO: 592778 - DNA, 13 bp, D. melanogaster
atttaaagcaatt

SEQ ID NO: 592779 - DNA, 14 bp, D. melanogaster
atttaaagcaattt

SEQ ID NO: 592780 - DNA, 13 bp, D. melanogaster
atttaaagcactt

SEQ ID NO: 592781 - DNA, 13 bp, D. melanogaster
atttaaagcattt

SEQ ID NO: 592782 - DNA, 14 bp, D. melanogaster
atttaaagcattta

SEQ ID NO: 592783 - DNA, 14 bp, D. melanogaster
atttaaagcatttt

SEQ ID NO: 592784 - DNA, 14 bp, D. melanogaster
atttaaagccaaag

SEQ ID NO: 592785 - DNA, 13 bp, D. melanogaster
atttaaagctatt

SEQ ID NO: 592786 - DNA, 13 bp, D. melanogaster
atttaaagcttaa

SEQ ID NO: 592787 - DNA, 13 bp, D. melanogaster
atttaaaggatac

SEQ ID NO: 592788 - DNA, 13 bp, D. melanogaster
atttaaaggtatt

SEQ ID NO: 592789 - DNA, 13 bp, D. melanogaster
atttaaagtaagc

SEQ ID NO: 592790 - DNA, 13 bp, D. melanogaster
atttaaagtaagt

SEQ ID NO: 592791 - DNA, 13 bp, D. melanogaster
atttaaagtatct

SEQ ID NO: 592792 - DNA, 13 bp, D. melanogaster
atttaaagtcaaa

SEQ ID NO: 592793 - DNA, 13 bp, D. melanogaster
atttaaagtcaat

SEQ ID NO: 592794 - DNA, 13 bp, D. melanogaster
atttaaagtctaa

SEQ ID NO: 592795 - DNA, 14 bp, D. melanogaster
atttaaagtctaat

SEQ ID NO: 592796 - DNA, 13 bp, D. melanogaster
atttaaagtgaat

SEQ ID NO: 592797 - DNA, 13 bp, D. melanogaster
atttaaagtgcca

SEQ ID NO: 592798 - DNA, 13 bp, D. melanogaster
atttaaagttcaa

SEQ ID NO: 592799 - DNA, 13 bp, D. melanogaster
atttaaagttctt

SEQ ID NO: 592800 - DNA, 13 bp, D. melanogaster
atttaaatacatg

SEQ ID NO: 592801 - DNA, 13 bp, D. melanogaster
atttaaatacctt

SEQ ID NO: 592802 - DNA, 13 bp, D. melanogaster
atttaaatagcaa

SEQ ID NO: 592803 - DNA, 13 bp, D. melanogaster
atttaaatagcat

SEQ ID NO: 592804 - DNA, 13 bp, D. melanogaster
atttaaatatagc

SEQ ID NO: 592805 - DNA, 14 bp, D. melanogaster
atttaaatatgcaa

SEQ ID NO: 592806 - DNA, 13 bp, D. melanogaster
atttaaatatgct

SEQ ID NO: 592807 - DNA, 13 bp, D. melanogaster
atttaaatcaaag

SEQ ID NO: 592808 - DNA, 13 bp, D. melanogaster
atttaaatcagtt

SEQ ID NO: 592809 - DNA, 13 bp, D. melanogaster
atttaaatccttt

SEQ ID NO: 592810 - DNA, 13 bp, D. melanogaster
atttaaatcgaaa

SEQ ID NO: 592811 - DNA, 13 bp, D. melanogaster
atttaaatcgaat

SEQ ID NO: 592812 - DNA, 13 bp, D. melanogaster
atttaaatctgaa

SEQ ID NO: 592813 - DNA, 13 bp, D. melanogaster
atttaaatctgtt

SEQ ID NO: 592814 - DNA, 13 bp, D. melanogaster
atttaaatgaaac

SEQ ID NO: 592815 - DNA, 14 bp, D. melanogaster
atttaaatgaaacg

SEQ ID NO: 592816 - DNA, 13 bp, D. melanogaster
atttaaatgaaag

SEQ ID NO: 592817 - DNA, 14 bp, D. melanogaster
atttaaatgaaatg

SEQ ID NO: 592818 - DNA, 13 bp, D. melanogaster
atttaaatgaagc

SEQ ID NO: 592819 - DNA, 13 bp, D. melanogaster
atttaaatgagct

SEQ ID NO: 592820 - DNA, 14 bp, D. melanogaster
atttaaatgataac

SEQ ID NO: 592821 - DNA, 19 bp, D. melanogaster
atttaaatgatctgcgaca

SEQ ID NO: 592822 - DNA, 13 bp, D. melanogaster
atttaaatgcaaa

SEQ ID NO: 592823 - DNA, 14 bp, D. melanogaster
atttaaatgcaaat

SEQ ID NO: 592824 - DNA, 13 bp, D. melanogaster
atttaaatgcacc

SEQ ID NO: 592825 - DNA, 13 bp, D. melanogaster
atttaaatgcagc

SEQ ID NO: 592826 - DNA, 13 bp, D. melanogaster
atttaaatgcatg

SEQ ID NO: 592827 - DNA, 14 bp, D. melanogaster
atttaaatgcatta

SEQ ID NO: 592828 - DNA, 14 bp, D. melanogaster
atttaaatgcattt

SEQ ID NO: 592829 - DNA, 13 bp, D. melanogaster
atttaaatgccag

SEQ ID NO: 592830 - DNA, 13 bp, D. melanogaster
atttaaatgccat

SEQ ID NO: 592831 - DNA, 13 bp, D. melanogaster
atttaaatgccca

SEQ ID NO: 592832 - DNA, 13 bp, D. melanogaster
atttaaatgcctt

SEQ ID NO: 592833 - DNA, 13 bp, D. melanogaster
atttaaatgcgag

SEQ ID NO: 592834 - DNA, 13 bp, D. melanogaster
atttaaatgcgca

SEQ ID NO: 592835 - DNA, 13 bp, D. melanogaster
atttaaatgcgtt

SEQ ID NO: 592836 - DNA, 14 bp, D. melanogaster
atttaaatgctaat

SEQ ID NO: 592837 - DNA, 13 bp, D. melanogaster
atttaaatgctgt

SEQ ID NO: 592838 - DNA, 13 bp, D. melanogaster
atttaaatgcttt

SEQ ID NO: 592839 - DNA, 13 bp, D. melanogaster
atttaaatggaaa

SEQ ID NO: 592840 - DNA, 13 bp, D. melanogaster
atttaaatggaat

SEQ ID NO: 592841 - DNA, 13 bp, D. melanogaster
atttaaatggcaa

SEQ ID NO: 592842 - DNA, 14 bp, D. melanogaster
atttaaatggcaaa

SEQ ID NO: 592843 - DNA, 14 bp, D. melanogaster
atttaaatgggaaa

SEQ ID NO: 592844 - DNA, 13 bp, D. melanogaster
atttaaatggtat

SEQ ID NO: 592845 - DNA, 13 bp, D. melanogaster
atttaaatggttt

SEQ ID NO: 592846 - DNA, 13 bp, D. melanogaster
atttaaatgttct

SEQ ID NO: 592847 - DNA, 14 bp, D. melanogaster
atttaaatgttctg

SEQ ID NO: 592848 - DNA, 13 bp, D. melanogaster
atttaaattacac

SEQ ID NO: 592849 - DNA, 13 bp, D. melanogaster
atttaaattacca

SEQ ID NO: 592850 - DNA, 13 bp, D. melanogaster
atttaaattagca

SEQ ID NO: 592851 - DNA, 13 bp, D. melanogaster
atttaaattccaa

SEQ ID NO: 592852 - DNA, 14 bp, D. melanogaster
atttaaattcccaa

SEQ ID NO: 592853 - DNA, 13 bp, D. melanogaster
atttaaattctga

SEQ ID NO: 592854 - DNA, 14 bp, D. melanogaster
atttaaattgaatg

SEQ ID NO: 592855 - DNA, 14 bp, D. melanogaster
atttaaattgcata

SEQ ID NO: 592856 - DNA, 13 bp, D. melanogaster
atttaaattgctc

SEQ ID NO: 592857 - DNA, 13 bp, D. melanogaster
atttaaattggct

SEQ ID NO: 592858 - DNA, 13 bp, D. melanogaster
atttaaattgtgc

SEQ ID NO: 592859 - DNA, 13 bp, D. melanogaster
atttaaatttagc

SEQ ID NO: 592860 - DNA, 13 bp, D. melanogaster
atttaaatttccc

SEQ ID NO: 592861 - DNA, 13 bp, D. melanogaster
atttaaatttctg

SEQ ID NO: 592862 - DNA, 14 bp, D. melanogaster
atttaaatttgcat

SEQ ID NO: 592863 - DNA, 13 bp, D. melanogaster
atttaaatttgcc

SEQ ID NO: 592864 - DNA, 13 bp, D. melanogaster
atttaaatttgga

SEQ ID NO: 592865 - DNA, 13 bp, D. melanogaster
atttaaatttggc

SEQ ID NO: 592866 - DNA, 14 bp, D. melanogaster
atttaaatttggca

SEQ ID NO: 592867 - DNA, 13 bp, D. melanogaster
atttaaatttgtg

SEQ ID NO: 592868 - DNA, 13 bp, D. melanogaster
atttaacaacttt

SEQ ID NO: 592869 - DNA, 13 bp, D. melanogaster
atttaacaatgtt

SEQ ID NO: 592870 - DNA, 13 bp, D. melanogaster
atttaacaattca

SEQ ID NO: 592871 - DNA, 14 bp, D. melanogaster
atttaacacatttt

SEQ ID NO: 592872 - DNA, 14 bp, D. melanogaster
atttaacatttaac

SEQ ID NO: 592873 - DNA, 13 bp, D. melanogaster
atttaacatttac

SEQ ID NO: 592874 - DNA, 13 bp, D. melanogaster
atttaaccaactc

SEQ ID NO: 592875 - DNA, 13 bp, D. melanogaster
atttaaccatttt

SEQ ID NO: 592876 - DNA, 13 bp, D. melanogaster
atttaacctattt

SEQ ID NO: 592877 - DNA, 13 bp, D. melanogaster
atttaacgaaaaa

SEQ ID NO: 592878 - DNA, 13 bp, D. melanogaster
atttaacgaaatt

SEQ ID NO: 592879 - DNA, 13 bp, D. melanogaster
atttaacgcattt

SEQ ID NO: 592880 - DNA, 13 bp, D. melanogaster
atttaactgaaaa

SEQ ID NO: 592881 - DNA, 14 bp, D. melanogaster
atttaactgaaaaa

SEQ ID NO: 592882 - DNA, 13 bp, D. melanogaster
atttaactgaaat

SEQ ID NO: 592883 - DNA, 13 bp, D. melanogaster
atttaactgcaaa

SEQ ID NO: 592884 - DNA, 13 bp, D. melanogaster
atttaacttacaa

SEQ ID NO: 592885 - DNA, 13 bp, D. melanogaster
atttaacttcaaa

SEQ ID NO: 592886 - DNA, 13 bp, D. melanogaster
atttaacttcatt

SEQ ID NO: 592887 - DNA, 13 bp, D. melanogaster
atttaactttcta

SEQ ID NO: 592888 - DNA, 13 bp, D. melanogaster
atttaactttggc

SEQ ID NO: 592889 - DNA, 13 bp, D. melanogaster
atttaacttttag

SEQ ID NO: 592890 - DNA, 13 bp, D. melanogaster
atttaagaaaaca

SEQ ID NO: 592891 - DNA, 13 bp, D. melanogaster
atttaagacaaaa

SEQ ID NO: 592892 - DNA, 13 bp, D. melanogaster
atttaagagaatg

SEQ ID NO: 592893 - DNA, 13 bp, D. melanogaster
atttaagattttc

SEQ ID NO: 592894 - DNA, 13 bp, D. melanogaster
atttaagcaaaaa

SEQ ID NO: 592895 - DNA, 13 bp, D. melanogaster
atttaagcaaaat

SEQ ID NO: 592896 - DNA, 13 bp, D. melanogaster
atttaagcaaata

SEQ ID NO: 592897 - DNA, 14 bp, D. melanogaster
atttaagcaaattt

SEQ ID NO: 592898 - DNA, 13 bp, D. melanogaster
atttaagcaacaa

SEQ ID NO: 592899 - DNA, 13 bp, D. melanogaster
atttaagcaactt

SEQ ID NO: 592900 - DNA, 13 bp, D. melanogaster
atttaagcacata

SEQ ID NO: 592901 - DNA, 13 bp, D. melanogaster
atttaagcacatt

SEQ ID NO: 592902 - DNA, 13 bp, D. melanogaster
atttaagcataat

SEQ ID NO: 592903 - DNA, 14 bp, D. melanogaster
atttaagcatttaa

SEQ ID NO: 592904 - DNA, 13 bp, D. melanogaster
atttaagcatttc

SEQ ID NO: 592905 - DNA, 13 bp, D. melanogaster
atttaagcatttt

SEQ ID NO: 592906 - DNA, 13 bp, D. melanogaster
atttaagccaaaa

SEQ ID NO: 592907 - DNA, 13 bp, D. melanogaster
atttaagccaaca

SEQ ID NO: 592908 - DNA, 13 bp, D. melanogaster
atttaagcgaaat

SEQ ID NO: 592909 - DNA, 13 bp, D. melanogaster
atttaagcgtttt

SEQ ID NO: 592910 - DNA, 13 bp, D. melanogaster
atttaagctcttt

SEQ ID NO: 592911 - DNA, 13 bp, D. melanogaster
atttaagcttaag

SEQ ID NO: 592912 - DNA, 13 bp, D. melanogaster
atttaagcttatt

SEQ ID NO: 592913 - DNA, 13 bp, D. melanogaster
atttaagctttat

SEQ ID NO: 592914 - DNA, 13 bp, D. melanogaster
atttaaggaatat

SEQ ID NO: 592915 - DNA, 13 bp, D. melanogaster
atttaaggatata

SEQ ID NO: 592916 - DNA, 13 bp, D. melanogaster
atttaaggatatt

SEQ ID NO: 592917 - DNA, 13 bp, D. melanogaster
atttaaggatttt

SEQ ID NO: 592918 - DNA, 13 bp, D. melanogaster
atttaaggcaatt

SEQ ID NO: 592919 - DNA, 13 bp, D. melanogaster
atttaagggaaaa

SEQ ID NO: 592920 - DNA, 13 bp, D. melanogaster
atttaaggtaaat

SEQ ID NO: 592921 - DNA, 13 bp, D. melanogaster
atttaagtaaatc

SEQ ID NO: 592922 - DNA, 13 bp, D. melanogaster
atttaagtacatt

SEQ ID NO: 592923 - DNA, 13 bp, D. melanogaster
atttaagtcattt

SEQ ID NO: 592924 - DNA, 13 bp, D. melanogaster
atttaagtgcaca

SEQ ID NO: 592925 - DNA, 13 bp, D. melanogaster
atttaagtgcatt

SEQ ID NO: 592926 - DNA, 14 bp, D. melanogaster
atttaagtgcattt

SEQ ID NO: 592927 - DNA, 13 bp, D. melanogaster
atttaagtgctta

SEQ ID NO: 592928 - DNA, 13 bp, D. melanogaster
atttaagtggctt

SEQ ID NO: 592929 - DNA, 13 bp, D. melanogaster
atttaagtgttaa

SEQ ID NO: 592930 - DNA, 14 bp, D. melanogaster
atttaagtgttaaa

SEQ ID NO: 592931 - DNA, 14 bp, D. melanogaster
atttaagtgtttaa

SEQ ID NO: 592932 - DNA, 13 bp, D. melanogaster
atttaagttgaat

SEQ ID NO: 592933 - DNA, 13 bp, D. melanogaster
atttaagtttgta

SEQ ID NO: 592934 - DNA, 13 bp, D. melanogaster
atttaagtttttc

SEQ ID NO: 592935 - DNA, 13 bp, D. melanogaster
atttaataaagct

SEQ ID NO: 592936 - DNA, 13 bp, D. melanogaster
atttaataaatgc

SEQ ID NO: 592937 - DNA, 13 bp, D. melanogaster
atttaataagcaa

SEQ ID NO: 592938 - DNA, 13 bp, D. melanogaster
atttaataagcca

SEQ ID NO: 592939 - DNA, 13 bp, D. melanogaster
atttaataagctg

SEQ ID NO: 592940 - DNA, 13 bp, D. melanogaster
atttaatacacat

SEQ ID NO: 592941 - DNA, 13 bp, D. melanogaster
atttaatatgcga

SEQ ID NO: 592942 - DNA, 13 bp, D. melanogaster
atttaatatggaa

SEQ ID NO: 592943 - DNA, 14 bp, D. melanogaster
atttaatattgaca

SEQ ID NO: 592944 - DNA, 13 bp, D. melanogaster
atttaatattgct

SEQ ID NO: 592945 - DNA, 13 bp, D. melanogaster
atttaatcagaaa

SEQ ID NO: 592946 - DNA, 13 bp, D. melanogaster
atttaatcagcaa

SEQ ID NO: 592947 - DNA, 13 bp, D. melanogaster
atttaatcccaaa

SEQ ID NO: 592948 - DNA, 13 bp, D. melanogaster
atttaatcgattt

SEQ ID NO: 592949 - DNA, 13 bp, D. melanogaster
atttaatcgcatt

SEQ ID NO: 592950 - DNA, 13 bp, D. melanogaster
atttaatctgttt

SEQ ID NO: 592951 - DNA, 13 bp, D. melanogaster
atttaatgaacat

SEQ ID NO: 592952 - DNA, 13 bp, D. melanogaster
atttaatgaagtt

SEQ ID NO: 592953 - DNA, 13 bp, D. melanogaster
atttaatgacatt

SEQ ID NO: 592954 - DNA, 13 bp, D. melanogaster
atttaatgagctt

SEQ ID NO: 592955 - DNA, 13 bp, D. melanogaster
atttaatgatgaa

SEQ ID NO: 592956 - DNA, 13 bp, D. melanogaster
atttaatgcaaaa

SEQ ID NO: 592957 - DNA, 13 bp, D. melanogaster
atttaatgcaaat

SEQ ID NO: 592958 - DNA, 14 bp, D. melanogaster
atttaatgcaaatt

SEQ ID NO: 592959 - DNA, 13 bp, D. melanogaster
atttaatgcaatt

SEQ ID NO: 592960 - DNA, 14 bp, D. melanogaster
atttaatgcaattt

SEQ ID NO: 592961 - DNA, 13 bp, D. melanogaster
atttaatgcagca

SEQ ID NO: 592962 - DNA, 14 bp, D. melanogaster
atttaatgcatttt

SEQ ID NO: 592963 - DNA, 13 bp, D. melanogaster
atttaatgccatt

SEQ ID NO: 592964 - DNA, 14 bp, D. melanogaster
atttaatgccattt

SEQ ID NO: 592965 - DNA, 13 bp, D. melanogaster
atttaatgcgttt

SEQ ID NO: 592966 - DNA, 13 bp, D. melanogaster
atttaatgctttc

SEQ ID NO: 592967 - DNA, 13 bp, D. melanogaster
atttaatgctttt

SEQ ID NO: 592968 - DNA, 13 bp, D. melanogaster
atttaatggcaaa

SEQ ID NO: 592969 - DNA, 13 bp, D. melanogaster
atttaatggctgc

SEQ ID NO: 592970 - DNA, 13 bp, D. melanogaster
atttaatggtaaa

SEQ ID NO: 592971 - DNA, 13 bp, D. melanogaster
atttaatggtaat

SEQ ID NO: 592972 - DNA, 13 bp, D. melanogaster
atttaatgtcaaa

SEQ ID NO: 592973 - DNA, 13 bp, D. melanogaster
atttaatgtcagg

SEQ ID NO: 592974 - DNA, 14 bp, D. melanogaster
atttaatgtggctt

SEQ ID NO: 592975 - DNA, 14 bp, D. melanogaster
atttaatgttaaac

SEQ ID NO: 592976 - DNA, 13 bp, D. melanogaster
atttaatgtttgc

SEQ ID NO: 592977 - DNA, 13 bp, D. melanogaster
atttaattaagca

SEQ ID NO: 592978 - DNA, 13 bp, D. melanogaster
atttaattaagcc

SEQ ID NO: 592979 - DNA, 13 bp, D. melanogaster
atttaattaatgc

SEQ ID NO: 592980 - DNA, 13 bp, D. melanogaster
atttaattacact

SEQ ID NO: 592981 - DNA, 13 bp, D. melanogaster
atttaattaccaa

SEQ ID NO: 592982 - DNA, 13 bp, D. melanogaster
atttaattaccat

SEQ ID NO: 592983 - DNA, 13 bp, D. melanogaster
atttaattatgct

SEQ ID NO: 592984 - DNA, 13 bp, D. melanogaster
atttaattcaact

SEQ ID NO: 592985 - DNA, 13 bp, D. melanogaster
atttaattcactt

SEQ ID NO: 592986 - DNA, 13 bp, D. melanogaster
atttaattccatt

SEQ ID NO: 592987 - DNA, 13 bp, D. melanogaster
atttaattcgatt

SEQ ID NO: 592988 - DNA, 13 bp, D. melanogaster
atttaattgaagc

SEQ ID NO: 592989 - DNA, 13 bp, D. melanogaster
atttaattgactg

SEQ ID NO: 592990 - DNA, 13 bp, D. melanogaster
atttaattgagaa

SEQ ID NO: 592991 - DNA, 13 bp, D. melanogaster
atttaattgcaaa

SEQ ID NO: 592992 - DNA, 14 bp, D. melanogaster
atttaattgcaaaa

SEQ ID NO: 592993 - DNA, 14 bp, D. melanogaster
atttaattgcaaat

SEQ ID NO: 592994 - DNA, 13 bp, D. melanogaster
atttaattgcaag

SEQ ID NO: 592995 - DNA, 14 bp, D. melanogaster
atttaattgcaatt

SEQ ID NO: 592996 - DNA, 13 bp, D. melanogaster
atttaattgcata

SEQ ID NO: 592997 - DNA, 14 bp, D. melanogaster
atttaattgcattt

SEQ ID NO: 592998 - DNA, 13 bp, D. melanogaster
atttaattgccat

SEQ ID NO: 592999 - DNA, 13 bp, D. melanogaster
atttaattgcgaa

SEQ ID NO: 593000 - DNA, 13 bp, D. melanogaster
atttaattgcggt

SEQ ID NO: 593001 - DNA, 13 bp, D. melanogaster
atttaattgctta

SEQ ID NO: 593002 - DNA, 13 bp, D. melanogaster
atttaattgcttt

SEQ ID NO: 593003 - DNA, 14 bp, D. melanogaster
atttaattgctttc

SEQ ID NO: 593004 - DNA, 14 bp, D. melanogaster
atttaattggaatt

SEQ ID NO: 593005 - DNA, 13 bp, D. melanogaster
atttaattgtcaa

SEQ ID NO: 593006 - DNA, 13 bp, D. melanogaster
atttaattgttgc

SEQ ID NO: 593007 - DNA, 13 bp, D. melanogaster
atttaatttacct

SEQ ID NO: 593008 - DNA, 13 bp, D. melanogaster
atttaatttatgc

SEQ ID NO: 593009 - DNA, 14 bp, D. melanogaster
atttaatttatgct

SEQ ID NO: 593010 - DNA, 14 bp, D. melanogaster
atttaatttatggc

SEQ ID NO: 593011 - DNA, 13 bp, D. melanogaster
atttaatttcaag

SEQ ID NO: 593012 - DNA, 14 bp, D. melanogaster
atttaatttcagtt

SEQ ID NO: 593013 - DNA, 13 bp, D. melanogaster
atttaatttccaa

SEQ ID NO: 593014 - DNA, 14 bp, D. melanogaster
atttaatttccaat

SEQ ID NO: 593015 - DNA, 13 bp, D. melanogaster
atttaatttccct

SEQ ID NO: 593016 - DNA, 13 bp, D. melanogaster
atttaatttcctc

SEQ ID NO: 593017 - DNA, 13 bp, D. melanogaster
atttaatttcgaa

SEQ ID NO: 593018 - DNA, 13 bp, D. melanogaster
atttaatttcgag

SEQ ID NO: 593019 - DNA, 13 bp, D. melanogaster
atttaatttcgat

SEQ ID NO: 593020 - DNA, 14 bp, D. melanogaster
atttaatttcgatt

SEQ ID NO: 593021 - DNA, 14 bp, D. melanogaster
atttaatttcgttt

SEQ ID NO: 593022 - DNA, 13 bp, D. melanogaster
atttaatttctga

SEQ ID NO: 593023 - DNA, 13 bp, D. melanogaster
atttaatttgatg

SEQ ID NO: 593024 - DNA, 13 bp, D. melanogaster
atttaatttgcag

SEQ ID NO: 593025 - DNA, 14 bp, D. melanogaster
atttaatttgcatt

SEQ ID NO: 593026 - DNA, 13 bp, D. melanogaster
atttaatttgcca

SEQ ID NO: 593027 - DNA, 14 bp, D. melanogaster
atttaatttgccaa

SEQ ID NO: 593028 - DNA, 14 bp, D. melanogaster
atttaatttgcttt

SEQ ID NO: 593029 - DNA, 13 bp, D. melanogaster
atttaatttggat

SEQ ID NO: 593030 - DNA, 14 bp, D. melanogaster
atttaattttaagc

SEQ ID NO: 593031 - DNA, 14 bp, D. melanogaster
atttaattttaggg

SEQ ID NO: 593032 - DNA, 14 bp, D. melanogaster
atttaattttccaa

SEQ ID NO: 593033 - DNA, 13 bp, D. melanogaster
atttaattttgca

SEQ ID NO: 593034 - DNA, 14 bp, D. melanogaster
atttaattttgcat

SEQ ID NO: 593035 - DNA, 13 bp, D. melanogaster
atttaatttttgc

SEQ ID NO: 593036 - DNA, 14 bp, D. melanogaster
atttacaaaatgta

SEQ ID NO: 593037 - DNA, 13 bp, D. melanogaster
atttacaaacata

SEQ ID NO: 593038 - DNA, 13 bp, D. melanogaster
atttacaaacatt

SEQ ID NO: 593039 - DNA, 13 bp, D. melanogaster
atttacaaaggat

SEQ ID NO: 593040 - DNA, 13 bp, D. melanogaster
atttacaaattga

SEQ ID NO: 593041 - DNA, 13 bp, D. melanogaster
atttacaaattgt

SEQ ID NO: 593042 - DNA, 14 bp, D. melanogaster
atttacaacaattt

SEQ ID NO: 593043 - DNA, 13 bp, D. melanogaster
atttacaacatgg

SEQ ID NO: 593044 - DNA, 13 bp, D. melanogaster
atttacaacatta

SEQ ID NO: 593045 - DNA, 13 bp, D. melanogaster
atttacaacattt

SEQ ID NO: 593046 - DNA, 14 bp, D. melanogaster
atttacaacatttt

SEQ ID NO: 593047 - DNA, 13 bp, D. melanogaster
atttacaactttt

SEQ ID NO: 593048 - DNA, 13 bp, D. melanogaster
atttacaagaaaa

SEQ ID NO: 593049 - DNA, 13 bp, D. melanogaster
atttacaagaaat

SEQ ID NO: 593050 - DNA, 13 bp, D. melanogaster
atttacaagtcca

SEQ ID NO: 593051 - DNA, 13 bp, D. melanogaster
atttacaagtgca

SEQ ID NO: 593052 - DNA, 13 bp, D. melanogaster
atttacaagttaa

SEQ ID NO: 593053 - DNA, 13 bp, D. melanogaster
atttacaagtttt

SEQ ID NO: 593054 - DNA, 13 bp, D. melanogaster
atttacaatactt

SEQ ID NO: 593055 - DNA, 13 bp, D. melanogaster
atttacaattcat

SEQ ID NO: 593056 - DNA, 14 bp, D. melanogaster
atttacaatttaca

SEQ ID NO: 593057 - DNA, 13 bp, D. melanogaster
atttacaatttgg

SEQ ID NO: 593058 - DNA, 13 bp, D. melanogaster
atttacacaactt

SEQ ID NO: 593059 - DNA, 13 bp, D. melanogaster
atttacacagcaa

SEQ ID NO: 593060 - DNA, 13 bp, D. melanogaster
atttacacgcatt

SEQ ID NO: 593061 - DNA, 13 bp, D. melanogaster
atttacactagct

SEQ ID NO: 593062 - DNA, 13 bp, D. melanogaster
atttacagaaaaa

SEQ ID NO: 593063 - DNA, 13 bp, D. melanogaster
atttacagagaaa

SEQ ID NO: 593064 - DNA, 13 bp, D. melanogaster
atttacagatttt

SEQ ID NO: 593065 - DNA, 13 bp, D. melanogaster
atttacagcaatt

SEQ ID NO: 593066 - DNA, 13 bp, D. melanogaster
atttacagctggc

SEQ ID NO: 593067 - DNA, 13 bp, D. melanogaster
atttacagttgca

SEQ ID NO: 593068 - DNA, 13 bp, D. melanogaster
atttacagtttta

SEQ ID NO: 593069 - DNA, 13 bp, D. melanogaster
atttacataactg

SEQ ID NO: 593070 - DNA, 22 bp, D. melanogaster
atttacataagatatgaacgga

SEQ ID NO: 593071 - DNA, 13 bp, D. melanogaster
atttacataatca

SEQ ID NO: 593072 - DNA, 13 bp, D. melanogaster
atttacatacaca

SEQ ID NO: 593073 - DNA, 13 bp, D. melanogaster
atttacatacatg

SEQ ID NO: 593074 - DNA, 13 bp, D. melanogaster
atttacatacatt

SEQ ID NO: 593075 - DNA, 14 bp, D. melanogaster
atttacatacattt

SEQ ID NO: 593076 - DNA, 13 bp, D. melanogaster
atttacatacttt

SEQ ID NO: 593077 - DNA, 13 bp, D. melanogaster
atttacatataca

SEQ ID NO: 593078 - DNA, 14 bp, D. melanogaster
atttacatatacat

SEQ ID NO: 593079 - DNA, 13 bp, D. melanogaster
atttacatatgaa

SEQ ID NO: 593080 - DNA, 13 bp, D. melanogaster
atttacatatgca

SEQ ID NO: 593081 - DNA, 13 bp, D. melanogaster
atttacatatgcg

SEQ ID NO: 593082 - DNA, 13 bp, D. melanogaster
atttacatatgta

SEQ ID NO: 593083 - DNA, 13 bp, D. melanogaster
atttacatattac

SEQ ID NO: 593084 - DNA, 13 bp, D. melanogaster
atttacatatttc

SEQ ID NO: 593085 - DNA, 13 bp, D. melanogaster
atttacatgaaat

SEQ ID NO: 593086 - DNA, 13 bp, D. melanogaster
atttacatgtttt

SEQ ID NO: 593087 - DNA, 14 bp, D. melanogaster
atttacattacatt

SEQ ID NO: 593088 - DNA, 13 bp, D. melanogaster
atttacattcatt

SEQ ID NO: 593089 - DNA, 13 bp, D. melanogaster
atttacattgaaa

SEQ ID NO: 593090 - DNA, 13 bp, D. melanogaster
atttacattggca

SEQ ID NO: 593091 - DNA, 13 bp, D. melanogaster
atttacatttaca

SEQ ID NO: 593092 - DNA, 14 bp, D. melanogaster
atttacatttacat

SEQ ID NO: 593093 - DNA, 13 bp, D. melanogaster
atttacatttgaa

SEQ ID NO: 593094 - DNA, 14 bp, D. melanogaster
atttacatttgaat

SEQ ID NO: 593095 - DNA, 13 bp, D. melanogaster
atttacatttgtg

SEQ ID NO: 593096 - DNA, 13 bp, D. melanogaster
atttacatttgtt

SEQ ID NO: 593097 - DNA, 14 bp, D. melanogaster
atttacattttaca

SEQ ID NO: 593098 - DNA, 14 bp, D. melanogaster
atttacattttgtt

SEQ ID NO: 593099 - DNA, 13 bp, D. melanogaster
atttacatttttg

SEQ ID NO: 593100 - DNA, 13 bp, D. melanogaster
atttaccaaaaac

SEQ ID NO: 593101 - DNA, 13 bp, D. melanogaster
atttaccaaaaca

SEQ ID NO: 593102 - DNA, 13 bp, D. melanogaster
atttaccaaaatg

SEQ ID NO: 593103 - DNA, 13 bp, D. melanogaster
atttaccaaataa

SEQ ID NO: 593104 - DNA, 13 bp, D. melanogaster
atttaccaaatat

SEQ ID NO: 593105 - DNA, 13 bp, D. melanogaster
atttaccaactgc

SEQ ID NO: 593106 - DNA, 13 bp, D. melanogaster
atttaccataaat

SEQ ID NO: 593107 - DNA, 13 bp, D. melanogaster
atttaccatataa

SEQ ID NO: 593108 - DNA, 13 bp, D. melanogaster
atttacccaaaaa

SEQ ID NO: 593109 - DNA, 13 bp, D. melanogaster
atttaccttaaat

SEQ ID NO: 593110 - DNA, 13 bp, D. melanogaster
atttaccttttaa

SEQ ID NO: 593111 - DNA, 13 bp, D. melanogaster
atttacgaaaaaa

SEQ ID NO: 593112 - DNA, 13 bp, D. melanogaster
atttacgaataaa

SEQ ID NO: 593113 - DNA, 14 bp, D. melanogaster
atttacgaattaat

SEQ ID NO: 593114 - DNA, 13 bp, D. melanogaster
atttacgattatt

SEQ ID NO: 593115 - DNA, 13 bp, D. melanogaster
atttacgccagaa

SEQ ID NO: 593116 - DNA, 14 bp, D. melanogaster
atttacgctgaact

SEQ ID NO: 593117 - DNA, 13 bp, D. melanogaster
atttacgtttaaa

SEQ ID NO: 593118 - DNA, 13 bp, D. melanogaster
atttactaattac

SEQ ID NO: 593119 - DNA, 14 bp, D. melanogaster
atttactaattaca

SEQ ID NO: 593120 - DNA, 13 bp, D. melanogaster
atttactagctta

SEQ ID NO: 593121 - DNA, 13 bp, D. melanogaster
atttactcaaaac

SEQ ID NO: 593122 - DNA, 13 bp, D. melanogaster
atttactcaaaat

SEQ ID NO: 593123 - DNA, 13 bp, D. melanogaster
atttactcaattt

SEQ ID NO: 593124 - DNA, 13 bp, D. melanogaster
atttactctctga

SEQ ID NO: 593125 - DNA, 15 bp, D. melanogaster
atttactctctgatt

SEQ ID NO: 593126 - DNA, 13 bp, D. melanogaster
atttactgaaata

SEQ ID NO: 593127 - DNA, 13 bp, D. melanogaster
atttactgattta

SEQ ID NO: 593128 - DNA, 13 bp, D. melanogaster
atttactgcactt

SEQ ID NO: 593129 - DNA, 13 bp, D. melanogaster
atttactgcagag

SEQ ID NO: 593130 - DNA, 13 bp, D. melanogaster
atttacttaaaac

SEQ ID NO: 593131 - DNA, 13 bp, D. melanogaster
atttacttaaatg

SEQ ID NO: 593132 - DNA, 13 bp, D. melanogaster
atttacttaacat

SEQ ID NO: 593133 - DNA, 13 bp, D. melanogaster
atttacttaagaa

SEQ ID NO: 593134 - DNA, 14 bp, D. melanogaster
atttacttaggcct

SEQ ID NO: 593135 - DNA, 13 bp, D. melanogaster
atttacttcaaaa

SEQ ID NO: 593136 - DNA, 13 bp, D. melanogaster
atttacttcaaat

SEQ ID NO: 593137 - DNA, 13 bp, D. melanogaster
atttacttcgctc

SEQ ID NO: 593138 - DNA, 13 bp, D. melanogaster
atttacttgaatt

SEQ ID NO: 593139 - DNA, 13 bp, D. melanogaster
atttacttggctt

SEQ ID NO: 593140 - DNA, 13 bp, D. melanogaster
atttactttcaac

SEQ ID NO: 593141 - DNA, 13 bp, D. melanogaster
atttactttcaat

SEQ ID NO: 593142 - DNA, 13 bp, D. melanogaster
atttactttgaaa

SEQ ID NO: 593143 - DNA, 13 bp, D. melanogaster
atttactttgcat

SEQ ID NO: 593144 - DNA, 13 bp, D. melanogaster
atttactttgcca

SEQ ID NO: 593145 - DNA, 13 bp, D. melanogaster
atttactttggcc

SEQ ID NO: 593146 - DNA, 13 bp, D. melanogaster
atttactttggct

SEQ ID NO: 593147 - DNA, 13 bp, D. melanogaster
atttacttttcaa

SEQ ID NO: 593148 - DNA, 13 bp, D. melanogaster
atttacttttgaa

SEQ ID NO: 593149 - DNA, 14 bp, D. melanogaster
atttagaagagtat

SEQ ID NO: 593150 - DNA, 13 bp, D. melanogaster
atttagaagatca

SEQ ID NO: 593151 - DNA, 13 bp, D. melanogaster
atttagaagtcga

SEQ ID NO: 593152 - DNA, 14 bp, D. melanogaster
atttagaagtcgaa

SEQ ID NO: 593153 - DNA, 13 bp, D. melanogaster
atttagaatccaa

SEQ ID NO: 593154 - DNA, 13 bp, D. melanogaster
atttagaatgttt

SEQ ID NO: 593155 - DNA, 13 bp, D. melanogaster
atttagacaaaat

SEQ ID NO: 593156 - DNA, 14 bp, D. melanogaster
atttagacaaaatc

SEQ ID NO: 593157 - DNA, 13 bp, D. melanogaster
atttagactatta

SEQ ID NO: 593158 - DNA, 13 bp, D. melanogaster
atttagatacata

SEQ ID NO: 593159 - DNA, 13 bp, D. melanogaster
atttagatcaaat

SEQ ID NO: 593160 - DNA, 13 bp, D. melanogaster
atttagatcaatt

SEQ ID NO: 593161 - DNA, 13 bp, D. melanogaster
atttagattcaga

SEQ ID NO: 593162 - DNA, 13 bp, D. melanogaster
atttagcaaatat

SEQ ID NO: 593163 - DNA, 13 bp, D. melanogaster
atttagcatacag

SEQ ID NO: 593164 - DNA, 13 bp, D. melanogaster
atttagcattaaa

SEQ ID NO: 593165 - DNA, 13 bp, D. melanogaster
atttagcattcaa

SEQ ID NO: 593166 - DNA, 13 bp, D. melanogaster
atttagcatttta

SEQ ID NO: 593167 - DNA, 13 bp, D. melanogaster
atttagcattttg

SEQ ID NO: 593168 - DNA, 13 bp, D. melanogaster
atttagccaaata

SEQ ID NO: 593169 - DNA, 13 bp, D. melanogaster
atttagccagctt

SEQ ID NO: 593170 - DNA, 13 bp, D. melanogaster
atttagccataaa

SEQ ID NO: 593171 - DNA, 13 bp, D. melanogaster
atttagcccattt

SEQ ID NO: 593172 - DNA, 13 bp, D. melanogaster
atttagctaattt

SEQ ID NO: 593173 - DNA, 13 bp, D. melanogaster
atttagctattta

SEQ ID NO: 593174 - DNA, 13 bp, D. melanogaster
atttagctggcaa

SEQ ID NO: 593175 - DNA, 13 bp, D. melanogaster
atttagcttgaaa

SEQ ID NO: 593176 - DNA, 13 bp, D. melanogaster
atttagctttaaa

SEQ ID NO: 593177 - DNA, 13 bp, D. melanogaster
atttagcttttat

SEQ ID NO: 593178 - DNA, 13 bp, D. melanogaster
atttaggaaaatt

SEQ ID NO: 593179 - DNA, 13 bp, D. melanogaster
atttaggtattta

SEQ ID NO: 593180 - DNA, 14 bp, D. melanogaster
atttaggtatttag

SEQ ID NO: 593181 - DNA, 13 bp, D. melanogaster
atttaggtcacaa

SEQ ID NO: 593182 - DNA, 13 bp, D. melanogaster
atttaggttaagt

SEQ ID NO: 593183 - DNA, 14 bp, D. melanogaster
atttagtagataaa

SEQ ID NO: 593184 - DNA, 13 bp, D. melanogaster
atttagtataccc

SEQ ID NO: 593185 - DNA, 13 bp, D. melanogaster
atttagtcactat

SEQ ID NO: 593186 - DNA, 13 bp, D. melanogaster
atttagtgtagtc

SEQ ID NO: 593187 - DNA, 13 bp, D. melanogaster
atttagttaagca

SEQ ID NO: 593188 - DNA, 13 bp, D. melanogaster
atttagttacatt

SEQ ID NO: 593189 - DNA, 13 bp, D. melanogaster
atttagttagtta

SEQ ID NO: 593190 - DNA, 13 bp, D. melanogaster
atttagttgaatt

SEQ ID NO: 593191 - DNA, 13 bp, D. melanogaster
atttagttgcatt

SEQ ID NO: 593192 - DNA, 13 bp, D. melanogaster
atttagttggcaa

SEQ ID NO: 593193 - DNA, 13 bp, D. melanogaster
atttagtttagta

SEQ ID NO: 593194 - DNA, 13 bp, D. melanogaster
atttagtttcgtt

SEQ ID NO: 593195 - DNA, 13 bp, D. melanogaster
atttagtttgcat

SEQ ID NO: 593196 - DNA, 13 bp, D. melanogaster
atttagtttgctt

SEQ ID NO: 593197 - DNA, 13 bp, D. melanogaster
atttagttttgct

SEQ ID NO: 593198 - DNA, 13 bp, D. melanogaster
atttataaaactg

SEQ ID NO: 593199 - DNA, 13 bp, D. melanogaster
atttataaacaca

SEQ ID NO: 593200 - DNA, 13 bp, D. melanogaster
atttataaagcaa

SEQ ID NO: 593201 - DNA, 13 bp, D. melanogaster
atttataaagttc

SEQ ID NO: 593202 - DNA, 13 bp, D. melanogaster
atttataaatgca

SEQ ID NO: 593203 - DNA, 13 bp, D. melanogaster
atttataaatgcc

SEQ ID NO: 593204 - DNA, 13 bp, D. melanogaster
atttataaattgc

SEQ ID NO: 593205 - DNA, 13 bp, D. melanogaster
atttataaattgg

SEQ ID NO: 593206 - DNA, 13 bp, D. melanogaster
atttataaccatt

SEQ ID NO: 593207 - DNA, 13 bp, D. melanogaster
atttataacgaaa

SEQ ID NO: 593208 - DNA, 13 bp, D. melanogaster
atttataacttca

SEQ ID NO: 593209 - DNA, 13 bp, D. melanogaster
atttataactttg

SEQ ID NO: 593210 - DNA, 13 bp, D. melanogaster
atttataatgcga

SEQ ID NO: 593211 - DNA, 13 bp, D. melanogaster
atttataattgca

SEQ ID NO: 593212 - DNA, 13 bp, D. melanogaster
atttataattgct

SEQ ID NO: 593213 - DNA, 13 bp, D. melanogaster
atttatacaaaca

SEQ ID NO: 593214 - DNA, 13 bp, D. melanogaster
atttatacacaca

SEQ ID NO: 593215 - DNA, 14 bp, D. melanogaster
atttatacacatat

SEQ ID NO: 593216 - DNA, 13 bp, D. melanogaster
atttatacacatt

SEQ ID NO: 593217 - DNA, 13 bp, D. melanogaster
atttatacagtgc

SEQ ID NO: 593218 - DNA, 14 bp, D. melanogaster
atttatacatacat

SEQ ID NO: 593219 - DNA, 13 bp, D. melanogaster
atttataccaaaa

SEQ ID NO: 593220 - DNA, 13 bp, D. melanogaster
atttatacgaaaa

SEQ ID NO: 593221 - DNA, 13 bp, D. melanogaster
atttatactgtgt

SEQ ID NO: 593222 - DNA, 13 bp, D. melanogaster
atttatagaaaca

SEQ ID NO: 593223 - DNA, 13 bp, D. melanogaster
atttatagaactt

SEQ ID NO: 593224 - DNA, 13 bp, D. melanogaster
atttatagacatt

SEQ ID NO: 593225 - DNA, 13 bp, D. melanogaster
atttatagcaatt

SEQ ID NO: 593226 - DNA, 13 bp, D. melanogaster
atttatagccaaa

SEQ ID NO: 593227 - DNA, 13 bp, D. melanogaster
atttatataaagc

SEQ ID NO: 593228 - DNA, 13 bp, D. melanogaster
atttatataccaa

SEQ ID NO: 593229 - DNA, 13 bp, D. melanogaster
atttatatagaca

SEQ ID NO: 593230 - DNA, 13 bp, D. melanogaster
atttatatagatg

SEQ ID NO: 593231 - DNA, 14 bp, D. melanogaster
atttatatatacac

SEQ ID NO: 593232 - DNA, 13 bp, D. melanogaster
atttatatatgcc

SEQ ID NO: 593233 - DNA, 13 bp, D. melanogaster
atttatatcgatt

SEQ ID NO: 593234 - DNA, 13 bp, D. melanogaster
atttatatgaaac

SEQ ID NO: 593235 - DNA, 13 bp, D. melanogaster
atttatatgaaag

SEQ ID NO: 593236 - DNA, 13 bp, D. melanogaster
atttatatgagac

SEQ ID NO: 593237 - DNA, 13 bp, D. melanogaster
atttatatgcaaa

SEQ ID NO: 593238 - DNA, 14 bp, D. melanogaster
atttatatgcatat

SEQ ID NO: 593239 - DNA, 13 bp, D. melanogaster
atttatatgccat

SEQ ID NO: 593240 - DNA, 13 bp, D. melanogaster
atttatatgcgaa

SEQ ID NO: 593241 - DNA, 13 bp, D. melanogaster
atttatatgctaa

SEQ ID NO: 593242 - DNA, 13 bp, D. melanogaster
atttatatggaaa

SEQ ID NO: 593243 - DNA, 13 bp, D. melanogaster
atttatatgtaca

SEQ ID NO: 593244 - DNA, 13 bp, D. melanogaster
atttatattgatg

SEQ ID NO: 593245 - DNA, 13 bp, D. melanogaster
atttatatttacg

SEQ ID NO: 593246 - DNA, 13 bp, D. melanogaster
atttatatttcca

SEQ ID NO: 593247 - DNA, 13 bp, D. melanogaster
atttatatttgca

SEQ ID NO: 593248 - DNA, 13 bp, D. melanogaster
atttatcaaaagt

SEQ ID NO: 593249 - DNA, 13 bp, D. melanogaster
atttatcaaacaa

SEQ ID NO: 593250 - DNA, 13 bp, D. melanogaster
atttatcaatcaa

SEQ ID NO: 593251 - DNA, 13 bp, D. melanogaster
atttatcaatttc

SEQ ID NO: 593252 - DNA, 13 bp, D. melanogaster
atttatcacaaaa

SEQ ID NO: 593253 - DNA, 13 bp, D. melanogaster
atttatcagccaa

SEQ ID NO: 593254 - DNA, 13 bp, D. melanogaster
atttatcatcaaa

SEQ ID NO: 593255 - DNA, 13 bp, D. melanogaster
atttatcatttga

SEQ ID NO: 593256 - DNA, 14 bp, D. melanogaster
atttatcatttgaa

SEQ ID NO: 593257 - DNA, 13 bp, D. melanogaster
atttatcatttgc

SEQ ID NO: 593258 - DNA, 13 bp, D. melanogaster
atttatccaaagt

SEQ ID NO: 593259 - DNA, 13 bp, D. melanogaster
atttatcccgcca

SEQ ID NO: 593260 - DNA, 13 bp, D. melanogaster
atttatcgatttt

SEQ ID NO: 593261 - DNA, 13 bp, D. melanogaster
atttatcgtattt

SEQ ID NO: 593262 - DNA, 13 bp, D. melanogaster
atttatcgtttat

SEQ ID NO: 593263 - DNA, 13 bp, D. melanogaster
atttatctgaaat

SEQ ID NO: 593264 - DNA, 13 bp, D. melanogaster
atttatctgcaat

SEQ ID NO: 593265 - DNA, 13 bp, D. melanogaster
atttatcttgaaa

SEQ ID NO: 593266 - DNA, 13 bp, D. melanogaster
atttatgaaaaac

SEQ ID NO: 593267 - DNA, 13 bp, D. melanogaster
atttatgaaaact

SEQ ID NO: 593268 - DNA, 13 bp, D. melanogaster
atttatgaaaagt

SEQ ID NO: 593269 - DNA, 13 bp, D. melanogaster
atttatgaaacaa

SEQ ID NO: 593270 - DNA, 13 bp, D. melanogaster
atttatgaaagag

SEQ ID NO: 593271 - DNA, 13 bp, D. melanogaster
atttatgaaatgt

SEQ ID NO: 593272 - DNA, 13 bp, D. melanogaster
atttatgaaattg

SEQ ID NO: 593273 - DNA, 13 bp, D. melanogaster
atttatgaacttt

SEQ ID NO: 593274 - DNA, 13 bp, D. melanogaster
atttatgaagaac

SEQ ID NO: 593275 - DNA, 14 bp, D. melanogaster
atttatgaagaaca

SEQ ID NO: 593276 - DNA, 13 bp, D. melanogaster
atttatgaagttt

SEQ ID NO: 593277 - DNA, 13 bp, D. melanogaster
atttatgaatgca

SEQ ID NO: 593278 - DNA, 13 bp, D. melanogaster
atttatgacaaaa

SEQ ID NO: 593279 - DNA, 14 bp, D. melanogaster
atttatgacaattt

SEQ ID NO: 593280 - DNA, 13 bp, D. melanogaster
atttatgactaaa

SEQ ID NO: 593281 - DNA, 13 bp, D. melanogaster
atttatgacttgc

SEQ ID NO: 593282 - DNA, 13 bp, D. melanogaster
atttatgagaaat

SEQ ID NO: 593283 - DNA, 13 bp, D. melanogaster
atttatgagcaaa

SEQ ID NO: 593284 - DNA, 13 bp, D. melanogaster
atttatgagcaac

SEQ ID NO: 593285 - DNA, 13 bp, D. melanogaster
atttatgagcagc

SEQ ID NO: 593286 - DNA, 13 bp, D. melanogaster
atttatgagccgc

SEQ ID NO: 593287 - DNA, 13 bp, D. melanogaster
atttatgagctta

SEQ ID NO: 593288 - DNA, 13 bp, D. melanogaster
atttatgatgtgc

SEQ ID NO: 593289 - DNA, 13 bp, D. melanogaster
atttatgattatg

SEQ ID NO: 593290 - DNA, 13 bp, D. melanogaster
atttatgattcat

SEQ ID NO: 593291 - DNA, 13 bp, D. melanogaster
atttatgatttca

SEQ ID NO: 593292 - DNA, 13 bp, D. melanogaster
atttatgcaaatg

SEQ ID NO: 593293 - DNA, 13 bp, D. melanogaster
atttatgcaaatt

SEQ ID NO: 593294 - DNA, 14 bp, D. melanogaster
atttatgcaaattg

SEQ ID NO: 593295 - DNA, 14 bp, D. melanogaster
atttatgcaaattt

SEQ ID NO: 593296 - DNA, 13 bp, D. melanogaster
atttatgcaacta

SEQ ID NO: 593297 - DNA, 13 bp, D. melanogaster
atttatgcaactt

SEQ ID NO: 593298 - DNA, 13 bp, D. melanogaster
atttatgcaatat

SEQ ID NO: 593299 - DNA, 13 bp, D. melanogaster
atttatgcacaaa

SEQ ID NO: 593300 - DNA, 13 bp, D. melanogaster
atttatgcacatg

SEQ ID NO: 593301 - DNA, 13 bp, D. melanogaster
atttatgcactgc

SEQ ID NO: 593302 - DNA, 13 bp, D. melanogaster
atttatgcagaaa

SEQ ID NO: 593303 - DNA, 13 bp, D. melanogaster
atttatgcagata

SEQ ID NO: 593304 - DNA, 13 bp, D. melanogaster
atttatgcagcag

SEQ ID NO: 593305 - DNA, 13 bp, D. melanogaster
atttatgcagcat

SEQ ID NO: 593306 - DNA, 13 bp, D. melanogaster
atttatgcagcca

SEQ ID NO: 593307 - DNA, 13 bp, D. melanogaster
atttatgcagccc

SEQ ID NO: 593308 - DNA, 13 bp, D. melanogaster
atttatgcagctg

SEQ ID NO: 593309 - DNA, 13 bp, D. melanogaster
atttatgcagttg

SEQ ID NO: 593310 - DNA, 13 bp, D. melanogaster
atttatgcagttt

SEQ ID NO: 593311 - DNA, 13 bp, D. melanogaster
atttatgcataaa

SEQ ID NO: 593312 - DNA, 13 bp, D. melanogaster
atttatgcatgta

SEQ ID NO: 593313 - DNA, 13 bp, D. melanogaster
atttatgcatgtg

SEQ ID NO: 593314 - DNA, 13 bp, D. melanogaster
atttatgcatttg

SEQ ID NO: 593315 - DNA, 13 bp, D. melanogaster
atttatgcatttt

SEQ ID NO: 593316 - DNA, 14 bp, D. melanogaster
atttatgcattttt

SEQ ID NO: 593317 - DNA, 13 bp, D. melanogaster
atttatgccaaaa

SEQ ID NO: 593318 - DNA, 13 bp, D. melanogaster
atttatgccaatt

SEQ ID NO: 593319 - DNA, 13 bp, D. melanogaster
atttatgccacaa

SEQ ID NO: 593320 - DNA, 13 bp, D. melanogaster
atttatgccacat

SEQ ID NO: 593321 - DNA, 13 bp, D. melanogaster
atttatgccagca

SEQ ID NO: 593322 - DNA, 13 bp, D. melanogaster
atttatgcgaaaa

SEQ ID NO: 593323 - DNA, 13 bp, D. melanogaster
atttatgcgcctg

SEQ ID NO: 593324 - DNA, 13 bp, D. melanogaster
atttatgcggcaa

SEQ ID NO: 593325 - DNA, 13 bp, D. melanogaster
atttatgctaaaa

SEQ ID NO: 593326 - DNA, 14 bp, D. melanogaster
atttatgctaattt

SEQ ID NO: 593327 - DNA, 13 bp, D. melanogaster
atttatgctcaat

SEQ ID NO: 593328 - DNA, 14 bp, D. melanogaster
atttatggaaatat

SEQ ID NO: 593329 - DNA, 13 bp, D. melanogaster
atttatggaaatt

SEQ ID NO: 593330 - DNA, 14 bp, D. melanogaster
atttatggaaatta

SEQ ID NO: 593331 - DNA, 13 bp, D. melanogaster
atttatggcaact

SEQ ID NO: 593332 - DNA, 13 bp, D. melanogaster
atttatggcaatg

SEQ ID NO: 593333 - DNA, 13 bp, D. melanogaster
atttatggcactt

SEQ ID NO: 593334 - DNA, 13 bp, D. melanogaster
atttatggccaaa

SEQ ID NO: 593335 - DNA, 13 bp, D. melanogaster
atttatggcggga

SEQ ID NO: 593336 - DNA, 13 bp, D. melanogaster
atttatggctaat

SEQ ID NO: 593337 - DNA, 13 bp, D. melanogaster
atttatggctgat

SEQ ID NO: 593338 - DNA, 13 bp, D. melanogaster
atttatggcttaa

SEQ ID NO: 593339 - DNA, 13 bp, D. melanogaster
atttatgggcaaa

SEQ ID NO: 593340 - DNA, 13 bp, D. melanogaster
atttatggtaatt

SEQ ID NO: 593341 - DNA, 13 bp, D. melanogaster
atttatgtaaaca

SEQ ID NO: 593342 - DNA, 13 bp, D. melanogaster
atttatgtaaact

SEQ ID NO: 593343 - DNA, 13 bp, D. melanogaster
atttatgtaattg

SEQ ID NO: 593344 - DNA, 13 bp, D. melanogaster
atttatgtacaaa

SEQ ID NO: 593345 - DNA, 13 bp, D. melanogaster
atttatgtacata

SEQ ID NO: 593346 - DNA, 13 bp, D. melanogaster
atttatgtacatt

SEQ ID NO: 593347 - DNA, 13 bp, D. melanogaster
atttatgtcttta

SEQ ID NO: 593348 - DNA, 13 bp, D. melanogaster
atttatgtgcaat

SEQ ID NO: 593349 - DNA, 13 bp, D. melanogaster
atttatgtgcctg

SEQ ID NO: 593350 - DNA, 13 bp, D. melanogaster
atttatgtgcgca

SEQ ID NO: 593351 - DNA, 13 bp, D. melanogaster
atttatgtgctgc

SEQ ID NO: 593352 - DNA, 13 bp, D. melanogaster
atttatgtgcttt

SEQ ID NO: 593353 - DNA, 13 bp, D. melanogaster
atttatgtggaaa

SEQ ID NO: 593354 - DNA, 13 bp, D. melanogaster
atttatgtggcat

SEQ ID NO: 593355 - DNA, 13 bp, D. melanogaster
atttatgtgggtg

SEQ ID NO: 593356 - DNA, 13 bp, D. melanogaster
atttatgtgtatg

SEQ ID NO: 593357 - DNA, 13 bp, D. melanogaster
atttatgtgtggc

SEQ ID NO: 593358 - DNA, 13 bp, D. melanogaster
atttatgttaatg

SEQ ID NO: 593359 - DNA, 13 bp, D. melanogaster
atttatgttgcaa

SEQ ID NO: 593360 - DNA, 13 bp, D. melanogaster
atttatgttgcta

SEQ ID NO: 593361 - DNA, 14 bp, D. melanogaster
atttatgtttacgt

SEQ ID NO: 593362 - DNA, 13 bp, D. melanogaster
atttatgtttctg

SEQ ID NO: 593363 - DNA, 13 bp, D. melanogaster
atttattaaagct

SEQ ID NO: 593364 - DNA, 13 bp, D. melanogaster
atttattaagaac

SEQ ID NO: 593365 - DNA, 13 bp, D. melanogaster
atttattaagctt

SEQ ID NO: 593366 - DNA, 13 bp, D. melanogaster
atttattaatggt

SEQ ID NO: 593367 - DNA, 13 bp, D. melanogaster
atttattaccaat

SEQ ID NO: 593368 - DNA, 13 bp, D. melanogaster
atttattaccatt

SEQ ID NO: 593369 - DNA, 13 bp, D. melanogaster
atttattagctga

SEQ ID NO: 593370 - DNA, 14 bp, D. melanogaster
atttattagctgac

SEQ ID NO: 593371 - DNA, 14 bp, D. melanogaster
atttattatgcaaa

SEQ ID NO: 593372 - DNA, 13 bp, D. melanogaster
atttattatggaa

SEQ ID NO: 593373 - DNA, 13 bp, D. melanogaster
atttattatggcc

SEQ ID NO: 593374 - DNA, 13 bp, D. melanogaster
atttattattcag

SEQ ID NO: 593375 - DNA, 14 bp, D. melanogaster
atttattatttagc

SEQ ID NO: 593376 - DNA, 14 bp, D. melanogaster
atttattcaaaatg

SEQ ID NO: 593377 - DNA, 13 bp, D. melanogaster
atttattcaaatc

SEQ ID NO: 593378 - DNA, 13 bp, D. melanogaster
atttattcaagaa

SEQ ID NO: 593379 - DNA, 13 bp, D. melanogaster
atttattcaattg

SEQ ID NO: 593380 - DNA, 13 bp, D. melanogaster
atttattcagcat

SEQ ID NO: 593381 - DNA, 13 bp, D. melanogaster
atttattcagttt

SEQ ID NO: 593382 - DNA, 13 bp, D. melanogaster
atttattccaatt

SEQ ID NO: 593383 - DNA, 13 bp, D. melanogaster
atttattcgaaaa

SEQ ID NO: 593384 - DNA, 13 bp, D. melanogaster
atttattcgaatt

SEQ ID NO: 593385 - DNA, 13 bp, D. melanogaster
atttattcgcatt

SEQ ID NO: 593386 - DNA, 13 bp, D. melanogaster
atttattcgctgg

SEQ ID NO: 593387 - DNA, 14 bp, D. melanogaster
atttattcgctggg

SEQ ID NO: 593388 - DNA, 13 bp, D. melanogaster
atttattgaaaac

SEQ ID NO: 593389 - DNA, 13 bp, D. melanogaster
atttattgaaaag

SEQ ID NO: 593390 - DNA, 13 bp, D. melanogaster
atttattgaaagt

SEQ ID NO: 593391 - DNA, 14 bp, D. melanogaster
atttattgaaattc

SEQ ID NO: 593392 - DNA, 13 bp, D. melanogaster
atttattgaactc

SEQ ID NO: 593393 - DNA, 13 bp, D. melanogaster
atttattgaatgc

SEQ ID NO: 593394 - DNA, 13 bp, D. melanogaster
atttattgacaca

SEQ ID NO: 593395 - DNA, 13 bp, D. melanogaster
atttattgacatt

SEQ ID NO: 593396 - DNA, 13 bp, D. melanogaster
atttattgatgat

SEQ ID NO: 593397 - DNA, 13 bp, D. melanogaster
atttattgattga

SEQ ID NO: 593398 - DNA, 14 bp, D. melanogaster
atttattgattgaa

SEQ ID NO: 593399 - DNA, 13 bp, D. melanogaster
atttattgattgc

SEQ ID NO: 593400 - DNA, 13 bp, D. melanogaster
atttattgatttc

SEQ ID NO: 593401 - DNA, 13 bp, D. melanogaster
atttattgcaaaa

SEQ ID NO: 593402 - DNA, 13 bp, D. melanogaster
atttattgcaaat

SEQ ID NO: 593403 - DNA, 13 bp, D. melanogaster
atttattgcaatt

SEQ ID NO: 593404 - DNA, 13 bp, D. melanogaster
atttattgcactt

SEQ ID NO: 593405 - DNA, 13 bp, D. melanogaster
atttattgcataa

SEQ ID NO: 593406 - DNA, 14 bp, D. melanogaster
atttattgcatttg

SEQ ID NO: 593407 - DNA, 14 bp, D. melanogaster
atttattgcatttt

SEQ ID NO: 593408 - DNA, 13 bp, D. melanogaster
atttattgccaac

SEQ ID NO: 593409 - DNA, 14 bp, D. melanogaster
atttattgccaatt

SEQ ID NO: 593410 - DNA, 13 bp, D. melanogaster
atttattgccagc

SEQ ID NO: 593411 - DNA, 13 bp, D. melanogaster
atttattgccatt

SEQ ID NO: 593412 - DNA, 13 bp, D. melanogaster
atttattgccgcc

SEQ ID NO: 593413 - DNA, 13 bp, D. melanogaster
atttattgccttc

SEQ ID NO: 593414 - DNA, 13 bp, D. melanogaster
atttattgccttt

SEQ ID NO: 593415 - DNA, 14 bp, D. melanogaster
atttattgcctttt

SEQ ID NO: 593416 - DNA, 13 bp, D. melanogaster
atttattggcaaa

SEQ ID NO: 593417 - DNA, 13 bp, D. melanogaster
atttattggcaat

SEQ ID NO: 593418 - DNA, 14 bp, D. melanogaster
atttattggcattt

SEQ ID NO: 593419 - DNA, 13 bp, D. melanogaster
atttattggccaa

SEQ ID NO: 593420 - DNA, 13 bp, D. melanogaster
atttattggcctg

SEQ ID NO: 593421 - DNA, 13 bp, D. melanogaster
atttattgggaaa

SEQ ID NO: 593422 - DNA, 13 bp, D. melanogaster
atttattgggcaa

SEQ ID NO: 593423 - DNA, 13 bp, D. melanogaster
atttattggttaa

SEQ ID NO: 593424 - DNA, 13 bp, D. melanogaster
atttattgtagaa

SEQ ID NO: 593425 - DNA, 13 bp, D. melanogaster
atttattgtcatt

SEQ ID NO: 593426 - DNA, 13 bp, D. melanogaster
atttattgtgaaa

SEQ ID NO: 593427 - DNA, 13 bp, D. melanogaster
atttattgtgcaa

SEQ ID NO: 593428 - DNA, 13 bp, D. melanogaster
atttattgtgcca

SEQ ID NO: 593429 - DNA, 13 bp, D. melanogaster
atttatttaaagg

SEQ ID NO: 593430 - DNA, 14 bp, D. melanogaster
atttatttaaagtg

SEQ ID NO: 593431 - DNA, 13 bp, D. melanogaster
atttatttaacca

SEQ ID NO: 593432 - DNA, 13 bp, D. melanogaster
atttatttaactg

SEQ ID NO: 593433 - DNA, 13 bp, D. melanogaster
atttatttaagca

SEQ ID NO: 593434 - DNA, 13 bp, D. melanogaster
atttatttaagct

SEQ ID NO: 593435 - DNA, 14 bp, D. melanogaster
atttatttaattgc

SEQ ID NO: 593436 - DNA, 13 bp, D. melanogaster
atttatttacaac

SEQ ID NO: 593437 - DNA, 13 bp, D. melanogaster
atttatttaccac

SEQ ID NO: 593438 - DNA, 13 bp, D. melanogaster
atttatttaccca

SEQ ID NO: 593439 - DNA, 13 bp, D. melanogaster
atttatttactcg

SEQ ID NO: 593440 - DNA, 14 bp, D. melanogaster
atttatttactttg

SEQ ID NO: 593441 - DNA, 13 bp, D. melanogaster
atttatttagaag

SEQ ID NO: 593442 - DNA, 13 bp, D. melanogaster
atttatttagcca

SEQ ID NO: 593443 - DNA, 13 bp, D. melanogaster
atttatttagtca

SEQ ID NO: 593444 - DNA, 13 bp, D. melanogaster
atttatttatacc

SEQ ID NO: 593445 - DNA, 13 bp, D. melanogaster
atttatttatacg

SEQ ID NO: 593446 - DNA, 13 bp, D. melanogaster
atttatttatgac

SEQ ID NO: 593447 - DNA, 13 bp, D. melanogaster
atttatttatgca

SEQ ID NO: 593448 - DNA, 14 bp, D. melanogaster
atttatttatgcaa

SEQ ID NO: 593449 - DNA, 14 bp, D. melanogaster
atttatttatgcat

SEQ ID NO: 593450 - DNA, 14 bp, D. melanogaster
atttatttattcag

SEQ ID NO: 593451 - DNA, 13 bp, D. melanogaster
atttatttcacat

SEQ ID NO: 593452 - DNA, 13 bp, D. melanogaster
atttatttcactg

SEQ ID NO: 593453 - DNA, 13 bp, D. melanogaster
atttatttccact

SEQ ID NO: 593454 - DNA, 13 bp, D. melanogaster
atttatttccgtg

SEQ ID NO: 593455 - DNA, 13 bp, D. melanogaster
atttatttcgaaa

SEQ ID NO: 593456 - DNA, 13 bp, D. melanogaster
atttatttcgaat

SEQ ID NO: 593457 - DNA, 13 bp, D. melanogaster
atttatttcgcca

SEQ ID NO: 593458 - DNA, 13 bp, D. melanogaster
atttatttcgctt

SEQ ID NO: 593459 - DNA, 13 bp, D. melanogaster
atttatttcggca

SEQ ID NO: 593460 - DNA, 13 bp, D. melanogaster
atttatttcgtta

SEQ ID NO: 593461 - DNA, 13 bp, D. melanogaster
atttatttctcgt

SEQ ID NO: 593462 - DNA, 13 bp, D. melanogaster
atttatttgaaac

SEQ ID NO: 593463 - DNA, 13 bp, D. melanogaster
atttatttgaaag

SEQ ID NO: 593464 - DNA, 13 bp, D. melanogaster
atttatttgaaca

SEQ ID NO: 593465 - DNA, 14 bp, D. melanogaster
atttatttgaacat

SEQ ID NO: 593466 - DNA, 13 bp, D. melanogaster
atttatttgacac

SEQ ID NO: 593467 - DNA, 13 bp, D. melanogaster
atttatttgacta

SEQ ID NO: 593468 - DNA, 14 bp, D. melanogaster
atttatttgactac

SEQ ID NO: 593469 - DNA, 13 bp, D. melanogaster
atttatttgactg

SEQ ID NO: 593470 - DNA, 14 bp, D. melanogaster
atttatttgcaaat

SEQ ID NO: 593471 - DNA, 14 bp, D. melanogaster
atttatttgcaatt

SEQ ID NO: 593472 - DNA, 13 bp, D. melanogaster
atttatttgcata

SEQ ID NO: 593473 - DNA, 14 bp, D. melanogaster
atttatttgcatat

SEQ ID NO: 593474 - DNA, 13 bp, D. melanogaster
atttatttgcatc

SEQ ID NO: 593475 - DNA, 13 bp, D. melanogaster
atttatttgcatg

SEQ ID NO: 593476 - DNA, 13 bp, D. melanogaster
atttatttgcatt

SEQ ID NO: 593477 - DNA, 14 bp, D. melanogaster
atttatttgcattt

SEQ ID NO: 593478 - DNA, 14 bp, D. melanogaster
atttatttgccagc

SEQ ID NO: 593479 - DNA, 13 bp, D. melanogaster
atttatttgccca

SEQ ID NO: 593480 - DNA, 13 bp, D. melanogaster
atttatttgcgca

SEQ ID NO: 593481 - DNA, 13 bp, D. melanogaster
atttatttgctaa

SEQ ID NO: 593482 - DNA, 13 bp, D. melanogaster
atttatttgctct

SEQ ID NO: 593483 - DNA, 14 bp, D. melanogaster
atttatttgctttg

SEQ ID NO: 593484 - DNA, 13 bp, D. melanogaster
atttatttggaaa

SEQ ID NO: 593485 - DNA, 13 bp, D. melanogaster
atttatttggcaa

SEQ ID NO: 593486 - DNA, 13 bp, D. melanogaster
atttatttggcca

SEQ ID NO: 593487 - DNA, 14 bp, D. melanogaster
atttatttggccaa

SEQ ID NO: 593488 - DNA, 13 bp, D. melanogaster
atttatttggctt

SEQ ID NO: 593489 - DNA, 14 bp, D. melanogaster
atttatttggctta

SEQ ID NO: 593490 - DNA, 13 bp, D. melanogaster
atttatttgtaca

SEQ ID NO: 593491 - DNA, 13 bp, D. melanogaster
atttatttgtact

SEQ ID NO: 593492 - DNA, 14 bp, D. melanogaster
atttattttattgc

SEQ ID NO: 593493 - DNA, 13 bp, D. melanogaster
atttattttcaca

SEQ ID NO: 593494 - DNA, 15 bp, D. melanogaster
atttattttcacaga

SEQ ID NO: 593495 - DNA, 14 bp, D. melanogaster
atttattttccaaa

SEQ ID NO: 593496 - DNA, 13 bp, D. melanogaster
atttattttcgaa

SEQ ID NO: 593497 - DNA, 14 bp, D. melanogaster
atttattttcgaat

SEQ ID NO: 593498 - DNA, 13 bp, D. melanogaster
atttattttcgta

SEQ ID NO: 593499 - DNA, 14 bp, D. melanogaster
atttattttctgtg

SEQ ID NO: 593500 - DNA, 13 bp, D. melanogaster
atttattttgcaa

SEQ ID NO: 593501 - DNA, 15 bp, D. melanogaster
atttattttgcaact

SEQ ID NO: 593502 - DNA, 13 bp, D. melanogaster
atttattttgcga

SEQ ID NO: 593503 - DNA, 13 bp, D. melanogaster
atttattttgcta

SEQ ID NO: 593504 - DNA, 13 bp, D. melanogaster
atttattttggca

SEQ ID NO: 593505 - DNA, 13 bp, D. melanogaster
atttattttggcc

SEQ ID NO: 593506 - DNA, 14 bp, D. melanogaster
atttattttggcca

SEQ ID NO: 593507 - DNA, 13 bp, D. melanogaster
atttatttttcag

SEQ ID NO: 593508 - DNA, 13 bp, D. melanogaster
atttatttttcgc

SEQ ID NO: 593509 - DNA, 13 bp, D. melanogaster
atttatttttgca

SEQ ID NO: 593510 - DNA, 14 bp, D. melanogaster
atttatttttgcag

SEQ ID NO: 593511 - DNA, 13 bp, D. melanogaster
atttcaaaaacca

SEQ ID NO: 593512 - DNA, 13 bp, D. melanogaster
atttcaaaaagaa

SEQ ID NO: 593513 - DNA, 13 bp, D. melanogaster
atttcaaaaagtg

SEQ ID NO: 593514 - DNA, 13 bp, D. melanogaster
atttcaaaaagtt

SEQ ID NO: 593515 - DNA, 14 bp, D. melanogaster
atttcaaaaatatg

SEQ ID NO: 593516 - DNA, 13 bp, D. melanogaster
atttcaaaaatgc

SEQ ID NO: 593517 - DNA, 13 bp, D. melanogaster
atttcaaaaatgg

SEQ ID NO: 593518 - DNA, 13 bp, D. melanogaster
atttcaaaaatgt

SEQ ID NO: 593519 - DNA, 13 bp, D. melanogaster
atttcaaaaattc

SEQ ID NO: 593520 - DNA, 13 bp, D. melanogaster
atttcaaaaattg

SEQ ID NO: 593521 - DNA, 13 bp, D. melanogaster
atttcaaaacaat

SEQ ID NO: 593522 - DNA, 13 bp, D. melanogaster
atttcaaaacaca

SEQ ID NO: 593523 - DNA, 14 bp, D. melanogaster
atttcaaaacattt

SEQ ID NO: 593524 - DNA, 13 bp, D. melanogaster
atttcaaaaggaa

SEQ ID NO: 593525 - DNA, 13 bp, D. melanogaster
atttcaaaaggtt

SEQ ID NO: 593526 - DNA, 13 bp, D. melanogaster
atttcaaaagtat

SEQ ID NO: 593527 - DNA, 13 bp, D. melanogaster
atttcaaaagtgc

SEQ ID NO: 593528 - DNA, 13 bp, D. melanogaster
atttcaaaagttc

SEQ ID NO: 593529 - DNA, 14 bp, D. melanogaster
atttcaaaagtttt

SEQ ID NO: 593530 - DNA, 13 bp, D. melanogaster
atttcaaaatcta

SEQ ID NO: 593531 - DNA, 13 bp, D. melanogaster
atttcaaaatctt

SEQ ID NO: 593532 - DNA, 14 bp, D. melanogaster
atttcaaaatgaaa

SEQ ID NO: 593533 - DNA, 13 bp, D. melanogaster
atttcaaaatgta

SEQ ID NO: 593534 - DNA, 13 bp, D. melanogaster
atttcaaaattca

SEQ ID NO: 593535 - DNA, 14 bp, D. melanogaster
atttcaaaattcaa

SEQ ID NO: 593536 - DNA, 14 bp, D. melanogaster
atttcaaaattgtt

SEQ ID NO: 593537 - DNA, 13 bp, D. melanogaster
atttcaaacaaat

SEQ ID NO: 593538 - DNA, 14 bp, D. melanogaster
atttcaaacaaatt

SEQ ID NO: 593539 - DNA, 13 bp, D. melanogaster
atttcaaacaatt

SEQ ID NO: 593540 - DNA, 14 bp, D. melanogaster
atttcaaacaattc

SEQ ID NO: 593541 - DNA, 13 bp, D. melanogaster
atttcaaacatat

SEQ ID NO: 593542 - DNA, 13 bp, D. melanogaster
atttcaaacattt

SEQ ID NO: 593543 - DNA, 14 bp, D. melanogaster
atttcaaacatttc

SEQ ID NO: 593544 - DNA, 13 bp, D. melanogaster
atttcaaaccatt

SEQ ID NO: 593545 - DNA, 14 bp, D. melanogaster
atttcaaaccattt

SEQ ID NO: 593546 - DNA, 13 bp, D. melanogaster
atttcaaactcaa

SEQ ID NO: 593547 - DNA, 13 bp, D. melanogaster
atttcaaactgaa

SEQ ID NO: 593548 - DNA, 13 bp, D. melanogaster
atttcaaagaaaa

SEQ ID NO: 593549 - DNA, 15 bp, D. melanogaster
atttcaaagaaatca

SEQ ID NO: 593550 - DNA, 13 bp, D. melanogaster
atttcaaagataa

SEQ ID NO: 593551 - DNA, 13 bp, D. melanogaster
atttcaaagattt

SEQ ID NO: 593552 - DNA, 13 bp, D. melanogaster
atttcaaagcaat

SEQ ID NO: 593553 - DNA, 13 bp, D. melanogaster
atttcaaagtaaa

SEQ ID NO: 593554 - DNA, 13 bp, D. melanogaster
atttcaaagtatt

SEQ ID NO: 593555 - DNA, 13 bp, D. melanogaster
atttcaaagtttt

SEQ ID NO: 593556 - DNA, 13 bp, D. melanogaster
atttcaaatacat

SEQ ID NO: 593557 - DNA, 13 bp, D. melanogaster
atttcaaatactt

SEQ ID NO: 593558 - DNA, 13 bp, D. melanogaster
atttcaaatatca

SEQ ID NO: 593559 - DNA, 13 bp, D. melanogaster
atttcaaatattc

SEQ ID NO: 593560 - DNA, 13 bp, D. melanogaster
atttcaaatcaaa

SEQ ID NO: 593561 - DNA, 14 bp, D. melanogaster
atttcaaatcaaat

SEQ ID NO: 593562 - DNA, 13 bp, D. melanogaster
atttcaaatcgaa

SEQ ID NO: 593563 - DNA, 13 bp, D. melanogaster
atttcaaatcgat

SEQ ID NO: 593564 - DNA, 13 bp, D. melanogaster
atttcaaatgaaa

SEQ ID NO: 593565 - DNA, 14 bp, D. melanogaster
atttcaaatgcaaa

SEQ ID NO: 593566 - DNA, 13 bp, D. melanogaster
atttcaaatgcac

SEQ ID NO: 593567 - DNA, 13 bp, D. melanogaster
atttcaaatgctg

SEQ ID NO: 593568 - DNA, 13 bp, D. melanogaster
atttcaaatgtaa

SEQ ID NO: 593569 - DNA, 13 bp, D. melanogaster
atttcaaatgttt

SEQ ID NO: 593570 - DNA, 14 bp, D. melanogaster
atttcaaattcaaa

SEQ ID NO: 593571 - DNA, 13 bp, D. melanogaster
atttcaaattgaa

SEQ ID NO: 593572 - DNA, 14 bp, D. melanogaster
atttcaaattgatt

SEQ ID NO: 593573 - DNA, 13 bp, D. melanogaster
atttcaaattgtt

SEQ ID NO: 593574 - DNA, 13 bp, D. melanogaster
atttcaaatttca

SEQ ID NO: 593575 - DNA, 13 bp, D. melanogaster
atttcaaatttct

SEQ ID NO: 593576 - DNA, 13 bp, D. melanogaster
atttcaaattttg

SEQ ID NO: 593577 - DNA, 13 bp, D. melanogaster
atttcaacaaaat

SEQ ID NO: 593578 - DNA, 13 bp, D. melanogaster
atttcaacaaatt

SEQ ID NO: 593579 - DNA, 13 bp, D. melanogaster
atttcaacacttt

SEQ ID NO: 593580 - DNA, 13 bp, D. melanogaster
atttcaacatatt

SEQ ID NO: 593581 - DNA, 13 bp, D. melanogaster
atttcaacattat

SEQ ID NO: 593582 - DNA, 13 bp, D. melanogaster
atttcaacatttc

SEQ ID NO: 593583 - DNA, 13 bp, D. melanogaster
atttcaacatttt

SEQ ID NO: 593584 - DNA, 13 bp, D. melanogaster
atttcaaccattt

SEQ ID NO: 593585 - DNA, 13 bp, D. melanogaster
atttcaacgcaaa

SEQ ID NO: 593586 - DNA, 13 bp, D. melanogaster
atttcaacgtttc

SEQ ID NO: 593587 - DNA, 13 bp, D. melanogaster
atttcaactacgt

SEQ ID NO: 593588 - DNA, 13 bp, D. melanogaster
atttcaactgatt

SEQ ID NO: 593589 - DNA, 13 bp, D. melanogaster
atttcaactgcaa

SEQ ID NO: 593590 - DNA, 13 bp, D. melanogaster
atttcaacttcaa

SEQ ID NO: 593591 - DNA, 13 bp, D. melanogaster
atttcaacttcat

SEQ ID NO: 593592 - DNA, 13 bp, D. melanogaster
atttcaactttat

SEQ ID NO: 593593 - DNA, 13 bp, D. melanogaster
atttcaactttta

SEQ ID NO: 593594 - DNA, 13 bp, D. melanogaster
atttcaagaaaaa

SEQ ID NO: 593595 - DNA, 13 bp, D. melanogaster
atttcaagaattt

SEQ ID NO: 593596 - DNA, 13 bp, D. melanogaster
atttcaagcaatt

SEQ ID NO: 593597 - DNA, 13 bp, D. melanogaster
atttcaagctttt

SEQ ID NO: 593598 - DNA, 13 bp, D. melanogaster
atttcaaggaaat

SEQ ID NO: 593599 - DNA, 13 bp, D. melanogaster
atttcaagtattt

SEQ ID NO: 593600 - DNA, 13 bp, D. melanogaster
atttcaagtgaat

SEQ ID NO: 593601 - DNA, 13 bp, D. melanogaster
atttcaagtgatt

SEQ ID NO: 593602 - DNA, 13 bp, D. melanogaster
atttcaagtgcaa

SEQ ID NO: 593603 - DNA, 13 bp, D. melanogaster
atttcaagtgttt

SEQ ID NO: 593604 - DNA, 13 bp, D. melanogaster
atttcaagttatt

SEQ ID NO: 593605 - DNA, 13 bp, D. melanogaster
atttcaagttgtt

SEQ ID NO: 593606 - DNA, 13 bp, D. melanogaster
atttcaagtttaa

SEQ ID NO: 593607 - DNA, 13 bp, D. melanogaster
atttcaagtttat

SEQ ID NO: 593608 - DNA, 13 bp, D. melanogaster
atttcaagtttcc

SEQ ID NO: 593609 - DNA, 13 bp, D. melanogaster
atttcaataaaca

SEQ ID NO: 593610 - DNA, 13 bp, D. melanogaster
atttcaataaact

SEQ ID NO: 593611 - DNA, 14 bp, D. melanogaster
atttcaataaatgt

SEQ ID NO: 593612 - DNA, 13 bp, D. melanogaster
atttcaataattc

SEQ ID NO: 593613 - DNA, 13 bp, D. melanogaster
atttcaataccaa

SEQ ID NO: 593614 - DNA, 13 bp, D. melanogaster
atttcaatagatt

SEQ ID NO: 593615 - DNA, 13 bp, D. melanogaster
atttcaatagcaa

SEQ ID NO: 593616 - DNA, 13 bp, D. melanogaster
atttcaatatcaa

SEQ ID NO: 593617 - DNA, 13 bp, D. melanogaster
atttcaatatgaa

SEQ ID NO: 593618 - DNA, 13 bp, D. melanogaster
atttcaatatgca

SEQ ID NO: 593619 - DNA, 13 bp, D. melanogaster
atttcaatattca

SEQ ID NO: 593620 - DNA, 13 bp, D. melanogaster
atttcaatattgt

SEQ ID NO: 593621 - DNA, 13 bp, D. melanogaster
atttcaatatttc

SEQ ID NO: 593622 - DNA, 13 bp, D. melanogaster
atttcaatcaatt

SEQ ID NO: 593623 - DNA, 13 bp, D. melanogaster
atttcaatcattt

SEQ ID NO: 593624 - DNA, 13 bp, D. melanogaster
atttcaatcgaaa

SEQ ID NO: 593625 - DNA, 13 bp, D. melanogaster
atttcaatctatt

SEQ ID NO: 593626 - DNA, 13 bp, D. melanogaster
atttcaatgaaaa

SEQ ID NO: 593627 - DNA, 14 bp, D. melanogaster
atttcaatgaaaat

SEQ ID NO: 593628 - DNA, 13 bp, D. melanogaster
atttcaatgaact

SEQ ID NO: 593629 - DNA, 13 bp, D. melanogaster
atttcaatgaata

SEQ ID NO: 593630 - DNA, 14 bp, D. melanogaster
atttcaatgaatat

SEQ ID NO: 593631 - DNA, 13 bp, D. melanogaster
atttcaatgaatt

SEQ ID NO: 593632 - DNA, 14 bp, D. melanogaster
atttcaatgaattt

SEQ ID NO: 593633 - DNA, 13 bp, D. melanogaster
atttcaatgattt

SEQ ID NO: 593634 - DNA, 13 bp, D. melanogaster
atttcaatgcaaa

SEQ ID NO: 593635 - DNA, 14 bp, D. melanogaster
atttcaatgcaaat

SEQ ID NO: 593636 - DNA, 13 bp, D. melanogaster
atttcaatgcaat

SEQ ID NO: 593637 - DNA, 14 bp, D. melanogaster
atttcaatgcaatt

SEQ ID NO: 593638 - DNA, 13 bp, D. melanogaster
atttcaatgccaa

SEQ ID NO: 593639 - DNA, 13 bp, D. melanogaster
atttcaatggaaa

SEQ ID NO: 593640 - DNA, 13 bp, D. melanogaster
atttcaatggaac

SEQ ID NO: 593641 - DNA, 13 bp, D. melanogaster
atttcaatgggcc

SEQ ID NO: 593642 - DNA, 14 bp, D. melanogaster
atttcaatgggcct

SEQ ID NO: 593643 - DNA, 13 bp, D. melanogaster
atttcaatgtaaa

SEQ ID NO: 593644 - DNA, 13 bp, D. melanogaster
atttcaatgtgaa

SEQ ID NO: 593645 - DNA, 13 bp, D. melanogaster
atttcaatgttaa

SEQ ID NO: 593646 - DNA, 13 bp, D. melanogaster
atttcaatgttgt

SEQ ID NO: 593647 - DNA, 13 bp, D. melanogaster
atttcaatgtttt

SEQ ID NO: 593648 - DNA, 14 bp, D. melanogaster
atttcaatgttttt

SEQ ID NO: 593649 - DNA, 14 bp, D. melanogaster
atttcaattaaatc

SEQ ID NO: 593650 - DNA, 13 bp, D. melanogaster
atttcaattaaca

SEQ ID NO: 593651 - DNA, 14 bp, D. melanogaster
atttcaattaagtt

SEQ ID NO: 593652 - DNA, 13 bp, D. melanogaster
atttcaattacta

SEQ ID NO: 593653 - DNA, 13 bp, D. melanogaster
atttcaattactt

SEQ ID NO: 593654 - DNA, 13 bp, D. melanogaster
atttcaattagcc

SEQ ID NO: 593655 - DNA, 14 bp, D. melanogaster
atttcaattcaaat

SEQ ID NO: 593656 - DNA, 13 bp, D. melanogaster
atttcaattcaac

SEQ ID NO: 593657 - DNA, 13 bp, D. melanogaster
atttcaattcaat

SEQ ID NO: 593658 - DNA, 13 bp, D. melanogaster
atttcaattcgaa

SEQ ID NO: 593659 - DNA, 13 bp, D. melanogaster
atttcaattcgca

SEQ ID NO: 593660 - DNA, 13 bp, D. melanogaster
atttcaattgaaa

SEQ ID NO: 593661 - DNA, 14 bp, D. melanogaster
atttcaattgaaat

SEQ ID NO: 593662 - DNA, 13 bp, D. melanogaster
atttcaattgaag

SEQ ID NO: 593663 - DNA, 13 bp, D. melanogaster
atttcaattgaat

SEQ ID NO: 593664 - DNA, 13 bp, D. melanogaster
atttcaattgatt

SEQ ID NO: 593665 - DNA, 14 bp, D. melanogaster
atttcaattgcatt

SEQ ID NO: 593666 - DNA, 13 bp, D. melanogaster
atttcaattgctg

SEQ ID NO: 593667 - DNA, 13 bp, D. melanogaster
atttcaattggca

SEQ ID NO: 593668 - DNA, 13 bp, D. melanogaster
atttcaattggtt

SEQ ID NO: 593669 - DNA, 13 bp, D. melanogaster
atttcaattgttg

SEQ ID NO: 593670 - DNA, 13 bp, D. melanogaster
atttcaattgttt

SEQ ID NO: 593671 - DNA, 14 bp, D. melanogaster
atttcaattgtttg

SEQ ID NO: 593672 - DNA, 14 bp, D. melanogaster
atttcaattgtttt

SEQ ID NO: 593673 - DNA, 14 bp, D. melanogaster
atttcaatttcaat

SEQ ID NO: 593674 - DNA, 13 bp, D. melanogaster
atttcaatttcac

SEQ ID NO: 593675 - DNA, 13 bp, D. melanogaster
atttcaatttcca

SEQ ID NO: 593676 - DNA, 13 bp, D. melanogaster
atttcaatttcgc

SEQ ID NO: 593677 - DNA, 14 bp, D. melanogaster
atttcaatttgaat

SEQ ID NO: 593678 - DNA, 13 bp, D. melanogaster
atttcaatttgat

SEQ ID NO: 593679 - DNA, 13 bp, D. melanogaster
atttcaatttgca

SEQ ID NO: 593680 - DNA, 14 bp, D. melanogaster
atttcaatttgcaa

SEQ ID NO: 593681 - DNA, 14 bp, D. melanogaster
atttcaatttgcat

SEQ ID NO: 593682 - DNA, 13 bp, D. melanogaster
atttcaatttggt

SEQ ID NO: 593683 - DNA, 13 bp, D. melanogaster
atttcaatttgta

SEQ ID NO: 593684 - DNA, 13 bp, D. melanogaster
atttcaatttgtt

SEQ ID NO: 593685 - DNA, 14 bp, D. melanogaster
atttcaatttgttt

SEQ ID NO: 593686 - DNA, 13 bp, D. melanogaster
atttcaattttca

SEQ ID NO: 593687 - DNA, 13 bp, D. melanogaster
atttcaattttcc

SEQ ID NO: 593688 - DNA, 13 bp, D. melanogaster
atttcaattttga

SEQ ID NO: 593689 - DNA, 13 bp, D. melanogaster
atttcaattttgt

SEQ ID NO: 593690 - DNA, 13 bp, D. melanogaster
atttcacaaaaca

SEQ ID NO: 593691 - DNA, 13 bp, D. melanogaster
atttcacaaaatc

SEQ ID NO: 593692 - DNA, 13 bp, D. melanogaster
atttcacaaaatt

SEQ ID NO: 593693 - DNA, 13 bp, D. melanogaster
atttcacaaatat

SEQ ID NO: 593694 - DNA, 14 bp, D. melanogaster
atttcacaaatatt

SEQ ID NO: 593695 - DNA, 13 bp, D. melanogaster
atttcacaattgc

SEQ ID NO: 593696 - DNA, 13 bp, D. melanogaster
atttcacaatttc

SEQ ID NO: 593697 - DNA, 13 bp, D. melanogaster
atttcacacaaat

SEQ ID NO: 593698 - DNA, 13 bp, D. melanogaster
atttcacagtttt

SEQ ID NO: 593699 - DNA, 13 bp, D. melanogaster
atttcacattttg

SEQ ID NO: 593700 - DNA, 13 bp, D. melanogaster
atttcaccaattt

SEQ ID NO: 593701 - DNA, 13 bp, D. melanogaster
atttcaccatttc

SEQ ID NO: 593702 - DNA, 13 bp, D. melanogaster
atttcacgcaagg

SEQ ID NO: 593703 - DNA, 13 bp, D. melanogaster
atttcacgctttg

SEQ ID NO: 593704 - DNA, 13 bp, D. melanogaster
atttcactattta

SEQ ID NO: 593705 - DNA, 13 bp, D. melanogaster
atttcactgaaaa

SEQ ID NO: 593706 - DNA, 13 bp, D. melanogaster
atttcacttcatt

SEQ ID NO: 593707 - DNA, 14 bp, D. melanogaster
atttcacttcattt

SEQ ID NO: 593708 - DNA, 13 bp, D. melanogaster
atttcacttggcc

SEQ ID NO: 593709 - DNA, 13 bp, D. melanogaster
atttcacttgttg

SEQ ID NO: 593710 - DNA, 14 bp, D. melanogaster
atttcactttcaat

SEQ ID NO: 593711 - DNA, 13 bp, D. melanogaster
atttcactttcac

SEQ ID NO: 593712 - DNA, 13 bp, D. melanogaster
atttcacttttcg

SEQ ID NO: 593713 - DNA, 13 bp, D. melanogaster
atttcacttttgt

SEQ ID NO: 593714 - DNA, 13 bp, D. melanogaster
atttcagaaaaat

SEQ ID NO: 593715 - DNA, 13 bp, D. melanogaster
atttcagaaaatc

SEQ ID NO: 593716 - DNA, 13 bp, D. melanogaster
atttcagaacaaa

SEQ ID NO: 593717 - DNA, 13 bp, D. melanogaster
atttcagaatttt

SEQ ID NO: 593718 - DNA, 13 bp, D. melanogaster
atttcagaccata

SEQ ID NO: 593719 - DNA, 13 bp, D. melanogaster
atttcagatctta

SEQ ID NO: 593720 - DNA, 13 bp, D. melanogaster
atttcagatttaa

SEQ ID NO: 593721 - DNA, 13 bp, D. melanogaster
atttcagattttt

SEQ ID NO: 593722 - DNA, 13 bp, D. melanogaster
atttcagcaaaaa

SEQ ID NO: 593723 - DNA, 13 bp, D. melanogaster
atttcagcaaaca

SEQ ID NO: 593724 - DNA, 13 bp, D. melanogaster
atttcagcatttt

SEQ ID NO: 593725 - DNA, 13 bp, D. melanogaster
atttcagccaaaa

SEQ ID NO: 593726 - DNA, 13 bp, D. melanogaster
atttcagccagct

SEQ ID NO: 593727 - DNA, 13 bp, D. melanogaster
atttcagccattt

SEQ ID NO: 593728 - DNA, 13 bp, D. melanogaster
atttcagcttttt

SEQ ID NO: 593729 - DNA, 13 bp, D. melanogaster
atttcagtaaata

SEQ ID NO: 593730 - DNA, 13 bp, D. melanogaster
atttcagtatttt

SEQ ID NO: 593731 - DNA, 13 bp, D. melanogaster
atttcagttaaat

SEQ ID NO: 593732 - DNA, 14 bp, D. melanogaster
atttcagttaaatt

SEQ ID NO: 593733 - DNA, 13 bp, D. melanogaster
atttcagttcatt

SEQ ID NO: 593734 - DNA, 13 bp, D. melanogaster
atttcagttgaaa

SEQ ID NO: 593735 - DNA, 13 bp, D. melanogaster
atttcagttgcat

SEQ ID NO: 593736 - DNA, 13 bp, D. melanogaster
atttcagtttaaa

SEQ ID NO: 593737 - DNA, 13 bp, D. melanogaster
atttcagtttatt

SEQ ID NO: 593738 - DNA, 13 bp, D. melanogaster
atttcagtttcga

SEQ ID NO: 593739 - DNA, 13 bp, D. melanogaster
atttcagtttggc

SEQ ID NO: 593740 - DNA, 13 bp, D. melanogaster
atttcagtttggt

SEQ ID NO: 593741 - DNA, 13 bp, D. melanogaster
atttcagttttct

SEQ ID NO: 593742 - DNA, 13 bp, D. melanogaster
atttcagttttga

SEQ ID NO: 593743 - DNA, 13 bp, D. melanogaster
atttcagttttgt

SEQ ID NO: 593744 - DNA, 13 bp, D. melanogaster
atttcataaaaag

SEQ ID NO: 593745 - DNA, 13 bp, D. melanogaster
atttcataacaaa

SEQ ID NO: 593746 - DNA, 13 bp, D. melanogaster
atttcataacttt

SEQ ID NO: 593747 - DNA, 13 bp, D. melanogaster
atttcatacaaaa

SEQ ID NO: 593748 - DNA, 13 bp, D. melanogaster
atttcatacaatt

SEQ ID NO: 593749 - DNA, 13 bp, D. melanogaster
atttcatacattt

SEQ ID NO: 593750 - DNA, 14 bp, D. melanogaster
atttcatatacata

SEQ ID NO: 593751 - DNA, 13 bp, D. melanogaster
atttcatatatca

SEQ ID NO: 593752 - DNA, 14 bp, D. melanogaster
atttcatatatgta

SEQ ID NO: 593753 - DNA, 13 bp, D. melanogaster
atttcatatcgat

SEQ ID NO: 593754 - DNA, 14 bp, D. melanogaster
atttcatattcaaa

SEQ ID NO: 593755 - DNA, 13 bp, D. melanogaster
atttcatattcag

SEQ ID NO: 593756 - DNA, 13 bp, D. melanogaster
atttcatattcat

SEQ ID NO: 593757 - DNA, 13 bp, D. melanogaster
atttcatattgaa

SEQ ID NO: 593758 - DNA, 13 bp, D. melanogaster
atttcatattgat

SEQ ID NO: 593759 - DNA, 13 bp, D. melanogaster
atttcatattttg

SEQ ID NO: 593760 - DNA, 13 bp, D. melanogaster
atttcatcaaaaa

SEQ ID NO: 593761 - DNA, 13 bp, D. melanogaster
atttcatcaaata

SEQ ID NO: 593762 - DNA, 13 bp, D. melanogaster
atttcatcaaatg

SEQ ID NO: 593763 - DNA, 13 bp, D. melanogaster
atttcatcatcat

SEQ ID NO: 593764 - DNA, 14 bp, D. melanogaster
atttcatcatcatc

SEQ ID NO: 593765 - DNA, 13 bp, D. melanogaster
atttcatccattt

SEQ ID NO: 593766 - DNA, 13 bp, D. melanogaster
atttcatgaaaat

SEQ ID NO: 593767 - DNA, 13 bp, D. melanogaster
atttcatgcaatt

SEQ ID NO: 593768 - DNA, 13 bp, D. melanogaster
atttcatgcattt

SEQ ID NO: 593769 - DNA, 13 bp, D. melanogaster
atttcatgccaaa

SEQ ID NO: 593770 - DNA, 13 bp, D. melanogaster
atttcatgtagta

SEQ ID NO: 593771 - DNA, 13 bp, D. melanogaster
atttcatgtttta

SEQ ID NO: 593772 - DNA, 13 bp, D. melanogaster
atttcatgttttc

SEQ ID NO: 593773 - DNA, 14 bp, D. melanogaster
atttcattaaaaac

SEQ ID NO: 593774 - DNA, 13 bp, D. melanogaster
atttcattaaact

SEQ ID NO: 593775 - DNA, 14 bp, D. melanogaster
atttcattaaattg

SEQ ID NO: 593776 - DNA, 13 bp, D. melanogaster
atttcattaacaa

SEQ ID NO: 593777 - DNA, 13 bp, D. melanogaster
atttcattaactt

SEQ ID NO: 593778 - DNA, 13 bp, D. melanogaster
atttcattacatt

SEQ ID NO: 593779 - DNA, 14 bp, D. melanogaster
atttcattataact

SEQ ID NO: 593780 - DNA, 13 bp, D. melanogaster
atttcattatcat

SEQ ID NO: 593781 - DNA, 13 bp, D. melanogaster
atttcattcaatt

SEQ ID NO: 593782 - DNA, 13 bp, D. melanogaster
atttcattcagca

SEQ ID NO: 593783 - DNA, 13 bp, D. melanogaster
atttcattcatga

SEQ ID NO: 593784 - DNA, 14 bp, D. melanogaster
atttcattcatgat

SEQ ID NO: 593785 - DNA, 14 bp, D. melanogaster
atttcattcattaa

SEQ ID NO: 593786 - DNA, 13 bp, D. melanogaster
atttcattccatt

SEQ ID NO: 593787 - DNA, 14 bp, D. melanogaster
atttcattccattc

SEQ ID NO: 593788 - DNA, 13 bp, D. melanogaster
atttcattccgtt

SEQ ID NO: 593789 - DNA, 13 bp, D. melanogaster
atttcattctata

SEQ ID NO: 593790 - DNA, 13 bp, D. melanogaster
atttcattgaaaa

SEQ ID NO: 593791 - DNA, 13 bp, D. melanogaster
atttcattgaaca

SEQ ID NO: 593792 - DNA, 13 bp, D. melanogaster
atttcattgaaga

SEQ ID NO: 593793 - DNA, 13 bp, D. melanogaster
atttcattgactt

SEQ ID NO: 593794 - DNA, 14 bp, D. melanogaster
atttcattgactta

SEQ ID NO: 593795 - DNA, 13 bp, D. melanogaster
atttcattgcaaa

SEQ ID NO: 593796 - DNA, 13 bp, D. melanogaster
atttcattgcata

SEQ ID NO: 593797 - DNA, 13 bp, D. melanogaster
atttcattggaaa

SEQ ID NO: 593798 - DNA, 13 bp, D. melanogaster
atttcattggcca

SEQ ID NO: 593799 - DNA, 13 bp, D. melanogaster
atttcattgttca

SEQ ID NO: 593800 - DNA, 13 bp, D. melanogaster
atttcatttaagt

SEQ ID NO: 593801 - DNA, 13 bp, D. melanogaster
atttcatttacca

SEQ ID NO: 593802 - DNA, 13 bp, D. melanogaster
atttcatttagct

SEQ ID NO: 593803 - DNA, 13 bp, D. melanogaster
atttcatttcatc

SEQ ID NO: 593804 - DNA, 13 bp, D. melanogaster
atttcatttcatg

SEQ ID NO: 593805 - DNA, 13 bp, D. melanogaster
atttcatttcgaa

SEQ ID NO: 593806 - DNA, 14 bp, D. melanogaster
atttcatttcgctt

SEQ ID NO: 593807 - DNA, 13 bp, D. melanogaster
atttcatttcgtt

SEQ ID NO: 593808 - DNA, 13 bp, D. melanogaster
atttcatttgaaa

SEQ ID NO: 593809 - DNA, 14 bp, D. melanogaster
atttcatttgaaaa

SEQ ID NO: 593810 - DNA, 13 bp, D. melanogaster
atttcatttgaat

SEQ ID NO: 593811 - DNA, 14 bp, D. melanogaster
atttcatttgagtt

SEQ ID NO: 593812 - DNA, 13 bp, D. melanogaster
atttcatttgcag

SEQ ID NO: 593813 - DNA, 13 bp, D. melanogaster
atttcatttgcat

SEQ ID NO: 593814 - DNA, 13 bp, D. melanogaster
atttcatttggtt

SEQ ID NO: 593815 - DNA, 13 bp, D. melanogaster
atttcatttgtaa

SEQ ID NO: 593816 - DNA, 14 bp, D. melanogaster
atttcatttgtatt

SEQ ID NO: 593817 - DNA, 13 bp, D. melanogaster
atttcatttgtct

SEQ ID NO: 593818 - DNA, 13 bp, D. melanogaster
atttcatttgtgt

SEQ ID NO: 593819 - DNA, 13 bp, D. melanogaster
atttcattttacc

SEQ ID NO: 593820 - DNA, 13 bp, D. melanogaster
atttcattttaga

SEQ ID NO: 593821 - DNA, 14 bp, D. melanogaster
atttcattttagtt

SEQ ID NO: 593822 - DNA, 13 bp, D. melanogaster
atttcattttgca

SEQ ID NO: 593823 - DNA, 13 bp, D. melanogaster
atttcatttttga

SEQ ID NO: 593824 - DNA, 13 bp, D. melanogaster
atttccaaaaaat

SEQ ID NO: 593825 - DNA, 13 bp, D. melanogaster
atttccaaaaaca

SEQ ID NO: 593826 - DNA, 13 bp, D. melanogaster
atttccaaaaatg

SEQ ID NO: 593827 - DNA, 13 bp, D. melanogaster
atttccaaaacga

SEQ ID NO: 593828 - DNA, 13 bp, D. melanogaster
atttccaaacaaa

SEQ ID NO: 593829 - DNA, 13 bp, D. melanogaster
atttccaaagaaa

SEQ ID NO: 593830 - DNA, 13 bp, D. melanogaster
atttccaaataat

SEQ ID NO: 593831 - DNA, 14 bp, D. melanogaster
atttccaaatattt

SEQ ID NO: 593832 - DNA, 13 bp, D. melanogaster
atttccaaatgca

SEQ ID NO: 593833 - DNA, 13 bp, D. melanogaster
atttccaaatgtt

SEQ ID NO: 593834 - DNA, 13 bp, D. melanogaster
atttccaaattaa

SEQ ID NO: 593835 - DNA, 13 bp, D. melanogaster
atttccaacaaaa

SEQ ID NO: 593836 - DNA, 13 bp, D. melanogaster
atttccaacaata

SEQ ID NO: 593837 - DNA, 13 bp, D. melanogaster
atttccaacaatt

SEQ ID NO: 593838 - DNA, 14 bp, D. melanogaster
atttccaacaattc

SEQ ID NO: 593839 - DNA, 13 bp, D. melanogaster
atttccaacattt

SEQ ID NO: 593840 - DNA, 13 bp, D. melanogaster
atttccaactaaa

SEQ ID NO: 593841 - DNA, 13 bp, D. melanogaster
atttccaactaat

SEQ ID NO: 593842 - DNA, 13 bp, D. melanogaster
atttccaactatt

SEQ ID NO: 593843 - DNA, 13 bp, D. melanogaster
atttccaactggc

SEQ ID NO: 593844 - DNA, 13 bp, D. melanogaster
atttccaactttg

SEQ ID NO: 593845 - DNA, 13 bp, D. melanogaster
atttccaagccaa

SEQ ID NO: 593846 - DNA, 13 bp, D. melanogaster
atttccaagccga

SEQ ID NO: 593847 - DNA, 13 bp, D. melanogaster
atttccaataaag

SEQ ID NO: 593848 - DNA, 13 bp, D. melanogaster
atttccaatattt

SEQ ID NO: 593849 - DNA, 13 bp, D. melanogaster
atttccaatcaaa

SEQ ID NO: 593850 - DNA, 13 bp, D. melanogaster
atttccaatcgaa

SEQ ID NO: 593851 - DNA, 13 bp, D. melanogaster
atttccaatgaat

SEQ ID NO: 593852 - DNA, 13 bp, D. melanogaster
atttccaatgatt

SEQ ID NO: 593853 - DNA, 13 bp, D. melanogaster
atttccaatgcaa

SEQ ID NO: 593854 - DNA, 13 bp, D. melanogaster
atttccaatgtta

SEQ ID NO: 593855 - DNA, 13 bp, D. melanogaster
atttccaattaca

SEQ ID NO: 593856 - DNA, 13 bp, D. melanogaster
atttccaatttat

SEQ ID NO: 593857 - DNA, 13 bp, D. melanogaster
atttccaattttc

SEQ ID NO: 593858 - DNA, 13 bp, D. melanogaster
atttccacaattt

SEQ ID NO: 593859 - DNA, 13 bp, D. melanogaster
atttccacacaaa

SEQ ID NO: 593860 - DNA, 13 bp, D. melanogaster
atttccacacttt

SEQ ID NO: 593861 - DNA, 13 bp, D. melanogaster
atttccacatcca

SEQ ID NO: 593862 - DNA, 13 bp, D. melanogaster
atttccaccaccc

SEQ ID NO: 593863 - DNA, 13 bp, D. melanogaster
atttccaccattt

SEQ ID NO: 593864 - DNA, 13 bp, D. melanogaster
atttccacgaaaa

SEQ ID NO: 593865 - DNA, 13 bp, D. melanogaster
atttccacgattt

SEQ ID NO: 593866 - DNA, 13 bp, D. melanogaster
atttccactagct

SEQ ID NO: 593867 - DNA, 13 bp, D. melanogaster
atttccactgaaa

SEQ ID NO: 593868 - DNA, 13 bp, D. melanogaster
atttccacttttc

SEQ ID NO: 593869 - DNA, 13 bp, D. melanogaster
atttccagcaatt

SEQ ID NO: 593870 - DNA, 13 bp, D. melanogaster
atttccagccaaa

SEQ ID NO: 593871 - DNA, 13 bp, D. melanogaster
atttccagctaaa

SEQ ID NO: 593872 - DNA, 13 bp, D. melanogaster
atttccagctgct

SEQ ID NO: 593873 - DNA, 13 bp, D. melanogaster
atttccagctggc

SEQ ID NO: 593874 - DNA, 14 bp, D. melanogaster
atttccataaatat

SEQ ID NO: 593875 - DNA, 13 bp, D. melanogaster
atttccatacaaa

SEQ ID NO: 593876 - DNA, 13 bp, D. melanogaster
atttccatatcca

SEQ ID NO: 593877 - DNA, 13 bp, D. melanogaster
atttccatattca

SEQ ID NO: 593878 - DNA, 13 bp, D. melanogaster
atttccatattta

SEQ ID NO: 593879 - DNA, 13 bp, D. melanogaster
atttccatatttc

SEQ ID NO: 593880 - DNA, 13 bp, D. melanogaster
atttccatcatca

SEQ ID NO: 593881 - DNA, 13 bp, D. melanogaster
atttccatcattt

SEQ ID NO: 593882 - DNA, 13 bp, D. melanogaster
atttccatgaaaa

SEQ ID NO: 593883 - DNA, 13 bp, D. melanogaster
atttccatgccat

SEQ ID NO: 593884 - DNA, 13 bp, D. melanogaster
atttccatgccca

SEQ ID NO: 593885 - DNA, 13 bp, D. melanogaster
atttccatgtcca

SEQ ID NO: 593886 - DNA, 13 bp, D. melanogaster
atttccattaaca

SEQ ID NO: 593887 - DNA, 13 bp, D. melanogaster
atttccattacca

SEQ ID NO: 593888 - DNA, 13 bp, D. melanogaster
atttccattcatt

SEQ ID NO: 593889 - DNA, 14 bp, D. melanogaster
atttccattccatt

SEQ ID NO: 593890 - DNA, 13 bp, D. melanogaster
atttccattccca

SEQ ID NO: 593891 - DNA, 14 bp, D. melanogaster
atttccattcccat

SEQ ID NO: 593892 - DNA, 13 bp, D. melanogaster
atttccattcccg

SEQ ID NO: 593893 - DNA, 13 bp, D. melanogaster
atttccattcgaa

SEQ ID NO: 593894 - DNA, 13 bp, D. melanogaster
atttccattcgat

SEQ ID NO: 593895 - DNA, 13 bp, D. melanogaster
atttccattcgca

SEQ ID NO: 593896 - DNA, 14 bp, D. melanogaster
atttccattgattt

SEQ ID NO: 593897 - DNA, 13 bp, D. melanogaster
atttccattgcag

SEQ ID NO: 593898 - DNA, 13 bp, D. melanogaster
atttccattgcca

SEQ ID NO: 593899 - DNA, 13 bp, D. melanogaster
atttccattggca

SEQ ID NO: 593900 - DNA, 13 bp, D. melanogaster
atttccattgtgt

SEQ ID NO: 593901 - DNA, 13 bp, D. melanogaster
atttccattgttg

SEQ ID NO: 593902 - DNA, 14 bp, D. melanogaster
atttccatttaaat

SEQ ID NO: 593903 - DNA, 13 bp, D. melanogaster
atttccatttata

SEQ ID NO: 593904 - DNA, 13 bp, D. melanogaster
atttccatttatc

SEQ ID NO: 593905 - DNA, 13 bp, D. melanogaster
atttccatttcaa

SEQ ID NO: 593906 - DNA, 14 bp, D. melanogaster
atttccatttcatt

SEQ ID NO: 593907 - DNA, 14 bp, D. melanogaster
atttccatttccat

SEQ ID NO: 593908 - DNA, 14 bp, D. melanogaster
atttccatttcgat

SEQ ID NO: 593909 - DNA, 14 bp, D. melanogaster
atttccatttcgtt

SEQ ID NO: 593910 - DNA, 13 bp, D. melanogaster
atttccatttgaa

SEQ ID NO: 593911 - DNA, 14 bp, D. melanogaster
atttccatttgaaa

SEQ ID NO: 593912 - DNA, 13 bp, D. melanogaster
atttccatttgca

SEQ ID NO: 593913 - DNA, 13 bp, D. melanogaster
atttccatttgcg

SEQ ID NO: 593914 - DNA, 13 bp, D. melanogaster
atttccatttgtg

SEQ ID NO: 593915 - DNA, 14 bp, D. melanogaster
atttccattttgat

SEQ ID NO: 593916 - DNA, 13 bp, D. melanogaster
atttcccaaaaaa

SEQ ID NO: 593917 - DNA, 14 bp, D. melanogaster
atttcccaaaaaaa

SEQ ID NO: 593918 - DNA, 13 bp, D. melanogaster
atttcccaaaaac

SEQ ID NO: 593919 - DNA, 13 bp, D. melanogaster
atttcccaaaaga

SEQ ID NO: 593920 - DNA, 13 bp, D. melanogaster
atttcccaaataa

SEQ ID NO: 593921 - DNA, 13 bp, D. melanogaster
atttcccaacatt

SEQ ID NO: 593922 - DNA, 13 bp, D. melanogaster
atttcccaagcga

SEQ ID NO: 593923 - DNA, 13 bp, D. melanogaster
atttcccagctga

SEQ ID NO: 593924 - DNA, 13 bp, D. melanogaster
atttcccataaaa

SEQ ID NO: 593925 - DNA, 13 bp, D. melanogaster
atttcccatcaaa

SEQ ID NO: 593926 - DNA, 14 bp, D. melanogaster
atttcccattaaaa

SEQ ID NO: 593927 - DNA, 13 bp, D. melanogaster
atttcccattaat

SEQ ID NO: 593928 - DNA, 13 bp, D. melanogaster
atttcccattcga

SEQ ID NO: 593929 - DNA, 13 bp, D. melanogaster
atttcccattgaa

SEQ ID NO: 593930 - DNA, 13 bp, D. melanogaster
atttcccattgca

SEQ ID NO: 593931 - DNA, 13 bp, D. melanogaster
atttcccattgcc

SEQ ID NO: 593932 - DNA, 13 bp, D. melanogaster
atttcccatttac

SEQ ID NO: 593933 - DNA, 14 bp, D. melanogaster
atttcccatttatt

SEQ ID NO: 593934 - DNA, 13 bp, D. melanogaster
atttcccatttca

SEQ ID NO: 593935 - DNA, 14 bp, D. melanogaster
atttcccattttcc

SEQ ID NO: 593936 - DNA, 13 bp, D. melanogaster
atttccccaaaaa

SEQ ID NO: 593937 - DNA, 13 bp, D. melanogaster
atttccccaattt

SEQ ID NO: 593938 - DNA, 13 bp, D. melanogaster
atttccccagaaa

SEQ ID NO: 593939 - DNA, 13 bp, D. melanogaster
atttccccagcca

SEQ ID NO: 593940 - DNA, 13 bp, D. melanogaster
atttccccatttg

SEQ ID NO: 593941 - DNA, 13 bp, D. melanogaster
atttcccccaaaa

SEQ ID NO: 593942 - DNA, 13 bp, D. melanogaster
atttccccccatt

SEQ ID NO: 593943 - DNA, 13 bp, D. melanogaster
atttccccgtttt

SEQ ID NO: 593944 - DNA, 13 bp, D. melanogaster
atttcccgctttc

SEQ ID NO: 593945 - DNA, 13 bp, D. melanogaster
atttccctcaatt

SEQ ID NO: 593946 - DNA, 13 bp, D. melanogaster
atttcccttttgc

SEQ ID NO: 593947 - DNA, 13 bp, D. melanogaster
atttccgaaaatt

SEQ ID NO: 593948 - DNA, 13 bp, D. melanogaster
atttccgaagaat

SEQ ID NO: 593949 - DNA, 13 bp, D. melanogaster
atttccgaatttt

SEQ ID NO: 593950 - DNA, 13 bp, D. melanogaster
atttccgatttcc

SEQ ID NO: 593951 - DNA, 13 bp, D. melanogaster
atttccgcaattt

SEQ ID NO: 593952 - DNA, 13 bp, D. melanogaster
atttccgctgcat

SEQ ID NO: 593953 - DNA, 13 bp, D. melanogaster
atttccgctgcca

SEQ ID NO: 593954 - DNA, 13 bp, D. melanogaster
atttccgcttccg

SEQ ID NO: 593955 - DNA, 13 bp, D. melanogaster
atttccgtgctga

SEQ ID NO: 593956 - DNA, 13 bp, D. melanogaster
atttccgtttaaa

SEQ ID NO: 593957 - DNA, 13 bp, D. melanogaster
atttccgtttccg

SEQ ID NO: 593958 - DNA, 14 bp, D. melanogaster
atttccgtttccgc

SEQ ID NO: 593959 - DNA, 13 bp, D. melanogaster
atttccgtttcct

SEQ ID NO: 593960 - DNA, 13 bp, D. melanogaster
atttccgttttct

SEQ ID NO: 593961 - DNA, 13 bp, D. melanogaster
atttcctacaaat

SEQ ID NO: 593962 - DNA, 14 bp, D. melanogaster
atttcctatccaat

SEQ ID NO: 593963 - DNA, 13 bp, D. melanogaster
atttcctcaatat

SEQ ID NO: 593964 - DNA, 13 bp, D. melanogaster
atttcctgtactt

SEQ ID NO: 593965 - DNA, 13 bp, D. melanogaster
atttccttaaaaa

SEQ ID NO: 593966 - DNA, 13 bp, D. melanogaster
atttccttaaatt

SEQ ID NO: 593967 - DNA, 13 bp, D. melanogaster
atttccttaagtt

SEQ ID NO: 593968 - DNA, 13 bp, D. melanogaster
atttccttggcat

SEQ ID NO: 593969 - DNA, 13 bp, D. melanogaster
atttccttggcca

SEQ ID NO: 593970 - DNA, 13 bp, D. melanogaster
atttcctttaaat

SEQ ID NO: 593971 - DNA, 13 bp, D. melanogaster
atttcctttcaaa

SEQ ID NO: 593972 - DNA, 13 bp, D. melanogaster
atttcctttgatt

SEQ ID NO: 593973 - DNA, 13 bp, D. melanogaster
atttcctttgtat

SEQ ID NO: 593974 - DNA, 14 bp, D. melanogaster
atttcctttgtata

SEQ ID NO: 593975 - DNA, 13 bp, D. melanogaster
atttccttttcgt

SEQ ID NO: 593976 - DNA, 13 bp, D. melanogaster
atttcgaaaaaaa

SEQ ID NO: 593977 - DNA, 14 bp, D. melanogaster
atttcgaaaaatat

SEQ ID NO: 593978 - DNA, 13 bp, D. melanogaster
atttcgaaaaatg

SEQ ID NO: 593979 - DNA, 13 bp, D. melanogaster
atttcgaaaaatt

SEQ ID NO: 593980 - DNA, 13 bp, D. melanogaster
atttcgaaaacat

SEQ ID NO: 593981 - DNA, 13 bp, D. melanogaster
atttcgaaaagta

SEQ ID NO: 593982 - DNA, 13 bp, D. melanogaster
atttcgaaaagtt

SEQ ID NO: 593983 - DNA, 13 bp, D. melanogaster
atttcgaaaataa

SEQ ID NO: 593984 - DNA, 13 bp, D. melanogaster
atttcgaaaatca

SEQ ID NO: 593985 - DNA, 13 bp, D. melanogaster
atttcgaaacaaa

SEQ ID NO: 593986 - DNA, 13 bp, D. melanogaster
atttcgaaacaat

SEQ ID NO: 593987 - DNA, 13 bp, D. melanogaster
atttcgaaacatt

SEQ ID NO: 593988 - DNA, 13 bp, D. melanogaster
atttcgaaactaa

SEQ ID NO: 593989 - DNA, 13 bp, D. melanogaster
atttcgaaactac

SEQ ID NO: 593990 - DNA, 14 bp, D. melanogaster
atttcgaaatattt

SEQ ID NO: 593991 - DNA, 13 bp, D. melanogaster
atttcgaaatcaa

SEQ ID NO: 593992 - DNA, 13 bp, D. melanogaster
atttcgaaatcga

SEQ ID NO: 593993 - DNA, 14 bp, D. melanogaster
atttcgaaatcgaa

SEQ ID NO: 593994 - DNA, 13 bp, D. melanogaster
atttcgaaattcg

SEQ ID NO: 593995 - DNA, 13 bp, D. melanogaster
atttcgaacaaaa

SEQ ID NO: 593996 - DNA, 13 bp, D. melanogaster
atttcgaagaaaa

SEQ ID NO: 593997 - DNA, 13 bp, D. melanogaster
atttcgaatatat

SEQ ID NO: 593998 - DNA, 13 bp, D. melanogaster
atttcgaatcaaa

SEQ ID NO: 593999 - DNA, 13 bp, D. melanogaster
atttcgaatcaat

SEQ ID NO: 594000 - DNA, 13 bp, D. melanogaster
atttcgaatcgaa

SEQ ID NO: 594001 - DNA, 13 bp, D. melanogaster
atttcgaatgaaa

SEQ ID NO: 594002 - DNA, 13 bp, D. melanogaster
atttcgaatgcaa

SEQ ID NO: 594003 - DNA, 14 bp, D. melanogaster
atttcgaatgcaaa

SEQ ID NO: 594004 - DNA, 13 bp, D. melanogaster
atttcgaattaaa

SEQ ID NO: 594005 - DNA, 13 bp, D. melanogaster
atttcgaattcat

SEQ ID NO: 594006 - DNA, 14 bp, D. melanogaster
atttcgaatttaaa

SEQ ID NO: 594007 - DNA, 14 bp, D. melanogaster
atttcgaatttcga

SEQ ID NO: 594008 - DNA, 13 bp, D. melanogaster
atttcgaatttga

SEQ ID NO: 594009 - DNA, 13 bp, D. melanogaster
atttcgaattttg

SEQ ID NO: 594010 - DNA, 13 bp, D. melanogaster
atttcgaccattt

SEQ ID NO: 594011 - DNA, 13 bp, D. melanogaster
atttcgagtggca

SEQ ID NO: 594012 - DNA, 13 bp, D. melanogaster
atttcgataagaa

SEQ ID NO: 594013 - DNA, 13 bp, D. melanogaster
atttcgatatttt

SEQ ID NO: 594014 - DNA, 13 bp, D. melanogaster
atttcgatggcaa

SEQ ID NO: 594015 - DNA, 13 bp, D. melanogaster
atttcgatgtttt

SEQ ID NO: 594016 - DNA, 13 bp, D. melanogaster
atttcgattattt

SEQ ID NO: 594017 - DNA, 13 bp, D. melanogaster
atttcgattcaaa

SEQ ID NO: 594018 - DNA, 13 bp, D. melanogaster
atttcgattccaa

SEQ ID NO: 594019 - DNA, 14 bp, D. melanogaster
atttcgattccgat

SEQ ID NO: 594020 - DNA, 13 bp, D. melanogaster
atttcgattcgat

SEQ ID NO: 594021 - DNA, 13 bp, D. melanogaster
atttcgattgctt

SEQ ID NO: 594022 - DNA, 13 bp, D. melanogaster
atttcgatttaaa

SEQ ID NO: 594023 - DNA, 13 bp, D. melanogaster
atttcgatttatt

SEQ ID NO: 594024 - DNA, 14 bp, D. melanogaster
atttcgatttattt

SEQ ID NO: 594025 - DNA, 13 bp, D. melanogaster
atttcgatttcaa

SEQ ID NO: 594026 - DNA, 13 bp, D. melanogaster
atttcgatttcca

SEQ ID NO: 594027 - DNA, 13 bp, D. melanogaster
atttcgatttcga

SEQ ID NO: 594028 - DNA, 13 bp, D. melanogaster
atttcgatttcgg

SEQ ID NO: 594029 - DNA, 13 bp, D. melanogaster
atttcgatttctc

SEQ ID NO: 594030 - DNA, 13 bp, D. melanogaster
atttcgatttgaa

SEQ ID NO: 594031 - DNA, 13 bp, D. melanogaster
atttcgatttgat

SEQ ID NO: 594032 - DNA, 14 bp, D. melanogaster
atttcgatttgatt

SEQ ID NO: 594033 - DNA, 13 bp, D. melanogaster
atttcgatttgca

SEQ ID NO: 594034 - DNA, 13 bp, D. melanogaster
atttcgatttgta

SEQ ID NO: 594035 - DNA, 13 bp, D. melanogaster
atttcgattttaa

SEQ ID NO: 594036 - DNA, 13 bp, D. melanogaster
atttcgattttat

SEQ ID NO: 594037 - DNA, 13 bp, D. melanogaster
atttcgattttcc

SEQ ID NO: 594038 - DNA, 14 bp, D. melanogaster
atttcgattttccc

SEQ ID NO: 594039 - DNA, 13 bp, D. melanogaster
atttcgattttga

SEQ ID NO: 594040 - DNA, 13 bp, D. melanogaster
atttcgattttgt

SEQ ID NO: 594041 - DNA, 14 bp, D. melanogaster
atttcgattttgtt

SEQ ID NO: 594042 - DNA, 13 bp, D. melanogaster
atttcgcaaaatt

SEQ ID NO: 594043 - DNA, 13 bp, D. melanogaster
atttcgcaaataa

SEQ ID NO: 594044 - DNA, 13 bp, D. melanogaster
atttcgcaacaag

SEQ ID NO: 594045 - DNA, 13 bp, D. melanogaster
atttcgcataaat

SEQ ID NO: 594046 - DNA, 13 bp, D. melanogaster
atttcgcataatt

SEQ ID NO: 594047 - DNA, 13 bp, D. melanogaster
atttcgcatattt

SEQ ID NO: 594048 - DNA, 14 bp, D. melanogaster
atttcgcattcgca

SEQ ID NO: 594049 - DNA, 13 bp, D. melanogaster
atttcgcattgtt

SEQ ID NO: 594050 - DNA, 13 bp, D. melanogaster
atttcgcatttct

SEQ ID NO: 594051 - DNA, 13 bp, D. melanogaster
atttcgcgcagtg

SEQ ID NO: 594052 - DNA, 13 bp, D. melanogaster
atttcgcgttcgc

SEQ ID NO: 594053 - DNA, 14 bp, D. melanogaster
atttcgcgttcgca

SEQ ID NO: 594054 - DNA, 13 bp, D. melanogaster
atttcgctcattt

SEQ ID NO: 594055 - DNA, 13 bp, D. melanogaster
atttcgctccatt

SEQ ID NO: 594056 - DNA, 13 bp, D. melanogaster
atttcgctcttgg

SEQ ID NO: 594057 - DNA, 13 bp, D. melanogaster
atttcgctgattt

SEQ ID NO: 594058 - DNA, 13 bp, D. melanogaster
atttcgctggcca

SEQ ID NO: 594059 - DNA, 13 bp, D. melanogaster
atttcgctggctg

SEQ ID NO: 594060 - DNA, 13 bp, D. melanogaster
atttcgctggctt

SEQ ID NO: 594061 - DNA, 13 bp, D. melanogaster
atttcgctgtttt

SEQ ID NO: 594062 - DNA, 13 bp, D. melanogaster
atttcgcttaaat

SEQ ID NO: 594063 - DNA, 13 bp, D. melanogaster
atttcgcttattt

SEQ ID NO: 594064 - DNA, 13 bp, D. melanogaster
atttcgcttggca

SEQ ID NO: 594065 - DNA, 13 bp, D. melanogaster
atttcgctttaat

SEQ ID NO: 594066 - DNA, 13 bp, D. melanogaster
atttcgctttcat

SEQ ID NO: 594067 - DNA, 13 bp, D. melanogaster
atttcgctttgaa

SEQ ID NO: 594068 - DNA, 14 bp, D. melanogaster
atttcgctttgttt

SEQ ID NO: 594069 - DNA, 13 bp, D. melanogaster
atttcgcttttaa

SEQ ID NO: 594070 - DNA, 13 bp, D. melanogaster
atttcggaagaac

SEQ ID NO: 594071 - DNA, 13 bp, D. melanogaster
atttcggatttcg

SEQ ID NO: 594072 - DNA, 13 bp, D. melanogaster
atttcggattttg

SEQ ID NO: 594073 - DNA, 13 bp, D. melanogaster
atttcggcactgg

SEQ ID NO: 594074 - DNA, 14 bp, D. melanogaster
atttcggcatttat

SEQ ID NO: 594075 - DNA, 13 bp, D. melanogaster
atttcggcccgaa

SEQ ID NO: 594076 - DNA, 13 bp, D. melanogaster
atttcgggggctc

SEQ ID NO: 594077 - DNA, 13 bp, D. melanogaster
atttcgggtggat

SEQ ID NO: 594078 - DNA, 14 bp, D. melanogaster
atttcgggtgtttt

SEQ ID NO: 594079 - DNA, 13 bp, D. melanogaster
atttcggttaatt

SEQ ID NO: 594080 - DNA, 13 bp, D. melanogaster
atttcggttattt

SEQ ID NO: 594081 - DNA, 13 bp, D. melanogaster
atttcggtttatt

SEQ ID NO: 594082 - DNA, 13 bp, D. melanogaster
atttcggtttcag

SEQ ID NO: 594083 - DNA, 13 bp, D. melanogaster
atttcggtttcgg

SEQ ID NO: 594084 - DNA, 14 bp, D. melanogaster
atttcggtttcttt

SEQ ID NO: 594085 - DNA, 13 bp, D. melanogaster
atttcggttttgg

SEQ ID NO: 594086 - DNA, 13 bp, D. melanogaster
atttcgtaaacaa

SEQ ID NO: 594087 - DNA, 13 bp, D. melanogaster
atttcgtaaattt

SEQ ID NO: 594088 - DNA, 13 bp, D. melanogaster
atttcgtaacttt

SEQ ID NO: 594089 - DNA, 13 bp, D. melanogaster
atttcgtaataat

SEQ ID NO: 594090 - DNA, 13 bp, D. melanogaster
atttcgtaatatt

SEQ ID NO: 594091 - DNA, 13 bp, D. melanogaster
atttcgtaatttc

SEQ ID NO: 594092 - DNA, 13 bp, D. melanogaster
atttcgtaatttt

SEQ ID NO: 594093 - DNA, 13 bp, D. melanogaster
atttcgtataaat

SEQ ID NO: 594094 - DNA, 13 bp, D. melanogaster
atttcgtatgcaa

SEQ ID NO: 594095 - DNA, 13 bp, D. melanogaster
atttcgtatgcat

SEQ ID NO: 594096 - DNA, 13 bp, D. melanogaster
atttcgtatttcg

SEQ ID NO: 594097 - DNA, 14 bp, D. melanogaster
atttcgtatttcgt

SEQ ID NO: 594098 - DNA, 13 bp, D. melanogaster
atttcgtatttgt

SEQ ID NO: 594099 - DNA, 13 bp, D. melanogaster
atttcgtattttg

SEQ ID NO: 594100 - DNA, 14 bp, D. melanogaster
atttcgtattttgt

SEQ ID NO: 594101 - DNA, 13 bp, D. melanogaster
atttcgtctttaa

SEQ ID NO: 594102 - DNA, 14 bp, D. melanogaster
atttcgtctttaat

SEQ ID NO: 594103 - DNA, 13 bp, D. melanogaster
atttcgtgcattt

SEQ ID NO: 594104 - DNA, 14 bp, D. melanogaster
atttcgtgtgtttg

SEQ ID NO: 594105 - DNA, 13 bp, D. melanogaster
atttcgtgttcat

SEQ ID NO: 594106 - DNA, 13 bp, D. melanogaster
atttcgttaagta

SEQ ID NO: 594107 - DNA, 13 bp, D. melanogaster
atttcgttataaa

SEQ ID NO: 594108 - DNA, 13 bp, D. melanogaster
atttcgttatttc

SEQ ID NO: 594109 - DNA, 13 bp, D. melanogaster
atttcgttcaatt

SEQ ID NO: 594110 - DNA, 13 bp, D. melanogaster
atttcgttcagtg

SEQ ID NO: 594111 - DNA, 13 bp, D. melanogaster
atttcgttcattt

SEQ ID NO: 594112 - DNA, 13 bp, D. melanogaster
atttcgttcgtgt

SEQ ID NO: 594113 - DNA, 14 bp, D. melanogaster
atttcgttcgtgtg

SEQ ID NO: 594114 - DNA, 13 bp, D. melanogaster
atttcgttgaaaa

SEQ ID NO: 594115 - DNA, 13 bp, D. melanogaster
atttcgttggcca

SEQ ID NO: 594116 - DNA, 13 bp, D. melanogaster
atttcgttggctt

SEQ ID NO: 594117 - DNA, 13 bp, D. melanogaster
atttcgttgttgt

SEQ ID NO: 594118 - DNA, 13 bp, D. melanogaster
atttcgtttaatt

SEQ ID NO: 594119 - DNA, 14 bp, D. melanogaster
atttcgtttaattt

SEQ ID NO: 594120 - DNA, 14 bp, D. melanogaster
atttcgtttcaatt

SEQ ID NO: 594121 - DNA, 14 bp, D. melanogaster
atttcgtttcattt

SEQ ID NO: 594122 - DNA, 13 bp, D. melanogaster
atttcgtttccaa

SEQ ID NO: 594123 - DNA, 13 bp, D. melanogaster
atttcgtttgatt

SEQ ID NO: 594124 - DNA, 13 bp, D. melanogaster
atttcgtttgccc

SEQ ID NO: 594125 - DNA, 14 bp, D. melanogaster
atttcgtttgcttt

SEQ ID NO: 594126 - DNA, 13 bp, D. melanogaster
atttcgtttggct

SEQ ID NO: 594127 - DNA, 13 bp, D. melanogaster
atttcgtttgtca

SEQ ID NO: 594128 - DNA, 13 bp, D. melanogaster
atttcgttttcaa

SEQ ID NO: 594129 - DNA, 13 bp, D. melanogaster
atttcgttttcat

SEQ ID NO: 594130 - DNA, 13 bp, D. melanogaster
atttcgttttggc

SEQ ID NO: 594131 - DNA, 13 bp, D. melanogaster
atttcgtttttgg

SEQ ID NO: 594132 - DNA, 13 bp, D. melanogaster
atttctaaaaatg

SEQ ID NO: 594133 - DNA, 13 bp, D. melanogaster
atttctaagcttt

SEQ ID NO: 594134 - DNA, 13 bp, D. melanogaster
atttctaatctaa

SEQ ID NO: 594135 - DNA, 13 bp, D. melanogaster
atttctaatctat

SEQ ID NO: 594136 - DNA, 13 bp, D. melanogaster
atttctacaaaaa

SEQ ID NO: 594137 - DNA, 13 bp, D. melanogaster
atttctacaaaca

SEQ ID NO: 594138 - DNA, 13 bp, D. melanogaster
atttctacatata

SEQ ID NO: 594139 - DNA, 13 bp, D. melanogaster
atttctagaattt

SEQ ID NO: 594140 - DNA, 13 bp, D. melanogaster
atttctatataca

SEQ ID NO: 594141 - DNA, 13 bp, D. melanogaster
atttctatatatg

SEQ ID NO: 594142 - DNA, 13 bp, D. melanogaster
atttctatatgga

SEQ ID NO: 594143 - DNA, 13 bp, D. melanogaster
atttctatcatat

SEQ ID NO: 594144 - DNA, 13 bp, D. melanogaster
atttctatcgata

SEQ ID NO: 594145 - DNA, 14 bp, D. melanogaster
atttctatcgatat

SEQ ID NO: 594146 - DNA, 14 bp, D. melanogaster
atttctatcgattt

SEQ ID NO: 594147 - DNA, 13 bp, D. melanogaster
atttctatctgga

SEQ ID NO: 594148 - DNA, 13 bp, D. melanogaster
atttctatgaaat

SEQ ID NO: 594149 - DNA, 13 bp, D. melanogaster
atttctatgattt

SEQ ID NO: 594150 - DNA, 13 bp, D. melanogaster
atttctatgccat

SEQ ID NO: 594151 - DNA, 13 bp, D. melanogaster
atttctatgtgtg

SEQ ID NO: 594152 - DNA, 13 bp, D. melanogaster
atttctattgaaa

SEQ ID NO: 594153 - DNA, 14 bp, D. melanogaster
atttctattgattt

SEQ ID NO: 594154 - DNA, 14 bp, D. melanogaster
atttctattgtact

SEQ ID NO: 594155 - DNA, 14 bp, D. melanogaster
atttctattgttgt

SEQ ID NO: 594156 - DNA, 13 bp, D. melanogaster
atttctatttaca

SEQ ID NO: 594157 - DNA, 14 bp, D. melanogaster
atttctatttccat

SEQ ID NO: 594158 - DNA, 13 bp, D. melanogaster
atttctatttctg

SEQ ID NO: 594159 - DNA, 14 bp, D. melanogaster
atttctatttctga

SEQ ID NO: 594160 - DNA, 13 bp, D. melanogaster
atttctatttgat

SEQ ID NO: 594161 - DNA, 13 bp, D. melanogaster
atttctattttgc

SEQ ID NO: 594162 - DNA, 13 bp, D. melanogaster
atttctattttgg

SEQ ID NO: 594163 - DNA, 13 bp, D. melanogaster
atttctcaaaaaa

SEQ ID NO: 594164 - DNA, 13 bp, D. melanogaster
atttctcaaaagt

SEQ ID NO: 594165 - DNA, 13 bp, D. melanogaster
atttctcaacttt

SEQ ID NO: 594166 - DNA, 13 bp, D. melanogaster
atttctcattaaa

SEQ ID NO: 594167 - DNA, 13 bp, D. melanogaster
atttctcattgcc

SEQ ID NO: 594168 - DNA, 14 bp, D. melanogaster
atttctcattgcca

SEQ ID NO: 594169 - DNA, 13 bp, D. melanogaster
atttctcattgtt

SEQ ID NO: 594170 - DNA, 13 bp, D. melanogaster
atttctcatttaa

SEQ ID NO: 594171 - DNA, 13 bp, D. melanogaster
atttctccaagtg

SEQ ID NO: 594172 - DNA, 13 bp, D. melanogaster
atttctccctgtg

SEQ ID NO: 594173 - DNA, 13 bp, D. melanogaster
atttctcgctgtg

SEQ ID NO: 594174 - DNA, 13 bp, D. melanogaster
atttctcgctttt

SEQ ID NO: 594175 - DNA, 13 bp, D. melanogaster
atttctcgttttg

SEQ ID NO: 594176 - DNA, 13 bp, D. melanogaster
atttctgaaaaaa

SEQ ID NO: 594177 - DNA, 13 bp, D. melanogaster
atttctgaaaata

SEQ ID NO: 594178 - DNA, 13 bp, D. melanogaster
atttctgaaacta

SEQ ID NO: 594179 - DNA, 14 bp, D. melanogaster
atttctgaaactaa

SEQ ID NO: 594180 - DNA, 13 bp, D. melanogaster
atttctgattatt

SEQ ID NO: 594181 - DNA, 13 bp, D. melanogaster
atttctgatttct

SEQ ID NO: 594182 - DNA, 13 bp, D. melanogaster
atttctgcaaata

SEQ ID NO: 594183 - DNA, 13 bp, D. melanogaster
atttctgcaattt

SEQ ID NO: 594184 - DNA, 13 bp, D. melanogaster
atttctgcacttg

SEQ ID NO: 594185 - DNA, 13 bp, D. melanogaster
atttctgcatttc

SEQ ID NO: 594186 - DNA, 13 bp, D. melanogaster
atttctgctattt

SEQ ID NO: 594187 - DNA, 13 bp, D. melanogaster
atttctgcttaca

SEQ ID NO: 594188 - DNA, 13 bp, D. melanogaster
atttctggaaatt

SEQ ID NO: 594189 - DNA, 13 bp, D. melanogaster
atttctggcagtg

SEQ ID NO: 594190 - DNA, 13 bp, D. melanogaster
atttctggccatt

SEQ ID NO: 594191 - DNA, 13 bp, D. melanogaster
atttctgggaaat

SEQ ID NO: 594192 - DNA, 13 bp, D. melanogaster
atttctggtttaa

SEQ ID NO: 594193 - DNA, 13 bp, D. melanogaster
atttctgtaaaat

SEQ ID NO: 594194 - DNA, 13 bp, D. melanogaster
atttctgtactgc

SEQ ID NO: 594195 - DNA, 13 bp, D. melanogaster
atttctgtatatg

SEQ ID NO: 594196 - DNA, 13 bp, D. melanogaster
atttctgtggaaa

SEQ ID NO: 594197 - DNA, 13 bp, D. melanogaster
atttctgtgtgca

SEQ ID NO: 594198 - DNA, 13 bp, D. melanogaster
atttctgttaaat

SEQ ID NO: 594199 - DNA, 13 bp, D. melanogaster
atttctgttaatt

SEQ ID NO: 594200 - DNA, 13 bp, D. melanogaster
atttctgttattc

SEQ ID NO: 594201 - DNA, 14 bp, D. melanogaster
atttctgtttctgt

SEQ ID NO: 594202 - DNA, 14 bp, D. melanogaster
atttctgtttgcct

SEQ ID NO: 594203 - DNA, 13 bp, D. melanogaster
atttctgtttgta

SEQ ID NO: 594204 - DNA, 13 bp, D. melanogaster
atttctgtttgtg

SEQ ID NO: 594205 - DNA, 14 bp, D. melanogaster
atttctgtttttag

SEQ ID NO: 594206 - DNA, 13 bp, D. melanogaster
atttcttaacaat

SEQ ID NO: 594207 - DNA, 13 bp, D. melanogaster
atttcttaatgat

SEQ ID NO: 594208 - DNA, 13 bp, D. melanogaster
atttcttaatgtt

SEQ ID NO: 594209 - DNA, 13 bp, D. melanogaster
atttcttaattgg

SEQ ID NO: 594210 - DNA, 13 bp, D. melanogaster
atttcttagaaaa

SEQ ID NO: 594211 - DNA, 13 bp, D. melanogaster
atttcttagtaaa

SEQ ID NO: 594212 - DNA, 14 bp, D. melanogaster
atttcttatcactt

SEQ ID NO: 594213 - DNA, 13 bp, D. melanogaster
atttcttatcgaa

SEQ ID NO: 594214 - DNA, 14 bp, D. melanogaster
atttcttatcgaaa

SEQ ID NO: 594215 - DNA, 13 bp, D. melanogaster
atttcttatgcaa

SEQ ID NO: 594216 - DNA, 13 bp, D. melanogaster
atttcttattcaa

SEQ ID NO: 594217 - DNA, 13 bp, D. melanogaster
atttcttcaatag

SEQ ID NO: 594218 - DNA, 13 bp, D. melanogaster
atttcttcaatta

SEQ ID NO: 594219 - DNA, 13 bp, D. melanogaster
atttcttcgccgc

SEQ ID NO: 594220 - DNA, 14 bp, D. melanogaster
atttcttcttcgaa

SEQ ID NO: 594221 - DNA, 13 bp, D. melanogaster
atttcttgcattt

SEQ ID NO: 594222 - DNA, 13 bp, D. melanogaster
atttcttggccac

SEQ ID NO: 594223 - DNA, 13 bp, D. melanogaster
atttcttggcgtt

SEQ ID NO: 594224 - DNA, 13 bp, D. melanogaster
atttcttgggtac

SEQ ID NO: 594225 - DNA, 13 bp, D. melanogaster
atttcttggtctt

SEQ ID NO: 594226 - DNA, 13 bp, D. melanogaster
atttcttgttaat

SEQ ID NO: 594227 - DNA, 13 bp, D. melanogaster
atttctttaagct

SEQ ID NO: 594228 - DNA, 13 bp, D. melanogaster
atttctttaagtt

SEQ ID NO: 594229 - DNA, 13 bp, D. melanogaster
atttctttaatga

SEQ ID NO: 594230 - DNA, 13 bp, D. melanogaster
atttctttacgtt

SEQ ID NO: 594231 - DNA, 13 bp, D. melanogaster
atttctttagaaa

SEQ ID NO: 594232 - DNA, 13 bp, D. melanogaster
atttctttagcat

SEQ ID NO: 594233 - DNA, 13 bp, D. melanogaster
atttctttcaata

SEQ ID NO: 594234 - DNA, 13 bp, D. melanogaster
atttctttcagtg

SEQ ID NO: 594235 - DNA, 13 bp, D. melanogaster
atttctttccgtg

SEQ ID NO: 594236 - DNA, 13 bp, D. melanogaster
atttctttcgcta

SEQ ID NO: 594237 - DNA, 14 bp, D. melanogaster
atttctttcggtgc

SEQ ID NO: 594238 - DNA, 13 bp, D. melanogaster
atttctttgaaaa

SEQ ID NO: 594239 - DNA, 13 bp, D. melanogaster
atttctttgaaat

SEQ ID NO: 594240 - DNA, 13 bp, D. melanogaster
atttctttgagtg

SEQ ID NO: 594241 - DNA, 13 bp, D. melanogaster
atttctttgataa

SEQ ID NO: 594242 - DNA, 13 bp, D. melanogaster
atttctttgcaaa

SEQ ID NO: 594243 - DNA, 13 bp, D. melanogaster
atttctttgcatt

SEQ ID NO: 594244 - DNA, 13 bp, D. melanogaster
atttctttggata

SEQ ID NO: 594245 - DNA, 13 bp, D. melanogaster
atttctttggcaa

SEQ ID NO: 594246 - DNA, 13 bp, D. melanogaster
atttctttggcca

SEQ ID NO: 594247 - DNA, 13 bp, D. melanogaster
atttctttggtat

SEQ ID NO: 594248 - DNA, 13 bp, D. melanogaster
atttcttttacaa

SEQ ID NO: 594249 - DNA, 14 bp, D. melanogaster
atttcttttcaaaa

SEQ ID NO: 594250 - DNA, 13 bp, D. melanogaster
atttcttttgaaa

SEQ ID NO: 594251 - DNA, 13 bp, D. melanogaster
atttcttttgcag

SEQ ID NO: 594252 - DNA, 13 bp, D. melanogaster
atttcttttgcca

SEQ ID NO: 594253 - DNA, 13 bp, D. melanogaster
atttcttttggcc

SEQ ID NO: 594254 - DNA, 14 bp, D. melanogaster
atttcttttggcca

SEQ ID NO: 594255 - DNA, 13 bp, D. melanogaster
atttgaaaaatgt

SEQ ID NO: 594256 - DNA, 14 bp, D. melanogaster
atttgaaaaatgtg

SEQ ID NO: 594257 - DNA, 14 bp, D. melanogaster
atttgaaaaatgtt

SEQ ID NO: 594258 - DNA, 13 bp, D. melanogaster
atttgaaaacatt

SEQ ID NO: 594259 - DNA, 13 bp, D. melanogaster
atttgaaaaccaa

SEQ ID NO: 594260 - DNA, 13 bp, D. melanogaster
atttgaaaacgtc

SEQ ID NO: 594261 - DNA, 13 bp, D. melanogaster
atttgaaaactga

SEQ ID NO: 594262 - DNA, 13 bp, D. melanogaster
atttgaaaagaat

SEQ ID NO: 594263 - DNA, 14 bp, D. melanogaster
atttgaaaagattt

SEQ ID NO: 594264 - DNA, 13 bp, D. melanogaster
atttgaaaagcaa

SEQ ID NO: 594265 - DNA, 14 bp, D. melanogaster
atttgaaaagcaaa

SEQ ID NO: 594266 - DNA, 14 bp, D. melanogaster
atttgaaaagcaat

SEQ ID NO: 594267 - DNA, 13 bp, D. melanogaster
atttgaaaaggaa

SEQ ID NO: 594268 - DNA, 13 bp, D. melanogaster
atttgaaaagtgc

SEQ ID NO: 594269 - DNA, 13 bp, D. melanogaster
atttgaaaagttt

SEQ ID NO: 594270 - DNA, 14 bp, D. melanogaster
atttgaaaatcaaa

SEQ ID NO: 594271 - DNA, 13 bp, D. melanogaster
atttgaaaatgca

SEQ ID NO: 594272 - DNA, 13 bp, D. melanogaster
atttgaaacaaat

SEQ ID NO: 594273 - DNA, 13 bp, D. melanogaster
atttgaaacaatt

SEQ ID NO: 594274 - DNA, 13 bp, D. melanogaster
atttgaaactaaa

SEQ ID NO: 594275 - DNA, 13 bp, D. melanogaster
atttgaaactaca

SEQ ID NO: 594276 - DNA, 13 bp, D. melanogaster
atttgaaactttt

SEQ ID NO: 594277 - DNA, 13 bp, D. melanogaster
atttgaaagcaaa

SEQ ID NO: 594278 - DNA, 13 bp, D. melanogaster
atttgaaagcaat

SEQ ID NO: 594279 - DNA, 13 bp, D. melanogaster
atttgaaaggaaa

SEQ ID NO: 594280 - DNA, 13 bp, D. melanogaster
atttgaaagtaaa

SEQ ID NO: 594281 - DNA, 13 bp, D. melanogaster
atttgaaagtatt

SEQ ID NO: 594282 - DNA, 13 bp, D. melanogaster
atttgaaagtgca

SEQ ID NO: 594283 - DNA, 13 bp, D. melanogaster
atttgaaagtttg

SEQ ID NO: 594284 - DNA, 13 bp, D. melanogaster
atttgaaataaac

SEQ ID NO: 594285 - DNA, 13 bp, D. melanogaster
atttgaaatacat

SEQ ID NO: 594286 - DNA, 13 bp, D. melanogaster
atttgaaatagtt

SEQ ID NO: 594287 - DNA, 13 bp, D. melanogaster
atttgaaatattg

SEQ ID NO: 594288 - DNA, 13 bp, D. melanogaster
atttgaaatcaaa

SEQ ID NO: 594289 - DNA, 13 bp, D. melanogaster
atttgaaatcatt

SEQ ID NO: 594290 - DNA, 13 bp, D. melanogaster
atttgaaatccat

SEQ ID NO: 594291 - DNA, 13 bp, D. melanogaster
atttgaaatcctt

SEQ ID NO: 594292 - DNA, 13 bp, D. melanogaster
atttgaaatgaat

SEQ ID NO: 594293 - DNA, 14 bp, D. melanogaster
atttgaaatgcaaa

SEQ ID NO: 594294 - DNA, 13 bp, D. melanogaster
atttgaaatgcgc

SEQ ID NO: 594295 - DNA, 13 bp, D. melanogaster
atttgaaatgtga

SEQ ID NO: 594296 - DNA, 13 bp, D. melanogaster
atttgaaatgttt

SEQ ID NO: 594297 - DNA, 13 bp, D. melanogaster
atttgaaattagg

SEQ ID NO: 594298 - DNA, 14 bp, D. melanogaster
atttgaaattcaaa

SEQ ID NO: 594299 - DNA, 13 bp, D. melanogaster
atttgaaattcag

SEQ ID NO: 594300 - DNA, 14 bp, D. melanogaster
atttgaaattcatt

SEQ ID NO: 594301 - DNA, 13 bp, D. melanogaster
atttgaaattcca

SEQ ID NO: 594302 - DNA, 14 bp, D. melanogaster
atttgaaattgaaa

SEQ ID NO: 594303 - DNA, 13 bp, D. melanogaster
atttgaaattgat

SEQ ID NO: 594304 - DNA, 13 bp, D. melanogaster
atttgaaattgca

SEQ ID NO: 594305 - DNA, 13 bp, D. melanogaster
atttgaaattgtt

SEQ ID NO: 594306 - DNA, 13 bp, D. melanogaster
atttgaaattttg

SEQ ID NO: 594307 - DNA, 13 bp, D. melanogaster
atttgaacaaatg

SEQ ID NO: 594308 - DNA, 13 bp, D. melanogaster
atttgaacaaatt

SEQ ID NO: 594309 - DNA, 13 bp, D. melanogaster
atttgaacaattt

SEQ ID NO: 594310 - DNA, 13 bp, D. melanogaster
atttgaacacttt

SEQ ID NO: 594311 - DNA, 13 bp, D. melanogaster
atttgaactttga

SEQ ID NO: 594312 - DNA, 13 bp, D. melanogaster
atttgaagaaatt

SEQ ID NO: 594313 - DNA, 13 bp, D. melanogaster
atttgaagaattt

SEQ ID NO: 594314 - DNA, 13 bp, D. melanogaster
atttgaagacatt

SEQ ID NO: 594315 - DNA, 14 bp, D. melanogaster
atttgaagacattg

SEQ ID NO: 594316 - DNA, 13 bp, D. melanogaster
atttgaagatatt

SEQ ID NO: 594317 - DNA, 13 bp, D. melanogaster
atttgaagatttg

SEQ ID NO: 594318 - DNA, 13 bp, D. melanogaster
atttgaagcattt

SEQ ID NO: 594319 - DNA, 13 bp, D. melanogaster
atttgaagctttt

SEQ ID NO: 594320 - DNA, 13 bp, D. melanogaster
atttgaagtattt

SEQ ID NO: 594321 - DNA, 13 bp, D. melanogaster
atttgaagtttaa

SEQ ID NO: 594322 - DNA, 13 bp, D. melanogaster
atttgaataaaga

SEQ ID NO: 594323 - DNA, 13 bp, D. melanogaster
atttgaataactc

SEQ ID NO: 594324 - DNA, 13 bp, D. melanogaster
atttgaataactt

SEQ ID NO: 594325 - DNA, 13 bp, D. melanogaster
atttgaatacaca

SEQ ID NO: 594326 - DNA, 13 bp, D. melanogaster
atttgaatacatt

SEQ ID NO: 594327 - DNA, 14 bp, D. melanogaster
atttgaatacattt

SEQ ID NO: 594328 - DNA, 13 bp, D. melanogaster
atttgaatagaaa

SEQ ID NO: 594329 - DNA, 14 bp, D. melanogaster
atttgaatagattt

SEQ ID NO: 594330 - DNA, 13 bp, D. melanogaster
atttgaatagtta

SEQ ID NO: 594331 - DNA, 13 bp, D. melanogaster
atttgaatataca

SEQ ID NO: 594332 - DNA, 13 bp, D. melanogaster
atttgaatatcaa

SEQ ID NO: 594333 - DNA, 13 bp, D. melanogaster
atttgaatatgat

SEQ ID NO: 594334 - DNA, 13 bp, D. melanogaster
atttgaatattag

SEQ ID NO: 594335 - DNA, 13 bp, D. melanogaster
atttgaatcaaat

SEQ ID NO: 594336 - DNA, 13 bp, D. melanogaster
atttgaatcaatt

SEQ ID NO: 594337 - DNA, 13 bp, D. melanogaster
atttgaatcgaaa

SEQ ID NO: 594338 - DNA, 13 bp, D. melanogaster
atttgaatctgaa

SEQ ID NO: 594339 - DNA, 14 bp, D. melanogaster
atttgaatctgaaa

SEQ ID NO: 594340 - DNA, 13 bp, D. melanogaster
atttgaatgaaaa

SEQ ID NO: 594341 - DNA, 13 bp, D. melanogaster
atttgaatgaaga

SEQ ID NO: 594342 - DNA, 13 bp, D. melanogaster
atttgaatgaatt

SEQ ID NO: 594343 - DNA, 13 bp, D. melanogaster
atttgaatgacaa

SEQ ID NO: 594344 - DNA, 13 bp, D. melanogaster
atttgaatgattt

SEQ ID NO: 594345 - DNA, 13 bp, D. melanogaster
atttgaatgcaac

SEQ ID NO: 594346 - DNA, 13 bp, D. melanogaster
atttgaatgccaa

SEQ ID NO: 594347 - DNA, 13 bp, D. melanogaster
atttgaatgccag

SEQ ID NO: 594348 - DNA, 13 bp, D. melanogaster
atttgaatgccca

SEQ ID NO: 594349 - DNA, 13 bp, D. melanogaster
atttgaatgcgaa

SEQ ID NO: 594350 - DNA, 13 bp, D. melanogaster
atttgaatggaaa

SEQ ID NO: 594351 - DNA, 13 bp, D. melanogaster
atttgaatggcat

SEQ ID NO: 594352 - DNA, 13 bp, D. melanogaster
atttgaatggctt

SEQ ID NO: 594353 - DNA, 13 bp, D. melanogaster
atttgaatgggaa

SEQ ID NO: 594354 - DNA, 13 bp, D. melanogaster
atttgaatgtgaa

SEQ ID NO: 594355 - DNA, 13 bp, D. melanogaster
atttgaatgttaa

SEQ ID NO: 594356 - DNA, 14 bp, D. melanogaster
atttgaattcaatt

SEQ ID NO: 594357 - DNA, 13 bp, D. melanogaster
atttgaattccta

SEQ ID NO: 594358 - DNA, 13 bp, D. melanogaster
atttgaattcctt

SEQ ID NO: 594359 - DNA, 13 bp, D. melanogaster
atttgaattcttt

SEQ ID NO: 594360 - DNA, 13 bp, D. melanogaster
atttgaattgcta

SEQ ID NO: 594361 - DNA, 13 bp, D. melanogaster
atttgaattgtaa

SEQ ID NO: 594362 - DNA, 13 bp, D. melanogaster
atttgaatttatg

SEQ ID NO: 594363 - DNA, 13 bp, D. melanogaster
atttgaatttcaa

SEQ ID NO: 594364 - DNA, 14 bp, D. melanogaster
atttgaatttcaaa

SEQ ID NO: 594365 - DNA, 14 bp, D. melanogaster
atttgaatttcaat

SEQ ID NO: 594366 - DNA, 13 bp, D. melanogaster
atttgaatttcat

SEQ ID NO: 594367 - DNA, 14 bp, D. melanogaster
atttgaatttcatt

SEQ ID NO: 594368 - DNA, 13 bp, D. melanogaster
atttgaatttcca

SEQ ID NO: 594369 - DNA, 13 bp, D. melanogaster
atttgaatttccc

SEQ ID NO: 594370 - DNA, 13 bp, D. melanogaster
atttgaatttcgt

SEQ ID NO: 594371 - DNA, 13 bp, D. melanogaster
atttgaatttgaa

SEQ ID NO: 594372 - DNA, 14 bp, D. melanogaster
atttgaatttgaaa

SEQ ID NO: 594373 - DNA, 14 bp, D. melanogaster
atttgaatttgaat

SEQ ID NO: 594374 - DNA, 13 bp, D. melanogaster
atttgaatttgat

SEQ ID NO: 594375 - DNA, 13 bp, D. melanogaster
atttgaatttgga

SEQ ID NO: 594376 - DNA, 13 bp, D. melanogaster
atttgaattttcc

SEQ ID NO: 594377 - DNA, 14 bp, D. melanogaster
atttgaattttccc

SEQ ID NO: 594378 - DNA, 13 bp, D. melanogaster
atttgaatttttc

SEQ ID NO: 594379 - DNA, 13 bp, D. melanogaster
atttgacaaaaaa

SEQ ID NO: 594380 - DNA, 13 bp, D. melanogaster
atttgacaaaata

SEQ ID NO: 594381 - DNA, 13 bp, D. melanogaster
atttgacaaacaa

SEQ ID NO: 594382 - DNA, 13 bp, D. melanogaster
atttgacaccact

SEQ ID NO: 594383 - DNA, 13 bp, D. melanogaster
atttgacatttaa

SEQ ID NO: 594384 - DNA, 13 bp, D. melanogaster
atttgacatttta

SEQ ID NO: 594385 - DNA, 13 bp, D. melanogaster
atttgaccaaaaa

SEQ ID NO: 594386 - DNA, 13 bp, D. melanogaster
atttgacgagcga

SEQ ID NO: 594387 - DNA, 13 bp, D. melanogaster
atttgactaattt

SEQ ID NO: 594388 - DNA, 13 bp, D. melanogaster
atttgactcgact

SEQ ID NO: 594389 - DNA, 13 bp, D. melanogaster
atttgacttaata

SEQ ID NO: 594390 - DNA, 14 bp, D. melanogaster
atttgacttaatat

SEQ ID NO: 594391 - DNA, 13 bp, D. melanogaster
atttgactttgat

SEQ ID NO: 594392 - DNA, 13 bp, D. melanogaster
atttgacttttat

SEQ ID NO: 594393 - DNA, 13 bp, D. melanogaster
atttgagaaaatt

SEQ ID NO: 594394 - DNA, 13 bp, D. melanogaster
atttgagagccag

SEQ ID NO: 594395 - DNA, 13 bp, D. melanogaster
atttgagatttat

SEQ ID NO: 594396 - DNA, 13 bp, D. melanogaster
atttgagcaattt

SEQ ID NO: 594397 - DNA, 13 bp, D. melanogaster
atttgagcacttt

SEQ ID NO: 594398 - DNA, 13 bp, D. melanogaster
atttgagcagcaa

SEQ ID NO: 594399 - DNA, 13 bp, D. melanogaster
atttgagccaaaa

SEQ ID NO: 594400 - DNA, 13 bp, D. melanogaster
atttgaggaattt

SEQ ID NO: 594401 - DNA, 13 bp, D. melanogaster
atttgaggttact

SEQ ID NO: 594402 - DNA, 13 bp, D. melanogaster
atttgagtaattt

SEQ ID NO: 594403 - DNA, 14 bp, D. melanogaster
atttgagtgaaaaa

SEQ ID NO: 594404 - DNA, 13 bp, D. melanogaster
atttgagttgaaa

SEQ ID NO: 594405 - DNA, 13 bp, D. melanogaster
atttgagttgcat

SEQ ID NO: 594406 - DNA, 13 bp, D. melanogaster
atttgagtttaat

SEQ ID NO: 594407 - DNA, 13 bp, D. melanogaster
atttgagtttgag

SEQ ID NO: 594408 - DNA, 13 bp, D. melanogaster
atttgagtttgat

SEQ ID NO: 594409 - DNA, 13 bp, D. melanogaster
atttgataaaaag

SEQ ID NO: 594410 - DNA, 13 bp, D. melanogaster
atttgataaatga

SEQ ID NO: 594411 - DNA, 13 bp, D. melanogaster
atttgataaattc

SEQ ID NO: 594412 - DNA, 13 bp, D. melanogaster
atttgataacaaa

SEQ ID NO: 594413 - DNA, 13 bp, D. melanogaster
atttgataagcaa

SEQ ID NO: 594414 - DNA, 13 bp, D. melanogaster
atttgatacattt

SEQ ID NO: 594415 - DNA, 14 bp, D. melanogaster
atttgatacatttt

SEQ ID NO: 594416 - DNA, 13 bp, D. melanogaster
atttgatactttt

SEQ ID NO: 594417 - DNA, 13 bp, D. melanogaster
atttgatatacat

SEQ ID NO: 594418 - DNA, 13 bp, D. melanogaster
atttgatatgaaa

SEQ ID NO: 594419 - DNA, 13 bp, D. melanogaster
atttgatatgcaa

SEQ ID NO: 594420 - DNA, 13 bp, D. melanogaster
atttgatattcaa

SEQ ID NO: 594421 - DNA, 13 bp, D. melanogaster
atttgatatttcc

SEQ ID NO: 594422 - DNA, 13 bp, D. melanogaster
atttgatatttga

SEQ ID NO: 594423 - DNA, 13 bp, D. melanogaster
atttgatcaaaaa

SEQ ID NO: 594424 - DNA, 13 bp, D. melanogaster
atttgatcaattt

SEQ ID NO: 594425 - DNA, 13 bp, D. melanogaster
atttgatcgattt

SEQ ID NO: 594426 - DNA, 13 bp, D. melanogaster
atttgatgaaaac

SEQ ID NO: 594427 - DNA, 14 bp, D. melanogaster
atttgatgaaaacc

SEQ ID NO: 594428 - DNA, 13 bp, D. melanogaster
atttgatgaaaat

SEQ ID NO: 594429 - DNA, 13 bp, D. melanogaster
atttgatgaaatc

SEQ ID NO: 594430 - DNA, 13 bp, D. melanogaster
atttgatgaattt

SEQ ID NO: 594431 - DNA, 13 bp, D. melanogaster
atttgatggaatt

SEQ ID NO: 594432 - DNA, 13 bp, D. melanogaster
atttgatgggcaa

SEQ ID NO: 594433 - DNA, 13 bp, D. melanogaster
atttgattaaagt

SEQ ID NO: 594434 - DNA, 13 bp, D. melanogaster
atttgattaaatg

SEQ ID NO: 594435 - DNA, 13 bp, D. melanogaster
atttgattaacaa

SEQ ID NO: 594436 - DNA, 13 bp, D. melanogaster
atttgattaactt

SEQ ID NO: 594437 - DNA, 13 bp, D. melanogaster
atttgattaagtt

SEQ ID NO: 594438 - DNA, 13 bp, D. melanogaster
atttgattaccaa

SEQ ID NO: 594439 - DNA, 13 bp, D. melanogaster
atttgattacttt

SEQ ID NO: 594440 - DNA, 13 bp, D. melanogaster
atttgattagatt

SEQ ID NO: 594441 - DNA, 13 bp, D. melanogaster
atttgattagcat

SEQ ID NO: 594442 - DNA, 13 bp, D. melanogaster
atttgattatgaa

SEQ ID NO: 594443 - DNA, 14 bp, D. melanogaster
atttgattattcta

SEQ ID NO: 594444 - DNA, 13 bp, D. melanogaster
atttgattcaaat

SEQ ID NO: 594445 - DNA, 13 bp, D. melanogaster
atttgattcaatt

SEQ ID NO: 594446 - DNA, 13 bp, D. melanogaster
atttgattcattt

SEQ ID NO: 594447 - DNA, 13 bp, D. melanogaster
atttgattcgatt

SEQ ID NO: 594448 - DNA, 14 bp, D. melanogaster
atttgattcgattt

SEQ ID NO: 594449 - DNA, 13 bp, D. melanogaster
atttgattctatt

SEQ ID NO: 594450 - DNA, 13 bp, D. melanogaster
atttgattgaaaa

SEQ ID NO: 594451 - DNA, 13 bp, D. melanogaster
atttgattgaaat

SEQ ID NO: 594452 - DNA, 13 bp, D. melanogaster
atttgattgagtt

SEQ ID NO: 594453 - DNA, 13 bp, D. melanogaster
atttgattgataa

SEQ ID NO: 594454 - DNA, 13 bp, D. melanogaster
atttgattgatgt

SEQ ID NO: 594455 - DNA, 13 bp, D. melanogaster
atttgattgcact

SEQ ID NO: 594456 - DNA, 14 bp, D. melanogaster
atttgattgcattt

SEQ ID NO: 594457 - DNA, 13 bp, D. melanogaster
atttgattgcctt

SEQ ID NO: 594458 - DNA, 13 bp, D. melanogaster
atttgatttatca

SEQ ID NO: 594459 - DNA, 13 bp, D. melanogaster
atttgatttatgc

SEQ ID NO: 594460 - DNA, 14 bp, D. melanogaster
atttgatttcaata

SEQ ID NO: 594461 - DNA, 14 bp, D. melanogaster
atttgatttcaatt

SEQ ID NO: 594462 - DNA, 13 bp, D. melanogaster
atttgatttcatt

SEQ ID NO: 594463 - DNA, 13 bp, D. melanogaster
atttgatttcctt

SEQ ID NO: 594464 - DNA, 13 bp, D. melanogaster
atttgatttcgat

SEQ ID NO: 594465 - DNA, 13 bp, D. melanogaster
atttgatttctct

SEQ ID NO: 594466 - DNA, 13 bp, D. melanogaster
atttgatttctgc

SEQ ID NO: 594467 - DNA, 13 bp, D. melanogaster
atttgatttgaaa

SEQ ID NO: 594468 - DNA, 13 bp, D. melanogaster
atttgatttgcaa

SEQ ID NO: 594469 - DNA, 14 bp, D. melanogaster
atttgatttgcaaa

SEQ ID NO: 594470 - DNA, 13 bp, D. melanogaster
atttgatttgcct

SEQ ID NO: 594471 - DNA, 13 bp, D. melanogaster
atttgatttgctt

SEQ ID NO: 594472 - DNA, 13 bp, D. melanogaster
atttgatttggaa

SEQ ID NO: 594473 - DNA, 13 bp, D. melanogaster
atttgatttggca

SEQ ID NO: 594474 - DNA, 13 bp, D. melanogaster
atttgatttggct

SEQ ID NO: 594475 - DNA, 14 bp, D. melanogaster
atttgatttgggaa

SEQ ID NO: 594476 - DNA, 13 bp, D. melanogaster
atttgatttgtca

SEQ ID NO: 594477 - DNA, 13 bp, D. melanogaster
atttgattttcaa

SEQ ID NO: 594478 - DNA, 13 bp, D. melanogaster
atttgattttcat

SEQ ID NO: 594479 - DNA, 13 bp, D. melanogaster
atttgattttcca

SEQ ID NO: 594480 - DNA, 13 bp, D. melanogaster
atttgattttcta

SEQ ID NO: 594481 - DNA, 13 bp, D. melanogaster
atttgattttctg

SEQ ID NO: 594482 - DNA, 14 bp, D. melanogaster
atttgattttctga

SEQ ID NO: 594483 - DNA, 13 bp, D. melanogaster
atttgattttgca

SEQ ID NO: 594484 - DNA, 13 bp, D. melanogaster
atttgcaaaaaaa

SEQ ID NO: 594485 - DNA, 14 bp, D. melanogaster
atttgcaaaaaaaa

SEQ ID NO: 594486 - DNA, 13 bp, D. melanogaster
atttgcaaaaaac

SEQ ID NO: 594487 - DNA, 13 bp, D. melanogaster
atttgcaaaaaat

SEQ ID NO: 594488 - DNA, 13 bp, D. melanogaster
atttgcaaaacat

SEQ ID NO: 594489 - DNA, 14 bp, D. melanogaster
atttgcaaaagcaa

SEQ ID NO: 594490 - DNA, 13 bp, D. melanogaster
atttgcaaaattg

SEQ ID NO: 594491 - DNA, 13 bp, D. melanogaster
atttgcaaaattt

SEQ ID NO: 594492 - DNA, 13 bp, D. melanogaster
atttgcaaacatt

SEQ ID NO: 594493 - DNA, 13 bp, D. melanogaster
atttgcaaacgca

SEQ ID NO: 594494 - DNA, 13 bp, D. melanogaster
atttgcaaactaa

SEQ ID NO: 594495 - DNA, 13 bp, D. melanogaster
atttgcaaagcca

SEQ ID NO: 594496 - DNA, 13 bp, D. melanogaster
atttgcaaaggaa

SEQ ID NO: 594497 - DNA, 13 bp, D. melanogaster
atttgcaaatatt

SEQ ID NO: 594498 - DNA, 14 bp, D. melanogaster
atttgcaaatattt

SEQ ID NO: 594499 - DNA, 13 bp, D. melanogaster
atttgcaaatgca

SEQ ID NO: 594500 - DNA, 13 bp, D. melanogaster
atttgcaaattaa

SEQ ID NO: 594501 - DNA, 14 bp, D. melanogaster
atttgcaaattgtt

SEQ ID NO: 594502 - DNA, 13 bp, D. melanogaster
atttgcaaattta

SEQ ID NO: 594503 - DNA, 13 bp, D. melanogaster
atttgcaacaaaa

SEQ ID NO: 594504 - DNA, 14 bp, D. melanogaster
atttgcaacaattt

SEQ ID NO: 594505 - DNA, 13 bp, D. melanogaster
atttgcaacacaa

SEQ ID NO: 594506 - DNA, 13 bp, D. melanogaster
atttgcaacagca

SEQ ID NO: 594507 - DNA, 13 bp, D. melanogaster
atttgcaacattt

SEQ ID NO: 594508 - DNA, 14 bp, D. melanogaster
atttgcaacatttt

SEQ ID NO: 594509 - DNA, 13 bp, D. melanogaster
atttgcaactttt

SEQ ID NO: 594510 - DNA, 13 bp, D. melanogaster
atttgcaagcaaa

SEQ ID NO: 594511 - DNA, 13 bp, D. melanogaster
atttgcaagcaat

SEQ ID NO: 594512 - DNA, 13 bp, D. melanogaster
atttgcaaggcaa

SEQ ID NO: 594513 - DNA, 13 bp, D. melanogaster
atttgcaagtttt

SEQ ID NO: 594514 - DNA, 13 bp, D. melanogaster
atttgcaataaaa

SEQ ID NO: 594515 - DNA, 13 bp, D. melanogaster
atttgcaataatt

SEQ ID NO: 594516 - DNA, 13 bp, D. melanogaster
atttgcaatattt

SEQ ID NO: 594517 - DNA, 13 bp, D. melanogaster
atttgcaatcaaa

SEQ ID NO: 594518 - DNA, 13 bp, D. melanogaster
atttgcaatcaat

SEQ ID NO: 594519 - DNA, 13 bp, D. melanogaster
atttgcaatcatt

SEQ ID NO: 594520 - DNA, 13 bp, D. melanogaster
atttgcaatcgca

SEQ ID NO: 594521 - DNA, 13 bp, D. melanogaster
atttgcaatctga

SEQ ID NO: 594522 - DNA, 13 bp, D. melanogaster
atttgcaatgaat

SEQ ID NO: 594523 - DNA, 14 bp, D. melanogaster
atttgcaattaaat

SEQ ID NO: 594524 - DNA, 13 bp, D. melanogaster
atttgcaattaac

SEQ ID NO: 594525 - DNA, 13 bp, D. melanogaster
atttgcaattaat

SEQ ID NO: 594526 - DNA, 14 bp, D. melanogaster
atttgcaattaatt

SEQ ID NO: 594527 - DNA, 13 bp, D. melanogaster
atttgcaattagt

SEQ ID NO: 594528 - DNA, 13 bp, D. melanogaster
atttgcaattatt

SEQ ID NO: 594529 - DNA, 14 bp, D. melanogaster
atttgcaattattt

SEQ ID NO: 594530 - DNA, 13 bp, D. melanogaster
atttgcaattcac

SEQ ID NO: 594531 - DNA, 13 bp, D. melanogaster
atttgcaattcca

SEQ ID NO: 594532 - DNA, 13 bp, D. melanogaster
atttgcaattgaa

SEQ ID NO: 594533 - DNA, 13 bp, D. melanogaster
atttgcaattgca

SEQ ID NO: 594534 - DNA, 13 bp, D. melanogaster
atttgcaattgcc

SEQ ID NO: 594535 - DNA, 13 bp, D. melanogaster
atttgcaattgtt

SEQ ID NO: 594536 - DNA, 13 bp, D. melanogaster
atttgcaatttaa

SEQ ID NO: 594537 - DNA, 13 bp, D. melanogaster
atttgcaatttca

SEQ ID NO: 594538 - DNA, 13 bp, D. melanogaster
atttgcaatttgg

SEQ ID NO: 594539 - DNA, 13 bp, D. melanogaster
atttgcaatttgt

SEQ ID NO: 594540 - DNA, 13 bp, D. melanogaster
atttgcaattttc

SEQ ID NO: 594541 - DNA, 13 bp, D. melanogaster
atttgcaattttt

SEQ ID NO: 594542 - DNA, 13 bp, D. melanogaster
atttgcacaaaaa

SEQ ID NO: 594543 - DNA, 14 bp, D. melanogaster
atttgcacaaaaaa

SEQ ID NO: 594544 - DNA, 13 bp, D. melanogaster
atttgcacaaaat

SEQ ID NO: 594545 - DNA, 13 bp, D. melanogaster
atttgcacaaata

SEQ ID NO: 594546 - DNA, 13 bp, D. melanogaster
atttgcacaaatg

SEQ ID NO: 594547 - DNA, 13 bp, D. melanogaster
atttgcacaacaa

SEQ ID NO: 594548 - DNA, 13 bp, D. melanogaster
atttgcacaactt

SEQ ID NO: 594549 - DNA, 13 bp, D. melanogaster
atttgcacaataa

SEQ ID NO: 594550 - DNA, 13 bp, D. melanogaster
atttgcacaattc

SEQ ID NO: 594551 - DNA, 13 bp, D. melanogaster
atttgcacaattg

SEQ ID NO: 594552 - DNA, 13 bp, D. melanogaster
atttgcacacaaa

SEQ ID NO: 594553 - DNA, 13 bp, D. melanogaster
atttgcacacaca

SEQ ID NO: 594554 - DNA, 13 bp, D. melanogaster
atttgcacagttt

SEQ ID NO: 594555 - DNA, 13 bp, D. melanogaster
atttgcacataaa

SEQ ID NO: 594556 - DNA, 13 bp, D. melanogaster
atttgcacataca

SEQ ID NO: 594557 - DNA, 13 bp, D. melanogaster
atttgcactaatt

SEQ ID NO: 594558 - DNA, 13 bp, D. melanogaster
atttgcactattt

SEQ ID NO: 594559 - DNA, 13 bp, D. melanogaster
atttgcactgcaa

SEQ ID NO: 594560 - DNA, 13 bp, D. melanogaster
atttgcacttcaa

SEQ ID NO: 594561 - DNA, 13 bp, D. melanogaster
atttgcacttcat

SEQ ID NO: 594562 - DNA, 13 bp, D. melanogaster
atttgcactttgc

SEQ ID NO: 594563 - DNA, 13 bp, D. melanogaster
atttgcactttta

SEQ ID NO: 594564 - DNA, 13 bp, D. melanogaster
atttgcacttttg

SEQ ID NO: 594565 - DNA, 13 bp, D. melanogaster
atttgcacttttt

SEQ ID NO: 594566 - DNA, 13 bp, D. melanogaster
atttgcagaaata

SEQ ID NO: 594567 - DNA, 13 bp, D. melanogaster
atttgcagcaaat

SEQ ID NO: 594568 - DNA, 13 bp, D. melanogaster
atttgcagcaaca

SEQ ID NO: 594569 - DNA, 13 bp, D. melanogaster
atttgcagcactt

SEQ ID NO: 594570 - DNA, 13 bp, D. melanogaster
atttgcagcagca

SEQ ID NO: 594571 - DNA, 13 bp, D. melanogaster
atttgcagcattt

SEQ ID NO: 594572 - DNA, 13 bp, D. melanogaster
atttgcagccatt

SEQ ID NO: 594573 - DNA, 13 bp, D. melanogaster
atttgcagctgct

SEQ ID NO: 594574 - DNA, 13 bp, D. melanogaster
atttgcagctgtc

SEQ ID NO: 594575 - DNA, 13 bp, D. melanogaster
atttgcagcttaa

SEQ ID NO: 594576 - DNA, 13 bp, D. melanogaster
atttgcaggcaaa

SEQ ID NO: 594577 - DNA, 13 bp, D. melanogaster
atttgcagtattt

SEQ ID NO: 594578 - DNA, 13 bp, D. melanogaster
atttgcagtgcag

SEQ ID NO: 594579 - DNA, 13 bp, D. melanogaster
atttgcagtttat

SEQ ID NO: 594580 - DNA, 13 bp, D. melanogaster
atttgcagtttgt

SEQ ID NO: 594581 - DNA, 14 bp, D. melanogaster
atttgcataaaaaa

SEQ ID NO: 594582 - DNA, 13 bp, D. melanogaster
atttgcataaaat

SEQ ID NO: 594583 - DNA, 13 bp, D. melanogaster
atttgcataaacg

SEQ ID NO: 594584 - DNA, 13 bp, D. melanogaster
atttgcataaata

SEQ ID NO: 594585 - DNA, 14 bp, D. melanogaster
atttgcataaataa

SEQ ID NO: 594586 - DNA, 13 bp, D. melanogaster
atttgcataaatt

SEQ ID NO: 594587 - DNA, 14 bp, D. melanogaster
atttgcataaatta

SEQ ID NO: 594588 - DNA, 14 bp, D. melanogaster
atttgcataaattg

SEQ ID NO: 594589 - DNA, 14 bp, D. melanogaster
atttgcataacaaa

SEQ ID NO: 594590 - DNA, 13 bp, D. melanogaster
atttgcataactt

SEQ ID NO: 594591 - DNA, 13 bp, D. melanogaster
atttgcataagaa

SEQ ID NO: 594592 - DNA, 13 bp, D. melanogaster
atttgcataagca

SEQ ID NO: 594593 - DNA, 13 bp, D. melanogaster
atttgcataagtt

SEQ ID NO: 594594 - DNA, 13 bp, D. melanogaster
atttgcataatgc

SEQ ID NO: 594595 - DNA, 13 bp, D. melanogaster
atttgcataatta

SEQ ID NO: 594596 - DNA, 14 bp, D. melanogaster
atttgcataattga

SEQ ID NO: 594597 - DNA, 13 bp, D. melanogaster
atttgcataattt

SEQ ID NO: 594598 - DNA, 14 bp, D. melanogaster
atttgcatacaaat

SEQ ID NO: 594599 - DNA, 13 bp, D. melanogaster
atttgcatacaca

SEQ ID NO: 594600 - DNA, 13 bp, D. melanogaster
atttgcatacact

SEQ ID NO: 594601 - DNA, 13 bp, D. melanogaster
atttgcataccaa

SEQ ID NO: 594602 - DNA, 13 bp, D. melanogaster
atttgcatacgct

SEQ ID NO: 594603 - DNA, 13 bp, D. melanogaster
atttgcatacgta

SEQ ID NO: 594604 - DNA, 13 bp, D. melanogaster
atttgcatagaat

SEQ ID NO: 594605 - DNA, 13 bp, D. melanogaster
atttgcatagaca

SEQ ID NO: 594606 - DNA, 13 bp, D. melanogaster
atttgcatagatt

SEQ ID NO: 594607 - DNA, 13 bp, D. melanogaster
atttgcataggaa

SEQ ID NO: 594608 - DNA, 13 bp, D. melanogaster
atttgcatataaa

SEQ ID NO: 594609 - DNA, 14 bp, D. melanogaster
atttgcatataaaa

SEQ ID NO: 594610 - DNA, 14 bp, D. melanogaster
atttgcatataaat

SEQ ID NO: 594611 - DNA, 13 bp, D. melanogaster
atttgcatatact

SEQ ID NO: 594612 - DNA, 14 bp, D. melanogaster
atttgcatatcaat

SEQ ID NO: 594613 - DNA, 13 bp, D. melanogaster
atttgcatatcca

SEQ ID NO: 594614 - DNA, 13 bp, D. melanogaster
atttgcatatgca

SEQ ID NO: 594615 - DNA, 14 bp, D. melanogaster
atttgcatatgcca

SEQ ID NO: 594616 - DNA, 13 bp, D. melanogaster
atttgcatatgcg

SEQ ID NO: 594617 - DNA, 13 bp, D. melanogaster
atttgcatatgga

SEQ ID NO: 594618 - DNA, 13 bp, D. melanogaster
atttgcatattta

SEQ ID NO: 594619 - DNA, 14 bp, D. melanogaster
atttgcatatttat

SEQ ID NO: 594620 - DNA, 13 bp, D. melanogaster
atttgcatatttc

SEQ ID NO: 594621 - DNA, 14 bp, D. melanogaster
atttgcatatttca

SEQ ID NO: 594622 - DNA, 13 bp, D. melanogaster
atttgcatatttt

SEQ ID NO: 594623 - DNA, 14 bp, D. melanogaster
atttgcatattttg

SEQ ID NO: 594624 - DNA, 14 bp, D. melanogaster
atttgcatattttt

SEQ ID NO: 594625 - DNA, 13 bp, D. melanogaster
atttgcatcattt

SEQ ID NO: 594626 - DNA, 13 bp, D. melanogaster
atttgcatcgatt

SEQ ID NO: 594627 - DNA, 13 bp, D. melanogaster
atttgcatctgaa

SEQ ID NO: 594628 - DNA, 13 bp, D. melanogaster
atttgcatctgca

SEQ ID NO: 594629 - DNA, 14 bp, D. melanogaster
atttgcatctgcaa

SEQ ID NO: 594630 - DNA, 13 bp, D. melanogaster
atttgcatctttt

SEQ ID NO: 594631 - DNA, 13 bp, D. melanogaster
atttgcatgaaat

SEQ ID NO: 594632 - DNA, 13 bp, D. melanogaster
atttgcatgcaac

SEQ ID NO: 594633 - DNA, 13 bp, D. melanogaster
atttgcatgcatt

SEQ ID NO: 594634 - DNA, 13 bp, D. melanogaster
atttgcatgccaa

SEQ ID NO: 594635 - DNA, 13 bp, D. melanogaster
atttgcatgcgaa

SEQ ID NO: 594636 - DNA, 13 bp, D. melanogaster
atttgcatgcgat

SEQ ID NO: 594637 - DNA, 13 bp, D. melanogaster
atttgcatgctaa

SEQ ID NO: 594638 - DNA, 13 bp, D. melanogaster
atttgcatggcaa

SEQ ID NO: 594639 - DNA, 14 bp, D. melanogaster
atttgcatggcaat

SEQ ID NO: 594640 - DNA, 13 bp, D. melanogaster
atttgcatggcca

SEQ ID NO: 594641 - DNA, 13 bp, D. melanogaster
atttgcatggcta

SEQ ID NO: 594642 - DNA, 13 bp, D. melanogaster
atttgcatgtaaa

SEQ ID NO: 594643 - DNA, 13 bp, D. melanogaster
atttgcatgtgca

SEQ ID NO: 594644 - DNA, 13 bp, D. melanogaster
atttgcatgtggc

SEQ ID NO: 594645 - DNA, 13 bp, D. melanogaster
atttgcatgtttt

SEQ ID NO: 594646 - DNA, 14 bp, D. melanogaster
atttgcatgttttt

SEQ ID NO: 594647 - DNA, 13 bp, D. melanogaster
atttgcattaaaa

SEQ ID NO: 594648 - DNA, 14 bp, D. melanogaster
atttgcattaaaat

SEQ ID NO: 594649 - DNA, 13 bp, D. melanogaster
atttgcattaaat

SEQ ID NO: 594650 - DNA, 13 bp, D. melanogaster
atttgcattaaca

SEQ ID NO: 594651 - DNA, 13 bp, D. melanogaster
atttgcattaatt

SEQ ID NO: 594652 - DNA, 13 bp, D. melanogaster
atttgcattactt

SEQ ID NO: 594653 - DNA, 13 bp, D. melanogaster
atttgcattagca

SEQ ID NO: 594654 - DNA, 13 bp, D. melanogaster
atttgcattataa

SEQ ID NO: 594655 - DNA, 13 bp, D. melanogaster
atttgcattatgc

SEQ ID NO: 594656 - DNA, 13 bp, D. melanogaster
atttgcattattt

SEQ ID NO: 594657 - DNA, 14 bp, D. melanogaster
atttgcattattta

SEQ ID NO: 594658 - DNA, 14 bp, D. melanogaster
atttgcattcaaat

SEQ ID NO: 594659 - DNA, 13 bp, D. melanogaster
atttgcattcatt

SEQ ID NO: 594660 - DNA, 14 bp, D. melanogaster
atttgcattcattt

SEQ ID NO: 594661 - DNA, 13 bp, D. melanogaster
atttgcattcctt

SEQ ID NO: 594662 - DNA, 13 bp, D. melanogaster
atttgcattcgca

SEQ ID NO: 594663 - DNA, 13 bp, D. melanogaster
atttgcattcgcc

SEQ ID NO: 594664 - DNA, 13 bp, D. melanogaster
atttgcattcgct

SEQ ID NO: 594665 - DNA, 13 bp, D. melanogaster
atttgcattgaaa

SEQ ID NO: 594666 - DNA, 14 bp, D. melanogaster
atttgcattgaaaa

SEQ ID NO: 594667 - DNA, 13 bp, D. melanogaster
atttgcattgaat

SEQ ID NO: 594668 - DNA, 13 bp, D. melanogaster
atttgcattgatt

SEQ ID NO: 594669 - DNA, 13 bp, D. melanogaster
atttgcattgcaa

SEQ ID NO: 594670 - DNA, 14 bp, D. melanogaster
atttgcattgcatt

SEQ ID NO: 594671 - DNA, 13 bp, D. melanogaster
atttgcattgcca

SEQ ID NO: 594672 - DNA, 13 bp, D. melanogaster
atttgcattgtgc

SEQ ID NO: 594673 - DNA, 13 bp, D. melanogaster
atttgcattgttt

SEQ ID NO: 594674 - DNA, 14 bp, D. melanogaster
atttgcattgtttg

SEQ ID NO: 594675 - DNA, 13 bp, D. melanogaster
atttgcatttaaa

SEQ ID NO: 594676 - DNA, 14 bp, D. melanogaster
atttgcatttaaaa

SEQ ID NO: 594677 - DNA, 13 bp, D. melanogaster
atttgcatttaac

SEQ ID NO: 594678 - DNA, 13 bp, D. melanogaster
atttgcatttaag

SEQ ID NO: 594679 - DNA, 13 bp, D. melanogaster
atttgcatttaat

SEQ ID NO: 594680 - DNA, 14 bp, D. melanogaster
atttgcatttacat

SEQ ID NO: 594681 - DNA, 14 bp, D. melanogaster
atttgcatttatat

SEQ ID NO: 594682 - DNA, 13 bp, D. melanogaster
atttgcatttcaa

SEQ ID NO: 594683 - DNA, 14 bp, D. melanogaster
atttgcatttcaaa

SEQ ID NO: 594684 - DNA, 13 bp, D. melanogaster
atttgcatttccc

SEQ ID NO: 594685 - DNA, 14 bp, D. melanogaster
atttgcatttccca

SEQ ID NO: 594686 - DNA, 13 bp, D. melanogaster
atttgcatttcga

SEQ ID NO: 594687 - DNA, 13 bp, D. melanogaster
atttgcatttcgg

SEQ ID NO: 594688 - DNA, 13 bp, D. melanogaster
atttgcatttgac

SEQ ID NO: 594689 - DNA, 13 bp, D. melanogaster
atttgcatttgag

SEQ ID NO: 594690 - DNA, 14 bp, D. melanogaster
atttgcatttgatt

SEQ ID NO: 594691 - DNA, 14 bp, D. melanogaster
atttgcatttgcat

SEQ ID NO: 594692 - DNA, 13 bp, D. melanogaster
atttgcatttgcc

SEQ ID NO: 594693 - DNA, 14 bp, D. melanogaster
atttgcatttgcca

SEQ ID NO: 594694 - DNA, 13 bp, D. melanogaster
atttgcatttgct

SEQ ID NO: 594695 - DNA, 14 bp, D. melanogaster
atttgcatttgctt

SEQ ID NO: 594696 - DNA, 13 bp, D. melanogaster
atttgcattttac

SEQ ID NO: 594697 - DNA, 13 bp, D. melanogaster
atttgcattttag

SEQ ID NO: 594698 - DNA, 13 bp, D. melanogaster
atttgcattttcc

SEQ ID NO: 594699 - DNA, 13 bp, D. melanogaster
atttgcattttcg

SEQ ID NO: 594700 - DNA, 13 bp, D. melanogaster
atttgcattttga

SEQ ID NO: 594701 - DNA, 14 bp, D. melanogaster
atttgcattttgca

SEQ ID NO: 594702 - DNA, 13 bp, D. melanogaster
atttgcattttta

SEQ ID NO: 594703 - DNA, 14 bp, D. melanogaster
atttgcatttttaa

SEQ ID NO: 594704 - DNA, 13 bp, D. melanogaster
atttgccaaaaaa

SEQ ID NO: 594705 - DNA, 14 bp, D. melanogaster
atttgccaaaaaac

SEQ ID NO: 594706 - DNA, 13 bp, D. melanogaster
atttgccaaaaat

SEQ ID NO: 594707 - DNA, 13 bp, D. melanogaster
atttgccaaacaa

SEQ ID NO: 594708 - DNA, 13 bp, D. melanogaster
atttgccaaagaa

SEQ ID NO: 594709 - DNA, 13 bp, D. melanogaster
atttgccaaagga

SEQ ID NO: 594710 - DNA, 13 bp, D. melanogaster
atttgccaaataa

SEQ ID NO: 594711 - DNA, 14 bp, D. melanogaster
atttgccaaataaa

SEQ ID NO: 594712 - DNA, 13 bp, D. melanogaster
atttgccaaatgg

SEQ ID NO: 594713 - DNA, 13 bp, D. melanogaster
atttgccaaatgt

SEQ ID NO: 594714 - DNA, 13 bp, D. melanogaster
atttgccaaattt

SEQ ID NO: 594715 - DNA, 13 bp, D. melanogaster
atttgccaacaat

SEQ ID NO: 594716 - DNA, 13 bp, D. melanogaster
atttgccaacatt

SEQ ID NO: 594717 - DNA, 14 bp, D. melanogaster
atttgccaacattt

SEQ ID NO: 594718 - DNA, 13 bp, D. melanogaster
atttgccaacttt

SEQ ID NO: 594719 - DNA, 13 bp, D. melanogaster
atttgccaatttg

SEQ ID NO: 594720 - DNA, 13 bp, D. melanogaster
atttgccaatttt

SEQ ID NO: 594721 - DNA, 13 bp, D. melanogaster
atttgccacaaaa

SEQ ID NO: 594722 - DNA, 13 bp, D. melanogaster
atttgccacacaa

SEQ ID NO: 594723 - DNA, 13 bp, D. melanogaster
atttgccacatta

SEQ ID NO: 594724 - DNA, 13 bp, D. melanogaster
atttgccacattt

SEQ ID NO: 594725 - DNA, 13 bp, D. melanogaster
atttgccaccgcc

SEQ ID NO: 594726 - DNA, 13 bp, D. melanogaster
atttgccagattt

SEQ ID NO: 594727 - DNA, 13 bp, D. melanogaster
atttgccagcaaa

SEQ ID NO: 594728 - DNA, 13 bp, D. melanogaster
atttgccagcaat

SEQ ID NO: 594729 - DNA, 13 bp, D. melanogaster
atttgccagccaa

SEQ ID NO: 594730 - DNA, 13 bp, D. melanogaster
atttgccagccat

SEQ ID NO: 594731 - DNA, 13 bp, D. melanogaster
atttgccagctga

SEQ ID NO: 594732 - DNA, 13 bp, D. melanogaster
atttgccaggcaa

SEQ ID NO: 594733 - DNA, 13 bp, D. melanogaster
atttgccagttcc

SEQ ID NO: 594734 - DNA, 13 bp, D. melanogaster
atttgccagttgc

SEQ ID NO: 594735 - DNA, 13 bp, D. melanogaster
atttgccataatt

SEQ ID NO: 594736 - DNA, 13 bp, D. melanogaster
atttgccatattt

SEQ ID NO: 594737 - DNA, 13 bp, D. melanogaster
atttgccatcaat

SEQ ID NO: 594738 - DNA, 13 bp, D. melanogaster
atttgccatcaca

SEQ ID NO: 594739 - DNA, 13 bp, D. melanogaster
atttgccattgtt

SEQ ID NO: 594740 - DNA, 13 bp, D. melanogaster
atttgccatttca

SEQ ID NO: 594741 - DNA, 13 bp, D. melanogaster
atttgccatttcc

SEQ ID NO: 594742 - DNA, 13 bp, D. melanogaster
atttgccatttgc

SEQ ID NO: 594743 - DNA, 14 bp, D. melanogaster
atttgccatttgct

SEQ ID NO: 594744 - DNA, 13 bp, D. melanogaster
atttgccatttgt

SEQ ID NO: 594745 - DNA, 14 bp, D. melanogaster
atttgccatttgtt

SEQ ID NO: 594746 - DNA, 13 bp, D. melanogaster
atttgcccaaaaa

SEQ ID NO: 594747 - DNA, 13 bp, D. melanogaster
atttgcccaaatt

SEQ ID NO: 594748 - DNA, 13 bp, D. melanogaster
atttgcccgaaaa

SEQ ID NO: 594749 - DNA, 13 bp, D. melanogaster
atttgccgaaaaa

SEQ ID NO: 594750 - DNA, 13 bp, D. melanogaster
atttgccgacgat

SEQ ID NO: 594751 - DNA, 13 bp, D. melanogaster
atttgccgcattt

SEQ ID NO: 594752 - DNA, 13 bp, D. melanogaster
atttgcctataaa

SEQ ID NO: 594753 - DNA, 13 bp, D. melanogaster
atttgcctcttcg

SEQ ID NO: 594754 - DNA, 13 bp, D. melanogaster
atttgcctgccat

SEQ ID NO: 594755 - DNA, 13 bp, D. melanogaster
atttgcctggcca

SEQ ID NO: 594756 - DNA, 13 bp, D. melanogaster
atttgcctggctt

SEQ ID NO: 594757 - DNA, 13 bp, D. melanogaster
atttgccttgcca

SEQ ID NO: 594758 - DNA, 13 bp, D. melanogaster
atttgccttgcga

SEQ ID NO: 594759 - DNA, 13 bp, D. melanogaster
atttgccttggcc

SEQ ID NO: 594760 - DNA, 13 bp, D. melanogaster
atttgccttttgt

SEQ ID NO: 594761 - DNA, 13 bp, D. melanogaster
atttgccttttta

SEQ ID NO: 594762 - DNA, 13 bp, D. melanogaster
atttgcgaaaaat

SEQ ID NO: 594763 - DNA, 13 bp, D. melanogaster
atttgcgaaatta

SEQ ID NO: 594764 - DNA, 13 bp, D. melanogaster
atttgcgaactgc

SEQ ID NO: 594765 - DNA, 13 bp, D. melanogaster
atttgcgagcagt

SEQ ID NO: 594766 - DNA, 13 bp, D. melanogaster
atttgcgatttaa

SEQ ID NO: 594767 - DNA, 13 bp, D. melanogaster
atttgcgcaattt

SEQ ID NO: 594768 - DNA, 13 bp, D. melanogaster
atttgcgcataaa

SEQ ID NO: 594769 - DNA, 13 bp, D. melanogaster
atttgcgcatttt

SEQ ID NO: 594770 - DNA, 13 bp, D. melanogaster
atttgcggaaaat

SEQ ID NO: 594771 - DNA, 13 bp, D. melanogaster
atttgcggcaaat

SEQ ID NO: 594772 - DNA, 13 bp, D. melanogaster
atttgcggcaatt

SEQ ID NO: 594773 - DNA, 13 bp, D. melanogaster
atttgcgtaaata

SEQ ID NO: 594774 - DNA, 13 bp, D. melanogaster
atttgcgtgtgtg

SEQ ID NO: 594775 - DNA, 13 bp, D. melanogaster
atttgcgttattt

SEQ ID NO: 594776 - DNA, 13 bp, D. melanogaster
atttgcgttccac

SEQ ID NO: 594777 - DNA, 13 bp, D. melanogaster
atttgcgttgatt

SEQ ID NO: 594778 - DNA, 14 bp, D. melanogaster
atttgcgttgtata

SEQ ID NO: 594779 - DNA, 13 bp, D. melanogaster
atttgcgtttaat

SEQ ID NO: 594780 - DNA, 14 bp, D. melanogaster
atttgcgtttaatt

SEQ ID NO: 594781 - DNA, 13 bp, D. melanogaster
atttgcgtttgtg

SEQ ID NO: 594782 - DNA, 13 bp, D. melanogaster
atttgctaacgtt

SEQ ID NO: 594783 - DNA, 13 bp, D. melanogaster
atttgctaataaa

SEQ ID NO: 594784 - DNA, 13 bp, D. melanogaster
atttgctaattgc

SEQ ID NO: 594785 - DNA, 13 bp, D. melanogaster
atttgctacattt

SEQ ID NO: 594786 - DNA, 13 bp, D. melanogaster
atttgctatatat

SEQ ID NO: 594787 - DNA, 13 bp, D. melanogaster
atttgctatttac

SEQ ID NO: 594788 - DNA, 13 bp, D. melanogaster
atttgctatttgc

SEQ ID NO: 594789 - DNA, 13 bp, D. melanogaster
atttgctatttta

SEQ ID NO: 594790 - DNA, 13 bp, D. melanogaster
atttgctattttc

SEQ ID NO: 594791 - DNA, 13 bp, D. melanogaster
atttgctcaagtg

SEQ ID NO: 594792 - DNA, 13 bp, D. melanogaster
atttgctcattaa

SEQ ID NO: 594793 - DNA, 13 bp, D. melanogaster
atttgctcattta

SEQ ID NO: 594794 - DNA, 13 bp, D. melanogaster
atttgctgaattt

SEQ ID NO: 594795 - DNA, 13 bp, D. melanogaster
atttgctgcaatt

SEQ ID NO: 594796 - DNA, 13 bp, D. melanogaster
atttgctgcagca

SEQ ID NO: 594797 - DNA, 13 bp, D. melanogaster
atttgctgcagtt

SEQ ID NO: 594798 - DNA, 13 bp, D. melanogaster
atttgctgcattt

SEQ ID NO: 594799 - DNA, 13 bp, D. melanogaster
atttgctgccaat

SEQ ID NO: 594800 - DNA, 13 bp, D. melanogaster
atttgctgccatt

SEQ ID NO: 594801 - DNA, 13 bp, D. melanogaster
atttgctgcgagg

SEQ ID NO: 594802 - DNA, 13 bp, D. melanogaster
atttgctgctggc

SEQ ID NO: 594803 - DNA, 13 bp, D. melanogaster
atttgctggcaaa

SEQ ID NO: 594804 - DNA, 13 bp, D. melanogaster
atttgctggccaa

SEQ ID NO: 594805 - DNA, 13 bp, D. melanogaster
atttgctgggaaa

SEQ ID NO: 594806 - DNA, 13 bp, D. melanogaster
atttgctgtaaat

SEQ ID NO: 594807 - DNA, 13 bp, D. melanogaster
atttgctgtcatt

SEQ ID NO: 594808 - DNA, 13 bp, D. melanogaster
atttgctgtttaa

SEQ ID NO: 594809 - DNA, 13 bp, D. melanogaster
atttgctgtttac

SEQ ID NO: 594810 - DNA, 13 bp, D. melanogaster
atttgcttaaaat

SEQ ID NO: 594811 - DNA, 13 bp, D. melanogaster
atttgcttaaatt

SEQ ID NO: 594812 - DNA, 13 bp, D. melanogaster
atttgcttaatta

SEQ ID NO: 594813 - DNA, 13 bp, D. melanogaster
atttgcttacaaa

SEQ ID NO: 594814 - DNA, 13 bp, D. melanogaster
atttgcttatatt

SEQ ID NO: 594815 - DNA, 13 bp, D. melanogaster
atttgcttatcaa

SEQ ID NO: 594816 - DNA, 14 bp, D. melanogaster
atttgcttattgga

SEQ ID NO: 594817 - DNA, 13 bp, D. melanogaster
atttgcttcgttt

SEQ ID NO: 594818 - DNA, 14 bp, D. melanogaster
atttgcttctttaa

SEQ ID NO: 594819 - DNA, 13 bp, D. melanogaster
atttgcttctttc

SEQ ID NO: 594820 - DNA, 13 bp, D. melanogaster
atttgcttgattt

SEQ ID NO: 594821 - DNA, 13 bp, D. melanogaster
atttgcttgccaa

SEQ ID NO: 594822 - DNA, 13 bp, D. melanogaster
atttgcttgccat

SEQ ID NO: 594823 - DNA, 13 bp, D. melanogaster
atttgcttgcctt

SEQ ID NO: 594824 - DNA, 13 bp, D. melanogaster
atttgcttgcttg

SEQ ID NO: 594825 - DNA, 13 bp, D. melanogaster
atttgcttggcaa

SEQ ID NO: 594826 - DNA, 13 bp, D. melanogaster
atttgcttggctg

SEQ ID NO: 594827 - DNA, 13 bp, D. melanogaster
atttgctttataa

SEQ ID NO: 594828 - DNA, 13 bp, D. melanogaster
atttgctttcaat

SEQ ID NO: 594829 - DNA, 14 bp, D. melanogaster
atttgctttcaatt

SEQ ID NO: 594830 - DNA, 13 bp, D. melanogaster
atttgctttcatt

SEQ ID NO: 594831 - DNA, 13 bp, D. melanogaster
atttgctttgaat

SEQ ID NO: 594832 - DNA, 13 bp, D. melanogaster
atttgctttggca

SEQ ID NO: 594833 - DNA, 13 bp, D. melanogaster
atttgcttttaat

SEQ ID NO: 594834 - DNA, 13 bp, D. melanogaster
atttgcttttcaa

SEQ ID NO: 594835 - DNA, 14 bp, D. melanogaster
atttgcttttcatt

SEQ ID NO: 594836 - DNA, 14 bp, D. melanogaster
atttgcttttgatt

SEQ ID NO: 594837 - DNA, 13 bp, D. melanogaster
atttgcttttggg

SEQ ID NO: 594838 - DNA, 13 bp, D. melanogaster
atttgctttttaa

SEQ ID NO: 594839 - DNA, 13 bp, D. melanogaster
atttggaaaaatc

SEQ ID NO: 594840 - DNA, 13 bp, D. melanogaster
atttggaaaaatt

SEQ ID NO: 594841 - DNA, 13 bp, D. melanogaster
atttggaaaacaa

SEQ ID NO: 594842 - DNA, 13 bp, D. melanogaster
atttggaaaacat

SEQ ID NO: 594843 - DNA, 13 bp, D. melanogaster
atttggaaaactt

SEQ ID NO: 594844 - DNA, 13 bp, D. melanogaster
atttggaaaagat

SEQ ID NO: 594845 - DNA, 13 bp, D. melanogaster
atttggaaaagtt

SEQ ID NO: 594846 - DNA, 14 bp, D. melanogaster
atttggaaaatatt

SEQ ID NO: 594847 - DNA, 13 bp, D. melanogaster
atttggaaaatga

SEQ ID NO: 594848 - DNA, 13 bp, D. melanogaster
atttggaaaatta

SEQ ID NO: 594849 - DNA, 13 bp, D. melanogaster
atttggaaaattt

SEQ ID NO: 594850 - DNA, 13 bp, D. melanogaster
atttggaaacaaa

SEQ ID NO: 594851 - DNA, 13 bp, D. melanogaster
atttggaaacatt

SEQ ID NO: 594852 - DNA, 13 bp, D. melanogaster
atttggaaagcaa

SEQ ID NO: 594853 - DNA, 13 bp, D. melanogaster
atttggaaataat

SEQ ID NO: 594854 - DNA, 13 bp, D. melanogaster
atttggaaatatc

SEQ ID NO: 594855 - DNA, 13 bp, D. melanogaster
atttggaaatggc

SEQ ID NO: 594856 - DNA, 13 bp, D. melanogaster
atttggaaattaa

SEQ ID NO: 594857 - DNA, 13 bp, D. melanogaster
atttggaaattca

SEQ ID NO: 594858 - DNA, 13 bp, D. melanogaster
atttggaaattgt

SEQ ID NO: 594859 - DNA, 13 bp, D. melanogaster
atttggaaattta

SEQ ID NO: 594860 - DNA, 13 bp, D. melanogaster
atttggaagatta

SEQ ID NO: 594861 - DNA, 13 bp, D. melanogaster
atttggaagccaa

SEQ ID NO: 594862 - DNA, 13 bp, D. melanogaster
atttggaagttgt

SEQ ID NO: 594863 - DNA, 13 bp, D. melanogaster
atttggaataaaa

SEQ ID NO: 594864 - DNA, 13 bp, D. melanogaster
atttggaatgttt

SEQ ID NO: 594865 - DNA, 14 bp, D. melanogaster
atttggaattggat

SEQ ID NO: 594866 - DNA, 13 bp, D. melanogaster
atttggaatttct

SEQ ID NO: 594867 - DNA, 13 bp, D. melanogaster
atttggaatttgt

SEQ ID NO: 594868 - DNA, 13 bp, D. melanogaster
atttggaatttta

SEQ ID NO: 594869 - DNA, 13 bp, D. melanogaster
atttggacaaaaa

SEQ ID NO: 594870 - DNA, 13 bp, D. melanogaster
atttggacaaatt

SEQ ID NO: 594871 - DNA, 13 bp, D. melanogaster
atttggacatttt

SEQ ID NO: 594872 - DNA, 13 bp, D. melanogaster
atttggaccatta

SEQ ID NO: 594873 - DNA, 13 bp, D. melanogaster
atttggagcattt

SEQ ID NO: 594874 - DNA, 13 bp, D. melanogaster
atttggatcatta

SEQ ID NO: 594875 - DNA, 13 bp, D. melanogaster
atttggatgaatt

SEQ ID NO: 594876 - DNA, 13 bp, D. melanogaster
atttggattaatt

SEQ ID NO: 594877 - DNA, 13 bp, D. melanogaster
atttggattggat

SEQ ID NO: 594878 - DNA, 13 bp, D. melanogaster
atttggatttcga

SEQ ID NO: 594879 - DNA, 14 bp, D. melanogaster
atttggatttgaat

SEQ ID NO: 594880 - DNA, 13 bp, D. melanogaster
atttggatttgga

SEQ ID NO: 594881 - DNA, 13 bp, D. melanogaster
atttggatttggt

SEQ ID NO: 594882 - DNA, 13 bp, D. melanogaster
atttggattttgg

SEQ ID NO: 594883 - DNA, 13 bp, D. melanogaster
atttggcaaaaat

SEQ ID NO: 594884 - DNA, 13 bp, D. melanogaster
atttggcaaacag

SEQ ID NO: 594885 - DNA, 13 bp, D. melanogaster
atttggcaaattc

SEQ ID NO: 594886 - DNA, 13 bp, D. melanogaster
atttggcaaattg

SEQ ID NO: 594887 - DNA, 13 bp, D. melanogaster
atttggcaagaaa

SEQ ID NO: 594888 - DNA, 13 bp, D. melanogaster
atttggcaagcaa

SEQ ID NO: 594889 - DNA, 13 bp, D. melanogaster
atttggcaattga

SEQ ID NO: 594890 - DNA, 13 bp, D. melanogaster
atttggcaattgg

SEQ ID NO: 594891 - DNA, 13 bp, D. melanogaster
atttggcacacac

SEQ ID NO: 594892 - DNA, 13 bp, D. melanogaster
atttggcacttaa

SEQ ID NO: 594893 - DNA, 13 bp, D. melanogaster
atttggcagacta

SEQ ID NO: 594894 - DNA, 13 bp, D. melanogaster
atttggcatgcaa

SEQ ID NO: 594895 - DNA, 13 bp, D. melanogaster
atttggcattata

SEQ ID NO: 594896 - DNA, 13 bp, D. melanogaster
atttggcattcaa

SEQ ID NO: 594897 - DNA, 13 bp, D. melanogaster
atttggcattgcc

SEQ ID NO: 594898 - DNA, 13 bp, D. melanogaster
atttggcattgct

SEQ ID NO: 594899 - DNA, 13 bp, D. melanogaster
atttggcattgtc

SEQ ID NO: 594900 - DNA, 13 bp, D. melanogaster
atttggcatttgg

SEQ ID NO: 594901 - DNA, 14 bp, D. melanogaster
atttggcatttggc

SEQ ID NO: 594902 - DNA, 13 bp, D. melanogaster
atttggcattttg

SEQ ID NO: 594903 - DNA, 13 bp, D. melanogaster
atttggcattttt

SEQ ID NO: 594904 - DNA, 13 bp, D. melanogaster
atttggccaaaaa

SEQ ID NO: 594905 - DNA, 14 bp, D. melanogaster
atttggccaaaagc

SEQ ID NO: 594906 - DNA, 14 bp, D. melanogaster
atttggccaaaatg

SEQ ID NO: 594907 - DNA, 13 bp, D. melanogaster
atttggccaaaca

SEQ ID NO: 594908 - DNA, 13 bp, D. melanogaster
atttggccaaagc

SEQ ID NO: 594909 - DNA, 13 bp, D. melanogaster
atttggccaaatc

SEQ ID NO: 594910 - DNA, 13 bp, D. melanogaster
atttggccaaatg

SEQ ID NO: 594911 - DNA, 13 bp, D. melanogaster
atttggccaacac

SEQ ID NO: 594912 - DNA, 13 bp, D. melanogaster
atttggccaacat

SEQ ID NO: 594913 - DNA, 13 bp, D. melanogaster
atttggccaagtg

SEQ ID NO: 594914 - DNA, 13 bp, D. melanogaster
atttggccaatta

SEQ ID NO: 594915 - DNA, 13 bp, D. melanogaster
atttggccagaaa

SEQ ID NO: 594916 - DNA, 13 bp, D. melanogaster
atttggccagcaa

SEQ ID NO: 594917 - DNA, 13 bp, D. melanogaster
atttggccagctg

SEQ ID NO: 594918 - DNA, 13 bp, D. melanogaster
atttggccagttt

SEQ ID NO: 594919 - DNA, 13 bp, D. melanogaster
atttggccatatt

SEQ ID NO: 594920 - DNA, 13 bp, D. melanogaster
atttggccatgtc

SEQ ID NO: 594921 - DNA, 13 bp, D. melanogaster
atttggccatgtt

SEQ ID NO: 594922 - DNA, 13 bp, D. melanogaster
atttggccatttg

SEQ ID NO: 594923 - DNA, 13 bp, D. melanogaster
atttggcccactc

SEQ ID NO: 594924 - DNA, 13 bp, D. melanogaster
atttggcggttaa

SEQ ID NO: 594925 - DNA, 14 bp, D. melanogaster
atttggcggttaaa

SEQ ID NO: 594926 - DNA, 13 bp, D. melanogaster
atttggctaaaac

SEQ ID NO: 594927 - DNA, 13 bp, D. melanogaster
atttggctaaatt

SEQ ID NO: 594928 - DNA, 13 bp, D. melanogaster
atttggctaacaa

SEQ ID NO: 594929 - DNA, 13 bp, D. melanogaster
atttggctaccag

SEQ ID NO: 594930 - DNA, 13 bp, D. melanogaster
atttggctataaa

SEQ ID NO: 594931 - DNA, 13 bp, D. melanogaster
atttggctatttc

SEQ ID NO: 594932 - DNA, 13 bp, D. melanogaster
atttggctgatat

SEQ ID NO: 594933 - DNA, 13 bp, D. melanogaster
atttggctgcaat

SEQ ID NO: 594934 - DNA, 13 bp, D. melanogaster
atttggcttacaa

SEQ ID NO: 594935 - DNA, 13 bp, D. melanogaster
atttggcttctat

SEQ ID NO: 594936 - DNA, 14 bp, D. melanogaster
atttggcttgttgt

SEQ ID NO: 594937 - DNA, 13 bp, D. melanogaster
atttggctttgat

SEQ ID NO: 594938 - DNA, 13 bp, D. melanogaster
atttggctttgcc

SEQ ID NO: 594939 - DNA, 13 bp, D. melanogaster
atttggcttttgt

SEQ ID NO: 594940 - DNA, 13 bp, D. melanogaster
atttgggaaaaaa

SEQ ID NO: 594941 - DNA, 13 bp, D. melanogaster
atttgggaaaaat

SEQ ID NO: 594942 - DNA, 14 bp, D. melanogaster
atttgggaattcta

SEQ ID NO: 594943 - DNA, 13 bp, D. melanogaster
atttgggacatcg

SEQ ID NO: 594944 - DNA, 13 bp, D. melanogaster
atttgggatttta

SEQ ID NO: 594945 - DNA, 16 bp, D. melanogaster
atttgggattttacac

SEQ ID NO: 594946 - DNA, 13 bp, D. melanogaster
atttgggcaaaca

SEQ ID NO: 594947 - DNA, 13 bp, D. melanogaster
atttgggccatta

SEQ ID NO: 594948 - DNA, 14 bp, D. melanogaster
atttgggccattat

SEQ ID NO: 594949 - DNA, 13 bp, D. melanogaster
atttggggaattg

SEQ ID NO: 594950 - DNA, 13 bp, D. melanogaster
atttgggttaaaa

SEQ ID NO: 594951 - DNA, 13 bp, D. melanogaster
atttgggttctta

SEQ ID NO: 594952 - DNA, 13 bp, D. melanogaster
atttgggtttgcg

SEQ ID NO: 594953 - DNA, 13 bp, D. melanogaster
atttgggttttaa

SEQ ID NO: 594954 - DNA, 13 bp, D. melanogaster
atttggtaaaaat

SEQ ID NO: 594955 - DNA, 13 bp, D. melanogaster
atttggtaaaaga

SEQ ID NO: 594956 - DNA, 13 bp, D. melanogaster
atttggtaaataa

SEQ ID NO: 594957 - DNA, 13 bp, D. melanogaster
atttggtaaatat

SEQ ID NO: 594958 - DNA, 13 bp, D. melanogaster
atttggtaacggt

SEQ ID NO: 594959 - DNA, 13 bp, D. melanogaster
atttggtaatgat

SEQ ID NO: 594960 - DNA, 13 bp, D. melanogaster
atttggtaattta

SEQ ID NO: 594961 - DNA, 13 bp, D. melanogaster
atttggtatatat

SEQ ID NO: 594962 - DNA, 13 bp, D. melanogaster
atttggtattcat

SEQ ID NO: 594963 - DNA, 13 bp, D. melanogaster
atttggtattcca

SEQ ID NO: 594964 - DNA, 13 bp, D. melanogaster
atttggtcaatcg

SEQ ID NO: 594965 - DNA, 13 bp, D. melanogaster
atttggtgaagtt

SEQ ID NO: 594966 - DNA, 13 bp, D. melanogaster
atttggtgagttt

SEQ ID NO: 594967 - DNA, 13 bp, D. melanogaster
atttggtgctatt

SEQ ID NO: 594968 - DNA, 13 bp, D. melanogaster
atttggttaaata

SEQ ID NO: 594969 - DNA, 13 bp, D. melanogaster
atttggttaaatt

SEQ ID NO: 594970 - DNA, 13 bp, D. melanogaster
atttggttaacaa

SEQ ID NO: 594971 - DNA, 13 bp, D. melanogaster
atttggttaccat

SEQ ID NO: 594972 - DNA, 13 bp, D. melanogaster
atttggttagctt

SEQ ID NO: 594973 - DNA, 13 bp, D. melanogaster
atttggttatcta

SEQ ID NO: 594974 - DNA, 13 bp, D. melanogaster
atttggttgaaat

SEQ ID NO: 594975 - DNA, 13 bp, D. melanogaster
atttggttgcttt

SEQ ID NO: 594976 - DNA, 13 bp, D. melanogaster
atttggttggaaa

SEQ ID NO: 594977 - DNA, 13 bp, D. melanogaster
atttggtttaaat

SEQ ID NO: 594978 - DNA, 14 bp, D. melanogaster
atttggtttaatac

SEQ ID NO: 594979 - DNA, 13 bp, D. melanogaster
atttggtttactt

SEQ ID NO: 594980 - DNA, 13 bp, D. melanogaster
atttggtttatga

SEQ ID NO: 594981 - DNA, 13 bp, D. melanogaster
atttggtttcatt

SEQ ID NO: 594982 - DNA, 13 bp, D. melanogaster
atttggtttcctt

SEQ ID NO: 594983 - DNA, 13 bp, D. melanogaster
atttggtttcgtt

SEQ ID NO: 594984 - DNA, 13 bp, D. melanogaster
atttggtttggct

SEQ ID NO: 594985 - DNA, 13 bp, D. melanogaster
atttggttttaag

SEQ ID NO: 594986 - DNA, 13 bp, D. melanogaster
atttggttttcat

SEQ ID NO: 594987 - DNA, 13 bp, D. melanogaster
atttggttttcca

SEQ ID NO: 594988 - DNA, 14 bp, D. melanogaster
atttgtaaacaaaa

SEQ ID NO: 594989 - DNA, 13 bp, D. melanogaster
atttgtaaacttt

SEQ ID NO: 594990 - DNA, 13 bp, D. melanogaster
atttgtaaatctt

SEQ ID NO: 594991 - DNA, 13 bp, D. melanogaster
atttgtaaatgtt

SEQ ID NO: 594992 - DNA, 13 bp, D. melanogaster
atttgtaaatttc

SEQ ID NO: 594993 - DNA, 13 bp, D. melanogaster
atttgtaacaaaa

SEQ ID NO: 594994 - DNA, 13 bp, D. melanogaster
atttgtaagaatt

SEQ ID NO: 594995 - DNA, 13 bp, D. melanogaster
atttgtaatcaaa

SEQ ID NO: 594996 - DNA, 13 bp, D. melanogaster
atttgtaatcatt

SEQ ID NO: 594997 - DNA, 13 bp, D. melanogaster
atttgtaatgaaa

SEQ ID NO: 594998 - DNA, 13 bp, D. melanogaster
atttgtaattaca

SEQ ID NO: 594999 - DNA, 13 bp, D. melanogaster
atttgtaattgcc

SEQ ID NO: 595000 - DNA, 13 bp, D. melanogaster
atttgtaattgct

SEQ ID NO: 595001 - DNA, 13 bp, D. melanogaster
atttgtacaaaat

SEQ ID NO: 595002 - DNA, 13 bp, D. melanogaster
atttgtacaaata

SEQ ID NO: 595003 - DNA, 13 bp, D. melanogaster
atttgtacaatat

SEQ ID NO: 595004 - DNA, 14 bp, D. melanogaster
atttgtacagactg

SEQ ID NO: 595005 - DNA, 13 bp, D. melanogaster
atttgtacataaa

SEQ ID NO: 595006 - DNA, 13 bp, D. melanogaster
atttgtacatata

SEQ ID NO: 595007 - DNA, 13 bp, D. melanogaster
atttgtacatatg

SEQ ID NO: 595008 - DNA, 13 bp, D. melanogaster
atttgtacatttt

SEQ ID NO: 595009 - DNA, 13 bp, D. melanogaster
atttgtacgaaaa

SEQ ID NO: 595010 - DNA, 13 bp, D. melanogaster
atttgtactcaat

SEQ ID NO: 595011 - DNA, 13 bp, D. melanogaster
atttgtacttaat

SEQ ID NO: 595012 - DNA, 13 bp, D. melanogaster
atttgtactttgt

SEQ ID NO: 595013 - DNA, 14 bp, D. melanogaster
atttgtactttgtt

SEQ ID NO: 595014 - DNA, 13 bp, D. melanogaster
atttgtacttttg

SEQ ID NO: 595015 - DNA, 13 bp, D. melanogaster
atttgtagcattt

SEQ ID NO: 595016 - DNA, 13 bp, D. melanogaster
atttgtagccaat

SEQ ID NO: 595017 - DNA, 13 bp, D. melanogaster
atttgtaggaaat

SEQ ID NO: 595018 - DNA, 13 bp, D. melanogaster
atttgtagttaaa

SEQ ID NO: 595019 - DNA, 13 bp, D. melanogaster
atttgtagttgta

SEQ ID NO: 595020 - DNA, 13 bp, D. melanogaster
atttgtataaaag

SEQ ID NO: 595021 - DNA, 13 bp, D. melanogaster
atttgtataacaa

SEQ ID NO: 595022 - DNA, 13 bp, D. melanogaster
atttgtataacat

SEQ ID NO: 595023 - DNA, 13 bp, D. melanogaster
atttgtataattg

SEQ ID NO: 595024 - DNA, 14 bp, D. melanogaster
atttgtatacaaat

SEQ ID NO: 595025 - DNA, 14 bp, D. melanogaster
atttgtatacatat

SEQ ID NO: 595026 - DNA, 13 bp, D. melanogaster
atttgtatacttt

SEQ ID NO: 595027 - DNA, 13 bp, D. melanogaster
atttgtatagaaa

SEQ ID NO: 595028 - DNA, 13 bp, D. melanogaster
atttgtatataca

SEQ ID NO: 595029 - DNA, 13 bp, D. melanogaster
atttgtatatatg

SEQ ID NO: 595030 - DNA, 13 bp, D. melanogaster
atttgtatatcaa

SEQ ID NO: 595031 - DNA, 14 bp, D. melanogaster
atttgtatatcaaa

SEQ ID NO: 595032 - DNA, 13 bp, D. melanogaster
atttgtatatgaa

SEQ ID NO: 595033 - DNA, 13 bp, D. melanogaster
atttgtatatgtg

SEQ ID NO: 595034 - DNA, 13 bp, D. melanogaster
atttgtatattct

SEQ ID NO: 595035 - DNA, 13 bp, D. melanogaster
atttgtatctaaa

SEQ ID NO: 595036 - DNA, 13 bp, D. melanogaster
atttgtatctcaa

SEQ ID NO: 595037 - DNA, 13 bp, D. melanogaster
atttgtatgaatt

SEQ ID NO: 595038 - DNA, 13 bp, D. melanogaster
atttgtatgcaaa

SEQ ID NO: 595039 - DNA, 14 bp, D. melanogaster
atttgtatgcaaaa

SEQ ID NO: 595040 - DNA, 14 bp, D. melanogaster
atttgtatgcaaat

SEQ ID NO: 595041 - DNA, 13 bp, D. melanogaster
atttgtatgccat

SEQ ID NO: 595042 - DNA, 13 bp, D. melanogaster
atttgtatgcctt

SEQ ID NO: 595043 - DNA, 13 bp, D. melanogaster
atttgtatggaaa

SEQ ID NO: 595044 - DNA, 13 bp, D. melanogaster
atttgtatgtaaa

SEQ ID NO: 595045 - DNA, 14 bp, D. melanogaster
atttgtatgtaaat

SEQ ID NO: 595046 - DNA, 13 bp, D. melanogaster
atttgtatgtttc

SEQ ID NO: 595047 - DNA, 13 bp, D. melanogaster
atttgtattcaat

SEQ ID NO: 595048 - DNA, 14 bp, D. melanogaster
atttgtattcctat

SEQ ID NO: 595049 - DNA, 14 bp, D. melanogaster
atttgtatttcaaa

SEQ ID NO: 595050 - DNA, 13 bp, D. melanogaster
atttgtatttcac

SEQ ID NO: 595051 - DNA, 13 bp, D. melanogaster
atttgtatttccc

SEQ ID NO: 595052 - DNA, 13 bp, D. melanogaster
atttgtatttcct

SEQ ID NO: 595053 - DNA, 13 bp, D. melanogaster
atttgtatttgaa

SEQ ID NO: 595054 - DNA, 13 bp, D. melanogaster
atttgtatttgca

SEQ ID NO: 595055 - DNA, 13 bp, D. melanogaster
atttgtcaaaaaa

SEQ ID NO: 595056 - DNA, 13 bp, D. melanogaster
atttgtcaacatt

SEQ ID NO: 595057 - DNA, 13 bp, D. melanogaster
atttgtcaataaa

SEQ ID NO: 595058 - DNA, 13 bp, D. melanogaster
atttgtcaatttg

SEQ ID NO: 595059 - DNA, 14 bp, D. melanogaster
atttgtcaattttt

SEQ ID NO: 595060 - DNA, 13 bp, D. melanogaster
atttgtcaccatt

SEQ ID NO: 595061 - DNA, 13 bp, D. melanogaster
atttgtcagcaat

SEQ ID NO: 595062 - DNA, 13 bp, D. melanogaster
atttgtcagtttt

SEQ ID NO: 595063 - DNA, 13 bp, D. melanogaster
atttgtcataatt

SEQ ID NO: 595064 - DNA, 13 bp, D. melanogaster
atttgtcatttgt

SEQ ID NO: 595065 - DNA, 13 bp, D. melanogaster
atttgtccaaaag

SEQ ID NO: 595066 - DNA, 13 bp, D. melanogaster
atttgtcgcacat

SEQ ID NO: 595067 - DNA, 13 bp, D. melanogaster
atttgtctagttg

SEQ ID NO: 595068 - DNA, 13 bp, D. melanogaster
atttgtctataaa

SEQ ID NO: 595069 - DNA, 13 bp, D. melanogaster
atttgtctgattt

SEQ ID NO: 595070 - DNA, 13 bp, D. melanogaster
atttgtctgcaaa

SEQ ID NO: 595071 - DNA, 13 bp, D. melanogaster
atttgtctgcatt

SEQ ID NO: 595072 - DNA, 13 bp, D. melanogaster
atttgtcttcatt

SEQ ID NO: 595073 - DNA, 13 bp, D. melanogaster
atttgtctttggc

SEQ ID NO: 595074 - DNA, 13 bp, D. melanogaster
atttgtgaaatat

SEQ ID NO: 595075 - DNA, 13 bp, D. melanogaster
atttgtgattttc

SEQ ID NO: 595076 - DNA, 13 bp, D. melanogaster
atttgtgcaacaa

SEQ ID NO: 595077 - DNA, 13 bp, D. melanogaster
atttgtgcaattt

SEQ ID NO: 595078 - DNA, 14 bp, D. melanogaster
atttgtgcaatttt

SEQ ID NO: 595079 - DNA, 13 bp, D. melanogaster
atttgtgcacaaa

SEQ ID NO: 595080 - DNA, 13 bp, D. melanogaster
atttgtgcagcaa

SEQ ID NO: 595081 - DNA, 13 bp, D. melanogaster
atttgtgcagctg

SEQ ID NO: 595082 - DNA, 13 bp, D. melanogaster
atttgtgcagttt

SEQ ID NO: 595083 - DNA, 14 bp, D. melanogaster
atttgtgcattttt

SEQ ID NO: 595084 - DNA, 13 bp, D. melanogaster
atttgtgccaaaa

SEQ ID NO: 595085 - DNA, 13 bp, D. melanogaster
atttgtgcgaatg

SEQ ID NO: 595086 - DNA, 13 bp, D. melanogaster
atttgtgcgtaaa

SEQ ID NO: 595087 - DNA, 14 bp, D. melanogaster
atttgtggaaaatt

SEQ ID NO: 595088 - DNA, 13 bp, D. melanogaster
atttgtggaattt

SEQ ID NO: 595089 - DNA, 13 bp, D. melanogaster
atttgtggagctt

SEQ ID NO: 595090 - DNA, 13 bp, D. melanogaster
atttgtggcattt

SEQ ID NO: 595091 - DNA, 14 bp, D. melanogaster
atttgtggcatttt

SEQ ID NO: 595092 - DNA, 13 bp, D. melanogaster
atttgtggccaat

SEQ ID NO: 595093 - DNA, 13 bp, D. melanogaster
atttgtggccatt

SEQ ID NO: 595094 - DNA, 13 bp, D. melanogaster
atttgtggccttt

SEQ ID NO: 595095 - DNA, 13 bp, D. melanogaster
atttgtggctaaa

SEQ ID NO: 595096 - DNA, 13 bp, D. melanogaster
atttgtgggcgtg

SEQ ID NO: 595097 - DNA, 14 bp, D. melanogaster
atttgtgggcgtgg

SEQ ID NO: 595098 - DNA, 14 bp, D. melanogaster
atttgtgtaaaatg

SEQ ID NO: 595099 - DNA, 13 bp, D. melanogaster
atttgtgtaaatt

SEQ ID NO: 595100 - DNA, 13 bp, D. melanogaster
atttgtgtaatta

SEQ ID NO: 595101 - DNA, 13 bp, D. melanogaster
atttgtgtacata

SEQ ID NO: 595102 - DNA, 13 bp, D. melanogaster
atttgtgtacttt

SEQ ID NO: 595103 - DNA, 13 bp, D. melanogaster
atttgtgtataat

SEQ ID NO: 595104 - DNA, 13 bp, D. melanogaster
atttgtgtcaaaa

SEQ ID NO: 595105 - DNA, 13 bp, D. melanogaster
atttgtgtgcaat

SEQ ID NO: 595106 - DNA, 13 bp, D. melanogaster
atttgtgtgcatt

SEQ ID NO: 595107 - DNA, 14 bp, D. melanogaster
atttgtgtgcattt

SEQ ID NO: 595108 - DNA, 13 bp, D. melanogaster
atttgtgtgcgtt

SEQ ID NO: 595109 - DNA, 13 bp, D. melanogaster
atttgtgtgctgc

SEQ ID NO: 595110 - DNA, 13 bp, D. melanogaster
atttgtgtggcaa

SEQ ID NO: 595111 - DNA, 13 bp, D. melanogaster
atttgtgtgtaaa

SEQ ID NO: 595112 - DNA, 13 bp, D. melanogaster
atttgtgtgtatg

SEQ ID NO: 595113 - DNA, 13 bp, D. melanogaster
atttgtgtgtgcc

SEQ ID NO: 595114 - DNA, 13 bp, D. melanogaster
atttgtgttgaaa

SEQ ID NO: 595115 - DNA, 13 bp, D. melanogaster
atttgtgttgcat

SEQ ID NO: 595116 - DNA, 13 bp, D. melanogaster
atttgtgttggca

SEQ ID NO: 595117 - DNA, 13 bp, D. melanogaster
atttgtgtttgct

SEQ ID NO: 595118 - DNA, 13 bp, D. melanogaster
atttgttaaaact

SEQ ID NO: 595119 - DNA, 14 bp, D. melanogaster
atttgttaaacaaa

SEQ ID NO: 595120 - DNA, 13 bp, D. melanogaster
atttgttaaatgc

SEQ ID NO: 595121 - DNA, 13 bp, D. melanogaster
atttgttaaatgt

SEQ ID NO: 595122 - DNA, 13 bp, D. melanogaster
atttgttaacaaa

SEQ ID NO: 595123 - DNA, 13 bp, D. melanogaster
atttgttacaatt

SEQ ID NO: 595124 - DNA, 13 bp, D. melanogaster
atttgttacatat

SEQ ID NO: 595125 - DNA, 14 bp, D. melanogaster
atttgttacatttt

SEQ ID NO: 595126 - DNA, 13 bp, D. melanogaster
atttgttagcttt

SEQ ID NO: 595127 - DNA, 13 bp, D. melanogaster
atttgttatcaat

SEQ ID NO: 595128 - DNA, 13 bp, D. melanogaster
atttgttatgaaa

SEQ ID NO: 595129 - DNA, 14 bp, D. melanogaster
atttgttatgcaaa

SEQ ID NO: 595130 - DNA, 13 bp, D. melanogaster
atttgttattgtc

SEQ ID NO: 595131 - DNA, 13 bp, D. melanogaster
atttgttcaaatg

SEQ ID NO: 595132 - DNA, 13 bp, D. melanogaster
atttgttcaaatt

SEQ ID NO: 595133 - DNA, 14 bp, D. melanogaster
atttgttcaaattt

SEQ ID NO: 595134 - DNA, 13 bp, D. melanogaster
atttgttcacttt

SEQ ID NO: 595135 - DNA, 13 bp, D. melanogaster
atttgttcattat

SEQ ID NO: 595136 - DNA, 13 bp, D. melanogaster
atttgttcgactg

SEQ ID NO: 595137 - DNA, 13 bp, D. melanogaster
atttgttctgaaa

SEQ ID NO: 595138 - DNA, 13 bp, D. melanogaster
atttgttgaaatg

SEQ ID NO: 595139 - DNA, 13 bp, D. melanogaster
atttgttgaattg

SEQ ID NO: 595140 - DNA, 13 bp, D. melanogaster
atttgttgagcaa

SEQ ID NO: 595141 - DNA, 13 bp, D. melanogaster
atttgttgagcat

SEQ ID NO: 595142 - DNA, 13 bp, D. melanogaster
atttgttgcagct

SEQ ID NO: 595143 - DNA, 13 bp, D. melanogaster
atttgttgcatat

SEQ ID NO: 595144 - DNA, 13 bp, D. melanogaster
atttgttgcattt

SEQ ID NO: 595145 - DNA, 13 bp, D. melanogaster
atttgttgccatt

SEQ ID NO: 595146 - DNA, 14 bp, D. melanogaster
atttgttgccattt

SEQ ID NO: 595147 - DNA, 13 bp, D. melanogaster
atttgttgcctaa

SEQ ID NO: 595148 - DNA, 13 bp, D. melanogaster
atttgttgcgccc

SEQ ID NO: 595149 - DNA, 14 bp, D. melanogaster
atttgttgcgcccc

SEQ ID NO: 595150 - DNA, 13 bp, D. melanogaster
atttgttgctaaa

SEQ ID NO: 595151 - DNA, 14 bp, D. melanogaster
atttgttgctgttg

SEQ ID NO: 595152 - DNA, 13 bp, D. melanogaster
atttgttggaaat

SEQ ID NO: 595153 - DNA, 13 bp, D. melanogaster
atttgttggccat

SEQ ID NO: 595154 - DNA, 13 bp, D. melanogaster
atttgttggcctt

SEQ ID NO: 595155 - DNA, 13 bp, D. melanogaster
atttgttggtaat

SEQ ID NO: 595156 - DNA, 13 bp, D. melanogaster
atttgttggtcaa

SEQ ID NO: 595157 - DNA, 13 bp, D. melanogaster
atttgttgtactt

SEQ ID NO: 595158 - DNA, 13 bp, D. melanogaster
atttgttgtatct

SEQ ID NO: 595159 - DNA, 13 bp, D. melanogaster
atttgttgtccat

SEQ ID NO: 595160 - DNA, 13 bp, D. melanogaster
atttgttgtcgtt

SEQ ID NO: 595161 - DNA, 13 bp, D. melanogaster
atttgttgtgcaa

SEQ ID NO: 595162 - DNA, 13 bp, D. melanogaster
atttgttgtgctg

SEQ ID NO: 595163 - DNA, 14 bp, D. melanogaster
atttgttgttgccg

SEQ ID NO: 595164 - DNA, 13 bp, D. melanogaster
atttgttgttgct

SEQ ID NO: 595165 - DNA, 13 bp, D. melanogaster
atttgttgttggc

SEQ ID NO: 595166 - DNA, 13 bp, D. melanogaster
atttgtttaaaca

SEQ ID NO: 595167 - DNA, 14 bp, D. melanogaster
atttgtttaaacaa

SEQ ID NO: 595168 - DNA, 13 bp, D. melanogaster
atttgtttaaact

SEQ ID NO: 595169 - DNA, 14 bp, D. melanogaster
atttgtttaacttt

SEQ ID NO: 595170 - DNA, 13 bp, D. melanogaster
atttgtttacaaa

SEQ ID NO: 595171 - DNA, 13 bp, D. melanogaster
atttgtttaccaa

SEQ ID NO: 595172 - DNA, 13 bp, D. melanogaster
atttgtttactta

SEQ ID NO: 595173 - DNA, 13 bp, D. melanogaster
atttgtttacttc

SEQ ID NO: 595174 - DNA, 13 bp, D. melanogaster
atttgtttagcaa

SEQ ID NO: 595175 - DNA, 13 bp, D. melanogaster
atttgtttagcat

SEQ ID NO: 595176 - DNA, 13 bp, D. melanogaster
atttgtttagctt

SEQ ID NO: 595177 - DNA, 14 bp, D. melanogaster
atttgtttataaac

SEQ ID NO: 595178 - DNA, 13 bp, D. melanogaster
atttgtttataca

SEQ ID NO: 595179 - DNA, 13 bp, D. melanogaster
atttgtttatgct

SEQ ID NO: 595180 - DNA, 13 bp, D. melanogaster
atttgtttatggc

SEQ ID NO: 595181 - DNA, 13 bp, D. melanogaster
atttgtttcaaaa

SEQ ID NO: 595182 - DNA, 13 bp, D. melanogaster
atttgtttcaaat

SEQ ID NO: 595183 - DNA, 13 bp, D. melanogaster
atttgtttcaatt

SEQ ID NO: 595184 - DNA, 13 bp, D. melanogaster
atttgtttcagtg

SEQ ID NO: 595185 - DNA, 13 bp, D. melanogaster
atttgtttcagtt

SEQ ID NO: 595186 - DNA, 13 bp, D. melanogaster
atttgtttcattc

SEQ ID NO: 595187 - DNA, 13 bp, D. melanogaster
atttgtttgaaat

SEQ ID NO: 595188 - DNA, 13 bp, D. melanogaster
atttgtttgataa

SEQ ID NO: 595189 - DNA, 13 bp, D. melanogaster
atttgtttgcaat

SEQ ID NO: 595190 - DNA, 13 bp, D. melanogaster
atttgtttgcagc

SEQ ID NO: 595191 - DNA, 13 bp, D. melanogaster
atttgtttgcata

SEQ ID NO: 595192 - DNA, 13 bp, D. melanogaster
atttgtttgcatt

SEQ ID NO: 595193 - DNA, 13 bp, D. melanogaster
atttgtttgccaa

SEQ ID NO: 595194 - DNA, 14 bp, D. melanogaster
atttgtttgccaaa

SEQ ID NO: 595195 - DNA, 13 bp, D. melanogaster
atttgtttgccca

SEQ ID NO: 595196 - DNA, 13 bp, D. melanogaster
atttgtttgcccg

SEQ ID NO: 595197 - DNA, 13 bp, D. melanogaster
atttgtttgccgc

SEQ ID NO: 595198 - DNA, 13 bp, D. melanogaster
atttgtttgcctt

SEQ ID NO: 595199 - DNA, 13 bp, D. melanogaster
atttgtttgctaa

SEQ ID NO: 595200 - DNA, 14 bp, D. melanogaster
atttgtttgctttg

SEQ ID NO: 595201 - DNA, 13 bp, D. melanogaster
atttgtttggaaa

SEQ ID NO: 595202 - DNA, 13 bp, D. melanogaster
atttgtttggcat

SEQ ID NO: 595203 - DNA, 13 bp, D. melanogaster
atttgtttggccg

SEQ ID NO: 595204 - DNA, 13 bp, D. melanogaster
atttgtttggcct

SEQ ID NO: 595205 - DNA, 13 bp, D. melanogaster
atttgtttggctt

SEQ ID NO: 595206 - DNA, 14 bp, D. melanogaster
atttgtttgtttac

SEQ ID NO: 595207 - DNA, 13 bp, D. melanogaster
atttgttttacaa

SEQ ID NO: 595208 - DNA, 14 bp, D. melanogaster
atttgttttacatt

SEQ ID NO: 595209 - DNA, 13 bp, D. melanogaster
atttgttttatcg

SEQ ID NO: 595210 - DNA, 13 bp, D. melanogaster
atttgttttcaat

SEQ ID NO: 595211 - DNA, 14 bp, D. melanogaster
atttgttttcaatt

SEQ ID NO: 595212 - DNA, 13 bp, D. melanogaster
atttgttttcagt

SEQ ID NO: 595213 - DNA, 13 bp, D. melanogaster
atttgttttccat

SEQ ID NO: 595214 - DNA, 13 bp, D. melanogaster
atttgttttctaa

SEQ ID NO: 595215 - DNA, 13 bp, D. melanogaster
atttgttttgaca

SEQ ID NO: 595216 - DNA, 14 bp, D. melanogaster
atttgttttgcatt

SEQ ID NO: 595217 - DNA, 13 bp, D. melanogaster
atttgttttggct

SEQ ID NO: 595218 - DNA, 14 bp, D. melanogaster
atttgttttggctt

SEQ ID NO: 595219 - DNA, 13 bp, D. melanogaster
atttgtttttagc

SEQ ID NO: 595220 - DNA, 14 bp, D. melanogaster
atttgtttttggcc

SEQ ID NO: 595221 - DNA, 13 bp, D. melanogaster
attttaaaaagct

SEQ ID NO: 595222 - DNA, 13 bp, D. melanogaster
attttaaaacaac

SEQ ID NO: 595223 - DNA, 13 bp, D. melanogaster
attttaaaaccaa

SEQ ID NO: 595224 - DNA, 13 bp, D. melanogaster
attttaaaaccac

SEQ ID NO: 595225 - DNA, 13 bp, D. melanogaster
attttaaaacgaa

SEQ ID NO: 595226 - DNA, 13 bp, D. melanogaster
attttaaaacgtt

SEQ ID NO: 595227 - DNA, 14 bp, D. melanogaster
attttaaaacgtta

SEQ ID NO: 595228 - DNA, 13 bp, D. melanogaster
attttaaaactgt

SEQ ID NO: 595229 - DNA, 13 bp, D. melanogaster
attttaaaagcca

SEQ ID NO: 595230 - DNA, 14 bp, D. melanogaster
attttaaaatatgg

SEQ ID NO: 595231 - DNA, 13 bp, D. melanogaster
attttaaaatcga

SEQ ID NO: 595232 - DNA, 13 bp, D. melanogaster
attttaaaatgca

SEQ ID NO: 595233 - DNA, 14 bp, D. melanogaster
attttaaaatgcaa

SEQ ID NO: 595234 - DNA, 13 bp, D. melanogaster
attttaaaatgct

SEQ ID NO: 595235 - DNA, 14 bp, D. melanogaster
attttaaaatgtgt

SEQ ID NO: 595236 - DNA, 13 bp, D. melanogaster
attttaaacaaag

SEQ ID NO: 595237 - DNA, 13 bp, D. melanogaster
attttaaacatga

SEQ ID NO: 595238 - DNA, 13 bp, D. melanogaster
attttaaacatgt

SEQ ID NO: 595239 - DNA, 13 bp, D. melanogaster
attttaaacgatt

SEQ ID NO: 595240 - DNA, 13 bp, D. melanogaster
attttaaactgat

SEQ ID NO: 595241 - DNA, 13 bp, D. melanogaster
attttaaagaggt

SEQ ID NO: 595242 - DNA, 13 bp, D. melanogaster
attttaaagatac

SEQ ID NO: 595243 - DNA, 13 bp, D. melanogaster
attttaaagcaaa

SEQ ID NO: 595244 - DNA, 14 bp, D. melanogaster
attttaaagcaaat

SEQ ID NO: 595245 - DNA, 13 bp, D. melanogaster
attttaaagcaat

SEQ ID NO: 595246 - DNA, 13 bp, D. melanogaster
attttaaagcact

SEQ ID NO: 595247 - DNA, 13 bp, D. melanogaster
attttaaagcgaa

SEQ ID NO: 595248 - DNA, 13 bp, D. melanogaster
attttaaagcgat

SEQ ID NO: 595249 - DNA, 13 bp, D. melanogaster
attttaaagcttt

SEQ ID NO: 595250 - DNA, 13 bp, D. melanogaster
attttaaaggaag

SEQ ID NO: 595251 - DNA, 13 bp, D. melanogaster
attttaaaggatt

SEQ ID NO: 595252 - DNA, 13 bp, D. melanogaster
attttaaagtaca

SEQ ID NO: 595253 - DNA, 13 bp, D. melanogaster
attttaaagtgca

SEQ ID NO: 595254 - DNA, 13 bp, D. melanogaster
attttaaatacac

SEQ ID NO: 595255 - DNA, 13 bp, D. melanogaster
attttaaatagca

SEQ ID NO: 595256 - DNA, 13 bp, D. melanogaster
attttaaatgagc

SEQ ID NO: 595257 - DNA, 14 bp, D. melanogaster
attttaaatgcaaa

SEQ ID NO: 595258 - DNA, 13 bp, D. melanogaster
attttaaatgcct

SEQ ID NO: 595259 - DNA, 13 bp, D. melanogaster
attttaaatgcga

SEQ ID NO: 595260 - DNA, 13 bp, D. melanogaster
attttaaatgctt

SEQ ID NO: 595261 - DNA, 14 bp, D. melanogaster
attttaaatgcttt

SEQ ID NO: 595262 - DNA, 13 bp, D. melanogaster
attttaaatggaa

SEQ ID NO: 595263 - DNA, 14 bp, D. melanogaster
attttaaatggaat

SEQ ID NO: 595264 - DNA, 13 bp, D. melanogaster
attttaaatggca

SEQ ID NO: 595265 - DNA, 13 bp, D. melanogaster
attttaaatgttg

SEQ ID NO: 595266 - DNA, 13 bp, D. melanogaster
attttaaattcga

SEQ ID NO: 595267 - DNA, 13 bp, D. melanogaster
attttaaattcgt

SEQ ID NO: 595268 - DNA, 13 bp, D. melanogaster
attttaaattggc

SEQ ID NO: 595269 - DNA, 13 bp, D. melanogaster
attttaacaaaca

SEQ ID NO: 595270 - DNA, 13 bp, D. melanogaster
attttaacaactt

SEQ ID NO: 595271 - DNA, 13 bp, D. melanogaster
attttaacacaat

SEQ ID NO: 595272 - DNA, 13 bp, D. melanogaster
attttaacattct

SEQ ID NO: 595273 - DNA, 13 bp, D. melanogaster
attttaacgattt

SEQ ID NO: 595274 - DNA, 13 bp, D. melanogaster
attttaacgtttt

SEQ ID NO: 595275 - DNA, 13 bp, D. melanogaster
attttaactgctt

SEQ ID NO: 595276 - DNA, 13 bp, D. melanogaster
attttaactttga

SEQ ID NO: 595277 - DNA, 14 bp, D. melanogaster
attttaactttgag

SEQ ID NO: 595278 - DNA, 13 bp, D. melanogaster
attttaagaacaa

SEQ ID NO: 595279 - DNA, 14 bp, D. melanogaster
attttaagaacaaa

SEQ ID NO: 595280 - DNA, 13 bp, D. melanogaster
attttaagaactt

SEQ ID NO: 595281 - DNA, 13 bp, D. melanogaster
attttaagaccaa

SEQ ID NO: 595282 - DNA, 13 bp, D. melanogaster
attttaagcaaaa

SEQ ID NO: 595283 - DNA, 13 bp, D. melanogaster
attttaagcaatt

SEQ ID NO: 595284 - DNA, 13 bp, D. melanogaster
attttaagcacaa

SEQ ID NO: 595285 - DNA, 13 bp, D. melanogaster
attttaagcacac

SEQ ID NO: 595286 - DNA, 13 bp, D. melanogaster
attttaagcattt

SEQ ID NO: 595287 - DNA, 13 bp, D. melanogaster
attttaagccatt

SEQ ID NO: 595288 - DNA, 13 bp, D. melanogaster
attttaagctttt

SEQ ID NO: 595289 - DNA, 13 bp, D. melanogaster
attttaaggaaat

SEQ ID NO: 595290 - DNA, 13 bp, D. melanogaster
attttaaggaact

SEQ ID NO: 595291 - DNA, 13 bp, D. melanogaster
attttaaggaata

SEQ ID NO: 595292 - DNA, 13 bp, D. melanogaster
attttaaggcact

SEQ ID NO: 595293 - DNA, 13 bp, D. melanogaster
attttaagggcat

SEQ ID NO: 595294 - DNA, 13 bp, D. melanogaster
attttaagtacat

SEQ ID NO: 595295 - DNA, 13 bp, D. melanogaster
attttaagtactt

SEQ ID NO: 595296 - DNA, 14 bp, D. melanogaster
attttaagtacttc

SEQ ID NO: 595297 - DNA, 13 bp, D. melanogaster
attttaagtgaaa

SEQ ID NO: 595298 - DNA, 13 bp, D. melanogaster
attttaagtgaat

SEQ ID NO: 595299 - DNA, 13 bp, D. melanogaster
attttaagtgcaa

SEQ ID NO: 595300 - DNA, 13 bp, D. melanogaster
attttaagtgcat

SEQ ID NO: 595301 - DNA, 13 bp, D. melanogaster
attttaagtgcct

SEQ ID NO: 595302 - DNA, 13 bp, D. melanogaster
attttaagtgctt

SEQ ID NO: 595303 - DNA, 13 bp, D. melanogaster
attttaagtggaa

SEQ ID NO: 595304 - DNA, 14 bp, D. melanogaster
attttaagtttagg

SEQ ID NO: 595305 - DNA, 13 bp, D. melanogaster
attttaagtttct

SEQ ID NO: 595306 - DNA, 13 bp, D. melanogaster
attttaataaacc

SEQ ID NO: 595307 - DNA, 14 bp, D. melanogaster
attttaataaaccg

SEQ ID NO: 595308 - DNA, 13 bp, D. melanogaster
attttaatatcga

SEQ ID NO: 595309 - DNA, 13 bp, D. melanogaster
attttaatatgca

SEQ ID NO: 595310 - DNA, 13 bp, D. melanogaster
attttaatcagct

SEQ ID NO: 595311 - DNA, 13 bp, D. melanogaster
attttaatcgaaa

SEQ ID NO: 595312 - DNA, 13 bp, D. melanogaster
attttaatcgatt

SEQ ID NO: 595313 - DNA, 13 bp, D. melanogaster
attttaatctcat

SEQ ID NO: 595314 - DNA, 13 bp, D. melanogaster
attttaatgatga

SEQ ID NO: 595315 - DNA, 13 bp, D. melanogaster
attttaatgcaaa

SEQ ID NO: 595316 - DNA, 13 bp, D. melanogaster
attttaatgcata

SEQ ID NO: 595317 - DNA, 13 bp, D. melanogaster
attttaatgccaa

SEQ ID NO: 595318 - DNA, 13 bp, D. melanogaster
attttaatgcgtt

SEQ ID NO: 595319 - DNA, 13 bp, D. melanogaster
attttaatgctta

SEQ ID NO: 595320 - DNA, 13 bp, D. melanogaster
attttaatgcttt

SEQ ID NO: 595321 - DNA, 13 bp, D. melanogaster
attttaatggcaa

SEQ ID NO: 595322 - DNA, 13 bp, D. melanogaster
attttaatggccg

SEQ ID NO: 595323 - DNA, 13 bp, D. melanogaster
attttaatgggca

SEQ ID NO: 595324 - DNA, 13 bp, D. melanogaster
attttaattacgc

SEQ ID NO: 595325 - DNA, 13 bp, D. melanogaster
attttaattccaa

SEQ ID NO: 595326 - DNA, 14 bp, D. melanogaster
attttaattccaaa

SEQ ID NO: 595327 - DNA, 13 bp, D. melanogaster
attttaattcgtt

SEQ ID NO: 595328 - DNA, 14 bp, D. melanogaster
attttaattcgttt

SEQ ID NO: 595329 - DNA, 13 bp, D. melanogaster
attttaattgcaa

SEQ ID NO: 595330 - DNA, 14 bp, D. melanogaster
attttaattgcaat

SEQ ID NO: 595331 - DNA, 13 bp, D. melanogaster
attttaattgcca

SEQ ID NO: 595332 - DNA, 14 bp, D. melanogaster
attttaattgcgaa

SEQ ID NO: 595333 - DNA, 14 bp, D. melanogaster
attttaattgcttt

SEQ ID NO: 595334 - DNA, 14 bp, D. melanogaster
attttaattggctt

SEQ ID NO: 595335 - DNA, 13 bp, D. melanogaster
attttaattgggc

SEQ ID NO: 595336 - DNA, 13 bp, D. melanogaster
attttaattgtct

SEQ ID NO: 595337 - DNA, 14 bp, D. melanogaster
attttaattgtgct

SEQ ID NO: 595338 - DNA, 13 bp, D. melanogaster
attttaatttgct

SEQ ID NO: 595339 - DNA, 13 bp, D. melanogaster
attttaatttggg

SEQ ID NO: 595340 - DNA, 13 bp, D. melanogaster
attttaatttgtc

SEQ ID NO: 595341 - DNA, 13 bp, D. melanogaster
attttacaaaatc

SEQ ID NO: 595342 - DNA, 13 bp, D. melanogaster
attttacaacaaa

SEQ ID NO: 595343 - DNA, 13 bp, D. melanogaster
attttacaagatt

SEQ ID NO: 595344 - DNA, 13 bp, D. melanogaster
attttacaatgtg

SEQ ID NO: 595345 - DNA, 13 bp, D. melanogaster
attttacaattac

SEQ ID NO: 595346 - DNA, 13 bp, D. melanogaster
attttacacaaat

SEQ ID NO: 595347 - DNA, 13 bp, D. melanogaster
attttacagaaat

SEQ ID NO: 595348 - DNA, 13 bp, D. melanogaster
attttacagtttt

SEQ ID NO: 595349 - DNA, 14 bp, D. melanogaster
attttacagttttt

SEQ ID NO: 595350 - DNA, 13 bp, D. melanogaster
attttacatgtta

SEQ ID NO: 595351 - DNA, 13 bp, D. melanogaster
attttacattcaa

SEQ ID NO: 595352 - DNA, 13 bp, D. melanogaster
attttacatttgg

SEQ ID NO: 595353 - DNA, 14 bp, D. melanogaster
attttacatttggt

SEQ ID NO: 595354 - DNA, 13 bp, D. melanogaster
attttacatttgt

SEQ ID NO: 595355 - DNA, 13 bp, D. melanogaster
attttacattttg

SEQ ID NO: 595356 - DNA, 13 bp, D. melanogaster
attttaccaattt

SEQ ID NO: 595357 - DNA, 13 bp, D. melanogaster
attttacccaaaa

SEQ ID NO: 595358 - DNA, 13 bp, D. melanogaster
attttacccattt

SEQ ID NO: 595359 - DNA, 13 bp, D. melanogaster
attttacgaattt

SEQ ID NO: 595360 - DNA, 13 bp, D. melanogaster
attttacgatatt

SEQ ID NO: 595361 - DNA, 13 bp, D. melanogaster
attttacgatttg

SEQ ID NO: 595362 - DNA, 13 bp, D. melanogaster
attttacgcattt

SEQ ID NO: 595363 - DNA, 13 bp, D. melanogaster
attttacgccaaa

SEQ ID NO: 595364 - DNA, 13 bp, D. melanogaster
attttacgtacaa

SEQ ID NO: 595365 - DNA, 13 bp, D. melanogaster
attttactacaaa

SEQ ID NO: 595366 - DNA, 13 bp, D. melanogaster
attttactacatt

SEQ ID NO: 595367 - DNA, 13 bp, D. melanogaster
attttactcaatt

SEQ ID NO: 595368 - DNA, 13 bp, D. melanogaster
attttactctacg

SEQ ID NO: 595369 - DNA, 13 bp, D. melanogaster
attttacttattg

SEQ ID NO: 595370 - DNA, 13 bp, D. melanogaster
attttacttcaaa

SEQ ID NO: 595371 - DNA, 13 bp, D. melanogaster
attttactttcgt

SEQ ID NO: 595372 - DNA, 13 bp, D. melanogaster
attttagaacagg

SEQ ID NO: 595373 - DNA, 13 bp, D. melanogaster
attttagaggaaa

SEQ ID NO: 595374 - DNA, 14 bp, D. melanogaster
attttagaggaaat

SEQ ID NO: 595375 - DNA, 13 bp, D. melanogaster
attttagagtgtc

SEQ ID NO: 595376 - DNA, 13 bp, D. melanogaster
attttagatcaac

SEQ ID NO: 595377 - DNA, 13 bp, D. melanogaster
attttagcaaaat

SEQ ID NO: 595378 - DNA, 13 bp, D. melanogaster
attttagcaaatt

SEQ ID NO: 595379 - DNA, 13 bp, D. melanogaster
attttagcatatt

SEQ ID NO: 595380 - DNA, 13 bp, D. melanogaster
attttagcattta

SEQ ID NO: 595381 - DNA, 13 bp, D. melanogaster
attttagctgcaa

SEQ ID NO: 595382 - DNA, 13 bp, D. melanogaster
attttagctgtgc

SEQ ID NO: 595383 - DNA, 13 bp, D. melanogaster
attttagcttaaa

SEQ ID NO: 595384 - DNA, 13 bp, D. melanogaster
attttagtcctaa

SEQ ID NO: 595385 - DNA, 13 bp, D. melanogaster
attttagtgcatt

SEQ ID NO: 595386 - DNA, 13 bp, D. melanogaster
attttagttatcc

SEQ ID NO: 595387 - DNA, 13 bp, D. melanogaster
attttagttgaaa

SEQ ID NO: 595388 - DNA, 13 bp, D. melanogaster
attttagtttcat

SEQ ID NO: 595389 - DNA, 13 bp, D. melanogaster
attttagtttgca

SEQ ID NO: 595390 - DNA, 13 bp, D. melanogaster
attttataaactc

SEQ ID NO: 595391 - DNA, 13 bp, D. melanogaster
attttatacactt

SEQ ID NO: 595392 - DNA, 13 bp, D. melanogaster
attttatacgaaa

SEQ ID NO: 595393 - DNA, 13 bp, D. melanogaster
attttatacgaat

SEQ ID NO: 595394 - DNA, 13 bp, D. melanogaster
attttatagaaac

SEQ ID NO: 595395 - DNA, 13 bp, D. melanogaster
attttatagcttt

SEQ ID NO: 595396 - DNA, 13 bp, D. melanogaster
attttatagttcc

SEQ ID NO: 595397 - DNA, 13 bp, D. melanogaster
attttatatcgaa

SEQ ID NO: 595398 - DNA, 13 bp, D. melanogaster
attttatatgttc

SEQ ID NO: 595399 - DNA, 13 bp, D. melanogaster
attttatattcca

SEQ ID NO: 595400 - DNA, 13 bp, D. melanogaster
attttatccatct

SEQ ID NO: 595401 - DNA, 14 bp, D. melanogaster
attttatccatttc

SEQ ID NO: 595402 - DNA, 13 bp, D. melanogaster
attttatgacaaa

SEQ ID NO: 595403 - DNA, 13 bp, D. melanogaster
attttatgacatt

SEQ ID NO: 595404 - DNA, 13 bp, D. melanogaster
attttatgaccaa

SEQ ID NO: 595405 - DNA, 13 bp, D. melanogaster
attttatgagcat

SEQ ID NO: 595406 - DNA, 13 bp, D. melanogaster
attttatgagcca

SEQ ID NO: 595407 - DNA, 13 bp, D. melanogaster
attttatgattga

SEQ ID NO: 595408 - DNA, 13 bp, D. melanogaster
attttatgcaaaa

SEQ ID NO: 595409 - DNA, 14 bp, D. melanogaster
attttatgcaaaat

SEQ ID NO: 595410 - DNA, 13 bp, D. melanogaster
attttatgcaaat

SEQ ID NO: 595411 - DNA, 13 bp, D. melanogaster
attttatgcaatt

SEQ ID NO: 595412 - DNA, 14 bp, D. melanogaster
attttatgcatttt

SEQ ID NO: 595413 - DNA, 13 bp, D. melanogaster
attttatgcgatt

SEQ ID NO: 595414 - DNA, 13 bp, D. melanogaster
attttatgcgttt

SEQ ID NO: 595415 - DNA, 13 bp, D. melanogaster
attttatgctaat

SEQ ID NO: 595416 - DNA, 14 bp, D. melanogaster
attttatgctaatt

SEQ ID NO: 595417 - DNA, 13 bp, D. melanogaster
attttatggagaa

SEQ ID NO: 595418 - DNA, 14 bp, D. melanogaster
attttatggcattt

SEQ ID NO: 595419 - DNA, 13 bp, D. melanogaster
attttatggccac

SEQ ID NO: 595420 - DNA, 13 bp, D. melanogaster
attttatggccca

SEQ ID NO: 595421 - DNA, 13 bp, D. melanogaster
attttatggcttt

SEQ ID NO: 595422 - DNA, 14 bp, D. melanogaster
attttatgtacatg

SEQ ID NO: 595423 - DNA, 13 bp, D. melanogaster
attttatgtgaaa

SEQ ID NO: 595424 - DNA, 13 bp, D. melanogaster
attttatgttatc

SEQ ID NO: 595425 - DNA, 13 bp, D. melanogaster
attttatgtttca

SEQ ID NO: 595426 - DNA, 13 bp, D. melanogaster
attttattacgaa

SEQ ID NO: 595427 - DNA, 14 bp, D. melanogaster
attttattacgaat

SEQ ID NO: 595428 - DNA, 13 bp, D. melanogaster
attttattagcat

SEQ ID NO: 595429 - DNA, 13 bp, D. melanogaster
attttattatagc

SEQ ID NO: 595430 - DNA, 13 bp, D. melanogaster
attttattatgca

SEQ ID NO: 595431 - DNA, 13 bp, D. melanogaster
attttattatgct

SEQ ID NO: 595432 - DNA, 14 bp, D. melanogaster
attttattattgca

SEQ ID NO: 595433 - DNA, 14 bp, D. melanogaster
attttattatttgc

SEQ ID NO: 595434 - DNA, 13 bp, D. melanogaster
attttattcacca

SEQ ID NO: 595435 - DNA, 14 bp, D. melanogaster
attttattcaccaa

SEQ ID NO: 595436 - DNA, 13 bp, D. melanogaster
attttattcatac

SEQ ID NO: 595437 - DNA, 13 bp, D. melanogaster
attttattccaca

SEQ ID NO: 595438 - DNA, 13 bp, D. melanogaster
attttattcgaaa

SEQ ID NO: 595439 - DNA, 14 bp, D. melanogaster
attttattcgattt

SEQ ID NO: 595440 - DNA, 13 bp, D. melanogaster
attttattcgctt

SEQ ID NO: 595441 - DNA, 13 bp, D. melanogaster
attttattgacat

SEQ ID NO: 595442 - DNA, 13 bp, D. melanogaster
attttattgcaaa

SEQ ID NO: 595443 - DNA, 14 bp, D. melanogaster
attttattgccaaa

SEQ ID NO: 595444 - DNA, 13 bp, D. melanogaster
attttattggcag

SEQ ID NO: 595445 - DNA, 13 bp, D. melanogaster
attttattggctt

SEQ ID NO: 595446 - DNA, 13 bp, D. melanogaster
attttattgtgaa

SEQ ID NO: 595447 - DNA, 13 bp, D. melanogaster
attttattgtgca

SEQ ID NO: 595448 - DNA, 13 bp, D. melanogaster
attttatttccca

SEQ ID NO: 595449 - DNA, 13 bp, D. melanogaster
attttatttcgat

SEQ ID NO: 595450 - DNA, 13 bp, D. melanogaster
attttatttcgca

SEQ ID NO: 595451 - DNA, 13 bp, D. melanogaster
attttatttcgcc

SEQ ID NO: 595452 - DNA, 13 bp, D. melanogaster
attttatttgact

SEQ ID NO: 595453 - DNA, 13 bp, D. melanogaster
attttatttgaga

SEQ ID NO: 595454 - DNA, 13 bp, D. melanogaster
attttatttgcat

SEQ ID NO: 595455 - DNA, 14 bp, D. melanogaster
attttatttgccat

SEQ ID NO: 595456 - DNA, 13 bp, D. melanogaster
attttatttggaa

SEQ ID NO: 595457 - DNA, 13 bp, D. melanogaster
attttatttggcc

SEQ ID NO: 595458 - DNA, 13 bp, D. melanogaster
attttatttggct

SEQ ID NO: 595459 - DNA, 13 bp, D. melanogaster
attttatttgtgc

SEQ ID NO: 595460 - DNA, 14 bp, D. melanogaster
attttattttcagt

SEQ ID NO: 595461 - DNA, 13 bp, D. melanogaster
attttcaaaaagc

SEQ ID NO: 595462 - DNA, 13 bp, D. melanogaster
attttcaaaaagt

SEQ ID NO: 595463 - DNA, 13 bp, D. melanogaster
attttcaaaaatc

SEQ ID NO: 595464 - DNA, 13 bp, D. melanogaster
attttcaaaacaa

SEQ ID NO: 595465 - DNA, 13 bp, D. melanogaster
attttcaaaacta

SEQ ID NO: 595466 - DNA, 13 bp, D. melanogaster
attttcaaaactg

SEQ ID NO: 595467 - DNA, 13 bp, D. melanogaster
attttcaaaactt

SEQ ID NO: 595468 - DNA, 13 bp, D. melanogaster
attttcaaaagat

SEQ ID NO: 595469 - DNA, 13 bp, D. melanogaster
attttcaaaatcg

SEQ ID NO: 595470 - DNA, 13 bp, D. melanogaster
attttcaaaatga

SEQ ID NO: 595471 - DNA, 14 bp, D. melanogaster
attttcaaaatgaa

SEQ ID NO: 595472 - DNA, 13 bp, D. melanogaster
attttcaaaatgt

SEQ ID NO: 595473 - DNA, 13 bp, D. melanogaster
attttcaaacaat

SEQ ID NO: 595474 - DNA, 13 bp, D. melanogaster
attttcaaagaaa

SEQ ID NO: 595475 - DNA, 13 bp, D. melanogaster
attttcaaagtat

SEQ ID NO: 595476 - DNA, 13 bp, D. melanogaster
attttcaaagttt

SEQ ID NO: 595477 - DNA, 13 bp, D. melanogaster
attttcaaataca

SEQ ID NO: 595478 - DNA, 14 bp, D. melanogaster
attttcaaatcaaa

SEQ ID NO: 595479 - DNA, 13 bp, D. melanogaster
attttcaaatgct

SEQ ID NO: 595480 - DNA, 13 bp, D. melanogaster
attttcaaatgtt

SEQ ID NO: 595481 - DNA, 13 bp, D. melanogaster
attttcaaattag

SEQ ID NO: 595482 - DNA, 14 bp, D. melanogaster
attttcaaattgtt

SEQ ID NO: 595483 - DNA, 13 bp, D. melanogaster
attttcaaatttc

SEQ ID NO: 595484 - DNA, 13 bp, D. melanogaster
attttcaaatttg

SEQ ID NO: 595485 - DNA, 13 bp, D. melanogaster
attttcaacaaat

SEQ ID NO: 595486 - DNA, 13 bp, D. melanogaster
attttcaacaagt

SEQ ID NO: 595487 - DNA, 13 bp, D. melanogaster
attttcaacactc

SEQ ID NO: 595488 - DNA, 13 bp, D. melanogaster
attttcaaccaaa

SEQ ID NO: 595489 - DNA, 13 bp, D. melanogaster
attttcaaccatt

SEQ ID NO: 595490 - DNA, 13 bp, D. melanogaster
attttcaacgaat

SEQ ID NO: 595491 - DNA, 13 bp, D. melanogaster
attttcaactttg

SEQ ID NO: 595492 - DNA, 14 bp, D. melanogaster
attttcaactttga

SEQ ID NO: 595493 - DNA, 13 bp, D. melanogaster
attttcaagaaaa

SEQ ID NO: 595494 - DNA, 13 bp, D. melanogaster
attttcaagaaat

SEQ ID NO: 595495 - DNA, 13 bp, D. melanogaster
attttcaagtatt

SEQ ID NO: 595496 - DNA, 13 bp, D. melanogaster
attttcaagtgct

SEQ ID NO: 595497 - DNA, 13 bp, D. melanogaster
attttcaagttca

SEQ ID NO: 595498 - DNA, 13 bp, D. melanogaster
attttcaagtttg

SEQ ID NO: 595499 - DNA, 13 bp, D. melanogaster
attttcaatacaa

SEQ ID NO: 595500 - DNA, 13 bp, D. melanogaster
attttcaatagtt

SEQ ID NO: 595501 - DNA, 13 bp, D. melanogaster
attttcaatcaat

SEQ ID NO: 595502 - DNA, 13 bp, D. melanogaster
attttcaatcact

SEQ ID NO: 595503 - DNA, 13 bp, D. melanogaster
attttcaatcgaa

SEQ ID NO: 595504 - DNA, 14 bp, D. melanogaster
attttcaatgcaaa

SEQ ID NO: 595505 - DNA, 13 bp, D. melanogaster
attttcaatgcca

SEQ ID NO: 595506 - DNA, 14 bp, D. melanogaster
attttcaatgtttt

SEQ ID NO: 595507 - DNA, 13 bp, D. melanogaster
attttcaattacc

SEQ ID NO: 595508 - DNA, 13 bp, D. melanogaster
attttcaattact

SEQ ID NO: 595509 - DNA, 13 bp, D. melanogaster
attttcaattagc

SEQ ID NO: 595510 - DNA, 13 bp, D. melanogaster
attttcaattcaa

SEQ ID NO: 595511 - DNA, 13 bp, D. melanogaster
attttcaattgtt

SEQ ID NO: 595512 - DNA, 13 bp, D. melanogaster
attttcaatttac

SEQ ID NO: 595513 - DNA, 14 bp, D. melanogaster
attttcaatttcaa

SEQ ID NO: 595514 - DNA, 14 bp, D. melanogaster
attttcaatttgaa

SEQ ID NO: 595515 - DNA, 14 bp, D. melanogaster
attttcaatttgca

SEQ ID NO: 595516 - DNA, 14 bp, D. melanogaster
attttcaatttggc

SEQ ID NO: 595517 - DNA, 13 bp, D. melanogaster
attttcacaaaag

SEQ ID NO: 595518 - DNA, 13 bp, D. melanogaster
attttcacaaaca

SEQ ID NO: 595519 - DNA, 14 bp, D. melanogaster
attttcacaaattt

SEQ ID NO: 595520 - DNA, 13 bp, D. melanogaster
attttcacaatta

SEQ ID NO: 595521 - DNA, 13 bp, D. melanogaster
attttcacactca

SEQ ID NO: 595522 - DNA, 13 bp, D. melanogaster
attttcacatata

SEQ ID NO: 595523 - DNA, 13 bp, D. melanogaster
attttcacattgt

SEQ ID NO: 595524 - DNA, 14 bp, D. melanogaster
attttcaccatttt

SEQ ID NO: 595525 - DNA, 13 bp, D. melanogaster
attttcacgaaaa

SEQ ID NO: 595526 - DNA, 13 bp, D. melanogaster
attttcacgctgc

SEQ ID NO: 595527 - DNA, 13 bp, D. melanogaster
attttcactgcat

SEQ ID NO: 595528 - DNA, 13 bp, D. melanogaster
attttcacttaaa

SEQ ID NO: 595529 - DNA, 14 bp, D. melanogaster
attttcacttcatt

SEQ ID NO: 595530 - DNA, 13 bp, D. melanogaster
attttcacttgca

SEQ ID NO: 595531 - DNA, 13 bp, D. melanogaster
attttcacttggc

SEQ ID NO: 595532 - DNA, 13 bp, D. melanogaster
attttcacttgtt

SEQ ID NO: 595533 - DNA, 13 bp, D. melanogaster
attttcactttgt

SEQ ID NO: 595534 - DNA, 13 bp, D. melanogaster
attttcagcaaaa

SEQ ID NO: 595535 - DNA, 13 bp, D. melanogaster
attttcagcaaat

SEQ ID NO: 595536 - DNA, 13 bp, D. melanogaster
attttcagcataa

SEQ ID NO: 595537 - DNA, 13 bp, D. melanogaster
attttcagccaca

SEQ ID NO: 595538 - DNA, 13 bp, D. melanogaster
attttcagctgtt

SEQ ID NO: 595539 - DNA, 13 bp, D. melanogaster
attttcagcttaa

SEQ ID NO: 595540 - DNA, 14 bp, D. melanogaster
attttcagcttttc

SEQ ID NO: 595541 - DNA, 13 bp, D. melanogaster
attttcagtgatt

SEQ ID NO: 595542 - DNA, 13 bp, D. melanogaster
attttcagttaaa

SEQ ID NO: 595543 - DNA, 14 bp, D. melanogaster
attttcagttattt

SEQ ID NO: 595544 - DNA, 13 bp, D. melanogaster
attttcagtttaa

SEQ ID NO: 595545 - DNA, 13 bp, D. melanogaster
attttcagtttta

SEQ ID NO: 595546 - DNA, 13 bp, D. melanogaster
attttcataaagt

SEQ ID NO: 595547 - DNA, 13 bp, D. melanogaster
attttcatatgtg

SEQ ID NO: 595548 - DNA, 13 bp, D. melanogaster
attttcatcaaat

SEQ ID NO: 595549 - DNA, 13 bp, D. melanogaster
attttcatcaatt

SEQ ID NO: 595550 - DNA, 13 bp, D. melanogaster
attttcatccatt

SEQ ID NO: 595551 - DNA, 14 bp, D. melanogaster
attttcatccattt

SEQ ID NO: 595552 - DNA, 13 bp, D. melanogaster
attttcatgaaat

SEQ ID NO: 595553 - DNA, 13 bp, D. melanogaster
attttcatgccat

SEQ ID NO: 595554 - DNA, 13 bp, D. melanogaster
attttcatgtatt

SEQ ID NO: 595555 - DNA, 13 bp, D. melanogaster
attttcatgttca

SEQ ID NO: 595556 - DNA, 14 bp, D. melanogaster
attttcatgttcat

SEQ ID NO: 595557 - DNA, 13 bp, D. melanogaster
attttcatgttct

SEQ ID NO: 595558 - DNA, 14 bp, D. melanogaster
attttcatgttctt

SEQ ID NO: 595559 - DNA, 13 bp, D. melanogaster
attttcattaaag

SEQ ID NO: 595560 - DNA, 13 bp, D. melanogaster
attttcattaagt

SEQ ID NO: 595561 - DNA, 13 bp, D. melanogaster
attttcattcaaa

SEQ ID NO: 595562 - DNA, 13 bp, D. melanogaster
attttcattcaac

SEQ ID NO: 595563 - DNA, 13 bp, D. melanogaster
attttcattccaa

SEQ ID NO: 595564 - DNA, 13 bp, D. melanogaster
attttcattcgca

SEQ ID NO: 595565 - DNA, 14 bp, D. melanogaster
attttcattgaaaa

SEQ ID NO: 595566 - DNA, 13 bp, D. melanogaster
attttcattgatc

SEQ ID NO: 595567 - DNA, 14 bp, D. melanogaster
attttcattgattt

SEQ ID NO: 595568 - DNA, 13 bp, D. melanogaster
attttcattgcaa

SEQ ID NO: 595569 - DNA, 13 bp, D. melanogaster
attttcattgcat

SEQ ID NO: 595570 - DNA, 13 bp, D. melanogaster
attttcattgccc

SEQ ID NO: 595571 - DNA, 13 bp, D. melanogaster
attttcattgctc

SEQ ID NO: 595572 - DNA, 13 bp, D. melanogaster
attttcattgtaa

SEQ ID NO: 595573 - DNA, 13 bp, D. melanogaster
attttcattgtca

SEQ ID NO: 595574 - DNA, 13 bp, D. melanogaster
attttcattgttg

SEQ ID NO: 595575 - DNA, 14 bp, D. melanogaster
attttcatttaagt

SEQ ID NO: 595576 - DNA, 14 bp, D. melanogaster
attttcatttcaaa

SEQ ID NO: 595577 - DNA, 13 bp, D. melanogaster
attttcatttcca

SEQ ID NO: 595578 - DNA, 14 bp, D. melanogaster
attttcatttgatt

SEQ ID NO: 595579 - DNA, 14 bp, D. melanogaster
attttcatttgcca

SEQ ID NO: 595580 - DNA, 13 bp, D. melanogaster
attttcatttggc

SEQ ID NO: 595581 - DNA, 14 bp, D. melanogaster
attttcatttgttg

SEQ ID NO: 595582 - DNA, 13 bp, D. melanogaster
attttccaaaaaa

SEQ ID NO: 595583 - DNA, 13 bp, D. melanogaster
attttccaaaaac

SEQ ID NO: 595584 - DNA, 13 bp, D. melanogaster
attttccaaaagt

SEQ ID NO: 595585 - DNA, 13 bp, D. melanogaster
attttccaaaatg

SEQ ID NO: 595586 - DNA, 13 bp, D. melanogaster
attttccaaagcg

SEQ ID NO: 595587 - DNA, 13 bp, D. melanogaster
attttccaaatgt

SEQ ID NO: 595588 - DNA, 13 bp, D. melanogaster
attttccaaattc

SEQ ID NO: 595589 - DNA, 13 bp, D. melanogaster
attttccaacact

SEQ ID NO: 595590 - DNA, 13 bp, D. melanogaster
attttccaactga

SEQ ID NO: 595591 - DNA, 13 bp, D. melanogaster
attttccaactgc

SEQ ID NO: 595592 - DNA, 13 bp, D. melanogaster
attttccaacttt

SEQ ID NO: 595593 - DNA, 13 bp, D. melanogaster
attttccaagcag

SEQ ID NO: 595594 - DNA, 13 bp, D. melanogaster
attttccaagcat

SEQ ID NO: 595595 - DNA, 13 bp, D. melanogaster
attttccaagcca

SEQ ID NO: 595596 - DNA, 13 bp, D. melanogaster
attttccaaggca

SEQ ID NO: 595597 - DNA, 13 bp, D. melanogaster
attttccaatcga

SEQ ID NO: 595598 - DNA, 13 bp, D. melanogaster
attttccaattaa

SEQ ID NO: 595599 - DNA, 14 bp, D. melanogaster
attttccaattaaa

SEQ ID NO: 595600 - DNA, 13 bp, D. melanogaster
attttccaattac

SEQ ID NO: 595601 - DNA, 13 bp, D. melanogaster
attttccaattat

SEQ ID NO: 595602 - DNA, 13 bp, D. melanogaster
attttccaattgc

SEQ ID NO: 595603 - DNA, 13 bp, D. melanogaster
attttccacaaaa

SEQ ID NO: 595604 - DNA, 13 bp, D. melanogaster
attttccacaaac

SEQ ID NO: 595605 - DNA, 13 bp, D. melanogaster
attttccacaaat

SEQ ID NO: 595606 - DNA, 14 bp, D. melanogaster
attttccacaaatt

SEQ ID NO: 595607 - DNA, 14 bp, D. melanogaster
attttccacaattt

SEQ ID NO: 595608 - DNA, 13 bp, D. melanogaster
attttccacactt

SEQ ID NO: 595609 - DNA, 13 bp, D. melanogaster
attttccacagct

SEQ ID NO: 595610 - DNA, 13 bp, D. melanogaster
attttccacattt

SEQ ID NO: 595611 - DNA, 13 bp, D. melanogaster
attttccaccact

SEQ ID NO: 595612 - DNA, 13 bp, D. melanogaster
attttccacccac

SEQ ID NO: 595613 - DNA, 14 bp, D. melanogaster
attttccacccaca

SEQ ID NO: 595614 - DNA, 13 bp, D. melanogaster
attttccacccca

SEQ ID NO: 595615 - DNA, 13 bp, D. melanogaster
attttccacccgc

SEQ ID NO: 595616 - DNA, 13 bp, D. melanogaster
attttccacctgc

SEQ ID NO: 595617 - DNA, 13 bp, D. melanogaster
attttccaccttc

SEQ ID NO: 595618 - DNA, 13 bp, D. melanogaster
attttccactgga

SEQ ID NO: 595619 - DNA, 13 bp, D. melanogaster
attttccactggc

SEQ ID NO: 595620 - DNA, 13 bp, D. melanogaster
attttccacttga

SEQ ID NO: 595621 - DNA, 14 bp, D. melanogaster
attttccacttggc

SEQ ID NO: 595622 - DNA, 13 bp, D. melanogaster
attttccacttta

SEQ ID NO: 595623 - DNA, 14 bp, D. melanogaster
attttccagcattt

SEQ ID NO: 595624 - DNA, 13 bp, D. melanogaster
attttccagcgcc

SEQ ID NO: 595625 - DNA, 13 bp, D. melanogaster
attttccagtttt

SEQ ID NO: 595626 - DNA, 13 bp, D. melanogaster
attttccataaaa

SEQ ID NO: 595627 - DNA, 13 bp, D. melanogaster
attttccataaat

SEQ ID NO: 595628 - DNA, 13 bp, D. melanogaster
attttccatacac

SEQ ID NO: 595629 - DNA, 13 bp, D. melanogaster
attttccatatat

SEQ ID NO: 595630 - DNA, 13 bp, D. melanogaster
attttccatcaat

SEQ ID NO: 595631 - DNA, 13 bp, D. melanogaster
attttccatccaa

SEQ ID NO: 595632 - DNA, 13 bp, D. melanogaster
attttccatgaat

SEQ ID NO: 595633 - DNA, 13 bp, D. melanogaster
attttccatggaa

SEQ ID NO: 595634 - DNA, 13 bp, D. melanogaster
attttccatgtta

SEQ ID NO: 595635 - DNA, 13 bp, D. melanogaster
attttccatgttt

SEQ ID NO: 595636 - DNA, 13 bp, D. melanogaster
attttccattcga

SEQ ID NO: 595637 - DNA, 13 bp, D. melanogaster
attttccattctg

SEQ ID NO: 595638 - DNA, 13 bp, D. melanogaster
attttccattgaa

SEQ ID NO: 595639 - DNA, 13 bp, D. melanogaster
attttccattggc

SEQ ID NO: 595640 - DNA, 14 bp, D. melanogaster
attttccattgttt

SEQ ID NO: 595641 - DNA, 13 bp, D. melanogaster
attttccatttaa

SEQ ID NO: 595642 - DNA, 14 bp, D. melanogaster
attttccatttaaa

SEQ ID NO: 595643 - DNA, 13 bp, D. melanogaster
attttccatttac

SEQ ID NO: 595644 - DNA, 14 bp, D. melanogaster
attttccatttacc

SEQ ID NO: 595645 - DNA, 13 bp, D. melanogaster
attttccatttga

SEQ ID NO: 595646 - DNA, 14 bp, D. melanogaster
attttccatttgaa

SEQ ID NO: 595647 - DNA, 14 bp, D. melanogaster
attttccatttgca

SEQ ID NO: 595648 - DNA, 13 bp, D. melanogaster
attttcccaacat

SEQ ID NO: 595649 - DNA, 13 bp, D. melanogaster
attttcccaacca

SEQ ID NO: 595650 - DNA, 13 bp, D. melanogaster
attttcccaactg

SEQ ID NO: 595651 - DNA, 14 bp, D. melanogaster
attttcccaactgg

SEQ ID NO: 595652 - DNA, 13 bp, D. melanogaster
attttcccaatta

SEQ ID NO: 595653 - DNA, 13 bp, D. melanogaster
attttcccacaaa

SEQ ID NO: 595654 - DNA, 13 bp, D. melanogaster
attttcccagcta

SEQ ID NO: 595655 - DNA, 13 bp, D. melanogaster
attttcccataaa

SEQ ID NO: 595656 - DNA, 13 bp, D. melanogaster
attttcccatatt

SEQ ID NO: 595657 - DNA, 13 bp, D. melanogaster
attttcccattcc

SEQ ID NO: 595658 - DNA, 14 bp, D. melanogaster
attttcccatttcc

SEQ ID NO: 595659 - DNA, 13 bp, D. melanogaster
attttccccactg

SEQ ID NO: 595660 - DNA, 13 bp, D. melanogaster
attttccccactt

SEQ ID NO: 595661 - DNA, 13 bp, D. melanogaster
attttccccagct

SEQ ID NO: 595662 - DNA, 13 bp, D. melanogaster
attttccccatat

SEQ ID NO: 595663 - DNA, 13 bp, D. melanogaster
attttccccccaa

SEQ ID NO: 595664 - DNA, 13 bp, D. melanogaster
attttccccttaa

SEQ ID NO: 595665 - DNA, 13 bp, D. melanogaster
attttcccgattt

SEQ ID NO: 595666 - DNA, 13 bp, D. melanogaster
attttcccgccca

SEQ ID NO: 595667 - DNA, 13 bp, D. melanogaster
attttccgaaaat

SEQ ID NO: 595668 - DNA, 13 bp, D. melanogaster
attttccgaaatt

SEQ ID NO: 595669 - DNA, 13 bp, D. melanogaster
attttccgaattt

SEQ ID NO: 595670 - DNA, 14 bp, D. melanogaster
attttccgactttt

SEQ ID NO: 595671 - DNA, 13 bp, D. melanogaster
attttccgatacc

SEQ ID NO: 595672 - DNA, 13 bp, D. melanogaster
attttccgatttc

SEQ ID NO: 595673 - DNA, 14 bp, D. melanogaster
attttccgattttc

SEQ ID NO: 595674 - DNA, 13 bp, D. melanogaster
attttccgcaaat

SEQ ID NO: 595675 - DNA, 13 bp, D. melanogaster
attttccgcccac

SEQ ID NO: 595676 - DNA, 13 bp, D. melanogaster
attttccgcctgc

SEQ ID NO: 595677 - DNA, 13 bp, D. melanogaster
attttccgctgca

SEQ ID NO: 595678 - DNA, 13 bp, D. melanogaster
attttccgctgct

SEQ ID NO: 595679 - DNA, 14 bp, D. melanogaster
attttccgcttttc

SEQ ID NO: 595680 - DNA, 13 bp, D. melanogaster
attttccggaaaa

SEQ ID NO: 595681 - DNA, 13 bp, D. melanogaster
attttccggctgc

SEQ ID NO: 595682 - DNA, 13 bp, D. melanogaster
attttccgggaaa

SEQ ID NO: 595683 - DNA, 13 bp, D. melanogaster
attttccgttttc

SEQ ID NO: 595684 - DNA, 13 bp, D. melanogaster
attttcctaaaaa

SEQ ID NO: 595685 - DNA, 13 bp, D. melanogaster
attttcctcagtg

SEQ ID NO: 595686 - DNA, 14 bp, D. melanogaster
attttcctcgattt

SEQ ID NO: 595687 - DNA, 13 bp, D. melanogaster
attttcctcgctt

SEQ ID NO: 595688 - DNA, 13 bp, D. melanogaster
attttcctcgttt

SEQ ID NO: 595689 - DNA, 13 bp, D. melanogaster
attttcctctggc

SEQ ID NO: 595690 - DNA, 13 bp, D. melanogaster
attttcctgcatt

SEQ ID NO: 595691 - DNA, 13 bp, D. melanogaster
attttcctgctcc

SEQ ID NO: 595692 - DNA, 13 bp, D. melanogaster
attttcctggaaa

SEQ ID NO: 595693 - DNA, 13 bp, D. melanogaster
attttcctgttta

SEQ ID NO: 595694 - DNA, 14 bp, D. melanogaster
attttcctgtttag

SEQ ID NO: 595695 - DNA, 13 bp, D. melanogaster
attttccttcact

SEQ ID NO: 595696 - DNA, 13 bp, D. melanogaster
attttccttcgct

SEQ ID NO: 595697 - DNA, 13 bp, D. melanogaster
attttccttgaaa

SEQ ID NO: 595698 - DNA, 13 bp, D. melanogaster
attttccttgaat

SEQ ID NO: 595699 - DNA, 13 bp, D. melanogaster
attttcctttagc

SEQ ID NO: 595700 - DNA, 13 bp, D. melanogaster
attttcctttatg

SEQ ID NO: 595701 - DNA, 13 bp, D. melanogaster
attttcctttcgc

SEQ ID NO: 595702 - DNA, 13 bp, D. melanogaster
attttcctttgcc

SEQ ID NO: 595703 - DNA, 13 bp, D. melanogaster
attttccttttgc

SEQ ID NO: 595704 - DNA, 14 bp, D. melanogaster
attttccttttggc

SEQ ID NO: 595705 - DNA, 13 bp, D. melanogaster
attttcgaaaaat

SEQ ID NO: 595706 - DNA, 14 bp, D. melanogaster
attttcgaaaaatc

SEQ ID NO: 595707 - DNA, 13 bp, D. melanogaster
attttcgaaaata

SEQ ID NO: 595708 - DNA, 14 bp, D. melanogaster
attttcgaaaatat

SEQ ID NO: 595709 - DNA, 13 bp, D. melanogaster
attttcgaaaatc

SEQ ID NO: 595710 - DNA, 13 bp, D. melanogaster
attttcgaaaatt

SEQ ID NO: 595711 - DNA, 13 bp, D. melanogaster
attttcgaaacaa

SEQ ID NO: 595712 - DNA, 13 bp, D. melanogaster
attttcgaaataa

SEQ ID NO: 595713 - DNA, 13 bp, D. melanogaster
attttcgaacaaa

SEQ ID NO: 595714 - DNA, 13 bp, D. melanogaster
attttcgaacttt

SEQ ID NO: 595715 - DNA, 14 bp, D. melanogaster
attttcgaatattt

SEQ ID NO: 595716 - DNA, 13 bp, D. melanogaster
attttcgaatttt

SEQ ID NO: 595717 - DNA, 13 bp, D. melanogaster
attttcgacattt

SEQ ID NO: 595718 - DNA, 13 bp, D. melanogaster
attttcgactttt

SEQ ID NO: 595719 - DNA, 13 bp, D. melanogaster
attttcgagtttt

SEQ ID NO: 595720 - DNA, 14 bp, D. melanogaster
attttcgataatat

SEQ ID NO: 595721 - DNA, 13 bp, D. melanogaster
attttcgattaat

SEQ ID NO: 595722 - DNA, 13 bp, D. melanogaster
attttcgattcca

SEQ ID NO: 595723 - DNA, 13 bp, D. melanogaster
attttcgattgtt

SEQ ID NO: 595724 - DNA, 13 bp, D. melanogaster
attttcgatttga

SEQ ID NO: 595725 - DNA, 13 bp, D. melanogaster
attttcgcaaaac

SEQ ID NO: 595726 - DNA, 13 bp, D. melanogaster
attttcgcacatt

SEQ ID NO: 595727 - DNA, 13 bp, D. melanogaster
attttcgcacttt

SEQ ID NO: 595728 - DNA, 13 bp, D. melanogaster
attttcgcataaa

SEQ ID NO: 595729 - DNA, 13 bp, D. melanogaster
attttcgccattt

SEQ ID NO: 595730 - DNA, 13 bp, D. melanogaster
attttcgctcaca

SEQ ID NO: 595731 - DNA, 13 bp, D. melanogaster
attttcgctttga

SEQ ID NO: 595732 - DNA, 13 bp, D. melanogaster
attttcggaaatt

SEQ ID NO: 595733 - DNA, 13 bp, D. melanogaster
attttcggaggct

SEQ ID NO: 595734 - DNA, 13 bp, D. melanogaster
attttcggatttc

SEQ ID NO: 595735 - DNA, 13 bp, D. melanogaster
attttcggcaaat

SEQ ID NO: 595736 - DNA, 13 bp, D. melanogaster
attttcggcattt

SEQ ID NO: 595737 - DNA, 13 bp, D. melanogaster
attttcggccaaa

SEQ ID NO: 595738 - DNA, 13 bp, D. melanogaster
attttcggcctgt

SEQ ID NO: 595739 - DNA, 13 bp, D. melanogaster
attttcggctgcc

SEQ ID NO: 595740 - DNA, 13 bp, D. melanogaster
attttcgggcatt

SEQ ID NO: 595741 - DNA, 13 bp, D. melanogaster
attttcggtatta

SEQ ID NO: 595742 - DNA, 14 bp, D. melanogaster
attttcggtattat

SEQ ID NO: 595743 - DNA, 13 bp, D. melanogaster
attttcggtggct

SEQ ID NO: 595744 - DNA, 13 bp, D. melanogaster
attttcggtttct

SEQ ID NO: 595745 - DNA, 13 bp, D. melanogaster
attttcggtttgg

SEQ ID NO: 595746 - DNA, 14 bp, D. melanogaster
attttcgtacaaat

SEQ ID NO: 595747 - DNA, 13 bp, D. melanogaster
attttcgtatata

SEQ ID NO: 595748 - DNA, 13 bp, D. melanogaster
attttcgtggaaa

SEQ ID NO: 595749 - DNA, 13 bp, D. melanogaster
attttcgtggcat

SEQ ID NO: 595750 - DNA, 13 bp, D. melanogaster
attttcgttaatt

SEQ ID NO: 595751 - DNA, 13 bp, D. melanogaster
attttcgttcaat

SEQ ID NO: 595752 - DNA, 13 bp, D. melanogaster
attttcgttgaaa

SEQ ID NO: 595753 - DNA, 13 bp, D. melanogaster
attttcgtttagt

SEQ ID NO: 595754 - DNA, 14 bp, D. melanogaster
attttcgtttagtt

SEQ ID NO: 595755 - DNA, 13 bp, D. melanogaster
attttcgtttcgc

SEQ ID NO: 595756 - DNA, 14 bp, D. melanogaster
attttcgtttcgtt

SEQ ID NO: 595757 - DNA, 13 bp, D. melanogaster
attttctaaaaac

SEQ ID NO: 595758 - DNA, 13 bp, D. melanogaster
attttctaacgat

SEQ ID NO: 595759 - DNA, 13 bp, D. melanogaster
attttctaattgc

SEQ ID NO: 595760 - DNA, 13 bp, D. melanogaster
attttctaccaaa

SEQ ID NO: 595761 - DNA, 13 bp, D. melanogaster
attttctataaac

SEQ ID NO: 595762 - DNA, 13 bp, D. melanogaster
attttctatatgc

SEQ ID NO: 595763 - DNA, 14 bp, D. melanogaster
attttctatatgca

SEQ ID NO: 595764 - DNA, 13 bp, D. melanogaster
attttctatgaat

SEQ ID NO: 595765 - DNA, 13 bp, D. melanogaster
attttctatgact

SEQ ID NO: 595766 - DNA, 13 bp, D. melanogaster
attttctatgcaa

SEQ ID NO: 595767 - DNA, 14 bp, D. melanogaster
attttctatgcatt

SEQ ID NO: 595768 - DNA, 13 bp, D. melanogaster
attttctatgcca

SEQ ID NO: 595769 - DNA, 13 bp, D. melanogaster
attttctattgaa

SEQ ID NO: 595770 - DNA, 13 bp, D. melanogaster
attttctcaatag

SEQ ID NO: 595771 - DNA, 13 bp, D. melanogaster
attttctcacaca

SEQ ID NO: 595772 - DNA, 14 bp, D. melanogaster
attttctccaattt

SEQ ID NO: 595773 - DNA, 13 bp, D. melanogaster
attttctccgtgt

SEQ ID NO: 595774 - DNA, 14 bp, D. melanogaster
attttctcctgcga

SEQ ID NO: 595775 - DNA, 13 bp, D. melanogaster
attttctcgctgt

SEQ ID NO: 595776 - DNA, 14 bp, D. melanogaster
attttctctctgtg

SEQ ID NO: 595777 - DNA, 13 bp, D. melanogaster
attttctgaaata

SEQ ID NO: 595778 - DNA, 13 bp, D. melanogaster
attttctgaattt

SEQ ID NO: 595779 - DNA, 13 bp, D. melanogaster
attttctgacttg

SEQ ID NO: 595780 - DNA, 14 bp, D. melanogaster
attttctgacttgg

SEQ ID NO: 595781 - DNA, 13 bp, D. melanogaster
attttctgcactt

SEQ ID NO: 595782 - DNA, 13 bp, D. melanogaster
attttctgcattt

SEQ ID NO: 595783 - DNA, 14 bp, D. melanogaster
attttctgccaatt

SEQ ID NO: 595784 - DNA, 13 bp, D. melanogaster
attttctggaaat

SEQ ID NO: 595785 - DNA, 13 bp, D. melanogaster
attttctggattt

SEQ ID NO: 595786 - DNA, 14 bp, D. melanogaster
attttctggtcttg

SEQ ID NO: 595787 - DNA, 13 bp, D. melanogaster
attttctgtaata

SEQ ID NO: 595788 - DNA, 14 bp, D. melanogaster
attttctgtaatat

SEQ ID NO: 595789 - DNA, 13 bp, D. melanogaster
attttctgttaaa

SEQ ID NO: 595790 - DNA, 13 bp, D. melanogaster
attttctgttgcc

SEQ ID NO: 595791 - DNA, 13 bp, D. melanogaster
attttctgttggc

SEQ ID NO: 595792 - DNA, 13 bp, D. melanogaster
attttctgtttgc

SEQ ID NO: 595793 - DNA, 13 bp, D. melanogaster
attttcttaaaag

SEQ ID NO: 595794 - DNA, 13 bp, D. melanogaster
attttcttcaact

SEQ ID NO: 595795 - DNA, 15 bp, D. melanogaster
attttcttcagataa

SEQ ID NO: 595796 - DNA, 13 bp, D. melanogaster
attttcttcagtg

SEQ ID NO: 595797 - DNA, 13 bp, D. melanogaster
attttcttcgagt

SEQ ID NO: 595798 - DNA, 13 bp, D. melanogaster
attttcttgaaaa

SEQ ID NO: 595799 - DNA, 13 bp, D. melanogaster
attttcttggctt

SEQ ID NO: 595800 - DNA, 13 bp, D. melanogaster
attttcttgggtt

SEQ ID NO: 595801 - DNA, 14 bp, D. melanogaster
attttcttgggttc

SEQ ID NO: 595802 - DNA, 13 bp, D. melanogaster
attttcttgtaaa

SEQ ID NO: 595803 - DNA, 13 bp, D. melanogaster
attttcttgtaat

SEQ ID NO: 595804 - DNA, 13 bp, D. melanogaster
attttctttaaga

SEQ ID NO: 595805 - DNA, 13 bp, D. melanogaster
attttgaaaaaag

SEQ ID NO: 595806 - DNA, 13 bp, D. melanogaster
attttgaaaaacg

SEQ ID NO: 595807 - DNA, 13 bp, D. melanogaster
attttgaaaaatg

SEQ ID NO: 595808 - DNA, 14 bp, D. melanogaster
attttgaaaaatgt

SEQ ID NO: 595809 - DNA, 13 bp, D. melanogaster
attttgaaaacaa

SEQ ID NO: 595810 - DNA, 14 bp, D. melanogaster
attttgaaaacatt

SEQ ID NO: 595811 - DNA, 13 bp, D. melanogaster
attttgaaaagaa

SEQ ID NO: 595812 - DNA, 13 bp, D. melanogaster
attttgaaaagtg

SEQ ID NO: 595813 - DNA, 13 bp, D. melanogaster
attttgaaaatca

SEQ ID NO: 595814 - DNA, 13 bp, D. melanogaster
attttgaaaatgc

SEQ ID NO: 595815 - DNA, 14 bp, D. melanogaster
attttgaaaatgtt

SEQ ID NO: 595816 - DNA, 13 bp, D. melanogaster
attttgaaacaaa

SEQ ID NO: 595817 - DNA, 13 bp, D. melanogaster
attttgaaactct

SEQ ID NO: 595818 - DNA, 13 bp, D. melanogaster
attttgaaagaaa

SEQ ID NO: 595819 - DNA, 13 bp, D. melanogaster
attttgaaagcaa

SEQ ID NO: 595820 - DNA, 13 bp, D. melanogaster
attttgaaatact

SEQ ID NO: 595821 - DNA, 13 bp, D. melanogaster
attttgaaatcaa

SEQ ID NO: 595822 - DNA, 14 bp, D. melanogaster
attttgaaatcaaa

SEQ ID NO: 595823 - DNA, 13 bp, D. melanogaster
attttgaaatgaa

SEQ ID NO: 595824 - DNA, 13 bp, D. melanogaster
attttgaaatgta

SEQ ID NO: 595825 - DNA, 13 bp, D. melanogaster
attttgaaatgtt

SEQ ID NO: 595826 - DNA, 13 bp, D. melanogaster
attttgaaattcc

SEQ ID NO: 595827 - DNA, 14 bp, D. melanogaster
attttgaaattgaa

SEQ ID NO: 595828 - DNA, 13 bp, D. melanogaster
attttgaacaatt

SEQ ID NO: 595829 - DNA, 14 bp, D. melanogaster
attttgaacattaa

SEQ ID NO: 595830 - DNA, 13 bp, D. melanogaster
attttgaacattt

SEQ ID NO: 595831 - DNA, 13 bp, D. melanogaster
attttgaactggg

SEQ ID NO: 595832 - DNA, 14 bp, D. melanogaster
attttgaacttcaa

SEQ ID NO: 595833 - DNA, 13 bp, D. melanogaster
attttgaacttga

SEQ ID NO: 595834 - DNA, 13 bp, D. melanogaster
attttgaactttt

SEQ ID NO: 595835 - DNA, 13 bp, D. melanogaster
attttgaagatcg

SEQ ID NO: 595836 - DNA, 13 bp, D. melanogaster
attttgaagcatt

SEQ ID NO: 595837 - DNA, 14 bp, D. melanogaster
attttgaatacttt

SEQ ID NO: 595838 - DNA, 14 bp, D. melanogaster
attttgaatagtgg

SEQ ID NO: 595839 - DNA, 13 bp, D. melanogaster
attttgaatatga

SEQ ID NO: 595840 - DNA, 13 bp, D. melanogaster
attttgaatattg

SEQ ID NO: 595841 - DNA, 13 bp, D. melanogaster
attttgaatcaaa

SEQ ID NO: 595842 - DNA, 13 bp, D. melanogaster
attttgaatgatt

SEQ ID NO: 595843 - DNA, 13 bp, D. melanogaster
attttgaatgcca

SEQ ID NO: 595844 - DNA, 13 bp, D. melanogaster
attttgaatggga

SEQ ID NO: 595845 - DNA, 14 bp, D. melanogaster
attttgaatgggaa

SEQ ID NO: 595846 - DNA, 13 bp, D. melanogaster
attttgaattgaa

SEQ ID NO: 595847 - DNA, 13 bp, D. melanogaster
attttgaatttct

SEQ ID NO: 595848 - DNA, 13 bp, D. melanogaster
attttgacaaaaa

SEQ ID NO: 595849 - DNA, 13 bp, D. melanogaster
attttgacaaaat

SEQ ID NO: 595850 - DNA, 13 bp, D. melanogaster
attttgacaaatg

SEQ ID NO: 595851 - DNA, 14 bp, D. melanogaster
attttgacaatttt

SEQ ID NO: 595852 - DNA, 13 bp, D. melanogaster
attttgacataaa

SEQ ID NO: 595853 - DNA, 13 bp, D. melanogaster
attttgacatttt

SEQ ID NO: 595854 - DNA, 14 bp, D. melanogaster
attttgacattttt

SEQ ID NO: 595855 - DNA, 13 bp, D. melanogaster
attttgaccaaaa

SEQ ID NO: 595856 - DNA, 14 bp, D. melanogaster
attttgaccaattt

SEQ ID NO: 595857 - DNA, 13 bp, D. melanogaster
attttgaccattt

SEQ ID NO: 595858 - DNA, 13 bp, D. melanogaster
attttgacgatgt

SEQ ID NO: 595859 - DNA, 13 bp, D. melanogaster
attttgactattg

SEQ ID NO: 595860 - DNA, 13 bp, D. melanogaster
attttgacttatg

SEQ ID NO: 595861 - DNA, 13 bp, D. melanogaster
attttgactttaa

SEQ ID NO: 595862 - DNA, 13 bp, D. melanogaster
attttgactttga

SEQ ID NO: 595863 - DNA, 13 bp, D. melanogaster
attttgagaaaaa

SEQ ID NO: 595864 - DNA, 15 bp, D. melanogaster
attttgagatagatt

SEQ ID NO: 595865 - DNA, 13 bp, D. melanogaster
attttgagcattt

SEQ ID NO: 595866 - DNA, 13 bp, D. melanogaster
attttgaggaaat

SEQ ID NO: 595867 - DNA, 13 bp, D. melanogaster
attttgagtaaat

SEQ ID NO: 595868 - DNA, 13 bp, D. melanogaster
attttgagtttga

SEQ ID NO: 595869 - DNA, 13 bp, D. melanogaster
attttgataaaca

SEQ ID NO: 595870 - DNA, 13 bp, D. melanogaster
attttgataagta

SEQ ID NO: 595871 - DNA, 13 bp, D. melanogaster
attttgatatgaa

SEQ ID NO: 595872 - DNA, 13 bp, D. melanogaster
attttgatatggg

SEQ ID NO: 595873 - DNA, 13 bp, D. melanogaster
attttgatcaatt

SEQ ID NO: 595874 - DNA, 13 bp, D. melanogaster
attttgatcataa

SEQ ID NO: 595875 - DNA, 13 bp, D. melanogaster
attttgatgaaat

SEQ ID NO: 595876 - DNA, 13 bp, D. melanogaster
attttgatgatga

SEQ ID NO: 595877 - DNA, 13 bp, D. melanogaster
attttgatgcatt

SEQ ID NO: 595878 - DNA, 13 bp, D. melanogaster
attttgatggaaa

SEQ ID NO: 595879 - DNA, 13 bp, D. melanogaster
attttgatggcaa

SEQ ID NO: 595880 - DNA, 13 bp, D. melanogaster
attttgattgatg

SEQ ID NO: 595881 - DNA, 14 bp, D. melanogaster
attttgattgattg

SEQ ID NO: 595882 - DNA, 13 bp, D. melanogaster
attttgattgcat

SEQ ID NO: 595883 - DNA, 13 bp, D. melanogaster
attttgattggaa

SEQ ID NO: 595884 - DNA, 13 bp, D. melanogaster
attttgatttcaa

SEQ ID NO: 595885 - DNA, 13 bp, D. melanogaster
attttgatttcat

SEQ ID NO: 595886 - DNA, 13 bp, D. melanogaster
attttgatttcca

SEQ ID NO: 595887 - DNA, 14 bp, D. melanogaster
attttgatttcgtt

SEQ ID NO: 595888 - DNA, 13 bp, D. melanogaster
attttgatttgaa

SEQ ID NO: 595889 - DNA, 13 bp, D. melanogaster
attttgattttca

SEQ ID NO: 595890 - DNA, 13 bp, D. melanogaster
attttgcaaaaaa

SEQ ID NO: 595891 - DNA, 13 bp, D. melanogaster
attttgcaaaaac

SEQ ID NO: 595892 - DNA, 13 bp, D. melanogaster
attttgcaaaagt

SEQ ID NO: 595893 - DNA, 13 bp, D. melanogaster
attttgcaaaata

SEQ ID NO: 595894 - DNA, 13 bp, D. melanogaster
attttgcaaatat

SEQ ID NO: 595895 - DNA, 14 bp, D. melanogaster
attttgcaaatatt

SEQ ID NO: 595896 - DNA, 13 bp, D. melanogaster
attttgcaaatga

SEQ ID NO: 595897 - DNA, 13 bp, D. melanogaster
attttgcaacatt

SEQ ID NO: 595898 - DNA, 13 bp, D. melanogaster
attttgcaactaa

SEQ ID NO: 595899 - DNA, 13 bp, D. melanogaster
attttgcaagtgc

SEQ ID NO: 595900 - DNA, 13 bp, D. melanogaster
attttgcaatatt

SEQ ID NO: 595901 - DNA, 14 bp, D. melanogaster
attttgcaatttgc

SEQ ID NO: 595902 - DNA, 13 bp, D. melanogaster
attttgcacattt

SEQ ID NO: 595903 - DNA, 13 bp, D. melanogaster
attttgcactgtt

SEQ ID NO: 595904 - DNA, 13 bp, D. melanogaster
attttgcacttgg

SEQ ID NO: 595905 - DNA, 14 bp, D. melanogaster
attttgcagaatgt

SEQ ID NO: 595906 - DNA, 13 bp, D. melanogaster
attttgcagcatt

SEQ ID NO: 595907 - DNA, 14 bp, D. melanogaster
attttgcataaaat

SEQ ID NO: 595908 - DNA, 13 bp, D. melanogaster
attttgcataaat

SEQ ID NO: 595909 - DNA, 13 bp, D. melanogaster
attttgcataatt

SEQ ID NO: 595910 - DNA, 14 bp, D. melanogaster
attttgcataattt

SEQ ID NO: 595911 - DNA, 13 bp, D. melanogaster
attttgcatattt

SEQ ID NO: 595912 - DNA, 14 bp, D. melanogaster
attttgcatatttt

SEQ ID NO: 595913 - DNA, 13 bp, D. melanogaster
attttgcattaaa

SEQ ID NO: 595914 - DNA, 13 bp, D. melanogaster
attttgcattaat

SEQ ID NO: 595915 - DNA, 13 bp, D. melanogaster
attttgcattaca

SEQ ID NO: 595916 - DNA, 14 bp, D. melanogaster
attttgcattataa

SEQ ID NO: 595917 - DNA, 13 bp, D. melanogaster
attttgcattatt

SEQ ID NO: 595918 - DNA, 14 bp, D. melanogaster
attttgcattattt

SEQ ID NO: 595919 - DNA, 13 bp, D. melanogaster
attttgcattcaa

SEQ ID NO: 595920 - DNA, 14 bp, D. melanogaster
attttgcatttaat

SEQ ID NO: 595921 - DNA, 13 bp, D. melanogaster
attttgcatttat

SEQ ID NO: 595922 - DNA, 13 bp, D. melanogaster
attttgcatttcg

SEQ ID NO: 595923 - DNA, 13 bp, D. melanogaster
attttgcatttgc

SEQ ID NO: 595924 - DNA, 14 bp, D. melanogaster
attttgcatttgtt

SEQ ID NO: 595925 - DNA, 14 bp, D. melanogaster
attttgcattttgc

SEQ ID NO: 595926 - DNA, 14 bp, D. melanogaster
attttgcattttgt

SEQ ID NO: 595927 - DNA, 13 bp, D. melanogaster
attttgccaaaaa

SEQ ID NO: 595928 - DNA, 14 bp, D. melanogaster
attttgccaaaaag

SEQ ID NO: 595929 - DNA, 13 bp, D. melanogaster
attttgccaaaca

SEQ ID NO: 595930 - DNA, 13 bp, D. melanogaster
attttgccaaata

SEQ ID NO: 595931 - DNA, 13 bp, D. melanogaster
attttgccaacat

SEQ ID NO: 595932 - DNA, 14 bp, D. melanogaster
attttgccaacatg

SEQ ID NO: 595933 - DNA, 13 bp, D. melanogaster
attttgccagaga

SEQ ID NO: 595934 - DNA, 13 bp, D. melanogaster
attttgccagcta

SEQ ID NO: 595935 - DNA, 13 bp, D. melanogaster
attttgcctttat

SEQ ID NO: 595936 - DNA, 13 bp, D. melanogaster
attttgcggtcat

SEQ ID NO: 595937 - DNA, 13 bp, D. melanogaster
attttgcgttcgc

SEQ ID NO: 595938 - DNA, 13 bp, D. melanogaster
attttgcgtttgt

SEQ ID NO: 595939 - DNA, 13 bp, D. melanogaster
attttgctaatta

SEQ ID NO: 595940 - DNA, 13 bp, D. melanogaster
attttgctcattt

SEQ ID NO: 595941 - DNA, 14 bp, D. melanogaster
attttgctgatcaa

SEQ ID NO: 595942 - DNA, 13 bp, D. melanogaster
attttgctgctgc

SEQ ID NO: 595943 - DNA, 13 bp, D. melanogaster
attttgctgctgt

SEQ ID NO: 595944 - DNA, 13 bp, D. melanogaster
attttgctggcca

SEQ ID NO: 595945 - DNA, 13 bp, D. melanogaster
attttgcttaatt

SEQ ID NO: 595946 - DNA, 13 bp, D. melanogaster
attttgcttactt

SEQ ID NO: 595947 - DNA, 13 bp, D. melanogaster
attttgcttatca

SEQ ID NO: 595948 - DNA, 13 bp, D. melanogaster
attttggaaaaat

SEQ ID NO: 595949 - DNA, 13 bp, D. melanogaster
attttggaaaaca

SEQ ID NO: 595950 - DNA, 13 bp, D. melanogaster
attttggaaaact

SEQ ID NO: 595951 - DNA, 14 bp, D. melanogaster
attttggaaaatat

SEQ ID NO: 595952 - DNA, 13 bp, D. melanogaster
attttggaaatta

SEQ ID NO: 595953 - DNA, 13 bp, D. melanogaster
attttggaagatt

SEQ ID NO: 595954 - DNA, 14 bp, D. melanogaster
attttggaagatta

SEQ ID NO: 595955 - DNA, 13 bp, D. melanogaster
attttggaatatt

SEQ ID NO: 595956 - DNA, 13 bp, D. melanogaster
attttggaattaa

SEQ ID NO: 595957 - DNA, 13 bp, D. melanogaster
attttggaccaac

SEQ ID NO: 595958 - DNA, 13 bp, D. melanogaster
attttggatttcg

SEQ ID NO: 595959 - DNA, 13 bp, D. melanogaster
attttggcaaaaa

SEQ ID NO: 595960 - DNA, 13 bp, D. melanogaster
attttggcaaatc

SEQ ID NO: 595961 - DNA, 13 bp, D. melanogaster
attttggcaaatt

SEQ ID NO: 595962 - DNA, 13 bp, D. melanogaster
attttggcaacaa

SEQ ID NO: 595963 - DNA, 13 bp, D. melanogaster
attttggcaagtt

SEQ ID NO: 595964 - DNA, 14 bp, D. melanogaster
attttggcaataat

SEQ ID NO: 595965 - DNA, 13 bp, D. melanogaster
attttggcagcaa

SEQ ID NO: 595966 - DNA, 13 bp, D. melanogaster
attttggcataaa

SEQ ID NO: 595967 - DNA, 13 bp, D. melanogaster
attttggccaaag

SEQ ID NO: 595968 - DNA, 13 bp, D. melanogaster
attttggccacaa

SEQ ID NO: 595969 - DNA, 14 bp, D. melanogaster
attttggccacaaa

SEQ ID NO: 595970 - DNA, 13 bp, D. melanogaster
attttggccacat

SEQ ID NO: 595971 - DNA, 13 bp, D. melanogaster
attttggccagcc

SEQ ID NO: 595972 - DNA, 13 bp, D. melanogaster
attttggccatgt

SEQ ID NO: 595973 - DNA, 13 bp, D. melanogaster
attttggccattt

SEQ ID NO: 595974 - DNA, 13 bp, D. melanogaster
attttggccgaaa

SEQ ID NO: 595975 - DNA, 13 bp, D. melanogaster
attttggcctgcc

SEQ ID NO: 595976 - DNA, 13 bp, D. melanogaster
attttggctttat

SEQ ID NO: 595977 - DNA, 13 bp, D. melanogaster
attttgggaaaac

SEQ ID NO: 595978 - DNA, 14 bp, D. melanogaster
attttgggcacttg

SEQ ID NO: 595979 - DNA, 13 bp, D. melanogaster
attttgggcttat

SEQ ID NO: 595980 - DNA, 13 bp, D. melanogaster
attttgggtatac

SEQ ID NO: 595981 - DNA, 13 bp, D. melanogaster
attttgggtgaac

SEQ ID NO: 595982 - DNA, 13 bp, D. melanogaster
attttggtaaaaa

SEQ ID NO: 595983 - DNA, 13 bp, D. melanogaster
attttggtatata

SEQ ID NO: 595984 - DNA, 13 bp, D. melanogaster
attttggtgtttc

SEQ ID NO: 595985 - DNA, 13 bp, D. melanogaster
attttggttaaaa

SEQ ID NO: 595986 - DNA, 13 bp, D. melanogaster
attttggtttact

SEQ ID NO: 595987 - DNA, 13 bp, D. melanogaster
attttggtttcag

SEQ ID NO: 595988 - DNA, 13 bp, D. melanogaster
attttggttttgc

SEQ ID NO: 595989 - DNA, 13 bp, D. melanogaster
attttgtaaaatg

SEQ ID NO: 595990 - DNA, 13 bp, D. melanogaster
attttgtaaacat

SEQ ID NO: 595991 - DNA, 13 bp, D. melanogaster
attttgtaaatga

SEQ ID NO: 595992 - DNA, 13 bp, D. melanogaster
attttgtaaccaa

SEQ ID NO: 595993 - DNA, 13 bp, D. melanogaster
attttgtaacttt

SEQ ID NO: 595994 - DNA, 13 bp, D. melanogaster
attttgtaatctt

SEQ ID NO: 595995 - DNA, 13 bp, D. melanogaster
attttgtacaaaa

SEQ ID NO: 595996 - DNA, 13 bp, D. melanogaster
attttgtacaaat

SEQ ID NO: 595997 - DNA, 13 bp, D. melanogaster
attttgtacattt

SEQ ID NO: 595998 - DNA, 14 bp, D. melanogaster
attttgtacatttt

SEQ ID NO: 595999 - DNA, 13 bp, D. melanogaster
attttgtagaaaa

SEQ ID NO: 596000 - DNA, 13 bp, D. melanogaster
attttgtagccaa

SEQ ID NO: 596001 - DNA, 14 bp, D. melanogaster
attttgtagccaag

SEQ ID NO: 596002 - DNA, 14 bp, D. melanogaster
attttgtataaaag

SEQ ID NO: 596003 - DNA, 13 bp, D. melanogaster
attttgtatattc

SEQ ID NO: 596004 - DNA, 13 bp, D. melanogaster
attttgtatcatt

SEQ ID NO: 596005 - DNA, 13 bp, D. melanogaster
attttgtatgaaa

SEQ ID NO: 596006 - DNA, 13 bp, D. melanogaster
attttgtatgcat

SEQ ID NO: 596007 - DNA, 13 bp, D. melanogaster
attttgtattcaa

SEQ ID NO: 596008 - DNA, 13 bp, D. melanogaster
attttgtattcca

SEQ ID NO: 596009 - DNA, 13 bp, D. melanogaster
attttgtatttca

SEQ ID NO: 596010 - DNA, 13 bp, D. melanogaster
attttgtatttcc

SEQ ID NO: 596011 - DNA, 13 bp, D. melanogaster
attttgtcaaaaa

SEQ ID NO: 596012 - DNA, 13 bp, D. melanogaster
attttgtcaaaat

SEQ ID NO: 596013 - DNA, 13 bp, D. melanogaster
attttgtcaaatt

SEQ ID NO: 596014 - DNA, 14 bp, D. melanogaster
attttgtcaaattt

SEQ ID NO: 596015 - DNA, 13 bp, D. melanogaster
attttgtcaattg

SEQ ID NO: 596016 - DNA, 13 bp, D. melanogaster
attttgtcaattt

SEQ ID NO: 596017 - DNA, 13 bp, D. melanogaster
attttgtccgttt

SEQ ID NO: 596018 - DNA, 13 bp, D. melanogaster
attttgtcgattt

SEQ ID NO: 596019 - DNA, 13 bp, D. melanogaster
attttgtctaaaa

SEQ ID NO: 596020 - DNA, 13 bp, D. melanogaster
attttgtctagtt

SEQ ID NO: 596021 - DNA, 14 bp, D. melanogaster
attttgtctagttt

SEQ ID NO: 596022 - DNA, 13 bp, D. melanogaster
attttgtctgtgt

SEQ ID NO: 596023 - DNA, 13 bp, D. melanogaster
attttgtgaaaaa

SEQ ID NO: 596024 - DNA, 13 bp, D. melanogaster
attttgtgaaatt

SEQ ID NO: 596025 - DNA, 14 bp, D. melanogaster
attttgtgaagaag

SEQ ID NO: 596026 - DNA, 13 bp, D. melanogaster
attttgtgaatta

SEQ ID NO: 596027 - DNA, 13 bp, D. melanogaster
attttgtgacttt

SEQ ID NO: 596028 - DNA, 14 bp, D. melanogaster
attttgtgatcttt

SEQ ID NO: 596029 - DNA, 13 bp, D. melanogaster
attttgtgcaaat

SEQ ID NO: 596030 - DNA, 13 bp, D. melanogaster
attttgtgcattt

SEQ ID NO: 596031 - DNA, 13 bp, D. melanogaster
attttgtgccatt

SEQ ID NO: 596032 - DNA, 13 bp, D. melanogaster
attttgtgccttt

SEQ ID NO: 596033 - DNA, 13 bp, D. melanogaster
attttgtgcggtt

SEQ ID NO: 596034 - DNA, 13 bp, D. melanogaster
attttgtggcaaa

SEQ ID NO: 596035 - DNA, 13 bp, D. melanogaster
attttgtggcagc

SEQ ID NO: 596036 - DNA, 13 bp, D. melanogaster
attttgtggcata

SEQ ID NO: 596037 - DNA, 13 bp, D. melanogaster
attttgtggccaa

SEQ ID NO: 596038 - DNA, 13 bp, D. melanogaster
attttgtggctaa

SEQ ID NO: 596039 - DNA, 13 bp, D. melanogaster
attttgtggctgt

SEQ ID NO: 596040 - DNA, 14 bp, D. melanogaster
attttgtggctttt

SEQ ID NO: 596041 - DNA, 13 bp, D. melanogaster
attttgtgggcgt

SEQ ID NO: 596042 - DNA, 13 bp, D. melanogaster
attttgtggtcag

SEQ ID NO: 596043 - DNA, 13 bp, D. melanogaster
attttgtgtactt

SEQ ID NO: 596044 - DNA, 13 bp, D. melanogaster
attttgtgtatgg

SEQ ID NO: 596045 - DNA, 13 bp, D. melanogaster
attttgtgtgcac

SEQ ID NO: 596046 - DNA, 13 bp, D. melanogaster
attttgtgttgcc

SEQ ID NO: 596047 - DNA, 13 bp, D. melanogaster
attttgttaaaca

SEQ ID NO: 596048 - DNA, 13 bp, D. melanogaster
attttgttaacaa

SEQ ID NO: 596049 - DNA, 13 bp, D. melanogaster
attttgttaagaa

SEQ ID NO: 596050 - DNA, 13 bp, D. melanogaster
attttgttacatt

SEQ ID NO: 596051 - DNA, 14 bp, D. melanogaster
attttgttacattt

SEQ ID NO: 596052 - DNA, 13 bp, D. melanogaster
attttgttagctt

SEQ ID NO: 596053 - DNA, 13 bp, D. melanogaster
attttgttcagtg

SEQ ID NO: 596054 - DNA, 13 bp, D. melanogaster
attttgttgaaac

SEQ ID NO: 596055 - DNA, 13 bp, D. melanogaster
attttgttgactt

SEQ ID NO: 596056 - DNA, 13 bp, D. melanogaster
attttgttgcaat

SEQ ID NO: 596057 - DNA, 13 bp, D. melanogaster
attttgttgccat

SEQ ID NO: 596058 - DNA, 13 bp, D. melanogaster
attttgttgctgt

SEQ ID NO: 596059 - DNA, 13 bp, D. melanogaster
attttgttggaaa

SEQ ID NO: 596060 - DNA, 13 bp, D. melanogaster
attttgttggcaa

SEQ ID NO: 596061 - DNA, 13 bp, D. melanogaster
attttgttggcat

SEQ ID NO: 596062 - DNA, 14 bp, D. melanogaster
attttgttggccaa

SEQ ID NO: 596063 - DNA, 13 bp, D. melanogaster
attttgttgtaaa

SEQ ID NO: 596064 - DNA, 13 bp, D. melanogaster
attttgttgtact

SEQ ID NO: 596065 - DNA, 13 bp, D. melanogaster
attttgtttacaa

SEQ ID NO: 596066 - DNA, 14 bp, D. melanogaster
attttgtttacaaa

SEQ ID NO: 596067 - DNA, 13 bp, D. melanogaster
attttgtttacat

SEQ ID NO: 596068 - DNA, 13 bp, D. melanogaster
attttgtttatac

SEQ ID NO: 596069 - DNA, 13 bp, D. melanogaster
attttgtttcact

SEQ ID NO: 596070 - DNA, 14 bp, D. melanogaster
attttgtttgaaaa

SEQ ID NO: 596071 - DNA, 14 bp, D. melanogaster
attttgtttgccaa

SEQ ID NO: 596072 - DNA, 14 bp, D. melanogaster
attttgtttgcctt

SEQ ID NO: 596073 - DNA, 13 bp, D. melanogaster
attttgtttgcgg

SEQ ID NO: 596074 - DNA, 13 bp, D. melanogaster
attttgtttgctc

SEQ ID NO: 596075 - DNA, 13 bp, D. melanogaster
attttgtttggct

SEQ ID NO: 596076 - DNA, 14 bp, D. melanogaster
attttgtttggctt

SEQ ID NO: 596077 - DNA, 14 bp, D. melanogaster
attttgtttgtcaa

SEQ ID NO: 596078 - DNA, 16 bp, D. melanogaster
attttgtttgtcaaat

SEQ ID NO: 596079 - DNA, 13 bp, D. melanogaster
attttgttttcaa

SEQ ID NO: 596080 - DNA, 14 bp, D. melanogaster
attttgttttcaat

SEQ ID NO: 596081 - DNA, 14 bp, D. melanogaster
attttgttttccta

SEQ ID NO: 596082 - DNA, 13 bp, D. melanogaster
atttttaaaacga

SEQ ID NO: 596083 - DNA, 13 bp, D. melanogaster
atttttaaaagga

SEQ ID NO: 596084 - DNA, 14 bp, D. melanogaster
atttttaaaaggat

SEQ ID NO: 596085 - DNA, 13 bp, D. melanogaster
atttttaaacaca

SEQ ID NO: 596086 - DNA, 14 bp, D. melanogaster
atttttaaaccaaa

SEQ ID NO: 596087 - DNA, 13 bp, D. melanogaster
atttttaaacctt

SEQ ID NO: 596088 - DNA, 14 bp, D. melanogaster
atttttaaagcaat

SEQ ID NO: 596089 - DNA, 13 bp, D. melanogaster
atttttaaagcac

SEQ ID NO: 596090 - DNA, 13 bp, D. melanogaster
atttttaaaggca

SEQ ID NO: 596091 - DNA, 13 bp, D. melanogaster
atttttaaagtgt

SEQ ID NO: 596092 - DNA, 13 bp, D. melanogaster
atttttaaatccg

SEQ ID NO: 596093 - DNA, 13 bp, D. melanogaster
atttttaaatgct

SEQ ID NO: 596094 - DNA, 13 bp, D. melanogaster
atttttaaatgga

SEQ ID NO: 596095 - DNA, 13 bp, D. melanogaster
atttttaacagaa

SEQ ID NO: 596096 - DNA, 13 bp, D. melanogaster
atttttaacagtt

SEQ ID NO: 596097 - DNA, 13 bp, D. melanogaster
atttttaacgaaa

SEQ ID NO: 596098 - DNA, 13 bp, D. melanogaster
atttttaacgttt

SEQ ID NO: 596099 - DNA, 14 bp, D. melanogaster
atttttaacgtttg

SEQ ID NO: 596100 - DNA, 13 bp, D. melanogaster
atttttaagaaga

SEQ ID NO: 596101 - DNA, 13 bp, D. melanogaster
atttttaagagcc

SEQ ID NO: 596102 - DNA, 13 bp, D. melanogaster
atttttaagcaat

SEQ ID NO: 596103 - DNA, 13 bp, D. melanogaster
atttttaagcagt

SEQ ID NO: 596104 - DNA, 13 bp, D. melanogaster
atttttaagcata

SEQ ID NO: 596105 - DNA, 13 bp, D. melanogaster
atttttaagcatt

SEQ ID NO: 596106 - DNA, 13 bp, D. melanogaster
atttttaaggaaa

SEQ ID NO: 596107 - DNA, 13 bp, D. melanogaster
atttttaaggaat

SEQ ID NO: 596108 - DNA, 13 bp, D. melanogaster
atttttaaggttg

SEQ ID NO: 596109 - DNA, 14 bp, D. melanogaster
atttttaatatgca

SEQ ID NO: 596110 - DNA, 13 bp, D. melanogaster
atttttaatctgt

SEQ ID NO: 596111 - DNA, 14 bp, D. melanogaster
atttttaatgaaac

SEQ ID NO: 596112 - DNA, 13 bp, D. melanogaster
atttttaatgagt

SEQ ID NO: 596113 - DNA, 13 bp, D. melanogaster
atttttaatgatg

SEQ ID NO: 596114 - DNA, 13 bp, D. melanogaster
atttttaatgcaa

SEQ ID NO: 596115 - DNA, 13 bp, D. melanogaster
atttttaatgcca

SEQ ID NO: 596116 - DNA, 13 bp, D. melanogaster
atttttaatgcta

SEQ ID NO: 596117 - DNA, 13 bp, D. melanogaster
atttttaatggaa

SEQ ID NO: 596118 - DNA, 13 bp, D. melanogaster
atttttaattagc

SEQ ID NO: 596119 - DNA, 13 bp, D. melanogaster
atttttaattcac

SEQ ID NO: 596120 - DNA, 13 bp, D. melanogaster
atttttaattgca

SEQ ID NO: 596121 - DNA, 13 bp, D. melanogaster
atttttacaaact

SEQ ID NO: 596122 - DNA, 13 bp, D. melanogaster
atttttacaagca

SEQ ID NO: 596123 - DNA, 14 bp, D. melanogaster
atttttacaagcaa

SEQ ID NO: 596124 - DNA, 14 bp, D. melanogaster
atttttacacaaaa

SEQ ID NO: 596125 - DNA, 13 bp, D. melanogaster
atttttacgattg

SEQ ID NO: 596126 - DNA, 13 bp, D. melanogaster
atttttacgattt

SEQ ID NO: 596127 - DNA, 13 bp, D. melanogaster
atttttacttgat

SEQ ID NO: 596128 - DNA, 13 bp, D. melanogaster
atttttactttga

SEQ ID NO: 596129 - DNA, 13 bp, D. melanogaster
atttttagacaaa

SEQ ID NO: 596130 - DNA, 13 bp, D. melanogaster
atttttagcaatt

SEQ ID NO: 596131 - DNA, 13 bp, D. melanogaster
atttttagcactt

SEQ ID NO: 596132 - DNA, 13 bp, D. melanogaster
atttttagcattt

SEQ ID NO: 596133 - DNA, 13 bp, D. melanogaster
atttttagctctt

SEQ ID NO: 596134 - DNA, 13 bp, D. melanogaster
atttttagtgaaa

SEQ ID NO: 596135 - DNA, 13 bp, D. melanogaster
atttttataagcc

SEQ ID NO: 596136 - DNA, 14 bp, D. melanogaster
atttttatacccgt

SEQ ID NO: 596137 - DNA, 13 bp, D. melanogaster
atttttatacgat

SEQ ID NO: 596138 - DNA, 13 bp, D. melanogaster
atttttatagcca

SEQ ID NO: 596139 - DNA, 13 bp, D. melanogaster
atttttatatgca

SEQ ID NO: 596140 - DNA, 14 bp, D. melanogaster
atttttatatgctt

SEQ ID NO: 596141 - DNA, 13 bp, D. melanogaster
atttttatcgatt

SEQ ID NO: 596142 - DNA, 13 bp, D. melanogaster
atttttatcgctt

SEQ ID NO: 596143 - DNA, 13 bp, D. melanogaster
atttttatctgta

SEQ ID NO: 596144 - DNA, 13 bp, D. melanogaster
atttttatgaaca

SEQ ID NO: 596145 - DNA, 13 bp, D. melanogaster
atttttatgaact

SEQ ID NO: 596146 - DNA, 13 bp, D. melanogaster
atttttatgatca

SEQ ID NO: 596147 - DNA, 13 bp, D. melanogaster
atttttatgcaaa

SEQ ID NO: 596148 - DNA, 14 bp, D. melanogaster
atttttatgcaaaa

SEQ ID NO: 596149 - DNA, 13 bp, D. melanogaster
atttttatgccat

SEQ ID NO: 596150 - DNA, 13 bp, D. melanogaster
atttttatgccgc

SEQ ID NO: 596151 - DNA, 13 bp, D. melanogaster
atttttatgctgc

SEQ ID NO: 596152 - DNA, 13 bp, D. melanogaster
atttttatgctta

SEQ ID NO: 596153 - DNA, 14 bp, D. melanogaster
atttttatgcttag

SEQ ID NO: 596154 - DNA, 13 bp, D. melanogaster
atttttatggcat

SEQ ID NO: 596155 - DNA, 13 bp, D. melanogaster
atttttatggcca

SEQ ID NO: 596156 - DNA, 13 bp, D. melanogaster
atttttattagca

SEQ ID NO: 596157 - DNA, 13 bp, D. melanogaster
atttttattatgc

SEQ ID NO: 596158 - DNA, 13 bp, D. melanogaster
atttttattgatc

SEQ ID NO: 596159 - DNA, 14 bp, D. melanogaster
atttttattgatca

SEQ ID NO: 596160 - DNA, 14 bp, D. melanogaster
atttttatttgcat

SEQ ID NO: 596161 - DNA, 13 bp, D. melanogaster
atttttatttgcc

SEQ ID NO: 596162 - DNA, 14 bp, D. melanogaster
atttttatttgcct

SEQ ID NO: 596163 - DNA, 13 bp, D. melanogaster
atttttcaaaaca

SEQ ID NO: 596164 - DNA, 13 bp, D. melanogaster
atttttcaaaagt

SEQ ID NO: 596165 - DNA, 13 bp, D. melanogaster
atttttcaaagtt

SEQ ID NO: 596166 - DNA, 13 bp, D. melanogaster
atttttcaaatga

SEQ ID NO: 596167 - DNA, 13 bp, D. melanogaster
atttttcaaatgc

SEQ ID NO: 596168 - DNA, 13 bp, D. melanogaster
atttttcaaatgg

SEQ ID NO: 596169 - DNA, 13 bp, D. melanogaster
atttttcaaatgt

SEQ ID NO: 596170 - DNA, 14 bp, D. melanogaster
atttttcaaatgtt

SEQ ID NO: 596171 - DNA, 13 bp, D. melanogaster
atttttcaacaaa

SEQ ID NO: 596172 - DNA, 14 bp, D. melanogaster
atttttcaacaaaa

SEQ ID NO: 596173 - DNA, 13 bp, D. melanogaster
atttttcaacaat

SEQ ID NO: 596174 - DNA, 14 bp, D. melanogaster
atttttcaacaatt

SEQ ID NO: 596175 - DNA, 13 bp, D. melanogaster
atttttcaacatt

SEQ ID NO: 596176 - DNA, 13 bp, D. melanogaster
atttttcaagaaa

SEQ ID NO: 596177 - DNA, 13 bp, D. melanogaster
atttttcaagcat

SEQ ID NO: 596178 - DNA, 13 bp, D. melanogaster
atttttcaagtgt

SEQ ID NO: 596179 - DNA, 14 bp, D. melanogaster
atttttcaatagct

SEQ ID NO: 596180 - DNA, 13 bp, D. melanogaster
atttttcaatgct

SEQ ID NO: 596181 - DNA, 14 bp, D. melanogaster
atttttcaattaag

SEQ ID NO: 596182 - DNA, 13 bp, D. melanogaster
atttttcacaaca

SEQ ID NO: 596183 - DNA, 13 bp, D. melanogaster
atttttcacacac

SEQ ID NO: 596184 - DNA, 13 bp, D. melanogaster
atttttcacacat

SEQ ID NO: 596185 - DNA, 13 bp, D. melanogaster
atttttcacagtt

SEQ ID NO: 596186 - DNA, 14 bp, D. melanogaster
atttttcacatttc

SEQ ID NO: 596187 - DNA, 13 bp, D. melanogaster
atttttcaccaag

SEQ ID NO: 596188 - DNA, 13 bp, D. melanogaster
atttttcacctgc

SEQ ID NO: 596189 - DNA, 13 bp, D. melanogaster
atttttcagattt

SEQ ID NO: 596190 - DNA, 13 bp, D. melanogaster
atttttcagctgc

SEQ ID NO: 596191 - DNA, 14 bp, D. melanogaster
atttttcaggatgt

SEQ ID NO: 596192 - DNA, 13 bp, D. melanogaster
atttttcagtttc

SEQ ID NO: 596193 - DNA, 13 bp, D. melanogaster
atttttcatcaaa

SEQ ID NO: 596194 - DNA, 13 bp, D. melanogaster
atttttcatgcca

SEQ ID NO: 596195 - DNA, 13 bp, D. melanogaster
atttttcattcga

SEQ ID NO: 596196 - DNA, 13 bp, D. melanogaster
atttttcattgcc

SEQ ID NO: 596197 - DNA, 13 bp, D. melanogaster
atttttccaaaac

SEQ ID NO: 596198 - DNA, 13 bp, D. melanogaster
atttttccaaaga

SEQ ID NO: 596199 - DNA, 13 bp, D. melanogaster
atttttccaaatt

SEQ ID NO: 596200 - DNA, 13 bp, D. melanogaster
atttttccaacat

SEQ ID NO: 596201 - DNA, 13 bp, D. melanogaster
atttttccaacta

SEQ ID NO: 596202 - DNA, 13 bp, D. melanogaster
atttttccaactg

SEQ ID NO: 596203 - DNA, 13 bp, D. melanogaster
atttttccaagtg

SEQ ID NO: 596204 - DNA, 14 bp, D. melanogaster
atttttccaagtgt

SEQ ID NO: 596205 - DNA, 13 bp, D. melanogaster
atttttccaataa

SEQ ID NO: 596206 - DNA, 14 bp, D. melanogaster
atttttccaataat

SEQ ID NO: 596207 - DNA, 13 bp, D. melanogaster
atttttccacagc

SEQ ID NO: 596208 - DNA, 13 bp, D. melanogaster
atttttccagcaa

SEQ ID NO: 596209 - DNA, 13 bp, D. melanogaster
atttttccatgtc

SEQ ID NO: 596210 - DNA, 13 bp, D. melanogaster
atttttccattgc

SEQ ID NO: 596211 - DNA, 13 bp, D. melanogaster
atttttcccaaaa

SEQ ID NO: 596212 - DNA, 13 bp, D. melanogaster
atttttcccaata

SEQ ID NO: 596213 - DNA, 14 bp, D. melanogaster
atttttcccaataa

SEQ ID NO: 596214 - DNA, 13 bp, D. melanogaster
atttttccccatt

SEQ ID NO: 596215 - DNA, 13 bp, D. melanogaster
atttttccgaacc

SEQ ID NO: 596216 - DNA, 13 bp, D. melanogaster
atttttccgcttt

SEQ ID NO: 596217 - DNA, 14 bp, D. melanogaster
atttttccttggtt

SEQ ID NO: 596218 - DNA, 13 bp, D. melanogaster
atttttcgaaaaa

SEQ ID NO: 596219 - DNA, 14 bp, D. melanogaster
atttttcgaaaata

SEQ ID NO: 596220 - DNA, 13 bp, D. melanogaster
atttttcgagtgc

SEQ ID NO: 596221 - DNA, 13 bp, D. melanogaster
atttttcgcaaaa

SEQ ID NO: 596222 - DNA, 14 bp, D. melanogaster
atttttcgcaaaaa

SEQ ID NO: 596223 - DNA, 13 bp, D. melanogaster
atttttcgcaaat

SEQ ID NO: 596224 - DNA, 13 bp, D. melanogaster
atttttcgcaatt

SEQ ID NO: 596225 - DNA, 14 bp, D. melanogaster
atttttcgcaattt

SEQ ID NO: 596226 - DNA, 14 bp, D. melanogaster
atttttcgcagtgc

SEQ ID NO: 596227 - DNA, 13 bp, D. melanogaster
atttttcgcattt

SEQ ID NO: 596228 - DNA, 14 bp, D. melanogaster
atttttcgcatttt

SEQ ID NO: 596229 - DNA, 13 bp, D. melanogaster
atttttcgccaaa

SEQ ID NO: 596230 - DNA, 13 bp, D. melanogaster
atttttcggaaaa

SEQ ID NO: 596231 - DNA, 14 bp, D. melanogaster
atttttcggcttgt

SEQ ID NO: 596232 - DNA, 13 bp, D. melanogaster
atttttctaaaag

SEQ ID NO: 596233 - DNA, 13 bp, D. melanogaster
atttttctaaact

SEQ ID NO: 596234 - DNA, 13 bp, D. melanogaster
atttttctataac

SEQ ID NO: 596235 - DNA, 13 bp, D. melanogaster
atttttctataca

SEQ ID NO: 596236 - DNA, 13 bp, D. melanogaster
atttttctcaaaa

SEQ ID NO: 596237 - DNA, 13 bp, D. melanogaster
atttttctcccag

SEQ ID NO: 596238 - DNA, 13 bp, D. melanogaster
atttttctcgctt

SEQ ID NO: 596239 - DNA, 13 bp, D. melanogaster
atttttctcggca

SEQ ID NO: 596240 - DNA, 13 bp, D. melanogaster
atttttctcggtg

SEQ ID NO: 596241 - DNA, 13 bp, D. melanogaster
atttttctgcagc

SEQ ID NO: 596242 - DNA, 13 bp, D. melanogaster
atttttctgcatt

SEQ ID NO: 596243 - DNA, 13 bp, D. melanogaster
atttttctggtat

SEQ ID NO: 596244 - DNA, 13 bp, D. melanogaster
atttttctgtgtg

SEQ ID NO: 596245 - DNA, 13 bp, D. melanogaster
atttttcttgctg

SEQ ID NO: 596246 - DNA, 13 bp, D. melanogaster
atttttcttggat

SEQ ID NO: 596247 - DNA, 13 bp, D. melanogaster
atttttcttggct

SEQ ID NO: 596248 - DNA, 13 bp, D. melanogaster
atttttcttgggt

SEQ ID NO: 596249 - DNA, 13 bp, D. melanogaster
atttttcttggtc

SEQ ID NO: 596250 - DNA, 13 bp, D. melanogaster
atttttctttggc

SEQ ID NO: 596251 - DNA, 13 bp, D. melanogaster
atttttgaaaaca

SEQ ID NO: 596252 - DNA, 14 bp, D. melanogaster
atttttgaaaactt

SEQ ID NO: 596253 - DNA, 13 bp, D. melanogaster
atttttgaaacat

SEQ ID NO: 596254 - DNA, 13 bp, D. melanogaster
atttttgaaagtg

SEQ ID NO: 596255 - DNA, 13 bp, D. melanogaster
atttttgaaattg

SEQ ID NO: 596256 - DNA, 13 bp, D. melanogaster
atttttgaacaca

SEQ ID NO: 596257 - DNA, 13 bp, D. melanogaster
atttttgaacatt

SEQ ID NO: 596258 - DNA, 14 bp, D. melanogaster
atttttgaactttt

SEQ ID NO: 596259 - DNA, 13 bp, D. melanogaster
atttttgaataga

SEQ ID NO: 596260 - DNA, 13 bp, D. melanogaster
atttttgaatatg

SEQ ID NO: 596261 - DNA, 13 bp, D. melanogaster
atttttgaatttc

SEQ ID NO: 596262 - DNA, 13 bp, D. melanogaster
atttttgacattt

SEQ ID NO: 596263 - DNA, 13 bp, D. melanogaster
atttttgagcaaa

SEQ ID NO: 596264 - DNA, 14 bp, D. melanogaster
atttttgagcatat

SEQ ID NO: 596265 - DNA, 13 bp, D. melanogaster
atttttgagtcat

SEQ ID NO: 596266 - DNA, 13 bp, D. melanogaster
atttttgagtgca

SEQ ID NO: 596267 - DNA, 13 bp, D. melanogaster
atttttgagttaa

SEQ ID NO: 596268 - DNA, 14 bp, D. melanogaster
atttttgataaaac

SEQ ID NO: 596269 - DNA, 13 bp, D. melanogaster
atttttgataaac

SEQ ID NO: 596270 - DNA, 13 bp, D. melanogaster
atttttgataaag

SEQ ID NO: 596271 - DNA, 14 bp, D. melanogaster
atttttgatcaagg

SEQ ID NO: 596272 - DNA, 13 bp, D. melanogaster
atttttgatcaat

SEQ ID NO: 596273 - DNA, 14 bp, D. melanogaster
atttttgatcaatt

SEQ ID NO: 596274 - DNA, 13 bp, D. melanogaster
atttttgatggca

SEQ ID NO: 596275 - DNA, 13 bp, D. melanogaster
atttttgattaca

SEQ ID NO: 596276 - DNA, 13 bp, D. melanogaster
atttttgattgct

SEQ ID NO: 596277 - DNA, 14 bp, D. melanogaster
atttttgatttcct

SEQ ID NO: 596278 - DNA, 14 bp, D. melanogaster
atttttgattttcg

SEQ ID NO: 596279 - DNA, 13 bp, D. melanogaster
atttttgcaaata

SEQ ID NO: 596280 - DNA, 13 bp, D. melanogaster
atttttgcaaatg

SEQ ID NO: 596281 - DNA, 13 bp, D. melanogaster
atttttgcaacaa

SEQ ID NO: 596282 - DNA, 13 bp, D. melanogaster
atttttgcaacat

SEQ ID NO: 596283 - DNA, 13 bp, D. melanogaster
atttttgcaagtg

SEQ ID NO: 596284 - DNA, 13 bp, D. melanogaster
atttttgcaatta

SEQ ID NO: 596285 - DNA, 14 bp, D. melanogaster
atttttgcaattaa

SEQ ID NO: 596286 - DNA, 14 bp, D. melanogaster
atttttgcaatttt

SEQ ID NO: 596287 - DNA, 13 bp, D. melanogaster
atttttgcacagg

SEQ ID NO: 596288 - DNA, 13 bp, D. melanogaster
atttttgcagcat

SEQ ID NO: 596289 - DNA, 14 bp, D. melanogaster
atttttgcataaat

SEQ ID NO: 596290 - DNA, 13 bp, D. melanogaster
atttttgcataat

SEQ ID NO: 596291 - DNA, 14 bp, D. melanogaster
atttttgcatatct

SEQ ID NO: 596292 - DNA, 13 bp, D. melanogaster
atttttgcatgtt

SEQ ID NO: 596293 - DNA, 13 bp, D. melanogaster
atttttgccaaaa

SEQ ID NO: 596294 - DNA, 13 bp, D. melanogaster
atttttgccaagt

SEQ ID NO: 596295 - DNA, 13 bp, D. melanogaster
atttttgccaatt

SEQ ID NO: 596296 - DNA, 13 bp, D. melanogaster
atttttgccagtg

SEQ ID NO: 596297 - DNA, 14 bp, D. melanogaster
atttttgccatttt

SEQ ID NO: 596298 - DNA, 13 bp, D. melanogaster
atttttgcctgct

SEQ ID NO: 596299 - DNA, 13 bp, D. melanogaster
atttttgcgaaaa

SEQ ID NO: 596300 - DNA, 13 bp, D. melanogaster
atttttgcgctcg

SEQ ID NO: 596301 - DNA, 13 bp, D. melanogaster
atttttgctcatt

SEQ ID NO: 596302 - DNA, 14 bp, D. melanogaster
atttttgctcattt

SEQ ID NO: 596303 - DNA, 13 bp, D. melanogaster
atttttgctgcaa

SEQ ID NO: 596304 - DNA, 13 bp, D. melanogaster
atttttgcttaat

SEQ ID NO: 596305 - DNA, 14 bp, D. melanogaster
atttttgcttaatt

SEQ ID NO: 596306 - DNA, 13 bp, D. melanogaster
atttttgcttatg

SEQ ID NO: 596307 - DNA, 14 bp, D. melanogaster
atttttgctttgat

SEQ ID NO: 596308 - DNA, 13 bp, D. melanogaster
atttttggaaatt

SEQ ID NO: 596309 - DNA, 14 bp, D. melanogaster
atttttggacactc

SEQ ID NO: 596310 - DNA, 13 bp, D. melanogaster
atttttggagacc

SEQ ID NO: 596311 - DNA, 13 bp, D. melanogaster
atttttggataat

SEQ ID NO: 596312 - DNA, 13 bp, D. melanogaster
atttttggatttc

SEQ ID NO: 596313 - DNA, 13 bp, D. melanogaster
atttttggcaaaa

SEQ ID NO: 596314 - DNA, 14 bp, D. melanogaster
atttttggcaaaaa

SEQ ID NO: 596315 - DNA, 13 bp, D. melanogaster
atttttggcaaat

SEQ ID NO: 596316 - DNA, 13 bp, D. melanogaster
atttttggcaatt

SEQ ID NO: 596317 - DNA, 14 bp, D. melanogaster
atttttggcaattt

SEQ ID NO: 596318 - DNA, 13 bp, D. melanogaster
atttttggcactt

SEQ ID NO: 596319 - DNA, 13 bp, D. melanogaster
atttttggcagtg

SEQ ID NO: 596320 - DNA, 13 bp, D. melanogaster
atttttggcattc

SEQ ID NO: 596321 - DNA, 13 bp, D. melanogaster
atttttggcattg

SEQ ID NO: 596322 - DNA, 13 bp, D. melanogaster
atttttggcattt

SEQ ID NO: 596323 - DNA, 13 bp, D. melanogaster
atttttggccaaa

SEQ ID NO: 596324 - DNA, 13 bp, D. melanogaster
atttttggccaat

SEQ ID NO: 596325 - DNA, 13 bp, D. melanogaster
atttttggccaca

SEQ ID NO: 596326 - DNA, 13 bp, D. melanogaster
atttttggcgaaa

SEQ ID NO: 596327 - DNA, 13 bp, D. melanogaster
atttttggcttgg

SEQ ID NO: 596328 - DNA, 14 bp, D. melanogaster
atttttggctttgc

SEQ ID NO: 596329 - DNA, 13 bp, D. melanogaster
atttttgggaaaa

SEQ ID NO: 596330 - DNA, 13 bp, D. melanogaster
atttttgggaaat

SEQ ID NO: 596331 - DNA, 13 bp, D. melanogaster
atttttgggaatt

SEQ ID NO: 596332 - DNA, 15 bp, D. melanogaster
atttttgggacacaa

SEQ ID NO: 596333 - DNA, 13 bp, D. melanogaster
atttttggggaaa

SEQ ID NO: 596334 - DNA, 13 bp, D. melanogaster
atttttgggggaa

SEQ ID NO: 596335 - DNA, 13 bp, D. melanogaster
atttttgggtaaa

SEQ ID NO: 596336 - DNA, 13 bp, D. melanogaster
atttttgggttaa

SEQ ID NO: 596337 - DNA, 13 bp, D. melanogaster
atttttggtataa

SEQ ID NO: 596338 - DNA, 13 bp, D. melanogaster
atttttggttaaa

SEQ ID NO: 596339 - DNA, 13 bp, D. melanogaster
atttttggttgaa

SEQ ID NO: 596340 - DNA, 13 bp, D. melanogaster
atttttgtaactt

SEQ ID NO: 596341 - DNA, 13 bp, D. melanogaster
atttttgtaagct

SEQ ID NO: 596342 - DNA, 13 bp, D. melanogaster
atttttgtaatca

SEQ ID NO: 596343 - DNA, 14 bp, D. melanogaster
atttttgtacattt

SEQ ID NO: 596344 - DNA, 13 bp, D. melanogaster
atttttgtactta

SEQ ID NO: 596345 - DNA, 14 bp, D. melanogaster
atttttgtattatc

SEQ ID NO: 596346 - DNA, 13 bp, D. melanogaster
atttttgtcaaat

SEQ ID NO: 596347 - DNA, 14 bp, D. melanogaster
atttttgtcaaatt

SEQ ID NO: 596348 - DNA, 13 bp, D. melanogaster
atttttgtcaaca

SEQ ID NO: 596349 - DNA, 13 bp, D. melanogaster
atttttgtcaatt

SEQ ID NO: 596350 - DNA, 13 bp, D. melanogaster
atttttgtcttaa

SEQ ID NO: 596351 - DNA, 13 bp, D. melanogaster
atttttgtgataa

SEQ ID NO: 596352 - DNA, 13 bp, D. melanogaster
atttttgtgcagc

SEQ ID NO: 596353 - DNA, 13 bp, D. melanogaster
atttttgtgctca

SEQ ID NO: 596354 - DNA, 13 bp, D. melanogaster
atttttgtgctgt

SEQ ID NO: 596355 - DNA, 13 bp, D. melanogaster
atttttgtggcaa

SEQ ID NO: 596356 - DNA, 13 bp, D. melanogaster
atttttgtggcta

SEQ ID NO: 596357 - DNA, 13 bp, D. melanogaster
atttttgtgggct

SEQ ID NO: 596358 - DNA, 13 bp, D. melanogaster
atttttgtggtaa

SEQ ID NO: 596359 - DNA, 13 bp, D. melanogaster
atttttgttaccg

SEQ ID NO: 596360 - DNA, 15 bp, D. melanogaster
atttttgttaccgcc

SEQ ID NO: 596361 - DNA, 13 bp, D. melanogaster
atttttgttagag

SEQ ID NO: 596362 - DNA, 13 bp, D. melanogaster
atttttgttcaag

SEQ ID NO: 596363 - DNA, 13 bp, D. melanogaster
atttttgttcaat

SEQ ID NO: 596364 - DNA, 13 bp, D. melanogaster
atttttgttcagt

SEQ ID NO: 596365 - DNA, 13 bp, D. melanogaster
atttttgttgaaa

SEQ ID NO: 596366 - DNA, 13 bp, D. melanogaster
atttttgttgact

SEQ ID NO: 596367 - DNA, 13 bp, D. melanogaster
atttttgttgtgc

SEQ ID NO: 596368 - DNA, 14 bp, D. melanogaster
atttttgttgttgc

SEQ ID NO: 596369 - DNA, 13 bp, D. melanogaster
atttttgtttaac

SEQ ID NO: 596370 - DNA, 13 bp, D. melanogaster
attttttaaaacg

SEQ ID NO: 596371 - DNA, 13 bp, D. melanogaster
attttttaaaagc

SEQ ID NO: 596372 - DNA, 13 bp, D. melanogaster
attttttaaaagg

SEQ ID NO: 596373 - DNA, 14 bp, D. melanogaster
attttttaaaagtg

SEQ ID NO: 596374 - DNA, 13 bp, D. melanogaster
attttttaaacca

SEQ ID NO: 596375 - DNA, 13 bp, D. melanogaster
attttttaactgc

SEQ ID NO: 596376 - DNA, 13 bp, D. melanogaster
attttttaagtgc

SEQ ID NO: 596377 - DNA, 13 bp, D. melanogaster
attttttaatagg

SEQ ID NO: 596378 - DNA, 13 bp, D. melanogaster
attttttacaaca

SEQ ID NO: 596379 - DNA, 13 bp, D. melanogaster
attttttacaagc

SEQ ID NO: 596380 - DNA, 14 bp, D. melanogaster
attttttacatcca

SEQ ID NO: 596381 - DNA, 13 bp, D. melanogaster
attttttaccaaa

SEQ ID NO: 596382 - DNA, 14 bp, D. melanogaster
attttttaccaaac

SEQ ID NO: 596383 - DNA, 13 bp, D. melanogaster
attttttagacac

SEQ ID NO: 596384 - DNA, 13 bp, D. melanogaster
attttttagcaaa

SEQ ID NO: 596385 - DNA, 13 bp, D. melanogaster
attttttataagc

SEQ ID NO: 596386 - DNA, 13 bp, D. melanogaster
attttttatccgt

SEQ ID NO: 596387 - DNA, 13 bp, D. melanogaster
attttttatgcaa

SEQ ID NO: 596388 - DNA, 13 bp, D. melanogaster
attttttatgcgc

SEQ ID NO: 596389 - DNA, 13 bp, D. melanogaster
attttttcaaaca

SEQ ID NO: 596390 - DNA, 13 bp, D. melanogaster
attttttcaacat

SEQ ID NO: 596391 - DNA, 13 bp, D. melanogaster
attttttcagaat

SEQ ID NO: 596392 - DNA, 13 bp, D. melanogaster
attttttcagttg

SEQ ID NO: 596393 - DNA, 13 bp, D. melanogaster
attttttcatgtg

SEQ ID NO: 596394 - DNA, 13 bp, D. melanogaster
attttttccaaaa

SEQ ID NO: 596395 - DNA, 13 bp, D. melanogaster
attttttccccat

SEQ ID NO: 596396 - DNA, 13 bp, D. melanogaster
attttttccccca

SEQ ID NO: 596397 - DNA, 13 bp, D. melanogaster
attttttcgaaat

SEQ ID NO: 596398 - DNA, 13 bp, D. melanogaster
attttttcgatct

SEQ ID NO: 596399 - DNA, 13 bp, D. melanogaster
attttttcgcagt

SEQ ID NO: 596400 - DNA, 13 bp, D. melanogaster
attttttcgcatt

SEQ ID NO: 596401 - DNA, 13 bp, D. melanogaster
attttttcgccgt

SEQ ID NO: 596402 - DNA, 14 bp, D. melanogaster
attttttctcagtg

SEQ ID NO: 596403 - DNA, 14 bp, D. melanogaster
attttttctctgtg

SEQ ID NO: 596404 - DNA, 13 bp, D. melanogaster
attttttctgtaa

SEQ ID NO: 596405 - DNA, 13 bp, D. melanogaster
attttttgaaaac

SEQ ID NO: 596406 - DNA, 13 bp, D. melanogaster
attttttgaaagc

SEQ ID NO: 596407 - DNA, 13 bp, D. melanogaster
attttttgattca

SEQ ID NO: 596408 - DNA, 14 bp, D. melanogaster
attttttgattcat

SEQ ID NO: 596409 - DNA, 13 bp, D. melanogaster
attttttgcaatt

SEQ ID NO: 596410 - DNA, 13 bp, D. melanogaster
attttttgcatat

SEQ ID NO: 596411 - DNA, 13 bp, D. melanogaster
attttttgcattc

SEQ ID NO: 596412 - DNA, 13 bp, D. melanogaster
attttttgccaaa

SEQ ID NO: 596413 - DNA, 14 bp, D. melanogaster
attttttgccattt

SEQ ID NO: 596414 - DNA, 13 bp, D. melanogaster
attttttggaaaa

SEQ ID NO: 596415 - DNA, 13 bp, D. melanogaster
attttttggcaaa

SEQ ID NO: 596416 - DNA, 13 bp, D. melanogaster
attttttggcaac

SEQ ID NO: 596417 - DNA, 14 bp, D. melanogaster
attttttggcaacc

SEQ ID NO: 596418 - DNA, 13 bp, D. melanogaster
attttttggcatc

SEQ ID NO: 596419 - DNA, 13 bp, D. melanogaster
attttttggccgt

SEQ ID NO: 596420 - DNA, 13 bp, D. melanogaster
attttttggcgct

SEQ ID NO: 596421 - DNA, 13 bp, D. melanogaster
attttttgggaaa

SEQ ID NO: 596422 - DNA, 13 bp, D. melanogaster
attttttgtacaa

SEQ ID NO: 596423 - DNA, 13 bp, D. melanogaster
attttttgtcagt

SEQ ID NO: 596424 - DNA, 13 bp, D. melanogaster
attttttgtgaaa

SEQ ID NO: 596425 - DNA, 13 bp, D. melanogaster
attttttgtgcgg

SEQ ID NO: 596426 - DNA, 14 bp, D. melanogaster
attttttgtgcggt

SEQ ID NO: 596427 - DNA, 13 bp, D. melanogaster
attttttgtgctg

SEQ ID NO: 596428 - DNA, 13 bp, D. melanogaster
attttttgttggc

SEQ ID NO: 596429 - DNA, 14 bp, D. melanogaster
attttttgttggct

SEQ ID NO: 596430 - DNA, 13 bp, D. melanogaster
atttttttaaagc

SEQ ID NO: 596431 - DNA, 13 bp, D. melanogaster
atttttttaggaa

SEQ ID NO: 596432 - DNA, 13 bp, D. melanogaster
atttttttcaaag

SEQ ID NO: 596433 - DNA, 13 bp, D. melanogaster
atttttttcgaaa

SEQ ID NO: 596434 - DNA, 14 bp, D. melanogaster
atttttttcgaaat

SEQ ID NO: 596435 - DNA, 13 bp, D. melanogaster
atttttttcgagt

SEQ ID NO: 596436 - DNA, 14 bp, D. melanogaster
atttttttgacatt

SEQ ID NO: 596437 - DNA, 13 bp, D. melanogaster
atttttttgcaaa

SEQ ID NO: 596438 - DNA, 13 bp, D. melanogaster
atttttttgcaac

SEQ ID NO: 596439 - DNA, 13 bp, D. melanogaster
atttttttgcagt

SEQ ID NO: 596440 - DNA, 13 bp, D. melanogaster
atttttttgccat

SEQ ID NO: 596441 - DNA, 13 bp, D. melanogaster
attttttttgcaa

SEQ ID NO: 596442 - DNA, 14 bp, D. melanogaster
atttttttttagca

SEQ ID NO: 596443 - DNA, 14 bp, D. melanogaster
atttttttttcgaa

SEQ ID NO: 596444 - DNA, 14 bp, D. melanogaster
caaaaaaaggcatc

SEQ ID NO: 596445 - DNA, 13 bp, D. melanogaster
caaaaaacagctg

SEQ ID NO: 596446 - DNA, 14 bp, D. melanogaster
caaaaaacagtatg

SEQ ID NO: 596447 - DNA, 13 bp, D. melanogaster
caaaaaaccgaat

SEQ ID NO: 596448 - DNA, 13 bp, D. melanogaster
caaaaaacctttt

SEQ ID NO: 596449 - DNA, 13 bp, D. melanogaster
caaaaaacggcga

SEQ ID NO: 596450 - DNA, 13 bp, D. melanogaster
caaaaaacgtttg

SEQ ID NO: 596451 - DNA, 13 bp, D. melanogaster
caaaaaactgatt

SEQ ID NO: 596452 - DNA, 13 bp, D. melanogaster
caaaaaacttaag

SEQ ID NO: 596453 - DNA, 13 bp, D. melanogaster
caaaaaactttca

SEQ ID NO: 596454 - DNA, 13 bp, D. melanogaster
caaaaaacttttt

SEQ ID NO: 596455 - DNA, 13 bp, D. melanogaster
caaaaaagcgttt

SEQ ID NO: 596456 - DNA, 13 bp, D. melanogaster
caaaaaaggcagc

SEQ ID NO: 596457 - DNA, 13 bp, D. melanogaster
caaaaaaggggca

SEQ ID NO: 596458 - DNA, 13 bp, D. melanogaster
caaaaaaggtttg

SEQ ID NO: 596459 - DNA, 13 bp, D. melanogaster
caaaaaagttata

SEQ ID NO: 596460 - DNA, 13 bp, D. melanogaster
caaaaaagttatt

SEQ ID NO: 596461 - DNA, 13 bp, D. melanogaster
caaaaaagttggc

SEQ ID NO: 596462 - DNA, 13 bp, D. melanogaster
caaaaaagtttct

SEQ ID NO: 596463 - DNA, 13 bp, D. melanogaster
caaaaaagtttgc

SEQ ID NO: 596464 - DNA, 13 bp, D. melanogaster
caaaaaatacttg

SEQ ID NO: 596465 - DNA, 14 bp, D. melanogaster
caaaaaatagaatt

SEQ ID NO: 596466 - DNA, 13 bp, D. melanogaster
caaaaaatatgat

SEQ ID NO: 596467 - DNA, 13 bp, D. melanogaster
caaaaaatcagtt

SEQ ID NO: 596468 - DNA, 13 bp, D. melanogaster
caaaaaatcgaat

SEQ ID NO: 596469 - DNA, 13 bp, D. melanogaster
caaaaaatcgtat

SEQ ID NO: 596470 - DNA, 13 bp, D. melanogaster
caaaaaatcgtgt

SEQ ID NO: 596471 - DNA, 14 bp, D. melanogaster
caaaaaatctgaaa

SEQ ID NO: 596472 - DNA, 13 bp, D. melanogaster
caaaaaatctgac

SEQ ID NO: 596473 - DNA, 13 bp, D. melanogaster
caaaaaatgaatg

SEQ ID NO: 596474 - DNA, 13 bp, D. melanogaster
caaaaaatgatag

SEQ ID NO: 596475 - DNA, 13 bp, D. melanogaster
caaaaaatgatga

SEQ ID NO: 596476 - DNA, 13 bp, D. melanogaster
caaaaaatgcgaa

SEQ ID NO: 596477 - DNA, 13 bp, D. melanogaster
caaaaaatggcaa

SEQ ID NO: 596478 - DNA, 13 bp, D. melanogaster
caaaaaatggcca

SEQ ID NO: 596479 - DNA, 13 bp, D. melanogaster
caaaaaatgggca

SEQ ID NO: 596480 - DNA, 14 bp, D. melanogaster
caaaaaatgtattt

SEQ ID NO: 596481 - DNA, 13 bp, D. melanogaster
caaaaaatgtgca

SEQ ID NO: 596482 - DNA, 13 bp, D. melanogaster
caaaaaatgttaa

SEQ ID NO: 596483 - DNA, 13 bp, D. melanogaster
caaaaaattagca

SEQ ID NO: 596484 - DNA, 13 bp, D. melanogaster
caaaaaattccca

SEQ ID NO: 596485 - DNA, 13 bp, D. melanogaster
caaaaaattcgaa

SEQ ID NO: 596486 - DNA, 13 bp, D. melanogaster
caaaaaattgaat

SEQ ID NO: 596487 - DNA, 13 bp, D. melanogaster
caaaaaattgcaa

SEQ ID NO: 596488 - DNA, 13 bp, D. melanogaster
caaaaaattgttg

SEQ ID NO: 596489 - DNA, 13 bp, D. melanogaster
caaaaaattgttt

SEQ ID NO: 596490 - DNA, 13 bp, D. melanogaster
caaaaaatttgtt

SEQ ID NO: 596491 - DNA, 13 bp, D. melanogaster
caaaaaattttca

SEQ ID NO: 596492 - DNA, 13 bp, D. melanogaster
caaaaacaaagtg

SEQ ID NO: 596493 - DNA, 13 bp, D. melanogaster
caaaaacaaatgc

SEQ ID NO: 596494 - DNA, 13 bp, D. melanogaster
caaaaacaaattg

SEQ ID NO: 596495 - DNA, 14 bp, D. melanogaster
caaaaacaaattgt

SEQ ID NO: 596496 - DNA, 14 bp, D. melanogaster
caaaaacaacaatg

SEQ ID NO: 596497 - DNA, 13 bp, D. melanogaster
caaaaacaacagt

SEQ ID NO: 596498 - DNA, 13 bp, D. melanogaster
caaaaacaacggc

SEQ ID NO: 596499 - DNA, 13 bp, D. melanogaster
caaaaacaatcga

SEQ ID NO: 596500 - DNA, 13 bp, D. melanogaster
caaaaacaatgca

SEQ ID NO: 596501 - DNA, 13 bp, D. melanogaster
caaaaacaattgc

SEQ ID NO: 596502 - DNA, 13 bp, D. melanogaster
caaaaacaattgt

SEQ ID NO: 596503 - DNA, 13 bp, D. melanogaster
caaaaacaatttg

SEQ ID NO: 596504 - DNA, 13 bp, D. melanogaster
caaaaacaatttt

SEQ ID NO: 596505 - DNA, 14 bp, D. melanogaster
caaaaacacaacgt

SEQ ID NO: 596506 - DNA, 13 bp, D. melanogaster
caaaaacacactt

SEQ ID NO: 596507 - DNA, 13 bp, D. melanogaster
caaaaacacagat

SEQ ID NO: 596508 - DNA, 13 bp, D. melanogaster
caaaaacacttta

SEQ ID NO: 596509 - DNA, 13 bp, D. melanogaster
caaaaacactttc

SEQ ID NO: 596510 - DNA, 13 bp, D. melanogaster
caaaaacagtcgc

SEQ ID NO: 596511 - DNA, 13 bp, D. melanogaster
caaaaacatattt

SEQ ID NO: 596512 - DNA, 13 bp, D. melanogaster
caaaaacatggcc

SEQ ID NO: 596513 - DNA, 13 bp, D. melanogaster
caaaaacattttg

SEQ ID NO: 596514 - DNA, 13 bp, D. melanogaster
caaaaacattttt

SEQ ID NO: 596515 - DNA, 14 bp, D. melanogaster
caaaaaccagaaat

SEQ ID NO: 596516 - DNA, 13 bp, D. melanogaster
caaaaaccagagc

SEQ ID NO: 596517 - DNA, 13 bp, D. melanogaster
caaaaaccagcga

SEQ ID NO: 596518 - DNA, 13 bp, D. melanogaster
caaaaaccattta

SEQ ID NO: 596519 - DNA, 13 bp, D. melanogaster
caaaaacccattt

SEQ ID NO: 596520 - DNA, 13 bp, D. melanogaster
caaaaaccgaaat

SEQ ID NO: 596521 - DNA, 14 bp, D. melanogaster
caaaaaccgaaatc

SEQ ID NO: 596522 - DNA, 13 bp, D. melanogaster
caaaaaccgaatc

SEQ ID NO: 596523 - DNA, 13 bp, D. melanogaster
caaaaaccttggc

SEQ ID NO: 596524 - DNA, 13 bp, D. melanogaster
caaaaacgaaact

SEQ ID NO: 596525 - DNA, 13 bp, D. melanogaster
caaaaacgaaatc

SEQ ID NO: 596526 - DNA, 13 bp, D. melanogaster
caaaaacgatttt

SEQ ID NO: 596527 - DNA, 13 bp, D. melanogaster
caaaaacgcattg

SEQ ID NO: 596528 - DNA, 13 bp, D. melanogaster
caaaaacggacat

SEQ ID NO: 596529 - DNA, 13 bp, D. melanogaster
caaaaacgtaaac

SEQ ID NO: 596530 - DNA, 13 bp, D. melanogaster
caaaaacgttttt

SEQ ID NO: 596531 - DNA, 13 bp, D. melanogaster
caaaaactaaagc

SEQ ID NO: 596532 - DNA, 13 bp, D. melanogaster
caaaaactaaatg

SEQ ID NO: 596533 - DNA, 13 bp, D. melanogaster
caaaaactaagca

SEQ ID NO: 596534 - DNA, 13 bp, D. melanogaster
caaaaactacaag

SEQ ID NO: 596535 - DNA, 13 bp, D. melanogaster
caaaaactacgaa

SEQ ID NO: 596536 - DNA, 14 bp, D. melanogaster
caaaaactacgtaa

SEQ ID NO: 596537 - DNA, 13 bp, D. melanogaster
caaaaactactta

SEQ ID NO: 596538 - DNA, 13 bp, D. melanogaster
caaaaactatgca

SEQ ID NO: 596539 - DNA, 13 bp, D. melanogaster
caaaaactattag

SEQ ID NO: 596540 - DNA, 13 bp, D. melanogaster
caaaaactcatca

SEQ ID NO: 596541 - DNA, 13 bp, D. melanogaster
caaaaactgaagc

SEQ ID NO: 596542 - DNA, 13 bp, D. melanogaster
caaaaactgaatg

SEQ ID NO: 596543 - DNA, 13 bp, D. melanogaster
caaaaactgaatt

SEQ ID NO: 596544 - DNA, 13 bp, D. melanogaster
caaaaactgcaaa

SEQ ID NO: 596545 - DNA, 13 bp, D. melanogaster
caaaaactggacg

SEQ ID NO: 596546 - DNA, 13 bp, D. melanogaster
caaaaactggagg

SEQ ID NO: 596547 - DNA, 14 bp, D. melanogaster
caaaaactggagga

SEQ ID NO: 596548 - DNA, 13 bp, D. melanogaster
caaaaactggcca

SEQ ID NO: 596549 - DNA, 13 bp, D. melanogaster
caaaaactgtcaa

SEQ ID NO: 596550 - DNA, 13 bp, D. melanogaster
caaaaactgttaa

SEQ ID NO: 596551 - DNA, 13 bp, D. melanogaster
caaaaacttaagc

SEQ ID NO: 596552 - DNA, 14 bp, D. melanogaster
caaaaacttaagcg

SEQ ID NO: 596553 - DNA, 16 bp, D. melanogaster
caaaaacttaagcgaa

SEQ ID NO: 596554 - DNA, 13 bp, D. melanogaster
caaaaacttcagc

SEQ ID NO: 596555 - DNA, 13 bp, D. melanogaster
caaaaacttgaaa

SEQ ID NO: 596556 - DNA, 13 bp, D. melanogaster
caaaaacttggcc

SEQ ID NO: 596557 - DNA, 13 bp, D. melanogaster
caaaaacttgtca

SEQ ID NO: 596558 - DNA, 13 bp, D. melanogaster
caaaaacttgttt

SEQ ID NO: 596559 - DNA, 13 bp, D. melanogaster
caaaaactttgga

SEQ ID NO: 596560 - DNA, 13 bp, D. melanogaster
caaaaactttgtt

SEQ ID NO: 596561 - DNA, 13 bp, D. melanogaster
caaaaacttttgc

SEQ ID NO: 596562 - DNA, 14 bp, D. melanogaster
caaaaacttttgcc

SEQ ID NO: 596563 - DNA, 13 bp, D. melanogaster
caaaaagaaagtt

SEQ ID NO: 596564 - DNA, 13 bp, D. melanogaster
caaaaagaagtac

SEQ ID NO: 596565 - DNA, 13 bp, D. melanogaster
caaaaagaatatt

SEQ ID NO: 596566 - DNA, 13 bp, D. melanogaster
caaaaagaattac

SEQ ID NO: 596567 - DNA, 13 bp, D. melanogaster
caaaaagacaatt

SEQ ID NO: 596568 - DNA, 13 bp, D. melanogaster
caaaaagagaatt

SEQ ID NO: 596569 - DNA, 14 bp, D. melanogaster
caaaaagataccga

SEQ ID NO: 596570 - DNA, 13 bp, D. melanogaster
caaaaagatatat

SEQ ID NO: 596571 - DNA, 14 bp, D. melanogaster
caaaaagatatttt

SEQ ID NO: 596572 - DNA, 13 bp, D. melanogaster
caaaaagattcaa

SEQ ID NO: 596573 - DNA, 13 bp, D. melanogaster
caaaaagatttta

SEQ ID NO: 596574 - DNA, 13 bp, D. melanogaster
caaaaagcagcca

SEQ ID NO: 596575 - DNA, 13 bp, D. melanogaster
caaaaagcattca

SEQ ID NO: 596576 - DNA, 13 bp, D. melanogaster
caaaaagcattga

SEQ ID NO: 596577 - DNA, 13 bp, D. melanogaster
caaaaagccaaat

SEQ ID NO: 596578 - DNA, 13 bp, D. melanogaster
caaaaagccaagc

SEQ ID NO: 596579 - DNA, 13 bp, D. melanogaster
caaaaagccaagt

SEQ ID NO: 596580 - DNA, 13 bp, D. melanogaster
caaaaagccattt

SEQ ID NO: 596581 - DNA, 13 bp, D. melanogaster
caaaaagccgcaa

SEQ ID NO: 596582 - DNA, 13 bp, D. melanogaster
caaaaagcgaagc

SEQ ID NO: 596583 - DNA, 13 bp, D. melanogaster
caaaaagcgcaca

SEQ ID NO: 596584 - DNA, 13 bp, D. melanogaster
caaaaagctggca

SEQ ID NO: 596585 - DNA, 13 bp, D. melanogaster
caaaaagcttaaa

SEQ ID NO: 596586 - DNA, 13 bp, D. melanogaster
caaaaagctttaa

SEQ ID NO: 596587 - DNA, 13 bp, D. melanogaster
caaaaaggaaatc

SEQ ID NO: 596588 - DNA, 14 bp, D. melanogaster
caaaaaggaaattt

SEQ ID NO: 596589 - DNA, 13 bp, D. melanogaster
caaaaaggacatt

SEQ ID NO: 596590 - DNA, 13 bp, D. melanogaster
caaaaaggataat

SEQ ID NO: 596591 - DNA, 13 bp, D. melanogaster
caaaaaggatatc

SEQ ID NO: 596592 - DNA, 13 bp, D. melanogaster
caaaaaggatttt

SEQ ID NO: 596593 - DNA, 13 bp, D. melanogaster
caaaaaggcagcg

SEQ ID NO: 596594 - DNA, 13 bp, D. melanogaster
caaaaagggagca

SEQ ID NO: 596595 - DNA, 13 bp, D. melanogaster
caaaaagggcaac

SEQ ID NO: 596596 - DNA, 13 bp, D. melanogaster
caaaaaggggcaa

SEQ ID NO: 596597 - DNA, 13 bp, D. melanogaster
caaaaaggtaatt

SEQ ID NO: 596598 - DNA, 13 bp, D. melanogaster
caaaaaggtacaa

SEQ ID NO: 596599 - DNA, 13 bp, D. melanogaster
caaaaaggtgaaa

SEQ ID NO: 596600 - DNA, 13 bp, D. melanogaster
caaaaaggttttt

SEQ ID NO: 596601 - DNA, 13 bp, D. melanogaster
caaaaagtaaatc

SEQ ID NO: 596602 - DNA, 13 bp, D. melanogaster
caaaaagtacata

SEQ ID NO: 596603 - DNA, 14 bp, D. melanogaster
caaaaagtaggcaa

SEQ ID NO: 596604 - DNA, 13 bp, D. melanogaster
caaaaagtataag

SEQ ID NO: 596605 - DNA, 13 bp, D. melanogaster
caaaaagtatctg

SEQ ID NO: 596606 - DNA, 14 bp, D. melanogaster
caaaaagtatgcaa

SEQ ID NO: 596607 - DNA, 13 bp, D. melanogaster
caaaaagtcaact

SEQ ID NO: 596608 - DNA, 13 bp, D. melanogaster
caaaaagtgagca

SEQ ID NO: 596609 - DNA, 13 bp, D. melanogaster
caaaaagtgatag

SEQ ID NO: 596610 - DNA, 14 bp, D. melanogaster
caaaaagtgcaaaa

SEQ ID NO: 596611 - DNA, 13 bp, D. melanogaster
caaaaagtgcaat

SEQ ID NO: 596612 - DNA, 13 bp, D. melanogaster
caaaaagtggaaa

SEQ ID NO: 596613 - DNA, 13 bp, D. melanogaster
caaaaagtggcag

SEQ ID NO: 596614 - DNA, 13 bp, D. melanogaster
caaaaagtgggca

SEQ ID NO: 596615 - DNA, 13 bp, D. melanogaster
caaaaagtgggtg

SEQ ID NO: 596616 - DNA, 14 bp, D. melanogaster
caaaaagtggtctt

SEQ ID NO: 596617 - DNA, 13 bp, D. melanogaster
caaaaagtgtaaa

SEQ ID NO: 596618 - DNA, 13 bp, D. melanogaster
caaaaagtgtaat

SEQ ID NO: 596619 - DNA, 13 bp, D. melanogaster
caaaaagtgtgtg

SEQ ID NO: 596620 - DNA, 13 bp, D. melanogaster
caaaaagtgttta

SEQ ID NO: 596621 - DNA, 13 bp, D. melanogaster
caaaaagttcaat

SEQ ID NO: 596622 - DNA, 13 bp, D. melanogaster
caaaaagttgaat

SEQ ID NO: 596623 - DNA, 13 bp, D. melanogaster
caaaaagttgagc

SEQ ID NO: 596624 - DNA, 13 bp, D. melanogaster
caaaaagttgcaa

SEQ ID NO: 596625 - DNA, 13 bp, D. melanogaster
caaaaagttggcc

SEQ ID NO: 596626 - DNA, 13 bp, D. melanogaster
caaaaagttggct

SEQ ID NO: 596627 - DNA, 13 bp, D. melanogaster
caaaaagttgtat

SEQ ID NO: 596628 - DNA, 13 bp, D. melanogaster
caaaaagttgttt

SEQ ID NO: 596629 - DNA, 13 bp, D. melanogaster
caaaaagtttaaa

SEQ ID NO: 596630 - DNA, 13 bp, D. melanogaster
caaaaagtttatt

SEQ ID NO: 596631 - DNA, 13 bp, D. melanogaster
caaaaagtttctt

SEQ ID NO: 596632 - DNA, 13 bp, D. melanogaster
caaaaagtttgcc

SEQ ID NO: 596633 - DNA, 13 bp, D. melanogaster
caaaaagtttgtt

SEQ ID NO: 596634 - DNA, 13 bp, D. melanogaster
caaaaagtttttt

SEQ ID NO: 596635 - DNA, 14 bp, D. melanogaster
caaaaagttttttg

SEQ ID NO: 596636 - DNA, 13 bp, D. melanogaster
caaaaataaaccg

SEQ ID NO: 596637 - DNA, 13 bp, D. melanogaster
caaaaataaacgt

SEQ ID NO: 596638 - DNA, 13 bp, D. melanogaster
caaaaataaaggt

SEQ ID NO: 596639 - DNA, 14 bp, D. melanogaster
caaaaataacggaa

SEQ ID NO: 596640 - DNA, 14 bp, D. melanogaster
caaaaataatgaat

SEQ ID NO: 596641 - DNA, 13 bp, D. melanogaster
caaaaataatgtt

SEQ ID NO: 596642 - DNA, 13 bp, D. melanogaster
caaaaataattgt

SEQ ID NO: 596643 - DNA, 13 bp, D. melanogaster
caaaaatacttca

SEQ ID NO: 596644 - DNA, 13 bp, D. melanogaster
caaaaatagcaac

SEQ ID NO: 596645 - DNA, 13 bp, D. melanogaster
caaaaatagcact

SEQ ID NO: 596646 - DNA, 14 bp, D. melanogaster
caaaaatagcactg

SEQ ID NO: 596647 - DNA, 13 bp, D. melanogaster
caaaaatagccaa

SEQ ID NO: 596648 - DNA, 13 bp, D. melanogaster
caaaaatagttaa

SEQ ID NO: 596649 - DNA, 13 bp, D. melanogaster
caaaaatagtttc

SEQ ID NO: 596650 - DNA, 13 bp, D. melanogaster
caaaaatatcgaa

SEQ ID NO: 596651 - DNA, 13 bp, D. melanogaster
caaaaatatcgct

SEQ ID NO: 596652 - DNA, 13 bp, D. melanogaster
caaaaatatctga

SEQ ID NO: 596653 - DNA, 13 bp, D. melanogaster
caaaaatatcttt

SEQ ID NO: 596654 - DNA, 14 bp, D. melanogaster
caaaaatatgtata

SEQ ID NO: 596655 - DNA, 13 bp, D. melanogaster
caaaaatatgtga

SEQ ID NO: 596656 - DNA, 13 bp, D. melanogaster
caaaaatatgttc

SEQ ID NO: 596657 - DNA, 13 bp, D. melanogaster
caaaaatattatg

SEQ ID NO: 596658 - DNA, 13 bp, D. melanogaster
caaaaatattcat

SEQ ID NO: 596659 - DNA, 13 bp, D. melanogaster
caaaaatattgca

SEQ ID NO: 596660 - DNA, 13 bp, D. melanogaster
caaaaatattgta

SEQ ID NO: 596661 - DNA, 13 bp, D. melanogaster
caaaaatatttca

SEQ ID NO: 596662 - DNA, 13 bp, D. melanogaster
caaaaatatttga

SEQ ID NO: 596663 - DNA, 14 bp, D. melanogaster
caaaaatatttgcc

SEQ ID NO: 596664 - DNA, 13 bp, D. melanogaster
caaaaatcaatgg

SEQ ID NO: 596665 - DNA, 13 bp, D. melanogaster
caaaaatcatatg

SEQ ID NO: 596666 - DNA, 13 bp, D. melanogaster
caaaaatcatttc

SEQ ID NO: 596667 - DNA, 13 bp, D. melanogaster
caaaaatccactt

SEQ ID NO: 596668 - DNA, 13 bp, D. melanogaster
caaaaatcctgcg

SEQ ID NO: 596669 - DNA, 13 bp, D. melanogaster
caaaaatcgaaca

SEQ ID NO: 596670 - DNA, 13 bp, D. melanogaster
caaaaatcgatta

SEQ ID NO: 596671 - DNA, 13 bp, D. melanogaster
caaaaatcgcaaa

SEQ ID NO: 596672 - DNA, 13 bp, D. melanogaster
caaaaatcgtatt

SEQ ID NO: 596673 - DNA, 13 bp, D. melanogaster
caaaaatctatat

SEQ ID NO: 596674 - DNA, 13 bp, D. melanogaster
caaaaatctattt

SEQ ID NO: 596675 - DNA, 13 bp, D. melanogaster
caaaaatgaattg

SEQ ID NO: 596676 - DNA, 13 bp, D. melanogaster
caaaaatgaattt

SEQ ID NO: 596677 - DNA, 13 bp, D. melanogaster
caaaaatgacgaa

SEQ ID NO: 596678 - DNA, 13 bp, D. melanogaster
caaaaatgacttt

SEQ ID NO: 596679 - DNA, 13 bp, D. melanogaster
caaaaatgagaat

SEQ ID NO: 596680 - DNA, 13 bp, D. melanogaster
caaaaatgagttg

SEQ ID NO: 596681 - DNA, 13 bp, D. melanogaster
caaaaatgataca

SEQ ID NO: 596682 - DNA, 14 bp, D. melanogaster
caaaaatgatacag

SEQ ID NO: 596683 - DNA, 13 bp, D. melanogaster
caaaaatgatttg

SEQ ID NO: 596684 - DNA, 13 bp, D. melanogaster
caaaaatgatttt

SEQ ID NO: 596685 - DNA, 13 bp, D. melanogaster
caaaaatgcaaca

SEQ ID NO: 596686 - DNA, 13 bp, D. melanogaster
caaaaatgcaagc

SEQ ID NO: 596687 - DNA, 14 bp, D. melanogaster
caaaaatgcaagca

SEQ ID NO: 596688 - DNA, 13 bp, D. melanogaster
caaaaatgcaata

SEQ ID NO: 596689 - DNA, 14 bp, D. melanogaster
caaaaatgcaataa

SEQ ID NO: 596690 - DNA, 13 bp, D. melanogaster
caaaaatgcacaa

SEQ ID NO: 596691 - DNA, 13 bp, D. melanogaster
caaaaatgcactt

SEQ ID NO: 596692 - DNA, 13 bp, D. melanogaster
caaaaatgccaaa

SEQ ID NO: 596693 - DNA, 13 bp, D. melanogaster
caaaaatgcgaaa

SEQ ID NO: 596694 - DNA, 14 bp, D. melanogaster
caaaaatgcgaaaa

SEQ ID NO: 596695 - DNA, 13 bp, D. melanogaster
caaaaatgctgca

SEQ ID NO: 596696 - DNA, 13 bp, D. melanogaster
caaaaatgctgtt

SEQ ID NO: 596697 - DNA, 14 bp, D. melanogaster
caaaaatggaaaac

SEQ ID NO: 596698 - DNA, 14 bp, D. melanogaster
caaaaatggaaatt

SEQ ID NO: 596699 - DNA, 13 bp, D. melanogaster
caaaaatggattt

SEQ ID NO: 596700 - DNA, 13 bp, D. melanogaster
caaaaatggcaaa

SEQ ID NO: 596701 - DNA, 14 bp, D. melanogaster
caaaaatggcaaaa

SEQ ID NO: 596702 - DNA, 13 bp, D. melanogaster
caaaaatggcagc

SEQ ID NO: 596703 - DNA, 13 bp, D. melanogaster
caaaaatggcatt

SEQ ID NO: 596704 - DNA, 13 bp, D. melanogaster
caaaaatggcgtc

SEQ ID NO: 596705 - DNA, 13 bp, D. melanogaster
caaaaatggtgaa

SEQ ID NO: 596706 - DNA, 13 bp, D. melanogaster
caaaaatggtttt

SEQ ID NO: 596707 - DNA, 13 bp, D. melanogaster
caaaaatgtaaat

SEQ ID NO: 596708 - DNA, 13 bp, D. melanogaster
caaaaatgtaaca

SEQ ID NO: 596709 - DNA, 13 bp, D. melanogaster
caaaaatgtacaa

SEQ ID NO: 596710 - DNA, 13 bp, D. melanogaster
caaaaatgtagaa

SEQ ID NO: 596711 - DNA, 14 bp, D. melanogaster
caaaaatgtatttt

SEQ ID NO: 596712 - DNA, 14 bp, D. melanogaster
caaaaatgtcaaaa

SEQ ID NO: 596713 - DNA, 13 bp, D. melanogaster
caaaaatgtcttt

SEQ ID NO: 596714 - DNA, 13 bp, D. melanogaster
caaaaatgtgact

SEQ ID NO: 596715 - DNA, 13 bp, D. melanogaster
caaaaatgtgcaa

SEQ ID NO: 596716 - DNA, 13 bp, D. melanogaster
caaaaatgtggca

SEQ ID NO: 596717 - DNA, 13 bp, D. melanogaster
caaaaatgtgggc

SEQ ID NO: 596718 - DNA, 13 bp, D. melanogaster
caaaaatgtgttt

SEQ ID NO: 596719 - DNA, 13 bp, D. melanogaster
caaaaatgtttca

SEQ ID NO: 596720 - DNA, 14 bp, D. melanogaster
caaaaatgtttcaa

SEQ ID NO: 596721 - DNA, 13 bp, D. melanogaster
caaaaatgttttt

SEQ ID NO: 596722 - DNA, 13 bp, D. melanogaster
caaaaattaaggg

SEQ ID NO: 596723 - DNA, 13 bp, D. melanogaster
caaaaattaattg

SEQ ID NO: 596724 - DNA, 13 bp, D. melanogaster
caaaaattactca

SEQ ID NO: 596725 - DNA, 13 bp, D. melanogaster
caaaaattatacc

SEQ ID NO: 596726 - DNA, 14 bp, D. melanogaster
caaaaattatgaaa

SEQ ID NO: 596727 - DNA, 14 bp, D. melanogaster
caaaaattatgcaa

SEQ ID NO: 596728 - DNA, 13 bp, D. melanogaster
caaaaattattgc

SEQ ID NO: 596729 - DNA, 13 bp, D. melanogaster
caaaaattatttc

SEQ ID NO: 596730 - DNA, 13 bp, D. melanogaster
caaaaattcaact

SEQ ID NO: 596731 - DNA, 13 bp, D. melanogaster
caaaaattcactt

SEQ ID NO: 596732 - DNA, 13 bp, D. melanogaster
caaaaattccaat

SEQ ID NO: 596733 - DNA, 13 bp, D. melanogaster
caaaaattcgaaa

SEQ ID NO: 596734 - DNA, 13 bp, D. melanogaster
caaaaattcgaga

SEQ ID NO: 596735 - DNA, 14 bp, D. melanogaster
caaaaattcgattt

SEQ ID NO: 596736 - DNA, 14 bp, D. melanogaster
caaaaattgaaaga

SEQ ID NO: 596737 - DNA, 13 bp, D. melanogaster
caaaaattgaaat

SEQ ID NO: 596738 - DNA, 14 bp, D. melanogaster
caaaaattgaaatt

SEQ ID NO: 596739 - DNA, 13 bp, D. melanogaster
caaaaattgaaca

SEQ ID NO: 596740 - DNA, 13 bp, D. melanogaster
caaaaattgaatt

SEQ ID NO: 596741 - DNA, 13 bp, D. melanogaster
caaaaattgagat

SEQ ID NO: 596742 - DNA, 13 bp, D. melanogaster
caaaaattgcaca

SEQ ID NO: 596743 - DNA, 13 bp, D. melanogaster
caaaaattgcatt

SEQ ID NO: 596744 - DNA, 14 bp, D. melanogaster
caaaaattgcattt

SEQ ID NO: 596745 - DNA, 13 bp, D. melanogaster
caaaaattgtaca

SEQ ID NO: 596746 - DNA, 14 bp, D. melanogaster
caaaaattgtattt

SEQ ID NO: 596747 - DNA, 13 bp, D. melanogaster
caaaaattgttat

SEQ ID NO: 596748 - DNA, 14 bp, D. melanogaster
caaaaattgtttaa

SEQ ID NO: 596749 - DNA, 13 bp, D. melanogaster
caaaaattgtttc

SEQ ID NO: 596750 - DNA, 14 bp, D. melanogaster
caaaaattgtttct

SEQ ID NO: 596751 - DNA, 14 bp, D. melanogaster
caaaaattgttttt

SEQ ID NO: 596752 - DNA, 13 bp, D. melanogaster
caaaaatttcaat

SEQ ID NO: 596753 - DNA, 13 bp, D. melanogaster
caaaaatttcgtt

SEQ ID NO: 596754 - DNA, 14 bp, D. melanogaster
caaaaatttgaaat

SEQ ID NO: 596755 - DNA, 13 bp, D. melanogaster
caaaaatttgcat

SEQ ID NO: 596756 - DNA, 13 bp, D. melanogaster
caaaaatttggca

SEQ ID NO: 596757 - DNA, 13 bp, D. melanogaster
caaaaatttgtta

SEQ ID NO: 596758 - DNA, 13 bp, D. melanogaster
caaaaatttgttt

SEQ ID NO: 596759 - DNA, 13 bp, D. melanogaster
caaaaattttgtt

SEQ ID NO: 596760 - DNA, 14 bp, D. melanogaster
caaaacaaaactga

SEQ ID NO: 596761 - DNA, 13 bp, D. melanogaster
caaaacaaaagct

SEQ ID NO: 596762 - DNA, 13 bp, D. melanogaster
caaaacaaacgat

SEQ ID NO: 596763 - DNA, 13 bp, D. melanogaster
caaaacaaactgt

SEQ ID NO: 596764 - DNA, 13 bp, D. melanogaster
caaaacaaacttt

SEQ ID NO: 596765 - DNA, 13 bp, D. melanogaster
caaaacaaagcgc

SEQ ID NO: 596766 - DNA, 13 bp, D. melanogaster
caaaacaaagtgc

SEQ ID NO: 596767 - DNA, 13 bp, D. melanogaster
caaaacaaatcgc

SEQ ID NO: 596768 - DNA, 14 bp, D. melanogaster
caaaacaaatgcca

SEQ ID NO: 596769 - DNA, 13 bp, D. melanogaster
caaaacaaatggc

SEQ ID NO: 596770 - DNA, 14 bp, D. melanogaster
caaaacaaatgtgt

SEQ ID NO: 596771 - DNA, 13 bp, D. melanogaster
caaaacaaattgc

SEQ ID NO: 596772 - DNA, 14 bp, D. melanogaster
caaaacaaattttt

SEQ ID NO: 596773 - DNA, 14 bp, D. melanogaster
caaaacaacatatt

SEQ ID NO: 596774 - DNA, 13 bp, D. melanogaster
caaaacaacctta

SEQ ID NO: 596775 - DNA, 14 bp, D. melanogaster
caaaacaacgcttt

SEQ ID NO: 596776 - DNA, 14 bp, D. melanogaster
caaaacaagaattt

SEQ ID NO: 596777 - DNA, 13 bp, D. melanogaster
caaaacaagattt

SEQ ID NO: 596778 - DNA, 13 bp, D. melanogaster
caaaacaagcaat

SEQ ID NO: 596779 - DNA, 13 bp, D. melanogaster
caaaacaagcagc

SEQ ID NO: 596780 - DNA, 13 bp, D. melanogaster
caaaacaagtgca

SEQ ID NO: 596781 - DNA, 13 bp, D. melanogaster
caaaacaataagg

SEQ ID NO: 596782 - DNA, 13 bp, D. melanogaster
caaaacaatcgaa

SEQ ID NO: 596783 - DNA, 13 bp, D. melanogaster
caaaacaatgcaa

SEQ ID NO: 596784 - DNA, 13 bp, D. melanogaster
caaaacaatgttt

SEQ ID NO: 596785 - DNA, 13 bp, D. melanogaster
caaaacaattgaa

SEQ ID NO: 596786 - DNA, 13 bp, D. melanogaster
caaaacaattgct

SEQ ID NO: 596787 - DNA, 13 bp, D. melanogaster
caaaacaattgga

SEQ ID NO: 596788 - DNA, 13 bp, D. melanogaster
caaaacaatttag

SEQ ID NO: 596789 - DNA, 13 bp, D. melanogaster
caaaacaatttat

SEQ ID NO: 596790 - DNA, 14 bp, D. melanogaster
caaaacaatttcaa

SEQ ID NO: 596791 - DNA, 13 bp, D. melanogaster
caaaacaatttgc

SEQ ID NO: 596792 - DNA, 13 bp, D. melanogaster
caaaacaatttgt

SEQ ID NO: 596793 - DNA, 13 bp, D. melanogaster
caaaacaatttta

SEQ ID NO: 596794 - DNA, 13 bp, D. melanogaster
caaaacaattttc

SEQ ID NO: 596795 - DNA, 13 bp, D. melanogaster
caaaacaattttt

SEQ ID NO: 596796 - DNA, 13 bp, D. melanogaster
caaaacacttaca

SEQ ID NO: 596797 - DNA, 13 bp, D. melanogaster
caaaacacttgaa

SEQ ID NO: 596798 - DNA, 13 bp, D. melanogaster
caaaacacttgga

SEQ ID NO: 596799 - DNA, 13 bp, D. melanogaster
caaaacagaaatt

SEQ ID NO: 596800 - DNA, 14 bp, D. melanogaster
caaaacagaacata

SEQ ID NO: 596801 - DNA, 13 bp, D. melanogaster
caaaacagaggta

SEQ ID NO: 596802 - DNA, 13 bp, D. melanogaster
caaaacagatttt

SEQ ID NO: 596803 - DNA, 13 bp, D. melanogaster
caaaacagcagag

SEQ ID NO: 596804 - DNA, 13 bp, D. melanogaster
caaaacagcagcc

SEQ ID NO: 596805 - DNA, 13 bp, D. melanogaster
caaaacagcagcg

SEQ ID NO: 596806 - DNA, 14 bp, D. melanogaster
caaaacagtaagaa

SEQ ID NO: 596807 - DNA, 13 bp, D. melanogaster
caaaacagtgcag

SEQ ID NO: 596808 - DNA, 13 bp, D. melanogaster
caaaacataagca

SEQ ID NO: 596809 - DNA, 13 bp, D. melanogaster
caaaacatattta

SEQ ID NO: 596810 - DNA, 13 bp, D. melanogaster
caaaacatgaaca

SEQ ID NO: 596811 - DNA, 13 bp, D. melanogaster
caaaacatgcaaa

SEQ ID NO: 596812 - DNA, 13 bp, D. melanogaster
caaaacattcaat

SEQ ID NO: 596813 - DNA, 13 bp, D. melanogaster
caaaacatttata

SEQ ID NO: 596814 - DNA, 13 bp, D. melanogaster
caaaacatttgaa

SEQ ID NO: 596815 - DNA, 13 bp, D. melanogaster
caaaacatttgac

SEQ ID NO: 596816 - DNA, 13 bp, D. melanogaster
caaaacatttgcc

SEQ ID NO: 596817 - DNA, 13 bp, D. melanogaster
caaaacattttaa

SEQ ID NO: 596818 - DNA, 14 bp, D. melanogaster
caaaacattttaat

SEQ ID NO: 596819 - DNA, 14 bp, D. melanogaster
caaaacattttcaa

SEQ ID NO: 596820 - DNA, 13 bp, D. melanogaster
caaaacattttgc

SEQ ID NO: 596821 - DNA, 13 bp, D. melanogaster
caaaacattttta

SEQ ID NO: 596822 - DNA, 13 bp, D. melanogaster
caaaaccaaattg

SEQ ID NO: 596823 - DNA, 13 bp, D. melanogaster
caaaaccaatttg

SEQ ID NO: 596824 - DNA, 13 bp, D. melanogaster
caaaaccagtttg

SEQ ID NO: 596825 - DNA, 13 bp, D. melanogaster
caaaaccataatg

SEQ ID NO: 596826 - DNA, 13 bp, D. melanogaster
caaaaccatttta

SEQ ID NO: 596827 - DNA, 13 bp, D. melanogaster
caaaacccatatt

SEQ ID NO: 596828 - DNA, 13 bp, D. melanogaster
caaaacccatttc

SEQ ID NO: 596829 - DNA, 13 bp, D. melanogaster
caaaaccgaaact

SEQ ID NO: 596830 - DNA, 13 bp, D. melanogaster
caaaaccgaaagc

SEQ ID NO: 596831 - DNA, 13 bp, D. melanogaster
caaaaccgattgg

SEQ ID NO: 596832 - DNA, 13 bp, D. melanogaster
caaaaccttcgac

SEQ ID NO: 596833 - DNA, 13 bp, D. melanogaster
caaaaccttttga

SEQ ID NO: 596834 - DNA, 14 bp, D. melanogaster
caaaacgaaaactt

SEQ ID NO: 596835 - DNA, 13 bp, D. melanogaster
caaaacgaaaatc

SEQ ID NO: 596836 - DNA, 13 bp, D. melanogaster
caaaacgaaacta

SEQ ID NO: 596837 - DNA, 14 bp, D. melanogaster
caaaacgaaagact

SEQ ID NO: 596838 - DNA, 14 bp, D. melanogaster
caaaacgaaatgaa

SEQ ID NO: 596839 - DNA, 13 bp, D. melanogaster
caaaacgaaatta

SEQ ID NO: 596840 - DNA, 13 bp, D. melanogaster
caaaacgaaccga

SEQ ID NO: 596841 - DNA, 13 bp, D. melanogaster
caaaacgatttca

SEQ ID NO: 596842 - DNA, 13 bp, D. melanogaster
caaaacgattttt

SEQ ID NO: 596843 - DNA, 13 bp, D. melanogaster
caaaacgcacact

SEQ ID NO: 596844 - DNA, 13 bp, D. melanogaster
caaaacgcagttg

SEQ ID NO: 596845 - DNA, 13 bp, D. melanogaster
caaaacggaaatg

SEQ ID NO: 596846 - DNA, 13 bp, D. melanogaster
caaaacggaagtt

SEQ ID NO: 596847 - DNA, 13 bp, D. melanogaster
caaaacggccctt

SEQ ID NO: 596848 - DNA, 13 bp, D. melanogaster
caaaacgtttttt

SEQ ID NO: 596849 - DNA, 13 bp, D. melanogaster
caaaactaaagcc

SEQ ID NO: 596850 - DNA, 13 bp, D. melanogaster
caaaactaattga

SEQ ID NO: 596851 - DNA, 13 bp, D. melanogaster
caaaactagacta

SEQ ID NO: 596852 - DNA, 13 bp, D. melanogaster
caaaactatttaa

SEQ ID NO: 596853 - DNA, 13 bp, D. melanogaster
caaaactatttgt

SEQ ID NO: 596854 - DNA, 13 bp, D. melanogaster
caaaactcaatta

SEQ ID NO: 596855 - DNA, 14 bp, D. melanogaster
caaaactcaatttt

SEQ ID NO: 596856 - DNA, 13 bp, D. melanogaster
caaaactcactcg

SEQ ID NO: 596857 - DNA, 14 bp, D. melanogaster
caaaactcagacgc

SEQ ID NO: 596858 - DNA, 13 bp, D. melanogaster
caaaactcccgaa

SEQ ID NO: 596859 - DNA, 13 bp, D. melanogaster
caaaactgaattg

SEQ ID NO: 596860 - DNA, 13 bp, D. melanogaster
caaaactgagaaa

SEQ ID NO: 596861 - DNA, 13 bp, D. melanogaster
caaaactgcaaaa

SEQ ID NO: 596862 - DNA, 13 bp, D. melanogaster
caaaactgcattt

SEQ ID NO: 596863 - DNA, 13 bp, D. melanogaster
caaaactgtaaaa

SEQ ID NO: 596864 - DNA, 13 bp, D. melanogaster
caaaactgttatt

SEQ ID NO: 596865 - DNA, 13 bp, D. melanogaster
caaaacttaattt

SEQ ID NO: 596866 - DNA, 13 bp, D. melanogaster
caaaacttgaatt

SEQ ID NO: 596867 - DNA, 13 bp, D. melanogaster
caaaacttgattt

SEQ ID NO: 596868 - DNA, 13 bp, D. melanogaster
caaaacttggcca

SEQ ID NO: 596869 - DNA, 13 bp, D. melanogaster
caaaactttcaat

SEQ ID NO: 596870 - DNA, 13 bp, D. melanogaster
caaaactttccac

SEQ ID NO: 596871 - DNA, 13 bp, D. melanogaster
caaaactttccca

SEQ ID NO: 596872 - DNA, 13 bp, D. melanogaster
caaaactttgaca

SEQ ID NO: 596873 - DNA, 13 bp, D. melanogaster
caaaactttgcca

SEQ ID NO: 596874 - DNA, 13 bp, D. melanogaster
caaaactttgccc

SEQ ID NO: 596875 - DNA, 13 bp, D. melanogaster
caaaactttggcc

SEQ ID NO: 596876 - DNA, 13 bp, D. melanogaster
caaaacttttaaa

SEQ ID NO: 596877 - DNA, 13 bp, D. melanogaster
caaaacttttaat

SEQ ID NO: 596878 - DNA, 13 bp, D. melanogaster
caaaacttttcac

SEQ ID NO: 596879 - DNA, 13 bp, D. melanogaster
caaaacttttgaa

SEQ ID NO: 596880 - DNA, 13 bp, D. melanogaster
caaaacttttgat

SEQ ID NO: 596881 - DNA, 13 bp, D. melanogaster
caaaacttttgca

SEQ ID NO: 596882 - DNA, 13 bp, D. melanogaster
caaaacttttgcc

SEQ ID NO: 596883 - DNA, 13 bp, D. melanogaster
caaaacttttgtt

SEQ ID NO: 596884 - DNA, 13 bp, D. melanogaster
caaaactttttga

SEQ ID NO: 596885 - DNA, 14 bp, D. melanogaster
caaaactttttgaa

SEQ ID NO: 596886 - DNA, 13 bp, D. melanogaster
caaaactttttgc

SEQ ID NO: 596887 - DNA, 13 bp, D. melanogaster
caaaagaaaactt

SEQ ID NO: 596888 - DNA, 13 bp, D. melanogaster
caaaagaaaagct

SEQ ID NO: 596889 - DNA, 13 bp, D. melanogaster
caaaagaaaagtg

SEQ ID NO: 596890 - DNA, 13 bp, D. melanogaster
caaaagaaaagtt

SEQ ID NO: 596891 - DNA, 14 bp, D. melanogaster
caaaagaaaatatt

SEQ ID NO: 596892 - DNA, 13 bp, D. melanogaster
caaaagaaaatgg

SEQ ID NO: 596893 - DNA, 13 bp, D. melanogaster
caaaagaaaattt

SEQ ID NO: 596894 - DNA, 13 bp, D. melanogaster
caaaagaaatatt

SEQ ID NO: 596895 - DNA, 13 bp, D. melanogaster
caaaagaaatgca

SEQ ID NO: 596896 - DNA, 13 bp, D. melanogaster
caaaagaaatggc

SEQ ID NO: 596897 - DNA, 13 bp, D. melanogaster
caaaagaaatgta

SEQ ID NO: 596898 - DNA, 13 bp, D. melanogaster
caaaagaaattag

SEQ ID NO: 596899 - DNA, 13 bp, D. melanogaster
caaaagaaattgc

SEQ ID NO: 596900 - DNA, 13 bp, D. melanogaster
caaaagaaatttt

SEQ ID NO: 596901 - DNA, 13 bp, D. melanogaster
caaaagaacttaa

SEQ ID NO: 596902 - DNA, 13 bp, D. melanogaster
caaaagaactttg

SEQ ID NO: 596903 - DNA, 14 bp, D. melanogaster
caaaagaagactca

SEQ ID NO: 596904 - DNA, 13 bp, D. melanogaster
caaaagaagtgca

SEQ ID NO: 596905 - DNA, 13 bp, D. melanogaster
caaaagaatgcca

SEQ ID NO: 596906 - DNA, 13 bp, D. melanogaster
caaaagaatttta

SEQ ID NO: 596907 - DNA, 14 bp, D. melanogaster
caaaagaattttaa

SEQ ID NO: 596908 - DNA, 13 bp, D. melanogaster
caaaagacttaag

SEQ ID NO: 596909 - DNA, 14 bp, D. melanogaster
caaaagacttaagc

SEQ ID NO: 596910 - DNA, 13 bp, D. melanogaster
caaaagagcaccg

SEQ ID NO: 596911 - DNA, 13 bp, D. melanogaster
caaaagagggatt

SEQ ID NO: 596912 - DNA, 13 bp, D. melanogaster
caaaagagtacat

SEQ ID NO: 596913 - DNA, 14 bp, D. melanogaster
caaaagagtacatc

SEQ ID NO: 596914 - DNA, 13 bp, D. melanogaster
caaaagataatac

SEQ ID NO: 596915 - DNA, 13 bp, D. melanogaster
caaaagataattt

SEQ ID NO: 596916 - DNA, 13 bp, D. melanogaster
caaaagatacttt

SEQ ID NO: 596917 - DNA, 13 bp, D. melanogaster
caaaagatatata

SEQ ID NO: 596918 - DNA, 13 bp, D. melanogaster
caaaagatatcaa

SEQ ID NO: 596919 - DNA, 13 bp, D. melanogaster
caaaagatccatt

SEQ ID NO: 596920 - DNA, 13 bp, D. melanogaster
caaaagatcgttg

SEQ ID NO: 596921 - DNA, 13 bp, D. melanogaster
caaaagatgaaag

SEQ ID NO: 596922 - DNA, 14 bp, D. melanogaster
caaaagattatttt

SEQ ID NO: 596923 - DNA, 14 bp, D. melanogaster
caaaagcaaaagcg

SEQ ID NO: 596924 - DNA, 13 bp, D. melanogaster
caaaagcaaaagt

SEQ ID NO: 596925 - DNA, 13 bp, D. melanogaster
caaaagcaaagat

SEQ ID NO: 596926 - DNA, 13 bp, D. melanogaster
caaaagcaaagtt

SEQ ID NO: 596927 - DNA, 13 bp, D. melanogaster
caaaagcaaatcc

SEQ ID NO: 596928 - DNA, 13 bp, D. melanogaster
caaaagcaaatgc

SEQ ID NO: 596929 - DNA, 13 bp, D. melanogaster
caaaagcaataat

SEQ ID NO: 596930 - DNA, 13 bp, D. melanogaster
caaaagcaatgca

SEQ ID NO: 596931 - DNA, 13 bp, D. melanogaster
caaaagcaatttg

SEQ ID NO: 596932 - DNA, 14 bp, D. melanogaster
caaaagcaatttgt

SEQ ID NO: 596933 - DNA, 13 bp, D. melanogaster
caaaagcacaaat

SEQ ID NO: 596934 - DNA, 13 bp, D. melanogaster
caaaagcagaaat

SEQ ID NO: 596935 - DNA, 13 bp, D. melanogaster
caaaagcagaagt

SEQ ID NO: 596936 - DNA, 13 bp, D. melanogaster
caaaagcagagca

SEQ ID NO: 596937 - DNA, 13 bp, D. melanogaster
caaaagcagcaat

SEQ ID NO: 596938 - DNA, 13 bp, D. melanogaster
caaaagcagcaga

SEQ ID NO: 596939 - DNA, 14 bp, D. melanogaster
caaaagcagcagca

SEQ ID NO: 596940 - DNA, 13 bp, D. melanogaster
caaaagcagccaa

SEQ ID NO: 596941 - DNA, 13 bp, D. melanogaster
caaaagcagcgca

SEQ ID NO: 596942 - DNA, 13 bp, D. melanogaster
caaaagcagcggc

SEQ ID NO: 596943 - DNA, 13 bp, D. melanogaster
caaaagcagctga

SEQ ID NO: 596944 - DNA, 13 bp, D. melanogaster
caaaagcatacaa

SEQ ID NO: 596945 - DNA, 13 bp, D. melanogaster
caaaagcatttaa

SEQ ID NO: 596946 - DNA, 13 bp, D. melanogaster
caaaagcatttca

SEQ ID NO: 596947 - DNA, 13 bp, D. melanogaster
caaaagcatttta

SEQ ID NO: 596948 - DNA, 14 bp, D. melanogaster
caaaagcattttaa

SEQ ID NO: 596949 - DNA, 13 bp, D. melanogaster
caaaagccaaaat

SEQ ID NO: 596950 - DNA, 13 bp, D. melanogaster
caaaagccaagcc

SEQ ID NO: 596951 - DNA, 13 bp, D. melanogaster
caaaagccaagga

SEQ ID NO: 596952 - DNA, 13 bp, D. melanogaster
caaaagccagaag

SEQ ID NO: 596953 - DNA, 13 bp, D. melanogaster
caaaagccagaga

SEQ ID NO: 596954 - DNA, 13 bp, D. melanogaster
caaaagccagcaa

SEQ ID NO: 596955 - DNA, 13 bp, D. melanogaster
caaaagccgaatc

SEQ ID NO: 596956 - DNA, 13 bp, D. melanogaster
caaaagccgcaaa

SEQ ID NO: 596957 - DNA, 13 bp, D. melanogaster
caaaagcgaaacg

SEQ ID NO: 596958 - DNA, 13 bp, D. melanogaster
caaaagcgaaagc

SEQ ID NO: 596959 - DNA, 13 bp, D. melanogaster
caaaagcgaaatt

SEQ ID NO: 596960 - DNA, 13 bp, D. melanogaster
caaaagcgcagca

SEQ ID NO: 596961 - DNA, 13 bp, D. melanogaster
caaaagcgcataa

SEQ ID NO: 596962 - DNA, 13 bp, D. melanogaster
caaaagcggccaa

SEQ ID NO: 596963 - DNA, 13 bp, D. melanogaster
caaaagctaaaag

SEQ ID NO: 596964 - DNA, 13 bp, D. melanogaster
caaaagctaaaca

SEQ ID NO: 596965 - DNA, 13 bp, D. melanogaster
caaaagctaatta

SEQ ID NO: 596966 - DNA, 13 bp, D. melanogaster
caaaagctgaaac

SEQ ID NO: 596967 - DNA, 13 bp, D. melanogaster
caaaagctgacaa

SEQ ID NO: 596968 - DNA, 13 bp, D. melanogaster
caaaagctgcaaa

SEQ ID NO: 596969 - DNA, 13 bp, D. melanogaster
caaaagctgcaca

SEQ ID NO: 596970 - DNA, 13 bp, D. melanogaster
caaaagctgccaa

SEQ ID NO: 596971 - DNA, 13 bp, D. melanogaster
caaaagctgccct

SEQ ID NO: 596972 - DNA, 13 bp, D. melanogaster
caaaagctggcca

SEQ ID NO: 596973 - DNA, 13 bp, D. melanogaster
caaaagctgtcaa

SEQ ID NO: 596974 - DNA, 13 bp, D. melanogaster
caaaagcttaaaa

SEQ ID NO: 596975 - DNA, 13 bp, D. melanogaster
caaaagcttttat

SEQ ID NO: 596976 - DNA, 13 bp, D. melanogaster
caaaagcttttgc

SEQ ID NO: 596977 - DNA, 13 bp, D. melanogaster
caaaagcttttgg

SEQ ID NO: 596978 - DNA, 14 bp, D. melanogaster
caaaagcttttttc

SEQ ID NO: 596979 - DNA, 13 bp, D. melanogaster
caaaaggaaaact

SEQ ID NO: 596980 - DNA, 13 bp, D. melanogaster
caaaaggaaatca

SEQ ID NO: 596981 - DNA, 13 bp, D. melanogaster
caaaaggaaattg

SEQ ID NO: 596982 - DNA, 13 bp, D. melanogaster
caaaaggacgaag

SEQ ID NO: 596983 - DNA, 13 bp, D. melanogaster
caaaaggagcagc

SEQ ID NO: 596984 - DNA, 13 bp, D. melanogaster
caaaaggcaacag

SEQ ID NO: 596985 - DNA, 14 bp, D. melanogaster
caaaaggcacaaag

SEQ ID NO: 596986 - DNA, 13 bp, D. melanogaster
caaaaggccaaag

SEQ ID NO: 596987 - DNA, 13 bp, D. melanogaster
caaaaggccaaat

SEQ ID NO: 596988 - DNA, 13 bp, D. melanogaster
caaaaggccacaa

SEQ ID NO: 596989 - DNA, 13 bp, D. melanogaster
caaaaggccgaaa

SEQ ID NO: 596990 - DNA, 13 bp, D. melanogaster
caaaaggcggcga

SEQ ID NO: 596991 - DNA, 13 bp, D. melanogaster
caaaaggggcgtg

SEQ ID NO: 596992 - DNA, 13 bp, D. melanogaster
caaaagggggcgg

SEQ ID NO: 596993 - DNA, 13 bp, D. melanogaster
caaaagggttttc

SEQ ID NO: 596994 - DNA, 13 bp, D. melanogaster
caaaaggtaaaca

SEQ ID NO: 596995 - DNA, 13 bp, D. melanogaster
caaaaggtaaata

SEQ ID NO: 596996 - DNA, 14 bp, D. melanogaster
caaaaggtatttaa

SEQ ID NO: 596997 - DNA, 13 bp, D. melanogaster
caaaaggtcataa

SEQ ID NO: 596998 - DNA, 13 bp, D. melanogaster
caaaagtaaactt

SEQ ID NO: 596999 - DNA, 13 bp, D. melanogaster
caaaagtaaatat

SEQ ID NO: 597000 - DNA, 13 bp, D. melanogaster
caaaagtaatcaa

SEQ ID NO: 597001 - DNA, 13 bp, D. melanogaster
caaaagtaatgga

SEQ ID NO: 597002 - DNA, 13 bp, D. melanogaster
caaaagtaattaa

SEQ ID NO: 597003 - DNA, 13 bp, D. melanogaster
caaaagtaattta

SEQ ID NO: 597004 - DNA, 13 bp, D. melanogaster
caaaagtacaaat

SEQ ID NO: 597005 - DNA, 14 bp, D. melanogaster
caaaagtacaaata

SEQ ID NO: 597006 - DNA, 13 bp, D. melanogaster
caaaagtacaaca

SEQ ID NO: 597007 - DNA, 13 bp, D. melanogaster
caaaagtatctgc

SEQ ID NO: 597008 - DNA, 14 bp, D. melanogaster
caaaagtatttaca

SEQ ID NO: 597009 - DNA, 13 bp, D. melanogaster
caaaagtatttga

SEQ ID NO: 597010 - DNA, 13 bp, D. melanogaster
caaaagtatttgc

SEQ ID NO: 597011 - DNA, 13 bp, D. melanogaster
caaaagtcaacaa

SEQ ID NO: 597012 - DNA, 13 bp, D. melanogaster
caaaagtcaacat

SEQ ID NO: 597013 - DNA, 13 bp, D. melanogaster
caaaagtcaatca

SEQ ID NO: 597014 - DNA, 13 bp, D. melanogaster
caaaagtcaatga

SEQ ID NO: 597015 - DNA, 13 bp, D. melanogaster
caaaagtcatatc

SEQ ID NO: 597016 - DNA, 16 bp, D. melanogaster
caaaagtcatatcaaa

SEQ ID NO: 597017 - DNA, 13 bp, D. melanogaster
caaaagtcatttg

SEQ ID NO: 597018 - DNA, 13 bp, D. melanogaster
caaaagtccttta

SEQ ID NO: 597019 - DNA, 13 bp, D. melanogaster
caaaagtgaaaac

SEQ ID NO: 597020 - DNA, 13 bp, D. melanogaster
caaaagtgatttt

SEQ ID NO: 597021 - DNA, 13 bp, D. melanogaster
caaaagtgcaaac

SEQ ID NO: 597022 - DNA, 13 bp, D. melanogaster
caaaagtgcaaat

SEQ ID NO: 597023 - DNA, 13 bp, D. melanogaster
caaaagtgcaacg

SEQ ID NO: 597024 - DNA, 13 bp, D. melanogaster
caaaagtgcaatt

SEQ ID NO: 597025 - DNA, 13 bp, D. melanogaster
caaaagtgcacaa

SEQ ID NO: 597026 - DNA, 13 bp, D. melanogaster
caaaagtgcctta

SEQ ID NO: 597027 - DNA, 13 bp, D. melanogaster
caaaagtgcgaaa

SEQ ID NO: 597028 - DNA, 13 bp, D. melanogaster
caaaagtgctgca

SEQ ID NO: 597029 - DNA, 13 bp, D. melanogaster
caaaagtgggagg

SEQ ID NO: 597030 - DNA, 13 bp, D. melanogaster
caaaagtggtttt

SEQ ID NO: 597031 - DNA, 13 bp, D. melanogaster
caaaagtgtaaaa

SEQ ID NO: 597032 - DNA, 13 bp, D. melanogaster
caaaagtgtgagc

SEQ ID NO: 597033 - DNA, 13 bp, D. melanogaster
caaaagtgtggac

SEQ ID NO: 597034 - DNA, 13 bp, D. melanogaster
caaaagtgtgtaa

SEQ ID NO: 597035 - DNA, 14 bp, D. melanogaster
caaaagtgtgtaaa

SEQ ID NO: 597036 - DNA, 13 bp, D. melanogaster
caaaagtgttgcc

SEQ ID NO: 597037 - DNA, 13 bp, D. melanogaster
caaaagttaacaa

SEQ ID NO: 597038 - DNA, 13 bp, D. melanogaster
caaaagttaatta

SEQ ID NO: 597039 - DNA, 13 bp, D. melanogaster
caaaagttcaaag

SEQ ID NO: 597040 - DNA, 13 bp, D. melanogaster
caaaagttcaaca

SEQ ID NO: 597041 - DNA, 13 bp, D. melanogaster
caaaagttgaaag

SEQ ID NO: 597042 - DNA, 13 bp, D. melanogaster
caaaagttgaatt

SEQ ID NO: 597043 - DNA, 13 bp, D. melanogaster
caaaagttgatta

SEQ ID NO: 597044 - DNA, 13 bp, D. melanogaster
caaaagttgcaca

SEQ ID NO: 597045 - DNA, 13 bp, D. melanogaster
caaaagttgccaa

SEQ ID NO: 597046 - DNA, 13 bp, D. melanogaster
caaaagttggcca

SEQ ID NO: 597047 - DNA, 13 bp, D. melanogaster
caaaagttggcgc

SEQ ID NO: 597048 - DNA, 13 bp, D. melanogaster
caaaagttgtcaa

SEQ ID NO: 597049 - DNA, 13 bp, D. melanogaster
caaaagttgtgcg

SEQ ID NO: 597050 - DNA, 13 bp, D. melanogaster
caaaagttgtggg

SEQ ID NO: 597051 - DNA, 13 bp, D. melanogaster
caaaagttgttga

SEQ ID NO: 597052 - DNA, 13 bp, D. melanogaster
caaaagttgtttt

SEQ ID NO: 597053 - DNA, 13 bp, D. melanogaster
caaaagtttaatt

SEQ ID NO: 597054 - DNA, 13 bp, D. melanogaster
caaaagtttactt

SEQ ID NO: 597055 - DNA, 13 bp, D. melanogaster
caaaagtttcatt

SEQ ID NO: 597056 - DNA, 13 bp, D. melanogaster
caaaagtttcgct

SEQ ID NO: 597057 - DNA, 13 bp, D. melanogaster
caaaagtttgaac

SEQ ID NO: 597058 - DNA, 13 bp, D. melanogaster
caaaagtttgcaa

SEQ ID NO: 597059 - DNA, 13 bp, D. melanogaster
caaaagtttgcca

SEQ ID NO: 597060 - DNA, 13 bp, D. melanogaster
caaaagtttggcg

SEQ ID NO: 597061 - DNA, 13 bp, D. melanogaster
caaaagttttaaa

SEQ ID NO: 597062 - DNA, 13 bp, D. melanogaster
caaaagttttaat

SEQ ID NO: 597063 - DNA, 13 bp, D. melanogaster
caaaagttttatg

SEQ ID NO: 597064 - DNA, 13 bp, D. melanogaster
caaaagttttccc

SEQ ID NO: 597065 - DNA, 13 bp, D. melanogaster
caaaagttttcct

SEQ ID NO: 597066 - DNA, 13 bp, D. melanogaster
caaaagttttcgg

SEQ ID NO: 597067 - DNA, 13 bp, D. melanogaster
caaaagtttttaa

SEQ ID NO: 597068 - DNA, 14 bp, D. melanogaster
caaaagtttttcat

SEQ ID NO: 597069 - DNA, 13 bp, D. melanogaster
caaaagtttttcg

SEQ ID NO: 597070 - DNA, 13 bp, D. melanogaster
caaaagttttttt

SEQ ID NO: 597071 - DNA, 14 bp, D. melanogaster
caaaataaaaatgg

SEQ ID NO: 597072 - DNA, 14 bp, D. melanogaster
caaaataaaatgca

SEQ ID NO: 597073 - DNA, 13 bp, D. melanogaster
caaaataaacgca

SEQ ID NO: 597074 - DNA, 13 bp, D. melanogaster
caaaataaagcag

SEQ ID NO: 597075 - DNA, 13 bp, D. melanogaster
caaaataaagcca

SEQ ID NO: 597076 - DNA, 14 bp, D. melanogaster
caaaataaatatgt

SEQ ID NO: 597077 - DNA, 13 bp, D. melanogaster
caaaataaatgca

SEQ ID NO: 597078 - DNA, 13 bp, D. melanogaster
caaaataaattcg

SEQ ID NO: 597079 - DNA, 14 bp, D. melanogaster
caaaataaattcgt

SEQ ID NO: 597080 - DNA, 13 bp, D. melanogaster
caaaataaattgt

SEQ ID NO: 597081 - DNA, 13 bp, D. melanogaster
caaaataacattt

SEQ ID NO: 597082 - DNA, 13 bp, D. melanogaster
caaaataagaact

SEQ ID NO: 597083 - DNA, 13 bp, D. melanogaster
caaaataagagtg

SEQ ID NO: 597084 - DNA, 13 bp, D. melanogaster
caaaataagtgaa

SEQ ID NO: 597085 - DNA, 13 bp, D. melanogaster
caaaataagttaa

SEQ ID NO: 597086 - DNA, 13 bp, D. melanogaster
caaaataatagtt

SEQ ID NO: 597087 - DNA, 13 bp, D. melanogaster
caaaataatgaca

SEQ ID NO: 597088 - DNA, 13 bp, D. melanogaster
caaaataattaag

SEQ ID NO: 597089 - DNA, 13 bp, D. melanogaster
caaaataatttcg

SEQ ID NO: 597090 - DNA, 13 bp, D. melanogaster
caaaataatttgt

SEQ ID NO: 597091 - DNA, 13 bp, D. melanogaster
caaaatacaattg

SEQ ID NO: 597092 - DNA, 13 bp, D. melanogaster
caaaatacaattt

SEQ ID NO: 597093 - DNA, 14 bp, D. melanogaster
caaaatacatacat

SEQ ID NO: 597094 - DNA, 13 bp, D. melanogaster
caaaatacatttt

SEQ ID NO: 597095 - DNA, 13 bp, D. melanogaster
caaaataccgaat

SEQ ID NO: 597096 - DNA, 13 bp, D. melanogaster
caaaatacttatg

SEQ ID NO: 597097 - DNA, 14 bp, D. melanogaster
caaaatacttatgc

SEQ ID NO: 597098 - DNA, 13 bp, D. melanogaster
caaaatactttgc

SEQ ID NO: 597099 - DNA, 13 bp, D. melanogaster
caaaatagaaagt

SEQ ID NO: 597100 - DNA, 13 bp, D. melanogaster
caaaatagttgaa

SEQ ID NO: 597101 - DNA, 13 bp, D. melanogaster
caaaatataaagt

SEQ ID NO: 597102 - DNA, 13 bp, D. melanogaster
caaaatataatga

SEQ ID NO: 597103 - DNA, 13 bp, D. melanogaster
caaaatatattcg

SEQ ID NO: 597104 - DNA, 13 bp, D. melanogaster
caaaatatattgt

SEQ ID NO: 597105 - DNA, 13 bp, D. melanogaster
caaaatatcaatg

SEQ ID NO: 597106 - DNA, 13 bp, D. melanogaster
caaaatatcacag

SEQ ID NO: 597107 - DNA, 13 bp, D. melanogaster
caaaatatcatta

SEQ ID NO: 597108 - DNA, 13 bp, D. melanogaster
caaaatatgaaat

SEQ ID NO: 597109 - DNA, 13 bp, D. melanogaster
caaaatatgataa

SEQ ID NO: 597110 - DNA, 13 bp, D. melanogaster
caaaatatgcaat

SEQ ID NO: 597111 - DNA, 13 bp, D. melanogaster
caaaatatgtcga

SEQ ID NO: 597112 - DNA, 13 bp, D. melanogaster
caaaatatgtgtt

SEQ ID NO: 597113 - DNA, 14 bp, D. melanogaster
caaaatatgtgtta

SEQ ID NO: 597114 - DNA, 13 bp, D. melanogaster
caaaatattcact

SEQ ID NO: 597115 - DNA, 13 bp, D. melanogaster
caaaatattcata

SEQ ID NO: 597116 - DNA, 13 bp, D. melanogaster
caaaatattcctg

SEQ ID NO: 597117 - DNA, 13 bp, D. melanogaster
caaaatattgaaa

SEQ ID NO: 597118 - DNA, 13 bp, D. melanogaster
caaaatattgaat

SEQ ID NO: 597119 - DNA, 13 bp, D. melanogaster
caaaatattgatt

SEQ ID NO: 597120 - DNA, 13 bp, D. melanogaster
caaaatattgcca

SEQ ID NO: 597121 - DNA, 13 bp, D. melanogaster
caaaatattggtt

SEQ ID NO: 597122 - DNA, 13 bp, D. melanogaster
caaaatattgttt

SEQ ID NO: 597123 - DNA, 13 bp, D. melanogaster
caaaatatttaca

SEQ ID NO: 597124 - DNA, 13 bp, D. melanogaster
caaaatatttagt

SEQ ID NO: 597125 - DNA, 13 bp, D. melanogaster
caaaatatttcca

SEQ ID NO: 597126 - DNA, 13 bp, D. melanogaster
caaaatatttgaa

SEQ ID NO: 597127 - DNA, 13 bp, D. melanogaster
caaaatatttgct

SEQ ID NO: 597128 - DNA, 14 bp, D. melanogaster
caaaatatttggta

SEQ ID NO: 597129 - DNA, 13 bp, D. melanogaster
caaaatatttgtg

SEQ ID NO: 597130 - DNA, 13 bp, D. melanogaster
caaaatatttgtt

SEQ ID NO: 597131 - DNA, 14 bp, D. melanogaster
caaaatatttgttt

SEQ ID NO: 597132 - DNA, 14 bp, D. melanogaster
caaaatattttgaa

SEQ ID NO: 597133 - DNA, 13 bp, D. melanogaster
caaaatcaaaagc

SEQ ID NO: 597134 - DNA, 13 bp, D. melanogaster
caaaatcaaactg

SEQ ID NO: 597135 - DNA, 13 bp, D. melanogaster
caaaatcaaagtc

SEQ ID NO: 597136 - DNA, 13 bp, D. melanogaster
caaaatcaaagtg

SEQ ID NO: 597137 - DNA, 13 bp, D. melanogaster
caaaatcaaatcg

SEQ ID NO: 597138 - DNA, 14 bp, D. melanogaster
caaaatcaaattca

SEQ ID NO: 597139 - DNA, 13 bp, D. melanogaster
caaaatcaatcga

SEQ ID NO: 597140 - DNA, 14 bp, D. melanogaster
caaaatcaatcgaa

SEQ ID NO: 597141 - DNA, 13 bp, D. melanogaster
caaaatcaattca

SEQ ID NO: 597142 - DNA, 13 bp, D. melanogaster
caaaatcaatttg

SEQ ID NO: 597143 - DNA, 13 bp, D. melanogaster
caaaatcaatttt

SEQ ID NO: 597144 - DNA, 13 bp, D. melanogaster
caaaatcactaat

SEQ ID NO: 597145 - DNA, 13 bp, D. melanogaster
caaaatcacttaa

SEQ ID NO: 597146 - DNA, 13 bp, D. melanogaster
caaaatcagaatt

SEQ ID NO: 597147 - DNA, 14 bp, D. melanogaster
caaaatcagaatta

SEQ ID NO: 597148 - DNA, 14 bp, D. melanogaster
caaaatcagcaatc

SEQ ID NO: 597149 - DNA, 13 bp, D. melanogaster
caaaatcagcagc

SEQ ID NO: 597150 - DNA, 13 bp, D. melanogaster
caaaatcaggtaa

SEQ ID NO: 597151 - DNA, 13 bp, D. melanogaster
caaaatcagttgc

SEQ ID NO: 597152 - DNA, 13 bp, D. melanogaster
caaaatcagttta

SEQ ID NO: 597153 - DNA, 13 bp, D. melanogaster
caaaatcatagaa

SEQ ID NO: 597154 - DNA, 14 bp, D. melanogaster
caaaatcatagaat

SEQ ID NO: 597155 - DNA, 14 bp, D. melanogaster
caaaatcatagctt

SEQ ID NO: 597156 - DNA, 13 bp, D. melanogaster
caaaatcatcatc

SEQ ID NO: 597157 - DNA, 13 bp, D. melanogaster
caaaatcattgat

SEQ ID NO: 597158 - DNA, 13 bp, D. melanogaster
caaaatcatttat

SEQ ID NO: 597159 - DNA, 13 bp, D. melanogaster
caaaatcatttgc

SEQ ID NO: 597160 - DNA, 13 bp, D. melanogaster
caaaatccaaatc

SEQ ID NO: 597161 - DNA, 13 bp, D. melanogaster
caaaatccaacta

SEQ ID NO: 597162 - DNA, 13 bp, D. melanogaster
caaaatccattaa

SEQ ID NO: 597163 - DNA, 13 bp, D. melanogaster
caaaatccgtttt

SEQ ID NO: 597164 - DNA, 13 bp, D. melanogaster
caaaatcctactt

SEQ ID NO: 597165 - DNA, 14 bp, D. melanogaster
caaaatcctacttc

SEQ ID NO: 597166 - DNA, 13 bp, D. melanogaster
caaaatccttcaa

SEQ ID NO: 597167 - DNA, 13 bp, D. melanogaster
caaaatcgaaacc

SEQ ID NO: 597168 - DNA, 13 bp, D. melanogaster
caaaatcgaaaga

SEQ ID NO: 597169 - DNA, 13 bp, D. melanogaster
caaaatcgaaata

SEQ ID NO: 597170 - DNA, 14 bp, D. melanogaster
caaaatcgaaatca

SEQ ID NO: 597171 - DNA, 13 bp, D. melanogaster
caaaatcgaatca

SEQ ID NO: 597172 - DNA, 13 bp, D. melanogaster
caaaatcgaattc

SEQ ID NO: 597173 - DNA, 13 bp, D. melanogaster
caaaatcgaccaa

SEQ ID NO: 597174 - DNA, 13 bp, D. melanogaster
caaaatcgcaaaa

SEQ ID NO: 597175 - DNA, 13 bp, D. melanogaster
caaaatcggaaaa

SEQ ID NO: 597176 - DNA, 13 bp, D. melanogaster
caaaatcggttgt

SEQ ID NO: 597177 - DNA, 13 bp, D. melanogaster
caaaatctagcca

SEQ ID NO: 597178 - DNA, 13 bp, D. melanogaster
caaaatcttgaaa

SEQ ID NO: 597179 - DNA, 14 bp, D. melanogaster
caaaatcttgaaac

SEQ ID NO: 597180 - DNA, 13 bp, D. melanogaster
caaaatctttaaa

SEQ ID NO: 597181 - DNA, 13 bp, D. melanogaster
caaaatgaaaagg

SEQ ID NO: 597182 - DNA, 14 bp, D. melanogaster
caaaatgaaaatga

SEQ ID NO: 597183 - DNA, 14 bp, D. melanogaster
caaaatgaaaatgt

SEQ ID NO: 597184 - DNA, 14 bp, D. melanogaster
caaaatgaaaattt

SEQ ID NO: 597185 - DNA, 14 bp, D. melanogaster
caaaatgaaatatt

SEQ ID NO: 597186 - DNA, 14 bp, D. melanogaster
caaaatgaaatcaa

SEQ ID NO: 597187 - DNA, 13 bp, D. melanogaster
caaaatgaagctg

SEQ ID NO: 597188 - DNA, 13 bp, D. melanogaster
caaaatgaatgaa

SEQ ID NO: 597189 - DNA, 14 bp, D. melanogaster
caaaatgaatgaaa

SEQ ID NO: 597190 - DNA, 13 bp, D. melanogaster
caaaatgaatgca

SEQ ID NO: 597191 - DNA, 13 bp, D. melanogaster
caaaatgaatgga

SEQ ID NO: 597192 - DNA, 13 bp, D. melanogaster
caaaatgaattgc

SEQ ID NO: 597193 - DNA, 14 bp, D. melanogaster
caaaatgaatttat

SEQ ID NO: 597194 - DNA, 13 bp, D. melanogaster
caaaatgagaaat

SEQ ID NO: 597195 - DNA, 13 bp, D. melanogaster
caaaatgagattt

SEQ ID NO: 597196 - DNA, 13 bp, D. melanogaster
caaaatgagcaaa

SEQ ID NO: 597197 - DNA, 13 bp, D. melanogaster
caaaatgagggaa

SEQ ID NO: 597198 - DNA, 13 bp, D. melanogaster
caaaatgatggcc

SEQ ID NO: 597199 - DNA, 13 bp, D. melanogaster
caaaatgatgtca

SEQ ID NO: 597200 - DNA, 13 bp, D. melanogaster
caaaatgattgaa

SEQ ID NO: 597201 - DNA, 13 bp, D. melanogaster
caaaatgcaaaac

SEQ ID NO: 597202 - DNA, 14 bp, D. melanogaster
caaaatgcaaaatg

SEQ ID NO: 597203 - DNA, 13 bp, D. melanogaster
caaaatgcaaact

SEQ ID NO: 597204 - DNA, 13 bp, D. melanogaster
caaaatgcaaagc

SEQ ID NO: 597205 - DNA, 13 bp, D. melanogaster
caaaatgcaaata

SEQ ID NO: 597206 - DNA, 13 bp, D. melanogaster
caaaatgcaaatg

SEQ ID NO: 597207 - DNA, 14 bp, D. melanogaster
caaaatgcaaatga

SEQ ID NO: 597208 - DNA, 13 bp, D. melanogaster
caaaatgcaaatt

SEQ ID NO: 597209 - DNA, 13 bp, D. melanogaster
caaaatgcaacat

SEQ ID NO: 597210 - DNA, 13 bp, D. melanogaster
caaaatgcaatca

SEQ ID NO: 597211 - DNA, 14 bp, D. melanogaster
caaaatgcaatcaa

SEQ ID NO: 597212 - DNA, 13 bp, D. melanogaster
caaaatgcaattc

SEQ ID NO: 597213 - DNA, 13 bp, D. melanogaster
caaaatgcaattg

SEQ ID NO: 597214 - DNA, 13 bp, D. melanogaster
caaaatgcaattt

SEQ ID NO: 597215 - DNA, 13 bp, D. melanogaster
caaaatgcacaaa

SEQ ID NO: 597216 - DNA, 13 bp, D. melanogaster
caaaatgcacaca

SEQ ID NO: 597217 - DNA, 13 bp, D. melanogaster
caaaatgcactcg

SEQ ID NO: 597218 - DNA, 13 bp, D. melanogaster
caaaatgcagact

SEQ ID NO: 597219 - DNA, 13 bp, D. melanogaster
caaaatgcagcaa

SEQ ID NO: 597220 - DNA, 13 bp, D. melanogaster
caaaatgcatatt

SEQ ID NO: 597221 - DNA, 13 bp, D. melanogaster
caaaatgcattaa

SEQ ID NO: 597222 - DNA, 13 bp, D. melanogaster
caaaatgcattag

SEQ ID NO: 597223 - DNA, 13 bp, D. melanogaster
caaaatgcattca

SEQ ID NO: 597224 - DNA, 13 bp, D. melanogaster
caaaatgccaaat

SEQ ID NO: 597225 - DNA, 13 bp, D. melanogaster
caaaatgccaaca

SEQ ID NO: 597226 - DNA, 13 bp, D. melanogaster
caaaatgccaatg

SEQ ID NO: 597227 - DNA, 13 bp, D. melanogaster
caaaatgccacaa

SEQ ID NO: 597228 - DNA, 13 bp, D. melanogaster
caaaatgccagca

SEQ ID NO: 597229 - DNA, 13 bp, D. melanogaster
caaaatgccatta

SEQ ID NO: 597230 - DNA, 13 bp, D. melanogaster
caaaatgccattt

SEQ ID NO: 597231 - DNA, 13 bp, D. melanogaster
caaaatgcgaaaa

SEQ ID NO: 597232 - DNA, 13 bp, D. melanogaster
caaaatgcggcaa

SEQ ID NO: 597233 - DNA, 13 bp, D. melanogaster
caaaatgctacaa

SEQ ID NO: 597234 - DNA, 13 bp, D. melanogaster
caaaatgctgacc

SEQ ID NO: 597235 - DNA, 13 bp, D. melanogaster
caaaatgctgcca

SEQ ID NO: 597236 - DNA, 13 bp, D. melanogaster
caaaatggaacaa

SEQ ID NO: 597237 - DNA, 13 bp, D. melanogaster
caaaatggaagag

SEQ ID NO: 597238 - DNA, 13 bp, D. melanogaster
caaaatggaataa

SEQ ID NO: 597239 - DNA, 14 bp, D. melanogaster
caaaatggaatagc

SEQ ID NO: 597240 - DNA, 13 bp, D. melanogaster
caaaatggaattg

SEQ ID NO: 597241 - DNA, 13 bp, D. melanogaster
caaaatggcaaaa

SEQ ID NO: 597242 - DNA, 13 bp, D. melanogaster
caaaatggcaaag

SEQ ID NO: 597243 - DNA, 13 bp, D. melanogaster
caaaatggcagca

SEQ ID NO: 597244 - DNA, 13 bp, D. melanogaster
caaaatggccaaa

SEQ ID NO: 597245 - DNA, 13 bp, D. melanogaster
caaaatggccacc

SEQ ID NO: 597246 - DNA, 13 bp, D. melanogaster
caaaatggccgac

SEQ ID NO: 597247 - DNA, 13 bp, D. melanogaster
caaaatggccgcc

SEQ ID NO: 597248 - DNA, 14 bp, D. melanogaster
caaaatggccgcca

SEQ ID NO: 597249 - DNA, 13 bp, D. melanogaster
caaaatggcggca

SEQ ID NO: 597250 - DNA, 13 bp, D. melanogaster
caaaatggcggcg

SEQ ID NO: 597251 - DNA, 13 bp, D. melanogaster
caaaatggcgtcg

SEQ ID NO: 597252 - DNA, 14 bp, D. melanogaster
caaaatggctgcca

SEQ ID NO: 597253 - DNA, 13 bp, D. melanogaster
caaaatggctggc

SEQ ID NO: 597254 - DNA, 13 bp, D. melanogaster
caaaatgggcaat

SEQ ID NO: 597255 - DNA, 14 bp, D. melanogaster
caaaatgggtctaa

SEQ ID NO: 597256 - DNA, 13 bp, D. melanogaster
caaaatgggttaa

SEQ ID NO: 597257 - DNA, 13 bp, D. melanogaster
caaaatggtatcc

SEQ ID NO: 597258 - DNA, 13 bp, D. melanogaster
caaaatggtggcg

SEQ ID NO: 597259 - DNA, 15 bp, D. melanogaster
caaaatggtggcgga

SEQ ID NO: 597260 - DNA, 13 bp, D. melanogaster
caaaatgtaaaca

SEQ ID NO: 597261 - DNA, 13 bp, D. melanogaster
caaaatgtaaata

SEQ ID NO: 597262 - DNA, 13 bp, D. melanogaster
caaaatgtaaatg

SEQ ID NO: 597263 - DNA, 13 bp, D. melanogaster
caaaatgtaacaa

SEQ ID NO: 597264 - DNA, 13 bp, D. melanogaster
caaaatgtaattt

SEQ ID NO: 597265 - DNA, 13 bp, D. melanogaster
caaaatgtacaaa

SEQ ID NO: 597266 - DNA, 13 bp, D. melanogaster
caaaatgtataaa

SEQ ID NO: 597267 - DNA, 13 bp, D. melanogaster
caaaatgtataca

SEQ ID NO: 597268 - DNA, 13 bp, D. melanogaster
caaaatgtatata

SEQ ID NO: 597269 - DNA, 14 bp, D. melanogaster
caaaatgtatatat

SEQ ID NO: 597270 - DNA, 13 bp, D. melanogaster
caaaatgtatcaa

SEQ ID NO: 597271 - DNA, 13 bp, D. melanogaster
caaaatgtattaa

SEQ ID NO: 597272 - DNA, 13 bp, D. melanogaster
caaaatgtattcc

SEQ ID NO: 597273 - DNA, 13 bp, D. melanogaster
caaaatgtattta

SEQ ID NO: 597274 - DNA, 13 bp, D. melanogaster
caaaatgtcaatg

SEQ ID NO: 597275 - DNA, 13 bp, D. melanogaster
caaaatgtgcaaa

SEQ ID NO: 597276 - DNA, 13 bp, D. melanogaster
caaaatgtgcata

SEQ ID NO: 597277 - DNA, 13 bp, D. melanogaster
caaaatgtgtgtg

SEQ ID NO: 597278 - DNA, 13 bp, D. melanogaster
caaaatgttaaaa

SEQ ID NO: 597279 - DNA, 13 bp, D. melanogaster
caaaatgttaaca

SEQ ID NO: 597280 - DNA, 13 bp, D. melanogaster
caaaatgttatta

SEQ ID NO: 597281 - DNA, 13 bp, D. melanogaster
caaaatgttgcac

SEQ ID NO: 597282 - DNA, 13 bp, D. melanogaster
caaaatgttgcca

SEQ ID NO: 597283 - DNA, 13 bp, D. melanogaster
caaaatgtttaaa

SEQ ID NO: 597284 - DNA, 14 bp, D. melanogaster
caaaatgtttaaat

SEQ ID NO: 597285 - DNA, 13 bp, D. melanogaster
caaaatgtttact

SEQ ID NO: 597286 - DNA, 13 bp, D. melanogaster
caaaatgtttata

SEQ ID NO: 597287 - DNA, 13 bp, D. melanogaster
caaaatgtttccc

SEQ ID NO: 597288 - DNA, 13 bp, D. melanogaster
caaaatgtttgaa

SEQ ID NO: 597289 - DNA, 13 bp, D. melanogaster
caaaatgtttgat

SEQ ID NO: 597290 - DNA, 13 bp, D. melanogaster
caaaatgtttggc

SEQ ID NO: 597291 - DNA, 13 bp, D. melanogaster
caaaatgtttgtt

SEQ ID NO: 597292 - DNA, 14 bp, D. melanogaster
caaaatgttttaaa

SEQ ID NO: 597293 - DNA, 13 bp, D. melanogaster
caaaatgttttga

SEQ ID NO: 597294 - DNA, 13 bp, D. melanogaster
caaaatgttttgg

SEQ ID NO: 597295 - DNA, 14 bp, D. melanogaster
caaaatgtttttgt

SEQ ID NO: 597296 - DNA, 13 bp, D. melanogaster
caaaattaaaatg

SEQ ID NO: 597297 - DNA, 14 bp, D. melanogaster
caaaattaaacgat

SEQ ID NO: 597298 - DNA, 13 bp, D. melanogaster
caaaattagccaa

SEQ ID NO: 597299 - DNA, 13 bp, D. melanogaster
caaaattatgatt

SEQ ID NO: 597300 - DNA, 13 bp, D. melanogaster
caaaattattcct

SEQ ID NO: 597301 - DNA, 13 bp, D. melanogaster
caaaattatttca

SEQ ID NO: 597302 - DNA, 13 bp, D. melanogaster
caaaattatttcg

SEQ ID NO: 597303 - DNA, 13 bp, D. melanogaster
caaaattattttc

SEQ ID NO: 597304 - DNA, 13 bp, D. melanogaster
caaaattcaaagc

SEQ ID NO: 597305 - DNA, 13 bp, D. melanogaster
caaaattccaaat

SEQ ID NO: 597306 - DNA, 13 bp, D. melanogaster
caaaattccccat

SEQ ID NO: 597307 - DNA, 13 bp, D. melanogaster
caaaattcgaaaa

SEQ ID NO: 597308 - DNA, 13 bp, D. melanogaster
caaaattctaaag

SEQ ID NO: 597309 - DNA, 13 bp, D. melanogaster
caaaattctaatt

SEQ ID NO: 597310 - DNA, 13 bp, D. melanogaster
caaaattctttcg

SEQ ID NO: 597311 - DNA, 13 bp, D. melanogaster
caaaattctttgc

SEQ ID NO: 597312 - DNA, 14 bp, D. melanogaster
caaaattctttgct

SEQ ID NO: 597313 - DNA, 13 bp, D. melanogaster
caaaattgaaaca

SEQ ID NO: 597314 - DNA, 13 bp, D. melanogaster
caaaattgaaatt

SEQ ID NO: 597315 - DNA, 13 bp, D. melanogaster
caaaattgcaatg

SEQ ID NO: 597316 - DNA, 13 bp, D. melanogaster
caaaattgcattg

SEQ ID NO: 597317 - DNA, 13 bp, D. melanogaster
caaaattgccaaa

SEQ ID NO: 597318 - DNA, 13 bp, D. melanogaster
caaaattgctctc

SEQ ID NO: 597319 - DNA, 13 bp, D. melanogaster
caaaattgtaaaa

SEQ ID NO: 597320 - DNA, 14 bp, D. melanogaster
caaaattgtcaaaa

SEQ ID NO: 597321 - DNA, 14 bp, D. melanogaster
caaaattgtgccaa

SEQ ID NO: 597322 - DNA, 13 bp, D. melanogaster
caaaattgtttca

SEQ ID NO: 597323 - DNA, 13 bp, D. melanogaster
caaaatttaatca

SEQ ID NO: 597324 - DNA, 13 bp, D. melanogaster
caaaatttaattg

SEQ ID NO: 597325 - DNA, 13 bp, D. melanogaster
caaaatttatgaa

SEQ ID NO: 597326 - DNA, 14 bp, D. melanogaster
caaaatttattaca

SEQ ID NO: 597327 - DNA, 13 bp, D. melanogaster
caaaatttcacaa

SEQ ID NO: 597328 - DNA, 14 bp, D. melanogaster
caaaatttcacaag

SEQ ID NO: 597329 - DNA, 13 bp, D. melanogaster
caaaatttcatta

SEQ ID NO: 597330 - DNA, 13 bp, D. melanogaster
caaaatttccaat

SEQ ID NO: 597331 - DNA, 13 bp, D. melanogaster
caaaatttccagt

SEQ ID NO: 597332 - DNA, 13 bp, D. melanogaster
caaaatttcggga

SEQ ID NO: 597333 - DNA, 14 bp, D. melanogaster
caaaatttgaaatt

SEQ ID NO: 597334 - DNA, 13 bp, D. melanogaster
caaaatttgcaaa

SEQ ID NO: 597335 - DNA, 14 bp, D. melanogaster
caaaatttgcgaaa

SEQ ID NO: 597336 - DNA, 13 bp, D. melanogaster
caaaatttggaaa

SEQ ID NO: 597337 - DNA, 13 bp, D. melanogaster
caaaatttgtaat

SEQ ID NO: 597338 - DNA, 13 bp, D. melanogaster
caaaatttgtata

SEQ ID NO: 597339 - DNA, 13 bp, D. melanogaster
caaaatttgtcaa

SEQ ID NO: 597340 - DNA, 13 bp, D. melanogaster
caaaatttgtttt

SEQ ID NO: 597341 - DNA, 13 bp, D. melanogaster
caaaattttcaaa

SEQ ID NO: 597342 - DNA, 13 bp, D. melanogaster
caaaattttgttg

SEQ ID NO: 597343 - DNA, 14 bp, D. melanogaster
caaaatttttgttt

SEQ ID NO: 597344 - DNA, 13 bp, D. melanogaster
caaaattttttga

SEQ ID NO: 597345 - DNA, 13 bp, D. melanogaster
caaacaaaacgtt

SEQ ID NO: 597346 - DNA, 13 bp, D. melanogaster
caaacaaaacttt

SEQ ID NO: 597347 - DNA, 13 bp, D. melanogaster
caaacaaaagact

SEQ ID NO: 597348 - DNA, 13 bp, D. melanogaster
caaacaaaagccg

SEQ ID NO: 597349 - DNA, 13 bp, D. melanogaster
caaacaaaagctg

SEQ ID NO: 597350 - DNA, 13 bp, D. melanogaster
caaacaaaaggcc

SEQ ID NO: 597351 - DNA, 14 bp, D. melanogaster
caaacaaaatattc

SEQ ID NO: 597352 - DNA, 13 bp, D. melanogaster
caaacaaaatcgc

SEQ ID NO: 597353 - DNA, 13 bp, D. melanogaster
caaacaaaatgca

SEQ ID NO: 597354 - DNA, 14 bp, D. melanogaster
caaacaaaatgcaa

SEQ ID NO: 597355 - DNA, 13 bp, D. melanogaster
caaacaaaatgcc

SEQ ID NO: 597356 - DNA, 13 bp, D. melanogaster
caaacaaaatgct

SEQ ID NO: 597357 - DNA, 13 bp, D. melanogaster
caaacaaaatggc

SEQ ID NO: 597358 - DNA, 13 bp, D. melanogaster
caaacaaaatggg

SEQ ID NO: 597359 - DNA, 13 bp, D. melanogaster
caaacaaaattgt

SEQ ID NO: 597360 - DNA, 13 bp, D. melanogaster
caaacaaaatttg

SEQ ID NO: 597361 - DNA, 13 bp, D. melanogaster
caaacaaacaagt

SEQ ID NO: 597362 - DNA, 13 bp, D. melanogaster
caaacaaacaatg

SEQ ID NO: 597363 - DNA, 13 bp, D. melanogaster
caaacaaacagat

SEQ ID NO: 597364 - DNA, 13 bp, D. melanogaster
caaacaaacagct

SEQ ID NO: 597365 - DNA, 13 bp, D. melanogaster
caaacaaacagtg

SEQ ID NO: 597366 - DNA, 13 bp, D. melanogaster
caaacaaacatgc

SEQ ID NO: 597367 - DNA, 13 bp, D. melanogaster
caaacaaacattt

SEQ ID NO: 597368 - DNA, 13 bp, D. melanogaster
caaacaaacgaat

SEQ ID NO: 597369 - DNA, 13 bp, D. melanogaster
caaacaaacgggc

SEQ ID NO: 597370 - DNA, 13 bp, D. melanogaster
caaacaaactttg

SEQ ID NO: 597371 - DNA, 13 bp, D. melanogaster
caaacaaagcagc

SEQ ID NO: 597372 - DNA, 13 bp, D. melanogaster
caaacaaagccat

SEQ ID NO: 597373 - DNA, 13 bp, D. melanogaster
caaacaaagcgca

SEQ ID NO: 597374 - DNA, 13 bp, D. melanogaster
caaacaaagcggc

SEQ ID NO: 597375 - DNA, 13 bp, D. melanogaster
caaacaaaggagc

SEQ ID NO: 597376 - DNA, 13 bp, D. melanogaster
caaacaaaggcag

SEQ ID NO: 597377 - DNA, 13 bp, D. melanogaster
caaacaaagtcag

SEQ ID NO: 597378 - DNA, 13 bp, D. melanogaster
caaacaaagttga

SEQ ID NO: 597379 - DNA, 13 bp, D. melanogaster
caaacaaagtttt

SEQ ID NO: 597380 - DNA, 13 bp, D. melanogaster
caaacaaataagc

SEQ ID NO: 597381 - DNA, 13 bp, D. melanogaster
caaacaaatcgca

SEQ ID NO: 597382 - DNA, 13 bp, D. melanogaster
caaacaaatcttt

SEQ ID NO: 597383 - DNA, 13 bp, D. melanogaster
caaacaaatgaac

SEQ ID NO: 597384 - DNA, 13 bp, D. melanogaster
caaacaaatgaat

SEQ ID NO: 597385 - DNA, 13 bp, D. melanogaster
caaacaaatgaca

SEQ ID NO: 597386 - DNA, 13 bp, D. melanogaster
caaacaaatgacc

SEQ ID NO: 597387 - DNA, 13 bp, D. melanogaster
caaacaaatgatg

SEQ ID NO: 597388 - DNA, 13 bp, D. melanogaster
caaacaaatgatt

SEQ ID NO: 597389 - DNA, 13 bp, D. melanogaster
caaacaaatgcaa

SEQ ID NO: 597390 - DNA, 14 bp, D. melanogaster
caaacaaatgcaaa

SEQ ID NO: 597391 - DNA, 14 bp, D. melanogaster
caaacaaatgccaa

SEQ ID NO: 597392 - DNA, 14 bp, D. melanogaster
caaacaaatggaaa

SEQ ID NO: 597393 - DNA, 13 bp, D. melanogaster
caaacaaatggag

SEQ ID NO: 597394 - DNA, 14 bp, D. melanogaster
caaacaaatggcaa

SEQ ID NO: 597395 - DNA, 13 bp, D. melanogaster
caaacaaatgtgt

SEQ ID NO: 597396 - DNA, 13 bp, D. melanogaster
caaacaaattatt

SEQ ID NO: 597397 - DNA, 13 bp, D. melanogaster
caaacaaattgat

SEQ ID NO: 597398 - DNA, 14 bp, D. melanogaster
caaacaaattgatt

SEQ ID NO: 597399 - DNA, 13 bp, D. melanogaster
caaacaaattgca

SEQ ID NO: 597400 - DNA, 14 bp, D. melanogaster
caaacaaattgcaa

SEQ ID NO: 597401 - DNA, 13 bp, D. melanogaster
caaacaaattggc

SEQ ID NO: 597402 - DNA, 14 bp, D. melanogaster
caaacaaattgttt

SEQ ID NO: 597403 - DNA, 13 bp, D. melanogaster
caaacaaatttac

SEQ ID NO: 597404 - DNA, 13 bp, D. melanogaster
caaacaacaaatg

SEQ ID NO: 597405 - DNA, 13 bp, D. melanogaster
caaacaacagcga

SEQ ID NO: 597406 - DNA, 13 bp, D. melanogaster
caaacaacagctg

SEQ ID NO: 597407 - DNA, 13 bp, D. melanogaster
caaacaacgaaat

SEQ ID NO: 597408 - DNA, 13 bp, D. melanogaster
caaacaactgaaa

SEQ ID NO: 597409 - DNA, 13 bp, D. melanogaster
caaacaacttgaa

SEQ ID NO: 597410 - DNA, 13 bp, D. melanogaster
caaacaacttggc

SEQ ID NO: 597411 - DNA, 13 bp, D. melanogaster
caaacaactttca

SEQ ID NO: 597412 - DNA, 13 bp, D. melanogaster
caaacaagaattt

SEQ ID NO: 597413 - DNA, 13 bp, D. melanogaster
caaacaagcaaat

SEQ ID NO: 597414 - DNA, 13 bp, D. melanogaster
caaacaagccaag

SEQ ID NO: 597415 - DNA, 13 bp, D. melanogaster
caaacaagccgca

SEQ ID NO: 597416 - DNA, 13 bp, D. melanogaster
caaacaagcggca

SEQ ID NO: 597417 - DNA, 13 bp, D. melanogaster
caaacaaggcgaa

SEQ ID NO: 597418 - DNA, 13 bp, D. melanogaster
caaacaagtcttt

SEQ ID NO: 597419 - DNA, 13 bp, D. melanogaster
caaacaagtgaaa

SEQ ID NO: 597420 - DNA, 13 bp, D. melanogaster
caaacaataacag

SEQ ID NO: 597421 - DNA, 13 bp, D. melanogaster
caaacaataagca

SEQ ID NO: 597422 - DNA, 13 bp, D. melanogaster
caaacaatagcaa

SEQ ID NO: 597423 - DNA, 13 bp, D. melanogaster
caaacaatatcga

SEQ ID NO: 597424 - DNA, 13 bp, D. melanogaster
caaacaatatttt

SEQ ID NO: 597425 - DNA, 13 bp, D. melanogaster
caaacaatgcaaa

SEQ ID NO: 597426 - DNA, 13 bp, D. melanogaster
caaacaatgcagc

SEQ ID NO: 597427 - DNA, 13 bp, D. melanogaster
caaacaatgcgaa

SEQ ID NO: 597428 - DNA, 13 bp, D. melanogaster
caaacaatgcgta

SEQ ID NO: 597429 - DNA, 13 bp, D. melanogaster
caaacaatggaaa

SEQ ID NO: 597430 - DNA, 13 bp, D. melanogaster
caaacaatggcaa

SEQ ID NO: 597431 - DNA, 13 bp, D. melanogaster
caaacaatggcag

SEQ ID NO: 597432 - DNA, 14 bp, D. melanogaster
caaacaatggccaa

SEQ ID NO: 597433 - DNA, 13 bp, D. melanogaster
caaacaatgggaa

SEQ ID NO: 597434 - DNA, 13 bp, D. melanogaster
caaacaatgggca

SEQ ID NO: 597435 - DNA, 13 bp, D. melanogaster
caaacaatgtaaa

SEQ ID NO: 597436 - DNA, 14 bp, D. melanogaster
caaacaattcaatt

SEQ ID NO: 597437 - DNA, 14 bp, D. melanogaster
caaacaattgaaat

SEQ ID NO: 597438 - DNA, 13 bp, D. melanogaster
caaacaatttaat

SEQ ID NO: 597439 - DNA, 13 bp, D. melanogaster
caaacaatttatt

SEQ ID NO: 597440 - DNA, 13 bp, D. melanogaster
caaacaatttcaa

SEQ ID NO: 597441 - DNA, 13 bp, D. melanogaster
caaacaatttccg

SEQ ID NO: 597442 - DNA, 13 bp, D. melanogaster
caaacaatttgaa

SEQ ID NO: 597443 - DNA, 14 bp, D. melanogaster
caaacaatttgaaa

SEQ ID NO: 597444 - DNA, 13 bp, D. melanogaster
caaacaatttggc

SEQ ID NO: 597445 - DNA, 13 bp, D. melanogaster
caaacaattttat

SEQ ID NO: 597446 - DNA, 13 bp, D. melanogaster
caaacaattttga

SEQ ID NO: 597447 - DNA, 13 bp, D. melanogaster
caaacacaaatcg

SEQ ID NO: 597448 - DNA, 13 bp, D. melanogaster
caaacacaattca

SEQ ID NO: 597449 - DNA, 16 bp, D. melanogaster
caaacacaattcactt

SEQ ID NO: 597450 - DNA, 13 bp, D. melanogaster
caaacacaattta

SEQ ID NO: 597451 - DNA, 14 bp, D. melanogaster
caaacacacacatg

SEQ ID NO: 597452 - DNA, 13 bp, D. melanogaster
caaacacacatat

SEQ ID NO: 597453 - DNA, 13 bp, D. melanogaster
caaacacacatgc

SEQ ID NO: 597454 - DNA, 13 bp, D. melanogaster
caaacacactcgc

SEQ ID NO: 597455 - DNA, 13 bp, D. melanogaster
caaacacactgac

SEQ ID NO: 597456 - DNA, 13 bp, D. melanogaster
caaacacactttt

SEQ ID NO: 597457 - DNA, 13 bp, D. melanogaster
caaacacaggcac

SEQ ID NO: 597458 - DNA, 13 bp, D. melanogaster
caaacacatttgt

SEQ ID NO: 597459 - DNA, 13 bp, D. melanogaster
caaacactctgtt

SEQ ID NO: 597460 - DNA, 13 bp, D. melanogaster
caaacactgtccc

SEQ ID NO: 597461 - DNA, 13 bp, D. melanogaster
caaacacttgaaa

SEQ ID NO: 597462 - DNA, 13 bp, D. melanogaster
caaacacttggcc

SEQ ID NO: 597463 - DNA, 13 bp, D. melanogaster
caaacactttcca

SEQ ID NO: 597464 - DNA, 13 bp, D. melanogaster
caaacactttgtt

SEQ ID NO: 597465 - DNA, 13 bp, D. melanogaster
caaacagaaaact

SEQ ID NO: 597466 - DNA, 13 bp, D. melanogaster
caaacagaaaatc

SEQ ID NO: 597467 - DNA, 13 bp, D. melanogaster
caaacagaaaatg

SEQ ID NO: 597468 - DNA, 13 bp, D. melanogaster
caaacagaaaccg

SEQ ID NO: 597469 - DNA, 13 bp, D. melanogaster
caaacagaaactg

SEQ ID NO: 597470 - DNA, 13 bp, D. melanogaster
caaacagaaatat

SEQ ID NO: 597471 - DNA, 13 bp, D. melanogaster
caaacagaaattg

SEQ ID NO: 597472 - DNA, 13 bp, D. melanogaster
caaacagaaattt

SEQ ID NO: 597473 - DNA, 14 bp, D. melanogaster
caaacagaagcaga

SEQ ID NO: 597474 - DNA, 13 bp, D. melanogaster
caaacagaattcc

SEQ ID NO: 597475 - DNA, 14 bp, D. melanogaster
caaacagaattccc

SEQ ID NO: 597476 - DNA, 13 bp, D. melanogaster
caaacagagcaga

SEQ ID NO: 597477 - DNA, 13 bp, D. melanogaster
caaacagatacag

SEQ ID NO: 597478 - DNA, 14 bp, D. melanogaster
caaacagatgtcat

SEQ ID NO: 597479 - DNA, 13 bp, D. melanogaster
caaacagatttaa

SEQ ID NO: 597480 - DNA, 13 bp, D. melanogaster
caaacagcaaaat

SEQ ID NO: 597481 - DNA, 13 bp, D. melanogaster
caaacagcaaacg

SEQ ID NO: 597482 - DNA, 13 bp, D. melanogaster
caaacagcagcaa

SEQ ID NO: 597483 - DNA, 13 bp, D. melanogaster
caaacagcagcca

SEQ ID NO: 597484 - DNA, 13 bp, D. melanogaster
caaacagcagcgg

SEQ ID NO: 597485 - DNA, 13 bp, D. melanogaster
caaacagcggcaa

SEQ ID NO: 597486 - DNA, 13 bp, D. melanogaster
caaacagctgttc

SEQ ID NO: 597487 - DNA, 14 bp, D. melanogaster
caaacagctgtttg

SEQ ID NO: 597488 - DNA, 14 bp, D. melanogaster
caaacagctttgaa

SEQ ID NO: 597489 - DNA, 13 bp, D. melanogaster
caaacagggcgac

SEQ ID NO: 597490 - DNA, 13 bp, D. melanogaster
caaacagtgtgct

SEQ ID NO: 597491 - DNA, 14 bp, D. melanogaster
caaacagttcttca

SEQ ID NO: 597492 - DNA, 13 bp, D. melanogaster
caaacagttgcaa

SEQ ID NO: 597493 - DNA, 13 bp, D. melanogaster
caaacagttttcc

SEQ ID NO: 597494 - DNA, 13 bp, D. melanogaster
caaacagtttttt

SEQ ID NO: 597495 - DNA, 13 bp, D. melanogaster
caaacataaactt

SEQ ID NO: 597496 - DNA, 13 bp, D. melanogaster
caaacataaatgt

SEQ ID NO: 597497 - DNA, 14 bp, D. melanogaster
caaacatacaaatt

SEQ ID NO: 597498 - DNA, 13 bp, D. melanogaster
caaacatacatag

SEQ ID NO: 597499 - DNA, 14 bp, D. melanogaster
caaacatatgtatg

SEQ ID NO: 597500 - DNA, 13 bp, D. melanogaster
caaacatattcat

SEQ ID NO: 597501 - DNA, 13 bp, D. melanogaster
caaacatattgaa

SEQ ID NO: 597502 - DNA, 13 bp, D. melanogaster
caaacatatttac

SEQ ID NO: 597503 - DNA, 13 bp, D. melanogaster
caaacatatttat

SEQ ID NO: 597504 - DNA, 13 bp, D. melanogaster
caaacatatttgc

SEQ ID NO: 597505 - DNA, 13 bp, D. melanogaster
caaacatcaaatt

SEQ ID NO: 597506 - DNA, 13 bp, D. melanogaster
caaacatgaattt

SEQ ID NO: 597507 - DNA, 13 bp, D. melanogaster
caaacatgcaaca

SEQ ID NO: 597508 - DNA, 13 bp, D. melanogaster
caaacatggattt

SEQ ID NO: 597509 - DNA, 13 bp, D. melanogaster
caaacatgggcaa

SEQ ID NO: 597510 - DNA, 13 bp, D. melanogaster
caaacattattaa

SEQ ID NO: 597511 - DNA, 13 bp, D. melanogaster
caaacattatttt

SEQ ID NO: 597512 - DNA, 13 bp, D. melanogaster
caaacattcattt

SEQ ID NO: 597513 - DNA, 13 bp, D. melanogaster
caaacattgtaaa

SEQ ID NO: 597514 - DNA, 13 bp, D. melanogaster
caaacatttaaat

SEQ ID NO: 597515 - DNA, 13 bp, D. melanogaster
caaacatttaatg

SEQ ID NO: 597516 - DNA, 13 bp, D. melanogaster
caaacatttacaa

SEQ ID NO: 597517 - DNA, 13 bp, D. melanogaster
caaacatttactt

SEQ ID NO: 597518 - DNA, 13 bp, D. melanogaster
caaacatttatat

SEQ ID NO: 597519 - DNA, 13 bp, D. melanogaster
caaacatttatca

SEQ ID NO: 597520 - DNA, 13 bp, D. melanogaster
caaacatttattt

SEQ ID NO: 597521 - DNA, 13 bp, D. melanogaster
caaacatttcaaa

SEQ ID NO: 597522 - DNA, 13 bp, D. melanogaster
caaacatttcaca

SEQ ID NO: 597523 - DNA, 13 bp, D. melanogaster
caaacatttcgag

SEQ ID NO: 597524 - DNA, 14 bp, D. melanogaster
caaacatttgcata

SEQ ID NO: 597525 - DNA, 13 bp, D. melanogaster
caaacatttgcca

SEQ ID NO: 597526 - DNA, 13 bp, D. melanogaster
caaacatttgcgc

SEQ ID NO: 597527 - DNA, 14 bp, D. melanogaster
caaacatttgcgca

SEQ ID NO: 597528 - DNA, 13 bp, D. melanogaster
caaacattttaaa

SEQ ID NO: 597529 - DNA, 14 bp, D. melanogaster
caaacattttcaat

SEQ ID NO: 597530 - DNA, 13 bp, D. melanogaster
caaacattttcat

SEQ ID NO: 597531 - DNA, 14 bp, D. melanogaster
caaacattttcatt

SEQ ID NO: 597532 - DNA, 13 bp, D. melanogaster
caaacatttttca

SEQ ID NO: 597533 - DNA, 13 bp, D. melanogaster
caaacatttttct

SEQ ID NO: 597534 - DNA, 13 bp, D. melanogaster
caaacatttttgc

SEQ ID NO: 597535 - DNA, 13 bp, D. melanogaster
caaacatttttgg

SEQ ID NO: 597536 - DNA, 14 bp, D. melanogaster
caaacatttttggt

SEQ ID NO: 597537 - DNA, 13 bp, D. melanogaster
caaaccaaacttt

SEQ ID NO: 597538 - DNA, 13 bp, D. melanogaster
caaaccaaagcga

SEQ ID NO: 597539 - DNA, 13 bp, D. melanogaster
caaaccaaaggca

SEQ ID NO: 597540 - DNA, 13 bp, D. melanogaster
caaaccaaatcga

SEQ ID NO: 597541 - DNA, 13 bp, D. melanogaster
caaaccaaatttt

SEQ ID NO: 597542 - DNA, 13 bp, D. melanogaster
caaaccaagcgag

SEQ ID NO: 597543 - DNA, 13 bp, D. melanogaster
caaaccaagtgaa

SEQ ID NO: 597544 - DNA, 13 bp, D. melanogaster
caaaccaattcaa

SEQ ID NO: 597545 - DNA, 13 bp, D. melanogaster
caaaccactcgca

SEQ ID NO: 597546 - DNA, 13 bp, D. melanogaster
caaaccagattca

SEQ ID NO: 597547 - DNA, 13 bp, D. melanogaster
caaaccaggaaat

SEQ ID NO: 597548 - DNA, 13 bp, D. melanogaster
caaaccagtaaac

SEQ ID NO: 597549 - DNA, 13 bp, D. melanogaster
caaacccaaatcg

SEQ ID NO: 597550 - DNA, 14 bp, D. melanogaster
caaacccaaatcga

SEQ ID NO: 597551 - DNA, 14 bp, D. melanogaster
caaacccaatttgt

SEQ ID NO: 597552 - DNA, 13 bp, D. melanogaster
caaaccccgtttg

SEQ ID NO: 597553 - DNA, 13 bp, D. melanogaster
caaaccgaaacga

SEQ ID NO: 597554 - DNA, 13 bp, D. melanogaster
caaaccgagctga

SEQ ID NO: 597555 - DNA, 13 bp, D. melanogaster
caaacgaaaatgt

SEQ ID NO: 597556 - DNA, 13 bp, D. melanogaster
caaacgaaaattc

SEQ ID NO: 597557 - DNA, 13 bp, D. melanogaster
caaacgaaactaa

SEQ ID NO: 597558 - DNA, 13 bp, D. melanogaster
caaacgaaacttt

SEQ ID NO: 597559 - DNA, 14 bp, D. melanogaster
caaacgaaagactt

SEQ ID NO: 597560 - DNA, 13 bp, D. melanogaster
caaacgaaataat

SEQ ID NO: 597561 - DNA, 16 bp, D. melanogaster
caaacgaaataattta

SEQ ID NO: 597562 - DNA, 13 bp, D. melanogaster
caaacgaaatcaa

SEQ ID NO: 597563 - DNA, 14 bp, D. melanogaster
caaacgaaatcaaa

SEQ ID NO: 597564 - DNA, 13 bp, D. melanogaster
caaacgaaatgga

SEQ ID NO: 597565 - DNA, 13 bp, D. melanogaster
caaacgaaattat

SEQ ID NO: 597566 - DNA, 13 bp, D. melanogaster
caaacgaaattta

SEQ ID NO: 597567 - DNA, 13 bp, D. melanogaster
caaacgaaccgaa

SEQ ID NO: 597568 - DNA, 13 bp, D. melanogaster
caaacgaacgaac

SEQ ID NO: 597569 - DNA, 13 bp, D. melanogaster
caaacgaatcgaa

SEQ ID NO: 597570 - DNA, 13 bp, D. melanogaster
caaacgagaaaat

SEQ ID NO: 597571 - DNA, 13 bp, D. melanogaster
caaacgatggcca

SEQ ID NO: 597572 - DNA, 15 bp, D. melanogaster
caaacgatgttattg

SEQ ID NO: 597573 - DNA, 13 bp, D. melanogaster
caaacgattccag

SEQ ID NO: 597574 - DNA, 13 bp, D. melanogaster
caaacgatttact

SEQ ID NO: 597575 - DNA, 13 bp, D. melanogaster
caaacgattttgt

SEQ ID NO: 597576 - DNA, 13 bp, D. melanogaster
caaacgcaaaatg

SEQ ID NO: 597577 - DNA, 13 bp, D. melanogaster
caaacgcaaacgc

SEQ ID NO: 597578 - DNA, 14 bp, D. melanogaster
caaacgcaaacgca

SEQ ID NO: 597579 - DNA, 13 bp, D. melanogaster
caaacgcaaataa

SEQ ID NO: 597580 - DNA, 13 bp, D. melanogaster
caaacgcaaattg

SEQ ID NO: 597581 - DNA, 13 bp, D. melanogaster
caaacgcaacgct

SEQ ID NO: 597582 - DNA, 13 bp, D. melanogaster
caaacgcaatttg

SEQ ID NO: 597583 - DNA, 13 bp, D. melanogaster
caaacgcattaaa

SEQ ID NO: 597584 - DNA, 14 bp, D. melanogaster
caaacgcgaaattt

SEQ ID NO: 597585 - DNA, 13 bp, D. melanogaster
caaacgctgatca

SEQ ID NO: 597586 - DNA, 13 bp, D. melanogaster
caaacggaaaagt

SEQ ID NO: 597587 - DNA, 13 bp, D. melanogaster
caaacggaaaatg

SEQ ID NO: 597588 - DNA, 13 bp, D. melanogaster
caaacggaaatca

SEQ ID NO: 597589 - DNA, 13 bp, D. melanogaster
caaacggaaattg

SEQ ID NO: 597590 - DNA, 13 bp, D. melanogaster
caaacggacatgg

SEQ ID NO: 597591 - DNA, 13 bp, D. melanogaster
caaacggatgcct

SEQ ID NO: 597592 - DNA, 13 bp, D. melanogaster
caaacgttaaaaa

SEQ ID NO: 597593 - DNA, 13 bp, D. melanogaster
caaacgttttcgc

SEQ ID NO: 597594 - DNA, 13 bp, D. melanogaster
caaacgttttttt

SEQ ID NO: 597595 - DNA, 14 bp, D. melanogaster
caaacgtttttttt

SEQ ID NO: 597596 - DNA, 13 bp, D. melanogaster
caaactaaacttt

SEQ ID NO: 597597 - DNA, 13 bp, D. melanogaster
caaactaaatatt

SEQ ID NO: 597598 - DNA, 13 bp, D. melanogaster
caaactaaatttc

SEQ ID NO: 597599 - DNA, 13 bp, D. melanogaster
caaactaagtgag

SEQ ID NO: 597600 - DNA, 13 bp, D. melanogaster
caaactaattgaa

SEQ ID NO: 597601 - DNA, 13 bp, D. melanogaster
caaactaatttaa

SEQ ID NO: 597602 - DNA, 13 bp, D. melanogaster
caaactaatttta

SEQ ID NO: 597603 - DNA, 13 bp, D. melanogaster
caaactacaaact

SEQ ID NO: 597604 - DNA, 13 bp, D. melanogaster
caaactataatta

SEQ ID NO: 597605 - DNA, 13 bp, D. melanogaster
caaactatatata

SEQ ID NO: 597606 - DNA, 14 bp, D. melanogaster
caaactatatatat

SEQ ID NO: 597607 - DNA, 13 bp, D. melanogaster
caaactatgtgaa

SEQ ID NO: 597608 - DNA, 13 bp, D. melanogaster
caaactatttaca

SEQ ID NO: 597609 - DNA, 13 bp, D. melanogaster
caaactcaaatta

SEQ ID NO: 597610 - DNA, 13 bp, D. melanogaster
caaactcaattaa

SEQ ID NO: 597611 - DNA, 13 bp, D. melanogaster
caaactcaatttg

SEQ ID NO: 597612 - DNA, 13 bp, D. melanogaster
caaactcacactc

SEQ ID NO: 597613 - DNA, 13 bp, D. melanogaster
caaactcactgaa

SEQ ID NO: 597614 - DNA, 13 bp, D. melanogaster
caaactcgaactc

SEQ ID NO: 597615 - DNA, 13 bp, D. melanogaster
caaactgaaaaac

SEQ ID NO: 597616 - DNA, 13 bp, D. melanogaster
caaactgaaaaat

SEQ ID NO: 597617 - DNA, 13 bp, D. melanogaster
caaactgaaaact

SEQ ID NO: 597618 - DNA, 13 bp, D. melanogaster
caaactgaaactg

SEQ ID NO: 597619 - DNA, 13 bp, D. melanogaster
caaactgaaactt

SEQ ID NO: 597620 - DNA, 13 bp, D. melanogaster
caaactgaacaaa

SEQ ID NO: 597621 - DNA, 13 bp, D. melanogaster
caaactgaaccga

SEQ ID NO: 597622 - DNA, 13 bp, D. melanogaster
caaactgaacgaa

SEQ ID NO: 597623 - DNA, 13 bp, D. melanogaster
caaactgaatgaa

SEQ ID NO: 597624 - DNA, 13 bp, D. melanogaster
caaactgatttat

SEQ ID NO: 597625 - DNA, 14 bp, D. melanogaster
caaactgcaaactg

SEQ ID NO: 597626 - DNA, 13 bp, D. melanogaster
caaactgcaaatg

SEQ ID NO: 597627 - DNA, 13 bp, D. melanogaster
caaactgcaactg

SEQ ID NO: 597628 - DNA, 14 bp, D. melanogaster
caaactgcaactgc

SEQ ID NO: 597629 - DNA, 13 bp, D. melanogaster
caaactgcaattg

SEQ ID NO: 597630 - DNA, 13 bp, D. melanogaster
caaactgcacaaa

SEQ ID NO: 597631 - DNA, 13 bp, D. melanogaster
caaactgcagttt

SEQ ID NO: 597632 - DNA, 13 bp, D. melanogaster
caaactgccaaga

SEQ ID NO: 597633 - DNA, 14 bp, D. melanogaster
caaactgcgggaaa

SEQ ID NO: 597634 - DNA, 13 bp, D. melanogaster
caaactggaactt

SEQ ID NO: 597635 - DNA, 13 bp, D. melanogaster
caaactggataat

SEQ ID NO: 597636 - DNA, 13 bp, D. melanogaster
caaactggccaaa

SEQ ID NO: 597637 - DNA, 13 bp, D. melanogaster
caaactggccaac

SEQ ID NO: 597638 - DNA, 13 bp, D. melanogaster
caaactggccaag

SEQ ID NO: 597639 - DNA, 14 bp, D. melanogaster
caaactggccaagg

SEQ ID NO: 597640 - DNA, 13 bp, D. melanogaster
caaactggctcag

SEQ ID NO: 597641 - DNA, 13 bp, D. melanogaster
caaactgggtaaa

SEQ ID NO: 597642 - DNA, 13 bp, D. melanogaster
caaacttaaactt

SEQ ID NO: 597643 - DNA, 13 bp, D. melanogaster
caaacttaaagta

SEQ ID NO: 597644 - DNA, 13 bp, D. melanogaster
caaacttattaaa

SEQ ID NO: 597645 - DNA, 13 bp, D. melanogaster
caaacttcctcat

SEQ ID NO: 597646 - DNA, 13 bp, D. melanogaster
caaacttctaact

SEQ ID NO: 597647 - DNA, 13 bp, D. melanogaster
caaacttgagcta

SEQ ID NO: 597648 - DNA, 13 bp, D. melanogaster
caaactttaaata

SEQ ID NO: 597649 - DNA, 13 bp, D. melanogaster
caaactttattta

SEQ ID NO: 597650 - DNA, 14 bp, D. melanogaster
caaactttcaaatg

SEQ ID NO: 597651 - DNA, 13 bp, D. melanogaster
caaactttcctca

SEQ ID NO: 597652 - DNA, 13 bp, D. melanogaster
caaactttctgtc

SEQ ID NO: 597653 - DNA, 13 bp, D. melanogaster
caaacttttaaaa

SEQ ID NO: 597654 - DNA, 13 bp, D. melanogaster
caaacttttgcct

SEQ ID NO: 597655 - DNA, 13 bp, D. melanogaster
caaacttttggca

SEQ ID NO: 597656 - DNA, 13 bp, D. melanogaster
caaactttttcaa

SEQ ID NO: 597657 - DNA, 14 bp, D. melanogaster
caaactttttcgtt

SEQ ID NO: 597658 - DNA, 14 bp, D. melanogaster
caaagaaaaatatt

SEQ ID NO: 597659 - DNA, 13 bp, D. melanogaster
caaagaaaaatgt

SEQ ID NO: 597660 - DNA, 13 bp, D. melanogaster
caaagaaaacatt

SEQ ID NO: 597661 - DNA, 13 bp, D. melanogaster
caaagaaaactat

SEQ ID NO: 597662 - DNA, 13 bp, D. melanogaster
caaagaaaactca

SEQ ID NO: 597663 - DNA, 13 bp, D. melanogaster
caaagaaaagcgc

SEQ ID NO: 597664 - DNA, 13 bp, D. melanogaster
caaagaaaagttc

SEQ ID NO: 597665 - DNA, 13 bp, D. melanogaster
caaagaaaagttt

SEQ ID NO: 597666 - DNA, 13 bp, D. melanogaster
caaagaaaatatt

SEQ ID NO: 597667 - DNA, 14 bp, D. melanogaster
caaagaaaatattc

SEQ ID NO: 597668 - DNA, 13 bp, D. melanogaster
caaagaaaatgca

SEQ ID NO: 597669 - DNA, 13 bp, D. melanogaster
caaagaaaatgta

SEQ ID NO: 597670 - DNA, 13 bp, D. melanogaster
caaagaaaattcc

SEQ ID NO: 597671 - DNA, 13 bp, D. melanogaster
caaagaaaattgt

SEQ ID NO: 597672 - DNA, 13 bp, D. melanogaster
caaagaaacaatc

SEQ ID NO: 597673 - DNA, 13 bp, D. melanogaster
caaagaaaccact

SEQ ID NO: 597674 - DNA, 13 bp, D. melanogaster
caaagaaagtatt

SEQ ID NO: 597675 - DNA, 13 bp, D. melanogaster
caaagaaagtggg

SEQ ID NO: 597676 - DNA, 13 bp, D. melanogaster
caaagaaatatgt

SEQ ID NO: 597677 - DNA, 13 bp, D. melanogaster
caaagaaatatta

SEQ ID NO: 597678 - DNA, 13 bp, D. melanogaster
caaagaaatcagt

SEQ ID NO: 597679 - DNA, 13 bp, D. melanogaster
caaagaaatcata

SEQ ID NO: 597680 - DNA, 13 bp, D. melanogaster
caaagaaatctaa

SEQ ID NO: 597681 - DNA, 13 bp, D. melanogaster
caaagaaattgga

SEQ ID NO: 597682 - DNA, 13 bp, D. melanogaster
caaagaaattgtt

SEQ ID NO: 597683 - DNA, 13 bp, D. melanogaster
caaagaaatttgc

SEQ ID NO: 597684 - DNA, 13 bp, D. melanogaster
caaagaacatttt

SEQ ID NO: 597685 - DNA, 13 bp, D. melanogaster
caaagaactgcag

SEQ ID NO: 597686 - DNA, 14 bp, D. melanogaster
caaagaataaagtc

SEQ ID NO: 597687 - DNA, 14 bp, D. melanogaster
caaagaatgatgac

SEQ ID NO: 597688 - DNA, 13 bp, D. melanogaster
caaagaatgcaag

SEQ ID NO: 597689 - DNA, 13 bp, D. melanogaster
caaagaattgaaa

SEQ ID NO: 597690 - DNA, 13 bp, D. melanogaster
caaagaattgaag

SEQ ID NO: 597691 - DNA, 13 bp, D. melanogaster
caaagaatttact

SEQ ID NO: 597692 - DNA, 13 bp, D. melanogaster
caaagaatttgtt

SEQ ID NO: 597693 - DNA, 13 bp, D. melanogaster
caaagaattttgc

SEQ ID NO: 597694 - DNA, 14 bp, D. melanogaster
caaagaattttgca

SEQ ID NO: 597695 - DNA, 13 bp, D. melanogaster
caaagaattttta

SEQ ID NO: 597696 - DNA, 13 bp, D. melanogaster
caaagacaaagtt

SEQ ID NO: 597697 - DNA, 13 bp, D. melanogaster
caaagacaataga

SEQ ID NO: 597698 - DNA, 13 bp, D. melanogaster
caaagacaatggc

SEQ ID NO: 597699 - DNA, 14 bp, D. melanogaster
caaagacaatggca

SEQ ID NO: 597700 - DNA, 15 bp, D. melanogaster
caaagacactagaat

SEQ ID NO: 597701 - DNA, 13 bp, D. melanogaster
caaagacagacac

SEQ ID NO: 597702 - DNA, 15 bp, D. melanogaster
caaagacatccagtt

SEQ ID NO: 597703 - DNA, 14 bp, D. melanogaster
caaagacattagaa

SEQ ID NO: 597704 - DNA, 13 bp, D. melanogaster
caaagactaaaag

SEQ ID NO: 597705 - DNA, 13 bp, D. melanogaster
caaagactacgaa

SEQ ID NO: 597706 - DNA, 14 bp, D. melanogaster
caaagactacgaac

SEQ ID NO: 597707 - DNA, 13 bp, D. melanogaster
caaagactccaat

SEQ ID NO: 597708 - DNA, 13 bp, D. melanogaster
caaagagaaaatg

SEQ ID NO: 597709 - DNA, 13 bp, D. melanogaster
caaagagaaatat

SEQ ID NO: 597710 - DNA, 13 bp, D. melanogaster
caaagagcaaaat

SEQ ID NO: 597711 - DNA, 13 bp, D. melanogaster
caaagagcacaat

SEQ ID NO: 597712 - DNA, 13 bp, D. melanogaster
caaagagcacaca

SEQ ID NO: 597713 - DNA, 13 bp, D. melanogaster
caaagagctgaaa

SEQ ID NO: 597714 - DNA, 13 bp, D. melanogaster
caaagaggcaaag

SEQ ID NO: 597715 - DNA, 13 bp, D. melanogaster
caaagaggcaatt

SEQ ID NO: 597716 - DNA, 13 bp, D. melanogaster
caaagaggtaata

SEQ ID NO: 597717 - DNA, 13 bp, D. melanogaster
caaagagtgaaaa

SEQ ID NO: 597718 - DNA, 13 bp, D. melanogaster
caaagatacattt

SEQ ID NO: 597719 - DNA, 13 bp, D. melanogaster
caaagatactttt

SEQ ID NO: 597720 - DNA, 13 bp, D. melanogaster
caaagatagatac

SEQ ID NO: 597721 - DNA, 13 bp, D. melanogaster
caaagatatttat

SEQ ID NO: 597722 - DNA, 13 bp, D. melanogaster
caaagatgccaaa

SEQ ID NO: 597723 - DNA, 13 bp, D. melanogaster
caaagatttgtta

SEQ ID NO: 597724 - DNA, 13 bp, D. melanogaster
caaagatttttaa

SEQ ID NO: 597725 - DNA, 13 bp, D. melanogaster
caaagcaaaacta

SEQ ID NO: 597726 - DNA, 13 bp, D. melanogaster
caaagcaaaatat

SEQ ID NO: 597727 - DNA, 13 bp, D. melanogaster
caaagcaaaatgc

SEQ ID NO: 597728 - DNA, 13 bp, D. melanogaster
caaagcaaacaat

SEQ ID NO: 597729 - DNA, 13 bp, D. melanogaster
caaagcaaacagc

SEQ ID NO: 597730 - DNA, 13 bp, D. melanogaster
caaagcaaacatt

SEQ ID NO: 597731 - DNA, 13 bp, D. melanogaster
caaagcaaactca

SEQ ID NO: 597732 - DNA, 13 bp, D. melanogaster
caaagcaaagcga

SEQ ID NO: 597733 - DNA, 13 bp, D. melanogaster
caaagcaaagcta

SEQ ID NO: 597734 - DNA, 13 bp, D. melanogaster
caaagcaaatata

SEQ ID NO: 597735 - DNA, 13 bp, D. melanogaster
caaagcaaatatg

SEQ ID NO: 597736 - DNA, 13 bp, D. melanogaster
caaagcaaatcaa

SEQ ID NO: 597737 - DNA, 14 bp, D. melanogaster
caaagcaaatcaaa

SEQ ID NO: 597738 - DNA, 13 bp, D. melanogaster
caaagcaaatgaa

SEQ ID NO: 597739 - DNA, 13 bp, D. melanogaster
caaagcaacagca

SEQ ID NO: 597740 - DNA, 13 bp, D. melanogaster
caaagcaacgagt

SEQ ID NO: 597741 - DNA, 13 bp, D. melanogaster
caaagcaatcaaa

SEQ ID NO: 597742 - DNA, 13 bp, D. melanogaster
caaagcaatgaaa

SEQ ID NO: 597743 - DNA, 14 bp, D. melanogaster
caaagcaattaaaa

SEQ ID NO: 597744 - DNA, 13 bp, D. melanogaster
caaagcaatttaa

SEQ ID NO: 597745 - DNA, 13 bp, D. melanogaster
caaagcaatttgc

SEQ ID NO: 597746 - DNA, 13 bp, D. melanogaster
caaagcaccaaag

SEQ ID NO: 597747 - DNA, 13 bp, D. melanogaster
caaagcagagaat

SEQ ID NO: 597748 - DNA, 13 bp, D. melanogaster
caaagcagcaaag

SEQ ID NO: 597749 - DNA, 13 bp, D. melanogaster
caaagcagcaaca

SEQ ID NO: 597750 - DNA, 13 bp, D. melanogaster
caaagcagccaaa

SEQ ID NO: 597751 - DNA, 13 bp, D. melanogaster
caaagcataaata

SEQ ID NO: 597752 - DNA, 13 bp, D. melanogaster
caaagcatatttt

SEQ ID NO: 597753 - DNA, 13 bp, D. melanogaster
caaagcattatgt

SEQ ID NO: 597754 - DNA, 13 bp, D. melanogaster
caaagcatttaaa

SEQ ID NO: 597755 - DNA, 13 bp, D. melanogaster
caaagcatttcaa

SEQ ID NO: 597756 - DNA, 13 bp, D. melanogaster
caaagcatttttg

SEQ ID NO: 597757 - DNA, 13 bp, D. melanogaster
caaagccaaaagc

SEQ ID NO: 597758 - DNA, 13 bp, D. melanogaster
caaagccaaagca

SEQ ID NO: 597759 - DNA, 13 bp, D. melanogaster
caaagccaaagga

SEQ ID NO: 597760 - DNA, 13 bp, D. melanogaster
caaagccaaaggc

SEQ ID NO: 597761 - DNA, 14 bp, D. melanogaster
caaagccaaaggca

SEQ ID NO: 597762 - DNA, 13 bp, D. melanogaster
caaagccaaagtc

SEQ ID NO: 597763 - DNA, 14 bp, D. melanogaster
caaagccaaataaa

SEQ ID NO: 597764 - DNA, 13 bp, D. melanogaster
caaagccaaatcc

SEQ ID NO: 597765 - DNA, 14 bp, D. melanogaster
caaagccaaatcca

SEQ ID NO: 597766 - DNA, 13 bp, D. melanogaster
caaagccaaatgg

SEQ ID NO: 597767 - DNA, 13 bp, D. melanogaster
caaagccaaattg

SEQ ID NO: 597768 - DNA, 14 bp, D. melanogaster
caaagccaagccaa

SEQ ID NO: 597769 - DNA, 13 bp, D. melanogaster
caaagccaaggca

SEQ ID NO: 597770 - DNA, 13 bp, D. melanogaster
caaagccagacaa

SEQ ID NO: 597771 - DNA, 13 bp, D. melanogaster
caaagccagccaa

SEQ ID NO: 597772 - DNA, 14 bp, D. melanogaster
caaagccagcggaa

SEQ ID NO: 597773 - DNA, 13 bp, D. melanogaster
caaagccagctgg

SEQ ID NO: 597774 - DNA, 13 bp, D. melanogaster
caaagccaggaaa

SEQ ID NO: 597775 - DNA, 13 bp, D. melanogaster
caaagccccaaag

SEQ ID NO: 597776 - DNA, 13 bp, D. melanogaster
caaagccgcaaaa

SEQ ID NO: 597777 - DNA, 13 bp, D. melanogaster
caaagcctcgtta

SEQ ID NO: 597778 - DNA, 13 bp, D. melanogaster
caaagcgaaatca

SEQ ID NO: 597779 - DNA, 13 bp, D. melanogaster
caaagcgaagagg

SEQ ID NO: 597780 - DNA, 13 bp, D. melanogaster
caaagcgaatcga

SEQ ID NO: 597781 - DNA, 13 bp, D. melanogaster
caaagcgattccc

SEQ ID NO: 597782 - DNA, 14 bp, D. melanogaster
caaagcgattccca

SEQ ID NO: 597783 - DNA, 13 bp, D. melanogaster
caaagcggaaatt

SEQ ID NO: 597784 - DNA, 13 bp, D. melanogaster
caaagctaaagcc

SEQ ID NO: 597785 - DNA, 13 bp, D. melanogaster
caaagctaaagct

SEQ ID NO: 597786 - DNA, 13 bp, D. melanogaster
caaagctaaataa

SEQ ID NO: 597787 - DNA, 13 bp, D. melanogaster
caaagctgccaaa

SEQ ID NO: 597788 - DNA, 13 bp, D. melanogaster
caaaggaaaaact

SEQ ID NO: 597789 - DNA, 13 bp, D. melanogaster
caaaggaaaactt

SEQ ID NO: 597790 - DNA, 13 bp, D. melanogaster
caaaggaaaatta

SEQ ID NO: 597791 - DNA, 13 bp, D. melanogaster
caaaggaaaattg

SEQ ID NO: 597792 - DNA, 13 bp, D. melanogaster
caaaggaaaccca

SEQ ID NO: 597793 - DNA, 13 bp, D. melanogaster
caaaggaaatgaa

SEQ ID NO: 597794 - DNA, 13 bp, D. melanogaster
caaaggaaatgcc

SEQ ID NO: 597795 - DNA, 13 bp, D. melanogaster
caaaggaaattaa

SEQ ID NO: 597796 - DNA, 13 bp, D. melanogaster
caaaggaaattat

SEQ ID NO: 597797 - DNA, 13 bp, D. melanogaster
caaaggaacactg

SEQ ID NO: 597798 - DNA, 14 bp, D. melanogaster
caaaggaacactgg

SEQ ID NO: 597799 - DNA, 13 bp, D. melanogaster
caaaggaagttgg

SEQ ID NO: 597800 - DNA, 13 bp, D. melanogaster
caaaggacacaca

SEQ ID NO: 597801 - DNA, 13 bp, D. melanogaster
caaaggacgaagg

SEQ ID NO: 597802 - DNA, 13 bp, D. melanogaster
caaaggagcagcc

SEQ ID NO: 597803 - DNA, 13 bp, D. melanogaster
caaaggagcagga

SEQ ID NO: 597804 - DNA, 13 bp, D. melanogaster
caaaggagcctct

SEQ ID NO: 597805 - DNA, 13 bp, D. melanogaster
caaaggaggatat

SEQ ID NO: 597806 - DNA, 13 bp, D. melanogaster
caaaggaggatgg

SEQ ID NO: 597807 - DNA, 13 bp, D. melanogaster
caaaggatcgtta

SEQ ID NO: 597808 - DNA, 13 bp, D. melanogaster
caaaggcaaagca

SEQ ID NO: 597809 - DNA, 14 bp, D. melanogaster
caaaggcaaagcca

SEQ ID NO: 597810 - DNA, 13 bp, D. melanogaster
caaaggcaaatgt

SEQ ID NO: 597811 - DNA, 13 bp, D. melanogaster
caaaggcaacaat

SEQ ID NO: 597812 - DNA, 13 bp, D. melanogaster
caaaggcaacaca

SEQ ID NO: 597813 - DNA, 13 bp, D. melanogaster
caaaggcaactaa

SEQ ID NO: 597814 - DNA, 13 bp, D. melanogaster
caaaggcacacac

SEQ ID NO: 597815 - DNA, 14 bp, D. melanogaster
caaaggcacacaca

SEQ ID NO: 597816 - DNA, 13 bp, D. melanogaster
caaaggcagcaac

SEQ ID NO: 597817 - DNA, 14 bp, D. melanogaster
caaaggcagcagca

SEQ ID NO: 597818 - DNA, 13 bp, D. melanogaster
caaaggcagccag

SEQ ID NO: 597819 - DNA, 13 bp, D. melanogaster
caaaggcagcgaa

SEQ ID NO: 597820 - DNA, 13 bp, D. melanogaster
caaaggcagctgc

SEQ ID NO: 597821 - DNA, 13 bp, D. melanogaster
caaaggcattcga

SEQ ID NO: 597822 - DNA, 13 bp, D. melanogaster
caaaggccaaaac

SEQ ID NO: 597823 - DNA, 13 bp, D. melanogaster
caaaggccaaaag

SEQ ID NO: 597824 - DNA, 13 bp, D. melanogaster
caaaggcggcaaa

SEQ ID NO: 597825 - DNA, 13 bp, D. melanogaster
caaaggcggtggc

SEQ ID NO: 597826 - DNA, 13 bp, D. melanogaster
caaagggatttca

SEQ ID NO: 597827 - DNA, 13 bp, D. melanogaster
caaagggcaaagg

SEQ ID NO: 597828 - DNA, 13 bp, D. melanogaster
caaagggttaagg

SEQ ID NO: 597829 - DNA, 13 bp, D. melanogaster
caaaggtaaacaa

SEQ ID NO: 597830 - DNA, 13 bp, D. melanogaster
caaaggtgctgca

SEQ ID NO: 597831 - DNA, 13 bp, D. melanogaster
caaaggtggtgaa

SEQ ID NO: 597832 - DNA, 13 bp, D. melanogaster
caaaggttatcaa

SEQ ID NO: 597833 - DNA, 13 bp, D. melanogaster
caaagtaaaaagt

SEQ ID NO: 597834 - DNA, 13 bp, D. melanogaster
caaagtaaaagtt

SEQ ID NO: 597835 - DNA, 13 bp, D. melanogaster
caaagtaaacttt

SEQ ID NO: 597836 - DNA, 14 bp, D. melanogaster
caaagtaaataaat

SEQ ID NO: 597837 - DNA, 14 bp, D. melanogaster
caaagtaaatgaaa

SEQ ID NO: 597838 - DNA, 13 bp, D. melanogaster
caaagtaattgaa

SEQ ID NO: 597839 - DNA, 13 bp, D. melanogaster
caaagtaatttta

SEQ ID NO: 597840 - DNA, 14 bp, D. melanogaster
caaagtaggaaaac

SEQ ID NO: 597841 - DNA, 13 bp, D. melanogaster
caaagtatttaaa

SEQ ID NO: 597842 - DNA, 13 bp, D. melanogaster
caaagtatttaca

SEQ ID NO: 597843 - DNA, 13 bp, D. melanogaster
caaagtatttggc

SEQ ID NO: 597844 - DNA, 13 bp, D. melanogaster
caaagtattttat

SEQ ID NO: 597845 - DNA, 14 bp, D. melanogaster
caaagtatttttca

SEQ ID NO: 597846 - DNA, 13 bp, D. melanogaster
caaagtcaaaagc

SEQ ID NO: 597847 - DNA, 13 bp, D. melanogaster
caaagtcaaacaa

SEQ ID NO: 597848 - DNA, 14 bp, D. melanogaster
caaagtcaaacaaa

SEQ ID NO: 597849 - DNA, 13 bp, D. melanogaster
caaagtcaaagtc

SEQ ID NO: 597850 - DNA, 14 bp, D. melanogaster
caaagtcaaagtcg

SEQ ID NO: 597851 - DNA, 13 bp, D. melanogaster
caaagtcaaatgc

SEQ ID NO: 597852 - DNA, 13 bp, D. melanogaster
caaagtcaacaaa

SEQ ID NO: 597853 - DNA, 13 bp, D. melanogaster
caaagtcaatttc

SEQ ID NO: 597854 - DNA, 13 bp, D. melanogaster
caaagtcggaaaa

SEQ ID NO: 597855 - DNA, 13 bp, D. melanogaster
caaagtcttctaa

SEQ ID NO: 597856 - DNA, 13 bp, D. melanogaster
caaagtgaaaaca

SEQ ID NO: 597857 - DNA, 13 bp, D. melanogaster
caaagtgaaaatt

SEQ ID NO: 597858 - DNA, 13 bp, D. melanogaster
caaagtgaaacaa

SEQ ID NO: 597859 - DNA, 13 bp, D. melanogaster
caaagtgaaatgc

SEQ ID NO: 597860 - DNA, 14 bp, D. melanogaster
caaagtgaaatgca

SEQ ID NO: 597861 - DNA, 13 bp, D. melanogaster
caaagtgaaatta

SEQ ID NO: 597862 - DNA, 13 bp, D. melanogaster
caaagtgaaccaa

SEQ ID NO: 597863 - DNA, 14 bp, D. melanogaster
caaagtgaaccaat

SEQ ID NO: 597864 - DNA, 13 bp, D. melanogaster
caaagtgaagtaa

SEQ ID NO: 597865 - DNA, 14 bp, D. melanogaster
caaagtgaagtaac

SEQ ID NO: 597866 - DNA, 13 bp, D. melanogaster
caaagtgattttt

SEQ ID NO: 597867 - DNA, 13 bp, D. melanogaster
caaagtgcaaaaa

SEQ ID NO: 597868 - DNA, 13 bp, D. melanogaster
caaagtgcaaaag

SEQ ID NO: 597869 - DNA, 13 bp, D. melanogaster
caaagtgcaaata

SEQ ID NO: 597870 - DNA, 13 bp, D. melanogaster
caaagtgcaaatt

SEQ ID NO: 597871 - DNA, 13 bp, D. melanogaster
caaagtgcaacaa

SEQ ID NO: 597872 - DNA, 13 bp, D. melanogaster
caaagtgcaataa

SEQ ID NO: 597873 - DNA, 13 bp, D. melanogaster
caaagtgcaatgc

SEQ ID NO: 597874 - DNA, 13 bp, D. melanogaster
caaagtgcagtgc

SEQ ID NO: 597875 - DNA, 13 bp, D. melanogaster
caaagtgcagttg

SEQ ID NO: 597876 - DNA, 13 bp, D. melanogaster
caaagtgctgcca

SEQ ID NO: 597877 - DNA, 13 bp, D. melanogaster
caaagtggaaaag

SEQ ID NO: 597878 - DNA, 13 bp, D. melanogaster
caaagtggacaaa

SEQ ID NO: 597879 - DNA, 13 bp, D. melanogaster
caaagtggagcag

SEQ ID NO: 597880 - DNA, 13 bp, D. melanogaster
caaagtggcaaag

SEQ ID NO: 597881 - DNA, 13 bp, D. melanogaster
caaagtggcagcc

SEQ ID NO: 597882 - DNA, 13 bp, D. melanogaster
caaagtggcatac

SEQ ID NO: 597883 - DNA, 13 bp, D. melanogaster
caaagtgggcgga

SEQ ID NO: 597884 - DNA, 13 bp, D. melanogaster
caaagtgggcggc

SEQ ID NO: 597885 - DNA, 13 bp, D. melanogaster
caaagtgtcaaag

SEQ ID NO: 597886 - DNA, 13 bp, D. melanogaster
caaagtgtgctga

SEQ ID NO: 597887 - DNA, 13 bp, D. melanogaster
caaagtgtgggcg

SEQ ID NO: 597888 - DNA, 13 bp, D. melanogaster
caaagtgtgtgtg

SEQ ID NO: 597889 - DNA, 13 bp, D. melanogaster
caaagtgttaaaa

SEQ ID NO: 597890 - DNA, 13 bp, D. melanogaster
caaagtgttaagt

SEQ ID NO: 597891 - DNA, 13 bp, D. melanogaster
caaagtgttgcaa

SEQ ID NO: 597892 - DNA, 13 bp, D. melanogaster
caaagtgtttgcc

SEQ ID NO: 597893 - DNA, 13 bp, D. melanogaster
caaagtgtttggc

SEQ ID NO: 597894 - DNA, 13 bp, D. melanogaster
caaagtgttttgc

SEQ ID NO: 597895 - DNA, 13 bp, D. melanogaster
caaagtgtttttg

SEQ ID NO: 597896 - DNA, 13 bp, D. melanogaster
caaagttaaacaa

SEQ ID NO: 597897 - DNA, 13 bp, D. melanogaster
caaagttaaagtt

SEQ ID NO: 597898 - DNA, 13 bp, D. melanogaster
caaagttaatttt

SEQ ID NO: 597899 - DNA, 13 bp, D. melanogaster
caaagttattaaa

SEQ ID NO: 597900 - DNA, 13 bp, D. melanogaster
caaagttcaaaag

SEQ ID NO: 597901 - DNA, 13 bp, D. melanogaster
caaagttccgcag

SEQ ID NO: 597902 - DNA, 13 bp, D. melanogaster
caaagttgaaaat

SEQ ID NO: 597903 - DNA, 13 bp, D. melanogaster
caaagttgctgcc

SEQ ID NO: 597904 - DNA, 13 bp, D. melanogaster
caaagttggcaac

SEQ ID NO: 597905 - DNA, 13 bp, D. melanogaster
caaagttggccaa

SEQ ID NO: 597906 - DNA, 13 bp, D. melanogaster
caaagttgggcaa

SEQ ID NO: 597907 - DNA, 13 bp, D. melanogaster
caaagttgttggc

SEQ ID NO: 597908 - DNA, 13 bp, D. melanogaster
caaagtttaataa

SEQ ID NO: 597909 - DNA, 13 bp, D. melanogaster
caaagtttcgctg

SEQ ID NO: 597910 - DNA, 13 bp, D. melanogaster
caaagtttctcgc

SEQ ID NO: 597911 - DNA, 13 bp, D. melanogaster
caaagtttgcatt

SEQ ID NO: 597912 - DNA, 13 bp, D. melanogaster
caaagtttgccaa

SEQ ID NO: 597913 - DNA, 13 bp, D. melanogaster
caaagtttgcttt

SEQ ID NO: 597914 - DNA, 13 bp, D. melanogaster
caaagtttggcca

SEQ ID NO: 597915 - DNA, 13 bp, D. melanogaster
caaagtttgtctg

SEQ ID NO: 597916 - DNA, 13 bp, D. melanogaster
caaagttttcaat

SEQ ID NO: 597917 - DNA, 13 bp, D. melanogaster
caaagttttccag

SEQ ID NO: 597918 - DNA, 13 bp, D. melanogaster
caaagttttccca

SEQ ID NO: 597919 - DNA, 13 bp, D. melanogaster
caaagttttgaaa

SEQ ID NO: 597920 - DNA, 13 bp, D. melanogaster
caaagttttgcat

SEQ ID NO: 597921 - DNA, 13 bp, D. melanogaster
caaagttttggca

SEQ ID NO: 597922 - DNA, 13 bp, D. melanogaster
caaagttttggcc

SEQ ID NO: 597923 - DNA, 13 bp, D. melanogaster
caaagttttgttt

SEQ ID NO: 597924 - DNA, 14 bp, D. melanogaster
caaagttttgtttt

SEQ ID NO: 597925 - DNA, 13 bp, D. melanogaster
caaagtttttaat

SEQ ID NO: 597926 - DNA, 13 bp, D. melanogaster
caaagtttttcaa

SEQ ID NO: 597927 - DNA, 13 bp, D. melanogaster
caaagtttttcca

SEQ ID NO: 597928 - DNA, 13 bp, D. melanogaster
caaagtttttgaa

SEQ ID NO: 597929 - DNA, 13 bp, D. melanogaster
caaagtttttggc

SEQ ID NO: 597930 - DNA, 14 bp, D. melanogaster
caaagttttttttt

SEQ ID NO: 597931 - DNA, 14 bp, D. melanogaster
caaataaaaagttt

SEQ ID NO: 597932 - DNA, 13 bp, D. melanogaster
caaataaaaatgc

SEQ ID NO: 597933 - DNA, 13 bp, D. melanogaster
caaataaaaatgg

SEQ ID NO: 597934 - DNA, 13 bp, D. melanogaster
caaataaaaatgt

SEQ ID NO: 597935 - DNA, 13 bp, D. melanogaster
caaataaaaattg

SEQ ID NO: 597936 - DNA, 13 bp, D. melanogaster
caaataaaacagc

SEQ ID NO: 597937 - DNA, 13 bp, D. melanogaster
caaataaaacgat

SEQ ID NO: 597938 - DNA, 14 bp, D. melanogaster
caaataaaacgatt

SEQ ID NO: 597939 - DNA, 13 bp, D. melanogaster
caaataaaacgca

SEQ ID NO: 597940 - DNA, 13 bp, D. melanogaster
caaataaaactga

SEQ ID NO: 597941 - DNA, 13 bp, D. melanogaster
caaataaaacttt

SEQ ID NO: 597942 - DNA, 13 bp, D. melanogaster
caaataaaaggca

SEQ ID NO: 597943 - DNA, 13 bp, D. melanogaster
caaataaaagtat

SEQ ID NO: 597944 - DNA, 14 bp, D. melanogaster
caaataaaatagtt

SEQ ID NO: 597945 - DNA, 13 bp, D. melanogaster
caaataaaatatg

SEQ ID NO: 597946 - DNA, 13 bp, D. melanogaster
caaataaaatcag

SEQ ID NO: 597947 - DNA, 14 bp, D. melanogaster
caaataaaatgcaa

SEQ ID NO: 597948 - DNA, 13 bp, D. melanogaster
caaataaaatggc

SEQ ID NO: 597949 - DNA, 13 bp, D. melanogaster
caaataaaatgta

SEQ ID NO: 597950 - DNA, 13 bp, D. melanogaster
caaataaaatgtc

SEQ ID NO: 597951 - DNA, 13 bp, D. melanogaster
caaataaaattga

SEQ ID NO: 597952 - DNA, 13 bp, D. melanogaster
caaataaaattgg

SEQ ID NO: 597953 - DNA, 13 bp, D. melanogaster
caaataaacaatg

SEQ ID NO: 597954 - DNA, 13 bp, D. melanogaster
caaataaacttta

SEQ ID NO: 597955 - DNA, 14 bp, D. melanogaster
caaataaagcaaat

SEQ ID NO: 597956 - DNA, 13 bp, D. melanogaster
caaataaagcaat

SEQ ID NO: 597957 - DNA, 13 bp, D. melanogaster
caaataaagtata

SEQ ID NO: 597958 - DNA, 13 bp, D. melanogaster
caaataaagttgg

SEQ ID NO: 597959 - DNA, 13 bp, D. melanogaster
caaataaataatg

SEQ ID NO: 597960 - DNA, 13 bp, D. melanogaster
caaataaatacag

SEQ ID NO: 597961 - DNA, 14 bp, D. melanogaster
caaataaatacagt

SEQ ID NO: 597962 - DNA, 13 bp, D. melanogaster
caaataaatcagc

SEQ ID NO: 597963 - DNA, 13 bp, D. melanogaster
caaataaatcatt

SEQ ID NO: 597964 - DNA, 13 bp, D. melanogaster
caaataaatcgaa

SEQ ID NO: 597965 - DNA, 13 bp, D. melanogaster
caaataaatcgca

SEQ ID NO: 597966 - DNA, 13 bp, D. melanogaster
caaataaatcgtt

SEQ ID NO: 597967 - DNA, 13 bp, D. melanogaster
caaataaatgcaa

SEQ ID NO: 597968 - DNA, 13 bp, D. melanogaster
caaataaatgcga

SEQ ID NO: 597969 - DNA, 14 bp, D. melanogaster
caaataaatggcaa

SEQ ID NO: 597970 - DNA, 13 bp, D. melanogaster
caaataaatgtgt

SEQ ID NO: 597971 - DNA, 13 bp, D. melanogaster
caaataaattagt

SEQ ID NO: 597972 - DNA, 13 bp, D. melanogaster
caaataaattcat

SEQ ID NO: 597973 - DNA, 13 bp, D. melanogaster
caaataaattgca

SEQ ID NO: 597974 - DNA, 13 bp, D. melanogaster
caaataacaaatg

SEQ ID NO: 597975 - DNA, 14 bp, D. melanogaster
caaataacactttt

SEQ ID NO: 597976 - DNA, 13 bp, D. melanogaster
caaataacttgca

SEQ ID NO: 597977 - DNA, 13 bp, D. melanogaster
caaataactttta

SEQ ID NO: 597978 - DNA, 13 bp, D. melanogaster
caaataacttttt

SEQ ID NO: 597979 - DNA, 13 bp, D. melanogaster
caaataagcaaac

SEQ ID NO: 597980 - DNA, 13 bp, D. melanogaster
caaataagttttt

SEQ ID NO: 597981 - DNA, 13 bp, D. melanogaster
caaataataatga

SEQ ID NO: 597982 - DNA, 13 bp, D. melanogaster
caaataatacttt

SEQ ID NO: 597983 - DNA, 13 bp, D. melanogaster
caaataatagcaa

SEQ ID NO: 597984 - DNA, 13 bp, D. melanogaster
caaataatcagtt

SEQ ID NO: 597985 - DNA, 13 bp, D. melanogaster
caaataatcttta

SEQ ID NO: 597986 - DNA, 13 bp, D. melanogaster
caaataattacat

SEQ ID NO: 597987 - DNA, 13 bp, D. melanogaster
caaataattagtt

SEQ ID NO: 597988 - DNA, 13 bp, D. melanogaster
caaataattccaa

SEQ ID NO: 597989 - DNA, 13 bp, D. melanogaster
caaataattgaat

SEQ ID NO: 597990 - DNA, 13 bp, D. melanogaster
caaataattgtta

SEQ ID NO: 597991 - DNA, 13 bp, D. melanogaster
caaataattttca

SEQ ID NO: 597992 - DNA, 13 bp, D. melanogaster
caaataattttga

SEQ ID NO: 597993 - DNA, 13 bp, D. melanogaster
caaatacaaaacg

SEQ ID NO: 597994 - DNA, 13 bp, D. melanogaster
caaatacaaaatg

SEQ ID NO: 597995 - DNA, 13 bp, D. melanogaster
caaatacaaatgc

SEQ ID NO: 597996 - DNA, 13 bp, D. melanogaster
caaatacaaatgg

SEQ ID NO: 597997 - DNA, 14 bp, D. melanogaster
caaatacaaatgga

SEQ ID NO: 597998 - DNA, 14 bp, D. melanogaster
caaatacaaatttt

SEQ ID NO: 597999 - DNA, 13 bp, D. melanogaster
caaatacaagata

SEQ ID NO: 598000 - DNA, 13 bp, D. melanogaster
caaatacaatcgc

SEQ ID NO: 598001 - DNA, 13 bp, D. melanogaster
caaatacaatttt

SEQ ID NO: 598002 - DNA, 14 bp, D. melanogaster
caaatacaattttc

SEQ ID NO: 598003 - DNA, 14 bp, D. melanogaster
caaatacagataca

SEQ ID NO: 598004 - DNA, 13 bp, D. melanogaster
caaatacatattt

SEQ ID NO: 598005 - DNA, 13 bp, D. melanogaster
caaatacatttat

SEQ ID NO: 598006 - DNA, 13 bp, D. melanogaster
caaatacattttt

SEQ ID NO: 598007 - DNA, 13 bp, D. melanogaster
caaataccaacag

SEQ ID NO: 598008 - DNA, 13 bp, D. melanogaster
caaataccctgta

SEQ ID NO: 598009 - DNA, 13 bp, D. melanogaster
caaataccgaaaa

SEQ ID NO: 598010 - DNA, 13 bp, D. melanogaster
caaataccgcgca

SEQ ID NO: 598011 - DNA, 13 bp, D. melanogaster
caaatacgagtat

SEQ ID NO: 598012 - DNA, 13 bp, D. melanogaster
caaatacgtcact

SEQ ID NO: 598013 - DNA, 13 bp, D. melanogaster
caaatactatata

SEQ ID NO: 598014 - DNA, 14 bp, D. melanogaster
caaatactgaggct

SEQ ID NO: 598015 - DNA, 13 bp, D. melanogaster
caaatacttattt

SEQ ID NO: 598016 - DNA, 13 bp, D. melanogaster
caaatacttcaaa

SEQ ID NO: 598017 - DNA, 13 bp, D. melanogaster
caaatacttcaat

SEQ ID NO: 598018 - DNA, 13 bp, D. melanogaster
caaatactttaat

SEQ ID NO: 598019 - DNA, 13 bp, D. melanogaster
caaatagaaaagc

SEQ ID NO: 598020 - DNA, 13 bp, D. melanogaster
caaatagaaattc

SEQ ID NO: 598021 - DNA, 14 bp, D. melanogaster
caaatagaacttga

SEQ ID NO: 598022 - DNA, 13 bp, D. melanogaster
caaatagaatgaa

SEQ ID NO: 598023 - DNA, 13 bp, D. melanogaster
caaatagagaagt

SEQ ID NO: 598024 - DNA, 13 bp, D. melanogaster
caaatagagcaga

SEQ ID NO: 598025 - DNA, 13 bp, D. melanogaster
caaatagcaaaca

SEQ ID NO: 598026 - DNA, 13 bp, D. melanogaster
caaatagcaaata

SEQ ID NO: 598027 - DNA, 13 bp, D. melanogaster
caaatagcaacaa

SEQ ID NO: 598028 - DNA, 13 bp, D. melanogaster
caaatagccaaac

SEQ ID NO: 598029 - DNA, 13 bp, D. melanogaster
caaataggagctg

SEQ ID NO: 598030 - DNA, 14 bp, D. melanogaster
caaatagtacataa

SEQ ID NO: 598031 - DNA, 13 bp, D. melanogaster
caaatagtgaaca

SEQ ID NO: 598032 - DNA, 13 bp, D. melanogaster
caaatagttcata

SEQ ID NO: 598033 - DNA, 14 bp, D. melanogaster
caaatagttcataa

SEQ ID NO: 598034 - DNA, 13 bp, D. melanogaster
caaatagtttatt

SEQ ID NO: 598035 - DNA, 13 bp, D. melanogaster
caaatagttttat

SEQ ID NO: 598036 - DNA, 13 bp, D. melanogaster
caaatataaagta

SEQ ID NO: 598037 - DNA, 13 bp, D. melanogaster
caaatatacacac

SEQ ID NO: 598038 - DNA, 13 bp, D. melanogaster
caaatatacatat

SEQ ID NO: 598039 - DNA, 13 bp, D. melanogaster
caaatatagcaaa

SEQ ID NO: 598040 - DNA, 14 bp, D. melanogaster
caaatatagccttt

SEQ ID NO: 598041 - DNA, 13 bp, D. melanogaster
caaatatatatct

SEQ ID NO: 598042 - DNA, 14 bp, D. melanogaster
caaatatatctata

SEQ ID NO: 598043 - DNA, 13 bp, D. melanogaster
caaatatatgcat

SEQ ID NO: 598044 - DNA, 14 bp, D. melanogaster
caaatatattttgt

SEQ ID NO: 598045 - DNA, 13 bp, D. melanogaster
caaatatccgaac

SEQ ID NO: 598046 - DNA, 13 bp, D. melanogaster
caaatatcgaaaa

SEQ ID NO: 598047 - DNA, 13 bp, D. melanogaster
caaatatcgaatg

SEQ ID NO: 598048 - DNA, 13 bp, D. melanogaster
caaatatctaaga

SEQ ID NO: 598049 - DNA, 13 bp, D. melanogaster
caaatatcttaaa

SEQ ID NO: 598050 - DNA, 13 bp, D. melanogaster
caaatatgaaaat

SEQ ID NO: 598051 - DNA, 13 bp, D. melanogaster
caaatatgaaata

SEQ ID NO: 598052 - DNA, 13 bp, D. melanogaster
caaatatgaagtt

SEQ ID NO: 598053 - DNA, 13 bp, D. melanogaster
caaatatgataaa

SEQ ID NO: 598054 - DNA, 13 bp, D. melanogaster
caaatatgccaaa

SEQ ID NO: 598055 - DNA, 14 bp, D. melanogaster
caaatatgccaaaa

SEQ ID NO: 598056 - DNA, 13 bp, D. melanogaster
caaatatggacga

SEQ ID NO: 598057 - DNA, 13 bp, D. melanogaster
caaatatggcaat

SEQ ID NO: 598058 - DNA, 13 bp, D. melanogaster
caaatatggccaa

SEQ ID NO: 598059 - DNA, 14 bp, D. melanogaster
caaatatgtataaa

SEQ ID NO: 598060 - DNA, 13 bp, D. melanogaster
caaatatgtatat

SEQ ID NO: 598061 - DNA, 13 bp, D. melanogaster
caaatatgtatgt

SEQ ID NO: 598062 - DNA, 13 bp, D. melanogaster
caaatatgtgcat

SEQ ID NO: 598063 - DNA, 13 bp, D. melanogaster
caaatatgtttat

SEQ ID NO: 598064 - DNA, 13 bp, D. melanogaster
caaatattaaact

SEQ ID NO: 598065 - DNA, 13 bp, D. melanogaster
caaatattaatga

SEQ ID NO: 598066 - DNA, 13 bp, D. melanogaster
caaatattacagg

SEQ ID NO: 598067 - DNA, 13 bp, D. melanogaster
caaatattacgta

SEQ ID NO: 598068 - DNA, 13 bp, D. melanogaster
caaatattattca

SEQ ID NO: 598069 - DNA, 13 bp, D. melanogaster
caaatattattgt

SEQ ID NO: 598070 - DNA, 13 bp, D. melanogaster
caaatattcaaat

SEQ ID NO: 598071 - DNA, 13 bp, D. melanogaster
caaatattctcag

SEQ ID NO: 598072 - DNA, 13 bp, D. melanogaster
caaatattgaagc

SEQ ID NO: 598073 - DNA, 13 bp, D. melanogaster
caaatattgaatt

SEQ ID NO: 598074 - DNA, 13 bp, D. melanogaster
caaatattgattt

SEQ ID NO: 598075 - DNA, 13 bp, D. melanogaster
caaatattgcaaa

SEQ ID NO: 598076 - DNA, 14 bp, D. melanogaster
caaatattgcataa

SEQ ID NO: 598077 - DNA, 13 bp, D. melanogaster
caaatattgtaat

SEQ ID NO: 598078 - DNA, 13 bp, D. melanogaster
caaatattgttga

SEQ ID NO: 598079 - DNA, 13 bp, D. melanogaster
caaatattgtttt

SEQ ID NO: 598080 - DNA, 14 bp, D. melanogaster
caaatatttacaat

SEQ ID NO: 598081 - DNA, 13 bp, D. melanogaster
caaatatttaccc

SEQ ID NO: 598082 - DNA, 14 bp, D. melanogaster
caaatatttaccca

SEQ ID NO: 598083 - DNA, 13 bp, D. melanogaster
caaatatttacta

SEQ ID NO: 598084 - DNA, 13 bp, D. melanogaster
caaatatttcata

SEQ ID NO: 598085 - DNA, 13 bp, D. melanogaster
caaatatttccat

SEQ ID NO: 598086 - DNA, 14 bp, D. melanogaster
caaatatttccatt

SEQ ID NO: 598087 - DNA, 13 bp, D. melanogaster
caaatatttccct

SEQ ID NO: 598088 - DNA, 13 bp, D. melanogaster
caaatatttctta

SEQ ID NO: 598089 - DNA, 13 bp, D. melanogaster
caaatatttgaaa

SEQ ID NO: 598090 - DNA, 13 bp, D. melanogaster
caaatatttgaat

SEQ ID NO: 598091 - DNA, 13 bp, D. melanogaster
caaatatttgatt

SEQ ID NO: 598092 - DNA, 14 bp, D. melanogaster
caaatatttgcaca

SEQ ID NO: 598093 - DNA, 13 bp, D. melanogaster
caaatatttgcca

SEQ ID NO: 598094 - DNA, 14 bp, D. melanogaster
caaatatttgccat

SEQ ID NO: 598095 - DNA, 13 bp, D. melanogaster
caaatatttggca

SEQ ID NO: 598096 - DNA, 14 bp, D. melanogaster
caaatatttggcat

SEQ ID NO: 598097 - DNA, 14 bp, D. melanogaster
caaatatttggcca

SEQ ID NO: 598098 - DNA, 13 bp, D. melanogaster
caaatatttggct

SEQ ID NO: 598099 - DNA, 14 bp, D. melanogaster
caaatatttgtaat

SEQ ID NO: 598100 - DNA, 14 bp, D. melanogaster
caaatatttgtatt

SEQ ID NO: 598101 - DNA, 13 bp, D. melanogaster
caaatatttgtct

SEQ ID NO: 598102 - DNA, 13 bp, D. melanogaster
caaatatttgtgg

SEQ ID NO: 598103 - DNA, 14 bp, D. melanogaster
caaatatttgtgtt

SEQ ID NO: 598104 - DNA, 14 bp, D. melanogaster
caaatattttcaaa

SEQ ID NO: 598105 - DNA, 14 bp, D. melanogaster
caaatattttcaat

SEQ ID NO: 598106 - DNA, 14 bp, D. melanogaster
caaatattttgcat

SEQ ID NO: 598107 - DNA, 14 bp, D. melanogaster
caaatattttgcca

SEQ ID NO: 598108 - DNA, 13 bp, D. melanogaster
caaatattttgta

SEQ ID NO: 598109 - DNA, 14 bp, D. melanogaster
caaatattttgtca

SEQ ID NO: 598110 - DNA, 13 bp, D. melanogaster
caaatattttgtt

SEQ ID NO: 598111 - DNA, 13 bp, D. melanogaster
caaatatttttct

SEQ ID NO: 598112 - DNA, 14 bp, D. melanogaster
caaatatttttgct

SEQ ID NO: 598113 - DNA, 13 bp, D. melanogaster
caaatcaaaagac

SEQ ID NO: 598114 - DNA, 13 bp, D. melanogaster
caaatcaaaagca

SEQ ID NO: 598115 - DNA, 13 bp, D. melanogaster
caaatcaaaagcc

SEQ ID NO: 598116 - DNA, 13 bp, D. melanogaster
caaatcaaaatgc

SEQ ID NO: 598117 - DNA, 13 bp, D. melanogaster
caaatcaaaatgg

SEQ ID NO: 598118 - DNA, 14 bp, D. melanogaster
caaatcaaaatggc

SEQ ID NO: 598119 - DNA, 13 bp, D. melanogaster
caaatcaaagcag

SEQ ID NO: 598120 - DNA, 13 bp, D. melanogaster
caaatcaaagcca

SEQ ID NO: 598121 - DNA, 13 bp, D. melanogaster
caaatcaaaggca

SEQ ID NO: 598122 - DNA, 13 bp, D. melanogaster
caaatcaaagtaa

SEQ ID NO: 598123 - DNA, 13 bp, D. melanogaster
caaatcaaagtca

SEQ ID NO: 598124 - DNA, 13 bp, D. melanogaster
caaatcaaagtgc

SEQ ID NO: 598125 - DNA, 13 bp, D. melanogaster
caaatcaaataga

SEQ ID NO: 598126 - DNA, 13 bp, D. melanogaster
caaatcaaatcgg

SEQ ID NO: 598127 - DNA, 13 bp, D. melanogaster
caaatcaaatgaa

SEQ ID NO: 598128 - DNA, 13 bp, D. melanogaster
caaatcaaatgca

SEQ ID NO: 598129 - DNA, 13 bp, D. melanogaster
caaatcaaattca

SEQ ID NO: 598130 - DNA, 13 bp, D. melanogaster
caaatcaaattta

SEQ ID NO: 598131 - DNA, 14 bp, D. melanogaster
caaatcaagagaaa

SEQ ID NO: 598132 - DNA, 13 bp, D. melanogaster
caaatcaagcaaa

SEQ ID NO: 598133 - DNA, 13 bp, D. melanogaster
caaatcaagcgaa

SEQ ID NO: 598134 - DNA, 13 bp, D. melanogaster
caaatcaagtgaa

SEQ ID NO: 598135 - DNA, 13 bp, D. melanogaster
caaatcaatagaa

SEQ ID NO: 598136 - DNA, 14 bp, D. melanogaster
caaatcaatagaaa

SEQ ID NO: 598137 - DNA, 13 bp, D. melanogaster
caaatcaatatct

SEQ ID NO: 598138 - DNA, 13 bp, D. melanogaster
caaatcaatgaaa

SEQ ID NO: 598139 - DNA, 13 bp, D. melanogaster
caaatcaatgcaa

SEQ ID NO: 598140 - DNA, 13 bp, D. melanogaster
caaatcaattaag

SEQ ID NO: 598141 - DNA, 13 bp, D. melanogaster
caaatcaattcct

SEQ ID NO: 598142 - DNA, 13 bp, D. melanogaster
caaatcaattgaa

SEQ ID NO: 598143 - DNA, 13 bp, D. melanogaster
caaatcaattgat

SEQ ID NO: 598144 - DNA, 13 bp, D. melanogaster
caaatcaattgca

SEQ ID NO: 598145 - DNA, 13 bp, D. melanogaster
caaatcaatttca

SEQ ID NO: 598146 - DNA, 13 bp, D. melanogaster
caaatcacattat

SEQ ID NO: 598147 - DNA, 13 bp, D. melanogaster
caaatcactttaa

SEQ ID NO: 598148 - DNA, 14 bp, D. melanogaster
caaatcagaatgaa

SEQ ID NO: 598149 - DNA, 13 bp, D. melanogaster
caaatcagctgtg

SEQ ID NO: 598150 - DNA, 14 bp, D. melanogaster
caaatcagcttaaa

SEQ ID NO: 598151 - DNA, 13 bp, D. melanogaster
caaatcataaatt

SEQ ID NO: 598152 - DNA, 13 bp, D. melanogaster
caaatcattgacc

SEQ ID NO: 598153 - DNA, 13 bp, D. melanogaster
caaatcattttaa

SEQ ID NO: 598154 - DNA, 13 bp, D. melanogaster
caaatcattttca

SEQ ID NO: 598155 - DNA, 13 bp, D. melanogaster
caaatccaaagct

SEQ ID NO: 598156 - DNA, 13 bp, D. melanogaster
caaatccaaatct

SEQ ID NO: 598157 - DNA, 13 bp, D. melanogaster
caaatccaatcaa

SEQ ID NO: 598158 - DNA, 13 bp, D. melanogaster
caaatccaattaa

SEQ ID NO: 598159 - DNA, 13 bp, D. melanogaster
caaatccaattac

SEQ ID NO: 598160 - DNA, 14 bp, D. melanogaster
caaatccaattgtt

SEQ ID NO: 598161 - DNA, 13 bp, D. melanogaster
caaatccaatttc

SEQ ID NO: 598162 - DNA, 13 bp, D. melanogaster
caaatccacatcc

SEQ ID NO: 598163 - DNA, 14 bp, D. melanogaster
caaatccacatcca

SEQ ID NO: 598164 - DNA, 13 bp, D. melanogaster
caaatcccaatcc

SEQ ID NO: 598165 - DNA, 14 bp, D. melanogaster
caaatcccaatccc

SEQ ID NO: 598166 - DNA, 13 bp, D. melanogaster
caaatcccatttg

SEQ ID NO: 598167 - DNA, 13 bp, D. melanogaster
caaatcccatttt

SEQ ID NO: 598168 - DNA, 13 bp, D. melanogaster
caaatccgaaatc

SEQ ID NO: 598169 - DNA, 13 bp, D. melanogaster
caaatccgaatcg

SEQ ID NO: 598170 - DNA, 13 bp, D. melanogaster
caaatccgcaaat

SEQ ID NO: 598171 - DNA, 13 bp, D. melanogaster
caaatcctgaagt

SEQ ID NO: 598172 - DNA, 13 bp, D. melanogaster
caaatcgaaaaag

SEQ ID NO: 598173 - DNA, 13 bp, D. melanogaster
caaatcgaaaatc

SEQ ID NO: 598174 - DNA, 13 bp, D. melanogaster
caaatcgaaaatt

SEQ ID NO: 598175 - DNA, 13 bp, D. melanogaster
caaatcgaaacat

SEQ ID NO: 598176 - DNA, 13 bp, D. melanogaster
caaatcgaaagcg

SEQ ID NO: 598177 - DNA, 14 bp, D. melanogaster
caaatcgaaataaa

SEQ ID NO: 598178 - DNA, 13 bp, D. melanogaster
caaatcgaaatcg

SEQ ID NO: 598179 - DNA, 14 bp, D. melanogaster
caaatcgaaatcga

SEQ ID NO: 598180 - DNA, 13 bp, D. melanogaster
caaatcgaaatgc

SEQ ID NO: 598181 - DNA, 13 bp, D. melanogaster
caaatcgaaatta

SEQ ID NO: 598182 - DNA, 13 bp, D. melanogaster
caaatcgaaattc

SEQ ID NO: 598183 - DNA, 13 bp, D. melanogaster
caaatcgaaattt

SEQ ID NO: 598184 - DNA, 13 bp, D. melanogaster
caaatcgaatata

SEQ ID NO: 598185 - DNA, 13 bp, D. melanogaster
caaatcgaatcaa

SEQ ID NO: 598186 - DNA, 14 bp, D. melanogaster
caaatcgaatcaaa

SEQ ID NO: 598187 - DNA, 13 bp, D. melanogaster
caaatcgaatcag

SEQ ID NO: 598188 - DNA, 14 bp, D. melanogaster
caaatcgaatcgaa

SEQ ID NO: 598189 - DNA, 13 bp, D. melanogaster
caaatcgaattaa

SEQ ID NO: 598190 - DNA, 13 bp, D. melanogaster
caaatcgaattca

SEQ ID NO: 598191 - DNA, 13 bp, D. melanogaster
caaatcgaattcg

SEQ ID NO: 598192 - DNA, 13 bp, D. melanogaster
caaatcgaattgc

SEQ ID NO: 598193 - DNA, 13 bp, D. melanogaster
caaatcgaattta

SEQ ID NO: 598194 - DNA, 13 bp, D. melanogaster
caaatcgacaatg

SEQ ID NO: 598195 - DNA, 13 bp, D. melanogaster
caaatcgacttcg

SEQ ID NO: 598196 - DNA, 13 bp, D. melanogaster
caaatcgagcaac

SEQ ID NO: 598197 - DNA, 13 bp, D. melanogaster
caaatcgataact

SEQ ID NO: 598198 - DNA, 14 bp, D. melanogaster
caaatcgatagaaa

SEQ ID NO: 598199 - DNA, 13 bp, D. melanogaster
caaatcgattcga

SEQ ID NO: 598200 - DNA, 13 bp, D. melanogaster
caaatcgatttca

SEQ ID NO: 598201 - DNA, 13 bp, D. melanogaster
caaatcgatttga

SEQ ID NO: 598202 - DNA, 13 bp, D. melanogaster
caaatcgatttta

SEQ ID NO: 598203 - DNA, 13 bp, D. melanogaster
caaatcgattttc

SEQ ID NO: 598204 - DNA, 13 bp, D. melanogaster
caaatcgattttt

SEQ ID NO: 598205 - DNA, 13 bp, D. melanogaster
caaatcgcaaatc

SEQ ID NO: 598206 - DNA, 13 bp, D. melanogaster
caaatcgcataaa

SEQ ID NO: 598207 - DNA, 13 bp, D. melanogaster
caaatcgctgcca

SEQ ID NO: 598208 - DNA, 13 bp, D. melanogaster
caaatcgctggca

SEQ ID NO: 598209 - DNA, 13 bp, D. melanogaster
caaatcggcaata

SEQ ID NO: 598210 - DNA, 14 bp, D. melanogaster
caaatcggcaatat

SEQ ID NO: 598211 - DNA, 13 bp, D. melanogaster
caaatcggctaag

SEQ ID NO: 598212 - DNA, 13 bp, D. melanogaster
caaatcggtgatc

SEQ ID NO: 598213 - DNA, 13 bp, D. melanogaster
caaatcgttttaa

SEQ ID NO: 598214 - DNA, 13 bp, D. melanogaster
caaatctatttct

SEQ ID NO: 598215 - DNA, 13 bp, D. melanogaster
caaatctatttta

SEQ ID NO: 598216 - DNA, 13 bp, D. melanogaster
caaatctcgcagc

SEQ ID NO: 598217 - DNA, 13 bp, D. melanogaster
caaatctttaaaa

SEQ ID NO: 598218 - DNA, 13 bp, D. melanogaster
caaatgaaaacca

SEQ ID NO: 598219 - DNA, 14 bp, D. melanogaster
caaatgaaaacgaa

SEQ ID NO: 598220 - DNA, 13 bp, D. melanogaster
caaatgaaaagca

SEQ ID NO: 598221 - DNA, 14 bp, D. melanogaster
caaatgaaaatgca

SEQ ID NO: 598222 - DNA, 13 bp, D. melanogaster
caaatgaaaattc

SEQ ID NO: 598223 - DNA, 14 bp, D. melanogaster
caaatgaaaattgt

SEQ ID NO: 598224 - DNA, 13 bp, D. melanogaster
caaatgaaacaat

SEQ ID NO: 598225 - DNA, 13 bp, D. melanogaster
caaatgaaacatt

SEQ ID NO: 598226 - DNA, 14 bp, D. melanogaster
caaatgaaacgaaa

SEQ ID NO: 598227 - DNA, 13 bp, D. melanogaster
caaatgaaactaa

SEQ ID NO: 598228 - DNA, 13 bp, D. melanogaster
caaatgaaacttt

SEQ ID NO: 598229 - DNA, 13 bp, D. melanogaster
caaatgaaagtga

SEQ ID NO: 598230 - DNA, 13 bp, D. melanogaster
caaatgaaatatg

SEQ ID NO: 598231 - DNA, 13 bp, D. melanogaster
caaatgaaatcaa

SEQ ID NO: 598232 - DNA, 13 bp, D. melanogaster
caaatgaaatgaa

SEQ ID NO: 598233 - DNA, 14 bp, D. melanogaster
caaatgaaatgaaa

SEQ ID NO: 598234 - DNA, 13 bp, D. melanogaster
caaatgaaatgca

SEQ ID NO: 598235 - DNA, 13 bp, D. melanogaster
caaatgaaatgcg

SEQ ID NO: 598236 - DNA, 13 bp, D. melanogaster
caaatgaaattaa

SEQ ID NO: 598237 - DNA, 13 bp, D. melanogaster
caaatgaaattat

SEQ ID NO: 598238 - DNA, 13 bp, D. melanogaster
caaatgaaattca

SEQ ID NO: 598239 - DNA, 13 bp, D. melanogaster
caaatgaaattga

SEQ ID NO: 598240 - DNA, 14 bp, D. melanogaster
caaatgaaattgaa

SEQ ID NO: 598241 - DNA, 14 bp, D. melanogaster
caaatgaaatttaa

SEQ ID NO: 598242 - DNA, 14 bp, D. melanogaster
caaatgaaatttat

SEQ ID NO: 598243 - DNA, 13 bp, D. melanogaster
caaatgaaatttc

SEQ ID NO: 598244 - DNA, 13 bp, D. melanogaster
caaatgaaatttt

SEQ ID NO: 598245 - DNA, 13 bp, D. melanogaster
caaatgaactgaa

SEQ ID NO: 598246 - DNA, 13 bp, D. melanogaster
caaatgaagcaaa

SEQ ID NO: 598247 - DNA, 13 bp, D. melanogaster
caaatgaagttat

SEQ ID NO: 598248 - DNA, 13 bp, D. melanogaster
caaatgaagttgt

SEQ ID NO: 598249 - DNA, 13 bp, D. melanogaster
caaatgaataaat

SEQ ID NO: 598250 - DNA, 13 bp, D. melanogaster
caaatgaatgatt

SEQ ID NO: 598251 - DNA, 13 bp, D. melanogaster
caaatgaatgcaa

SEQ ID NO: 598252 - DNA, 13 bp, D. melanogaster
caaatgaatgcca

SEQ ID NO: 598253 - DNA, 13 bp, D. melanogaster
caaatgaatgcga

SEQ ID NO: 598254 - DNA, 13 bp, D. melanogaster
caaatgaattaaa

SEQ ID NO: 598255 - DNA, 13 bp, D. melanogaster
caaatgaattata

SEQ ID NO: 598256 - DNA, 13 bp, D. melanogaster
caaatgaattcga

SEQ ID NO: 598257 - DNA, 13 bp, D. melanogaster
caaatgaattgtg

SEQ ID NO: 598258 - DNA, 13 bp, D. melanogaster
caaatgaatttgg

SEQ ID NO: 598259 - DNA, 14 bp, D. melanogaster
caaatgaattttaa

SEQ ID NO: 598260 - DNA, 13 bp, D. melanogaster
caaatgaattttt

SEQ ID NO: 598261 - DNA, 13 bp, D. melanogaster
caaatgacaaaat

SEQ ID NO: 598262 - DNA, 13 bp, D. melanogaster
caaatgacaaagg

SEQ ID NO: 598263 - DNA, 13 bp, D. melanogaster
caaatgacaaatg

SEQ ID NO: 598264 - DNA, 13 bp, D. melanogaster
caaatgacattta

SEQ ID NO: 598265 - DNA, 13 bp, D. melanogaster
caaatgactttgc

SEQ ID NO: 598266 - DNA, 13 bp, D. melanogaster
caaatgactttgg

SEQ ID NO: 598267 - DNA, 13 bp, D. melanogaster
caaatgagaaaat

SEQ ID NO: 598268 - DNA, 14 bp, D. melanogaster
caaatgagaaagaa

SEQ ID NO: 598269 - DNA, 13 bp, D. melanogaster
caaatgagaaatg

SEQ ID NO: 598270 - DNA, 13 bp, D. melanogaster
caaatgagattaa

SEQ ID NO: 598271 - DNA, 13 bp, D. melanogaster
caaatgagcagca

SEQ ID NO: 598272 - DNA, 13 bp, D. melanogaster
caaatgagccgag

SEQ ID NO: 598273 - DNA, 13 bp, D. melanogaster
caaatgagcctgc

SEQ ID NO: 598274 - DNA, 13 bp, D. melanogaster
caaatgataataa

SEQ ID NO: 598275 - DNA, 13 bp, D. melanogaster
caaatgataatta

SEQ ID NO: 598276 - DNA, 13 bp, D. melanogaster
caaatgataattt

SEQ ID NO: 598277 - DNA, 13 bp, D. melanogaster
caaatgatagtaa

SEQ ID NO: 598278 - DNA, 13 bp, D. melanogaster
caaatgatataaa

SEQ ID NO: 598279 - DNA, 13 bp, D. melanogaster
caaatgatatttt

SEQ ID NO: 598280 - DNA, 13 bp, D. melanogaster
caaatgatcaaca

SEQ ID NO: 598281 - DNA, 14 bp, D. melanogaster
caaatgatcattgt

SEQ ID NO: 598282 - DNA, 13 bp, D. melanogaster
caaatgatgaata

SEQ ID NO: 598283 - DNA, 13 bp, D. melanogaster
caaatgatgatga

SEQ ID NO: 598284 - DNA, 14 bp, D. melanogaster
caaatgatgatgat

SEQ ID NO: 598285 - DNA, 13 bp, D. melanogaster
caaatgatggcca

SEQ ID NO: 598286 - DNA, 13 bp, D. melanogaster
caaatgatgtccg

SEQ ID NO: 598287 - DNA, 13 bp, D. melanogaster
caaatgattatta

SEQ ID NO: 598288 - DNA, 13 bp, D. melanogaster
caaatgattgatt

SEQ ID NO: 598289 - DNA, 14 bp, D. melanogaster
caaatgatttaata

SEQ ID NO: 598290 - DNA, 13 bp, D. melanogaster
caaatgatttatt

SEQ ID NO: 598291 - DNA, 13 bp, D. melanogaster
caaatgatttcat

SEQ ID NO: 598292 - DNA, 14 bp, D. melanogaster
caaatgatttgttt

SEQ ID NO: 598293 - DNA, 13 bp, D. melanogaster
caaatgattttaa

SEQ ID NO: 598294 - DNA, 13 bp, D. melanogaster
caaatgcaaaaat

SEQ ID NO: 598295 - DNA, 13 bp, D. melanogaster
caaatgcaaaaga

SEQ ID NO: 598296 - DNA, 13 bp, D. melanogaster
caaatgcaaaagt

SEQ ID NO: 598297 - DNA, 14 bp, D. melanogaster
caaatgcaaaataa

SEQ ID NO: 598298 - DNA, 13 bp, D. melanogaster
caaatgcaaaatt

SEQ ID NO: 598299 - DNA, 14 bp, D. melanogaster
caaatgcaaacaaa

SEQ ID NO: 598300 - DNA, 13 bp, D. melanogaster
caaatgcaaacga

SEQ ID NO: 598301 - DNA, 13 bp, D. melanogaster
caaatgcaaactg

SEQ ID NO: 598302 - DNA, 13 bp, D. melanogaster
caaatgcaaagtg

SEQ ID NO: 598303 - DNA, 14 bp, D. melanogaster
caaatgcaaatatt

SEQ ID NO: 598304 - DNA, 13 bp, D. melanogaster
caaatgcaaatcg

SEQ ID NO: 598305 - DNA, 13 bp, D. melanogaster
caaatgcaaatga

SEQ ID NO: 598306 - DNA, 14 bp, D. melanogaster
caaatgcaaatgaa

SEQ ID NO: 598307 - DNA, 14 bp, D. melanogaster
caaatgcaaattca

SEQ ID NO: 598308 - DNA, 13 bp, D. melanogaster
caaatgcaaattg

SEQ ID NO: 598309 - DNA, 13 bp, D. melanogaster
caaatgcaaattt

SEQ ID NO: 598310 - DNA, 14 bp, D. melanogaster
caaatgcaacaaaa

SEQ ID NO: 598311 - DNA, 13 bp, D. melanogaster
caaatgcaacttt

SEQ ID NO: 598312 - DNA, 13 bp, D. melanogaster
caaatgcaatcaa

SEQ ID NO: 598313 - DNA, 13 bp, D. melanogaster
caaatgcaattaa

SEQ ID NO: 598314 - DNA, 13 bp, D. melanogaster
caaatgcaattca

SEQ ID NO: 598315 - DNA, 13 bp, D. melanogaster
caaatgcaattgc

SEQ ID NO: 598316 - DNA, 13 bp, D. melanogaster
caaatgcacaaaa

SEQ ID NO: 598317 - DNA, 13 bp, D. melanogaster
caaatgcacacac

SEQ ID NO: 598318 - DNA, 13 bp, D. melanogaster
caaatgcactgca

SEQ ID NO: 598319 - DNA, 13 bp, D. melanogaster
caaatgcacttga

SEQ ID NO: 598320 - DNA, 13 bp, D. melanogaster
caaatgcagaaaa

SEQ ID NO: 598321 - DNA, 14 bp, D. melanogaster
caaatgcagatgca

SEQ ID NO: 598322 - DNA, 13 bp, D. melanogaster
caaatgcagccag

SEQ ID NO: 598323 - DNA, 13 bp, D. melanogaster
caaatgcagcgaa

SEQ ID NO: 598324 - DNA, 13 bp, D. melanogaster
caaatgcatcaaa

SEQ ID NO: 598325 - DNA, 13 bp, D. melanogaster
caaatgcatgcaa

SEQ ID NO: 598326 - DNA, 13 bp, D. melanogaster
caaatgcattcat

SEQ ID NO: 598327 - DNA, 13 bp, D. melanogaster
caaatgcattcgc

SEQ ID NO: 598328 - DNA, 13 bp, D. melanogaster
caaatgcattgaa

SEQ ID NO: 598329 - DNA, 13 bp, D. melanogaster
caaatgcattggc

SEQ ID NO: 598330 - DNA, 13 bp, D. melanogaster
caaatgcatttcg

SEQ ID NO: 598331 - DNA, 14 bp, D. melanogaster
caaatgcatttgca

SEQ ID NO: 598332 - DNA, 13 bp, D. melanogaster
caaatgccaaaac

SEQ ID NO: 598333 - DNA, 14 bp, D. melanogaster
caaatgccaaacaa

SEQ ID NO: 598334 - DNA, 14 bp, D. melanogaster
caaatgccaaatgc

SEQ ID NO: 598335 - DNA, 13 bp, D. melanogaster
caaatgccaagga

SEQ ID NO: 598336 - DNA, 13 bp, D. melanogaster
caaatgccaagtg

SEQ ID NO: 598337 - DNA, 13 bp, D. melanogaster
caaatgccaagtt

SEQ ID NO: 598338 - DNA, 14 bp, D. melanogaster
caaatgccaagttc

SEQ ID NO: 598339 - DNA, 13 bp, D. melanogaster
caaatgccaattg

SEQ ID NO: 598340 - DNA, 13 bp, D. melanogaster
caaatgccatgat

SEQ ID NO: 598341 - DNA, 13 bp, D. melanogaster
caaatgccattta

SEQ ID NO: 598342 - DNA, 13 bp, D. melanogaster
caaatgcccaaaa

SEQ ID NO: 598343 - DNA, 13 bp, D. melanogaster
caaatgccgcaca

SEQ ID NO: 598344 - DNA, 14 bp, D. melanogaster
caaatgcctgcgcg

SEQ ID NO: 598345 - DNA, 13 bp, D. melanogaster
caaatgcctggca

SEQ ID NO: 598346 - DNA, 13 bp, D. melanogaster
caaatgcgaaaat

SEQ ID NO: 598347 - DNA, 13 bp, D. melanogaster
caaatgcgaaatg

SEQ ID NO: 598348 - DNA, 13 bp, D. melanogaster
caaatgcgacaga

SEQ ID NO: 598349 - DNA, 13 bp, D. melanogaster
caaatgctcaaca

SEQ ID NO: 598350 - DNA, 14 bp, D. melanogaster
caaatgctcaacaa

SEQ ID NO: 598351 - DNA, 13 bp, D. melanogaster
caaatgctgaatg

SEQ ID NO: 598352 - DNA, 13 bp, D. melanogaster
caaatgctgttgc

SEQ ID NO: 598353 - DNA, 13 bp, D. melanogaster
caaatgcttaatt

SEQ ID NO: 598354 - DNA, 13 bp, D. melanogaster
caaatgcttattt

SEQ ID NO: 598355 - DNA, 13 bp, D. melanogaster
caaatgcttggac

SEQ ID NO: 598356 - DNA, 13 bp, D. melanogaster
caaatgcttgtag

SEQ ID NO: 598357 - DNA, 13 bp, D. melanogaster
caaatgctttact

SEQ ID NO: 598358 - DNA, 13 bp, D. melanogaster
caaatgctttggc

SEQ ID NO: 598359 - DNA, 13 bp, D. melanogaster
caaatgcttttta

SEQ ID NO: 598360 - DNA, 13 bp, D. melanogaster
caaatggaaaaca

SEQ ID NO: 598361 - DNA, 14 bp, D. melanogaster
caaatggaaaacaa

SEQ ID NO: 598362 - DNA, 13 bp, D. melanogaster
caaatggaaaact

SEQ ID NO: 598363 - DNA, 13 bp, D. melanogaster
caaatggaaaagg

SEQ ID NO: 598364 - DNA, 13 bp, D. melanogaster
caaatggaaaata

SEQ ID NO: 598365 - DNA, 13 bp, D. melanogaster
caaatggaaaatg

SEQ ID NO: 598366 - DNA, 14 bp, D. melanogaster
caaatggaaaatgg

SEQ ID NO: 598367 - DNA, 14 bp, D. melanogaster
caaatggaaatcaa

SEQ ID NO: 598368 - DNA, 13 bp, D. melanogaster
caaatggaaatgg

SEQ ID NO: 598369 - DNA, 13 bp, D. melanogaster
caaatggaaattg

SEQ ID NO: 598370 - DNA, 13 bp, D. melanogaster
caaatggaacaca

SEQ ID NO: 598371 - DNA, 13 bp, D. melanogaster
caaatggaacatt

SEQ ID NO: 598372 - DNA, 13 bp, D. melanogaster
caaatggaataaa

SEQ ID NO: 598373 - DNA, 13 bp, D. melanogaster
caaatggaatgaa

SEQ ID NO: 598374 - DNA, 13 bp, D. melanogaster
caaatggaatgga

SEQ ID NO: 598375 - DNA, 13 bp, D. melanogaster
caaatggaatttc

SEQ ID NO: 598376 - DNA, 13 bp, D. melanogaster
caaatggagcaca

SEQ ID NO: 598377 - DNA, 14 bp, D. melanogaster
caaatggatgtaaa

SEQ ID NO: 598378 - DNA, 13 bp, D. melanogaster
caaatggatttcc

SEQ ID NO: 598379 - DNA, 13 bp, D. melanogaster
caaatggcaaaag

SEQ ID NO: 598380 - DNA, 13 bp, D. melanogaster
caaatggcaaaca

SEQ ID NO: 598381 - DNA, 13 bp, D. melanogaster
caaatggcaaacg

SEQ ID NO: 598382 - DNA, 13 bp, D. melanogaster
caaatggcaaatg

SEQ ID NO: 598383 - DNA, 13 bp, D. melanogaster
caaatggcaactg

SEQ ID NO: 598384 - DNA, 13 bp, D. melanogaster
caaatggcaagtg

SEQ ID NO: 598385 - DNA, 14 bp, D. melanogaster
caaatggcaatcgc

SEQ ID NO: 598386 - DNA, 13 bp, D. melanogaster
caaatggcaattg

SEQ ID NO: 598387 - DNA, 13 bp, D. melanogaster
caaatggcacaca

SEQ ID NO: 598388 - DNA, 13 bp, D. melanogaster
caaatggcagaaa

SEQ ID NO: 598389 - DNA, 13 bp, D. melanogaster
caaatggcagcaa

SEQ ID NO: 598390 - DNA, 13 bp, D. melanogaster
caaatggcataaa

SEQ ID NO: 598391 - DNA, 13 bp, D. melanogaster
caaatggcattcg

SEQ ID NO: 598392 - DNA, 14 bp, D. melanogaster
caaatggcattcga

SEQ ID NO: 598393 - DNA, 13 bp, D. melanogaster
caaatggccaaaa

SEQ ID NO: 598394 - DNA, 14 bp, D. melanogaster
caaatggccaaatg

SEQ ID NO: 598395 - DNA, 13 bp, D. melanogaster
caaatggccaact

SEQ ID NO: 598396 - DNA, 13 bp, D. melanogaster
caaatggccaatg

SEQ ID NO: 598397 - DNA, 13 bp, D. melanogaster
caaatggccagaa

SEQ ID NO: 598398 - DNA, 13 bp, D. melanogaster
caaatggccagcg

SEQ ID NO: 598399 - DNA, 13 bp, D. melanogaster
caaatggccataa

SEQ ID NO: 598400 - DNA, 13 bp, D. melanogaster
caaatggcccaaa

SEQ ID NO: 598401 - DNA, 13 bp, D. melanogaster
caaatggcgccat

SEQ ID NO: 598402 - DNA, 13 bp, D. melanogaster
caaatggctggca

SEQ ID NO: 598403 - DNA, 13 bp, D. melanogaster
caaatggctttca

SEQ ID NO: 598404 - DNA, 13 bp, D. melanogaster
caaatggcttttc

SEQ ID NO: 598405 - DNA, 13 bp, D. melanogaster
caaatgggaaaac

SEQ ID NO: 598406 - DNA, 13 bp, D. melanogaster
caaatgggaaaag

SEQ ID NO: 598407 - DNA, 13 bp, D. melanogaster
caaatgggatttg

SEQ ID NO: 598408 - DNA, 13 bp, D. melanogaster
caaatgggatttt

SEQ ID NO: 598409 - DNA, 13 bp, D. melanogaster
caaatgggcgtgg

SEQ ID NO: 598410 - DNA, 14 bp, D. melanogaster
caaatgggcgtggc

SEQ ID NO: 598411 - DNA, 13 bp, D. melanogaster
caaatggttattg

SEQ ID NO: 598412 - DNA, 13 bp, D. melanogaster
caaatggtttaca

SEQ ID NO: 598413 - DNA, 13 bp, D. melanogaster
caaatggttttat

SEQ ID NO: 598414 - DNA, 13 bp, D. melanogaster
caaatggttttca

SEQ ID NO: 598415 - DNA, 13 bp, D. melanogaster
caaatgtaaaatc

SEQ ID NO: 598416 - DNA, 13 bp, D. melanogaster
caaatgtaaataa

SEQ ID NO: 598417 - DNA, 13 bp, D. melanogaster
caaatgtaaatgc

SEQ ID NO: 598418 - DNA, 13 bp, D. melanogaster
caaatgtaaatgt

SEQ ID NO: 598419 - DNA, 13 bp, D. melanogaster
caaatgtaaattt

SEQ ID NO: 598420 - DNA, 13 bp, D. melanogaster
caaatgtaacaaa

SEQ ID NO: 598421 - DNA, 13 bp, D. melanogaster
caaatgtaatatt

SEQ ID NO: 598422 - DNA, 13 bp, D. melanogaster
caaatgtaatgta

SEQ ID NO: 598423 - DNA, 13 bp, D. melanogaster
caaatgtaattta

SEQ ID NO: 598424 - DNA, 13 bp, D. melanogaster
caaatgtatctcg

SEQ ID NO: 598425 - DNA, 13 bp, D. melanogaster
caaatgtatctgc

SEQ ID NO: 598426 - DNA, 13 bp, D. melanogaster
caaatgtatctgt

SEQ ID NO: 598427 - DNA, 14 bp, D. melanogaster
caaatgtatctgta

SEQ ID NO: 598428 - DNA, 13 bp, D. melanogaster
caaatgtatcttt

SEQ ID NO: 598429 - DNA, 13 bp, D. melanogaster
caaatgtatgaaa

SEQ ID NO: 598430 - DNA, 13 bp, D. melanogaster
caaatgtatgtat

SEQ ID NO: 598431 - DNA, 13 bp, D. melanogaster
caaatgtatgtgt

SEQ ID NO: 598432 - DNA, 13 bp, D. melanogaster
caaatgtatttta

SEQ ID NO: 598433 - DNA, 13 bp, D. melanogaster
caaatgtcaaaag

SEQ ID NO: 598434 - DNA, 13 bp, D. melanogaster
caaatgtcaaagt

SEQ ID NO: 598435 - DNA, 13 bp, D. melanogaster
caaatgtcaaatg

SEQ ID NO: 598436 - DNA, 13 bp, D. melanogaster
caaatgtcaaatt

SEQ ID NO: 598437 - DNA, 13 bp, D. melanogaster
caaatgtcaatca

SEQ ID NO: 598438 - DNA, 13 bp, D. melanogaster
caaatgtcatttt

SEQ ID NO: 598439 - DNA, 13 bp, D. melanogaster
caaatgtcccaat

SEQ ID NO: 598440 - DNA, 13 bp, D. melanogaster
caaatgtcgaaaa

SEQ ID NO: 598441 - DNA, 13 bp, D. melanogaster
caaatgtgagttt

SEQ ID NO: 598442 - DNA, 13 bp, D. melanogaster
caaatgtgccaaa

SEQ ID NO: 598443 - DNA, 13 bp, D. melanogaster
caaatgtggccaa

SEQ ID NO: 598444 - DNA, 13 bp, D. melanogaster
caaatgtgtataa

SEQ ID NO: 598445 - DNA, 13 bp, D. melanogaster
caaatgtgtgaaa

SEQ ID NO: 598446 - DNA, 14 bp, D. melanogaster
caaatgtgtgtgtg

SEQ ID NO: 598447 - DNA, 13 bp, D. melanogaster
caaatgtgttggc

SEQ ID NO: 598448 - DNA, 13 bp, D. melanogaster
caaatgtgtttgc

SEQ ID NO: 598449 - DNA, 13 bp, D. melanogaster
caaatgtgtttgt

SEQ ID NO: 598450 - DNA, 13 bp, D. melanogaster
caaatgttaatga

SEQ ID NO: 598451 - DNA, 13 bp, D. melanogaster
caaatgttaattg

SEQ ID NO: 598452 - DNA, 13 bp, D. melanogaster
caaatgttaattt

SEQ ID NO: 598453 - DNA, 13 bp, D. melanogaster
caaatgttcaatt

SEQ ID NO: 598454 - DNA, 13 bp, D. melanogaster
caaatgttgcaat

SEQ ID NO: 598455 - DNA, 13 bp, D. melanogaster
caaatgttgccaa

SEQ ID NO: 598456 - DNA, 13 bp, D. melanogaster
caaatgttgctaa

SEQ ID NO: 598457 - DNA, 13 bp, D. melanogaster
caaatgttgtttt

SEQ ID NO: 598458 - DNA, 13 bp, D. melanogaster
caaatgtttaaat

SEQ ID NO: 598459 - DNA, 13 bp, D. melanogaster
caaatgtttacat

SEQ ID NO: 598460 - DNA, 13 bp, D. melanogaster
caaatgtttactt

SEQ ID NO: 598461 - DNA, 13 bp, D. melanogaster
caaatgtttcagc

SEQ ID NO: 598462 - DNA, 14 bp, D. melanogaster
caaatgtttcatta

SEQ ID NO: 598463 - DNA, 13 bp, D. melanogaster
caaatgtttgcca

SEQ ID NO: 598464 - DNA, 13 bp, D. melanogaster
caaatgtttggca

SEQ ID NO: 598465 - DNA, 13 bp, D. melanogaster
caaatgtttgttt

SEQ ID NO: 598466 - DNA, 14 bp, D. melanogaster
caaatgttttaaaa

SEQ ID NO: 598467 - DNA, 13 bp, D. melanogaster
caaatgttttaca

SEQ ID NO: 598468 - DNA, 13 bp, D. melanogaster
caaatgttttgct

SEQ ID NO: 598469 - DNA, 13 bp, D. melanogaster
caaatgttttgtt

SEQ ID NO: 598470 - DNA, 14 bp, D. melanogaster
caaatgttttgttt

SEQ ID NO: 598471 - DNA, 14 bp, D. melanogaster
caaatgtttttgtt

SEQ ID NO: 598472 - DNA, 13 bp, D. melanogaster
caaatgtttttta

SEQ ID NO: 598473 - DNA, 14 bp, D. melanogaster
caaattaaaaagtt

SEQ ID NO: 598474 - DNA, 13 bp, D. melanogaster
caaattaaaagtg

SEQ ID NO: 598475 - DNA, 13 bp, D. melanogaster
caaattaaaagtt

SEQ ID NO: 598476 - DNA, 13 bp, D. melanogaster
caaattaaaatag

SEQ ID NO: 598477 - DNA, 13 bp, D. melanogaster
caaattaaaatgt

SEQ ID NO: 598478 - DNA, 13 bp, D. melanogaster
caaattaaaattg

SEQ ID NO: 598479 - DNA, 14 bp, D. melanogaster
caaattaaaattgt

SEQ ID NO: 598480 - DNA, 13 bp, D. melanogaster
caaattaaacgaa

SEQ ID NO: 598481 - DNA, 13 bp, D. melanogaster
caaattaaagtga

SEQ ID NO: 598482 - DNA, 13 bp, D. melanogaster
caaattaaagtgt

SEQ ID NO: 598483 - DNA, 13 bp, D. melanogaster
caaattaaagtta

SEQ ID NO: 598484 - DNA, 13 bp, D. melanogaster
caaattaaagttt

SEQ ID NO: 598485 - DNA, 13 bp, D. melanogaster
caaattaaataag

SEQ ID NO: 598486 - DNA, 13 bp, D. melanogaster
caaattaaatcat

SEQ ID NO: 598487 - DNA, 13 bp, D. melanogaster
caaattaaatcca

SEQ ID NO: 598488 - DNA, 14 bp, D. melanogaster
caaattaaatgaat

SEQ ID NO: 598489 - DNA, 13 bp, D. melanogaster
caaattaaatgcc

SEQ ID NO: 598490 - DNA, 13 bp, D. melanogaster
caaattaaattcc

SEQ ID NO: 598491 - DNA, 14 bp, D. melanogaster
caaattaaattgca

SEQ ID NO: 598492 - DNA, 13 bp, D. melanogaster
caaattaaatttg

SEQ ID NO: 598493 - DNA, 14 bp, D. melanogaster
caaattaaatttgc

SEQ ID NO: 598494 - DNA, 13 bp, D. melanogaster
caaattaacaatt

SEQ ID NO: 598495 - DNA, 13 bp, D. melanogaster
caaattaactgaa

SEQ ID NO: 598496 - DNA, 13 bp, D. melanogaster
caaattaacttta

SEQ ID NO: 598497 - DNA, 13 bp, D. melanogaster
caaattaagcttt

SEQ ID NO: 598498 - DNA, 13 bp, D. melanogaster
caaattaagttca

SEQ ID NO: 598499 - DNA, 14 bp, D. melanogaster
caaattaataaatg

SEQ ID NO: 598500 - DNA, 13 bp, D. melanogaster
caaattaatagaa

SEQ ID NO: 598501 - DNA, 13 bp, D. melanogaster
caaattaatgaaa

SEQ ID NO: 598502 - DNA, 13 bp, D. melanogaster
caaattaatgaat

SEQ ID NO: 598503 - DNA, 13 bp, D. melanogaster
caaattaatggcc

SEQ ID NO: 598504 - DNA, 13 bp, D. melanogaster
caaattaatgtaa

SEQ ID NO: 598505 - DNA, 13 bp, D. melanogaster
caaattaattgaa

SEQ ID NO: 598506 - DNA, 13 bp, D. melanogaster
caaattaattgat

SEQ ID NO: 598507 - DNA, 14 bp, D. melanogaster
caaattaattgcaa

SEQ ID NO: 598508 - DNA, 13 bp, D. melanogaster
caaattacacaag

SEQ ID NO: 598509 - DNA, 13 bp, D. melanogaster
caaattacagcaa

SEQ ID NO: 598510 - DNA, 13 bp, D. melanogaster
caaattacattta

SEQ ID NO: 598511 - DNA, 14 bp, D. melanogaster
caaattacatttaa

SEQ ID NO: 598512 - DNA, 13 bp, D. melanogaster
caaattaccagca

SEQ ID NO: 598513 - DNA, 13 bp, D. melanogaster
caaattacgcaga

SEQ ID NO: 598514 - DNA, 13 bp, D. melanogaster
caaattacgtata

SEQ ID NO: 598515 - DNA, 13 bp, D. melanogaster
caaattactaaac

SEQ ID NO: 598516 - DNA, 13 bp, D. melanogaster
caaattactcact

SEQ ID NO: 598517 - DNA, 13 bp, D. melanogaster
caaattagaaaac

SEQ ID NO: 598518 - DNA, 14 bp, D. melanogaster
caaattagaattaa

SEQ ID NO: 598519 - DNA, 13 bp, D. melanogaster
caaattagcaaaa

SEQ ID NO: 598520 - DNA, 13 bp, D. melanogaster
caaattaggcaaa

SEQ ID NO: 598521 - DNA, 13 bp, D. melanogaster
caaattagttgca

SEQ ID NO: 598522 - DNA, 13 bp, D. melanogaster
caaattagtttaa

SEQ ID NO: 598523 - DNA, 13 bp, D. melanogaster
caaattataaaag

SEQ ID NO: 598524 - DNA, 13 bp, D. melanogaster
caaattataacac

SEQ ID NO: 598525 - DNA, 13 bp, D. melanogaster
caaattatatggc

SEQ ID NO: 598526 - DNA, 13 bp, D. melanogaster
caaattatgcaat

SEQ ID NO: 598527 - DNA, 13 bp, D. melanogaster
caaattatgcata

SEQ ID NO: 598528 - DNA, 13 bp, D. melanogaster
caaattatggcaa

SEQ ID NO: 598529 - DNA, 13 bp, D. melanogaster
caaattatgtcgt

SEQ ID NO: 598530 - DNA, 14 bp, D. melanogaster
caaattattagaaa

SEQ ID NO: 598531 - DNA, 13 bp, D. melanogaster
caaattattcaca

SEQ ID NO: 598532 - DNA, 13 bp, D. melanogaster
caaattattgcca

SEQ ID NO: 598533 - DNA, 13 bp, D. melanogaster
caaattatttaga

SEQ ID NO: 598534 - DNA, 13 bp, D. melanogaster
caaattatttgtt

SEQ ID NO: 598535 - DNA, 13 bp, D. melanogaster
caaattcaaaact

SEQ ID NO: 598536 - DNA, 13 bp, D. melanogaster
caaattcaaaagt

SEQ ID NO: 598537 - DNA, 13 bp, D. melanogaster
caaattcaaaatg

SEQ ID NO: 598538 - DNA, 13 bp, D. melanogaster
caaattcaaagga

SEQ ID NO: 598539 - DNA, 13 bp, D. melanogaster
caaattcaaatac

SEQ ID NO: 598540 - DNA, 13 bp, D. melanogaster
caaattcaaatcc

SEQ ID NO: 598541 - DNA, 13 bp, D. melanogaster
caaattcaaatcg

SEQ ID NO: 598542 - DNA, 13 bp, D. melanogaster
caaattcaaattc

SEQ ID NO: 598543 - DNA, 13 bp, D. melanogaster
caaattcaaattt

SEQ ID NO: 598544 - DNA, 13 bp, D. melanogaster
caaattcaacttt

SEQ ID NO: 598545 - DNA, 13 bp, D. melanogaster
caaattcaagaaa

SEQ ID NO: 598546 - DNA, 13 bp, D. melanogaster
caaattcaataat

SEQ ID NO: 598547 - DNA, 13 bp, D. melanogaster
caaattcaatgga

SEQ ID NO: 598548 - DNA, 13 bp, D. melanogaster
caaattcaattca

SEQ ID NO: 598549 - DNA, 14 bp, D. melanogaster
caaattcaattcaa

SEQ ID NO: 598550 - DNA, 13 bp, D. melanogaster
caaattcaatttg

SEQ ID NO: 598551 - DNA, 13 bp, D. melanogaster
caaattcacgtct

SEQ ID NO: 598552 - DNA, 13 bp, D. melanogaster
caaattcatattt

SEQ ID NO: 598553 - DNA, 13 bp, D. melanogaster
caaattcatttga

SEQ ID NO: 598554 - DNA, 13 bp, D. melanogaster
caaattccaaatt

SEQ ID NO: 598555 - DNA, 13 bp, D. melanogaster
caaattccaagaa

SEQ ID NO: 598556 - DNA, 13 bp, D. melanogaster
caaattccaagtt

SEQ ID NO: 598557 - DNA, 14 bp, D. melanogaster
caaattccaagttt

SEQ ID NO: 598558 - DNA, 13 bp, D. melanogaster
caaattccattca

SEQ ID NO: 598559 - DNA, 13 bp, D. melanogaster
caaattcccattt

SEQ ID NO: 598560 - DNA, 13 bp, D. melanogaster
caaattcgaaaaa

SEQ ID NO: 598561 - DNA, 13 bp, D. melanogaster
caaattcgatcga

SEQ ID NO: 598562 - DNA, 13 bp, D. melanogaster
caaattctatttt

SEQ ID NO: 598563 - DNA, 13 bp, D. melanogaster
caaattctcaaga

SEQ ID NO: 598564 - DNA, 13 bp, D. melanogaster
caaattctgagaa

SEQ ID NO: 598565 - DNA, 13 bp, D. melanogaster
caaattctgcagc

SEQ ID NO: 598566 - DNA, 14 bp, D. melanogaster
caaattgaaaacaa

SEQ ID NO: 598567 - DNA, 13 bp, D. melanogaster
caaattgaaaacc

SEQ ID NO: 598568 - DNA, 13 bp, D. melanogaster
caaattgaaagtt

SEQ ID NO: 598569 - DNA, 13 bp, D. melanogaster
caaattgaaatat

SEQ ID NO: 598570 - DNA, 14 bp, D. melanogaster
caaattgaaatcga

SEQ ID NO: 598571 - DNA, 13 bp, D. melanogaster
caaattgaaatgc

SEQ ID NO: 598572 - DNA, 14 bp, D. melanogaster
caaattgaaatgca

SEQ ID NO: 598573 - DNA, 14 bp, D. melanogaster
caaattgaaattga

SEQ ID NO: 598574 - DNA, 13 bp, D. melanogaster
caaattgaaattt

SEQ ID NO: 598575 - DNA, 14 bp, D. melanogaster
caaattgaaatttt

SEQ ID NO: 598576 - DNA, 13 bp, D. melanogaster
caaattgaaggca

SEQ ID NO: 598577 - DNA, 13 bp, D. melanogaster
caaattgaataaa

SEQ ID NO: 598578 - DNA, 13 bp, D. melanogaster
caaattgaattag

SEQ ID NO: 598579 - DNA, 13 bp, D. melanogaster
caaattgaattcg

SEQ ID NO: 598580 - DNA, 13 bp, D. melanogaster
caaattgaattgt

SEQ ID NO: 598581 - DNA, 13 bp, D. melanogaster
caaattgaatttc

SEQ ID NO: 598582 - DNA, 13 bp, D. melanogaster
caaattgaatttg

SEQ ID NO: 598583 - DNA, 14 bp, D. melanogaster
caaattgaatttgc

SEQ ID NO: 598584 - DNA, 14 bp, D. melanogaster
caaattgaattttc

SEQ ID NO: 598585 - DNA, 13 bp, D. melanogaster
caaattgacgaaa

SEQ ID NO: 598586 - DNA, 13 bp, D. melanogaster
caaattgactttc

SEQ ID NO: 598587 - DNA, 13 bp, D. melanogaster
caaattgagttga

SEQ ID NO: 598588 - DNA, 13 bp, D. melanogaster
caaattgagtttc

SEQ ID NO: 598589 - DNA, 13 bp, D. melanogaster
caaattgagtttg

SEQ ID NO: 598590 - DNA, 13 bp, D. melanogaster
caaattgataaga

SEQ ID NO: 598591 - DNA, 13 bp, D. melanogaster
caaattgatatta

SEQ ID NO: 598592 - DNA, 13 bp, D. melanogaster
caaattgatattg

SEQ ID NO: 598593 - DNA, 14 bp, D. melanogaster
caaattgattaatt

SEQ ID NO: 598594 - DNA, 13 bp, D. melanogaster
caaattgattgat

SEQ ID NO: 598595 - DNA, 14 bp, D. melanogaster
caaattgattgatt

SEQ ID NO: 598596 - DNA, 13 bp, D. melanogaster
caaattgattgtt

SEQ ID NO: 598597 - DNA, 13 bp, D. melanogaster
caaattgatttat

SEQ ID NO: 598598 - DNA, 13 bp, D. melanogaster
caaattgatttcg

SEQ ID NO: 598599 - DNA, 14 bp, D. melanogaster
caaattgatttgtt

SEQ ID NO: 598600 - DNA, 14 bp, D. melanogaster
caaattgcaaaata

SEQ ID NO: 598601 - DNA, 14 bp, D. melanogaster
caaattgcaaattg

SEQ ID NO: 598602 - DNA, 13 bp, D. melanogaster
caaattgcaactg

SEQ ID NO: 598603 - DNA, 13 bp, D. melanogaster
caaattgcaataa

SEQ ID NO: 598604 - DNA, 13 bp, D. melanogaster
caaattgcaatga

SEQ ID NO: 598605 - DNA, 13 bp, D. melanogaster
caaattgcaatta

SEQ ID NO: 598606 - DNA, 13 bp, D. melanogaster
caaattgcaattg

SEQ ID NO: 598607 - DNA, 14 bp, D. melanogaster
caaattgcaattgc

SEQ ID NO: 598608 - DNA, 13 bp, D. melanogaster
caaattgcagaaa

SEQ ID NO: 598609 - DNA, 13 bp, D. melanogaster
caaattgcagcca

SEQ ID NO: 598610 - DNA, 13 bp, D. melanogaster
caaattgcagttt

SEQ ID NO: 598611 - DNA, 13 bp, D. melanogaster
caaattgcataaa

SEQ ID NO: 598612 - DNA, 13 bp, D. melanogaster
caaattgcatgca

SEQ ID NO: 598613 - DNA, 13 bp, D. melanogaster
caaattgcattgc

SEQ ID NO: 598614 - DNA, 13 bp, D. melanogaster
caaattgcatttg

SEQ ID NO: 598615 - DNA, 14 bp, D. melanogaster
caaattgcatttgc

SEQ ID NO: 598616 - DNA, 14 bp, D. melanogaster
caaattgcatttta

SEQ ID NO: 598617 - DNA, 13 bp, D. melanogaster
caaattgccaaaa

SEQ ID NO: 598618 - DNA, 13 bp, D. melanogaster
caaattgccaaag

SEQ ID NO: 598619 - DNA, 13 bp, D. melanogaster
caaattgccaaca

SEQ ID NO: 598620 - DNA, 13 bp, D. melanogaster
caaattgccaaga

SEQ ID NO: 598621 - DNA, 13 bp, D. melanogaster
caaattgccaagt

SEQ ID NO: 598622 - DNA, 13 bp, D. melanogaster
caaattgccagca

SEQ ID NO: 598623 - DNA, 13 bp, D. melanogaster
caaattgccagtt

SEQ ID NO: 598624 - DNA, 13 bp, D. melanogaster
caaattgccatca

SEQ ID NO: 598625 - DNA, 13 bp, D. melanogaster
caaattgcgtata

SEQ ID NO: 598626 - DNA, 13 bp, D. melanogaster
caaattgcgtttg

SEQ ID NO: 598627 - DNA, 13 bp, D. melanogaster
caaattgctaaat

SEQ ID NO: 598628 - DNA, 13 bp, D. melanogaster
caaattgctattt

SEQ ID NO: 598629 - DNA, 14 bp, D. melanogaster
caaattgctgacca

SEQ ID NO: 598630 - DNA, 13 bp, D. melanogaster
caaattgctgctg

SEQ ID NO: 598631 - DNA, 13 bp, D. melanogaster
caaattgctggca

SEQ ID NO: 598632 - DNA, 13 bp, D. melanogaster
caaattgctttgc

SEQ ID NO: 598633 - DNA, 13 bp, D. melanogaster
caaattgctttgt

SEQ ID NO: 598634 - DNA, 13 bp, D. melanogaster
caaattggaaaat

SEQ ID NO: 598635 - DNA, 13 bp, D. melanogaster
caaattggaaatt

SEQ ID NO: 598636 - DNA, 13 bp, D. melanogaster
caaattggaccag

SEQ ID NO: 598637 - DNA, 13 bp, D. melanogaster
caaattggattga

SEQ ID NO: 598638 - DNA, 14 bp, D. melanogaster
caaattggatttaa

SEQ ID NO: 598639 - DNA, 13 bp, D. melanogaster
caaattggcaaat

SEQ ID NO: 598640 - DNA, 13 bp, D. melanogaster
caaattggcaact

SEQ ID NO: 598641 - DNA, 13 bp, D. melanogaster
caaattggcaatc

SEQ ID NO: 598642 - DNA, 13 bp, D. melanogaster
caaattggcagca

SEQ ID NO: 598643 - DNA, 13 bp, D. melanogaster
caaattggccaag

SEQ ID NO: 598644 - DNA, 13 bp, D. melanogaster
caaattggccaat

SEQ ID NO: 598645 - DNA, 13 bp, D. melanogaster
caaattggctaaa

SEQ ID NO: 598646 - DNA, 13 bp, D. melanogaster
caaattggcttaa

SEQ ID NO: 598647 - DNA, 14 bp, D. melanogaster
caaattgggtttgc

SEQ ID NO: 598648 - DNA, 13 bp, D. melanogaster
caaattggtgggc

SEQ ID NO: 598649 - DNA, 13 bp, D. melanogaster
caaattggttttc

SEQ ID NO: 598650 - DNA, 13 bp, D. melanogaster
caaattgtaaaca

SEQ ID NO: 598651 - DNA, 13 bp, D. melanogaster
caaattgtaaata

SEQ ID NO: 598652 - DNA, 13 bp, D. melanogaster
caaattgtaacca

SEQ ID NO: 598653 - DNA, 13 bp, D. melanogaster
caaattgtaatta

SEQ ID NO: 598654 - DNA, 13 bp, D. melanogaster
caaattgtatgca

SEQ ID NO: 598655 - DNA, 13 bp, D. melanogaster
caaattgtcaaat

SEQ ID NO: 598656 - DNA, 13 bp, D. melanogaster
caaattgtcattt

SEQ ID NO: 598657 - DNA, 13 bp, D. melanogaster
caaattgtggcaa

SEQ ID NO: 598658 - DNA, 13 bp, D. melanogaster
caaattgtggcca

SEQ ID NO: 598659 - DNA, 13 bp, D. melanogaster
caaattgtgtatt

SEQ ID NO: 598660 - DNA, 13 bp, D. melanogaster
caaattgtgtttg

SEQ ID NO: 598661 - DNA, 13 bp, D. melanogaster
caaattgtgtttt

SEQ ID NO: 598662 - DNA, 13 bp, D. melanogaster
caaattgttaaca

SEQ ID NO: 598663 - DNA, 13 bp, D. melanogaster
caaattgttattg

SEQ ID NO: 598664 - DNA, 13 bp, D. melanogaster
caaattgttgaaa

SEQ ID NO: 598665 - DNA, 14 bp, D. melanogaster
caaattgttgaatt

SEQ ID NO: 598666 - DNA, 13 bp, D. melanogaster
caaattgttgaca

SEQ ID NO: 598667 - DNA, 13 bp, D. melanogaster
caaattgttgcac

SEQ ID NO: 598668 - DNA, 13 bp, D. melanogaster
caaattgttggcc

SEQ ID NO: 598669 - DNA, 13 bp, D. melanogaster
caaattgttgtgc

SEQ ID NO: 598670 - DNA, 13 bp, D. melanogaster
caaattgttgttg

SEQ ID NO: 598671 - DNA, 14 bp, D. melanogaster
caaattgtttattt

SEQ ID NO: 598672 - DNA, 13 bp, D. melanogaster
caaattgtttgcc

SEQ ID NO: 598673 - DNA, 13 bp, D. melanogaster
caaattgttttcg

SEQ ID NO: 598674 - DNA, 13 bp, D. melanogaster
caaattgttttta

SEQ ID NO: 598675 - DNA, 13 bp, D. melanogaster
caaatttaaaaag

SEQ ID NO: 598676 - DNA, 14 bp, D. melanogaster
caaatttaaaaagc

SEQ ID NO: 598677 - DNA, 13 bp, D. melanogaster
caaatttaaacta

SEQ ID NO: 598678 - DNA, 14 bp, D. melanogaster
caaatttaaatgaa

SEQ ID NO: 598679 - DNA, 13 bp, D. melanogaster
caaatttaacagc

SEQ ID NO: 598680 - DNA, 13 bp, D. melanogaster
caaatttaagtta

SEQ ID NO: 598681 - DNA, 13 bp, D. melanogaster
caaatttaagttt

SEQ ID NO: 598682 - DNA, 13 bp, D. melanogaster
caaatttaattcg

SEQ ID NO: 598683 - DNA, 13 bp, D. melanogaster
caaatttacaatg

SEQ ID NO: 598684 - DNA, 13 bp, D. melanogaster
caaatttacactt

SEQ ID NO: 598685 - DNA, 13 bp, D. melanogaster
caaatttacataa

SEQ ID NO: 598686 - DNA, 13 bp, D. melanogaster
caaatttacattt

SEQ ID NO: 598687 - DNA, 13 bp, D. melanogaster
caaatttagattt

SEQ ID NO: 598688 - DNA, 14 bp, D. melanogaster
caaatttatcgcac

SEQ ID NO: 598689 - DNA, 13 bp, D. melanogaster
caaatttatgaaa

SEQ ID NO: 598690 - DNA, 13 bp, D. melanogaster
caaatttatgaca

SEQ ID NO: 598691 - DNA, 13 bp, D. melanogaster
caaatttatgggc

SEQ ID NO: 598692 - DNA, 13 bp, D. melanogaster
caaatttatgtgc

SEQ ID NO: 598693 - DNA, 13 bp, D. melanogaster
caaatttattcaa

SEQ ID NO: 598694 - DNA, 13 bp, D. melanogaster
caaatttatttca

SEQ ID NO: 598695 - DNA, 13 bp, D. melanogaster
caaatttatttgg

SEQ ID NO: 598696 - DNA, 13 bp, D. melanogaster
caaatttatttgt

SEQ ID NO: 598697 - DNA, 14 bp, D. melanogaster
caaatttatttgtt

SEQ ID NO: 598698 - DNA, 13 bp, D. melanogaster
caaatttcaaata

SEQ ID NO: 598699 - DNA, 13 bp, D. melanogaster
caaatttcaaatg

SEQ ID NO: 598700 - DNA, 13 bp, D. melanogaster
caaatttcaatag

SEQ ID NO: 598701 - DNA, 13 bp, D. melanogaster
caaatttcacatt

SEQ ID NO: 598702 - DNA, 13 bp, D. melanogaster
caaatttcactta

SEQ ID NO: 598703 - DNA, 15 bp, D. melanogaster
caaatttcagatcta

SEQ ID NO: 598704 - DNA, 13 bp, D. melanogaster
caaatttcagttt

SEQ ID NO: 598705 - DNA, 14 bp, D. melanogaster
caaatttcagtttg

SEQ ID NO: 598706 - DNA, 13 bp, D. melanogaster
caaatttcataat

SEQ ID NO: 598707 - DNA, 13 bp, D. melanogaster
caaatttcatatt

SEQ ID NO: 598708 - DNA, 13 bp, D. melanogaster
caaatttcatttc

SEQ ID NO: 598709 - DNA, 14 bp, D. melanogaster
caaatttcatttca

SEQ ID NO: 598710 - DNA, 13 bp, D. melanogaster
caaatttccactc

SEQ ID NO: 598711 - DNA, 13 bp, D. melanogaster
caaatttccactt

SEQ ID NO: 598712 - DNA, 13 bp, D. melanogaster
caaatttccgatt

SEQ ID NO: 598713 - DNA, 14 bp, D. melanogaster
caaatttccttttt

SEQ ID NO: 598714 - DNA, 13 bp, D. melanogaster
caaatttcgaaaa

SEQ ID NO: 598715 - DNA, 13 bp, D. melanogaster
caaatttcgaata

SEQ ID NO: 598716 - DNA, 13 bp, D. melanogaster
caaatttcgcttt

SEQ ID NO: 598717 - DNA, 13 bp, D. melanogaster
caaatttctcgca

SEQ ID NO: 598718 - DNA, 13 bp, D. melanogaster
caaatttctcgtt

SEQ ID NO: 598719 - DNA, 13 bp, D. melanogaster
caaatttctcttc

SEQ ID NO: 598720 - DNA, 13 bp, D. melanogaster
caaatttgaacaa

SEQ ID NO: 598721 - DNA, 13 bp, D. melanogaster
caaatttgaagta

SEQ ID NO: 598722 - DNA, 13 bp, D. melanogaster
caaatttgaataa

SEQ ID NO: 598723 - DNA, 13 bp, D. melanogaster
caaatttgaatat

SEQ ID NO: 598724 - DNA, 13 bp, D. melanogaster
caaatttgatttg

SEQ ID NO: 598725 - DNA, 13 bp, D. melanogaster
caaatttgcacag

SEQ ID NO: 598726 - DNA, 14 bp, D. melanogaster
caaatttgcatatt

SEQ ID NO: 598727 - DNA, 13 bp, D. melanogaster
caaatttgcatta

SEQ ID NO: 598728 - DNA, 13 bp, D. melanogaster
caaatttgcattg

SEQ ID NO: 598729 - DNA, 13 bp, D. melanogaster
caaatttggcaaa

SEQ ID NO: 598730 - DNA, 13 bp, D. melanogaster
caaatttgtaaca

SEQ ID NO: 598731 - DNA, 13 bp, D. melanogaster
caaatttgtaatg

SEQ ID NO: 598732 - DNA, 13 bp, D. melanogaster
caaatttgtaatt

SEQ ID NO: 598733 - DNA, 13 bp, D. melanogaster
caaatttgtatgc

SEQ ID NO: 598734 - DNA, 13 bp, D. melanogaster
caaatttgttata

SEQ ID NO: 598735 - DNA, 13 bp, D. melanogaster
caaatttgttatt

SEQ ID NO: 598736 - DNA, 13 bp, D. melanogaster
caaatttgttcaa

SEQ ID NO: 598737 - DNA, 13 bp, D. melanogaster
caaatttgttgcc

SEQ ID NO: 598738 - DNA, 13 bp, D. melanogaster
caaattttaaagg

SEQ ID NO: 598739 - DNA, 13 bp, D. melanogaster
caaattttaagtt

SEQ ID NO: 598740 - DNA, 14 bp, D. melanogaster
caaattttaagttt

SEQ ID NO: 598741 - DNA, 13 bp, D. melanogaster
caaattttaatga

SEQ ID NO: 598742 - DNA, 13 bp, D. melanogaster
caaattttacaaa

SEQ ID NO: 598743 - DNA, 13 bp, D. melanogaster
caaattttacatt

SEQ ID NO: 598744 - DNA, 13 bp, D. melanogaster
caaattttataga

SEQ ID NO: 598745 - DNA, 13 bp, D. melanogaster
caaattttatgca

SEQ ID NO: 598746 - DNA, 13 bp, D. melanogaster
caaattttattca

SEQ ID NO: 598747 - DNA, 13 bp, D. melanogaster
caaattttcactt

SEQ ID NO: 598748 - DNA, 13 bp, D. melanogaster
caaattttcatat

SEQ ID NO: 598749 - DNA, 13 bp, D. melanogaster
caaattttcgcat

SEQ ID NO: 598750 - DNA, 13 bp, D. melanogaster
caaattttcggag

SEQ ID NO: 598751 - DNA, 13 bp, D. melanogaster
caaattttctaat

SEQ ID NO: 598752 - DNA, 13 bp, D. melanogaster
caaattttcttat

SEQ ID NO: 598753 - DNA, 14 bp, D. melanogaster
caaattttgatttt

SEQ ID NO: 598754 - DNA, 13 bp, D. melanogaster
caaattttgtatt

SEQ ID NO: 598755 - DNA, 14 bp, D. melanogaster
caaattttgtcttt

SEQ ID NO: 598756 - DNA, 13 bp, D. melanogaster
caaattttgtgtg

SEQ ID NO: 598757 - DNA, 13 bp, D. melanogaster
caaattttgtgtt

SEQ ID NO: 598758 - DNA, 13 bp, D. melanogaster
caaattttgtttg

SEQ ID NO: 598759 - DNA, 13 bp, D. melanogaster
caaatttttaact

SEQ ID NO: 598760 - DNA, 13 bp, D. melanogaster
caaatttttacaa

SEQ ID NO: 598761 - DNA, 13 bp, D. melanogaster
caaatttttatac

SEQ ID NO: 598762 - DNA, 14 bp, D. melanogaster
caaatttttataca

SEQ ID NO: 598763 - DNA, 14 bp, D. melanogaster
caaatttttatgat

SEQ ID NO: 598764 - DNA, 13 bp, D. melanogaster
caaatttttcaat

SEQ ID NO: 598765 - DNA, 13 bp, D. melanogaster
caaatttttctgc

SEQ ID NO: 598766 - DNA, 13 bp, D. melanogaster
caaatttttgaaa

SEQ ID NO: 598767 - DNA, 13 bp, D. melanogaster
caaatttttgaat

SEQ ID NO: 598768 - DNA, 15 bp, D. melanogaster
caaatttttgagcat

SEQ ID NO: 598769 - DNA, 13 bp, D. melanogaster
caaatttttgcaa

SEQ ID NO: 598770 - DNA, 14 bp, D. melanogaster
caacaaaaacaatg

SEQ ID NO: 598771 - DNA, 13 bp, D. melanogaster
caacaaaaacatg

SEQ ID NO: 598772 - DNA, 13 bp, D. melanogaster
caacaaaaacggc

SEQ ID NO: 598773 - DNA, 13 bp, D. melanogaster
caacaaaaactgg

SEQ ID NO: 598774 - DNA, 13 bp, D. melanogaster
caacaaaaacttc

SEQ ID NO: 598775 - DNA, 13 bp, D. melanogaster
caacaaaaagtat

SEQ ID NO: 598776 - DNA, 13 bp, D. melanogaster
caacaaaaagttt

SEQ ID NO: 598777 - DNA, 13 bp, D. melanogaster
caacaaaaatgat

SEQ ID NO: 598778 - DNA, 13 bp, D. melanogaster
caacaaaaatggc

SEQ ID NO: 598779 - DNA, 13 bp, D. melanogaster
caacaaaacaatg

SEQ ID NO: 598780 - DNA, 13 bp, D. melanogaster
caacaaaagaatt

SEQ ID NO: 598781 - DNA, 13 bp, D. melanogaster
caacaaaagcaat

SEQ ID NO: 598782 - DNA, 14 bp, D. melanogaster
caacaaaagcaata

SEQ ID NO: 598783 - DNA, 13 bp, D. melanogaster
caacaaaagcagc

SEQ ID NO: 598784 - DNA, 13 bp, D. melanogaster
caacaaaagcgac

SEQ ID NO: 598785 - DNA, 13 bp, D. melanogaster
caacaaaagtata

SEQ ID NO: 598786 - DNA, 13 bp, D. melanogaster
caacaaaagtgca

SEQ ID NO: 598787 - DNA, 13 bp, D. melanogaster
caacaaaagttgc

SEQ ID NO: 598788 - DNA, 13 bp, D. melanogaster
caacaaaagtttc

SEQ ID NO: 598789 - DNA, 13 bp, D. melanogaster
caacaaaatattt

SEQ ID NO: 598790 - DNA, 13 bp, D. melanogaster
caacaaaatcatt

SEQ ID NO: 598791 - DNA, 13 bp, D. melanogaster
caacaaaatcgat

SEQ ID NO: 598792 - DNA, 13 bp, D. melanogaster
caacaaaatgaat

SEQ ID NO: 598793 - DNA, 13 bp, D. melanogaster
caacaaaatgcaa

SEQ ID NO: 598794 - DNA, 13 bp, D. melanogaster
caacaaaatgctg

SEQ ID NO: 598795 - DNA, 13 bp, D. melanogaster
caacaaaatggaa

SEQ ID NO: 598796 - DNA, 13 bp, D. melanogaster
caacaaaatggca

SEQ ID NO: 598797 - DNA, 13 bp, D. melanogaster
caacaaaatgtca

SEQ ID NO: 598798 - DNA, 13 bp, D. melanogaster
caacaaaatgttt

SEQ ID NO: 598799 - DNA, 13 bp, D. melanogaster
caacaaaattgaa

SEQ ID NO: 598800 - DNA, 13 bp, D. melanogaster
caacaaacaactt

SEQ ID NO: 598801 - DNA, 13 bp, D. melanogaster
caacaaacaattt

SEQ ID NO: 598802 - DNA, 14 bp, D. melanogaster
caacaaacacttat

SEQ ID NO: 598803 - DNA, 13 bp, D. melanogaster
caacaaacagcga

SEQ ID NO: 598804 - DNA, 13 bp, D. melanogaster
caacaaacatttc

SEQ ID NO: 598805 - DNA, 13 bp, D. melanogaster
caacaaactgcat

SEQ ID NO: 598806 - DNA, 13 bp, D. melanogaster
caacaaactgtcg

SEQ ID NO: 598807 - DNA, 13 bp, D. melanogaster
caacaaacttgag

SEQ ID NO: 598808 - DNA, 13 bp, D. melanogaster
caacaaagaaatt

SEQ ID NO: 598809 - DNA, 13 bp, D. melanogaster
caacaaagaatgc

SEQ ID NO: 598810 - DNA, 13 bp, D. melanogaster
caacaaagagcca

SEQ ID NO: 598811 - DNA, 14 bp, D. melanogaster
caacaaagaggcaa

SEQ ID NO: 598812 - DNA, 13 bp, D. melanogaster
caacaaagatcac

SEQ ID NO: 598813 - DNA, 13 bp, D. melanogaster
caacaaagcaaat

SEQ ID NO: 598814 - DNA, 13 bp, D. melanogaster
caacaaaggcaga

SEQ ID NO: 598815 - DNA, 14 bp, D. melanogaster
caacaaaggcgaaa

SEQ ID NO: 598816 - DNA, 13 bp, D. melanogaster
caacaaagtcaaa

SEQ ID NO: 598817 - DNA, 13 bp, D. melanogaster
caacaaagtgctg

SEQ ID NO: 598818 - DNA, 14 bp, D. melanogaster
caacaaagtgctgc

SEQ ID NO: 598819 - DNA, 13 bp, D. melanogaster
caacaaagtggac

SEQ ID NO: 598820 - DNA, 13 bp, D. melanogaster
caacaaagttgca

SEQ ID NO: 598821 - DNA, 13 bp, D. melanogaster
caacaaataaacg

SEQ ID NO: 598822 - DNA, 13 bp, D. melanogaster
caacaaataattt

SEQ ID NO: 598823 - DNA, 13 bp, D. melanogaster
caacaaatagaca

SEQ ID NO: 598824 - DNA, 13 bp, D. melanogaster
caacaaatattta

SEQ ID NO: 598825 - DNA, 13 bp, D. melanogaster
caacaaatatttt

SEQ ID NO: 598826 - DNA, 13 bp, D. melanogaster
caacaaatcaatt

SEQ ID NO: 598827 - DNA, 13 bp, D. melanogaster
caacaaatcagca

SEQ ID NO: 598828 - DNA, 13 bp, D. melanogaster
caacaaatcattt

SEQ ID NO: 598829 - DNA, 13 bp, D. melanogaster
caacaaatgccaa

SEQ ID NO: 598830 - DNA, 13 bp, D. melanogaster
caacaaatgccat

SEQ ID NO: 598831 - DNA, 13 bp, D. melanogaster
caacaaatgcgaa

SEQ ID NO: 598832 - DNA, 13 bp, D. melanogaster
caacaaatgcttt

SEQ ID NO: 598833 - DNA, 13 bp, D. melanogaster
caacaaatgtaaa

SEQ ID NO: 598834 - DNA, 13 bp, D. melanogaster
caacaaatgtaat

SEQ ID NO: 598835 - DNA, 13 bp, D. melanogaster
caacaaattatcc

SEQ ID NO: 598836 - DNA, 13 bp, D. melanogaster
caacaaattatgc

SEQ ID NO: 598837 - DNA, 13 bp, D. melanogaster
caacaaattccaa

SEQ ID NO: 598838 - DNA, 13 bp, D. melanogaster
caacaaattgaat

SEQ ID NO: 598839 - DNA, 13 bp, D. melanogaster
caacaaattgcat

SEQ ID NO: 598840 - DNA, 13 bp, D. melanogaster
caacaaattgcca

SEQ ID NO: 598841 - DNA, 14 bp, D. melanogaster
caacaaattgccaa

SEQ ID NO: 598842 - DNA, 13 bp, D. melanogaster
caacaaattgtat

SEQ ID NO: 598843 - DNA, 13 bp, D. melanogaster
caacaaattgtta

SEQ ID NO: 598844 - DNA, 13 bp, D. melanogaster
caacaaattgttt

SEQ ID NO: 598845 - DNA, 13 bp, D. melanogaster
caacaaatttaca

SEQ ID NO: 598846 - DNA, 13 bp, D. melanogaster
caacaaatttata

SEQ ID NO: 598847 - DNA, 13 bp, D. melanogaster
caacaaatttatg

SEQ ID NO: 598848 - DNA, 13 bp, D. melanogaster
caacaaatttatt

SEQ ID NO: 598849 - DNA, 14 bp, D. melanogaster
caacaaatttcaat

SEQ ID NO: 598850 - DNA, 13 bp, D. melanogaster
caacaaattttaa

SEQ ID NO: 598851 - DNA, 13 bp, D. melanogaster
caacaaattttca

SEQ ID NO: 598852 - DNA, 13 bp, D. melanogaster
caacaaattttcc

SEQ ID NO: 598853 - DNA, 14 bp, D. melanogaster
caacaacaaaaagt

SEQ ID NO: 598854 - DNA, 13 bp, D. melanogaster
caacaacaaaatg

SEQ ID NO: 598855 - DNA, 14 bp, D. melanogaster
caacaacaaaatga

SEQ ID NO: 598856 - DNA, 13 bp, D. melanogaster
caacaacaaagcg

SEQ ID NO: 598857 - DNA, 13 bp, D. melanogaster
caacaacaaaggc

SEQ ID NO: 598858 - DNA, 14 bp, D. melanogaster
caacaacaaatgaa

SEQ ID NO: 598859 - DNA, 13 bp, D. melanogaster
caacaacaaatgc

SEQ ID NO: 598860 - DNA, 14 bp, D. melanogaster
caacaacaaatgca

SEQ ID NO: 598861 - DNA, 13 bp, D. melanogaster
caacaacaaatgg

SEQ ID NO: 598862 - DNA, 13 bp, D. melanogaster
caacaacaaattg

SEQ ID NO: 598863 - DNA, 14 bp, D. melanogaster
caacaacaaattgg

SEQ ID NO: 598864 - DNA, 14 bp, D. melanogaster
caacaacaacaatg

SEQ ID NO: 598865 - DNA, 14 bp, D. melanogaster
caacaacaacagct

SEQ ID NO: 598866 - DNA, 14 bp, D. melanogaster
caacaacaacatcg

SEQ ID NO: 598867 - DNA, 13 bp, D. melanogaster
caacaacaacatt

SEQ ID NO: 598868 - DNA, 14 bp, D. melanogaster
caacaacaacgacg

SEQ ID NO: 598869 - DNA, 13 bp, D. melanogaster
caacaacaacgat

SEQ ID NO: 598870 - DNA, 13 bp, D. melanogaster
caacaacaacgct

SEQ ID NO: 598871 - DNA, 13 bp, D. melanogaster
caacaacaacggg

SEQ ID NO: 598872 - DNA, 13 bp, D. melanogaster
caacaacaactag

SEQ ID NO: 598873 - DNA, 13 bp, D. melanogaster
caacaacaactcg

SEQ ID NO: 598874 - DNA, 13 bp, D. melanogaster
caacaacaactga

SEQ ID NO: 598875 - DNA, 13 bp, D. melanogaster
caacaacaactgc

SEQ ID NO: 598876 - DNA, 14 bp, D. melanogaster
caacaacaactgcg

SEQ ID NO: 598877 - DNA, 13 bp, D. melanogaster
caacaacaactgt

SEQ ID NO: 598878 - DNA, 13 bp, D. melanogaster
caacaacaacttt

SEQ ID NO: 598879 - DNA, 13 bp, D. melanogaster
caacaacaagagc

SEQ ID NO: 598880 - DNA, 14 bp, D. melanogaster
caacaacaagagcg

SEQ ID NO: 598881 - DNA, 13 bp, D. melanogaster
caacaacaagatg

SEQ ID NO: 598882 - DNA, 13 bp, D. melanogaster
caacaacaagccg

SEQ ID NO: 598883 - DNA, 13 bp, D. melanogaster
caacaacaaggac

SEQ ID NO: 598884 - DNA, 13 bp, D. melanogaster
caacaacaagtga

SEQ ID NO: 598885 - DNA, 13 bp, D. melanogaster
caacaacaagtgc

SEQ ID NO: 598886 - DNA, 13 bp, D. melanogaster
caacaacaagtgg

SEQ ID NO: 598887 - DNA, 13 bp, D. melanogaster
caacaacaatatg

SEQ ID NO: 598888 - DNA, 13 bp, D. melanogaster
caacaacaatcag

SEQ ID NO: 598889 - DNA, 13 bp, D. melanogaster
caacaacaatgca

SEQ ID NO: 598890 - DNA, 14 bp, D. melanogaster
caacaacaatgcca

SEQ ID NO: 598891 - DNA, 13 bp, D. melanogaster
caacaacaatgcg

SEQ ID NO: 598892 - DNA, 14 bp, D. melanogaster
caacaacaatgcga

SEQ ID NO: 598893 - DNA, 13 bp, D. melanogaster
caacaacaatgga

SEQ ID NO: 598894 - DNA, 13 bp, D. melanogaster
caacaacaatggc

SEQ ID NO: 598895 - DNA, 14 bp, D. melanogaster
caacaacaatggca

SEQ ID NO: 598896 - DNA, 14 bp, D. melanogaster
caacaacaatggcg

SEQ ID NO: 598897 - DNA, 13 bp, D. melanogaster
caacaacaatgtc

SEQ ID NO: 598898 - DNA, 13 bp, D. melanogaster
caacaacaatgtg

SEQ ID NO: 598899 - DNA, 13 bp, D. melanogaster
caacaacaattga

SEQ ID NO: 598900 - DNA, 14 bp, D. melanogaster
caacaacaattgct

SEQ ID NO: 598901 - DNA, 13 bp, D. melanogaster
caacaacaattgg

SEQ ID NO: 598902 - DNA, 13 bp, D. melanogaster
caacaacaattta

SEQ ID NO: 598903 - DNA, 13 bp, D. melanogaster
caacaacaatttg

SEQ ID NO: 598904 - DNA, 13 bp, D. melanogaster
caacaacagaaat

SEQ ID NO: 598905 - DNA, 13 bp, D. melanogaster
caacaacagagca

SEQ ID NO: 598906 - DNA, 14 bp, D. melanogaster
caacaacagcaacg

SEQ ID NO: 598907 - DNA, 14 bp, D. melanogaster
caacaacagcaata

SEQ ID NO: 598908 - DNA, 13 bp, D. melanogaster
caacaacagcaga

SEQ ID NO: 598909 - DNA, 14 bp, D. melanogaster
caacaacagcagcc

SEQ ID NO: 598910 - DNA, 13 bp, D. melanogaster
caacaacagcagg

SEQ ID NO: 598911 - DNA, 13 bp, D. melanogaster
caacaacagccat

SEQ ID NO: 598912 - DNA, 14 bp, D. melanogaster
caacaacagcgaca

SEQ ID NO: 598913 - DNA, 13 bp, D. melanogaster
caacaacagcgca

SEQ ID NO: 598914 - DNA, 13 bp, D. melanogaster
caacaacagcgcc

SEQ ID NO: 598915 - DNA, 13 bp, D. melanogaster
caacaacagcggc

SEQ ID NO: 598916 - DNA, 13 bp, D. melanogaster
caacaacagctac

SEQ ID NO: 598917 - DNA, 14 bp, D. melanogaster
caacaacagctaca

SEQ ID NO: 598918 - DNA, 13 bp, D. melanogaster
caacaacagctga

SEQ ID NO: 598919 - DNA, 13 bp, D. melanogaster
caacaacagctgc

SEQ ID NO: 598920 - DNA, 13 bp, D. melanogaster
caacaacagctgg

SEQ ID NO: 598921 - DNA, 13 bp, D. melanogaster
caacaacaggagc

SEQ ID NO: 598922 - DNA, 13 bp, D. melanogaster
caacaacagtttc

SEQ ID NO: 598923 - DNA, 13 bp, D. melanogaster
caacaacataatt

SEQ ID NO: 598924 - DNA, 13 bp, D. melanogaster
caacaacatcagc

SEQ ID NO: 598925 - DNA, 14 bp, D. melanogaster
caacaacatcagca

SEQ ID NO: 598926 - DNA, 13 bp, D. melanogaster
caacaacatctct

SEQ ID NO: 598927 - DNA, 13 bp, D. melanogaster
caacaacatggca

SEQ ID NO: 598928 - DNA, 13 bp, D. melanogaster
caacaacattaag

SEQ ID NO: 598929 - DNA, 14 bp, D. melanogaster
caacaacattaagt

SEQ ID NO: 598930 - DNA, 13 bp, D. melanogaster
caacaacatttaa

SEQ ID NO: 598931 - DNA, 13 bp, D. melanogaster
caacaaccacatt

SEQ ID NO: 598932 - DNA, 13 bp, D. melanogaster
caacaacccggtt

SEQ ID NO: 598933 - DNA, 13 bp, D. melanogaster
caacaacgaaatt

SEQ ID NO: 598934 - DNA, 13 bp, D. melanogaster
caacaacgacaat

SEQ ID NO: 598935 - DNA, 13 bp, D. melanogaster
caacaacgacagc

SEQ ID NO: 598936 - DNA, 13 bp, D. melanogaster
caacaacgacatc

SEQ ID NO: 598937 - DNA, 14 bp, D. melanogaster
caacaacgacatca

SEQ ID NO: 598938 - DNA, 14 bp, D. melanogaster
caacaacggcaaca

SEQ ID NO: 598939 - DNA, 13 bp, D. melanogaster
caacaacggcaat

SEQ ID NO: 598940 - DNA, 14 bp, D. melanogaster
caacaacggcaatg

SEQ ID NO: 598941 - DNA, 13 bp, D. melanogaster
caacaacggcgac

SEQ ID NO: 598942 - DNA, 13 bp, D. melanogaster
caacaacggcggc

SEQ ID NO: 598943 - DNA, 13 bp, D. melanogaster
caacaactcaact

SEQ ID NO: 598944 - DNA, 13 bp, D. melanogaster
caacaactcaatt

SEQ ID NO: 598945 - DNA, 13 bp, D. melanogaster
caacaactgaacg

SEQ ID NO: 598946 - DNA, 13 bp, D. melanogaster
caacaactgcagc

SEQ ID NO: 598947 - DNA, 14 bp, D. melanogaster
caacaactgcagca

SEQ ID NO: 598948 - DNA, 13 bp, D. melanogaster
caacaactgctgc

SEQ ID NO: 598949 - DNA, 13 bp, D. melanogaster
caacaactggcaa

SEQ ID NO: 598950 - DNA, 13 bp, D. melanogaster
caacaactgttgc

SEQ ID NO: 598951 - DNA, 13 bp, D. melanogaster
caacaacttacac

SEQ ID NO: 598952 - DNA, 13 bp, D. melanogaster
caacaacttccag

SEQ ID NO: 598953 - DNA, 13 bp, D. melanogaster
caacaacttggcc

SEQ ID NO: 598954 - DNA, 13 bp, D. melanogaster
caacaactttaaa

SEQ ID NO: 598955 - DNA, 13 bp, D. melanogaster
caacaacttttcc

SEQ ID NO: 598956 - DNA, 13 bp, D. melanogaster
caacaacttttta

SEQ ID NO: 598957 - DNA, 13 bp, D. melanogaster
caacaagaaatac

SEQ ID NO: 598958 - DNA, 13 bp, D. melanogaster
caacaagaacaat

SEQ ID NO: 598959 - DNA, 13 bp, D. melanogaster
caacaagaacagc

SEQ ID NO: 598960 - DNA, 14 bp, D. melanogaster
caacaagagcagca

SEQ ID NO: 598961 - DNA, 13 bp, D. melanogaster
caacaagagcgga

SEQ ID NO: 598962 - DNA, 13 bp, D. melanogaster
caacaagcaacat

SEQ ID NO: 598963 - DNA, 13 bp, D. melanogaster
caacaagcaattt

SEQ ID NO: 598964 - DNA, 13 bp, D. melanogaster
caacaagccaaag

SEQ ID NO: 598965 - DNA, 13 bp, D. melanogaster
caacaagccgaaa

SEQ ID NO: 598966 - DNA, 13 bp, D. melanogaster
caacaagctgaca

SEQ ID NO: 598967 - DNA, 13 bp, D. melanogaster
caacaagctgcca

SEQ ID NO: 598968 - DNA, 13 bp, D. melanogaster
caacaagcttttc

SEQ ID NO: 598969 - DNA, 13 bp, D. melanogaster
caacaagtccaat

SEQ ID NO: 598970 - DNA, 13 bp, D. melanogaster
caacaagtggaaa

SEQ ID NO: 598971 - DNA, 13 bp, D. melanogaster
caacaagtggcaa

SEQ ID NO: 598972 - DNA, 13 bp, D. melanogaster
caacaagttcgct

SEQ ID NO: 598973 - DNA, 13 bp, D. melanogaster
caacaagttgcaa

SEQ ID NO: 598974 - DNA, 13 bp, D. melanogaster
caacaagttgcag

SEQ ID NO: 598975 - DNA, 13 bp, D. melanogaster
caacaagttgcca

SEQ ID NO: 598976 - DNA, 13 bp, D. melanogaster
caacaagttgtgt

SEQ ID NO: 598977 - DNA, 13 bp, D. melanogaster
caacaagttgttg

SEQ ID NO: 598978 - DNA, 13 bp, D. melanogaster
caacaataaaacg

SEQ ID NO: 598979 - DNA, 13 bp, D. melanogaster
caacaataaaagt

SEQ ID NO: 598980 - DNA, 13 bp, D. melanogaster
caacaataaaatg

SEQ ID NO: 598981 - DNA, 13 bp, D. melanogaster
caacaataaattt

SEQ ID NO: 598982 - DNA, 14 bp, D. melanogaster
caacaataaatttt

SEQ ID NO: 598983 - DNA, 14 bp, D. melanogaster
caacaataacaacg

SEQ ID NO: 598984 - DNA, 13 bp, D. melanogaster
caacaataacaag

SEQ ID NO: 598985 - DNA, 13 bp, D. melanogaster
caacaataacatt

SEQ ID NO: 598986 - DNA, 13 bp, D. melanogaster
caacaatacaatt

SEQ ID NO: 598987 - DNA, 13 bp, D. melanogaster
caacaatagcaac

SEQ ID NO: 598988 - DNA, 13 bp, D. melanogaster
caacaatataatg

SEQ ID NO: 598989 - DNA, 13 bp, D. melanogaster
caacaatataatt

SEQ ID NO: 598990 - DNA, 13 bp, D. melanogaster
caacaatatacat

SEQ ID NO: 598991 - DNA, 13 bp, D. melanogaster
caacaatatgttt

SEQ ID NO: 598992 - DNA, 13 bp, D. melanogaster
caacaatattcag

SEQ ID NO: 598993 - DNA, 13 bp, D. melanogaster
caacaatattttt

SEQ ID NO: 598994 - DNA, 13 bp, D. melanogaster
caacaatgaaaag

SEQ ID NO: 598995 - DNA, 13 bp, D. melanogaster
caacaatgcagac

SEQ ID NO: 598996 - DNA, 13 bp, D. melanogaster
caacaatggcaaa

SEQ ID NO: 598997 - DNA, 13 bp, D. melanogaster
caacaatggcaac

SEQ ID NO: 598998 - DNA, 13 bp, D. melanogaster
caacaatggcaag

SEQ ID NO: 598999 - DNA, 13 bp, D. melanogaster
caacaatggctgc

SEQ ID NO: 599000 - DNA, 13 bp, D. melanogaster
caacaatggttca

SEQ ID NO: 599001 - DNA, 13 bp, D. melanogaster
caacaatgtaaaa

SEQ ID NO: 599002 - DNA, 14 bp, D. melanogaster
caacaatgtctttt

SEQ ID NO: 599003 - DNA, 13 bp, D. melanogaster
caacaatgttgaa

SEQ ID NO: 599004 - DNA, 13 bp, D. melanogaster
caacaatgttgcc

SEQ ID NO: 599005 - DNA, 13 bp, D. melanogaster
caacaattaattg

SEQ ID NO: 599006 - DNA, 13 bp, D. melanogaster
caacaattaattt

SEQ ID NO: 599007 - DNA, 13 bp, D. melanogaster
caacaattactta

SEQ ID NO: 599008 - DNA, 13 bp, D. melanogaster
caacaattagcaa

SEQ ID NO: 599009 - DNA, 13 bp, D. melanogaster
caacaattatgca

SEQ ID NO: 599010 - DNA, 13 bp, D. melanogaster
caacaattcaatt

SEQ ID NO: 599011 - DNA, 13 bp, D. melanogaster
caacaattcactt

SEQ ID NO: 599012 - DNA, 13 bp, D. melanogaster
caacaattccaaa

SEQ ID NO: 599013 - DNA, 13 bp, D. melanogaster
caacaattgaaat

SEQ ID NO: 599014 - DNA, 14 bp, D. melanogaster
caacaattgcaatt

SEQ ID NO: 599015 - DNA, 13 bp, D. melanogaster
caacaattgcaca

SEQ ID NO: 599016 - DNA, 13 bp, D. melanogaster
caacaattgcagc

SEQ ID NO: 599017 - DNA, 13 bp, D. melanogaster
caacaattggcaa

SEQ ID NO: 599018 - DNA, 13 bp, D. melanogaster
caacaattgttgc

SEQ ID NO: 599019 - DNA, 13 bp, D. melanogaster
caacaatttacaa

SEQ ID NO: 599020 - DNA, 14 bp, D. melanogaster
caacaatttcaatt

SEQ ID NO: 599021 - DNA, 13 bp, D. melanogaster
caacaatttcatt

SEQ ID NO: 599022 - DNA, 13 bp, D. melanogaster
caacaatttcgtt

SEQ ID NO: 599023 - DNA, 13 bp, D. melanogaster
caacaatttcttt

SEQ ID NO: 599024 - DNA, 13 bp, D. melanogaster
caacaatttgatt

SEQ ID NO: 599025 - DNA, 13 bp, D. melanogaster
caacaatttgcca

SEQ ID NO: 599026 - DNA, 13 bp, D. melanogaster
caacaatttgctg

SEQ ID NO: 599027 - DNA, 13 bp, D. melanogaster
caacaatttggct

SEQ ID NO: 599028 - DNA, 13 bp, D. melanogaster
caacaatttgtat

SEQ ID NO: 599029 - DNA, 13 bp, D. melanogaster
caacaattttaaa

SEQ ID NO: 599030 - DNA, 13 bp, D. melanogaster
caacaattttact

SEQ ID NO: 599031 - DNA, 13 bp, D. melanogaster
caacaattttcca

SEQ ID NO: 599032 - DNA, 13 bp, D. melanogaster
caacaattttcgg

SEQ ID NO: 599033 - DNA, 13 bp, D. melanogaster
caacaattttctg

SEQ ID NO: 599034 - DNA, 13 bp, D. melanogaster
caacaatttttca

SEQ ID NO: 599035 - DNA, 13 bp, D. melanogaster
caacaatttttgt

SEQ ID NO: 599036 - DNA, 14 bp, D. melanogaster
caacacaaaaattt

SEQ ID NO: 599037 - DNA, 13 bp, D. melanogaster
caacacaaaattc

SEQ ID NO: 599038 - DNA, 13 bp, D. melanogaster
caacacaaatttt

SEQ ID NO: 599039 - DNA, 13 bp, D. melanogaster
caacacacttcca

SEQ ID NO: 599040 - DNA, 13 bp, D. melanogaster
caacacagcagca

SEQ ID NO: 599041 - DNA, 14 bp, D. melanogaster
caacacagcagcag

SEQ ID NO: 599042 - DNA, 13 bp, D. melanogaster
caacacatacgaa

SEQ ID NO: 599043 - DNA, 14 bp, D. melanogaster
caacacatacgaaa

SEQ ID NO: 599044 - DNA, 13 bp, D. melanogaster
caacacatacgga

SEQ ID NO: 599045 - DNA, 13 bp, D. melanogaster
caacacattacaa

SEQ ID NO: 599046 - DNA, 13 bp, D. melanogaster
caacacatttatt

SEQ ID NO: 599047 - DNA, 13 bp, D. melanogaster
caacacatttgcc

SEQ ID NO: 599048 - DNA, 13 bp, D. melanogaster
caacacatttttt

SEQ ID NO: 599049 - DNA, 13 bp, D. melanogaster
caacaccctcaat

SEQ ID NO: 599050 - DNA, 13 bp, D. melanogaster
caacaccgccaga

SEQ ID NO: 599051 - DNA, 13 bp, D. melanogaster
caacacctgctac

SEQ ID NO: 599052 - DNA, 13 bp, D. melanogaster
caacacgcataca

SEQ ID NO: 599053 - DNA, 13 bp, D. melanogaster
caacacgccccct

SEQ ID NO: 599054 - DNA, 13 bp, D. melanogaster
caacacggccggc

SEQ ID NO: 599055 - DNA, 14 bp, D. melanogaster
caacactaacaaga

SEQ ID NO: 599056 - DNA, 14 bp, D. melanogaster
caacactactttat

SEQ ID NO: 599057 - DNA, 13 bp, D. melanogaster
caacactgccact

SEQ ID NO: 599058 - DNA, 13 bp, D. melanogaster
caacactttggcc

SEQ ID NO: 599059 - DNA, 13 bp, D. melanogaster
caacacttttgaa

SEQ ID NO: 599060 - DNA, 13 bp, D. melanogaster
caacacttttttc

SEQ ID NO: 599061 - DNA, 13 bp, D. melanogaster
caacagaaaatat

SEQ ID NO: 599062 - DNA, 13 bp, D. melanogaster
caacagaaaattt

SEQ ID NO: 599063 - DNA, 13 bp, D. melanogaster
caacagaaactca

SEQ ID NO: 599064 - DNA, 14 bp, D. melanogaster
caacagaaactcag

SEQ ID NO: 599065 - DNA, 13 bp, D. melanogaster
caacagaaatatt

SEQ ID NO: 599066 - DNA, 13 bp, D. melanogaster
caacagaagcaac

SEQ ID NO: 599067 - DNA, 13 bp, D. melanogaster
caacagaagctgc

SEQ ID NO: 599068 - DNA, 13 bp, D. melanogaster
caacagacagcag

SEQ ID NO: 599069 - DNA, 13 bp, D. melanogaster
caacagagcaaga

SEQ ID NO: 599070 - DNA, 13 bp, D. melanogaster
caacagaggattc

SEQ ID NO: 599071 - DNA, 13 bp, D. melanogaster
caacagaggcagc

SEQ ID NO: 599072 - DNA, 13 bp, D. melanogaster
caacagatacaga

SEQ ID NO: 599073 - DNA, 13 bp, D. melanogaster
caacagatccaca

SEQ ID NO: 599074 - DNA, 13 bp, D. melanogaster
caacagatgccga

SEQ ID NO: 599075 - DNA, 14 bp, D. melanogaster
caacagatttgcct

SEQ ID NO: 599076 - DNA, 13 bp, D. melanogaster
caacagcaaaacg

SEQ ID NO: 599077 - DNA, 13 bp, D. melanogaster
caacagcaaaatt

SEQ ID NO: 599078 - DNA, 14 bp, D. melanogaster
caacagcaaacagc

SEQ ID NO: 599079 - DNA, 13 bp, D. melanogaster
caacagcaaaggc

SEQ ID NO: 599080 - DNA, 13 bp, D. melanogaster
caacagcaaatgc

SEQ ID NO: 599081 - DNA, 13 bp, D. melanogaster
caacagcaaattg

SEQ ID NO: 599082 - DNA, 14 bp, D. melanogaster
caacagcaacaaat

SEQ ID NO: 599083 - DNA, 13 bp, D. melanogaster
caacagcaacaag

SEQ ID NO: 599084 - DNA, 13 bp, D. melanogaster
caacagcaacaat

SEQ ID NO: 599085 - DNA, 14 bp, D. melanogaster
caacagcaacaatg

SEQ ID NO: 599086 - DNA, 13 bp, D. melanogaster
caacagcaacacg

SEQ ID NO: 599087 - DNA, 18 bp, D. melanogaster
caacagcaacagcagcaa

SEQ ID NO: 599088 - DNA, 14 bp, D. melanogaster
caacagcaacagcc

SEQ ID NO: 599089 - DNA, 14 bp, D. melanogaster
caacagcaacagcg

SEQ ID NO: 599090 - DNA, 13 bp, D. melanogaster
caacagcaacatc

SEQ ID NO: 599091 - DNA, 14 bp, D. melanogaster
caacagcaacatca

SEQ ID NO: 599092 - DNA, 14 bp, D. melanogaster
caacagcaacatcg

SEQ ID NO: 599093 - DNA, 14 bp, D. melanogaster
caacagcaacatgc

SEQ ID NO: 599094 - DNA, 14 bp, D. melanogaster
caacagcaacattg

SEQ ID NO: 599095 - DNA, 14 bp, D. melanogaster
caacagcaacggca

SEQ ID NO: 599096 - DNA, 13 bp, D. melanogaster
caacagcaactga

SEQ ID NO: 599097 - DNA, 13 bp, D. melanogaster
caacagcaacttg

SEQ ID NO: 599098 - DNA, 14 bp, D. melanogaster
caacagcaagggaa

SEQ ID NO: 599099 - DNA, 13 bp, D. melanogaster
caacagcaataaa

SEQ ID NO: 599100 - DNA, 13 bp, D. melanogaster
caacagcaataat

SEQ ID NO: 599101 - DNA, 14 bp, D. melanogaster
caacagcaataata

SEQ ID NO: 599102 - DNA, 13 bp, D. melanogaster
caacagcaatatt

SEQ ID NO: 599103 - DNA, 13 bp, D. melanogaster
caacagcaatggc

SEQ ID NO: 599104 - DNA, 13 bp, D. melanogaster
caacagcaattaa

SEQ ID NO: 599105 - DNA, 13 bp, D. melanogaster
caacagcaattag

SEQ ID NO: 599106 - DNA, 14 bp, D. melanogaster
caacagcaccagca

SEQ ID NO: 599107 - DNA, 13 bp, D. melanogaster
caacagcagaata

SEQ ID NO: 599108 - DNA, 13 bp, D. melanogaster
caacagcagcaaa

SEQ ID NO: 599109 - DNA, 20 bp, D. melanogaster
caacagcagcaacaacagca

SEQ ID NO: 599110 - DNA, 13 bp, D. melanogaster
caacagcagcaga

SEQ ID NO: 599111 - DNA, 14 bp, D. melanogaster
caacagcagcagcc

SEQ ID NO: 599112 - DNA, 14 bp, D. melanogaster
caacagcagcagct

SEQ ID NO: 599113 - DNA, 13 bp, D. melanogaster
caacagcagcagg

SEQ ID NO: 599114 - DNA, 13 bp, D. melanogaster
caacagcagcatc

SEQ ID NO: 599115 - DNA, 13 bp, D. melanogaster
caacagcagccaa

SEQ ID NO: 599116 - DNA, 13 bp, D. melanogaster
caacagcagccac

SEQ ID NO: 599117 - DNA, 13 bp, D. melanogaster
caacagcagccag

SEQ ID NO: 599118 - DNA, 13 bp, D. melanogaster
caacagcagccga

SEQ ID NO: 599119 - DNA, 13 bp, D. melanogaster
caacagcagccgg

SEQ ID NO: 599120 - DNA, 14 bp, D. melanogaster
caacagcagcggca

SEQ ID NO: 599121 - DNA, 13 bp, D. melanogaster
caacagcagctac

SEQ ID NO: 599122 - DNA, 14 bp, D. melanogaster
caacagcaggagca

SEQ ID NO: 599123 - DNA, 13 bp, D. melanogaster
caacagcagtagc

SEQ ID NO: 599124 - DNA, 14 bp, D. melanogaster
caacagcagtagca

SEQ ID NO: 599125 - DNA, 13 bp, D. melanogaster
caacagcagtggc

SEQ ID NO: 599126 - DNA, 14 bp, D. melanogaster
caacagcagtggca

SEQ ID NO: 599127 - DNA, 14 bp, D. melanogaster
caacagccaatggc

SEQ ID NO: 599128 - DNA, 13 bp, D. melanogaster
caacagccacatc

SEQ ID NO: 599129 - DNA, 13 bp, D. melanogaster
caacagcgactga

SEQ ID NO: 599130 - DNA, 13 bp, D. melanogaster
caacagcggaaaa

SEQ ID NO: 599131 - DNA, 13 bp, D. melanogaster
caacagctaccag

SEQ ID NO: 599132 - DNA, 13 bp, D. melanogaster
caacagctcatca

SEQ ID NO: 599133 - DNA, 13 bp, D. melanogaster
caacagctgccaa

SEQ ID NO: 599134 - DNA, 13 bp, D. melanogaster
caacagctgctgt

SEQ ID NO: 599135 - DNA, 13 bp, D. melanogaster
caacagctggcca

SEQ ID NO: 599136 - DNA, 13 bp, D. melanogaster
caacaggagcaac

SEQ ID NO: 599137 - DNA, 13 bp, D. melanogaster
caacaggcaacag

SEQ ID NO: 599138 - DNA, 13 bp, D. melanogaster
caacaggttatgg

SEQ ID NO: 599139 - DNA, 14 bp, D. melanogaster
caacagtaacaaca

SEQ ID NO: 599140 - DNA, 14 bp, D. melanogaster
caacagtagcaaca

SEQ ID NO: 599141 - DNA, 13 bp, D. melanogaster
caacagtcgacca

SEQ ID NO: 599142 - DNA, 13 bp, D. melanogaster
caacagtgcgtat

SEQ ID NO: 599143 - DNA, 14 bp, D. melanogaster
caacagttcagcag

SEQ ID NO: 599144 - DNA, 13 bp, D. melanogaster
caacagttgccgc

SEQ ID NO: 599145 - DNA, 13 bp, D. melanogaster
caacagttgctgc

SEQ ID NO: 599146 - DNA, 13 bp, D. melanogaster
caacagttggcca

SEQ ID NO: 599147 - DNA, 13 bp, D. melanogaster
caacagttttcca

SEQ ID NO: 599148 - DNA, 13 bp, D. melanogaster
caacagttttggc

SEQ ID NO: 599149 - DNA, 13 bp, D. melanogaster
caacataaaaagt

SEQ ID NO: 599150 - DNA, 13 bp, D. melanogaster
caacataatttaa

SEQ ID NO: 599151 - DNA, 13 bp, D. melanogaster
caacatacataca

SEQ ID NO: 599152 - DNA, 13 bp, D. melanogaster
caacatatgcaat

SEQ ID NO: 599153 - DNA, 13 bp, D. melanogaster
caacatatgttgc

SEQ ID NO: 599154 - DNA, 13 bp, D. melanogaster
caacatattcaac

SEQ ID NO: 599155 - DNA, 13 bp, D. melanogaster
caacatatttata

SEQ ID NO: 599156 - DNA, 13 bp, D. melanogaster
caacatcaaaatc

SEQ ID NO: 599157 - DNA, 13 bp, D. melanogaster
caacatcaaagcg

SEQ ID NO: 599158 - DNA, 14 bp, D. melanogaster
caacatcaaagcgt

SEQ ID NO: 599159 - DNA, 13 bp, D. melanogaster
caacatcaacaat

SEQ ID NO: 599160 - DNA, 13 bp, D. melanogaster
caacatcaacatc

SEQ ID NO: 599161 - DNA, 14 bp, D. melanogaster
caacatcaacatca

SEQ ID NO: 599162 - DNA, 13 bp, D. melanogaster
caacatcaacttc

SEQ ID NO: 599163 - DNA, 13 bp, D. melanogaster
caacatcaagaac

SEQ ID NO: 599164 - DNA, 13 bp, D. melanogaster
caacatcacacgg

SEQ ID NO: 599165 - DNA, 13 bp, D. melanogaster
caacatcagcaaa

SEQ ID NO: 599166 - DNA, 14 bp, D. melanogaster
caacatcagcaaca

SEQ ID NO: 599167 - DNA, 13 bp, D. melanogaster
caacatcagcggc

SEQ ID NO: 599168 - DNA, 13 bp, D. melanogaster
caacatcaggcca

SEQ ID NO: 599169 - DNA, 13 bp, D. melanogaster
caacatcatatcc

SEQ ID NO: 599170 - DNA, 13 bp, D. melanogaster
caacatcattatc

SEQ ID NO: 599171 - DNA, 13 bp, D. melanogaster
caacatccacatc

SEQ ID NO: 599172 - DNA, 13 bp, D. melanogaster
caacatccatggc

SEQ ID NO: 599173 - DNA, 13 bp, D. melanogaster
caacatcgagcag

SEQ ID NO: 599174 - DNA, 13 bp, D. melanogaster
caacatcgcagca

SEQ ID NO: 599175 - DNA, 13 bp, D. melanogaster
caacatctgatat

SEQ ID NO: 599176 - DNA, 13 bp, D. melanogaster
caacatctttcat

SEQ ID NO: 599177 - DNA, 13 bp, D. melanogaster
caacatctttggc

SEQ ID NO: 599178 - DNA, 13 bp, D. melanogaster
caacatgaaatgt

SEQ ID NO: 599179 - DNA, 13 bp, D. melanogaster
caacatgaagttg

SEQ ID NO: 599180 - DNA, 13 bp, D. melanogaster
caacatgatctgt

SEQ ID NO: 599181 - DNA, 13 bp, D. melanogaster
caacatgcaacat

SEQ ID NO: 599182 - DNA, 13 bp, D. melanogaster
caacatgcaactt

SEQ ID NO: 599183 - DNA, 13 bp, D. melanogaster
caacatgcagcaa

SEQ ID NO: 599184 - DNA, 13 bp, D. melanogaster
caacatgcagcat

SEQ ID NO: 599185 - DNA, 13 bp, D. melanogaster
caacatgctgtgg

SEQ ID NO: 599186 - DNA, 13 bp, D. melanogaster
caacatggatgac

SEQ ID NO: 599187 - DNA, 14 bp, D. melanogaster
caacatggatgcca

SEQ ID NO: 599188 - DNA, 13 bp, D. melanogaster
caacatggcaaca

SEQ ID NO: 599189 - DNA, 13 bp, D. melanogaster
caacatgttgcaa

SEQ ID NO: 599190 - DNA, 13 bp, D. melanogaster
caacatgttgcag

SEQ ID NO: 599191 - DNA, 13 bp, D. melanogaster
caacatgttgcat

SEQ ID NO: 599192 - DNA, 13 bp, D. melanogaster
caacatgttgcca

SEQ ID NO: 599193 - DNA, 14 bp, D. melanogaster
caacatgttgccaa

SEQ ID NO: 599194 - DNA, 13 bp, D. melanogaster
caacattaaaatg

SEQ ID NO: 599195 - DNA, 13 bp, D. melanogaster
caacattaagtcc

SEQ ID NO: 599196 - DNA, 13 bp, D. melanogaster
caacattaatata

SEQ ID NO: 599197 - DNA, 13 bp, D. melanogaster
caacattattttt

SEQ ID NO: 599198 - DNA, 13 bp, D. melanogaster
caacattcagctg

SEQ ID NO: 599199 - DNA, 13 bp, D. melanogaster
caacattggcaac

SEQ ID NO: 599200 - DNA, 13 bp, D. melanogaster
caacattgtggca

SEQ ID NO: 599201 - DNA, 13 bp, D. melanogaster
caacattgttgct

SEQ ID NO: 599202 - DNA, 13 bp, D. melanogaster
caacatttaaata

SEQ ID NO: 599203 - DNA, 13 bp, D. melanogaster
caacatttaatta

SEQ ID NO: 599204 - DNA, 13 bp, D. melanogaster
caacatttattaa

SEQ ID NO: 599205 - DNA, 13 bp, D. melanogaster
caacatttccatt

SEQ ID NO: 599206 - DNA, 14 bp, D. melanogaster
caacatttgaaagt

SEQ ID NO: 599207 - DNA, 13 bp, D. melanogaster
caacatttgcttt

SEQ ID NO: 599208 - DNA, 13 bp, D. melanogaster
caacatttggaaa

SEQ ID NO: 599209 - DNA, 13 bp, D. melanogaster
caacatttggcca

SEQ ID NO: 599210 - DNA, 13 bp, D. melanogaster
caacatttgttgc

SEQ ID NO: 599211 - DNA, 13 bp, D. melanogaster
caacattttccgc

SEQ ID NO: 599212 - DNA, 13 bp, D. melanogaster
caacattttcgct

SEQ ID NO: 599213 - DNA, 13 bp, D. melanogaster
caacattttcgtt

SEQ ID NO: 599214 - DNA, 13 bp, D. melanogaster
caacattttctct

SEQ ID NO: 599215 - DNA, 13 bp, D. melanogaster
caacattttctta

SEQ ID NO: 599216 - DNA, 13 bp, D. melanogaster
caacattttgcat

SEQ ID NO: 599217 - DNA, 13 bp, D. melanogaster
caacattttgcca

SEQ ID NO: 599218 - DNA, 13 bp, D. melanogaster
caacattttgccg

SEQ ID NO: 599219 - DNA, 13 bp, D. melanogaster
caacattttgctg

SEQ ID NO: 599220 - DNA, 13 bp, D. melanogaster
caacattttgtgc

SEQ ID NO: 599221 - DNA, 14 bp, D. melanogaster
caacattttgtggc

SEQ ID NO: 599222 - DNA, 13 bp, D. melanogaster
caacatttttaaa

SEQ ID NO: 599223 - DNA, 13 bp, D. melanogaster
caacatttttaca

SEQ ID NO: 599224 - DNA, 13 bp, D. melanogaster
caacatttttcaa

SEQ ID NO: 599225 - DNA, 13 bp, D. melanogaster
caacatttttcgg

SEQ ID NO: 599226 - DNA, 13 bp, D. melanogaster
caacatttttgca

SEQ ID NO: 599227 - DNA, 13 bp, D. melanogaster
caacatttttgct

SEQ ID NO: 599228 - DNA, 13 bp, D. melanogaster
caacatttttggc

SEQ ID NO: 599229 - DNA, 13 bp, D. melanogaster
caacatttttttg

SEQ ID NO: 599230 - DNA, 13 bp, D. melanogaster
caaccaaaattct

SEQ ID NO: 599231 - DNA, 14 bp, D. melanogaster
caaccaaattctaa

SEQ ID NO: 599232 - DNA, 13 bp, D. melanogaster
caaccaactactt

SEQ ID NO: 599233 - DNA, 13 bp, D. melanogaster
caaccaatttcct

SEQ ID NO: 599234 - DNA, 13 bp, D. melanogaster
caaccacaaatat

SEQ ID NO: 599235 - DNA, 13 bp, D. melanogaster
caaccacagatgt

SEQ ID NO: 599236 - DNA, 13 bp, D. melanogaster
caaccacccactt

SEQ ID NO: 599237 - DNA, 13 bp, D. melanogaster
caaccagatcacc

SEQ ID NO: 599238 - DNA, 14 bp, D. melanogaster
caaccagcaatggc

SEQ ID NO: 599239 - DNA, 14 bp, D. melanogaster
caaccagccagcca

SEQ ID NO: 599240 - DNA, 15 bp, D. melanogaster
caaccattattatta

SEQ ID NO: 599241 - DNA, 13 bp, D. melanogaster
caaccatttattt

SEQ ID NO: 599242 - DNA, 13 bp, D. melanogaster
caaccattttcca

SEQ ID NO: 599243 - DNA, 13 bp, D. melanogaster
caacccagcgaat

SEQ ID NO: 599244 - DNA, 13 bp, D. melanogaster
caacccattgggt

SEQ ID NO: 599245 - DNA, 13 bp, D. melanogaster
caacccatttttg

SEQ ID NO: 599246 - DNA, 13 bp, D. melanogaster
caacccctttcac

SEQ ID NO: 599247 - DNA, 13 bp, D. melanogaster
caacccggttggc

SEQ ID NO: 599248 - DNA, 13 bp, D. melanogaster
caaccgaaaaaat

SEQ ID NO: 599249 - DNA, 13 bp, D. melanogaster
caaccgaaaaata

SEQ ID NO: 599250 - DNA, 13 bp, D. melanogaster
caaccgaaaataa

SEQ ID NO: 599251 - DNA, 13 bp, D. melanogaster
caaccgaaatgtg

SEQ ID NO: 599252 - DNA, 13 bp, D. melanogaster
caaccgatgtttg

SEQ ID NO: 599253 - DNA, 13 bp, D. melanogaster
caaccgattccga

SEQ ID NO: 599254 - DNA, 13 bp, D. melanogaster
caaccgcaaaagc

SEQ ID NO: 599255 - DNA, 14 bp, D. melanogaster
caaccgcattttac

SEQ ID NO: 599256 - DNA, 13 bp, D. melanogaster
caaccgcccactt

SEQ ID NO: 599257 - DNA, 13 bp, D. melanogaster
caaccggaagcca

SEQ ID NO: 599258 - DNA, 13 bp, D. melanogaster
caaccgggccaat

SEQ ID NO: 599259 - DNA, 13 bp, D. melanogaster
caacctaaagtta

SEQ ID NO: 599260 - DNA, 13 bp, D. melanogaster
caacctcaaaaga

SEQ ID NO: 599261 - DNA, 13 bp, D. melanogaster
caacctcaacctc

SEQ ID NO: 599262 - DNA, 13 bp, D. melanogaster
caacctgacgaca

SEQ ID NO: 599263 - DNA, 14 bp, D. melanogaster
caacctgcaacctg

SEQ ID NO: 599264 - DNA, 14 bp, D. melanogaster
caaccttattcatt

SEQ ID NO: 599265 - DNA, 13 bp, D. melanogaster
caacgaaaatcaa

SEQ ID NO: 599266 - DNA, 13 bp, D. melanogaster
caacgaaaatgaa

SEQ ID NO: 599267 - DNA, 13 bp, D. melanogaster
caacgaaactgaa

SEQ ID NO: 599268 - DNA, 13 bp, D. melanogaster
caacgaaagcgaa

SEQ ID NO: 599269 - DNA, 13 bp, D. melanogaster
caacgaaagtgaa

SEQ ID NO: 599270 - DNA, 14 bp, D. melanogaster
caacgaaattgaaa

SEQ ID NO: 599271 - DNA, 14 bp, D. melanogaster
caacgaacggttaa

SEQ ID NO: 599272 - DNA, 13 bp, D. melanogaster
caacgaatctatt

SEQ ID NO: 599273 - DNA, 13 bp, D. melanogaster
caacgacaacaat

SEQ ID NO: 599274 - DNA, 13 bp, D. melanogaster
caacgacaacgac

SEQ ID NO: 599275 - DNA, 14 bp, D. melanogaster
caacgacaacgaca

SEQ ID NO: 599276 - DNA, 13 bp, D. melanogaster
caacgacactgca

SEQ ID NO: 599277 - DNA, 13 bp, D. melanogaster
caacgacattgtt

SEQ ID NO: 599278 - DNA, 13 bp, D. melanogaster
caacgagcagagc

SEQ ID NO: 599279 - DNA, 14 bp, D. melanogaster
caacgaggcgtatg

SEQ ID NO: 599280 - DNA, 13 bp, D. melanogaster
caacgatcttttg

SEQ ID NO: 599281 - DNA, 13 bp, D. melanogaster
caacgatgatgat

SEQ ID NO: 599282 - DNA, 13 bp, D. melanogaster
caacgatggaaga

SEQ ID NO: 599283 - DNA, 13 bp, D. melanogaster
caacgattttatt

SEQ ID NO: 599284 - DNA, 13 bp, D. melanogaster
caacgattttttt

SEQ ID NO: 599285 - DNA, 13 bp, D. melanogaster
caacgcaaacggg

SEQ ID NO: 599286 - DNA, 13 bp, D. melanogaster
caacgcaaatata

SEQ ID NO: 599287 - DNA, 13 bp, D. melanogaster
caacgcaacgcaa

SEQ ID NO: 599288 - DNA, 13 bp, D. melanogaster
caacgcacaaagt

SEQ ID NO: 599289 - DNA, 13 bp, D. melanogaster
caacgcagcagca

SEQ ID NO: 599290 - DNA, 13 bp, D. melanogaster
caacgcattagaa

SEQ ID NO: 599291 - DNA, 13 bp, D. melanogaster
caacgccaacgaa

SEQ ID NO: 599292 - DNA, 13 bp, D. melanogaster
caacgccaacgca

SEQ ID NO: 599293 - DNA, 13 bp, D. melanogaster
caacgccatcgcc

SEQ ID NO: 599294 - DNA, 13 bp, D. melanogaster
caacgccgatctt

SEQ ID NO: 599295 - DNA, 13 bp, D. melanogaster
caacgcggcgtat

SEQ ID NO: 599296 - DNA, 13 bp, D. melanogaster
caacgctagcaaa

SEQ ID NO: 599297 - DNA, 13 bp, D. melanogaster
caacgctctgaaa

SEQ ID NO: 599298 - DNA, 13 bp, D. melanogaster
caacgctgacttc

SEQ ID NO: 599299 - DNA, 13 bp, D. melanogaster
caacgctgcgtat

SEQ ID NO: 599300 - DNA, 14 bp, D. melanogaster
caacgctgcgtatg

SEQ ID NO: 599301 - DNA, 13 bp, D. melanogaster
caacggaaactct

SEQ ID NO: 599302 - DNA, 13 bp, D. melanogaster
caacggaaatgaa

SEQ ID NO: 599303 - DNA, 13 bp, D. melanogaster
caacggaaatgca

SEQ ID NO: 599304 - DNA, 13 bp, D. melanogaster
caacggaacgttg

SEQ ID NO: 599305 - DNA, 13 bp, D. melanogaster
caacggcaaaggc

SEQ ID NO: 599306 - DNA, 13 bp, D. melanogaster
caacggcaacaat

SEQ ID NO: 599307 - DNA, 14 bp, D. melanogaster
caacggcaacagca

SEQ ID NO: 599308 - DNA, 13 bp, D. melanogaster
caacggcaacatt

SEQ ID NO: 599309 - DNA, 14 bp, D. melanogaster
caacggcaacggca

SEQ ID NO: 599310 - DNA, 14 bp, D. melanogaster
caacggcaatgaaa

SEQ ID NO: 599311 - DNA, 13 bp, D. melanogaster
caacggcacttgt

SEQ ID NO: 599312 - DNA, 13 bp, D. melanogaster
caacggcagcaaa

SEQ ID NO: 599313 - DNA, 14 bp, D. melanogaster
caacggcagcagca

SEQ ID NO: 599314 - DNA, 13 bp, D. melanogaster
caacggcagcggc

SEQ ID NO: 599315 - DNA, 13 bp, D. melanogaster
caacggcagctgc

SEQ ID NO: 599316 - DNA, 13 bp, D. melanogaster
caacggcagtttt

SEQ ID NO: 599317 - DNA, 13 bp, D. melanogaster
caacggccaacaa

SEQ ID NO: 599318 - DNA, 14 bp, D. melanogaster
caacggctatcagc

SEQ ID NO: 599319 - DNA, 13 bp, D. melanogaster
caacggggcggat

SEQ ID NO: 599320 - DNA, 14 bp, D. melanogaster
caacggggcggatg

SEQ ID NO: 599321 - DNA, 13 bp, D. melanogaster
caacgggtcgtat

SEQ ID NO: 599322 - DNA, 13 bp, D. melanogaster
caacggtgcgtat

SEQ ID NO: 599323 - DNA, 14 bp, D. melanogaster
caacggtgcgtatg

SEQ ID NO: 599324 - DNA, 13 bp, D. melanogaster
caacggtttgcgc

SEQ ID NO: 599325 - DNA, 13 bp, D. melanogaster
caacgtaaacaaa

SEQ ID NO: 599326 - DNA, 13 bp, D. melanogaster
caacgtatccttt

SEQ ID NO: 599327 - DNA, 13 bp, D. melanogaster
caacgtccgaata

SEQ ID NO: 599328 - DNA, 13 bp, D. melanogaster
caacgtcggacaa

SEQ ID NO: 599329 - DNA, 13 bp, D. melanogaster
caacgtgaacaaa

SEQ ID NO: 599330 - DNA, 13 bp, D. melanogaster
caacgtggcgtat

SEQ ID NO: 599331 - DNA, 14 bp, D. melanogaster
caacgtggcgtatg

SEQ ID NO: 599332 - DNA, 13 bp, D. melanogaster
caacgtgtcgtat

SEQ ID NO: 599333 - DNA, 13 bp, D. melanogaster
caacgttcatata

SEQ ID NO: 599334 - DNA, 13 bp, D. melanogaster
caacgttctttaa

SEQ ID NO: 599335 - DNA, 15 bp, D. melanogaster
caacgttgcgtatac

SEQ ID NO: 599336 - DNA, 13 bp, D. melanogaster
caacgttttacac

SEQ ID NO: 599337 - DNA, 13 bp, D. melanogaster
caacgttttcaag

SEQ ID NO: 599338 - DNA, 13 bp, D. melanogaster
caacgttttgttt

SEQ ID NO: 599339 - DNA, 13 bp, D. melanogaster
caactaaaaatgc

SEQ ID NO: 599340 - DNA, 13 bp, D. melanogaster
caactaaatgaaa

SEQ ID NO: 599341 - DNA, 13 bp, D. melanogaster
caactaaatttaa

SEQ ID NO: 599342 - DNA, 13 bp, D. melanogaster
caactaaccaact

SEQ ID NO: 599343 - DNA, 13 bp, D. melanogaster
caactaactaact

SEQ ID NO: 599344 - DNA, 13 bp, D. melanogaster
caactaattaaca

SEQ ID NO: 599345 - DNA, 13 bp, D. melanogaster
caactaattacat

SEQ ID NO: 599346 - DNA, 13 bp, D. melanogaster
caactaattggca

SEQ ID NO: 599347 - DNA, 13 bp, D. melanogaster
caactaatttaat

SEQ ID NO: 599348 - DNA, 14 bp, D. melanogaster
caactaatttattt

SEQ ID NO: 599349 - DNA, 13 bp, D. melanogaster
caactacaacaat

SEQ ID NO: 599350 - DNA, 13 bp, D. melanogaster
caactacaactac

SEQ ID NO: 599351 - DNA, 14 bp, D. melanogaster
caactacaactaca

SEQ ID NO: 599352 - DNA, 13 bp, D. melanogaster
caactacaatcca

SEQ ID NO: 599353 - DNA, 13 bp, D. melanogaster
caactacagcaac

SEQ ID NO: 599354 - DNA, 13 bp, D. melanogaster
caactacatagag

SEQ ID NO: 599355 - DNA, 14 bp, D. melanogaster
caactaccaactac

SEQ ID NO: 599356 - DNA, 13 bp, D. melanogaster
caactactttaag

SEQ ID NO: 599357 - DNA, 13 bp, D. melanogaster
caactagacaaat

SEQ ID NO: 599358 - DNA, 13 bp, D. melanogaster
caactattataat

SEQ ID NO: 599359 - DNA, 13 bp, D. melanogaster
caactattccatc

SEQ ID NO: 599360 - DNA, 13 bp, D. melanogaster
caactattgttgt

SEQ ID NO: 599361 - DNA, 13 bp, D. melanogaster
caactatttatag

SEQ ID NO: 599362 - DNA, 13 bp, D. melanogaster
caactatttattt

SEQ ID NO: 599363 - DNA, 13 bp, D. melanogaster
caactattttatc

SEQ ID NO: 599364 - DNA, 14 bp, D. melanogaster
caactcaactcaac

SEQ ID NO: 599365 - DNA, 14 bp, D. melanogaster
caactcaactcagc

SEQ ID NO: 599366 - DNA, 13 bp, D. melanogaster
caactcaatcaaa

SEQ ID NO: 599367 - DNA, 13 bp, D. melanogaster
caactcaattaat

SEQ ID NO: 599368 - DNA, 13 bp, D. melanogaster
caactccaactcc

SEQ ID NO: 599369 - DNA, 14 bp, D. melanogaster
caactccaactcca

SEQ ID NO: 599370 - DNA, 13 bp, D. melanogaster
caactccaacttc

SEQ ID NO: 599371 - DNA, 13 bp, D. melanogaster
caactccagctcc

SEQ ID NO: 599372 - DNA, 14 bp, D. melanogaster
caactcccagttgc

SEQ ID NO: 599373 - DNA, 13 bp, D. melanogaster
caactcgcatgtg

SEQ ID NO: 599374 - DNA, 13 bp, D. melanogaster
caactcggctatt

SEQ ID NO: 599375 - DNA, 14 bp, D. melanogaster
caactcgtccacgt

SEQ ID NO: 599376 - DNA, 13 bp, D. melanogaster
caactcgtttcag

SEQ ID NO: 599377 - DNA, 13 bp, D. melanogaster
caactctctccca

SEQ ID NO: 599378 - DNA, 13 bp, D. melanogaster
caactctctctct

SEQ ID NO: 599379 - DNA, 13 bp, D. melanogaster
caactcttcgccc

SEQ ID NO: 599380 - DNA, 13 bp, D. melanogaster
caactcttctcca

SEQ ID NO: 599381 - DNA, 13 bp, D. melanogaster
caactcttttccc

SEQ ID NO: 599382 - DNA, 13 bp, D. melanogaster
caactgaaaaaga

SEQ ID NO: 599383 - DNA, 13 bp, D. melanogaster
caactgaaaagtt

SEQ ID NO: 599384 - DNA, 13 bp, D. melanogaster
caactgaaaatca

SEQ ID NO: 599385 - DNA, 14 bp, D. melanogaster
caactgaaaatcaa

SEQ ID NO: 599386 - DNA, 13 bp, D. melanogaster
caactgaaaattg

SEQ ID NO: 599387 - DNA, 13 bp, D. melanogaster
caactgaaaccga

SEQ ID NO: 599388 - DNA, 13 bp, D. melanogaster
caactgaaactga

SEQ ID NO: 599389 - DNA, 13 bp, D. melanogaster
caactgaaactgg

SEQ ID NO: 599390 - DNA, 13 bp, D. melanogaster
caactgaaagtga

SEQ ID NO: 599391 - DNA, 13 bp, D. melanogaster
caactgaaatgca

SEQ ID NO: 599392 - DNA, 13 bp, D. melanogaster
caactgaacccaa

SEQ ID NO: 599393 - DNA, 13 bp, D. melanogaster
caactgaaccgaa

SEQ ID NO: 599394 - DNA, 13 bp, D. melanogaster
caactgaactgaa

SEQ ID NO: 599395 - DNA, 13 bp, D. melanogaster
caactgaagagtt

SEQ ID NO: 599396 - DNA, 13 bp, D. melanogaster
caactgaagctga

SEQ ID NO: 599397 - DNA, 13 bp, D. melanogaster
caactgacaaatg

SEQ ID NO: 599398 - DNA, 13 bp, D. melanogaster
caactgacagctg

SEQ ID NO: 599399 - DNA, 13 bp, D. melanogaster
caactgataagca

SEQ ID NO: 599400 - DNA, 13 bp, D. melanogaster
caactgatgatga

SEQ ID NO: 599401 - DNA, 14 bp, D. melanogaster
caactgattttgca

SEQ ID NO: 599402 - DNA, 13 bp, D. melanogaster
caactgcaaaaca

SEQ ID NO: 599403 - DNA, 14 bp, D. melanogaster
caactgcaaaacaa

SEQ ID NO: 599404 - DNA, 13 bp, D. melanogaster
caactgcaaaatg

SEQ ID NO: 599405 - DNA, 14 bp, D. melanogaster
caactgcaaatgca

SEQ ID NO: 599406 - DNA, 13 bp, D. melanogaster
caactgcaaatta

SEQ ID NO: 599407 - DNA, 13 bp, D. melanogaster
caactgcaacaac

SEQ ID NO: 599408 - DNA, 13 bp, D. melanogaster
caactgcaacaat

SEQ ID NO: 599409 - DNA, 13 bp, D. melanogaster
caactgcaacaca

SEQ ID NO: 599410 - DNA, 13 bp, D. melanogaster
caactgcaacacc

SEQ ID NO: 599411 - DNA, 17 bp, D. melanogaster
caactgcaacaccagca

SEQ ID NO: 599412 - DNA, 13 bp, D. melanogaster
caactgcaacaga

SEQ ID NO: 599413 - DNA, 14 bp, D. melanogaster
caactgcaacagca

SEQ ID NO: 599414 - DNA, 13 bp, D. melanogaster
caactgcaacatc

SEQ ID NO: 599415 - DNA, 13 bp, D. melanogaster
caactgcaactcc

SEQ ID NO: 599416 - DNA, 13 bp, D. melanogaster
caactgcaactcg

SEQ ID NO: 599417 - DNA, 13 bp, D. melanogaster
caactgcaactga

SEQ ID NO: 599418 - DNA, 14 bp, D. melanogaster
caactgcaactgcc

SEQ ID NO: 599419 - DNA, 14 bp, D. melanogaster
caactgcaactgcg

SEQ ID NO: 599420 - DNA, 13 bp, D. melanogaster
caactgcaaggaa

SEQ ID NO: 599421 - DNA, 13 bp, D. melanogaster
caactgcaatgtc

SEQ ID NO: 599422 - DNA, 14 bp, D. melanogaster
caactgcaatgtct

SEQ ID NO: 599423 - DNA, 13 bp, D. melanogaster
caactgcaattgc

SEQ ID NO: 599424 - DNA, 14 bp, D. melanogaster
caactgcaattgca

SEQ ID NO: 599425 - DNA, 13 bp, D. melanogaster
caactgcaattgt

SEQ ID NO: 599426 - DNA, 13 bp, D. melanogaster
caactgcactttg

SEQ ID NO: 599427 - DNA, 13 bp, D. melanogaster
caactgcagaatc

SEQ ID NO: 599428 - DNA, 13 bp, D. melanogaster
caactgcagatgc

SEQ ID NO: 599429 - DNA, 13 bp, D. melanogaster
caactgcagcaaa

SEQ ID NO: 599430 - DNA, 13 bp, D. melanogaster
caactgcagcaac

SEQ ID NO: 599431 - DNA, 14 bp, D. melanogaster
caactgcagcaaca

SEQ ID NO: 599432 - DNA, 13 bp, D. melanogaster
caactgcagcact

SEQ ID NO: 599433 - DNA, 13 bp, D. melanogaster
caactgcagcaga

SEQ ID NO: 599434 - DNA, 14 bp, D. melanogaster
caactgcagcagca

SEQ ID NO: 599435 - DNA, 13 bp, D. melanogaster
caactgcagccgc

SEQ ID NO: 599436 - DNA, 13 bp, D. melanogaster
caactgcagcgaa

SEQ ID NO: 599437 - DNA, 13 bp, D. melanogaster
caactgcagcggc

SEQ ID NO: 599438 - DNA, 13 bp, D. melanogaster
caactgcagctcc

SEQ ID NO: 599439 - DNA, 13 bp, D. melanogaster
caactgcagtggc

SEQ ID NO: 599440 - DNA, 14 bp, D. melanogaster
caactgcagttgca

SEQ ID NO: 599441 - DNA, 13 bp, D. melanogaster
caactgccaactg

SEQ ID NO: 599442 - DNA, 13 bp, D. melanogaster
caactgccacaac

SEQ ID NO: 599443 - DNA, 14 bp, D. melanogaster
caactgccacaaca

SEQ ID NO: 599444 - DNA, 13 bp, D. melanogaster
caactgccacgcc

SEQ ID NO: 599445 - DNA, 13 bp, D. melanogaster
caactgccagctg

SEQ ID NO: 599446 - DNA, 13 bp, D. melanogaster
caactgccataaa

SEQ ID NO: 599447 - DNA, 13 bp, D. melanogaster
caactgcgactgc

SEQ ID NO: 599448 - DNA, 13 bp, D. melanogaster
caactgctgcagc

SEQ ID NO: 599449 - DNA, 13 bp, D. melanogaster
caactgctgttgc

SEQ ID NO: 599450 - DNA, 13 bp, D. melanogaster
caactggcaaatg

SEQ ID NO: 599451 - DNA, 13 bp, D. melanogaster
caactggcaacac

SEQ ID NO: 599452 - DNA, 14 bp, D. melanogaster
caactggcaactgg

SEQ ID NO: 599453 - DNA, 13 bp, D. melanogaster
caactggcagcag

SEQ ID NO: 599454 - DNA, 13 bp, D. melanogaster
caactggcagcca

SEQ ID NO: 599455 - DNA, 13 bp, D. melanogaster
caactggccaact

SEQ ID NO: 599456 - DNA, 13 bp, D. melanogaster
caactggctgaca

SEQ ID NO: 599457 - DNA, 13 bp, D. melanogaster
caactggctggct

SEQ ID NO: 599458 - DNA, 13 bp, D. melanogaster
caactgggaacag

SEQ ID NO: 599459 - DNA, 13 bp, D. melanogaster
caactgggcaact

SEQ ID NO: 599460 - DNA, 13 bp, D. melanogaster
caactggtttttg

SEQ ID NO: 599461 - DNA, 13 bp, D. melanogaster
caactgtcaactg

SEQ ID NO: 599462 - DNA, 13 bp, D. melanogaster
caactgtcaagtg

SEQ ID NO: 599463 - DNA, 13 bp, D. melanogaster
caactgtgaaaat

SEQ ID NO: 599464 - DNA, 13 bp, D. melanogaster
caactgtgtgtgt

SEQ ID NO: 599465 - DNA, 14 bp, D. melanogaster
caactgtgtgtgtg

SEQ ID NO: 599466 - DNA, 13 bp, D. melanogaster
caactgttctatg

SEQ ID NO: 599467 - DNA, 13 bp, D. melanogaster
caactgttggcca

SEQ ID NO: 599468 - DNA, 14 bp, D. melanogaster
caactgttgtttat

SEQ ID NO: 599469 - DNA, 13 bp, D. melanogaster
caactgtttcaac

SEQ ID NO: 599470 - DNA, 13 bp, D. melanogaster
caacttaaaagtt

SEQ ID NO: 599471 - DNA, 13 bp, D. melanogaster
caacttaaatgaa

SEQ ID NO: 599472 - DNA, 13 bp, D. melanogaster
caacttaaattgt

SEQ ID NO: 599473 - DNA, 13 bp, D. melanogaster
caacttaacttaa

SEQ ID NO: 599474 - DNA, 13 bp, D. melanogaster
caacttaaggaaa

SEQ ID NO: 599475 - DNA, 13 bp, D. melanogaster
caacttaatccgg

SEQ ID NO: 599476 - DNA, 13 bp, D. melanogaster
caacttaatttat

SEQ ID NO: 599477 - DNA, 13 bp, D. melanogaster
caacttaatttta

SEQ ID NO: 599478 - DNA, 13 bp, D. melanogaster
caacttagacgac

SEQ ID NO: 599479 - DNA, 13 bp, D. melanogaster
caacttatttatg

SEQ ID NO: 599480 - DNA, 13 bp, D. melanogaster
caacttcaacgga

SEQ ID NO: 599481 - DNA, 13 bp, D. melanogaster
caacttcaactgc

SEQ ID NO: 599482 - DNA, 14 bp, D. melanogaster
caacttcaactgca

SEQ ID NO: 599483 - DNA, 14 bp, D. melanogaster
caacttcaacttca

SEQ ID NO: 599484 - DNA, 13 bp, D. melanogaster
caacttcaacttt

SEQ ID NO: 599485 - DNA, 13 bp, D. melanogaster
caacttcaatttc

SEQ ID NO: 599486 - DNA, 13 bp, D. melanogaster
caacttcagcaca

SEQ ID NO: 599487 - DNA, 13 bp, D. melanogaster
caacttcagcggt

SEQ ID NO: 599488 - DNA, 13 bp, D. melanogaster
caacttcatcatc

SEQ ID NO: 599489 - DNA, 13 bp, D. melanogaster
caacttcatgttg

SEQ ID NO: 599490 - DNA, 13 bp, D. melanogaster
caacttcatttaa

SEQ ID NO: 599491 - DNA, 13 bp, D. melanogaster
caacttccaaatt

SEQ ID NO: 599492 - DNA, 13 bp, D. melanogaster
caacttccaactt

SEQ ID NO: 599493 - DNA, 13 bp, D. melanogaster
caacttccgctgc

SEQ ID NO: 599494 - DNA, 13 bp, D. melanogaster
caacttccgtttc

SEQ ID NO: 599495 - DNA, 14 bp, D. melanogaster
caacttccgtttcc

SEQ ID NO: 599496 - DNA, 13 bp, D. melanogaster
caacttcgatgct

SEQ ID NO: 599497 - DNA, 13 bp, D. melanogaster
caacttcgatggc

SEQ ID NO: 599498 - DNA, 13 bp, D. melanogaster
caacttcgtggtg

SEQ ID NO: 599499 - DNA, 13 bp, D. melanogaster
caacttctggcca

SEQ ID NO: 599500 - DNA, 13 bp, D. melanogaster
caacttgatttat

SEQ ID NO: 599501 - DNA, 13 bp, D. melanogaster
caacttgcaactc

SEQ ID NO: 599502 - DNA, 14 bp, D. melanogaster
caacttgcaactgg

SEQ ID NO: 599503 - DNA, 13 bp, D. melanogaster
caacttgcaactt

SEQ ID NO: 599504 - DNA, 14 bp, D. melanogaster
caacttgcaacttg

SEQ ID NO: 599505 - DNA, 13 bp, D. melanogaster
caacttgcagcag

SEQ ID NO: 599506 - DNA, 13 bp, D. melanogaster
caacttgctgctg

SEQ ID NO: 599507 - DNA, 13 bp, D. melanogaster
caacttggcaact

SEQ ID NO: 599508 - DNA, 13 bp, D. melanogaster
caacttggccaaa

SEQ ID NO: 599509 - DNA, 13 bp, D. melanogaster
caacttgtagcta

SEQ ID NO: 599510 - DNA, 13 bp, D. melanogaster
caacttgttgggc

SEQ ID NO: 599511 - DNA, 13 bp, D. melanogaster
caacttgtttgtt

SEQ ID NO: 599512 - DNA, 13 bp, D. melanogaster
caactttaaaatg

SEQ ID NO: 599513 - DNA, 13 bp, D. melanogaster
caactttaaactg

SEQ ID NO: 599514 - DNA, 13 bp, D. melanogaster
caactttaaatgc

SEQ ID NO: 599515 - DNA, 13 bp, D. melanogaster
caactttaagcaa

SEQ ID NO: 599516 - DNA, 13 bp, D. melanogaster
caactttaatatt

SEQ ID NO: 599517 - DNA, 13 bp, D. melanogaster
caactttaattgg

SEQ ID NO: 599518 - DNA, 14 bp, D. melanogaster
caactttacaactt

SEQ ID NO: 599519 - DNA, 13 bp, D. melanogaster
caactttatgcca

SEQ ID NO: 599520 - DNA, 13 bp, D. melanogaster
caactttattgaa

SEQ ID NO: 599521 - DNA, 14 bp, D. melanogaster
caactttcaacttt

SEQ ID NO: 599522 - DNA, 13 bp, D. melanogaster
caactttcaatgc

SEQ ID NO: 599523 - DNA, 13 bp, D. melanogaster
caactttctagct

SEQ ID NO: 599524 - DNA, 13 bp, D. melanogaster
caactttctctgg

SEQ ID NO: 599525 - DNA, 13 bp, D. melanogaster
caactttctgcaa

SEQ ID NO: 599526 - DNA, 13 bp, D. melanogaster
caactttgattga

SEQ ID NO: 599527 - DNA, 13 bp, D. melanogaster
caactttggcaac

SEQ ID NO: 599528 - DNA, 13 bp, D. melanogaster
caactttggcagc

SEQ ID NO: 599529 - DNA, 13 bp, D. melanogaster
caactttgtggca

SEQ ID NO: 599530 - DNA, 13 bp, D. melanogaster
caactttgtgtga

SEQ ID NO: 599531 - DNA, 13 bp, D. melanogaster
caacttttacttt

SEQ ID NO: 599532 - DNA, 13 bp, D. melanogaster
caacttttattga

SEQ ID NO: 599533 - DNA, 13 bp, D. melanogaster
caacttttcaact

SEQ ID NO: 599534 - DNA, 13 bp, D. melanogaster
caacttttccagc

SEQ ID NO: 599535 - DNA, 13 bp, D. melanogaster
caacttttccatt

SEQ ID NO: 599536 - DNA, 13 bp, D. melanogaster
caacttttgcgct

SEQ ID NO: 599537 - DNA, 13 bp, D. melanogaster
caacttttgcttt

SEQ ID NO: 599538 - DNA, 14 bp, D. melanogaster
caacttttggccaa

SEQ ID NO: 599539 - DNA, 13 bp, D. melanogaster
caacttttgtaat

SEQ ID NO: 599540 - DNA, 13 bp, D. melanogaster
caactttttgcca

SEQ ID NO: 599541 - DNA, 13 bp, D. melanogaster
caactttttggca

SEQ ID NO: 599542 - DNA, 13 bp, D. melanogaster
caactttttggct

SEQ ID NO: 599543 - DNA, 13 bp, D. melanogaster
caactttttggtt

SEQ ID NO: 599544 - DNA, 13 bp, D. melanogaster
caacttttttgtt

SEQ ID NO: 599545 - DNA, 13 bp, D. melanogaster
caagaaaaaatgc

SEQ ID NO: 599546 - DNA, 13 bp, D. melanogaster
caagaaaaaggat

SEQ ID NO: 599547 - DNA, 13 bp, D. melanogaster
caagaaaaatatt

SEQ ID NO: 599548 - DNA, 13 bp, D. melanogaster
caagaaaaatccc

SEQ ID NO: 599549 - DNA, 14 bp, D. melanogaster
caagaaaaatccca

SEQ ID NO: 599550 - DNA, 13 bp, D. melanogaster
caagaaaaatgca

SEQ ID NO: 599551 - DNA, 13 bp, D. melanogaster
caagaaaaccttc

SEQ ID NO: 599552 - DNA, 13 bp, D. melanogaster
caagaaaactaat

SEQ ID NO: 599553 - DNA, 13 bp, D. melanogaster
caagaaaacttaa

SEQ ID NO: 599554 - DNA, 13 bp, D. melanogaster
caagaaaagtata

SEQ ID NO: 599555 - DNA, 13 bp, D. melanogaster
caagaaaagtgca

SEQ ID NO: 599556 - DNA, 13 bp, D. melanogaster
caagaaaatatga

SEQ ID NO: 599557 - DNA, 14 bp, D. melanogaster
caagaaaatatttt

SEQ ID NO: 599558 - DNA, 13 bp, D. melanogaster
caagaaaattata

SEQ ID NO: 599559 - DNA, 13 bp, D. melanogaster
caagaaaattttt

SEQ ID NO: 599560 - DNA, 14 bp, D. melanogaster
caagaaacatggcc

SEQ ID NO: 599561 - DNA, 13 bp, D. melanogaster
caagaaactgcta

SEQ ID NO: 599562 - DNA, 13 bp, D. melanogaster
caagaaactgttt

SEQ ID NO: 599563 - DNA, 13 bp, D. melanogaster
caagaaacttgtt

SEQ ID NO: 599564 - DNA, 13 bp, D. melanogaster
caagaaagagcgc

SEQ ID NO: 599565 - DNA, 13 bp, D. melanogaster
caagaaagtagct

SEQ ID NO: 599566 - DNA, 13 bp, D. melanogaster
caagaaagtcagt

SEQ ID NO: 599567 - DNA, 13 bp, D. melanogaster
caagaaatacaat

SEQ ID NO: 599568 - DNA, 14 bp, D. melanogaster
caagaaatacaatt

SEQ ID NO: 599569 - DNA, 13 bp, D. melanogaster
caagaaatatata

SEQ ID NO: 599570 - DNA, 14 bp, D. melanogaster
caagaaatatatat

SEQ ID NO: 599571 - DNA, 13 bp, D. melanogaster
caagaaatatatt

SEQ ID NO: 599572 - DNA, 13 bp, D. melanogaster
caagaaatatgta

SEQ ID NO: 599573 - DNA, 13 bp, D. melanogaster
caagaaatattaa

SEQ ID NO: 599574 - DNA, 13 bp, D. melanogaster
caagaaatcaaga

SEQ ID NO: 599575 - DNA, 14 bp, D. melanogaster
caagaaatcactgc

SEQ ID NO: 599576 - DNA, 13 bp, D. melanogaster
caagaaatgcagc

SEQ ID NO: 599577 - DNA, 13 bp, D. melanogaster
caagaaattgaag

SEQ ID NO: 599578 - DNA, 13 bp, D. melanogaster
caagaaatttata

SEQ ID NO: 599579 - DNA, 13 bp, D. melanogaster
caagaaattttga

SEQ ID NO: 599580 - DNA, 14 bp, D. melanogaster
caagaacaacaact

SEQ ID NO: 599581 - DNA, 13 bp, D. melanogaster
caagaacaacaat

SEQ ID NO: 599582 - DNA, 13 bp, D. melanogaster
caagaacaataac

SEQ ID NO: 599583 - DNA, 13 bp, D. melanogaster
caagaacagcaac

SEQ ID NO: 599584 - DNA, 13 bp, D. melanogaster
caagaacgctgcc

SEQ ID NO: 599585 - DNA, 13 bp, D. melanogaster
caagaacgctgtt

SEQ ID NO: 599586 - DNA, 13 bp, D. melanogaster
caagaacggctgc

SEQ ID NO: 599587 - DNA, 14 bp, D. melanogaster
caagaagaagattg

SEQ ID NO: 599588 - DNA, 13 bp, D. melanogaster
caagaagcccaaa

SEQ ID NO: 599589 - DNA, 13 bp, D. melanogaster
caagaagctaaaa

SEQ ID NO: 599590 - DNA, 14 bp, D. melanogaster
caagaagctaaaac

SEQ ID NO: 599591 - DNA, 13 bp, D. melanogaster
caagaaggcagca

SEQ ID NO: 599592 - DNA, 13 bp, D. melanogaster
caagaagtactca

SEQ ID NO: 599593 - DNA, 13 bp, D. melanogaster
caagaagttttct

SEQ ID NO: 599594 - DNA, 13 bp, D. melanogaster
caagaataaatag

SEQ ID NO: 599595 - DNA, 13 bp, D. melanogaster
caagaatacggcc

SEQ ID NO: 599596 - DNA, 13 bp, D. melanogaster
caagaatagaaga

SEQ ID NO: 599597 - DNA, 14 bp, D. melanogaster
caagaatatacata

SEQ ID NO: 599598 - DNA, 13 bp, D. melanogaster
caagaatatatat

SEQ ID NO: 599599 - DNA, 14 bp, D. melanogaster
caagaatatatgta

SEQ ID NO: 599600 - DNA, 13 bp, D. melanogaster
caagaatgccaac

SEQ ID NO: 599601 - DNA, 13 bp, D. melanogaster
caagaatggcaaa

SEQ ID NO: 599602 - DNA, 13 bp, D. melanogaster
caagaatgtatta

SEQ ID NO: 599603 - DNA, 13 bp, D. melanogaster
caagaatgttcac

SEQ ID NO: 599604 - DNA, 13 bp, D. melanogaster
caagaattaaaat

SEQ ID NO: 599605 - DNA, 13 bp, D. melanogaster
caagaattccatt

SEQ ID NO: 599606 - DNA, 13 bp, D. melanogaster
caagaatttcaaa

SEQ ID NO: 599607 - DNA, 15 bp, D. melanogaster
caagaatttttcgca

SEQ ID NO: 599608 - DNA, 13 bp, D. melanogaster
caagacaacattt

SEQ ID NO: 599609 - DNA, 13 bp, D. melanogaster
caagacatccgag

SEQ ID NO: 599610 - DNA, 13 bp, D. melanogaster
caagaccaaaaat

SEQ ID NO: 599611 - DNA, 13 bp, D. melanogaster
caagaccagtggt

SEQ ID NO: 599612 - DNA, 13 bp, D. melanogaster
caagacgatttgt

SEQ ID NO: 599613 - DNA, 13 bp, D. melanogaster
caagacggcggca

SEQ ID NO: 599614 - DNA, 13 bp, D. melanogaster
caagactacaaaa

SEQ ID NO: 599615 - DNA, 13 bp, D. melanogaster
caagagagaatac

SEQ ID NO: 599616 - DNA, 13 bp, D. melanogaster
caagagcaacagc

SEQ ID NO: 599617 - DNA, 14 bp, D. melanogaster
caagagcaacagca

SEQ ID NO: 599618 - DNA, 13 bp, D. melanogaster
caagagcagcaaa

SEQ ID NO: 599619 - DNA, 13 bp, D. melanogaster
caagagcagcaac

SEQ ID NO: 599620 - DNA, 13 bp, D. melanogaster
caagagcgaaatg

SEQ ID NO: 599621 - DNA, 13 bp, D. melanogaster
caagagctcacac

SEQ ID NO: 599622 - DNA, 13 bp, D. melanogaster
caagaggcaggaa

SEQ ID NO: 599623 - DNA, 13 bp, D. melanogaster
caagaggtggaga

SEQ ID NO: 599624 - DNA, 14 bp, D. melanogaster
caagaggtggagaa

SEQ ID NO: 599625 - DNA, 13 bp, D. melanogaster
caagagtacaagg

SEQ ID NO: 599626 - DNA, 13 bp, D. melanogaster
caagagtcaaaaa

SEQ ID NO: 599627 - DNA, 13 bp, D. melanogaster
caagagttgcaag

SEQ ID NO: 599628 - DNA, 14 bp, D. melanogaster
caagatacaagata

SEQ ID NO: 599629 - DNA, 13 bp, D. melanogaster
caagatatctgca

SEQ ID NO: 599630 - DNA, 13 bp, D. melanogaster
caagatatgatgt

SEQ ID NO: 599631 - DNA, 13 bp, D. melanogaster
caagatatttact

SEQ ID NO: 599632 - DNA, 13 bp, D. melanogaster
caagatcaacaac

SEQ ID NO: 599633 - DNA, 14 bp, D. melanogaster
caagatcagaaaac

SEQ ID NO: 599634 - DNA, 13 bp, D. melanogaster
caagatcatcaac

SEQ ID NO: 599635 - DNA, 13 bp, D. melanogaster
caagatcccaagt

SEQ ID NO: 599636 - DNA, 14 bp, D. melanogaster
caagatcccaagtt

SEQ ID NO: 599637 - DNA, 13 bp, D. melanogaster
caagatctgcgtc

SEQ ID NO: 599638 - DNA, 13 bp, D. melanogaster
caagatgaatact

SEQ ID NO: 599639 - DNA, 13 bp, D. melanogaster
caagattaattaa

SEQ ID NO: 599640 - DNA, 13 bp, D. melanogaster
caagattgagctt

SEQ ID NO: 599641 - DNA, 13 bp, D. melanogaster
caagcaaaacaat

SEQ ID NO: 599642 - DNA, 13 bp, D. melanogaster
caagcaaacaaat

SEQ ID NO: 599643 - DNA, 14 bp, D. melanogaster
caagcaaacaaatt

SEQ ID NO: 599644 - DNA, 13 bp, D. melanogaster
caagcaaacaatt

SEQ ID NO: 599645 - DNA, 13 bp, D. melanogaster
caagcaaacacat

SEQ ID NO: 599646 - DNA, 13 bp, D. melanogaster
caagcaaacagca

SEQ ID NO: 599647 - DNA, 13 bp, D. melanogaster
caagcaaacattt

SEQ ID NO: 599648 - DNA, 13 bp, D. melanogaster
caagcaaacttcg

SEQ ID NO: 599649 - DNA, 13 bp, D. melanogaster
caagcaaaggcaa

SEQ ID NO: 599650 - DNA, 13 bp, D. melanogaster
caagcaaagtgcc

SEQ ID NO: 599651 - DNA, 14 bp, D. melanogaster
caagcaaataaaca

SEQ ID NO: 599652 - DNA, 13 bp, D. melanogaster
caagcaaatcaaa

SEQ ID NO: 599653 - DNA, 13 bp, D. melanogaster
caagcaaatgaaa

SEQ ID NO: 599654 - DNA, 13 bp, D. melanogaster
caagcaaattaaa

SEQ ID NO: 599655 - DNA, 13 bp, D. melanogaster
caagcaaattcta

SEQ ID NO: 599656 - DNA, 13 bp, D. melanogaster
caagcaacaacag

SEQ ID NO: 599657 - DNA, 13 bp, D. melanogaster
caagcaacaataa

SEQ ID NO: 599658 - DNA, 13 bp, D. melanogaster
caagcaagaaagt

SEQ ID NO: 599659 - DNA, 13 bp, D. melanogaster
caagcaagcaaat

SEQ ID NO: 599660 - DNA, 13 bp, D. melanogaster
caagcaagcaagc

SEQ ID NO: 599661 - DNA, 13 bp, D. melanogaster
caagcaatcaaaa

SEQ ID NO: 599662 - DNA, 13 bp, D. melanogaster
caagcaattacag

SEQ ID NO: 599663 - DNA, 13 bp, D. melanogaster
caagcaattagca

SEQ ID NO: 599664 - DNA, 13 bp, D. melanogaster
caagcaatttaaa

SEQ ID NO: 599665 - DNA, 13 bp, D. melanogaster
caagcacaaagcg

SEQ ID NO: 599666 - DNA, 14 bp, D. melanogaster
caagcacacacact

SEQ ID NO: 599667 - DNA, 14 bp, D. melanogaster
caagcacagaggct

SEQ ID NO: 599668 - DNA, 13 bp, D. melanogaster
caagcaccattgc

SEQ ID NO: 599669 - DNA, 13 bp, D. melanogaster
caagcactgggaa

SEQ ID NO: 599670 - DNA, 13 bp, D. melanogaster
caagcagaaaaat

SEQ ID NO: 599671 - DNA, 13 bp, D. melanogaster
caagcagaaaatt

SEQ ID NO: 599672 - DNA, 13 bp, D. melanogaster
caagcagcagcaa

SEQ ID NO: 599673 - DNA, 14 bp, D. melanogaster
caagcagcagcagc

SEQ ID NO: 599674 - DNA, 13 bp, D. melanogaster
caagcaggcatta

SEQ ID NO: 599675 - DNA, 13 bp, D. melanogaster
caagcaggccacc

SEQ ID NO: 599676 - DNA, 13 bp, D. melanogaster
caagcagtgcaaa

SEQ ID NO: 599677 - DNA, 13 bp, D. melanogaster
caagcatacaaaa

SEQ ID NO: 599678 - DNA, 13 bp, D. melanogaster
caagcatattcta

SEQ ID NO: 599679 - DNA, 13 bp, D. melanogaster
caagcatgcgcag

SEQ ID NO: 599680 - DNA, 13 bp, D. melanogaster
caagcatttcatg

SEQ ID NO: 599681 - DNA, 13 bp, D. melanogaster
caagcatttctat

SEQ ID NO: 599682 - DNA, 13 bp, D. melanogaster
caagcatttgtat

SEQ ID NO: 599683 - DNA, 14 bp, D. melanogaster
caagcatttgtatc

SEQ ID NO: 599684 - DNA, 13 bp, D. melanogaster
caagcatttgtgt

SEQ ID NO: 599685 - DNA, 13 bp, D. melanogaster
caagcatttgttt

SEQ ID NO: 599686 - DNA, 13 bp, D. melanogaster
caagcattttaaa

SEQ ID NO: 599687 - DNA, 13 bp, D. melanogaster
caagccaaaatta

SEQ ID NO: 599688 - DNA, 13 bp, D. melanogaster
caagccaaactaa

SEQ ID NO: 599689 - DNA, 13 bp, D. melanogaster
caagccaaagaat

SEQ ID NO: 599690 - DNA, 13 bp, D. melanogaster
caagccaaagcaa

SEQ ID NO: 599691 - DNA, 14 bp, D. melanogaster
caagccaaagccaa

SEQ ID NO: 599692 - DNA, 13 bp, D. melanogaster
caagccaaataaa

SEQ ID NO: 599693 - DNA, 13 bp, D. melanogaster
caagccaaatgca

SEQ ID NO: 599694 - DNA, 13 bp, D. melanogaster
caagccaagccaa

SEQ ID NO: 599695 - DNA, 14 bp, D. melanogaster
caagccaagccaaa

SEQ ID NO: 599696 - DNA, 16 bp, D. melanogaster
caagccaagccaagcc

SEQ ID NO: 599697 - DNA, 13 bp, D. melanogaster
caagccaagtcaa

SEQ ID NO: 599698 - DNA, 13 bp, D. melanogaster
caagccaattgca

SEQ ID NO: 599699 - DNA, 13 bp, D. melanogaster
caagccattaaaa

SEQ ID NO: 599700 - DNA, 13 bp, D. melanogaster
caagcccaagccc

SEQ ID NO: 599701 - DNA, 13 bp, D. melanogaster
caagcccgaattc

SEQ ID NO: 599702 - DNA, 13 bp, D. melanogaster
caagccgcaaaaa

SEQ ID NO: 599703 - DNA, 13 bp, D. melanogaster
caagccgcccaaa

SEQ ID NO: 599704 - DNA, 14 bp, D. melanogaster
caagcctaaagata

SEQ ID NO: 599705 - DNA, 13 bp, D. melanogaster
caagccttttaac

SEQ ID NO: 599706 - DNA, 13 bp, D. melanogaster
caagcgaaaaaat

SEQ ID NO: 599707 - DNA, 13 bp, D. melanogaster
caagcgaaaataa

SEQ ID NO: 599708 - DNA, 13 bp, D. melanogaster
caagcgaaacttt

SEQ ID NO: 599709 - DNA, 13 bp, D. melanogaster
caagcgaaataaa

SEQ ID NO: 599710 - DNA, 13 bp, D. melanogaster
caagcgaatgcaa

SEQ ID NO: 599711 - DNA, 13 bp, D. melanogaster
caagcgaatgcca

SEQ ID NO: 599712 - DNA, 13 bp, D. melanogaster
caagcgacagttt

SEQ ID NO: 599713 - DNA, 13 bp, D. melanogaster
caagcgccagaaa

SEQ ID NO: 599714 - DNA, 13 bp, D. melanogaster
caagcgcttcaaa

SEQ ID NO: 599715 - DNA, 13 bp, D. melanogaster
caagcggcaaaca

SEQ ID NO: 599716 - DNA, 13 bp, D. melanogaster
caagcgttttccc

SEQ ID NO: 599717 - DNA, 13 bp, D. melanogaster
caagctaaatata

SEQ ID NO: 599718 - DNA, 13 bp, D. melanogaster
caagctatctgaa

SEQ ID NO: 599719 - DNA, 14 bp, D. melanogaster
caagctatctgaat

SEQ ID NO: 599720 - DNA, 13 bp, D. melanogaster
caagctcagatca

SEQ ID NO: 599721 - DNA, 13 bp, D. melanogaster
caagctcataaat

SEQ ID NO: 599722 - DNA, 13 bp, D. melanogaster
caagctgaaaatt

SEQ ID NO: 599723 - DNA, 13 bp, D. melanogaster
caagctgcaaaaa

SEQ ID NO: 599724 - DNA, 13 bp, D. melanogaster
caagctggaaaat

SEQ ID NO: 599725 - DNA, 13 bp, D. melanogaster
caagctggcaaac

SEQ ID NO: 599726 - DNA, 13 bp, D. melanogaster
caagctgttgccc

SEQ ID NO: 599727 - DNA, 13 bp, D. melanogaster
caagctgtttaat

SEQ ID NO: 599728 - DNA, 13 bp, D. melanogaster
caagcttaaaaaa

SEQ ID NO: 599729 - DNA, 13 bp, D. melanogaster
caagctttgtaaa

SEQ ID NO: 599730 - DNA, 13 bp, D. melanogaster
caaggaaaaaccc

SEQ ID NO: 599731 - DNA, 13 bp, D. melanogaster
caaggaaaacacg

SEQ ID NO: 599732 - DNA, 13 bp, D. melanogaster
caaggaaaacatt

SEQ ID NO: 599733 - DNA, 13 bp, D. melanogaster
caaggaaaataag

SEQ ID NO: 599734 - DNA, 13 bp, D. melanogaster
caaggaaaatggc

SEQ ID NO: 599735 - DNA, 13 bp, D. melanogaster
caaggaaaatgtt

SEQ ID NO: 599736 - DNA, 13 bp, D. melanogaster
caaggaaatgaaa

SEQ ID NO: 599737 - DNA, 13 bp, D. melanogaster
caaggaagacatt

SEQ ID NO: 599738 - DNA, 13 bp, D. melanogaster
caaggaagcgttc

SEQ ID NO: 599739 - DNA, 13 bp, D. melanogaster
caaggacaaaccc

SEQ ID NO: 599740 - DNA, 13 bp, D. melanogaster
caaggacatttcg

SEQ ID NO: 599741 - DNA, 13 bp, D. melanogaster
caaggaccaagga

SEQ ID NO: 599742 - DNA, 14 bp, D. melanogaster
caaggaccaaggac

SEQ ID NO: 599743 - DNA, 13 bp, D. melanogaster
caaggacgaagga

SEQ ID NO: 599744 - DNA, 13 bp, D. melanogaster
caaggagcaagga

SEQ ID NO: 599745 - DNA, 13 bp, D. melanogaster
caaggagcaggag

SEQ ID NO: 599746 - DNA, 13 bp, D. melanogaster
caaggaggatgtc

SEQ ID NO: 599747 - DNA, 13 bp, D. melanogaster
caaggagggcata

SEQ ID NO: 599748 - DNA, 13 bp, D. melanogaster
caaggagttttaa

SEQ ID NO: 599749 - DNA, 13 bp, D. melanogaster
caaggatattttt

SEQ ID NO: 599750 - DNA, 13 bp, D. melanogaster
caaggatgccaag

SEQ ID NO: 599751 - DNA, 13 bp, D. melanogaster
caaggatgcggca

SEQ ID NO: 599752 - DNA, 13 bp, D. melanogaster
caaggcaaaaagt

SEQ ID NO: 599753 - DNA, 13 bp, D. melanogaster
caaggcaaaagcc

SEQ ID NO: 599754 - DNA, 13 bp, D. melanogaster
caaggcaaacgaa

SEQ ID NO: 599755 - DNA, 13 bp, D. melanogaster
caaggcaaataaa

SEQ ID NO: 599756 - DNA, 13 bp, D. melanogaster
caaggcaaatcaa

SEQ ID NO: 599757 - DNA, 13 bp, D. melanogaster
caaggcaaatgaa

SEQ ID NO: 599758 - DNA, 13 bp, D. melanogaster
caaggcaaatttt

SEQ ID NO: 599759 - DNA, 13 bp, D. melanogaster
caaggcaaggcaa

SEQ ID NO: 599760 - DNA, 13 bp, D. melanogaster
caaggcaataaaa

SEQ ID NO: 599761 - DNA, 13 bp, D. melanogaster
caaggcaattaaa

SEQ ID NO: 599762 - DNA, 13 bp, D. melanogaster
caaggcagcagtg

SEQ ID NO: 599763 - DNA, 14 bp, D. melanogaster
caaggcatatcact

SEQ ID NO: 599764 - DNA, 13 bp, D. melanogaster
caaggcatgaaaa

SEQ ID NO: 599765 - DNA, 13 bp, D. melanogaster
caaggccattata

SEQ ID NO: 599766 - DNA, 15 bp, D. melanogaster
caaggccgcaccctc

SEQ ID NO: 599767 - DNA, 13 bp, D. melanogaster
caaggcgaattta

SEQ ID NO: 599768 - DNA, 14 bp, D. melanogaster
caaggctgtcacca

SEQ ID NO: 599769 - DNA, 13 bp, D. melanogaster
caagggctttggt

SEQ ID NO: 599770 - DNA, 13 bp, D. melanogaster
caaggggttaagg

SEQ ID NO: 599771 - DNA, 14 bp, D. melanogaster
caaggtgaaagtaa

SEQ ID NO: 599772 - DNA, 13 bp, D. melanogaster
caaggtgactaag

SEQ ID NO: 599773 - DNA, 13 bp, D. melanogaster
caaggtggattaa

SEQ ID NO: 599774 - DNA, 13 bp, D. melanogaster
caagtaaaaaatg

SEQ ID NO: 599775 - DNA, 13 bp, D. melanogaster
caagtaaaataat

SEQ ID NO: 599776 - DNA, 13 bp, D. melanogaster
caagtaaataaac

SEQ ID NO: 599777 - DNA, 13 bp, D. melanogaster
caagtaaataaat

SEQ ID NO: 599778 - DNA, 14 bp, D. melanogaster
caagtaaataaata

SEQ ID NO: 599779 - DNA, 13 bp, D. melanogaster
caagtaaatgcaa

SEQ ID NO: 599780 - DNA, 13 bp, D. melanogaster
caagtaaattaat

SEQ ID NO: 599781 - DNA, 13 bp, D. melanogaster
caagtaaattgaa

SEQ ID NO: 599782 - DNA, 13 bp, D. melanogaster
caagtaataattt

SEQ ID NO: 599783 - DNA, 14 bp, D. melanogaster
caagtacaagtaca

SEQ ID NO: 599784 - DNA, 13 bp, D. melanogaster
caagtacaccagc

SEQ ID NO: 599785 - DNA, 13 bp, D. melanogaster
caagtacaggaaa

SEQ ID NO: 599786 - DNA, 13 bp, D. melanogaster
caagtacataaat

SEQ ID NO: 599787 - DNA, 13 bp, D. melanogaster
caagtacatttta

SEQ ID NO: 599788 - DNA, 13 bp, D. melanogaster
caagtaccgatcc

SEQ ID NO: 599789 - DNA, 13 bp, D. melanogaster
caagtagcaagta

SEQ ID NO: 599790 - DNA, 13 bp, D. melanogaster
caagtaggcaaaa

SEQ ID NO: 599791 - DNA, 13 bp, D. melanogaster
caagtatagtaca

SEQ ID NO: 599792 - DNA, 14 bp, D. melanogaster
caagtatatatata

SEQ ID NO: 599793 - DNA, 13 bp, D. melanogaster
caagtatgcaaat

SEQ ID NO: 599794 - DNA, 14 bp, D. melanogaster
caagtattaatcat

SEQ ID NO: 599795 - DNA, 13 bp, D. melanogaster
caagtatttattt

SEQ ID NO: 599796 - DNA, 13 bp, D. melanogaster
caagtatttcaaa

SEQ ID NO: 599797 - DNA, 13 bp, D. melanogaster
caagtatttgtat

SEQ ID NO: 599798 - DNA, 13 bp, D. melanogaster
caagtattttgtt

SEQ ID NO: 599799 - DNA, 13 bp, D. melanogaster
caagtcaaacaaa

SEQ ID NO: 599800 - DNA, 13 bp, D. melanogaster
caagtcaaataaa

SEQ ID NO: 599801 - DNA, 13 bp, D. melanogaster
caagtcaacggaa

SEQ ID NO: 599802 - DNA, 13 bp, D. melanogaster
caagtcaagaaaa

SEQ ID NO: 599803 - DNA, 13 bp, D. melanogaster
caagtcaagtcaa

SEQ ID NO: 599804 - DNA, 14 bp, D. melanogaster
caagtcaagtcaag

SEQ ID NO: 599805 - DNA, 13 bp, D. melanogaster
caagtcaagtcga

SEQ ID NO: 599806 - DNA, 13 bp, D. melanogaster
caagtcaagtggc

SEQ ID NO: 599807 - DNA, 13 bp, D. melanogaster
caagtcataaatt

SEQ ID NO: 599808 - DNA, 13 bp, D. melanogaster
caagtcatcaaca

SEQ ID NO: 599809 - DNA, 14 bp, D. melanogaster
caagtccaagtcca

SEQ ID NO: 599810 - DNA, 16 bp, D. melanogaster
caagtccaagtccaag

SEQ ID NO: 599811 - DNA, 13 bp, D. melanogaster
caagtccaatctg

SEQ ID NO: 599812 - DNA, 13 bp, D. melanogaster
caagtccatattg

SEQ ID NO: 599813 - DNA, 13 bp, D. melanogaster
caagtccatgtcc

SEQ ID NO: 599814 - DNA, 13 bp, D. melanogaster
caagtccgagtcc

SEQ ID NO: 599815 - DNA, 13 bp, D. melanogaster
caagtccttttca

SEQ ID NO: 599816 - DNA, 13 bp, D. melanogaster
caagtcgaacaaa

SEQ ID NO: 599817 - DNA, 13 bp, D. melanogaster
caagtcgagtcga

SEQ ID NO: 599818 - DNA, 14 bp, D. melanogaster
caagtcgtggagcg

SEQ ID NO: 599819 - DNA, 13 bp, D. melanogaster
caagtcgttcaag

SEQ ID NO: 599820 - DNA, 13 bp, D. melanogaster
caagtcgttttgc

SEQ ID NO: 599821 - DNA, 13 bp, D. melanogaster
caagtctggaaag

SEQ ID NO: 599822 - DNA, 13 bp, D. melanogaster
caagtgaaaaatt

SEQ ID NO: 599823 - DNA, 13 bp, D. melanogaster
caagtgaaaataa

SEQ ID NO: 599824 - DNA, 13 bp, D. melanogaster
caagtgaaaatat

SEQ ID NO: 599825 - DNA, 13 bp, D. melanogaster
caagtgaaatcaa

SEQ ID NO: 599826 - DNA, 13 bp, D. melanogaster
caagtgaaatgca

SEQ ID NO: 599827 - DNA, 13 bp, D. melanogaster
caagtgaagactg

SEQ ID NO: 599828 - DNA, 13 bp, D. melanogaster
caagtgagccgcc

SEQ ID NO: 599829 - DNA, 13 bp, D. melanogaster
caagtgcaaaagt

SEQ ID NO: 599830 - DNA, 13 bp, D. melanogaster
caagtgcaaagtg

SEQ ID NO: 599831 - DNA, 13 bp, D. melanogaster
caagtgcaaatgt

SEQ ID NO: 599832 - DNA, 13 bp, D. melanogaster
caagtgcaactgc

SEQ ID NO: 599833 - DNA, 14 bp, D. melanogaster
caagtgcaactgca

SEQ ID NO: 599834 - DNA, 13 bp, D. melanogaster
caagtgcaagtgc

SEQ ID NO: 599835 - DNA, 14 bp, D. melanogaster
caagtgcaagtgca

SEQ ID NO: 599836 - DNA, 13 bp, D. melanogaster
caagtgcaataaa

SEQ ID NO: 599837 - DNA, 13 bp, D. melanogaster
caagtgcaatgca

SEQ ID NO: 599838 - DNA, 13 bp, D. melanogaster
caagtgcacacat

SEQ ID NO: 599839 - DNA, 13 bp, D. melanogaster
caagtgcacagct

SEQ ID NO: 599840 - DNA, 13 bp, D. melanogaster
caagtgcagcagc

SEQ ID NO: 599841 - DNA, 13 bp, D. melanogaster
caagtgcagcgag

SEQ ID NO: 599842 - DNA, 13 bp, D. melanogaster
caagtgcagctgc

SEQ ID NO: 599843 - DNA, 13 bp, D. melanogaster
caagtgcagtgca

SEQ ID NO: 599844 - DNA, 13 bp, D. melanogaster
caagtgcatttat

SEQ ID NO: 599845 - DNA, 13 bp, D. melanogaster
caagtgcatttgc

SEQ ID NO: 599846 - DNA, 13 bp, D. melanogaster
caagtgccaaaag

SEQ ID NO: 599847 - DNA, 13 bp, D. melanogaster
caagtgccaaagt

SEQ ID NO: 599848 - DNA, 13 bp, D. melanogaster
caagtgccaagtg

SEQ ID NO: 599849 - DNA, 13 bp, D. melanogaster
caagtgccacaaa

SEQ ID NO: 599850 - DNA, 13 bp, D. melanogaster
caagtgccacgcc

SEQ ID NO: 599851 - DNA, 13 bp, D. melanogaster
caagtgcccaaaa

SEQ ID NO: 599852 - DNA, 14 bp, D. melanogaster
caagtgcccaaaat

SEQ ID NO: 599853 - DNA, 13 bp, D. melanogaster
caagtgccgttgg

SEQ ID NO: 599854 - DNA, 13 bp, D. melanogaster
caagtgcgtgtgt

SEQ ID NO: 599855 - DNA, 13 bp, D. melanogaster
caagtgctgcaaa

SEQ ID NO: 599856 - DNA, 13 bp, D. melanogaster
caagtgctgctgc

SEQ ID NO: 599857 - DNA, 13 bp, D. melanogaster
caagtgcttttcc

SEQ ID NO: 599858 - DNA, 13 bp, D. melanogaster
caagtggaaaaat

SEQ ID NO: 599859 - DNA, 13 bp, D. melanogaster
caagtggaaaatc

SEQ ID NO: 599860 - DNA, 13 bp, D. melanogaster
caagtggaaaatt

SEQ ID NO: 599861 - DNA, 13 bp, D. melanogaster
caagtggaaatta

SEQ ID NO: 599862 - DNA, 13 bp, D. melanogaster
caagtggaaattg

SEQ ID NO: 599863 - DNA, 13 bp, D. melanogaster
caagtggaagtgg

SEQ ID NO: 599864 - DNA, 13 bp, D. melanogaster
caagtggatgttt

SEQ ID NO: 599865 - DNA, 13 bp, D. melanogaster
caagtggcaaatg

SEQ ID NO: 599866 - DNA, 13 bp, D. melanogaster
caagtggcaagtg

SEQ ID NO: 599867 - DNA, 13 bp, D. melanogaster
caagtggcagcca

SEQ ID NO: 599868 - DNA, 13 bp, D. melanogaster
caagtggcaggca

SEQ ID NO: 599869 - DNA, 13 bp, D. melanogaster
caagtggcagtgg

SEQ ID NO: 599870 - DNA, 13 bp, D. melanogaster
caagtggccaaaa

SEQ ID NO: 599871 - DNA, 13 bp, D. melanogaster
caagtggccaaca

SEQ ID NO: 599872 - DNA, 13 bp, D. melanogaster
caagtggccaagt

SEQ ID NO: 599873 - DNA, 14 bp, D. melanogaster
caagtggccaagtg

SEQ ID NO: 599874 - DNA, 13 bp, D. melanogaster
caagtggctgctg

SEQ ID NO: 599875 - DNA, 13 bp, D. melanogaster
caagtggctggca

SEQ ID NO: 599876 - DNA, 13 bp, D. melanogaster
caagtggctggct

SEQ ID NO: 599877 - DNA, 13 bp, D. melanogaster
caagtgggcggtg

SEQ ID NO: 599878 - DNA, 13 bp, D. melanogaster
caagtgggtggca

SEQ ID NO: 599879 - DNA, 13 bp, D. melanogaster
caagtgggtgggt

SEQ ID NO: 599880 - DNA, 13 bp, D. melanogaster
caagtgggtggtg

SEQ ID NO: 599881 - DNA, 13 bp, D. melanogaster
caagtggtcaatg

SEQ ID NO: 599882 - DNA, 14 bp, D. melanogaster
caagtggtctagct

SEQ ID NO: 599883 - DNA, 13 bp, D. melanogaster
caagtgtaaataa

SEQ ID NO: 599884 - DNA, 13 bp, D. melanogaster
caagtgtaaattt

SEQ ID NO: 599885 - DNA, 13 bp, D. melanogaster
caagtgtatgaag

SEQ ID NO: 599886 - DNA, 13 bp, D. melanogaster
caagtgtcatcat

SEQ ID NO: 599887 - DNA, 13 bp, D. melanogaster
caagtgtccggaa

SEQ ID NO: 599888 - DNA, 13 bp, D. melanogaster
caagtgtgtgttt

SEQ ID NO: 599889 - DNA, 13 bp, D. melanogaster
caagtgttgcact

SEQ ID NO: 599890 - DNA, 13 bp, D. melanogaster
caagtgttggcca

SEQ ID NO: 599891 - DNA, 13 bp, D. melanogaster
caagtgtttgttt

SEQ ID NO: 599892 - DNA, 13 bp, D. melanogaster
caagtgttttggc

SEQ ID NO: 599893 - DNA, 13 bp, D. melanogaster
caagtgtttttct

SEQ ID NO: 599894 - DNA, 14 bp, D. melanogaster
caagtgtttttctc

SEQ ID NO: 599895 - DNA, 13 bp, D. melanogaster
caagtgttttttt

SEQ ID NO: 599896 - DNA, 14 bp, D. melanogaster
caagtgtttttttt

SEQ ID NO: 599897 - DNA, 13 bp, D. melanogaster
caagttaaatgaa

SEQ ID NO: 599898 - DNA, 13 bp, D. melanogaster
caagttaatgccg

SEQ ID NO: 599899 - DNA, 13 bp, D. melanogaster
caagttacccatt

SEQ ID NO: 599900 - DNA, 14 bp, D. melanogaster
caagttacccatta

SEQ ID NO: 599901 - DNA, 13 bp, D. melanogaster
caagttagcaaaa

SEQ ID NO: 599902 - DNA, 13 bp, D. melanogaster
caagttagtggtt

SEQ ID NO: 599903 - DNA, 14 bp, D. melanogaster
caagttatagccaa

SEQ ID NO: 599904 - DNA, 13 bp, D. melanogaster
caagttatccaag

SEQ ID NO: 599905 - DNA, 13 bp, D. melanogaster
caagttcaaaact

SEQ ID NO: 599906 - DNA, 13 bp, D. melanogaster
caagttcaaaatt

SEQ ID NO: 599907 - DNA, 13 bp, D. melanogaster
caagttcaaagtc

SEQ ID NO: 599908 - DNA, 13 bp, D. melanogaster
caagttcaaatgc

SEQ ID NO: 599909 - DNA, 13 bp, D. melanogaster
caagttcaagtgc

SEQ ID NO: 599910 - DNA, 14 bp, D. melanogaster
caagttcaagttca

SEQ ID NO: 599911 - DNA, 13 bp, D. melanogaster
caagttcaagttg

SEQ ID NO: 599912 - DNA, 13 bp, D. melanogaster
caagttcaagttt

SEQ ID NO: 599913 - DNA, 13 bp, D. melanogaster
caagttcaatggc

SEQ ID NO: 599914 - DNA, 13 bp, D. melanogaster
caagttcagaaat

SEQ ID NO: 599915 - DNA, 13 bp, D. melanogaster
caagttcataaaa

SEQ ID NO: 599916 - DNA, 13 bp, D. melanogaster
caagttcataaat

SEQ ID NO: 599917 - DNA, 13 bp, D. melanogaster
caagttcattata

SEQ ID NO: 599918 - DNA, 14 bp, D. melanogaster
caagttccacatta

SEQ ID NO: 599919 - DNA, 13 bp, D. melanogaster
caagttccacttg

SEQ ID NO: 599920 - DNA, 13 bp, D. melanogaster
caagttcgctgcc

SEQ ID NO: 599921 - DNA, 13 bp, D. melanogaster
caagttctcggct

SEQ ID NO: 599922 - DNA, 13 bp, D. melanogaster
caagttctttttt

SEQ ID NO: 599923 - DNA, 13 bp, D. melanogaster
caagttgaaaaat

SEQ ID NO: 599924 - DNA, 13 bp, D. melanogaster
caagttgaaagtt

SEQ ID NO: 599925 - DNA, 15 bp, D. melanogaster
caagttgaagagttt

SEQ ID NO: 599926 - DNA, 13 bp, D. melanogaster
caagttgaagttg

SEQ ID NO: 599927 - DNA, 13 bp, D. melanogaster
caagttgaatgca

SEQ ID NO: 599928 - DNA, 13 bp, D. melanogaster
caagttgacattt

SEQ ID NO: 599929 - DNA, 13 bp, D. melanogaster
caagttgcaaaaa

SEQ ID NO: 599930 - DNA, 13 bp, D. melanogaster
caagttgcaacaa

SEQ ID NO: 599931 - DNA, 13 bp, D. melanogaster
caagttgcaactt

SEQ ID NO: 599932 - DNA, 13 bp, D. melanogaster
caagttgcagttg

SEQ ID NO: 599933 - DNA, 13 bp, D. melanogaster
caagttgcatgtt

SEQ ID NO: 599934 - DNA, 13 bp, D. melanogaster
caagttgcattta

SEQ ID NO: 599935 - DNA, 13 bp, D. melanogaster
caagttgccagtt

SEQ ID NO: 599936 - DNA, 14 bp, D. melanogaster
caagttgctgctgc

SEQ ID NO: 599937 - DNA, 13 bp, D. melanogaster
caagttgctgttg

SEQ ID NO: 599938 - DNA, 13 bp, D. melanogaster
caagttggaaaat

SEQ ID NO: 599939 - DNA, 13 bp, D. melanogaster
caagttggcagca

SEQ ID NO: 599940 - DNA, 13 bp, D. melanogaster
caagttgtaaaat

SEQ ID NO: 599941 - DNA, 13 bp, D. melanogaster
caagttgttgctg

SEQ ID NO: 599942 - DNA, 13 bp, D. melanogaster
caagtttaaacaa

SEQ ID NO: 599943 - DNA, 14 bp, D. melanogaster
caagtttaaagaaa

SEQ ID NO: 599944 - DNA, 13 bp, D. melanogaster
caagtttaacttt

SEQ ID NO: 599945 - DNA, 13 bp, D. melanogaster
caagtttaataaa

SEQ ID NO: 599946 - DNA, 13 bp, D. melanogaster
caagtttattagt

SEQ ID NO: 599947 - DNA, 13 bp, D. melanogaster
caagtttatttat

SEQ ID NO: 599948 - DNA, 13 bp, D. melanogaster
caagtttcaaaaa

SEQ ID NO: 599949 - DNA, 13 bp, D. melanogaster
caagtttgccaaa

SEQ ID NO: 599950 - DNA, 13 bp, D. melanogaster
caagtttgtaagg

SEQ ID NO: 599951 - DNA, 13 bp, D. melanogaster
caagtttgttgac

SEQ ID NO: 599952 - DNA, 13 bp, D. melanogaster
caagtttgttgat

SEQ ID NO: 599953 - DNA, 13 bp, D. melanogaster
caagtttgttgtc

SEQ ID NO: 599954 - DNA, 13 bp, D. melanogaster
caagtttgttttc

SEQ ID NO: 599955 - DNA, 13 bp, D. melanogaster
caagttttaaagt

SEQ ID NO: 599956 - DNA, 13 bp, D. melanogaster
caagttttaataa

SEQ ID NO: 599957 - DNA, 13 bp, D. melanogaster
caagttttaatta

SEQ ID NO: 599958 - DNA, 13 bp, D. melanogaster
caagtttttaata

SEQ ID NO: 599959 - DNA, 13 bp, D. melanogaster
caagtttttcaat

SEQ ID NO: 599960 - DNA, 13 bp, D. melanogaster
caagtttttggcc

SEQ ID NO: 599961 - DNA, 13 bp, D. melanogaster
caagtttttgttg

SEQ ID NO: 599962 - DNA, 13 bp, D. melanogaster
caagttttttcaa

SEQ ID NO: 599963 - DNA, 13 bp, D. melanogaster
caataaaaaatgt

SEQ ID NO: 599964 - DNA, 14 bp, D. melanogaster
caataaaaaatgta

SEQ ID NO: 599965 - DNA, 13 bp, D. melanogaster
caataaaaacgca

SEQ ID NO: 599966 - DNA, 13 bp, D. melanogaster
caataaaaactgc

SEQ ID NO: 599967 - DNA, 14 bp, D. melanogaster
caataaaaactttt

SEQ ID NO: 599968 - DNA, 13 bp, D. melanogaster
caataaaaatatg

SEQ ID NO: 599969 - DNA, 13 bp, D. melanogaster
caataaaaatgat

SEQ ID NO: 599970 - DNA, 13 bp, D. melanogaster
caataaaaattga

SEQ ID NO: 599971 - DNA, 13 bp, D. melanogaster
caataaaacagca

SEQ ID NO: 599972 - DNA, 13 bp, D. melanogaster
caataaaacatgt

SEQ ID NO: 599973 - DNA, 13 bp, D. melanogaster
caataaaacattt

SEQ ID NO: 599974 - DNA, 13 bp, D. melanogaster
caataaaacctac

SEQ ID NO: 599975 - DNA, 13 bp, D. melanogaster
caataaaacgaag

SEQ ID NO: 599976 - DNA, 13 bp, D. melanogaster
caataaaacgatt

SEQ ID NO: 599977 - DNA, 13 bp, D. melanogaster
caataaaacgcaa

SEQ ID NO: 599978 - DNA, 13 bp, D. melanogaster
caataaaacgcag

SEQ ID NO: 599979 - DNA, 13 bp, D. melanogaster
caataaaacgttt

SEQ ID NO: 599980 - DNA, 13 bp, D. melanogaster
caataaaactttg

SEQ ID NO: 599981 - DNA, 14 bp, D. melanogaster
caataaaagcaaca

SEQ ID NO: 599982 - DNA, 13 bp, D. melanogaster
caataaaagccac

SEQ ID NO: 599983 - DNA, 13 bp, D. melanogaster
caataaaagcgaa

SEQ ID NO: 599984 - DNA, 13 bp, D. melanogaster
caataaaagtgtt

SEQ ID NO: 599985 - DNA, 13 bp, D. melanogaster
caataaaatactt

SEQ ID NO: 599986 - DNA, 13 bp, D. melanogaster
caataaaatagta

SEQ ID NO: 599987 - DNA, 13 bp, D. melanogaster
caataaaatattc

SEQ ID NO: 599988 - DNA, 13 bp, D. melanogaster
caataaaatcaag

SEQ ID NO: 599989 - DNA, 13 bp, D. melanogaster
caataaaatctat

SEQ ID NO: 599990 - DNA, 14 bp, D. melanogaster
caataaaatggcaa

SEQ ID NO: 599991 - DNA, 13 bp, D. melanogaster
caataaaatgtaa

SEQ ID NO: 599992 - DNA, 13 bp, D. melanogaster
caataaaatgtca

SEQ ID NO: 599993 - DNA, 14 bp, D. melanogaster
caataaaatgttaa

SEQ ID NO: 599994 - DNA, 13 bp, D. melanogaster
caataaaatgttt

SEQ ID NO: 599995 - DNA, 14 bp, D. melanogaster
caataaaatgttta

SEQ ID NO: 599996 - DNA, 13 bp, D. melanogaster
caataaaattgaa

SEQ ID NO: 599997 - DNA, 13 bp, D. melanogaster
caataaaatttga

SEQ ID NO: 599998 - DNA, 13 bp, D. melanogaster
caataaacaagca

SEQ ID NO: 599999 - DNA, 13 bp, D. melanogaster
caataaacattta

SEQ ID NO: 600000 - DNA, 13 bp, D. melanogaster
caataaacatttt

SEQ ID NO: 600001 - DNA, 13 bp, D. melanogaster
caataaacgttaa

SEQ ID NO: 600002 - DNA, 13 bp, D. melanogaster
caataaacttaat

SEQ ID NO: 600003 - DNA, 13 bp, D. melanogaster
caataaacttatt

SEQ ID NO: 600004 - DNA, 13 bp, D. melanogaster
caataaacttcat

SEQ ID NO: 600005 - DNA, 13 bp, D. melanogaster
caataaactttat

SEQ ID NO: 600006 - DNA, 13 bp, D. melanogaster
caataaactttta

SEQ ID NO: 600007 - DNA, 14 bp, D. melanogaster
caataaagaaatac

SEQ ID NO: 600008 - DNA, 13 bp, D. melanogaster
caataaagaatac

SEQ ID NO: 600009 - DNA, 13 bp, D. melanogaster
caataaagaatca

SEQ ID NO: 600010 - DNA, 13 bp, D. melanogaster
caataaagtgaaa

SEQ ID NO: 600011 - DNA, 13 bp, D. melanogaster
caataaagtgatg

SEQ ID NO: 600012 - DNA, 13 bp, D. melanogaster
caataaagtttaa

SEQ ID NO: 600013 - DNA, 13 bp, D. melanogaster
caataaataagca

SEQ ID NO: 600014 - DNA, 13 bp, D. melanogaster
caataaataatcc

SEQ ID NO: 600015 - DNA, 13 bp, D. melanogaster
caataaataattc

SEQ ID NO: 600016 - DNA, 13 bp, D. melanogaster
caataaataattg

SEQ ID NO: 600017 - DNA, 13 bp, D. melanogaster
caataaatacttg

SEQ ID NO: 600018 - DNA, 13 bp, D. melanogaster
caataaatagttt

SEQ ID NO: 600019 - DNA, 14 bp, D. melanogaster
caataaatatttga

SEQ ID NO: 600020 - DNA, 13 bp, D. melanogaster
caataaatcattg

SEQ ID NO: 600021 - DNA, 13 bp, D. melanogaster
caataaatcgatc

SEQ ID NO: 600022 - DNA, 13 bp, D. melanogaster
caataaatctatt

SEQ ID NO: 600023 - DNA, 13 bp, D. melanogaster
caataaatgcatt

SEQ ID NO: 600024 - DNA, 13 bp, D. melanogaster
caataaatggaaa

SEQ ID NO: 600025 - DNA, 13 bp, D. melanogaster
caataaatgtcaa

SEQ ID NO: 600026 - DNA, 13 bp, D. melanogaster
caataaatgtctt

SEQ ID NO: 600027 - DNA, 13 bp, D. melanogaster
caataaatgttaa

SEQ ID NO: 600028 - DNA, 13 bp, D. melanogaster
caataaattaaag

SEQ ID NO: 600029 - DNA, 13 bp, D. melanogaster
caataaattaagt

SEQ ID NO: 600030 - DNA, 13 bp, D. melanogaster
caataaattccat

SEQ ID NO: 600031 - DNA, 13 bp, D. melanogaster
caataaattgaaa

SEQ ID NO: 600032 - DNA, 13 bp, D. melanogaster
caataaattgaat

SEQ ID NO: 600033 - DNA, 13 bp, D. melanogaster
caataaattgcaa

SEQ ID NO: 600034 - DNA, 13 bp, D. melanogaster
caataaattgctt

SEQ ID NO: 600035 - DNA, 13 bp, D. melanogaster
caataaattgtaa

SEQ ID NO: 600036 - DNA, 14 bp, D. melanogaster
caataaattgttta

SEQ ID NO: 600037 - DNA, 13 bp, D. melanogaster
caataaatttatg

SEQ ID NO: 600038 - DNA, 13 bp, D. melanogaster
caataaatttcaa

SEQ ID NO: 600039 - DNA, 14 bp, D. melanogaster
caataaatttcaat

SEQ ID NO: 600040 - DNA, 13 bp, D. melanogaster
caataaatttgag

SEQ ID NO: 600041 - DNA, 13 bp, D. melanogaster
caataaatttgat

SEQ ID NO: 600042 - DNA, 14 bp, D. melanogaster
caataaatttgcaa

SEQ ID NO: 600043 - DNA, 14 bp, D. melanogaster
caataaatttgcat

SEQ ID NO: 600044 - DNA, 13 bp, D. melanogaster
caataaatttgtg

SEQ ID NO: 600045 - DNA, 13 bp, D. melanogaster
caataaattttca

SEQ ID NO: 600046 - DNA, 14 bp, D. melanogaster
caataaattttcat

SEQ ID NO: 600047 - DNA, 13 bp, D. melanogaster
caataaattttgc

SEQ ID NO: 600048 - DNA, 13 bp, D. melanogaster
caataaatttttc

SEQ ID NO: 600049 - DNA, 13 bp, D. melanogaster
caataacaaacag

SEQ ID NO: 600050 - DNA, 13 bp, D. melanogaster
caataacaaattg

SEQ ID NO: 600051 - DNA, 14 bp, D. melanogaster
caataacaacaacg

SEQ ID NO: 600052 - DNA, 13 bp, D. melanogaster
caataacaacaag

SEQ ID NO: 600053 - DNA, 13 bp, D. melanogaster
caataacaacgaa

SEQ ID NO: 600054 - DNA, 13 bp, D. melanogaster
caataacaatatt

SEQ ID NO: 600055 - DNA, 13 bp, D. melanogaster
caataacaatttc

SEQ ID NO: 600056 - DNA, 13 bp, D. melanogaster
caataacatcgtt

SEQ ID NO: 600057 - DNA, 13 bp, D. melanogaster
caataacattgat

SEQ ID NO: 600058 - DNA, 13 bp, D. melanogaster
caataacgaaaat

SEQ ID NO: 600059 - DNA, 13 bp, D. melanogaster
caataacgagtgc

SEQ ID NO: 600060 - DNA, 13 bp, D. melanogaster
caataacgataat

SEQ ID NO: 600061 - DNA, 13 bp, D. melanogaster
caataacttcagt

SEQ ID NO: 600062 - DNA, 13 bp, D. melanogaster
caataactttatt

SEQ ID NO: 600063 - DNA, 13 bp, D. melanogaster
caataagaacaac

SEQ ID NO: 600064 - DNA, 13 bp, D. melanogaster
caataagagtaca

SEQ ID NO: 600065 - DNA, 13 bp, D. melanogaster
caataagcataaa

SEQ ID NO: 600066 - DNA, 13 bp, D. melanogaster
caataagccaaaa

SEQ ID NO: 600067 - DNA, 13 bp, D. melanogaster
caataaggcaggt

SEQ ID NO: 600068 - DNA, 13 bp, D. melanogaster
caataaggccagg

SEQ ID NO: 600069 - DNA, 13 bp, D. melanogaster
caataagtaaaat

SEQ ID NO: 600070 - DNA, 13 bp, D. melanogaster
caataagtaaata

SEQ ID NO: 600071 - DNA, 14 bp, D. melanogaster
caataagtgaaata

SEQ ID NO: 600072 - DNA, 13 bp, D. melanogaster
caataagttaaat

SEQ ID NO: 600073 - DNA, 13 bp, D. melanogaster
caataagttattt

SEQ ID NO: 600074 - DNA, 13 bp, D. melanogaster
caataagtttaaa

SEQ ID NO: 600075 - DNA, 14 bp, D. melanogaster
caataagtttaaaa

SEQ ID NO: 600076 - DNA, 13 bp, D. melanogaster
caataataacact

SEQ ID NO: 600077 - DNA, 13 bp, D. melanogaster
caataataatagc

SEQ ID NO: 600078 - DNA, 13 bp, D. melanogaster
caataataatagt

SEQ ID NO: 600079 - DNA, 13 bp, D. melanogaster
caataataatgac

SEQ ID NO: 600080 - DNA, 13 bp, D. melanogaster
caataatagtaat

SEQ ID NO: 600081 - DNA, 13 bp, D. melanogaster
caataatattgta

SEQ ID NO: 600082 - DNA, 13 bp, D. melanogaster
caataatcataat

SEQ ID NO: 600083 - DNA, 13 bp, D. melanogaster
caataatcgtaaa

SEQ ID NO: 600084 - DNA, 13 bp, D. melanogaster
caataatgaaaat

SEQ ID NO: 600085 - DNA, 13 bp, D. melanogaster
caataatgaaatt

SEQ ID NO: 600086 - DNA, 13 bp, D. melanogaster
caataatgctaaa

SEQ ID NO: 600087 - DNA, 14 bp, D. melanogaster
caataatgtgtttt

SEQ ID NO: 600088 - DNA, 13 bp, D. melanogaster
caataattatgta

SEQ ID NO: 600089 - DNA, 14 bp, D. melanogaster
caataattatttag

SEQ ID NO: 600090 - DNA, 13 bp, D. melanogaster
caataattgcaaa

SEQ ID NO: 600091 - DNA, 13 bp, D. melanogaster
caataattgcaat

SEQ ID NO: 600092 - DNA, 13 bp, D. melanogaster
caataattgttaa

SEQ ID NO: 600093 - DNA, 13 bp, D. melanogaster
caataattgttag

SEQ ID NO: 600094 - DNA, 13 bp, D. melanogaster
caataatttatgt

SEQ ID NO: 600095 - DNA, 14 bp, D. melanogaster
caataatttattgc

SEQ ID NO: 600096 - DNA, 13 bp, D. melanogaster
caataatttcatt

SEQ ID NO: 600097 - DNA, 14 bp, D. melanogaster
caataatttcattt

SEQ ID NO: 600098 - DNA, 13 bp, D. melanogaster
caataattttcaa

SEQ ID NO: 600099 - DNA, 13 bp, D. melanogaster
caataattttggt

SEQ ID NO: 600100 - DNA, 13 bp, D. melanogaster
caatacaaatgca

SEQ ID NO: 600101 - DNA, 13 bp, D. melanogaster
caatacaaattta

SEQ ID NO: 600102 - DNA, 14 bp, D. melanogaster
caatacaagaaaat

SEQ ID NO: 600103 - DNA, 13 bp, D. melanogaster
caatacaatatat

SEQ ID NO: 600104 - DNA, 13 bp, D. melanogaster
caatacaatattt

SEQ ID NO: 600105 - DNA, 13 bp, D. melanogaster
caatacaattatt

SEQ ID NO: 600106 - DNA, 13 bp, D. melanogaster
caatacaatttgg

SEQ ID NO: 600107 - DNA, 13 bp, D. melanogaster
caatacatataca

SEQ ID NO: 600108 - DNA, 13 bp, D. melanogaster
caatacattgtga

SEQ ID NO: 600109 - DNA, 13 bp, D. melanogaster
caatacatttaat

SEQ ID NO: 600110 - DNA, 13 bp, D. melanogaster
caatacattttaa

SEQ ID NO: 600111 - DNA, 13 bp, D. melanogaster
caatacatttttg

SEQ ID NO: 600112 - DNA, 14 bp, D. melanogaster
caatacctttatgt

SEQ ID NO: 600113 - DNA, 13 bp, D. melanogaster
caatactaacaac

SEQ ID NO: 600114 - DNA, 13 bp, D. melanogaster
caatagaagcgtt

SEQ ID NO: 600115 - DNA, 13 bp, D. melanogaster
caatagaatttaa

SEQ ID NO: 600116 - DNA, 13 bp, D. melanogaster
caatagagcggga

SEQ ID NO: 600117 - DNA, 14 bp, D. melanogaster
caatagcaacaaaa

SEQ ID NO: 600118 - DNA, 14 bp, D. melanogaster
caatagcaataaaa

SEQ ID NO: 600119 - DNA, 13 bp, D. melanogaster
caatagcagcagc

SEQ ID NO: 600120 - DNA, 14 bp, D. melanogaster
caatagcagcagca

SEQ ID NO: 600121 - DNA, 13 bp, D. melanogaster
caatagcagcatc

SEQ ID NO: 600122 - DNA, 13 bp, D. melanogaster
caatagcgccaat

SEQ ID NO: 600123 - DNA, 13 bp, D. melanogaster
caatagctacttt

SEQ ID NO: 600124 - DNA, 13 bp, D. melanogaster
caatagtaagatg

SEQ ID NO: 600125 - DNA, 13 bp, D. melanogaster
caatagtttgttt

SEQ ID NO: 600126 - DNA, 13 bp, D. melanogaster
caatagtttttta

SEQ ID NO: 600127 - DNA, 13 bp, D. melanogaster
caatagttttttt

SEQ ID NO: 600128 - DNA, 13 bp, D. melanogaster
caatataaaatga

SEQ ID NO: 600129 - DNA, 13 bp, D. melanogaster
caatataaacatt

SEQ ID NO: 600130 - DNA, 13 bp, D. melanogaster
caatataaacgta

SEQ ID NO: 600131 - DNA, 13 bp, D. melanogaster
caatataaagtat

SEQ ID NO: 600132 - DNA, 13 bp, D. melanogaster
caatataacattt

SEQ ID NO: 600133 - DNA, 13 bp, D. melanogaster
caatataaccatt

SEQ ID NO: 600134 - DNA, 13 bp, D. melanogaster
caatataatgcag

SEQ ID NO: 600135 - DNA, 13 bp, D. melanogaster
caatatacaaatt

SEQ ID NO: 600136 - DNA, 14 bp, D. melanogaster
caatatacaactta

SEQ ID NO: 600137 - DNA, 13 bp, D. melanogaster
caatatacaattt

SEQ ID NO: 600138 - DNA, 13 bp, D. melanogaster
caatatacacata

SEQ ID NO: 600139 - DNA, 13 bp, D. melanogaster
caatatacatata

SEQ ID NO: 600140 - DNA, 13 bp, D. melanogaster
caatatagaattg

SEQ ID NO: 600141 - DNA, 13 bp, D. melanogaster
caatatatacaat

SEQ ID NO: 600142 - DNA, 13 bp, D. melanogaster
caatatatacaca

SEQ ID NO: 600143 - DNA, 14 bp, D. melanogaster
caatatatacatat

SEQ ID NO: 600144 - DNA, 13 bp, D. melanogaster
caatatatagata

SEQ ID NO: 600145 - DNA, 13 bp, D. melanogaster
caatatatataca

SEQ ID NO: 600146 - DNA, 13 bp, D. melanogaster
caatatatatgta

SEQ ID NO: 600147 - DNA, 13 bp, D. melanogaster
caatatatatttc

SEQ ID NO: 600148 - DNA, 13 bp, D. melanogaster
caatatatgtaaa

SEQ ID NO: 600149 - DNA, 15 bp, D. melanogaster
caatatatgtatgta

SEQ ID NO: 600150 - DNA, 13 bp, D. melanogaster
caatatattcaaa

SEQ ID NO: 600151 - DNA, 13 bp, D. melanogaster
caatatattgaaa

SEQ ID NO: 600152 - DNA, 14 bp, D. melanogaster
caatatattgtaca

SEQ ID NO: 600153 - DNA, 13 bp, D. melanogaster
caatatatttttg

SEQ ID NO: 600154 - DNA, 13 bp, D. melanogaster
caatatcaaattg

SEQ ID NO: 600155 - DNA, 14 bp, D. melanogaster
caatatcaaattga

SEQ ID NO: 600156 - DNA, 13 bp, D. melanogaster
caatatcaacaat

SEQ ID NO: 600157 - DNA, 13 bp, D. melanogaster
caatatcaatata

SEQ ID NO: 600158 - DNA, 13 bp, D. melanogaster
caatatcaatatc

SEQ ID NO: 600159 - DNA, 13 bp, D. melanogaster
caatatcagcaag

SEQ ID NO: 600160 - DNA, 13 bp, D. melanogaster
caatatccaataa

SEQ ID NO: 600161 - DNA, 13 bp, D. melanogaster
caatatcccaaca

SEQ ID NO: 600162 - DNA, 13 bp, D. melanogaster
caatatcggctaa

SEQ ID NO: 600163 - DNA, 13 bp, D. melanogaster
caatatctacaat

SEQ ID NO: 600164 - DNA, 13 bp, D. melanogaster
caatatctattca

SEQ ID NO: 600165 - DNA, 14 bp, D. melanogaster
caatatgaagaagt

SEQ ID NO: 600166 - DNA, 13 bp, D. melanogaster
caatatgatgaaa

SEQ ID NO: 600167 - DNA, 14 bp, D. melanogaster
caatatgatgtaat

SEQ ID NO: 600168 - DNA, 13 bp, D. melanogaster
caatatgctaatt

SEQ ID NO: 600169 - DNA, 13 bp, D. melanogaster
caatatgtatgta

SEQ ID NO: 600170 - DNA, 14 bp, D. melanogaster
caatatgtatgtat

SEQ ID NO: 600171 - DNA, 13 bp, D. melanogaster
caatatgtattta

SEQ ID NO: 600172 - DNA, 13 bp, D. melanogaster
caatatgtgaact

SEQ ID NO: 600173 - DNA, 13 bp, D. melanogaster
caatatgtgtgtg

SEQ ID NO: 600174 - DNA, 13 bp, D. melanogaster
caatatgtttaat

SEQ ID NO: 600175 - DNA, 13 bp, D. melanogaster
caatatgtttact

SEQ ID NO: 600176 - DNA, 13 bp, D. melanogaster
caatatgtttagc

SEQ ID NO: 600177 - DNA, 13 bp, D. melanogaster
caatatgtttttg

SEQ ID NO: 600178 - DNA, 13 bp, D. melanogaster
caatattaatatg

SEQ ID NO: 600179 - DNA, 13 bp, D. melanogaster
caatattcaaatt

SEQ ID NO: 600180 - DNA, 13 bp, D. melanogaster
caatattcataaa

SEQ ID NO: 600181 - DNA, 13 bp, D. melanogaster
caatattcccaac

SEQ ID NO: 600182 - DNA, 13 bp, D. melanogaster
caatattgatatt

SEQ ID NO: 600183 - DNA, 13 bp, D. melanogaster
caatattgtataa

SEQ ID NO: 600184 - DNA, 13 bp, D. melanogaster
caatattgtatta

SEQ ID NO: 600185 - DNA, 13 bp, D. melanogaster
caatatttaattc

SEQ ID NO: 600186 - DNA, 13 bp, D. melanogaster
caatatttacaag

SEQ ID NO: 600187 - DNA, 13 bp, D. melanogaster
caatatttacaat

SEQ ID NO: 600188 - DNA, 13 bp, D. melanogaster
caatatttacaca

SEQ ID NO: 600189 - DNA, 13 bp, D. melanogaster
caatatttatcaa

SEQ ID NO: 600190 - DNA, 13 bp, D. melanogaster
caatatttattca

SEQ ID NO: 600191 - DNA, 14 bp, D. melanogaster
caatatttatttgt

SEQ ID NO: 600192 - DNA, 13 bp, D. melanogaster
caatatttgcact

SEQ ID NO: 600193 - DNA, 13 bp, D. melanogaster
caatatttgccag

SEQ ID NO: 600194 - DNA, 14 bp, D. melanogaster
caatatttggccaa

SEQ ID NO: 600195 - DNA, 13 bp, D. melanogaster
caatattttaaca

SEQ ID NO: 600196 - DNA, 13 bp, D. melanogaster
caatattttcaaa

SEQ ID NO: 600197 - DNA, 13 bp, D. melanogaster
caatattttcgat

SEQ ID NO: 600198 - DNA, 13 bp, D. melanogaster
caatattttgaaa

SEQ ID NO: 600199 - DNA, 13 bp, D. melanogaster
caatattttgctt

SEQ ID NO: 600200 - DNA, 13 bp, D. melanogaster
caatattttggca

SEQ ID NO: 600201 - DNA, 13 bp, D. melanogaster
caatattttgtag

SEQ ID NO: 600202 - DNA, 13 bp, D. melanogaster
caatattttgttg

SEQ ID NO: 600203 - DNA, 13 bp, D. melanogaster
caatattttgttt

SEQ ID NO: 600204 - DNA, 13 bp, D. melanogaster
caatatttttcaa

SEQ ID NO: 600205 - DNA, 13 bp, D. melanogaster
caatatttttgaa

SEQ ID NO: 600206 - DNA, 13 bp, D. melanogaster
caatatttttgat

SEQ ID NO: 600207 - DNA, 13 bp, D. melanogaster
caatatttttgcc

SEQ ID NO: 600208 - DNA, 14 bp, D. melanogaster
caatatttttgttt

SEQ ID NO: 600209 - DNA, 13 bp, D. melanogaster
caatcaaaaagtt

SEQ ID NO: 600210 - DNA, 13 bp, D. melanogaster
caatcaaaaatcc

SEQ ID NO: 600211 - DNA, 13 bp, D. melanogaster
caatcaaaacaga

SEQ ID NO: 600212 - DNA, 13 bp, D. melanogaster
caatcaaaactta

SEQ ID NO: 600213 - DNA, 13 bp, D. melanogaster
caatcaaaacttt

SEQ ID NO: 600214 - DNA, 13 bp, D. melanogaster
caatcaaaagtgt

SEQ ID NO: 600215 - DNA, 13 bp, D. melanogaster
caatcaaaatgcg

SEQ ID NO: 600216 - DNA, 13 bp, D. melanogaster
caatcaaaatgta

SEQ ID NO: 600217 - DNA, 13 bp, D. melanogaster
caatcaaaattat

SEQ ID NO: 600218 - DNA, 13 bp, D. melanogaster
caatcaaaattca

SEQ ID NO: 600219 - DNA, 13 bp, D. melanogaster
caatcaaaattga

SEQ ID NO: 600220 - DNA, 13 bp, D. melanogaster
caatcaaaccgtc

SEQ ID NO: 600221 - DNA, 13 bp, D. melanogaster
caatcaaactgtg

SEQ ID NO: 600222 - DNA, 13 bp, D. melanogaster
caatcaaagcaac

SEQ ID NO: 600223 - DNA, 13 bp, D. melanogaster
caatcaaaggaaa

SEQ ID NO: 600224 - DNA, 13 bp, D. melanogaster
caatcaaagtatt

SEQ ID NO: 600225 - DNA, 13 bp, D. melanogaster
caatcaaatcgaa

SEQ ID NO: 600226 - DNA, 13 bp, D. melanogaster
caatcaaatggca

SEQ ID NO: 600227 - DNA, 13 bp, D. melanogaster
caatcaaatggcc

SEQ ID NO: 600228 - DNA, 13 bp, D. melanogaster
caatcaaatgtaa

SEQ ID NO: 600229 - DNA, 13 bp, D. melanogaster
caatcaaatgttt

SEQ ID NO: 600230 - DNA, 13 bp, D. melanogaster
caatcaaattact

SEQ ID NO: 600231 - DNA, 13 bp, D. melanogaster
caatcaaattgaa

SEQ ID NO: 600232 - DNA, 13 bp, D. melanogaster
caatcaaattgag

SEQ ID NO: 600233 - DNA, 13 bp, D. melanogaster
caatcaaattgat

SEQ ID NO: 600234 - DNA, 13 bp, D. melanogaster
caatcaaatttca

SEQ ID NO: 600235 - DNA, 13 bp, D. melanogaster
caatcaaatttcg

SEQ ID NO: 600236 - DNA, 13 bp, D. melanogaster
caatcaacaactt

SEQ ID NO: 600237 - DNA, 14 bp, D. melanogaster
caatcaacagagaa

SEQ ID NO: 600238 - DNA, 13 bp, D. melanogaster
caatcaacaggct

SEQ ID NO: 600239 - DNA, 13 bp, D. melanogaster
caatcaacgtttt

SEQ ID NO: 600240 - DNA, 13 bp, D. melanogaster
caatcaacttaat

SEQ ID NO: 600241 - DNA, 13 bp, D. melanogaster
caatcaacttttt

SEQ ID NO: 600242 - DNA, 13 bp, D. melanogaster
caatcaagtgaag

SEQ ID NO: 600243 - DNA, 13 bp, D. melanogaster
caatcaagttggc

SEQ ID NO: 600244 - DNA, 13 bp, D. melanogaster
caatcaataaatc

SEQ ID NO: 600245 - DNA, 13 bp, D. melanogaster
caatcaataaatg

SEQ ID NO: 600246 - DNA, 14 bp, D. melanogaster
caatcaataggaat

SEQ ID NO: 600247 - DNA, 13 bp, D. melanogaster
caatcaatattaa

SEQ ID NO: 600248 - DNA, 13 bp, D. melanogaster
caatcaatattta

SEQ ID NO: 600249 - DNA, 14 bp, D. melanogaster
caatcaatcaaaat

SEQ ID NO: 600250 - DNA, 14 bp, D. melanogaster
caatcaatcaatat

SEQ ID NO: 600251 - DNA, 14 bp, D. melanogaster
caatcaatcaatca

SEQ ID NO: 600252 - DNA, 14 bp, D. melanogaster
caatcaatcaatcg

SEQ ID NO: 600253 - DNA, 13 bp, D. melanogaster
caatcaatcaatt

SEQ ID NO: 600254 - DNA, 14 bp, D. melanogaster
caatcaatcaattt

SEQ ID NO: 600255 - DNA, 13 bp, D. melanogaster
caatcaatcagtc

SEQ ID NO: 600256 - DNA, 13 bp, D. melanogaster
caatcaatcattt

SEQ ID NO: 600257 - DNA, 13 bp, D. melanogaster
caatcaatcgaaa

SEQ ID NO: 600258 - DNA, 13 bp, D. melanogaster
caatcaatcgatc

SEQ ID NO: 600259 - DNA, 14 bp, D. melanogaster
caatcaatgccaaa

SEQ ID NO: 600260 - DNA, 13 bp, D. melanogaster
caatcaatggaaa

SEQ ID NO: 600261 - DNA, 13 bp, D. melanogaster
caatcaattaaat

SEQ ID NO: 600262 - DNA, 13 bp, D. melanogaster
caatcaattcaat

SEQ ID NO: 600263 - DNA, 13 bp, D. melanogaster
caatcaattgatt

SEQ ID NO: 600264 - DNA, 13 bp, D. melanogaster
caatcaattgcaa

SEQ ID NO: 600265 - DNA, 13 bp, D. melanogaster
caatcaattgttt

SEQ ID NO: 600266 - DNA, 13 bp, D. melanogaster
caatcaatttcaa

SEQ ID NO: 600267 - DNA, 13 bp, D. melanogaster
caatcaatttgca

SEQ ID NO: 600268 - DNA, 13 bp, D. melanogaster
caatcaatttgcc

SEQ ID NO: 600269 - DNA, 13 bp, D. melanogaster
caatcaattttat

SEQ ID NO: 600270 - DNA, 13 bp, D. melanogaster
caatcaatttttg

SEQ ID NO: 600271 - DNA, 14 bp, D. melanogaster
caatcacaatcaca

SEQ ID NO: 600272 - DNA, 13 bp, D. melanogaster
caatcacaatcgc

SEQ ID NO: 600273 - DNA, 13 bp, D. melanogaster
caatcacagctgt

SEQ ID NO: 600274 - DNA, 13 bp, D. melanogaster
caatcacggaact

SEQ ID NO: 600275 - DNA, 13 bp, D. melanogaster
caatcacttttgt

SEQ ID NO: 600276 - DNA, 13 bp, D. melanogaster
caatcagcaaata

SEQ ID NO: 600277 - DNA, 13 bp, D. melanogaster
caatcagcagcaa

SEQ ID NO: 600278 - DNA, 13 bp, D. melanogaster
caatcagccagcc

SEQ ID NO: 600279 - DNA, 13 bp, D. melanogaster
caatcagcgaaaa

SEQ ID NO: 600280 - DNA, 13 bp, D. melanogaster
caatcagtcagtc

SEQ ID NO: 600281 - DNA, 13 bp, D. melanogaster
caatcagtcatcg

SEQ ID NO: 600282 - DNA, 13 bp, D. melanogaster
caatcagtggttt

SEQ ID NO: 600283 - DNA, 13 bp, D. melanogaster
caatcagttttat

SEQ ID NO: 600284 - DNA, 13 bp, D. melanogaster
caatcatacataa

SEQ ID NO: 600285 - DNA, 13 bp, D. melanogaster
caatcatcaatca

SEQ ID NO: 600286 - DNA, 13 bp, D. melanogaster
caatcatcatcat

SEQ ID NO: 600287 - DNA, 13 bp, D. melanogaster
caatcattaatca

SEQ ID NO: 600288 - DNA, 13 bp, D. melanogaster
caatcattgcctt

SEQ ID NO: 600289 - DNA, 13 bp, D. melanogaster
caatcatttaaat

SEQ ID NO: 600290 - DNA, 13 bp, D. melanogaster
caatcatttgaaa

SEQ ID NO: 600291 - DNA, 14 bp, D. melanogaster
caatcatttgaaaa

SEQ ID NO: 600292 - DNA, 13 bp, D. melanogaster
caatcatttttat

SEQ ID NO: 600293 - DNA, 13 bp, D. melanogaster
caatcatttttca

SEQ ID NO: 600294 - DNA, 13 bp, D. melanogaster
caatccaaaatcc

SEQ ID NO: 600295 - DNA, 13 bp, D. melanogaster
caatccaatcaaa

SEQ ID NO: 600296 - DNA, 14 bp, D. melanogaster
caatccaatccaac

SEQ ID NO: 600297 - DNA, 13 bp, D. melanogaster
caatccaatccat

SEQ ID NO: 600298 - DNA, 13 bp, D. melanogaster
caatccaatccca

SEQ ID NO: 600299 - DNA, 13 bp, D. melanogaster
caatccaatcgaa

SEQ ID NO: 600300 - DNA, 13 bp, D. melanogaster
caatccaattcaa

SEQ ID NO: 600301 - DNA, 13 bp, D. melanogaster
caatccacaatcc

SEQ ID NO: 600302 - DNA, 13 bp, D. melanogaster
caatccactcaag

SEQ ID NO: 600303 - DNA, 13 bp, D. melanogaster
caatccactccac

SEQ ID NO: 600304 - DNA, 13 bp, D. melanogaster
caatccagcaatc

SEQ ID NO: 600305 - DNA, 13 bp, D. melanogaster
caatccatccatc

SEQ ID NO: 600306 - DNA, 13 bp, D. melanogaster
caatccattccat

SEQ ID NO: 600307 - DNA, 13 bp, D. melanogaster
caatcccaacgat

SEQ ID NO: 600308 - DNA, 13 bp, D. melanogaster
caatcccaatccc

SEQ ID NO: 600309 - DNA, 14 bp, D. melanogaster
caatcccaatcccg

SEQ ID NO: 600310 - DNA, 14 bp, D. melanogaster
caatcccaatccga

SEQ ID NO: 600311 - DNA, 13 bp, D. melanogaster
caatcccaatctc

SEQ ID NO: 600312 - DNA, 13 bp, D. melanogaster
caatcccaattcc

SEQ ID NO: 600313 - DNA, 13 bp, D. melanogaster
caatcccagccca

SEQ ID NO: 600314 - DNA, 13 bp, D. melanogaster
caatcccattccc

SEQ ID NO: 600315 - DNA, 13 bp, D. melanogaster
caatccccaatcc

SEQ ID NO: 600316 - DNA, 13 bp, D. melanogaster
caatcccgatccc

SEQ ID NO: 600317 - DNA, 13 bp, D. melanogaster
caatccctatccc

SEQ ID NO: 600318 - DNA, 13 bp, D. melanogaster
caatccgaaaagc

SEQ ID NO: 600319 - DNA, 13 bp, D. melanogaster
caatccgcaatcc

SEQ ID NO: 600320 - DNA, 13 bp, D. melanogaster
caatccgctaaat

SEQ ID NO: 600321 - DNA, 13 bp, D. melanogaster
caatccgttaatc

SEQ ID NO: 600322 - DNA, 13 bp, D. melanogaster
caatcgaaaataa

SEQ ID NO: 600323 - DNA, 13 bp, D. melanogaster
caatcgaaacaat

SEQ ID NO: 600324 - DNA, 13 bp, D. melanogaster
caatcgaaagttt

SEQ ID NO: 600325 - DNA, 13 bp, D. melanogaster
caatcgaaatatt

SEQ ID NO: 600326 - DNA, 13 bp, D. melanogaster
caatcgaaatcga

SEQ ID NO: 600327 - DNA, 13 bp, D. melanogaster
caatcgaaatgaa

SEQ ID NO: 600328 - DNA, 13 bp, D. melanogaster
caatcgaaatgca

SEQ ID NO: 600329 - DNA, 13 bp, D. melanogaster
caatcgaaattga

SEQ ID NO: 600330 - DNA, 13 bp, D. melanogaster
caatcgaactgca

SEQ ID NO: 600331 - DNA, 13 bp, D. melanogaster
caatcgaactgta

SEQ ID NO: 600332 - DNA, 13 bp, D. melanogaster
caatcgaagctgg

SEQ ID NO: 600333 - DNA, 13 bp, D. melanogaster
caatcgaatccaa

SEQ ID NO: 600334 - DNA, 14 bp, D. melanogaster
caatcgaatcgaat

SEQ ID NO: 600335 - DNA, 13 bp, D. melanogaster
caatcgatcgatc

SEQ ID NO: 600336 - DNA, 14 bp, D. melanogaster
caatcgatcgatcg

SEQ ID NO: 600337 - DNA, 13 bp, D. melanogaster
caatcgattggca

SEQ ID NO: 600338 - DNA, 13 bp, D. melanogaster
caatcgattggtg

SEQ ID NO: 600339 - DNA, 13 bp, D. melanogaster
caatcgcaacatc

SEQ ID NO: 600340 - DNA, 13 bp, D. melanogaster
caatcgcaatcaa

SEQ ID NO: 600341 - DNA, 13 bp, D. melanogaster
caatcgcaatccc

SEQ ID NO: 600342 - DNA, 14 bp, D. melanogaster
caatcgcaatcgca

SEQ ID NO: 600343 - DNA, 13 bp, D. melanogaster
caatcgcaatcgg

SEQ ID NO: 600344 - DNA, 13 bp, D. melanogaster
caatcgcaattgc

SEQ ID NO: 600345 - DNA, 13 bp, D. melanogaster
caatcgcacacca

SEQ ID NO: 600346 - DNA, 14 bp, D. melanogaster
caatcgcacaccac

SEQ ID NO: 600347 - DNA, 13 bp, D. melanogaster
caatcggaaaaca

SEQ ID NO: 600348 - DNA, 13 bp, D. melanogaster
caatcggaaaacg

SEQ ID NO: 600349 - DNA, 13 bp, D. melanogaster
caatcggagattt

SEQ ID NO: 600350 - DNA, 13 bp, D. melanogaster
caatcggattttc

SEQ ID NO: 600351 - DNA, 13 bp, D. melanogaster
caatcggctgtgt

SEQ ID NO: 600352 - DNA, 13 bp, D. melanogaster
caatcggttttgt

SEQ ID NO: 600353 - DNA, 14 bp, D. melanogaster
caatcggttttgtc

SEQ ID NO: 600354 - DNA, 13 bp, D. melanogaster
caatctaattaga

SEQ ID NO: 600355 - DNA, 14 bp, D. melanogaster
caatctatttttca

SEQ ID NO: 600356 - DNA, 13 bp, D. melanogaster
caatctcaatctc

SEQ ID NO: 600357 - DNA, 13 bp, D. melanogaster
caatctcagcccg

SEQ ID NO: 600358 - DNA, 14 bp, D. melanogaster
caatctcagcccga

SEQ ID NO: 600359 - DNA, 13 bp, D. melanogaster
caatctcatccgc

SEQ ID NO: 600360 - DNA, 13 bp, D. melanogaster
caatctgaatctg

SEQ ID NO: 600361 - DNA, 14 bp, D. melanogaster
caatctgaatctga

SEQ ID NO: 600362 - DNA, 13 bp, D. melanogaster
caatctgcatatg

SEQ ID NO: 600363 - DNA, 13 bp, D. melanogaster
caatctggttggt

SEQ ID NO: 600364 - DNA, 13 bp, D. melanogaster
caatctgtacaaa

SEQ ID NO: 600365 - DNA, 13 bp, D. melanogaster
caatcttcttctt

SEQ ID NO: 600366 - DNA, 13 bp, D. melanogaster
caatgaaaaatta

SEQ ID NO: 600367 - DNA, 13 bp, D. melanogaster
caatgaaaacaat

SEQ ID NO: 600368 - DNA, 13 bp, D. melanogaster
caatgaaaacaga

SEQ ID NO: 600369 - DNA, 13 bp, D. melanogaster
caatgaaaacatt

SEQ ID NO: 600370 - DNA, 13 bp, D. melanogaster
caatgaaaacgaa

SEQ ID NO: 600371 - DNA, 14 bp, D. melanogaster
caatgaaaacgaaa

SEQ ID NO: 600372 - DNA, 13 bp, D. melanogaster
caatgaaaactat

SEQ ID NO: 600373 - DNA, 13 bp, D. melanogaster
caatgaaaagttt

SEQ ID NO: 600374 - DNA, 13 bp, D. melanogaster
caatgaaaatata

SEQ ID NO: 600375 - DNA, 13 bp, D. melanogaster
caatgaaaatgag

SEQ ID NO: 600376 - DNA, 13 bp, D. melanogaster
caatgaaaatgct

SEQ ID NO: 600377 - DNA, 13 bp, D. melanogaster
caatgaaaatgtt

SEQ ID NO: 600378 - DNA, 14 bp, D. melanogaster
caatgaaaatgttt

SEQ ID NO: 600379 - DNA, 13 bp, D. melanogaster
caatgaaacattt

SEQ ID NO: 600380 - DNA, 13 bp, D. melanogaster
caatgaaacgaaa

SEQ ID NO: 600381 - DNA, 13 bp, D. melanogaster
caatgaaagccaa

SEQ ID NO: 600382 - DNA, 13 bp, D. melanogaster
caatgaaagcgaa

SEQ ID NO: 600383 - DNA, 13 bp, D. melanogaster
caatgaaagtaaa

SEQ ID NO: 600384 - DNA, 13 bp, D. melanogaster
caatgaaagtgaa

SEQ ID NO: 600385 - DNA, 13 bp, D. melanogaster
caatgaaatagca

SEQ ID NO: 600386 - DNA, 13 bp, D. melanogaster
caatgaaatgaaa

SEQ ID NO: 600387 - DNA, 14 bp, D. melanogaster
caatgaaatgaaat

SEQ ID NO: 600388 - DNA, 13 bp, D. melanogaster
caatgaaatggaa

SEQ ID NO: 600389 - DNA, 13 bp, D. melanogaster
caatgaaattcaa

SEQ ID NO: 600390 - DNA, 13 bp, D. melanogaster
caatgaaattgaa

SEQ ID NO: 600391 - DNA, 13 bp, D. melanogaster
caatgaaattgat

SEQ ID NO: 600392 - DNA, 13 bp, D. melanogaster
caatgaaattgta

SEQ ID NO: 600393 - DNA, 13 bp, D. melanogaster
caatgaactgaaa

SEQ ID NO: 600394 - DNA, 13 bp, D. melanogaster
caatgaagtggaa

SEQ ID NO: 600395 - DNA, 13 bp, D. melanogaster
caatgaatataaa

SEQ ID NO: 600396 - DNA, 13 bp, D. melanogaster
caatgaatattaa

SEQ ID NO: 600397 - DNA, 13 bp, D. melanogaster
caatgaatcaaaa

SEQ ID NO: 600398 - DNA, 14 bp, D. melanogaster
caatgaattgctgc

SEQ ID NO: 600399 - DNA, 13 bp, D. melanogaster
caatgaatttatt

SEQ ID NO: 600400 - DNA, 14 bp, D. melanogaster
caatgaatttattt

SEQ ID NO: 600401 - DNA, 13 bp, D. melanogaster
caatgaatttgta

SEQ ID NO: 600402 - DNA, 13 bp, D. melanogaster
caatgaatttgtt

SEQ ID NO: 600403 - DNA, 13 bp, D. melanogaster
caatgaatttttt

SEQ ID NO: 600404 - DNA, 13 bp, D. melanogaster
caatgacaatatt

SEQ ID NO: 600405 - DNA, 13 bp, D. melanogaster
caatgacaatgaa

SEQ ID NO: 600406 - DNA, 14 bp, D. melanogaster
caatgacaatgaca

SEQ ID NO: 600407 - DNA, 13 bp, D. melanogaster
caatgacaatggc

SEQ ID NO: 600408 - DNA, 13 bp, D. melanogaster
caatgaccaaatt

SEQ ID NO: 600409 - DNA, 13 bp, D. melanogaster
caatgaccaagaa

SEQ ID NO: 600410 - DNA, 13 bp, D. melanogaster
caatgacgataac

SEQ ID NO: 600411 - DNA, 13 bp, D. melanogaster
caatgacttcttg

SEQ ID NO: 600412 - DNA, 13 bp, D. melanogaster
caatgagaaaccc

SEQ ID NO: 600413 - DNA, 13 bp, D. melanogaster
caatgagaaattg

SEQ ID NO: 600414 - DNA, 13 bp, D. melanogaster
caatgagccaaga

SEQ ID NO: 600415 - DNA, 13 bp, D. melanogaster
caatgaggaggcc

SEQ ID NO: 600416 - DNA, 13 bp, D. melanogaster
caatgataaccaa

SEQ ID NO: 600417 - DNA, 13 bp, D. melanogaster
caatgatcatttg

SEQ ID NO: 600418 - DNA, 13 bp, D. melanogaster
caatgatgcattc

SEQ ID NO: 600419 - DNA, 13 bp, D. melanogaster
caatgatggtgtg

SEQ ID NO: 600420 - DNA, 13 bp, D. melanogaster
caatgattcgctt

SEQ ID NO: 600421 - DNA, 13 bp, D. melanogaster
caatgattgttga

SEQ ID NO: 600422 - DNA, 13 bp, D. melanogaster
caatgatttaaga

SEQ ID NO: 600423 - DNA, 13 bp, D. melanogaster
caatgatttcaat

SEQ ID NO: 600424 - DNA, 13 bp, D. melanogaster
caatgattttttt

SEQ ID NO: 600425 - DNA, 13 bp, D. melanogaster
caatgcaaacaaa

SEQ ID NO: 600426 - DNA, 13 bp, D. melanogaster
caatgcaaacaag

SEQ ID NO: 600427 - DNA, 13 bp, D. melanogaster
caatgcaaacaca

SEQ ID NO: 600428 - DNA, 13 bp, D. melanogaster
caatgcaaatgca

SEQ ID NO: 600429 - DNA, 14 bp, D. melanogaster
caatgcaaatgcaa

SEQ ID NO: 600430 - DNA, 13 bp, D. melanogaster
caatgcaaattta

SEQ ID NO: 600431 - DNA, 13 bp, D. melanogaster
caatgcaaatttg

SEQ ID NO: 600432 - DNA, 13 bp, D. melanogaster
caatgcaacaaca

SEQ ID NO: 600433 - DNA, 13 bp, D. melanogaster
caatgcaacaatg

SEQ ID NO: 600434 - DNA, 13 bp, D. melanogaster
caatgcaatgcaa

SEQ ID NO: 600435 - DNA, 14 bp, D. melanogaster
caatgcaatgcaat

SEQ ID NO: 600436 - DNA, 13 bp, D. melanogaster
caatgcaattgcc

SEQ ID NO: 600437 - DNA, 13 bp, D. melanogaster
caatgcaatttct

SEQ ID NO: 600438 - DNA, 13 bp, D. melanogaster
caatgcacaaata

SEQ ID NO: 600439 - DNA, 13 bp, D. melanogaster
caatgcacacaaa

SEQ ID NO: 600440 - DNA, 13 bp, D. melanogaster
caatgcacttttc

SEQ ID NO: 600441 - DNA, 13 bp, D. melanogaster
caatgcagaattt

SEQ ID NO: 600442 - DNA, 13 bp, D. melanogaster
caatgcagcagca

SEQ ID NO: 600443 - DNA, 13 bp, D. melanogaster
caatgcagctgcc

SEQ ID NO: 600444 - DNA, 13 bp, D. melanogaster
caatgcagtgaaa

SEQ ID NO: 600445 - DNA, 13 bp, D. melanogaster
caatgcatataaa

SEQ ID NO: 600446 - DNA, 13 bp, D. melanogaster
caatgcattcgat

SEQ ID NO: 600447 - DNA, 13 bp, D. melanogaster
caatgcattttct

SEQ ID NO: 600448 - DNA, 13 bp, D. melanogaster
caatgccaaaaat

SEQ ID NO: 600449 - DNA, 13 bp, D. melanogaster
caatgccaaaatg

SEQ ID NO: 600450 - DNA, 13 bp, D. melanogaster
caatgccaaacaa

SEQ ID NO: 600451 - DNA, 13 bp, D. melanogaster
caatgccaaacct

SEQ ID NO: 600452 - DNA, 13 bp, D. melanogaster
caatgccaaattg

SEQ ID NO: 600453 - DNA, 13 bp, D. melanogaster
caatgccaattaa

SEQ ID NO: 600454 - DNA, 13 bp, D. melanogaster
caatgccaattgc

SEQ ID NO: 600455 - DNA, 14 bp, D. melanogaster
caatgccagcaaca

SEQ ID NO: 600456 - DNA, 13 bp, D. melanogaster
caatgccataaat

SEQ ID NO: 600457 - DNA, 14 bp, D. melanogaster
caatgccatctttt

SEQ ID NO: 600458 - DNA, 13 bp, D. melanogaster
caatgccattaaa

SEQ ID NO: 600459 - DNA, 14 bp, D. melanogaster
caatgcccaatgcc

SEQ ID NO: 600460 - DNA, 13 bp, D. melanogaster
caatgccctgacc

SEQ ID NO: 600461 - DNA, 13 bp, D. melanogaster
caatgcccttaag

SEQ ID NO: 600462 - DNA, 13 bp, D. melanogaster
caatgcccttcag

SEQ ID NO: 600463 - DNA, 13 bp, D. melanogaster
caatgcctcgatg

SEQ ID NO: 600464 - DNA, 13 bp, D. melanogaster
caatgcgatgcga

SEQ ID NO: 600465 - DNA, 13 bp, D. melanogaster
caatgcggtccga

SEQ ID NO: 600466 - DNA, 13 bp, D. melanogaster
caatgcgtctgcg

SEQ ID NO: 600467 - DNA, 13 bp, D. melanogaster
caatgcgtttttg

SEQ ID NO: 600468 - DNA, 13 bp, D. melanogaster
caatgctaatgat

SEQ ID NO: 600469 - DNA, 13 bp, D. melanogaster
caatgctctcaaa

SEQ ID NO: 600470 - DNA, 13 bp, D. melanogaster
caatgctcttaat

SEQ ID NO: 600471 - DNA, 13 bp, D. melanogaster
caatgctggccaa

SEQ ID NO: 600472 - DNA, 13 bp, D. melanogaster
caatgcttgttct

SEQ ID NO: 600473 - DNA, 13 bp, D. melanogaster
caatggaaaaaat

SEQ ID NO: 600474 - DNA, 13 bp, D. melanogaster
caatggaaaaatg

SEQ ID NO: 600475 - DNA, 13 bp, D. melanogaster
caatggaaaagcg

SEQ ID NO: 600476 - DNA, 13 bp, D. melanogaster
caatggaaaagtg

SEQ ID NO: 600477 - DNA, 13 bp, D. melanogaster
caatggaaaataa

SEQ ID NO: 600478 - DNA, 13 bp, D. melanogaster
caatggaaaatgc

SEQ ID NO: 600479 - DNA, 13 bp, D. melanogaster
caatggaaattca

SEQ ID NO: 600480 - DNA, 13 bp, D. melanogaster
caatggaaattga

SEQ ID NO: 600481 - DNA, 13 bp, D. melanogaster
caatggaaatttg

SEQ ID NO: 600482 - DNA, 14 bp, D. melanogaster
caatggaacatact

SEQ ID NO: 600483 - DNA, 13 bp, D. melanogaster
caatggaagatga

SEQ ID NO: 600484 - DNA, 13 bp, D. melanogaster
caatggacgtgga

SEQ ID NO: 600485 - DNA, 13 bp, D. melanogaster
caatggataaaat

SEQ ID NO: 600486 - DNA, 13 bp, D. melanogaster
caatggcaaaagt

SEQ ID NO: 600487 - DNA, 13 bp, D. melanogaster
caatggcaaaata

SEQ ID NO: 600488 - DNA, 13 bp, D. melanogaster
caatggcaaacga

SEQ ID NO: 600489 - DNA, 13 bp, D. melanogaster
caatggcaacaca

SEQ ID NO: 600490 - DNA, 14 bp, D. melanogaster
caatggcaacagca

SEQ ID NO: 600491 - DNA, 13 bp, D. melanogaster
caatggcaataaa

SEQ ID NO: 600492 - DNA, 13 bp, D. melanogaster
caatggcaatagc

SEQ ID NO: 600493 - DNA, 13 bp, D. melanogaster
caatggcaatcaa

SEQ ID NO: 600494 - DNA, 13 bp, D. melanogaster
caatggcaatcag

SEQ ID NO: 600495 - DNA, 13 bp, D. melanogaster
caatggcaatgaa

SEQ ID NO: 600496 - DNA, 14 bp, D. melanogaster
caatggcaatgcca

SEQ ID NO: 600497 - DNA, 13 bp, D. melanogaster
caatggcagcaaa

SEQ ID NO: 600498 - DNA, 13 bp, D. melanogaster
caatggcagcaac

SEQ ID NO: 600499 - DNA, 13 bp, D. melanogaster
caatggcatttta

SEQ ID NO: 600500 - DNA, 13 bp, D. melanogaster
caatggccaaata

SEQ ID NO: 600501 - DNA, 13 bp, D. melanogaster
caatggccaacaa

SEQ ID NO: 600502 - DNA, 13 bp, D. melanogaster
caatggccaatgg

SEQ ID NO: 600503 - DNA, 13 bp, D. melanogaster
caatgggcaatgg

SEQ ID NO: 600504 - DNA, 14 bp, D. melanogaster
caatgggcaatggg

SEQ ID NO: 600505 - DNA, 13 bp, D. melanogaster
caatgggctgaga

SEQ ID NO: 600506 - DNA, 13 bp, D. melanogaster
caatgggttaagg

SEQ ID NO: 600507 - DNA, 13 bp, D. melanogaster
caatgggttgcta

SEQ ID NO: 600508 - DNA, 13 bp, D. melanogaster
caatggtatcaat

SEQ ID NO: 600509 - DNA, 13 bp, D. melanogaster
caatggtatctat

SEQ ID NO: 600510 - DNA, 13 bp, D. melanogaster
caatggtcaacaa

SEQ ID NO: 600511 - DNA, 13 bp, D. melanogaster
caatggtcgaggg

SEQ ID NO: 600512 - DNA, 14 bp, D. melanogaster
caatggtcgagggc

SEQ ID NO: 600513 - DNA, 13 bp, D. melanogaster
caatggtgcttgc

SEQ ID NO: 600514 - DNA, 13 bp, D. melanogaster
caatggttccgtg

SEQ ID NO: 600515 - DNA, 14 bp, D. melanogaster
caatggtttctttt

SEQ ID NO: 600516 - DNA, 14 bp, D. melanogaster
caatggttttaagt

SEQ ID NO: 600517 - DNA, 13 bp, D. melanogaster
caatgtaaaatat

SEQ ID NO: 600518 - DNA, 13 bp, D. melanogaster
caatgtacatatg

SEQ ID NO: 600519 - DNA, 13 bp, D. melanogaster
caatgtactaatt

SEQ ID NO: 600520 - DNA, 13 bp, D. melanogaster
caatgtatgtatg

SEQ ID NO: 600521 - DNA, 14 bp, D. melanogaster
caatgtatgtatgt

SEQ ID NO: 600522 - DNA, 13 bp, D. melanogaster
caatgtatttaat

SEQ ID NO: 600523 - DNA, 13 bp, D. melanogaster
caatgtattttat

SEQ ID NO: 600524 - DNA, 13 bp, D. melanogaster
caatgtcaaatgt

SEQ ID NO: 600525 - DNA, 14 bp, D. melanogaster
caatgtcaaatttt

SEQ ID NO: 600526 - DNA, 13 bp, D. melanogaster
caatgtcaatatt

SEQ ID NO: 600527 - DNA, 14 bp, D. melanogaster
caatgtcaatgcca

SEQ ID NO: 600528 - DNA, 13 bp, D. melanogaster
caatgtccaatgt

SEQ ID NO: 600529 - DNA, 13 bp, D. melanogaster
caatgtccggccg

SEQ ID NO: 600530 - DNA, 14 bp, D. melanogaster
caatgtcgatgagg

SEQ ID NO: 600531 - DNA, 13 bp, D. melanogaster
caatgtcttcaaa

SEQ ID NO: 600532 - DNA, 13 bp, D. melanogaster
caatgtgaaaaat

SEQ ID NO: 600533 - DNA, 13 bp, D. melanogaster
caatgtgcaacaa

SEQ ID NO: 600534 - DNA, 14 bp, D. melanogaster
caatgtgcaatgtg

SEQ ID NO: 600535 - DNA, 13 bp, D. melanogaster
caatgtgcatttt

SEQ ID NO: 600536 - DNA, 13 bp, D. melanogaster
caatgtgcctgcg

SEQ ID NO: 600537 - DNA, 13 bp, D. melanogaster
caatgtgtatgtg

SEQ ID NO: 600538 - DNA, 13 bp, D. melanogaster
caatgtgtgtgtg

SEQ ID NO: 600539 - DNA, 13 bp, D. melanogaster
caatgtgtttgtt

SEQ ID NO: 600540 - DNA, 13 bp, D. melanogaster
caatgtgtttttt

SEQ ID NO: 600541 - DNA, 13 bp, D. melanogaster
caatgttattgtt

SEQ ID NO: 600542 - DNA, 13 bp, D. melanogaster
caatgttcgcaag

SEQ ID NO: 600543 - DNA, 13 bp, D. melanogaster
caatgttgctgct

SEQ ID NO: 600544 - DNA, 14 bp, D. melanogaster
caatgttgctgctg

SEQ ID NO: 600545 - DNA, 13 bp, D. melanogaster
caatgttgctgtt

SEQ ID NO: 600546 - DNA, 14 bp, D. melanogaster
caatgttgttgttt

SEQ ID NO: 600547 - DNA, 13 bp, D. melanogaster
caatgtttaaatt

SEQ ID NO: 600548 - DNA, 13 bp, D. melanogaster
caatgtttatgtt

SEQ ID NO: 600549 - DNA, 13 bp, D. melanogaster
caatgttttaaaa

SEQ ID NO: 600550 - DNA, 13 bp, D. melanogaster
caatgttttgatt

SEQ ID NO: 600551 - DNA, 13 bp, D. melanogaster
caatgttttttct

SEQ ID NO: 600552 - DNA, 13 bp, D. melanogaster
caattaaaaagtc

SEQ ID NO: 600553 - DNA, 13 bp, D. melanogaster
caattaaaaatgc

SEQ ID NO: 600554 - DNA, 14 bp, D. melanogaster
caattaaaaatgtt

SEQ ID NO: 600555 - DNA, 13 bp, D. melanogaster
caattaaaaccac

SEQ ID NO: 600556 - DNA, 13 bp, D. melanogaster
caattaaaacgaa

SEQ ID NO: 600557 - DNA, 13 bp, D. melanogaster
caattaaaacgca

SEQ ID NO: 600558 - DNA, 13 bp, D. melanogaster
caattaaaacgga

SEQ ID NO: 600559 - DNA, 14 bp, D. melanogaster
caattaaaagcaaa

SEQ ID NO: 600560 - DNA, 13 bp, D. melanogaster
caattaaaagcgg

SEQ ID NO: 600561 - DNA, 14 bp, D. melanogaster
caattaaaagtaaa

SEQ ID NO: 600562 - DNA, 13 bp, D. melanogaster
caattaaaagtat

SEQ ID NO: 600563 - DNA, 13 bp, D. melanogaster
caattaaaagtga

SEQ ID NO: 600564 - DNA, 13 bp, D. melanogaster
caattaaaagttg

SEQ ID NO: 600565 - DNA, 13 bp, D. melanogaster
caattaaaatgca

SEQ ID NO: 600566 - DNA, 13 bp, D. melanogaster
caattaaaatgct

SEQ ID NO: 600567 - DNA, 13 bp, D. melanogaster
caattaaaatgta

SEQ ID NO: 600568 - DNA, 14 bp, D. melanogaster
caattaaaatgtaa

SEQ ID NO: 600569 - DNA, 13 bp, D. melanogaster
caattaaaatgtc

SEQ ID NO: 600570 - DNA, 14 bp, D. melanogaster
caattaaaatttca

SEQ ID NO: 600571 - DNA, 13 bp, D. melanogaster
caattaaaatttg

SEQ ID NO: 600572 - DNA, 13 bp, D. melanogaster
caattaaacaatt

SEQ ID NO: 600573 - DNA, 13 bp, D. melanogaster
caattaaactttt

SEQ ID NO: 600574 - DNA, 13 bp, D. melanogaster
caattaaagaaat

SEQ ID NO: 600575 - DNA, 13 bp, D. melanogaster
caattaaagccag

SEQ ID NO: 600576 - DNA, 14 bp, D. melanogaster
caattaaagccagc

SEQ ID NO: 600577 - DNA, 13 bp, D. melanogaster
caattaaagcgaa

SEQ ID NO: 600578 - DNA, 13 bp, D. melanogaster
caattaaagtcgc

SEQ ID NO: 600579 - DNA, 13 bp, D. melanogaster
caattaaagtgaa

SEQ ID NO: 600580 - DNA, 13 bp, D. melanogaster
caattaaagtttt

SEQ ID NO: 600581 - DNA, 13 bp, D. melanogaster
caattaaatcaca

SEQ ID NO: 600582 - DNA, 14 bp, D. melanogaster
caattaaatcattt

SEQ ID NO: 600583 - DNA, 13 bp, D. melanogaster
caattaaatgaaa

SEQ ID NO: 600584 - DNA, 13 bp, D. melanogaster
caattaaatgcaa

SEQ ID NO: 600585 - DNA, 14 bp, D. melanogaster
caattaaatgcaat

SEQ ID NO: 600586 - DNA, 13 bp, D. melanogaster
caattaaatgcca

SEQ ID NO: 600587 - DNA, 13 bp, D. melanogaster
caattaaatgctt

SEQ ID NO: 600588 - DNA, 13 bp, D. melanogaster
caattaaatggaa

SEQ ID NO: 600589 - DNA, 13 bp, D. melanogaster
caattaaatggca

SEQ ID NO: 600590 - DNA, 13 bp, D. melanogaster
caattaaatggga

SEQ ID NO: 600591 - DNA, 13 bp, D. melanogaster
caattaaatgtaa

SEQ ID NO: 600592 - DNA, 13 bp, D. melanogaster
caattaaatgtat

SEQ ID NO: 600593 - DNA, 13 bp, D. melanogaster
caattaaatgtca

SEQ ID NO: 600594 - DNA, 13 bp, D. melanogaster
caattaaatgtgc

SEQ ID NO: 600595 - DNA, 13 bp, D. melanogaster
caattaaattaca

SEQ ID NO: 600596 - DNA, 13 bp, D. melanogaster
caattaaattcgc

SEQ ID NO: 600597 - DNA, 13 bp, D. melanogaster
caattaaattgaa

SEQ ID NO: 600598 - DNA, 13 bp, D. melanogaster
caattaaattgca

SEQ ID NO: 600599 - DNA, 14 bp, D. melanogaster
caattaaattgcaa

SEQ ID NO: 600600 - DNA, 13 bp, D. melanogaster
caattaaattggc

SEQ ID NO: 600601 - DNA, 14 bp, D. melanogaster
caattaaatttgca

SEQ ID NO: 600602 - DNA, 13 bp, D. melanogaster
caattaaattttg

SEQ ID NO: 600603 - DNA, 13 bp, D. melanogaster
caattaacaatta

SEQ ID NO: 600604 - DNA, 13 bp, D. melanogaster
caattaacatatt

SEQ ID NO: 600605 - DNA, 13 bp, D. melanogaster
caattaacttaat

SEQ ID NO: 600606 - DNA, 13 bp, D. melanogaster
caattaacttatt

SEQ ID NO: 600607 - DNA, 13 bp, D. melanogaster
caattaagattcc

SEQ ID NO: 600608 - DNA, 13 bp, D. melanogaster
caattaagcaaac

SEQ ID NO: 600609 - DNA, 13 bp, D. melanogaster
caattaagtgaaa

SEQ ID NO: 600610 - DNA, 13 bp, D. melanogaster
caattaagtgcaa

SEQ ID NO: 600611 - DNA, 13 bp, D. melanogaster
caattaataatga

SEQ ID NO: 600612 - DNA, 13 bp, D. melanogaster
caattaatatcaa

SEQ ID NO: 600613 - DNA, 13 bp, D. melanogaster
caattaatatgca

SEQ ID NO: 600614 - DNA, 13 bp, D. melanogaster
caattaatcaaga

SEQ ID NO: 600615 - DNA, 13 bp, D. melanogaster
caattaatgcaat

SEQ ID NO: 600616 - DNA, 13 bp, D. melanogaster
caattaattatgc

SEQ ID NO: 600617 - DNA, 14 bp, D. melanogaster
caattaattcaatt

SEQ ID NO: 600618 - DNA, 13 bp, D. melanogaster
caattaattgcaa

SEQ ID NO: 600619 - DNA, 13 bp, D. melanogaster
caattaatttcca

SEQ ID NO: 600620 - DNA, 14 bp, D. melanogaster
caattaatttgaat

SEQ ID NO: 600621 - DNA, 13 bp, D. melanogaster
caattaattttga

SEQ ID NO: 600622 - DNA, 14 bp, D. melanogaster
caattacaaaaagg

SEQ ID NO: 600623 - DNA, 13 bp, D. melanogaster
caattacaaaatg

SEQ ID NO: 600624 - DNA, 13 bp, D. melanogaster
caattacaaatga

SEQ ID NO: 600625 - DNA, 13 bp, D. melanogaster
caattacaaattt

SEQ ID NO: 600626 - DNA, 13 bp, D. melanogaster
caattacaacaat

SEQ ID NO: 600627 - DNA, 13 bp, D. melanogaster
caattacaaccga

SEQ ID NO: 600628 - DNA, 13 bp, D. melanogaster
caattacaattca

SEQ ID NO: 600629 - DNA, 13 bp, D. melanogaster
caattacaatttc

SEQ ID NO: 600630 - DNA, 13 bp, D. melanogaster
caattacattaga

SEQ ID NO: 600631 - DNA, 14 bp, D. melanogaster
caattacattttga

SEQ ID NO: 600632 - DNA, 14 bp, D. melanogaster
caattaccagaaca

SEQ ID NO: 600633 - DNA, 13 bp, D. melanogaster
caattaccagaag

SEQ ID NO: 600634 - DNA, 13 bp, D. melanogaster
caattacccattt

SEQ ID NO: 600635 - DNA, 13 bp, D. melanogaster
caattacgttttt

SEQ ID NO: 600636 - DNA, 13 bp, D. melanogaster
caattacttaaat

SEQ ID NO: 600637 - DNA, 13 bp, D. melanogaster
caattagaagaaa

SEQ ID NO: 600638 - DNA, 13 bp, D. melanogaster
caattagaataaa

SEQ ID NO: 600639 - DNA, 13 bp, D. melanogaster
caattagaattta

SEQ ID NO: 600640 - DNA, 13 bp, D. melanogaster
caattagagcaat

SEQ ID NO: 600641 - DNA, 13 bp, D. melanogaster
caattagcaaaca

SEQ ID NO: 600642 - DNA, 13 bp, D. melanogaster
caattagcataat

SEQ ID NO: 600643 - DNA, 13 bp, D. melanogaster
caattagcatcga

SEQ ID NO: 600644 - DNA, 13 bp, D. melanogaster
caattagccaaat

SEQ ID NO: 600645 - DNA, 13 bp, D. melanogaster
caattagccaggc

SEQ ID NO: 600646 - DNA, 13 bp, D. melanogaster
caattagctgcaa

SEQ ID NO: 600647 - DNA, 13 bp, D. melanogaster
caattagtattat

SEQ ID NO: 600648 - DNA, 13 bp, D. melanogaster
caattagttgcaa

SEQ ID NO: 600649 - DNA, 13 bp, D. melanogaster
caattagttgttt

SEQ ID NO: 600650 - DNA, 13 bp, D. melanogaster
caattagtttaaa

SEQ ID NO: 600651 - DNA, 13 bp, D. melanogaster
caattagtttaat

SEQ ID NO: 600652 - DNA, 13 bp, D. melanogaster
caattagttttta

SEQ ID NO: 600653 - DNA, 13 bp, D. melanogaster
caattagtttttt

SEQ ID NO: 600654 - DNA, 14 bp, D. melanogaster
caattagttttttt

SEQ ID NO: 600655 - DNA, 13 bp, D. melanogaster
caattataattga

SEQ ID NO: 600656 - DNA, 13 bp, D. melanogaster
caattatacaatt

SEQ ID NO: 600657 - DNA, 13 bp, D. melanogaster
caattatagccaa

SEQ ID NO: 600658 - DNA, 13 bp, D. melanogaster
caattataggaaa

SEQ ID NO: 600659 - DNA, 13 bp, D. melanogaster
caattatgaaaaa

SEQ ID NO: 600660 - DNA, 13 bp, D. melanogaster
caattatgaagaa

SEQ ID NO: 600661 - DNA, 13 bp, D. melanogaster
caattatgcatta

SEQ ID NO: 600662 - DNA, 13 bp, D. melanogaster
caattatggccaa

SEQ ID NO: 600663 - DNA, 13 bp, D. melanogaster
caattattgaaat

SEQ ID NO: 600664 - DNA, 13 bp, D. melanogaster
caattattgtaat

SEQ ID NO: 600665 - DNA, 13 bp, D. melanogaster
caattattgtatt

SEQ ID NO: 600666 - DNA, 13 bp, D. melanogaster
caattattgttat

SEQ ID NO: 600667 - DNA, 13 bp, D. melanogaster
caattatttatgc

SEQ ID NO: 600668 - DNA, 13 bp, D. melanogaster
caattatttcaat

SEQ ID NO: 600669 - DNA, 14 bp, D. melanogaster
caattatttcaatt

SEQ ID NO: 600670 - DNA, 13 bp, D. melanogaster
caattatttcaca

SEQ ID NO: 600671 - DNA, 13 bp, D. melanogaster
caattatttcgca

SEQ ID NO: 600672 - DNA, 13 bp, D. melanogaster
caattatttgaaa

SEQ ID NO: 600673 - DNA, 13 bp, D. melanogaster
caattatttgata

SEQ ID NO: 600674 - DNA, 13 bp, D. melanogaster
caattatttgcat

SEQ ID NO: 600675 - DNA, 13 bp, D. melanogaster
caattattttcat

SEQ ID NO: 600676 - DNA, 13 bp, D. melanogaster
caattattttcta

SEQ ID NO: 600677 - DNA, 13 bp, D. melanogaster
caattattttgca

SEQ ID NO: 600678 - DNA, 13 bp, D. melanogaster
caattattttgta

SEQ ID NO: 600679 - DNA, 13 bp, D. melanogaster
caattcaaaattc

SEQ ID NO: 600680 - DNA, 13 bp, D. melanogaster
caattcaaataca

SEQ ID NO: 600681 - DNA, 13 bp, D. melanogaster
caattcaaatatt

SEQ ID NO: 600682 - DNA, 13 bp, D. melanogaster
caattcaaattaa

SEQ ID NO: 600683 - DNA, 13 bp, D. melanogaster
caattcaaattca

SEQ ID NO: 600684 - DNA, 13 bp, D. melanogaster
caattcaaattgt

SEQ ID NO: 600685 - DNA, 13 bp, D. melanogaster
caattcaaattta

SEQ ID NO: 600686 - DNA, 13 bp, D. melanogaster
caattcaagttca

SEQ ID NO: 600687 - DNA, 13 bp, D. melanogaster
caattcaataaat

SEQ ID NO: 600688 - DNA, 13 bp, D. melanogaster
caattcaataatg

SEQ ID NO: 600689 - DNA, 13 bp, D. melanogaster
caattcaatcaat

SEQ ID NO: 600690 - DNA, 14 bp, D. melanogaster
caattcaatcaatt

SEQ ID NO: 600691 - DNA, 14 bp, D. melanogaster
caattcaattattt

SEQ ID NO: 600692 - DNA, 13 bp, D. melanogaster
caattcaattcga

SEQ ID NO: 600693 - DNA, 14 bp, D. melanogaster
caattcaatttaat

SEQ ID NO: 600694 - DNA, 13 bp, D. melanogaster
caattcaatttcg

SEQ ID NO: 600695 - DNA, 13 bp, D. melanogaster
caattcaatttga

SEQ ID NO: 600696 - DNA, 13 bp, D. melanogaster
caattcaatttgt

SEQ ID NO: 600697 - DNA, 14 bp, D. melanogaster
caattcaatttgtt

SEQ ID NO: 600698 - DNA, 13 bp, D. melanogaster
caattcacaattt

SEQ ID NO: 600699 - DNA, 13 bp, D. melanogaster
caattcagaaatt

SEQ ID NO: 600700 - DNA, 13 bp, D. melanogaster
caattcagcgcaa

SEQ ID NO: 600701 - DNA, 13 bp, D. melanogaster
caattcataatta

SEQ ID NO: 600702 - DNA, 13 bp, D. melanogaster
caattcatggaat

SEQ ID NO: 600703 - DNA, 13 bp, D. melanogaster
caattcatttaaa

SEQ ID NO: 600704 - DNA, 13 bp, D. melanogaster
caattcatttggc

SEQ ID NO: 600705 - DNA, 13 bp, D. melanogaster
caattcattttca

SEQ ID NO: 600706 - DNA, 13 bp, D. melanogaster
caattccaaatat

SEQ ID NO: 600707 - DNA, 13 bp, D. melanogaster
caattccaatccc

SEQ ID NO: 600708 - DNA, 14 bp, D. melanogaster
caattccaatccca

SEQ ID NO: 600709 - DNA, 13 bp, D. melanogaster
caattccaattaa

SEQ ID NO: 600710 - DNA, 13 bp, D. melanogaster
caattccaattca

SEQ ID NO: 600711 - DNA, 13 bp, D. melanogaster
caattccaattcc

SEQ ID NO: 600712 - DNA, 13 bp, D. melanogaster
caattccaattgc

SEQ ID NO: 600713 - DNA, 13 bp, D. melanogaster
caattccaattta

SEQ ID NO: 600714 - DNA, 13 bp, D. melanogaster
caattccaatttc

SEQ ID NO: 600715 - DNA, 14 bp, D. melanogaster
caattccagcaatt

SEQ ID NO: 600716 - DNA, 13 bp, D. melanogaster
caattccattcca

SEQ ID NO: 600717 - DNA, 13 bp, D. melanogaster
caattccatttcc

SEQ ID NO: 600718 - DNA, 13 bp, D. melanogaster
caattccatttgc

SEQ ID NO: 600719 - DNA, 13 bp, D. melanogaster
caattcccaaact

SEQ ID NO: 600720 - DNA, 13 bp, D. melanogaster
caattccccaaat

SEQ ID NO: 600721 - DNA, 13 bp, D. melanogaster
caattccgattcc

SEQ ID NO: 600722 - DNA, 13 bp, D. melanogaster
caattcgaaatgc

SEQ ID NO: 600723 - DNA, 13 bp, D. melanogaster
caattcgaatgga

SEQ ID NO: 600724 - DNA, 13 bp, D. melanogaster
caattcgaattca

SEQ ID NO: 600725 - DNA, 13 bp, D. melanogaster
caattcgaatttc

SEQ ID NO: 600726 - DNA, 13 bp, D. melanogaster
caattcgattcga

SEQ ID NO: 600727 - DNA, 13 bp, D. melanogaster
caattcgatttga

SEQ ID NO: 600728 - DNA, 13 bp, D. melanogaster
caattcgctcgaa

SEQ ID NO: 600729 - DNA, 14 bp, D. melanogaster
caattcgctcgaaa

SEQ ID NO: 600730 - DNA, 13 bp, D. melanogaster
caattctttcaaa

SEQ ID NO: 600731 - DNA, 13 bp, D. melanogaster
caattgaaaaact

SEQ ID NO: 600732 - DNA, 13 bp, D. melanogaster
caattgaaaaaga

SEQ ID NO: 600733 - DNA, 13 bp, D. melanogaster
caattgaaaagaa

SEQ ID NO: 600734 - DNA, 13 bp, D. melanogaster
caattgaaaagct

SEQ ID NO: 600735 - DNA, 13 bp, D. melanogaster
caattgaaaagtt

SEQ ID NO: 600736 - DNA, 13 bp, D. melanogaster
caattgaaaataa

SEQ ID NO: 600737 - DNA, 13 bp, D. melanogaster
caattgaaaatca

SEQ ID NO: 600738 - DNA, 13 bp, D. melanogaster
caattgaaaatga

SEQ ID NO: 600739 - DNA, 13 bp, D. melanogaster
caattgaaaggca

SEQ ID NO: 600740 - DNA, 13 bp, D. melanogaster
caattgaaagtgt

SEQ ID NO: 600741 - DNA, 13 bp, D. melanogaster
caattgaaatcaa

SEQ ID NO: 600742 - DNA, 13 bp, D. melanogaster
caattgaaatcga

SEQ ID NO: 600743 - DNA, 14 bp, D. melanogaster
caattgaaatcgaa

SEQ ID NO: 600744 - DNA, 13 bp, D. melanogaster
caattgaaatgtt

SEQ ID NO: 600745 - DNA, 13 bp, D. melanogaster
caattgaaattca

SEQ ID NO: 600746 - DNA, 13 bp, D. melanogaster
caattgaaattcg

SEQ ID NO: 600747 - DNA, 14 bp, D. melanogaster
caattgaaattgat

SEQ ID NO: 600748 - DNA, 14 bp, D. melanogaster
caattgaaattgtt

SEQ ID NO: 600749 - DNA, 14 bp, D. melanogaster
caattgaaatttat

SEQ ID NO: 600750 - DNA, 13 bp, D. melanogaster
caattgaacttga

SEQ ID NO: 600751 - DNA, 13 bp, D. melanogaster
caattgaataatt

SEQ ID NO: 600752 - DNA, 13 bp, D. melanogaster
caattgaatgact

SEQ ID NO: 600753 - DNA, 13 bp, D. melanogaster
caattgaatggaa

SEQ ID NO: 600754 - DNA, 14 bp, D. melanogaster
caattgaattaaat

SEQ ID NO: 600755 - DNA, 13 bp, D. melanogaster
caattgaattatt

SEQ ID NO: 600756 - DNA, 13 bp, D. melanogaster
caattgaattcaa

SEQ ID NO: 600757 - DNA, 14 bp, D. melanogaster
caattgaattgaat

SEQ ID NO: 600758 - DNA, 13 bp, D. melanogaster
caattgaatttcg

SEQ ID NO: 600759 - DNA, 13 bp, D. melanogaster
caattgacaaaat

SEQ ID NO: 600760 - DNA, 14 bp, D. melanogaster
caattgacaatata

SEQ ID NO: 600761 - DNA, 13 bp, D. melanogaster
caattgacaattg

SEQ ID NO: 600762 - DNA, 13 bp, D. melanogaster
caattgacaattt

SEQ ID NO: 600763 - DNA, 13 bp, D. melanogaster
caattgagaagga

SEQ ID NO: 600764 - DNA, 13 bp, D. melanogaster
caattgatcaaaa

SEQ ID NO: 600765 - DNA, 13 bp, D. melanogaster
caattgattaatt

SEQ ID NO: 600766 - DNA, 13 bp, D. melanogaster
caattgattgcca

SEQ ID NO: 600767 - DNA, 13 bp, D. melanogaster
caattgatttatg

SEQ ID NO: 600768 - DNA, 13 bp, D. melanogaster
caattgatttgaa

SEQ ID NO: 600769 - DNA, 13 bp, D. melanogaster
caattgcaaaatg

SEQ ID NO: 600770 - DNA, 13 bp, D. melanogaster
caattgcaaataa

SEQ ID NO: 600771 - DNA, 14 bp, D. melanogaster
caattgcaaataaa

SEQ ID NO: 600772 - DNA, 13 bp, D. melanogaster
caattgcaacatt

SEQ ID NO: 600773 - DNA, 14 bp, D. melanogaster
caattgcaactgca

SEQ ID NO: 600774 - DNA, 13 bp, D. melanogaster
caattgcaatcga

SEQ ID NO: 600775 - DNA, 14 bp, D. melanogaster
caattgcaatgtca

SEQ ID NO: 600776 - DNA, 13 bp, D. melanogaster
caattgcaattag

SEQ ID NO: 600777 - DNA, 13 bp, D. melanogaster
caattgcaattca

SEQ ID NO: 600778 - DNA, 14 bp, D. melanogaster
caattgcaattgca

SEQ ID NO: 600779 - DNA, 14 bp, D. melanogaster
caattgcaattgct

SEQ ID NO: 600780 - DNA, 13 bp, D. melanogaster
caattgcaattgt

SEQ ID NO: 600781 - DNA, 13 bp, D. melanogaster
caattgcaatttg

SEQ ID NO: 600782 - DNA, 13 bp, D. melanogaster
caattgcacaatt

SEQ ID NO: 600783 - DNA, 14 bp, D. melanogaster
caattgcagctgca

SEQ ID NO: 600784 - DNA, 13 bp, D. melanogaster
caattgcagctgg

SEQ ID NO: 600785 - DNA, 14 bp, D. melanogaster
caattgcaggagat

SEQ ID NO: 600786 - DNA, 13 bp, D. melanogaster
caattgcagggca

SEQ ID NO: 600787 - DNA, 14 bp, D. melanogaster
caattgcagggcaa

SEQ ID NO: 600788 - DNA, 14 bp, D. melanogaster
caattgcagttgca

SEQ ID NO: 600789 - DNA, 13 bp, D. melanogaster
caattgcagttgg

SEQ ID NO: 600790 - DNA, 13 bp, D. melanogaster
caattgcagttgt

SEQ ID NO: 600791 - DNA, 13 bp, D. melanogaster
caattgcagtttc

SEQ ID NO: 600792 - DNA, 13 bp, D. melanogaster
caattgcatattt

SEQ ID NO: 600793 - DNA, 13 bp, D. melanogaster
caattgcattaaa

SEQ ID NO: 600794 - DNA, 13 bp, D. melanogaster
caattgcattggc

SEQ ID NO: 600795 - DNA, 14 bp, D. melanogaster
caattgcatttaaa

SEQ ID NO: 600796 - DNA, 13 bp, D. melanogaster
caattgcatttca

SEQ ID NO: 600797 - DNA, 13 bp, D. melanogaster
caattgcatttcg

SEQ ID NO: 600798 - DNA, 13 bp, D. melanogaster
caattgcatttta

SEQ ID NO: 600799 - DNA, 13 bp, D. melanogaster
caattgccaaaaa

SEQ ID NO: 600800 - DNA, 13 bp, D. melanogaster
caattgccaaaat

SEQ ID NO: 600801 - DNA, 13 bp, D. melanogaster
caattgccaaatt

SEQ ID NO: 600802 - DNA, 13 bp, D. melanogaster
caattgccaattg

SEQ ID NO: 600803 - DNA, 14 bp, D. melanogaster
caattgccaattgc

SEQ ID NO: 600804 - DNA, 13 bp, D. melanogaster
caattgccaattt

SEQ ID NO: 600805 - DNA, 13 bp, D. melanogaster
caattgccagtgg

SEQ ID NO: 600806 - DNA, 13 bp, D. melanogaster
caattgccatggc

SEQ ID NO: 600807 - DNA, 13 bp, D. melanogaster
caattgccattgc

SEQ ID NO: 600808 - DNA, 13 bp, D. melanogaster
caattgccgaaaa

SEQ ID NO: 600809 - DNA, 13 bp, D. melanogaster
caattgccgcaat

SEQ ID NO: 600810 - DNA, 13 bp, D. melanogaster
caattgcctcttt

SEQ ID NO: 600811 - DNA, 13 bp, D. melanogaster
caattgctaattg

SEQ ID NO: 600812 - DNA, 13 bp, D. melanogaster
caattgctcaatt

SEQ ID NO: 600813 - DNA, 13 bp, D. melanogaster
caattgctgatgt

SEQ ID NO: 600814 - DNA, 13 bp, D. melanogaster
caattgctggcat

SEQ ID NO: 600815 - DNA, 13 bp, D. melanogaster
caattgctgttgc

SEQ ID NO: 600816 - DNA, 13 bp, D. melanogaster
caattgctttggc

SEQ ID NO: 600817 - DNA, 13 bp, D. melanogaster
caattgctttttg

SEQ ID NO: 600818 - DNA, 13 bp, D. melanogaster
caattggaaaaac

SEQ ID NO: 600819 - DNA, 13 bp, D. melanogaster
caattggaaaaca

SEQ ID NO: 600820 - DNA, 13 bp, D. melanogaster
caattggaaaagt

SEQ ID NO: 600821 - DNA, 13 bp, D. melanogaster
caattggaaattt

SEQ ID NO: 600822 - DNA, 13 bp, D. melanogaster
caattggattcaa

SEQ ID NO: 600823 - DNA, 13 bp, D. melanogaster
caattggatttgc

SEQ ID NO: 600824 - DNA, 13 bp, D. melanogaster
caattggcaaaca

SEQ ID NO: 600825 - DNA, 14 bp, D. melanogaster
caattggcaaacaa

SEQ ID NO: 600826 - DNA, 13 bp, D. melanogaster
caattggcaaatg

SEQ ID NO: 600827 - DNA, 13 bp, D. melanogaster
caattggcaattg

SEQ ID NO: 600828 - DNA, 14 bp, D. melanogaster
caattggcaattgg

SEQ ID NO: 600829 - DNA, 14 bp, D. melanogaster
caattggcaccatg

SEQ ID NO: 600830 - DNA, 13 bp, D. melanogaster
caattggccaatt

SEQ ID NO: 600831 - DNA, 13 bp, D. melanogaster
caattggccataa

SEQ ID NO: 600832 - DNA, 13 bp, D. melanogaster
caattggccattg

SEQ ID NO: 600833 - DNA, 13 bp, D. melanogaster
caattggctgcaa

SEQ ID NO: 600834 - DNA, 13 bp, D. melanogaster
caattggtatttt

SEQ ID NO: 600835 - DNA, 14 bp, D. melanogaster
caattgtaaaaagt

SEQ ID NO: 600836 - DNA, 13 bp, D. melanogaster
caattgtaaaata

SEQ ID NO: 600837 - DNA, 13 bp, D. melanogaster
caattgtaaacaa

SEQ ID NO: 600838 - DNA, 13 bp, D. melanogaster
caattgtaatggg

SEQ ID NO: 600839 - DNA, 13 bp, D. melanogaster
caattgtaattta

SEQ ID NO: 600840 - DNA, 14 bp, D. melanogaster
caattgtattaaat

SEQ ID NO: 600841 - DNA, 13 bp, D. melanogaster
caattgtatttct

SEQ ID NO: 600842 - DNA, 14 bp, D. melanogaster
caattgtattttgg

SEQ ID NO: 600843 - DNA, 13 bp, D. melanogaster
caattgtcaccaa

SEQ ID NO: 600844 - DNA, 13 bp, D. melanogaster
caattgtcattgt

SEQ ID NO: 600845 - DNA, 13 bp, D. melanogaster
caattgtctggct

SEQ ID NO: 600846 - DNA, 13 bp, D. melanogaster
caattgtgacgcc

SEQ ID NO: 600847 - DNA, 13 bp, D. melanogaster
caattgtgcaaat

SEQ ID NO: 600848 - DNA, 13 bp, D. melanogaster
caattgtgcaatt

SEQ ID NO: 600849 - DNA, 14 bp, D. melanogaster
caattgtgcatatt

SEQ ID NO: 600850 - DNA, 13 bp, D. melanogaster
caattgttaaaaa

SEQ ID NO: 600851 - DNA, 13 bp, D. melanogaster
caattgttaatta

SEQ ID NO: 600852 - DNA, 13 bp, D. melanogaster
caattgttataaa

SEQ ID NO: 600853 - DNA, 13 bp, D. melanogaster
caattgttattgt

SEQ ID NO: 600854 - DNA, 13 bp, D. melanogaster
caattgttattta

SEQ ID NO: 600855 - DNA, 13 bp, D. melanogaster
caattgttgctgc

SEQ ID NO: 600856 - DNA, 13 bp, D. melanogaster
caattgttgtaaa

SEQ ID NO: 600857 - DNA, 13 bp, D. melanogaster
caattgttgttta

SEQ ID NO: 600858 - DNA, 13 bp, D. melanogaster
caattgtttaaaa

SEQ ID NO: 600859 - DNA, 13 bp, D. melanogaster
caattgtttcacg

SEQ ID NO: 600860 - DNA, 13 bp, D. melanogaster
caattgtttcgct

SEQ ID NO: 600861 - DNA, 13 bp, D. melanogaster
caattgtttgcca

SEQ ID NO: 600862 - DNA, 13 bp, D. melanogaster
caattgtttgctg

SEQ ID NO: 600863 - DNA, 13 bp, D. melanogaster
caattgtttggca

SEQ ID NO: 600864 - DNA, 13 bp, D. melanogaster
caattgtttgttt

SEQ ID NO: 600865 - DNA, 13 bp, D. melanogaster
caattgttttcca

SEQ ID NO: 600866 - DNA, 13 bp, D. melanogaster
caattgttttgat

SEQ ID NO: 600867 - DNA, 14 bp, D. melanogaster
caattgttttgttt

SEQ ID NO: 600868 - DNA, 13 bp, D. melanogaster
caattgtttttcc

SEQ ID NO: 600869 - DNA, 13 bp, D. melanogaster
caattgtttttct

SEQ ID NO: 600870 - DNA, 14 bp, D. melanogaster
caattgtttttgtt

SEQ ID NO: 600871 - DNA, 13 bp, D. melanogaster
caattgttttttc

SEQ ID NO: 600872 - DNA, 13 bp, D. melanogaster
caatttaaaaact

SEQ ID NO: 600873 - DNA, 13 bp, D. melanogaster
caatttaaaagcc

SEQ ID NO: 600874 - DNA, 13 bp, D. melanogaster
caatttaaactaa

SEQ ID NO: 600875 - DNA, 13 bp, D. melanogaster
caatttaaagtta

SEQ ID NO: 600876 - DNA, 13 bp, D. melanogaster
caatttaaagttg

SEQ ID NO: 600877 - DNA, 13 bp, D. melanogaster
caatttaaagttt

SEQ ID NO: 600878 - DNA, 13 bp, D. melanogaster
caatttaaatcaa

SEQ ID NO: 600879 - DNA, 13 bp, D. melanogaster
caatttaaatgaa

SEQ ID NO: 600880 - DNA, 13 bp, D. melanogaster
caatttaaatgcc

SEQ ID NO: 600881 - DNA, 13 bp, D. melanogaster
caatttaaatgtt

SEQ ID NO: 600882 - DNA, 14 bp, D. melanogaster
caatttaaattcat

SEQ ID NO: 600883 - DNA, 14 bp, D. melanogaster
caatttaaattgaa

SEQ ID NO: 600884 - DNA, 13 bp, D. melanogaster
caatttaaattgc

SEQ ID NO: 600885 - DNA, 13 bp, D. melanogaster
caatttaagcatt

SEQ ID NO: 600886 - DNA, 13 bp, D. melanogaster
caatttaagttta

SEQ ID NO: 600887 - DNA, 13 bp, D. melanogaster
caatttaataaac

SEQ ID NO: 600888 - DNA, 13 bp, D. melanogaster
caatttaatgaat

SEQ ID NO: 600889 - DNA, 13 bp, D. melanogaster
caatttaatgcca

SEQ ID NO: 600890 - DNA, 13 bp, D. melanogaster
caatttaatggct

SEQ ID NO: 600891 - DNA, 13 bp, D. melanogaster
caatttaattaag

SEQ ID NO: 600892 - DNA, 13 bp, D. melanogaster
caatttaattgta

SEQ ID NO: 600893 - DNA, 14 bp, D. melanogaster
caatttaattgttt

SEQ ID NO: 600894 - DNA, 13 bp, D. melanogaster
caatttaatttga

SEQ ID NO: 600895 - DNA, 13 bp, D. melanogaster
caatttacaaaat

SEQ ID NO: 600896 - DNA, 13 bp, D. melanogaster
caatttacaaatt

SEQ ID NO: 600897 - DNA, 13 bp, D. melanogaster
caatttacacaca

SEQ ID NO: 600898 - DNA, 13 bp, D. melanogaster
caatttacataat

SEQ ID NO: 600899 - DNA, 13 bp, D. melanogaster
caatttacatttt

SEQ ID NO: 600900 - DNA, 13 bp, D. melanogaster
caatttaccaatt

SEQ ID NO: 600901 - DNA, 13 bp, D. melanogaster
caatttacttaaa

SEQ ID NO: 600902 - DNA, 13 bp, D. melanogaster
caatttactttat

SEQ ID NO: 600903 - DNA, 13 bp, D. melanogaster
caatttagaaaaa

SEQ ID NO: 600904 - DNA, 13 bp, D. melanogaster
caatttagataaa

SEQ ID NO: 600905 - DNA, 13 bp, D. melanogaster
caatttagttaaa

SEQ ID NO: 600906 - DNA, 13 bp, D. melanogaster
caatttagttgca

SEQ ID NO: 600907 - DNA, 13 bp, D. melanogaster
caatttatacaat

SEQ ID NO: 600908 - DNA, 14 bp, D. melanogaster
caatttatatgaaa

SEQ ID NO: 600909 - DNA, 13 bp, D. melanogaster
caatttatgcaaa

SEQ ID NO: 600910 - DNA, 13 bp, D. melanogaster
caatttatgtaat

SEQ ID NO: 600911 - DNA, 13 bp, D. melanogaster
caatttatgtgca

SEQ ID NO: 600912 - DNA, 13 bp, D. melanogaster
caatttatgtttt

SEQ ID NO: 600913 - DNA, 13 bp, D. melanogaster
caatttattacaa

SEQ ID NO: 600914 - DNA, 13 bp, D. melanogaster
caatttattgtat

SEQ ID NO: 600915 - DNA, 13 bp, D. melanogaster
caatttattgttt

SEQ ID NO: 600916 - DNA, 13 bp, D. melanogaster
caatttatttcac

SEQ ID NO: 600917 - DNA, 13 bp, D. melanogaster
caatttatttgct

SEQ ID NO: 600918 - DNA, 13 bp, D. melanogaster
caatttatttgtt

SEQ ID NO: 600919 - DNA, 13 bp, D. melanogaster
caatttattttac

SEQ ID NO: 600920 - DNA, 13 bp, D. melanogaster
caatttcaaaaat

SEQ ID NO: 600921 - DNA, 13 bp, D. melanogaster
caatttcaaaaga

SEQ ID NO: 600922 - DNA, 13 bp, D. melanogaster
caatttcaaagtt

SEQ ID NO: 600923 - DNA, 14 bp, D. melanogaster
caatttcaaatatt

SEQ ID NO: 600924 - DNA, 13 bp, D. melanogaster
caatttcaaatgt

SEQ ID NO: 600925 - DNA, 13 bp, D. melanogaster
caatttcaataga

SEQ ID NO: 600926 - DNA, 13 bp, D. melanogaster
caatttcaatcaa

SEQ ID NO: 600927 - DNA, 13 bp, D. melanogaster
caatttcaatctg

SEQ ID NO: 600928 - DNA, 13 bp, D. melanogaster
caatttcaatgaa

SEQ ID NO: 600929 - DNA, 14 bp, D. melanogaster
caatttcaatgaat

SEQ ID NO: 600930 - DNA, 13 bp, D. melanogaster
caatttcaatgcc

SEQ ID NO: 600931 - DNA, 13 bp, D. melanogaster
caatttcaattat

SEQ ID NO: 600932 - DNA, 13 bp, D. melanogaster
caatttcaattca

SEQ ID NO: 600933 - DNA, 14 bp, D. melanogaster
caatttcaattcca

SEQ ID NO: 600934 - DNA, 14 bp, D. melanogaster
caatttcaattgaa

SEQ ID NO: 600935 - DNA, 13 bp, D. melanogaster
caatttcaatttc

SEQ ID NO: 600936 - DNA, 13 bp, D. melanogaster
caatttcaatttg

SEQ ID NO: 600937 - DNA, 13 bp, D. melanogaster
caatttcaatttt

SEQ ID NO: 600938 - DNA, 14 bp, D. melanogaster
caatttcaatttta

SEQ ID NO: 600939 - DNA, 13 bp, D. melanogaster
caatttcacaatt

SEQ ID NO: 600940 - DNA, 13 bp, D. melanogaster
caatttcagttgg

SEQ ID NO: 600941 - DNA, 13 bp, D. melanogaster
caatttcagtttc

SEQ ID NO: 600942 - DNA, 13 bp, D. melanogaster
caatttcataatt

SEQ ID NO: 600943 - DNA, 13 bp, D. melanogaster
caatttcatatat

SEQ ID NO: 600944 - DNA, 13 bp, D. melanogaster
caatttcatatcg

SEQ ID NO: 600945 - DNA, 14 bp, D. melanogaster
caatttcatatcga

SEQ ID NO: 600946 - DNA, 13 bp, D. melanogaster
caatttcattctc

SEQ ID NO: 600947 - DNA, 13 bp, D. melanogaster
caatttcatttcg

SEQ ID NO: 600948 - DNA, 13 bp, D. melanogaster
caatttcatttgc

SEQ ID NO: 600949 - DNA, 13 bp, D. melanogaster
caatttcatttgg

SEQ ID NO: 600950 - DNA, 13 bp, D. melanogaster
caatttccaatta

SEQ ID NO: 600951 - DNA, 13 bp, D. melanogaster
caatttccacaca

SEQ ID NO: 600952 - DNA, 13 bp, D. melanogaster
caatttccaccga

SEQ ID NO: 600953 - DNA, 13 bp, D. melanogaster
caatttccatttc

SEQ ID NO: 600954 - DNA, 13 bp, D. melanogaster
caatttccatttg

SEQ ID NO: 600955 - DNA, 13 bp, D. melanogaster
caatttccatttt

SEQ ID NO: 600956 - DNA, 13 bp, D. melanogaster
caatttcccattt

SEQ ID NO: 600957 - DNA, 13 bp, D. melanogaster
caatttccccaaa

SEQ ID NO: 600958 - DNA, 13 bp, D. melanogaster
caatttccccaat

SEQ ID NO: 600959 - DNA, 13 bp, D. melanogaster
caatttccgctgc

SEQ ID NO: 600960 - DNA, 13 bp, D. melanogaster
caatttccgcttt

SEQ ID NO: 600961 - DNA, 13 bp, D. melanogaster
caatttccgtgct

SEQ ID NO: 600962 - DNA, 13 bp, D. melanogaster
caatttccgtttc

SEQ ID NO: 600963 - DNA, 13 bp, D. melanogaster
caatttccgtttg

SEQ ID NO: 600964 - DNA, 13 bp, D. melanogaster
caatttcctacaa

SEQ ID NO: 600965 - DNA, 14 bp, D. melanogaster
caatttcgagtata

SEQ ID NO: 600966 - DNA, 13 bp, D. melanogaster
caatttcgatttc

SEQ ID NO: 600967 - DNA, 13 bp, D. melanogaster
caatttcgatttg

SEQ ID NO: 600968 - DNA, 13 bp, D. melanogaster
caatttctaaaac

SEQ ID NO: 600969 - DNA, 14 bp, D. melanogaster
caatttctacaaac

SEQ ID NO: 600970 - DNA, 14 bp, D. melanogaster
caatttctatgtgt

SEQ ID NO: 600971 - DNA, 13 bp, D. melanogaster
caatttctattta

SEQ ID NO: 600972 - DNA, 13 bp, D. melanogaster
caatttctatttc

SEQ ID NO: 600973 - DNA, 13 bp, D. melanogaster
caatttctgtttg

SEQ ID NO: 600974 - DNA, 13 bp, D. melanogaster
caatttctttaaa

SEQ ID NO: 600975 - DNA, 13 bp, D. melanogaster
caatttgaaaact

SEQ ID NO: 600976 - DNA, 13 bp, D. melanogaster
caatttgaaaatg

SEQ ID NO: 600977 - DNA, 13 bp, D. melanogaster
caatttgaaatgg

SEQ ID NO: 600978 - DNA, 13 bp, D. melanogaster
caatttgaacttg

SEQ ID NO: 600979 - DNA, 13 bp, D. melanogaster
caatttgaacttt

SEQ ID NO: 600980 - DNA, 13 bp, D. melanogaster
caatttgaatgca

SEQ ID NO: 600981 - DNA, 14 bp, D. melanogaster
caatttgaatgcca

SEQ ID NO: 600982 - DNA, 13 bp, D. melanogaster
caatttgaatggc

SEQ ID NO: 600983 - DNA, 13 bp, D. melanogaster
caatttgaattta

SEQ ID NO: 600984 - DNA, 13 bp, D. melanogaster
caatttgactttt

SEQ ID NO: 600985 - DNA, 13 bp, D. melanogaster
caatttgagagcc

SEQ ID NO: 600986 - DNA, 13 bp, D. melanogaster
caatttgataaaa

SEQ ID NO: 600987 - DNA, 14 bp, D. melanogaster
caatttgatatttt

SEQ ID NO: 600988 - DNA, 13 bp, D. melanogaster
caatttgattaat

SEQ ID NO: 600989 - DNA, 13 bp, D. melanogaster
caatttgatttat

SEQ ID NO: 600990 - DNA, 13 bp, D. melanogaster
caatttgatttga

SEQ ID NO: 600991 - DNA, 13 bp, D. melanogaster
caatttgatttgc

SEQ ID NO: 600992 - DNA, 13 bp, D. melanogaster
caatttgattttc

SEQ ID NO: 600993 - DNA, 13 bp, D. melanogaster
caatttgcaaact

SEQ ID NO: 600994 - DNA, 13 bp, D. melanogaster
caatttgcaaatt

SEQ ID NO: 600995 - DNA, 13 bp, D. melanogaster
caatttgcaatca

SEQ ID NO: 600996 - DNA, 13 bp, D. melanogaster
caatttgcaattt

SEQ ID NO: 600997 - DNA, 13 bp, D. melanogaster
caatttgcagcca

SEQ ID NO: 600998 - DNA, 13 bp, D. melanogaster
caatttgcaggca

SEQ ID NO: 600999 - DNA, 13 bp, D. melanogaster
caatttgcagttg

SEQ ID NO: 601000 - DNA, 13 bp, D. melanogaster
caatttgcatata

SEQ ID NO: 601001 - DNA, 13 bp, D. melanogaster
caatttgcatatc

SEQ ID NO: 601002 - DNA, 13 bp, D. melanogaster
caatttgccaaag

SEQ ID NO: 601003 - DNA, 13 bp, D. melanogaster
caatttgccaagc

SEQ ID NO: 601004 - DNA, 13 bp, D. melanogaster
caatttgccagcg

SEQ ID NO: 601005 - DNA, 13 bp, D. melanogaster
caatttgccagtt

SEQ ID NO: 601006 - DNA, 13 bp, D. melanogaster
caatttgccattt

SEQ ID NO: 601007 - DNA, 13 bp, D. melanogaster
caatttgccgcaa

SEQ ID NO: 601008 - DNA, 13 bp, D. melanogaster
caatttgccgctg

SEQ ID NO: 601009 - DNA, 13 bp, D. melanogaster
caatttgcgaaat

SEQ ID NO: 601010 - DNA, 13 bp, D. melanogaster
caatttgcgttgc

SEQ ID NO: 601011 - DNA, 13 bp, D. melanogaster
caatttgcgtttg

SEQ ID NO: 601012 - DNA, 13 bp, D. melanogaster
caatttgctaaat

SEQ ID NO: 601013 - DNA, 13 bp, D. melanogaster
caatttgctgaaa

SEQ ID NO: 601014 - DNA, 13 bp, D. melanogaster
caatttgctgcaa

SEQ ID NO: 601015 - DNA, 13 bp, D. melanogaster
caatttgctgcat

SEQ ID NO: 601016 - DNA, 13 bp, D. melanogaster
caatttgctgcca

SEQ ID NO: 601017 - DNA, 13 bp, D. melanogaster
caatttgctgctg

SEQ ID NO: 601018 - DNA, 13 bp, D. melanogaster
caatttgctggca

SEQ ID NO: 601019 - DNA, 13 bp, D. melanogaster
caatttgctggct

SEQ ID NO: 601020 - DNA, 13 bp, D. melanogaster
caatttgcttaaa

SEQ ID NO: 601021 - DNA, 13 bp, D. melanogaster
caatttgctttgc

SEQ ID NO: 601022 - DNA, 13 bp, D. melanogaster
caatttggaatat

SEQ ID NO: 601023 - DNA, 14 bp, D. melanogaster
caatttggatggat

SEQ ID NO: 601024 - DNA, 14 bp, D. melanogaster
caatttggatttcg

SEQ ID NO: 601025 - DNA, 13 bp, D. melanogaster
caatttggcaaag

SEQ ID NO: 601026 - DNA, 13 bp, D. melanogaster
caatttggcagcg

SEQ ID NO: 601027 - DNA, 13 bp, D. melanogaster
caatttggccaaa

SEQ ID NO: 601028 - DNA, 13 bp, D. melanogaster
caatttggccaat

SEQ ID NO: 601029 - DNA, 13 bp, D. melanogaster
caatttggccaga

SEQ ID NO: 601030 - DNA, 13 bp, D. melanogaster
caatttggctaat

SEQ ID NO: 601031 - DNA, 13 bp, D. melanogaster
caatttggctggc

SEQ ID NO: 601032 - DNA, 13 bp, D. melanogaster
caatttggtcgta

SEQ ID NO: 601033 - DNA, 13 bp, D. melanogaster
caatttggtggca

SEQ ID NO: 601034 - DNA, 13 bp, D. melanogaster
caatttggtttta

SEQ ID NO: 601035 - DNA, 13 bp, D. melanogaster
caatttgtaaaat

SEQ ID NO: 601036 - DNA, 13 bp, D. melanogaster
caatttgtaaaca

SEQ ID NO: 601037 - DNA, 13 bp, D. melanogaster
caatttgtaaatg

SEQ ID NO: 601038 - DNA, 14 bp, D. melanogaster
caatttgtactcaa

SEQ ID NO: 601039 - DNA, 13 bp, D. melanogaster
caatttgtatcac

SEQ ID NO: 601040 - DNA, 13 bp, D. melanogaster
caatttgtatctt

SEQ ID NO: 601041 - DNA, 13 bp, D. melanogaster
caatttgtatgcg

SEQ ID NO: 601042 - DNA, 13 bp, D. melanogaster
caatttgtatggc

SEQ ID NO: 601043 - DNA, 13 bp, D. melanogaster
caatttgtattca

SEQ ID NO: 601044 - DNA, 13 bp, D. melanogaster
caatttgtgaaat

SEQ ID NO: 601045 - DNA, 13 bp, D. melanogaster
caatttgtgcaaa

SEQ ID NO: 601046 - DNA, 13 bp, D. melanogaster
caatttgtgcaac

SEQ ID NO: 601047 - DNA, 13 bp, D. melanogaster
caatttgtgcaat

SEQ ID NO: 601048 - DNA, 13 bp, D. melanogaster
caatttgtgcggc

SEQ ID NO: 601049 - DNA, 13 bp, D. melanogaster
caatttgtgctgc

SEQ ID NO: 601050 - DNA, 13 bp, D. melanogaster
caatttgtggctt

SEQ ID NO: 601051 - DNA, 13 bp, D. melanogaster
caatttgtgtgtg

SEQ ID NO: 601052 - DNA, 13 bp, D. melanogaster
caatttgtgtttt

SEQ ID NO: 601053 - DNA, 13 bp, D. melanogaster
caatttgttaaca

SEQ ID NO: 601054 - DNA, 13 bp, D. melanogaster
caatttgttaata

SEQ ID NO: 601055 - DNA, 13 bp, D. melanogaster
caatttgttaatg

SEQ ID NO: 601056 - DNA, 13 bp, D. melanogaster
caatttgttattt

SEQ ID NO: 601057 - DNA, 13 bp, D. melanogaster
caatttgttgaca

SEQ ID NO: 601058 - DNA, 13 bp, D. melanogaster
caatttgttgact

SEQ ID NO: 601059 - DNA, 13 bp, D. melanogaster
caatttgttgctc

SEQ ID NO: 601060 - DNA, 13 bp, D. melanogaster
caatttgttgctg

SEQ ID NO: 601061 - DNA, 14 bp, D. melanogaster
caatttgttggcca

SEQ ID NO: 601062 - DNA, 13 bp, D. melanogaster
caatttgttggct

SEQ ID NO: 601063 - DNA, 13 bp, D. melanogaster
caatttgttgtca

SEQ ID NO: 601064 - DNA, 13 bp, D. melanogaster
caatttgttgttg

SEQ ID NO: 601065 - DNA, 13 bp, D. melanogaster
caatttgtttaaa

SEQ ID NO: 601066 - DNA, 14 bp, D. melanogaster
caatttgtttaaat

SEQ ID NO: 601067 - DNA, 13 bp, D. melanogaster
caatttgtttaca

SEQ ID NO: 601068 - DNA, 14 bp, D. melanogaster
caatttgtttacaa

SEQ ID NO: 601069 - DNA, 13 bp, D. melanogaster
caatttgtttata

SEQ ID NO: 601070 - DNA, 13 bp, D. melanogaster
caatttgtttgat

SEQ ID NO: 601071 - DNA, 13 bp, D. melanogaster
caatttgtttgct

SEQ ID NO: 601072 - DNA, 14 bp, D. melanogaster
caatttgtttgctc

SEQ ID NO: 601073 - DNA, 14 bp, D. melanogaster
caatttgtttgctt

SEQ ID NO: 601074 - DNA, 13 bp, D. melanogaster
caatttgttttat

SEQ ID NO: 601075 - DNA, 13 bp, D. melanogaster
caatttgttttgt

SEQ ID NO: 601076 - DNA, 13 bp, D. melanogaster
caattttaaatgt

SEQ ID NO: 601077 - DNA, 14 bp, D. melanogaster
caattttaagccaa

SEQ ID NO: 601078 - DNA, 13 bp, D. melanogaster
caattttaattga

SEQ ID NO: 601079 - DNA, 14 bp, D. melanogaster
caattttaatttca

SEQ ID NO: 601080 - DNA, 14 bp, D. melanogaster
caattttacaatat

SEQ ID NO: 601081 - DNA, 13 bp, D. melanogaster
caattttacaatt

SEQ ID NO: 601082 - DNA, 14 bp, D. melanogaster
caattttacaatta

SEQ ID NO: 601083 - DNA, 13 bp, D. melanogaster
caattttatagct

SEQ ID NO: 601084 - DNA, 13 bp, D. melanogaster
caattttatattg

SEQ ID NO: 601085 - DNA, 13 bp, D. melanogaster
caattttatgcaa

SEQ ID NO: 601086 - DNA, 13 bp, D. melanogaster
caattttatggcc

SEQ ID NO: 601087 - DNA, 13 bp, D. melanogaster
caattttattgaa

SEQ ID NO: 601088 - DNA, 13 bp, D. melanogaster
caattttattgcc

SEQ ID NO: 601089 - DNA, 13 bp, D. melanogaster
caattttatttgt

SEQ ID NO: 601090 - DNA, 13 bp, D. melanogaster
caattttcaattt

SEQ ID NO: 601091 - DNA, 13 bp, D. melanogaster
caattttcagctg

SEQ ID NO: 601092 - DNA, 13 bp, D. melanogaster
caattttcagttg

SEQ ID NO: 601093 - DNA, 13 bp, D. melanogaster
caattttcattaa

SEQ ID NO: 601094 - DNA, 13 bp, D. melanogaster
caattttccacaa

SEQ ID NO: 601095 - DNA, 13 bp, D. melanogaster
caattttccatgc

SEQ ID NO: 601096 - DNA, 13 bp, D. melanogaster
caattttcccaag

SEQ ID NO: 601097 - DNA, 13 bp, D. melanogaster
caattttcccaca

SEQ ID NO: 601098 - DNA, 13 bp, D. melanogaster
caattttcccatt

SEQ ID NO: 601099 - DNA, 13 bp, D. melanogaster
caattttcctata

SEQ ID NO: 601100 - DNA, 13 bp, D. melanogaster
caattttcctgcc

SEQ ID NO: 601101 - DNA, 13 bp, D. melanogaster
caattttcgcaca

SEQ ID NO: 601102 - DNA, 13 bp, D. melanogaster
caattttcgctca

SEQ ID NO: 601103 - DNA, 13 bp, D. melanogaster
caattttcgtaat

SEQ ID NO: 601104 - DNA, 13 bp, D. melanogaster
caattttctaaat

SEQ ID NO: 601105 - DNA, 13 bp, D. melanogaster
caattttctatat

SEQ ID NO: 601106 - DNA, 13 bp, D. melanogaster
caattttctatta

SEQ ID NO: 601107 - DNA, 13 bp, D. melanogaster
caattttctcgct

SEQ ID NO: 601108 - DNA, 13 bp, D. melanogaster
caattttctgaaa

SEQ ID NO: 601109 - DNA, 13 bp, D. melanogaster
caattttctggca

SEQ ID NO: 601110 - DNA, 13 bp, D. melanogaster
caattttgaatgc

SEQ ID NO: 601111 - DNA, 13 bp, D. melanogaster
caattttgaattt

SEQ ID NO: 601112 - DNA, 13 bp, D. melanogaster
caattttgacaaa

SEQ ID NO: 601113 - DNA, 13 bp, D. melanogaster
caattttgatgaa

SEQ ID NO: 601114 - DNA, 13 bp, D. melanogaster
caattttgatggc

SEQ ID NO: 601115 - DNA, 13 bp, D. melanogaster
caattttgcaaat

SEQ ID NO: 601116 - DNA, 13 bp, D. melanogaster
caattttgtaaat

SEQ ID NO: 601117 - DNA, 13 bp, D. melanogaster
caattttgtggct

SEQ ID NO: 601118 - DNA, 13 bp, D. melanogaster
caattttgttgct

SEQ ID NO: 601119 - DNA, 13 bp, D. melanogaster
caattttgtttaa

SEQ ID NO: 601120 - DNA, 14 bp, D. melanogaster
caattttgtttgtt

SEQ ID NO: 601121 - DNA, 14 bp, D. melanogaster
caattttgttttat

SEQ ID NO: 601122 - DNA, 13 bp, D. melanogaster
caatttttaaaca

SEQ ID NO: 601123 - DNA, 14 bp, D. melanogaster
caatttttaaacaa

SEQ ID NO: 601124 - DNA, 13 bp, D. melanogaster
caatttttaacaa

SEQ ID NO: 601125 - DNA, 13 bp, D. melanogaster
caatttttagcca

SEQ ID NO: 601126 - DNA, 13 bp, D. melanogaster
caatttttataca

SEQ ID NO: 601127 - DNA, 13 bp, D. melanogaster
caatttttatgac

SEQ ID NO: 601128 - DNA, 13 bp, D. melanogaster
caatttttatgat

SEQ ID NO: 601129 - DNA, 13 bp, D. melanogaster
caatttttatgcc

SEQ ID NO: 601130 - DNA, 14 bp, D. melanogaster
caatttttatgtgt

SEQ ID NO: 601131 - DNA, 14 bp, D. melanogaster
caatttttatgttt

SEQ ID NO: 601132 - DNA, 13 bp, D. melanogaster
caatttttattcg

SEQ ID NO: 601133 - DNA, 13 bp, D. melanogaster
caatttttcaaca

SEQ ID NO: 601134 - DNA, 13 bp, D. melanogaster
caatttttccaac

SEQ ID NO: 601135 - DNA, 13 bp, D. melanogaster
caatttttcgcat

SEQ ID NO: 601136 - DNA, 13 bp, D. melanogaster
caatttttgcaaa

SEQ ID NO: 601137 - DNA, 13 bp, D. melanogaster
caatttttggcca

SEQ ID NO: 601138 - DNA, 13 bp, D. melanogaster
caatttttgtgca

SEQ ID NO: 601139 - DNA, 13 bp, D. melanogaster
caatttttgttaa

SEQ ID NO: 601140 - DNA, 13 bp, D. melanogaster
caatttttgttgt

SEQ ID NO: 601141 - DNA, 13 bp, D. melanogaster
caattttttaaca

SEQ ID NO: 601142 - DNA, 13 bp, D. melanogaster
caattttttatac

SEQ ID NO: 601143 - DNA, 14 bp, D. melanogaster
caattttttataca

SEQ ID NO: 601144 - DNA, 13 bp, D. melanogaster
caattttttcaaa

SEQ ID NO: 601145 - DNA, 13 bp, D. melanogaster
caattttttgcca

SEQ ID NO: 601146 - DNA, 13 bp, D. melanogaster
caattttttgttg

SEQ ID NO: 601147 - DNA, 13 bp, D. melanogaster
caatttttttgta

SEQ ID NO: 601148 - DNA, 13 bp, D. melanogaster
cacaaaaaaattg

SEQ ID NO: 601149 - DNA, 13 bp, D. melanogaster
cacaaaaacattt

SEQ ID NO: 601150 - DNA, 13 bp, D. melanogaster
cacaaaaagcagc

SEQ ID NO: 601151 - DNA, 13 bp, D. melanogaster
cacaaaaagtgaa

SEQ ID NO: 601152 - DNA, 13 bp, D. melanogaster
cacaaaaagtgca

SEQ ID NO: 601153 - DNA, 13 bp, D. melanogaster
cacaaaaagttga

SEQ ID NO: 601154 - DNA, 13 bp, D. melanogaster
cacaaaaagttgc

SEQ ID NO: 601155 - DNA, 13 bp, D. melanogaster
cacaaaaatactt

SEQ ID NO: 601156 - DNA, 13 bp, D. melanogaster
cacaaaaatcgat

SEQ ID NO: 601157 - DNA, 13 bp, D. melanogaster
cacaaaaatgcca

SEQ ID NO: 601158 - DNA, 13 bp, D. melanogaster
cacaaaaatgctt

SEQ ID NO: 601159 - DNA, 13 bp, D. melanogaster
cacaaaaatgtca

SEQ ID NO: 601160 - DNA, 13 bp, D. melanogaster
cacaaaaatgttt

SEQ ID NO: 601161 - DNA, 14 bp, D. melanogaster
cacaaaaattaagg

SEQ ID NO: 601162 - DNA, 13 bp, D. melanogaster
cacaaaaattgtg

SEQ ID NO: 601163 - DNA, 13 bp, D. melanogaster
cacaaaaatttac

SEQ ID NO: 601164 - DNA, 13 bp, D. melanogaster
cacaaaaattttc

SEQ ID NO: 601165 - DNA, 14 bp, D. melanogaster
cacaaaacaaaagt

SEQ ID NO: 601166 - DNA, 13 bp, D. melanogaster
cacaaaacagtaa

SEQ ID NO: 601167 - DNA, 13 bp, D. melanogaster
cacaaaacatttt

SEQ ID NO: 601168 - DNA, 13 bp, D. melanogaster
cacaaaacgattt

SEQ ID NO: 601169 - DNA, 13 bp, D. melanogaster
cacaaaactcatt

SEQ ID NO: 601170 - DNA, 13 bp, D. melanogaster
cacaaaactgtca

SEQ ID NO: 601171 - DNA, 13 bp, D. melanogaster
cacaaaacttttc

SEQ ID NO: 601172 - DNA, 13 bp, D. melanogaster
cacaaaagataca

SEQ ID NO: 601173 - DNA, 14 bp, D. melanogaster
cacaaaagatcgtt

SEQ ID NO: 601174 - DNA, 13 bp, D. melanogaster
cacaaaagccgca

SEQ ID NO: 601175 - DNA, 13 bp, D. melanogaster
cacaaaaggcaac

SEQ ID NO: 601176 - DNA, 13 bp, D. melanogaster
cacaaaaggcatt

SEQ ID NO: 601177 - DNA, 13 bp, D. melanogaster
cacaaaaggccaa

SEQ ID NO: 601178 - DNA, 13 bp, D. melanogaster
cacaaaagtaatt

SEQ ID NO: 601179 - DNA, 13 bp, D. melanogaster
cacaaaagttaaa

SEQ ID NO: 601180 - DNA, 13 bp, D. melanogaster
cacaaaagttgca

SEQ ID NO: 601181 - DNA, 13 bp, D. melanogaster
cacaaaagtttcc

SEQ ID NO: 601182 - DNA, 14 bp, D. melanogaster
cacaaaatactcga

SEQ ID NO: 601183 - DNA, 13 bp, D. melanogaster
cacaaaatattga

SEQ ID NO: 601184 - DNA, 14 bp, D. melanogaster
cacaaaatattgta

SEQ ID NO: 601185 - DNA, 13 bp, D. melanogaster
cacaaaatattta

SEQ ID NO: 601186 - DNA, 13 bp, D. melanogaster
cacaaaatcagaa

SEQ ID NO: 601187 - DNA, 13 bp, D. melanogaster
cacaaaatgcaca

SEQ ID NO: 601188 - DNA, 13 bp, D. melanogaster
cacaaaatggaaa

SEQ ID NO: 601189 - DNA, 13 bp, D. melanogaster
cacaaaatgttgc

SEQ ID NO: 601190 - DNA, 13 bp, D. melanogaster
cacaaaattgcca

SEQ ID NO: 601191 - DNA, 13 bp, D. melanogaster
cacaaaattgtct

SEQ ID NO: 601192 - DNA, 13 bp, D. melanogaster
cacaaaattttaa

SEQ ID NO: 601193 - DNA, 13 bp, D. melanogaster
cacaaacaaactg

SEQ ID NO: 601194 - DNA, 13 bp, D. melanogaster
cacaaacaaatcg

SEQ ID NO: 601195 - DNA, 13 bp, D. melanogaster
cacaaacaaattt

SEQ ID NO: 601196 - DNA, 13 bp, D. melanogaster
cacaaacacaatt

SEQ ID NO: 601197 - DNA, 13 bp, D. melanogaster
cacaaacacagag

SEQ ID NO: 601198 - DNA, 13 bp, D. melanogaster
cacaaacacaggc

SEQ ID NO: 601199 - DNA, 13 bp, D. melanogaster
cacaaacatgaat

SEQ ID NO: 601200 - DNA, 14 bp, D. melanogaster
cacaaacgcaacgc

SEQ ID NO: 601201 - DNA, 13 bp, D. melanogaster
cacaaacgccaat

SEQ ID NO: 601202 - DNA, 13 bp, D. melanogaster
cacaaactatagc

SEQ ID NO: 601203 - DNA, 13 bp, D. melanogaster
cacaaacttttcc

SEQ ID NO: 601204 - DNA, 14 bp, D. melanogaster
cacaaagaaatatg

SEQ ID NO: 601205 - DNA, 13 bp, D. melanogaster
cacaaagcaaatg

SEQ ID NO: 601206 - DNA, 13 bp, D. melanogaster
cacaaaggactcc

SEQ ID NO: 601207 - DNA, 13 bp, D. melanogaster
cacaaaggcaaat

SEQ ID NO: 601208 - DNA, 13 bp, D. melanogaster
cacaaagtaaaca

SEQ ID NO: 601209 - DNA, 13 bp, D. melanogaster
cacaaagtgcatt

SEQ ID NO: 601210 - DNA, 13 bp, D. melanogaster
cacaaataattta

SEQ ID NO: 601211 - DNA, 13 bp, D. melanogaster
cacaaatacaatt

SEQ ID NO: 601212 - DNA, 13 bp, D. melanogaster
cacaaatagcaaa

SEQ ID NO: 601213 - DNA, 13 bp, D. melanogaster
cacaaatatgtat

SEQ ID NO: 601214 - DNA, 13 bp, D. melanogaster
cacaaatatgtgt

SEQ ID NO: 601215 - DNA, 13 bp, D. melanogaster
cacaaatatgttt

SEQ ID NO: 601216 - DNA, 13 bp, D. melanogaster
cacaaatattcat

SEQ ID NO: 601217 - DNA, 14 bp, D. melanogaster
cacaaatattgaaa

SEQ ID NO: 601218 - DNA, 13 bp, D. melanogaster
cacaaatatttgc

SEQ ID NO: 601219 - DNA, 13 bp, D. melanogaster
cacaaatcaaagc

SEQ ID NO: 601220 - DNA, 13 bp, D. melanogaster
cacaaatcaaatg

SEQ ID NO: 601221 - DNA, 13 bp, D. melanogaster
cacaaatcaatat

SEQ ID NO: 601222 - DNA, 13 bp, D. melanogaster
cacaaatcaatta

SEQ ID NO: 601223 - DNA, 13 bp, D. melanogaster
cacaaatcgaaaa

SEQ ID NO: 601224 - DNA, 13 bp, D. melanogaster
cacaaatgaaaat

SEQ ID NO: 601225 - DNA, 13 bp, D. melanogaster
cacaaatgaaact

SEQ ID NO: 601226 - DNA, 13 bp, D. melanogaster
cacaaatgaaatg

SEQ ID NO: 601227 - DNA, 13 bp, D. melanogaster
cacaaatgacttt

SEQ ID NO: 601228 - DNA, 13 bp, D. melanogaster
cacaaatgtaaat

SEQ ID NO: 601229 - DNA, 13 bp, D. melanogaster
cacaaatgtgggc

SEQ ID NO: 601230 - DNA, 13 bp, D. melanogaster
cacaaattaattg

SEQ ID NO: 601231 - DNA, 13 bp, D. melanogaster
cacaaattataat

SEQ ID NO: 601232 - DNA, 13 bp, D. melanogaster
cacaaattatata

SEQ ID NO: 601233 - DNA, 13 bp, D. melanogaster
cacaaattattta

SEQ ID NO: 601234 - DNA, 13 bp, D. melanogaster
cacaaattcaata

SEQ ID NO: 601235 - DNA, 13 bp, D. melanogaster
cacaaattcaatt

SEQ ID NO: 601236 - DNA, 13 bp, D. melanogaster
cacaaattgcatt

SEQ ID NO: 601237 - DNA, 13 bp, D. melanogaster
cacaaattgccaa

SEQ ID NO: 601238 - DNA, 13 bp, D. melanogaster
cacaaattgttta

SEQ ID NO: 601239 - DNA, 13 bp, D. melanogaster
cacaaatttcaca

SEQ ID NO: 601240 - DNA, 13 bp, D. melanogaster
cacaaattttcaa

SEQ ID NO: 601241 - DNA, 13 bp, D. melanogaster
cacaaattttcat

SEQ ID NO: 601242 - DNA, 13 bp, D. melanogaster
cacaaattttcca

SEQ ID NO: 601243 - DNA, 13 bp, D. melanogaster
cacaaattttgaa

SEQ ID NO: 601244 - DNA, 13 bp, D. melanogaster
cacaacaaacttt

SEQ ID NO: 601245 - DNA, 13 bp, D. melanogaster
cacaacaaagttg

SEQ ID NO: 601246 - DNA, 13 bp, D. melanogaster
cacaacaaatgaa

SEQ ID NO: 601247 - DNA, 13 bp, D. melanogaster
cacaacaaatggc

SEQ ID NO: 601248 - DNA, 13 bp, D. melanogaster
cacaacaacaatg

SEQ ID NO: 601249 - DNA, 14 bp, D. melanogaster
cacaacaacactgt

SEQ ID NO: 601250 - DNA, 14 bp, D. melanogaster
cacaacaacagcag

SEQ ID NO: 601251 - DNA, 13 bp, D. melanogaster
cacaacaatggca

SEQ ID NO: 601252 - DNA, 14 bp, D. melanogaster
cacaacaatggcaa

SEQ ID NO: 601253 - DNA, 13 bp, D. melanogaster
cacaacaatggcc

SEQ ID NO: 601254 - DNA, 13 bp, D. melanogaster
cacaacaattaca

SEQ ID NO: 601255 - DNA, 13 bp, D. melanogaster
cacaacacatttt

SEQ ID NO: 601256 - DNA, 13 bp, D. melanogaster
cacaacaccatcg

SEQ ID NO: 601257 - DNA, 14 bp, D. melanogaster
cacaacagcaacag

SEQ ID NO: 601258 - DNA, 13 bp, D. melanogaster
cacaacagcagca

SEQ ID NO: 601259 - DNA, 14 bp, D. melanogaster
cacaacagcagcaa

SEQ ID NO: 601260 - DNA, 13 bp, D. melanogaster
cacaacatcaact

SEQ ID NO: 601261 - DNA, 13 bp, D. melanogaster
cacaacatccatg

SEQ ID NO: 601262 - DNA, 13 bp, D. melanogaster
cacaaccaattat

SEQ ID NO: 601263 - DNA, 13 bp, D. melanogaster
cacaacccattat

SEQ ID NO: 601264 - DNA, 13 bp, D. melanogaster
cacaacgacattg

SEQ ID NO: 601265 - DNA, 13 bp, D. melanogaster
cacaacgatggaa

SEQ ID NO: 601266 - DNA, 13 bp, D. melanogaster
cacaactcactca

SEQ ID NO: 601267 - DNA, 13 bp, D. melanogaster
cacaactgtactt

SEQ ID NO: 601268 - DNA, 13 bp, D. melanogaster
cacaacttggcca

SEQ ID NO: 601269 - DNA, 13 bp, D. melanogaster
cacaacttttgcc

SEQ ID NO: 601270 - DNA, 13 bp, D. melanogaster
cacaagaatgtga

SEQ ID NO: 601271 - DNA, 13 bp, D. melanogaster
cacaagaccgaag

SEQ ID NO: 601272 - DNA, 13 bp, D. melanogaster
cacaagacgagga

SEQ ID NO: 601273 - DNA, 13 bp, D. melanogaster
cacaagcaaatac

SEQ ID NO: 601274 - DNA, 13 bp, D. melanogaster
cacaagcaagcaa

SEQ ID NO: 601275 - DNA, 13 bp, D. melanogaster
cacaagcacaagc

SEQ ID NO: 601276 - DNA, 14 bp, D. melanogaster
cacaagcacaagca

SEQ ID NO: 601277 - DNA, 14 bp, D. melanogaster
cacaagcacacacg

SEQ ID NO: 601278 - DNA, 13 bp, D. melanogaster
cacaagcacacgc

SEQ ID NO: 601279 - DNA, 13 bp, D. melanogaster
cacaagccgcaca

SEQ ID NO: 601280 - DNA, 13 bp, D. melanogaster
cacaagccgccca

SEQ ID NO: 601281 - DNA, 13 bp, D. melanogaster
cacaagctgaaaa

SEQ ID NO: 601282 - DNA, 13 bp, D. melanogaster
cacaagctgtaac

SEQ ID NO: 601283 - DNA, 13 bp, D. melanogaster
cacaaggaaaaat

SEQ ID NO: 601284 - DNA, 13 bp, D. melanogaster
cacaagtatgcaa

SEQ ID NO: 601285 - DNA, 13 bp, D. melanogaster
cacaagtcgagat

SEQ ID NO: 601286 - DNA, 13 bp, D. melanogaster
cacaagtcgcgat

SEQ ID NO: 601287 - DNA, 13 bp, D. melanogaster
cacaagtcgtgga

SEQ ID NO: 601288 - DNA, 13 bp, D. melanogaster
cacaagtgcccaa

SEQ ID NO: 601289 - DNA, 13 bp, D. melanogaster
cacaagtgggtgg

SEQ ID NO: 601290 - DNA, 14 bp, D. melanogaster
cacaagtgtttatt

SEQ ID NO: 601291 - DNA, 13 bp, D. melanogaster
cacaagtgttttt

SEQ ID NO: 601292 - DNA, 13 bp, D. melanogaster
cacaagttggcca

SEQ ID NO: 601293 - DNA, 13 bp, D. melanogaster
cacaataaacgat

SEQ ID NO: 601294 - DNA, 13 bp, D. melanogaster
cacaataagaagc

SEQ ID NO: 601295 - DNA, 14 bp, D. melanogaster
cacaataatggcag

SEQ ID NO: 601296 - DNA, 13 bp, D. melanogaster
cacaatacaattt

SEQ ID NO: 601297 - DNA, 13 bp, D. melanogaster
cacaatatatgat

SEQ ID NO: 601298 - DNA, 13 bp, D. melanogaster
cacaatattccca

SEQ ID NO: 601299 - DNA, 13 bp, D. melanogaster
cacaatatttatt

SEQ ID NO: 601300 - DNA, 13 bp, D. melanogaster
cacaatatttgca

SEQ ID NO: 601301 - DNA, 13 bp, D. melanogaster
cacaatatttttt

SEQ ID NO: 601302 - DNA, 13 bp, D. melanogaster
cacaatcaaatca

SEQ ID NO: 601303 - DNA, 13 bp, D. melanogaster
cacaatcaagcaa

SEQ ID NO: 601304 - DNA, 14 bp, D. melanogaster
cacaatcaagcaaa

SEQ ID NO: 601305 - DNA, 13 bp, D. melanogaster
cacaatcacaatc

SEQ ID NO: 601306 - DNA, 14 bp, D. melanogaster
cacaatcacaatca

SEQ ID NO: 601307 - DNA, 13 bp, D. melanogaster
cacaatcgcaatc

SEQ ID NO: 601308 - DNA, 14 bp, D. melanogaster
cacaatcgcaatca

SEQ ID NO: 601309 - DNA, 13 bp, D. melanogaster
cacaatctcaaca

SEQ ID NO: 601310 - DNA, 14 bp, D. melanogaster
cacaatcttttgca

SEQ ID NO: 601311 - DNA, 13 bp, D. melanogaster
cacaatgcaaaaa

SEQ ID NO: 601312 - DNA, 13 bp, D. melanogaster
cacaatgcaaaat

SEQ ID NO: 601313 - DNA, 13 bp, D. melanogaster
cacaatgcaaatg

SEQ ID NO: 601314 - DNA, 13 bp, D. melanogaster
cacaatgcctcga

SEQ ID NO: 601315 - DNA, 13 bp, D. melanogaster
cacaatggaaatt

SEQ ID NO: 601316 - DNA, 13 bp, D. melanogaster
cacaatggccaca

SEQ ID NO: 601317 - DNA, 13 bp, D. melanogaster
cacaatgtatgta

SEQ ID NO: 601318 - DNA, 13 bp, D. melanogaster
cacaatgtcggac

SEQ ID NO: 601319 - DNA, 13 bp, D. melanogaster
cacaattaaatgg

SEQ ID NO: 601320 - DNA, 14 bp, D. melanogaster
cacaattaatgaag

SEQ ID NO: 601321 - DNA, 14 bp, D. melanogaster
cacaattaccagaa

SEQ ID NO: 601322 - DNA, 13 bp, D. melanogaster
cacaattatgaca

SEQ ID NO: 601323 - DNA, 13 bp, D. melanogaster
cacaattcacaat

SEQ ID NO: 601324 - DNA, 13 bp, D. melanogaster
cacaattgaaatg

SEQ ID NO: 601325 - DNA, 14 bp, D. melanogaster
cacaattgagaagg

SEQ ID NO: 601326 - DNA, 13 bp, D. melanogaster
cacaattgcacaa

SEQ ID NO: 601327 - DNA, 13 bp, D. melanogaster
cacaattgctgat

SEQ ID NO: 601328 - DNA, 13 bp, D. melanogaster
cacaattgtattt

SEQ ID NO: 601329 - DNA, 13 bp, D. melanogaster
cacaattgtcact

SEQ ID NO: 601330 - DNA, 13 bp, D. melanogaster
cacaattgtttat

SEQ ID NO: 601331 - DNA, 13 bp, D. melanogaster
cacaatttacttt

SEQ ID NO: 601332 - DNA, 13 bp, D. melanogaster
cacaatttataat

SEQ ID NO: 601333 - DNA, 14 bp, D. melanogaster
cacaatttataatg

SEQ ID NO: 601334 - DNA, 13 bp, D. melanogaster
cacaatttataca

SEQ ID NO: 601335 - DNA, 13 bp, D. melanogaster
cacaatttatgca

SEQ ID NO: 601336 - DNA, 13 bp, D. melanogaster
cacaatttattat

SEQ ID NO: 601337 - DNA, 13 bp, D. melanogaster
cacaatttgcatg

SEQ ID NO: 601338 - DNA, 13 bp, D. melanogaster
cacaatttgttgt

SEQ ID NO: 601339 - DNA, 13 bp, D. melanogaster
cacaattttaaca

SEQ ID NO: 601340 - DNA, 13 bp, D. melanogaster
cacaattttaatt

SEQ ID NO: 601341 - DNA, 13 bp, D. melanogaster
cacaattttcatt

SEQ ID NO: 601342 - DNA, 13 bp, D. melanogaster
cacaatttttgaa

SEQ ID NO: 601343 - DNA, 13 bp, D. melanogaster
cacaattttttat

SEQ ID NO: 601344 - DNA, 13 bp, D. melanogaster
cacaattttttcg

SEQ ID NO: 601345 - DNA, 13 bp, D. melanogaster
cacacaaaagcag

SEQ ID NO: 601346 - DNA, 13 bp, D. melanogaster
cacacaaaagcga

SEQ ID NO: 601347 - DNA, 13 bp, D. melanogaster
cacacaaaatgca

SEQ ID NO: 601348 - DNA, 13 bp, D. melanogaster
cacacaaacactt

SEQ ID NO: 601349 - DNA, 13 bp, D. melanogaster
cacacaaacgcat

SEQ ID NO: 601350 - DNA, 13 bp, D. melanogaster
cacacaaacttct

SEQ ID NO: 601351 - DNA, 13 bp, D. melanogaster
cacacaaagaaat

SEQ ID NO: 601352 - DNA, 13 bp, D. melanogaster
cacacaaagcgaa

SEQ ID NO: 601353 - DNA, 13 bp, D. melanogaster
cacacaaaggcaa

SEQ ID NO: 601354 - DNA, 13 bp, D. melanogaster
cacacaaagttga

SEQ ID NO: 601355 - DNA, 13 bp, D. melanogaster
cacacaaataatt

SEQ ID NO: 601356 - DNA, 13 bp, D. melanogaster
cacacaaatgaaa

SEQ ID NO: 601357 - DNA, 13 bp, D. melanogaster
cacacaaatgaat

SEQ ID NO: 601358 - DNA, 13 bp, D. melanogaster
cacacaaatgcat

SEQ ID NO: 601359 - DNA, 13 bp, D. melanogaster
cacacaaatgctg

SEQ ID NO: 601360 - DNA, 13 bp, D. melanogaster
cacacaaatgtat

SEQ ID NO: 601361 - DNA, 13 bp, D. melanogaster
cacacaaattatg

SEQ ID NO: 601362 - DNA, 13 bp, D. melanogaster
cacacaaattgca

SEQ ID NO: 601363 - DNA, 13 bp, D. melanogaster
cacacaacaaatt

SEQ ID NO: 601364 - DNA, 13 bp, D. melanogaster
cacacaacaatgt

SEQ ID NO: 601365 - DNA, 13 bp, D. melanogaster
cacacaagcaagc

SEQ ID NO: 601366 - DNA, 13 bp, D. melanogaster
cacacaagcacag

SEQ ID NO: 601367 - DNA, 13 bp, D. melanogaster
cacacaagcacgc

SEQ ID NO: 601368 - DNA, 13 bp, D. melanogaster
cacacaagcgcac

SEQ ID NO: 601369 - DNA, 13 bp, D. melanogaster
cacacaatcatat

SEQ ID NO: 601370 - DNA, 13 bp, D. melanogaster
cacacaatggcca

SEQ ID NO: 601371 - DNA, 13 bp, D. melanogaster
cacacaattgcaa

SEQ ID NO: 601372 - DNA, 13 bp, D. melanogaster
cacacaatttcca

SEQ ID NO: 601373 - DNA, 13 bp, D. melanogaster
cacacaatttgaa

SEQ ID NO: 601374 - DNA, 13 bp, D. melanogaster
cacacaatttgca

SEQ ID NO: 601375 - DNA, 13 bp, D. melanogaster
cacacaatttgtg

SEQ ID NO: 601376 - DNA, 13 bp, D. melanogaster
cacacaatttgtt

SEQ ID NO: 601377 - DNA, 13 bp, D. melanogaster
cacacacaaactt

SEQ ID NO: 601378 - DNA, 13 bp, D. melanogaster
cacacacaaaggc

SEQ ID NO: 601379 - DNA, 13 bp, D. melanogaster
cacacacaaatgt

SEQ ID NO: 601380 - DNA, 13 bp, D. melanogaster
cacacacaaattt

SEQ ID NO: 601381 - DNA, 13 bp, D. melanogaster
cacacacaagcag

SEQ ID NO: 601382 - DNA, 13 bp, D. melanogaster
cacacacaagcgc

SEQ ID NO: 601383 - DNA, 13 bp, D. melanogaster
cacacacaaggac

SEQ ID NO: 601384 - DNA, 13 bp, D. melanogaster
cacacacaagtgt

SEQ ID NO: 601385 - DNA, 13 bp, D. melanogaster
cacacacaatggc

SEQ ID NO: 601386 - DNA, 13 bp, D. melanogaster
cacacacaatttg

SEQ ID NO: 601387 - DNA, 14 bp, D. melanogaster
cacacacacaaatt

SEQ ID NO: 601388 - DNA, 14 bp, D. melanogaster
cacacacacaagcg

SEQ ID NO: 601389 - DNA, 13 bp, D. melanogaster
cacacacacaagg

SEQ ID NO: 601390 - DNA, 13 bp, D. melanogaster
cacacacacaagt

SEQ ID NO: 601391 - DNA, 14 bp, D. melanogaster
cacacacacaatgg

SEQ ID NO: 601392 - DNA, 14 bp, D. melanogaster
cacacacacacagg

SEQ ID NO: 601393 - DNA, 14 bp, D. melanogaster
cacacacacacctt

SEQ ID NO: 601394 - DNA, 14 bp, D. melanogaster
cacacacacacgag

SEQ ID NO: 601395 - DNA, 14 bp, D. melanogaster
cacacacacacgct

SEQ ID NO: 601396 - DNA, 14 bp, D. melanogaster
cacacacacacgta

SEQ ID NO: 601397 - DNA, 14 bp, D. melanogaster
cacacacacacgtg

SEQ ID NO: 601398 - DNA, 14 bp, D. melanogaster
cacacacacactcg

SEQ ID NO: 601399 - DNA, 14 bp, D. melanogaster
cacacacacactgg

SEQ ID NO: 601400 - DNA, 13 bp, D. melanogaster
cacacacacactt

SEQ ID NO: 601401 - DNA, 14 bp, D. melanogaster
cacacacacactta

SEQ ID NO: 601402 - DNA, 14 bp, D. melanogaster
cacacacacagacg

SEQ ID NO: 601403 - DNA, 13 bp, D. melanogaster
cacacacacagag

SEQ ID NO: 601404 - DNA, 14 bp, D. melanogaster
cacacacacagcga

SEQ ID NO: 601405 - DNA, 13 bp, D. melanogaster
cacacacacagct

SEQ ID NO: 601406 - DNA, 14 bp, D. melanogaster
cacacacacaggca

SEQ ID NO: 601407 - DNA, 13 bp, D. melanogaster
cacacacacagtc

SEQ ID NO: 601408 - DNA, 15 bp, D. melanogaster
cacacacacagtcac

SEQ ID NO: 601409 - DNA, 13 bp, D. melanogaster
cacacacacagtt

SEQ ID NO: 601410 - DNA, 14 bp, D. melanogaster
cacacacacagtta

SEQ ID NO: 601411 - DNA, 14 bp, D. melanogaster
cacacacacagttg

SEQ ID NO: 601412 - DNA, 14 bp, D. melanogaster
cacacacacataag

SEQ ID NO: 601413 - DNA, 13 bp, D. melanogaster
cacacacacatag

SEQ ID NO: 601414 - DNA, 14 bp, D. melanogaster
cacacacacatatc

SEQ ID NO: 601415 - DNA, 14 bp, D. melanogaster
cacacacacatccg

SEQ ID NO: 601416 - DNA, 14 bp, D. melanogaster
cacacacacatcga

SEQ ID NO: 601417 - DNA, 14 bp, D. melanogaster
cacacacacatctg

SEQ ID NO: 601418 - DNA, 13 bp, D. melanogaster
cacacacacatga

SEQ ID NO: 601419 - DNA, 14 bp, D. melanogaster
cacacacacatgaa

SEQ ID NO: 601420 - DNA, 15 bp, D. melanogaster
cacacacacatgcac

SEQ ID NO: 601421 - DNA, 14 bp, D. melanogaster
cacacacacattca

SEQ ID NO: 601422 - DNA, 14 bp, D. melanogaster
cacacacacatttg

SEQ ID NO: 601423 - DNA, 14 bp, D. melanogaster
cacacacaccagcg

SEQ ID NO: 601424 - DNA, 13 bp, D. melanogaster
cacacacaccttc

SEQ ID NO: 601425 - DNA, 13 bp, D. melanogaster
cacacacaccttt

SEQ ID NO: 601426 - DNA, 13 bp, D. melanogaster
cacacacacgagc

SEQ ID NO: 601427 - DNA, 14 bp, D. melanogaster
cacacacacgagcg

SEQ ID NO: 601428 - DNA, 14 bp, D. melanogaster
cacacacacgcact

SEQ ID NO: 601429 - DNA, 14 bp, D. melanogaster
cacacacacgcagc

SEQ ID NO: 601430 - DNA, 13 bp, D. melanogaster
cacacacacgcga

SEQ ID NO: 601431 - DNA, 14 bp, D. melanogaster
cacacacacgcgca

SEQ ID NO: 601432 - DNA, 13 bp, D. melanogaster
cacacacacgcgg

SEQ ID NO: 601433 - DNA, 13 bp, D. melanogaster
cacacacacgcgt

SEQ ID NO: 601434 - DNA, 13 bp, D. melanogaster
cacacacacgctt

SEQ ID NO: 601435 - DNA, 13 bp, D. melanogaster
cacacacacgggc

SEQ ID NO: 601436 - DNA, 14 bp, D. melanogaster
cacacacacgtaca

SEQ ID NO: 601437 - DNA, 13 bp, D. melanogaster
cacacacacgtgc

SEQ ID NO: 601438 - DNA, 14 bp, D. melanogaster
cacacacactcacg

SEQ ID NO: 601439 - DNA, 14 bp, D. melanogaster
cacacacactcact

SEQ ID NO: 601440 - DNA, 13 bp, D. melanogaster
cacacacactcag

SEQ ID NO: 601441 - DNA, 14 bp, D. melanogaster
cacacacactcaga

SEQ ID NO: 601442 - DNA, 13 bp, D. melanogaster
cacacacactcat

SEQ ID NO: 601443 - DNA, 13 bp, D. melanogaster
cacacacactcga

SEQ ID NO: 601444 - DNA, 14 bp, D. melanogaster
cacacacactcgaa

SEQ ID NO: 601445 - DNA, 14 bp, D. melanogaster
cacacacactcgac

SEQ ID NO: 601446 - DNA, 13 bp, D. melanogaster
cacacacactcgt

SEQ ID NO: 601447 - DNA, 14 bp, D. melanogaster
cacacacactcgtg

SEQ ID NO: 601448 - DNA, 13 bp, D. melanogaster
cacacacactctc

SEQ ID NO: 601449 - DNA, 14 bp, D. melanogaster
cacacacactctca

SEQ ID NO: 601450 - DNA, 13 bp, D. melanogaster
cacacacactgga

SEQ ID NO: 601451 - DNA, 13 bp, D. melanogaster
cacacacactggc

SEQ ID NO: 601452 - DNA, 13 bp, D. melanogaster
cacacacacttaa

SEQ ID NO: 601453 - DNA, 13 bp, D. melanogaster
cacacacacttag

SEQ ID NO: 601454 - DNA, 13 bp, D. melanogaster
cacacacacttat

SEQ ID NO: 601455 - DNA, 13 bp, D. melanogaster
cacacacacttgt

SEQ ID NO: 601456 - DNA, 13 bp, D. melanogaster
cacacacactttc

SEQ ID NO: 601457 - DNA, 13 bp, D. melanogaster
cacacacagaaga

SEQ ID NO: 601458 - DNA, 13 bp, D. melanogaster
cacacacagacag

SEQ ID NO: 601459 - DNA, 14 bp, D. melanogaster
cacacacagacaga

SEQ ID NO: 601460 - DNA, 14 bp, D. melanogaster
cacacacagacagg

SEQ ID NO: 601461 - DNA, 14 bp, D. melanogaster
cacacacagacgca

SEQ ID NO: 601462 - DNA, 13 bp, D. melanogaster
cacacacagaggc

SEQ ID NO: 601463 - DNA, 13 bp, D. melanogaster
cacacacagatac

SEQ ID NO: 601464 - DNA, 14 bp, D. melanogaster
cacacacagataca

SEQ ID NO: 601465 - DNA, 14 bp, D. melanogaster
cacacacagatacg

SEQ ID NO: 601466 - DNA, 13 bp, D. melanogaster
cacacacagatgg

SEQ ID NO: 601467 - DNA, 13 bp, D. melanogaster
cacacacagcagc

SEQ ID NO: 601468 - DNA, 13 bp, D. melanogaster
cacacacagccat

SEQ ID NO: 601469 - DNA, 13 bp, D. melanogaster
cacacacagccgc

SEQ ID NO: 601470 - DNA, 14 bp, D. melanogaster
cacacacagccgca

SEQ ID NO: 601471 - DNA, 14 bp, D. melanogaster
cacacacagctgca

SEQ ID NO: 601472 - DNA, 13 bp, D. melanogaster
cacacacaggcac

SEQ ID NO: 601473 - DNA, 14 bp, D. melanogaster
cacacacaggcaca

SEQ ID NO: 601474 - DNA, 13 bp, D. melanogaster
cacacacagtcac

SEQ ID NO: 601475 - DNA, 13 bp, D. melanogaster
cacacacagtggc

SEQ ID NO: 601476 - DNA, 13 bp, D. melanogaster
cacacacataaat

SEQ ID NO: 601477 - DNA, 13 bp, D. melanogaster
cacacacataagc

SEQ ID NO: 601478 - DNA, 14 bp, D. melanogaster
cacacacatacact

SEQ ID NO: 601479 - DNA, 13 bp, D. melanogaster
cacacacatacag

SEQ ID NO: 601480 - DNA, 14 bp, D. melanogaster
cacacacatacata

SEQ ID NO: 601481 - DNA, 13 bp, D. melanogaster
cacacacatacgc

SEQ ID NO: 601482 - DNA, 14 bp, D. melanogaster
cacacacatacgca

SEQ ID NO: 601483 - DNA, 13 bp, D. melanogaster
cacacacatactc

SEQ ID NO: 601484 - DNA, 13 bp, D. melanogaster
cacacacatagag

SEQ ID NO: 601485 - DNA, 13 bp, D. melanogaster
cacacacatagtc

SEQ ID NO: 601486 - DNA, 13 bp, D. melanogaster
cacacacatatac

SEQ ID NO: 601487 - DNA, 14 bp, D. melanogaster
cacacacatataca

SEQ ID NO: 601488 - DNA, 13 bp, D. melanogaster
cacacacatatgc

SEQ ID NO: 601489 - DNA, 14 bp, D. melanogaster
cacacacatatgta

SEQ ID NO: 601490 - DNA, 13 bp, D. melanogaster
cacacacatattt

SEQ ID NO: 601491 - DNA, 13 bp, D. melanogaster
cacacacatcgca

SEQ ID NO: 601492 - DNA, 13 bp, D. melanogaster
cacacacatgacc

SEQ ID NO: 601493 - DNA, 13 bp, D. melanogaster
cacacacatgcac

SEQ ID NO: 601494 - DNA, 14 bp, D. melanogaster
cacacacatgcaca

SEQ ID NO: 601495 - DNA, 13 bp, D. melanogaster
cacacacatgccc

SEQ ID NO: 601496 - DNA, 13 bp, D. melanogaster
cacacacatgccg

SEQ ID NO: 601497 - DNA, 13 bp, D. melanogaster
cacacacatgcga

SEQ ID NO: 601498 - DNA, 13 bp, D. melanogaster
cacacacatggac

SEQ ID NO: 601499 - DNA, 14 bp, D. melanogaster
cacacacatggcca

SEQ ID NO: 601500 - DNA, 13 bp, D. melanogaster
cacacacatgtgc

SEQ ID NO: 601501 - DNA, 14 bp, D. melanogaster
cacacacatgtgcg

SEQ ID NO: 601502 - DNA, 13 bp, D. melanogaster
cacacacatgtgt

SEQ ID NO: 601503 - DNA, 13 bp, D. melanogaster
cacacacatgttg

SEQ ID NO: 601504 - DNA, 13 bp, D. melanogaster
cacacacattaag

SEQ ID NO: 601505 - DNA, 13 bp, D. melanogaster
cacacacattcac

SEQ ID NO: 601506 - DNA, 14 bp, D. melanogaster
cacacacattcaca

SEQ ID NO: 601507 - DNA, 13 bp, D. melanogaster
cacacacattcag

SEQ ID NO: 601508 - DNA, 13 bp, D. melanogaster
cacacacattcgt

SEQ ID NO: 601509 - DNA, 13 bp, D. melanogaster
cacacacatttaa

SEQ ID NO: 601510 - DNA, 13 bp, D. melanogaster
cacacacatttac

SEQ ID NO: 601511 - DNA, 13 bp, D. melanogaster
cacacacatttgc

SEQ ID NO: 601512 - DNA, 14 bp, D. melanogaster
cacacacatttgca

SEQ ID NO: 601513 - DNA, 13 bp, D. melanogaster
cacacacattttt

SEQ ID NO: 601514 - DNA, 13 bp, D. melanogaster
cacacacgagcac

SEQ ID NO: 601515 - DNA, 13 bp, D. melanogaster
cacacacgcaaat

SEQ ID NO: 601516 - DNA, 14 bp, D. melanogaster
cacacacgcacact

SEQ ID NO: 601517 - DNA, 13 bp, D. melanogaster
cacacacgcacag

SEQ ID NO: 601518 - DNA, 13 bp, D. melanogaster
cacacacgcacat

SEQ ID NO: 601519 - DNA, 13 bp, D. melanogaster
cacacacgcaccg

SEQ ID NO: 601520 - DNA, 14 bp, D. melanogaster
cacacacgcacgca

SEQ ID NO: 601521 - DNA, 13 bp, D. melanogaster
cacacacgcactt

SEQ ID NO: 601522 - DNA, 13 bp, D. melanogaster
cacacacgcagcc

SEQ ID NO: 601523 - DNA, 13 bp, D. melanogaster
cacacacgcatac

SEQ ID NO: 601524 - DNA, 13 bp, D. melanogaster
cacacacgcatgc

SEQ ID NO: 601525 - DNA, 14 bp, D. melanogaster
cacacacgcatgca

SEQ ID NO: 601526 - DNA, 13 bp, D. melanogaster
cacacacgcattc

SEQ ID NO: 601527 - DNA, 14 bp, D. melanogaster
cacacacgtacaca

SEQ ID NO: 601528 - DNA, 13 bp, D. melanogaster
cacacacgtacag

SEQ ID NO: 601529 - DNA, 13 bp, D. melanogaster
cacacacgtgcac

SEQ ID NO: 601530 - DNA, 13 bp, D. melanogaster
cacacactcactc

SEQ ID NO: 601531 - DNA, 14 bp, D. melanogaster
cacacactcactcg

SEQ ID NO: 601532 - DNA, 13 bp, D. melanogaster
cacacactcactt

SEQ ID NO: 601533 - DNA, 13 bp, D. melanogaster
cacacactcatac

SEQ ID NO: 601534 - DNA, 14 bp, D. melanogaster
cacacactcataca

SEQ ID NO: 601535 - DNA, 13 bp, D. melanogaster
cacacactcattc

SEQ ID NO: 601536 - DNA, 13 bp, D. melanogaster
cacacactcgaaa

SEQ ID NO: 601537 - DNA, 13 bp, D. melanogaster
cacacactcgcac

SEQ ID NO: 601538 - DNA, 14 bp, D. melanogaster
cacacactcgcacg

SEQ ID NO: 601539 - DNA, 13 bp, D. melanogaster
cacacactcgcag

SEQ ID NO: 601540 - DNA, 13 bp, D. melanogaster
cacacactcgcca

SEQ ID NO: 601541 - DNA, 13 bp, D. melanogaster
cacacactcgctc

SEQ ID NO: 601542 - DNA, 13 bp, D. melanogaster
cacacactctcac

SEQ ID NO: 601543 - DNA, 13 bp, D. melanogaster
cacacactgaaaa

SEQ ID NO: 601544 - DNA, 13 bp, D. melanogaster
cacacactgccac

SEQ ID NO: 601545 - DNA, 14 bp, D. melanogaster
cacacactgcgtat

SEQ ID NO: 601546 - DNA, 13 bp, D. melanogaster
cacacactggcaa

SEQ ID NO: 601547 - DNA, 13 bp, D. melanogaster
cacacactggcag

SEQ ID NO: 601548 - DNA, 13 bp, D. melanogaster
cacacactggcgc

SEQ ID NO: 601549 - DNA, 13 bp, D. melanogaster
cacacacttaaac

SEQ ID NO: 601550 - DNA, 13 bp, D. melanogaster
cacacacttattt

SEQ ID NO: 601551 - DNA, 13 bp, D. melanogaster
cacacacttgtgc

SEQ ID NO: 601552 - DNA, 13 bp, D. melanogaster
cacacactttaaa

SEQ ID NO: 601553 - DNA, 13 bp, D. melanogaster
cacacagaaaatg

SEQ ID NO: 601554 - DNA, 13 bp, D. melanogaster
cacacagacacag

SEQ ID NO: 601555 - DNA, 14 bp, D. melanogaster
cacacagacacata

SEQ ID NO: 601556 - DNA, 13 bp, D. melanogaster
cacacagacacga

SEQ ID NO: 601557 - DNA, 13 bp, D. melanogaster
cacacagacactc

SEQ ID NO: 601558 - DNA, 14 bp, D. melanogaster
cacacagacagaca

SEQ ID NO: 601559 - DNA, 13 bp, D. melanogaster
cacacagacagga

SEQ ID NO: 601560 - DNA, 13 bp, D. melanogaster
cacacagacatac

SEQ ID NO: 601561 - DNA, 14 bp, D. melanogaster
cacacagacgcacg

SEQ ID NO: 601562 - DNA, 13 bp, D. melanogaster
cacacagacgcag

SEQ ID NO: 601563 - DNA, 13 bp, D. melanogaster
cacacagagacac

SEQ ID NO: 601564 - DNA, 13 bp, D. melanogaster
cacacagagacag

SEQ ID NO: 601565 - DNA, 13 bp, D. melanogaster
cacacagagagaa

SEQ ID NO: 601566 - DNA, 13 bp, D. melanogaster
cacacagagagag

SEQ ID NO: 601567 - DNA, 13 bp, D. melanogaster
cacacagagatac

SEQ ID NO: 601568 - DNA, 13 bp, D. melanogaster
cacacagagccac

SEQ ID NO: 601569 - DNA, 14 bp, D. melanogaster
cacacagatacaca

SEQ ID NO: 601570 - DNA, 14 bp, D. melanogaster
cacacagatacaga

SEQ ID NO: 601571 - DNA, 13 bp, D. melanogaster
cacacagatacgc

SEQ ID NO: 601572 - DNA, 14 bp, D. melanogaster
cacacagatacgca

SEQ ID NO: 601573 - DNA, 13 bp, D. melanogaster
cacacagatactc

SEQ ID NO: 601574 - DNA, 13 bp, D. melanogaster
cacacagatactg

SEQ ID NO: 601575 - DNA, 13 bp, D. melanogaster
cacacagatatat

SEQ ID NO: 601576 - DNA, 13 bp, D. melanogaster
cacacagcaaacg

SEQ ID NO: 601577 - DNA, 13 bp, D. melanogaster
cacacagccgcac

SEQ ID NO: 601578 - DNA, 14 bp, D. melanogaster
cacacagccgcaca

SEQ ID NO: 601579 - DNA, 13 bp, D. melanogaster
cacacagctgcag

SEQ ID NO: 601580 - DNA, 13 bp, D. melanogaster
cacacaggacaca

SEQ ID NO: 601581 - DNA, 13 bp, D. melanogaster
cacacaggcaaac

SEQ ID NO: 601582 - DNA, 13 bp, D. melanogaster
cacacaggcacaa

SEQ ID NO: 601583 - DNA, 14 bp, D. melanogaster
cacacaggcacaca

SEQ ID NO: 601584 - DNA, 13 bp, D. melanogaster
cacacaggcacag

SEQ ID NO: 601585 - DNA, 13 bp, D. melanogaster
cacacaggcgcac

SEQ ID NO: 601586 - DNA, 13 bp, D. melanogaster
cacacagtcgcac

SEQ ID NO: 601587 - DNA, 13 bp, D. melanogaster
cacacagtgcgta

SEQ ID NO: 601588 - DNA, 13 bp, D. melanogaster
cacacagtggcac

SEQ ID NO: 601589 - DNA, 13 bp, D. melanogaster
cacacagttcatt

SEQ ID NO: 601590 - DNA, 13 bp, D. melanogaster
cacacataaaaag

SEQ ID NO: 601591 - DNA, 13 bp, D. melanogaster
cacacataaacat

SEQ ID NO: 601592 - DNA, 13 bp, D. melanogaster
cacacataaagtt

SEQ ID NO: 601593 - DNA, 14 bp, D. melanogaster
cacacatacacact

SEQ ID NO: 601594 - DNA, 14 bp, D. melanogaster
cacacatacacaga

SEQ ID NO: 601595 - DNA, 14 bp, D. melanogaster
cacacatacacatg

SEQ ID NO: 601596 - DNA, 14 bp, D. melanogaster
cacacatacacatt

SEQ ID NO: 601597 - DNA, 13 bp, D. melanogaster
cacacatacacgc

SEQ ID NO: 601598 - DNA, 13 bp, D. melanogaster
cacacatacactc

SEQ ID NO: 601599 - DNA, 14 bp, D. melanogaster
cacacatacactcg

SEQ ID NO: 601600 - DNA, 13 bp, D. melanogaster
cacacatacagat

SEQ ID NO: 601601 - DNA, 13 bp, D. melanogaster
cacacatacagcc

SEQ ID NO: 601602 - DNA, 13 bp, D. melanogaster
cacacatacataa

SEQ ID NO: 601603 - DNA, 14 bp, D. melanogaster
cacacatacataac

SEQ ID NO: 601604 - DNA, 13 bp, D. melanogaster
cacacatacatac

SEQ ID NO: 601605 - DNA, 14 bp, D. melanogaster
cacacatacataca

SEQ ID NO: 601606 - DNA, 14 bp, D. melanogaster
cacacatacatacg

SEQ ID NO: 601607 - DNA, 13 bp, D. melanogaster
cacacatacatgc

SEQ ID NO: 601608 - DNA, 13 bp, D. melanogaster
cacacatacgcac

SEQ ID NO: 601609 - DNA, 14 bp, D. melanogaster
cacacatacgcact

SEQ ID NO: 601610 - DNA, 13 bp, D. melanogaster
cacacatacgcag

SEQ ID NO: 601611 - DNA, 13 bp, D. melanogaster
cacacatactcac

SEQ ID NO: 601612 - DNA, 13 bp, D. melanogaster
cacacatagaaat

SEQ ID NO: 601613 - DNA, 14 bp, D. melanogaster
cacacatagaaatt

SEQ ID NO: 601614 - DNA, 14 bp, D. melanogaster
cacacatatacaca

SEQ ID NO: 601615 - DNA, 13 bp, D. melanogaster
cacacatatacat

SEQ ID NO: 601616 - DNA, 14 bp, D. melanogaster
cacacatatacata

SEQ ID NO: 601617 - DNA, 13 bp, D. melanogaster
cacacatatccat

SEQ ID NO: 601618 - DNA, 13 bp, D. melanogaster
cacacatatgcaa

SEQ ID NO: 601619 - DNA, 13 bp, D. melanogaster
cacacatatgcag

SEQ ID NO: 601620 - DNA, 13 bp, D. melanogaster
cacacatatgcat

SEQ ID NO: 601621 - DNA, 14 bp, D. melanogaster
cacacatatgtata

SEQ ID NO: 601622 - DNA, 13 bp, D. melanogaster
cacacatatttac

SEQ ID NO: 601623 - DNA, 13 bp, D. melanogaster
cacacatatttgc

SEQ ID NO: 601624 - DNA, 13 bp, D. melanogaster
cacacatccacat

SEQ ID NO: 601625 - DNA, 13 bp, D. melanogaster
cacacatcgcaca

SEQ ID NO: 601626 - DNA, 13 bp, D. melanogaster
cacacatgcaaac

SEQ ID NO: 601627 - DNA, 14 bp, D. melanogaster
cacacatgcaaaca

SEQ ID NO: 601628 - DNA, 13 bp, D. melanogaster
cacacatgcaaat

SEQ ID NO: 601629 - DNA, 13 bp, D. melanogaster
cacacatgcaaca

SEQ ID NO: 601630 - DNA, 13 bp, D. melanogaster
cacacatgcaagc

SEQ ID NO: 601631 - DNA, 14 bp, D. melanogaster
cacacatgcacaca

SEQ ID NO: 601632 - DNA, 14 bp, D. melanogaster
cacacatgcacacg

SEQ ID NO: 601633 - DNA, 13 bp, D. melanogaster
cacacatgcacag

SEQ ID NO: 601634 - DNA, 14 bp, D. melanogaster
cacacatgcacata

SEQ ID NO: 601635 - DNA, 13 bp, D. melanogaster
cacacatgcagag

SEQ ID NO: 601636 - DNA, 13 bp, D. melanogaster
cacacatgcagca

SEQ ID NO: 601637 - DNA, 13 bp, D. melanogaster
cacacatgcatat

SEQ ID NO: 601638 - DNA, 14 bp, D. melanogaster
cacacatgcatgca

SEQ ID NO: 601639 - DNA, 13 bp, D. melanogaster
cacacatgccaca

SEQ ID NO: 601640 - DNA, 13 bp, D. melanogaster
cacacatggacac

SEQ ID NO: 601641 - DNA, 13 bp, D. melanogaster
cacacatgtatat

SEQ ID NO: 601642 - DNA, 13 bp, D. melanogaster
cacacatgtgcgc

SEQ ID NO: 601643 - DNA, 13 bp, D. melanogaster
cacacattcacat

SEQ ID NO: 601644 - DNA, 13 bp, D. melanogaster
cacacattcgcac

SEQ ID NO: 601645 - DNA, 14 bp, D. melanogaster
cacacattcgcaca

SEQ ID NO: 601646 - DNA, 13 bp, D. melanogaster
cacacattcgcat

SEQ ID NO: 601647 - DNA, 13 bp, D. melanogaster
cacacatttaaaa

SEQ ID NO: 601648 - DNA, 13 bp, D. melanogaster
cacacatttaaat

SEQ ID NO: 601649 - DNA, 13 bp, D. melanogaster
cacacatttacat

SEQ ID NO: 601650 - DNA, 14 bp, D. melanogaster
cacacatttattta

SEQ ID NO: 601651 - DNA, 13 bp, D. melanogaster
cacacatttgttt

SEQ ID NO: 601652 - DNA, 13 bp, D. melanogaster
cacacattttaaa

SEQ ID NO: 601653 - DNA, 13 bp, D. melanogaster
cacacattttcca

SEQ ID NO: 601654 - DNA, 13 bp, D. melanogaster
cacacattttgca

SEQ ID NO: 601655 - DNA, 13 bp, D. melanogaster
cacacattttgtt

SEQ ID NO: 601656 - DNA, 13 bp, D. melanogaster
cacacatttttgt

SEQ ID NO: 601657 - DNA, 13 bp, D. melanogaster
cacaccagcgcac

SEQ ID NO: 601658 - DNA, 13 bp, D. melanogaster
cacaccatcattg

SEQ ID NO: 601659 - DNA, 13 bp, D. melanogaster
cacacccacactt

SEQ ID NO: 601660 - DNA, 13 bp, D. melanogaster
cacacccattggg

SEQ ID NO: 601661 - DNA, 13 bp, D. melanogaster
cacaccccaattg

SEQ ID NO: 601662 - DNA, 13 bp, D. melanogaster
cacacgaacgaaa

SEQ ID NO: 601663 - DNA, 13 bp, D. melanogaster
cacacgatctgcg

SEQ ID NO: 601664 - DNA, 14 bp, D. melanogaster
cacacgcacacacg

SEQ ID NO: 601665 - DNA, 14 bp, D. melanogaster
cacacgcacacact

SEQ ID NO: 601666 - DNA, 13 bp, D. melanogaster
cacacgcacacag

SEQ ID NO: 601667 - DNA, 14 bp, D. melanogaster
cacacgcacacaga

SEQ ID NO: 601668 - DNA, 14 bp, D. melanogaster
cacacgcacacagt

SEQ ID NO: 601669 - DNA, 14 bp, D. melanogaster
cacacgcacacatg

SEQ ID NO: 601670 - DNA, 14 bp, D. melanogaster
cacacgcacaccag

SEQ ID NO: 601671 - DNA, 13 bp, D. melanogaster
cacacgcacaccg

SEQ ID NO: 601672 - DNA, 13 bp, D. melanogaster
cacacgcacacct

SEQ ID NO: 601673 - DNA, 13 bp, D. melanogaster
cacacgcacacgt

SEQ ID NO: 601674 - DNA, 13 bp, D. melanogaster
cacacgcacactt

SEQ ID NO: 601675 - DNA, 13 bp, D. melanogaster
cacacgcacagac

SEQ ID NO: 601676 - DNA, 13 bp, D. melanogaster
cacacgcacatac

SEQ ID NO: 601677 - DNA, 14 bp, D. melanogaster
cacacgcacataca

SEQ ID NO: 601678 - DNA, 13 bp, D. melanogaster
cacacgcacatgc

SEQ ID NO: 601679 - DNA, 13 bp, D. melanogaster
cacacgcacgcaa

SEQ ID NO: 601680 - DNA, 13 bp, D. melanogaster
cacacgcacgcac

SEQ ID NO: 601681 - DNA, 13 bp, D. melanogaster
cacacgcagacac

SEQ ID NO: 601682 - DNA, 13 bp, D. melanogaster
cacacgccgcaag

SEQ ID NO: 601683 - DNA, 14 bp, D. melanogaster
cacacgcgcacaca

SEQ ID NO: 601684 - DNA, 14 bp, D. melanogaster
cacacgcgcgcaca

SEQ ID NO: 601685 - DNA, 13 bp, D. melanogaster
cacacgcgctcac

SEQ ID NO: 601686 - DNA, 13 bp, D. melanogaster
cacacggacacac

SEQ ID NO: 601687 - DNA, 13 bp, D. melanogaster
cacacggagaaaa

SEQ ID NO: 601688 - DNA, 14 bp, D. melanogaster
cacacggcgtatac

SEQ ID NO: 601689 - DNA, 14 bp, D. melanogaster
cacacggggcgtat

SEQ ID NO: 601690 - DNA, 14 bp, D. melanogaster
cacacgtacacaca

SEQ ID NO: 601691 - DNA, 13 bp, D. melanogaster
cacacgtacacca

SEQ ID NO: 601692 - DNA, 13 bp, D. melanogaster
cacacgtatgctc

SEQ ID NO: 601693 - DNA, 13 bp, D. melanogaster
cacacgtgtgtgc

SEQ ID NO: 601694 - DNA, 14 bp, D. melanogaster
cacacgtgtgtgtg

SEQ ID NO: 601695 - DNA, 13 bp, D. melanogaster
cacacgttacttc

SEQ ID NO: 601696 - DNA, 13 bp, D. melanogaster
cacacgttttttt

SEQ ID NO: 601697 - DNA, 14 bp, D. melanogaster
cacactcacacatg

SEQ ID NO: 601698 - DNA, 13 bp, D. melanogaster
cacactcacactc

SEQ ID NO: 601699 - DNA, 13 bp, D. melanogaster
cacactcacactt

SEQ ID NO: 601700 - DNA, 13 bp, D. melanogaster
cacactcacatac

SEQ ID NO: 601701 - DNA, 13 bp, D. melanogaster
cacactcacatgc

SEQ ID NO: 601702 - DNA, 13 bp, D. melanogaster
cacactcacattc

SEQ ID NO: 601703 - DNA, 13 bp, D. melanogaster
cacactcatgcac

SEQ ID NO: 601704 - DNA, 13 bp, D. melanogaster
cacactcgaacac

SEQ ID NO: 601705 - DNA, 13 bp, D. melanogaster
cacactcgcacaa

SEQ ID NO: 601706 - DNA, 13 bp, D. melanogaster
cacactcgcatac

SEQ ID NO: 601707 - DNA, 13 bp, D. melanogaster
cacactcgcatat

SEQ ID NO: 601708 - DNA, 13 bp, D. melanogaster
cacactcgcattc

SEQ ID NO: 601709 - DNA, 13 bp, D. melanogaster
cacactcgcccac

SEQ ID NO: 601710 - DNA, 13 bp, D. melanogaster
cacactcgctcac

SEQ ID NO: 601711 - DNA, 13 bp, D. melanogaster
cacactcgtacac

SEQ ID NO: 601712 - DNA, 13 bp, D. melanogaster
cacactctctctc

SEQ ID NO: 601713 - DNA, 14 bp, D. melanogaster
cacactctctctct

SEQ ID NO: 601714 - DNA, 13 bp, D. melanogaster
cacactcttcgac

SEQ ID NO: 601715 - DNA, 14 bp, D. melanogaster
cacactgaaagaaa

SEQ ID NO: 601716 - DNA, 13 bp, D. melanogaster
cacactgagaaaa

SEQ ID NO: 601717 - DNA, 14 bp, D. melanogaster
cacactgagaaaaa

SEQ ID NO: 601718 - DNA, 14 bp, D. melanogaster
cacactgagagaaa

SEQ ID NO: 601719 - DNA, 13 bp, D. melanogaster
cacactggaaaaa

SEQ ID NO: 601720 - DNA, 13 bp, D. melanogaster
cacactggaagaa

SEQ ID NO: 601721 - DNA, 13 bp, D. melanogaster
cacactggcaaac

SEQ ID NO: 601722 - DNA, 13 bp, D. melanogaster
cacactggcacac

SEQ ID NO: 601723 - DNA, 14 bp, D. melanogaster
cacactggcacaca

SEQ ID NO: 601724 - DNA, 13 bp, D. melanogaster
cacactggcgcac

SEQ ID NO: 601725 - DNA, 17 bp, D. melanogaster
cacactgtgaaataagt

SEQ ID NO: 601726 - DNA, 13 bp, D. melanogaster
cacacttacacac

SEQ ID NO: 601727 - DNA, 14 bp, D. melanogaster
cacacttacacaca

SEQ ID NO: 601728 - DNA, 13 bp, D. melanogaster
cacacttctcagc

SEQ ID NO: 601729 - DNA, 13 bp, D. melanogaster
cacacttgatctg

SEQ ID NO: 601730 - DNA, 13 bp, D. melanogaster
cacactttcactt

SEQ ID NO: 601731 - DNA, 13 bp, D. melanogaster
cacacttttaaaa

SEQ ID NO: 601732 - DNA, 13 bp, D. melanogaster
cacacttttaagc

SEQ ID NO: 601733 - DNA, 13 bp, D. melanogaster
cacacttttaatt

SEQ ID NO: 601734 - DNA, 13 bp, D. melanogaster
cacacttttattt

SEQ ID NO: 601735 - DNA, 13 bp, D. melanogaster
cacacttttcaca

SEQ ID NO: 601736 - DNA, 13 bp, D. melanogaster
cacacttttgaga

SEQ ID NO: 601737 - DNA, 14 bp, D. melanogaster
cacacttttgagac

SEQ ID NO: 601738 - DNA, 13 bp, D. melanogaster
cacacttttgcaa

SEQ ID NO: 601739 - DNA, 13 bp, D. melanogaster
cacacttttggcc

SEQ ID NO: 601740 - DNA, 13 bp, D. melanogaster
cacagaaaaagtt

SEQ ID NO: 601741 - DNA, 13 bp, D. melanogaster
cacagaaaacatg

SEQ ID NO: 601742 - DNA, 13 bp, D. melanogaster
cacagaaaccgaa

SEQ ID NO: 601743 - DNA, 13 bp, D. melanogaster
cacagaaatcggc

SEQ ID NO: 601744 - DNA, 13 bp, D. melanogaster
cacagaacttgaa

SEQ ID NO: 601745 - DNA, 13 bp, D. melanogaster
cacagaagcagca

SEQ ID NO: 601746 - DNA, 13 bp, D. melanogaster
cacagacaaaata

SEQ ID NO: 601747 - DNA, 13 bp, D. melanogaster
cacagacaaagga

SEQ ID NO: 601748 - DNA, 13 bp, D. melanogaster
cacagacacaaag

SEQ ID NO: 601749 - DNA, 14 bp, D. melanogaster
cacagacacacgca

SEQ ID NO: 601750 - DNA, 13 bp, D. melanogaster
cacagacacagac

SEQ ID NO: 601751 - DNA, 13 bp, D. melanogaster
cacagacactcac

SEQ ID NO: 601752 - DNA, 13 bp, D. melanogaster
cacagaccattaa

SEQ ID NO: 601753 - DNA, 14 bp, D. melanogaster
cacagacgcacaca

SEQ ID NO: 601754 - DNA, 13 bp, D. melanogaster
cacagagaaaata

SEQ ID NO: 601755 - DNA, 13 bp, D. melanogaster
cacagagaaagag

SEQ ID NO: 601756 - DNA, 13 bp, D. melanogaster
cacagagaaataa

SEQ ID NO: 601757 - DNA, 14 bp, D. melanogaster
cacagagacacaca

SEQ ID NO: 601758 - DNA, 13 bp, D. melanogaster
cacagagacttgg

SEQ ID NO: 601759 - DNA, 13 bp, D. melanogaster
cacagagagaaat

SEQ ID NO: 601760 - DNA, 13 bp, D. melanogaster
cacagagtcagag

SEQ ID NO: 601761 - DNA, 13 bp, D. melanogaster
cacagatacaaat

SEQ ID NO: 601762 - DNA, 13 bp, D. melanogaster
cacagatacaatt

SEQ ID NO: 601763 - DNA, 13 bp, D. melanogaster
cacagatacacac

SEQ ID NO: 601764 - DNA, 14 bp, D. melanogaster
cacagatacacaca

SEQ ID NO: 601765 - DNA, 13 bp, D. melanogaster
cacagatacatac

SEQ ID NO: 601766 - DNA, 13 bp, D. melanogaster
cacagatactcga

SEQ ID NO: 601767 - DNA, 13 bp, D. melanogaster
cacagatatatat

SEQ ID NO: 601768 - DNA, 13 bp, D. melanogaster
cacagatgcagat

SEQ ID NO: 601769 - DNA, 13 bp, D. melanogaster
cacagatttcaga

SEQ ID NO: 601770 - DNA, 13 bp, D. melanogaster
cacagcaaaaata

SEQ ID NO: 601771 - DNA, 13 bp, D. melanogaster
cacagcaaaagca

SEQ ID NO: 601772 - DNA, 13 bp, D. melanogaster
cacagcaaacata

SEQ ID NO: 601773 - DNA, 13 bp, D. melanogaster
cacagcaaataaa

SEQ ID NO: 601774 - DNA, 13 bp, D. melanogaster
cacagcaacaata

SEQ ID NO: 601775 - DNA, 13 bp, D. melanogaster
cacagcaacactt

SEQ ID NO: 601776 - DNA, 14 bp, D. melanogaster
cacagcacagcaca

SEQ ID NO: 601777 - DNA, 14 bp, D. melanogaster
cacagcagcaacat

SEQ ID NO: 601778 - DNA, 13 bp, D. melanogaster
cacagcagcagaa

SEQ ID NO: 601779 - DNA, 13 bp, D. melanogaster
cacagcagcagcg

SEQ ID NO: 601780 - DNA, 13 bp, D. melanogaster
cacagcatggact

SEQ ID NO: 601781 - DNA, 13 bp, D. melanogaster
cacagcatgttgg

SEQ ID NO: 601782 - DNA, 14 bp, D. melanogaster
cacagccacagcca

SEQ ID NO: 601783 - DNA, 14 bp, D. melanogaster
cacagccacatcca

SEQ ID NO: 601784 - DNA, 13 bp, D. melanogaster
cacagccattttt

SEQ ID NO: 601785 - DNA, 13 bp, D. melanogaster
cacagcccacagc

SEQ ID NO: 601786 - DNA, 13 bp, D. melanogaster
cacagcgaaaaac

SEQ ID NO: 601787 - DNA, 13 bp, D. melanogaster
cacagcgagaaaa

SEQ ID NO: 601788 - DNA, 13 bp, D. melanogaster
cacagcgagaaat

SEQ ID NO: 601789 - DNA, 13 bp, D. melanogaster
cacagcgataatt

SEQ ID NO: 601790 - DNA, 14 bp, D. melanogaster
cacagctcggagcc

SEQ ID NO: 601791 - DNA, 13 bp, D. melanogaster
cacagctgcagtt

SEQ ID NO: 601792 - DNA, 13 bp, D. melanogaster
cacagctgctgct

SEQ ID NO: 601793 - DNA, 13 bp, D. melanogaster
cacagctggtgga

SEQ ID NO: 601794 - DNA, 13 bp, D. melanogaster
cacagctgtatat

SEQ ID NO: 601795 - DNA, 13 bp, D. melanogaster
cacaggaagtaaa

SEQ ID NO: 601796 - DNA, 13 bp, D. melanogaster
cacaggacgaagg

SEQ ID NO: 601797 - DNA, 13 bp, D. melanogaster
cacaggagcaaca

SEQ ID NO: 601798 - DNA, 14 bp, D. melanogaster
cacaggatcaacaa

SEQ ID NO: 601799 - DNA, 13 bp, D. melanogaster
cacaggcacacaa

SEQ ID NO: 601800 - DNA, 13 bp, D. melanogaster
cacaggcacacgc

SEQ ID NO: 601801 - DNA, 13 bp, D. melanogaster
cacaggcacaggc

SEQ ID NO: 601802 - DNA, 14 bp, D. melanogaster
cacaggcacaggca

SEQ ID NO: 601803 - DNA, 13 bp, D. melanogaster
cacaggcgcacac

SEQ ID NO: 601804 - DNA, 13 bp, D. melanogaster
cacagggaaaaat

SEQ ID NO: 601805 - DNA, 13 bp, D. melanogaster
cacaggtgcagaa

SEQ ID NO: 601806 - DNA, 13 bp, D. melanogaster
cacagtaagaaat

SEQ ID NO: 601807 - DNA, 14 bp, D. melanogaster
cacagtagactggc

SEQ ID NO: 601808 - DNA, 13 bp, D. melanogaster
cacagtcaaccgc

SEQ ID NO: 601809 - DNA, 13 bp, D. melanogaster
cacagtcaacgat

SEQ ID NO: 601810 - DNA, 13 bp, D. melanogaster
cacagtgaaatgt

SEQ ID NO: 601811 - DNA, 13 bp, D. melanogaster
cacagtgccagaa

SEQ ID NO: 601812 - DNA, 13 bp, D. melanogaster
cacagtggaaaaa

SEQ ID NO: 601813 - DNA, 13 bp, D. melanogaster
cacagtgggccaa

SEQ ID NO: 601814 - DNA, 13 bp, D. melanogaster
cacagtgggtcaa

SEQ ID NO: 601815 - DNA, 13 bp, D. melanogaster
cacagtgtgtgtg

SEQ ID NO: 601816 - DNA, 13 bp, D. melanogaster
cacagttgcagtt

SEQ ID NO: 601817 - DNA, 13 bp, D. melanogaster
cacataaaactta

SEQ ID NO: 601818 - DNA, 13 bp, D. melanogaster
cacataaaagtgt

SEQ ID NO: 601819 - DNA, 13 bp, D. melanogaster
cacataaacatat

SEQ ID NO: 601820 - DNA, 13 bp, D. melanogaster
cacataaagaaat

SEQ ID NO: 601821 - DNA, 14 bp, D. melanogaster
cacataaagtaatt

SEQ ID NO: 601822 - DNA, 13 bp, D. melanogaster
cacataacaagat

SEQ ID NO: 601823 - DNA, 13 bp, D. melanogaster
cacataagcacac

SEQ ID NO: 601824 - DNA, 13 bp, D. melanogaster
cacataataaatt

SEQ ID NO: 601825 - DNA, 13 bp, D. melanogaster
cacataataatat

SEQ ID NO: 601826 - DNA, 13 bp, D. melanogaster
cacataatttaat

SEQ ID NO: 601827 - DNA, 13 bp, D. melanogaster
cacatacaaacat

SEQ ID NO: 601828 - DNA, 13 bp, D. melanogaster
cacatacacaagc

SEQ ID NO: 601829 - DNA, 14 bp, D. melanogaster
cacatacacacact

SEQ ID NO: 601830 - DNA, 13 bp, D. melanogaster
cacatacacacag

SEQ ID NO: 601831 - DNA, 13 bp, D. melanogaster
cacatacacacat

SEQ ID NO: 601832 - DNA, 14 bp, D. melanogaster
cacatacacacatg

SEQ ID NO: 601833 - DNA, 14 bp, D. melanogaster
cacatacacacatt

SEQ ID NO: 601834 - DNA, 14 bp, D. melanogaster
cacatacacataca

SEQ ID NO: 601835 - DNA, 13 bp, D. melanogaster
cacatacacatat

SEQ ID NO: 601836 - DNA, 13 bp, D. melanogaster
cacatacacatcc

SEQ ID NO: 601837 - DNA, 13 bp, D. melanogaster
cacatacacatgc

SEQ ID NO: 601838 - DNA, 15 bp, D. melanogaster
cacatacacgcacac

SEQ ID NO: 601839 - DNA, 13 bp, D. melanogaster
cacatacactcac

SEQ ID NO: 601840 - DNA, 14 bp, D. melanogaster
cacatacataaata

SEQ ID NO: 601841 - DNA, 14 bp, D. melanogaster
cacatacatacaac

SEQ ID NO: 601842 - DNA, 13 bp, D. melanogaster
cacatacatacgt

SEQ ID NO: 601843 - DNA, 14 bp, D. melanogaster
cacatacatataca

SEQ ID NO: 601844 - DNA, 13 bp, D. melanogaster
cacatacatatat

SEQ ID NO: 601845 - DNA, 13 bp, D. melanogaster
cacatacatatgt

SEQ ID NO: 601846 - DNA, 14 bp, D. melanogaster
cacatacatatgta

SEQ ID NO: 601847 - DNA, 13 bp, D. melanogaster
cacatacatgcac

SEQ ID NO: 601848 - DNA, 13 bp, D. melanogaster
cacatacatgcat

SEQ ID NO: 601849 - DNA, 14 bp, D. melanogaster
cacatacatgcata

SEQ ID NO: 601850 - DNA, 13 bp, D. melanogaster
cacatacatgtat

SEQ ID NO: 601851 - DNA, 13 bp, D. melanogaster
cacatacatttgt

SEQ ID NO: 601852 - DNA, 13 bp, D. melanogaster
cacataccacata

SEQ ID NO: 601853 - DNA, 13 bp, D. melanogaster
cacatacgcacgc

SEQ ID NO: 601854 - DNA, 13 bp, D. melanogaster
cacatacgcactg

SEQ ID NO: 601855 - DNA, 13 bp, D. melanogaster
cacatacgcagtg

SEQ ID NO: 601856 - DNA, 13 bp, D. melanogaster
cacatacgccatg

SEQ ID NO: 601857 - DNA, 13 bp, D. melanogaster
cacatacgccccg

SEQ ID NO: 601858 - DNA, 14 bp, D. melanogaster
cacatacgccccgt

SEQ ID NO: 601859 - DNA, 13 bp, D. melanogaster
cacatacggactt

SEQ ID NO: 601860 - DNA, 13 bp, D. melanogaster
cacatactacatc

SEQ ID NO: 601861 - DNA, 14 bp, D. melanogaster
cacatactcacaca

SEQ ID NO: 601862 - DNA, 13 bp, D. melanogaster
cacatagaaattg

SEQ ID NO: 601863 - DNA, 13 bp, D. melanogaster
cacatagacacat

SEQ ID NO: 601864 - DNA, 13 bp, D. melanogaster
cacatataaattt

SEQ ID NO: 601865 - DNA, 13 bp, D. melanogaster
cacatatacatac

SEQ ID NO: 601866 - DNA, 14 bp, D. melanogaster
cacatatacataca

SEQ ID NO: 601867 - DNA, 14 bp, D. melanogaster
cacatatacatata

SEQ ID NO: 601868 - DNA, 14 bp, D. melanogaster
cacatatactcgta

SEQ ID NO: 601869 - DNA, 14 bp, D. melanogaster
cacatatacttaca

SEQ ID NO: 601870 - DNA, 13 bp, D. melanogaster
cacatatataaat

SEQ ID NO: 601871 - DNA, 13 bp, D. melanogaster
cacatatataagt

SEQ ID NO: 601872 - DNA, 14 bp, D. melanogaster
cacatatatacaca

SEQ ID NO: 601873 - DNA, 13 bp, D. melanogaster
cacatatatatgc

SEQ ID NO: 601874 - DNA, 13 bp, D. melanogaster
cacatatatatgt

SEQ ID NO: 601875 - DNA, 13 bp, D. melanogaster
cacatatatgtat

SEQ ID NO: 601876 - DNA, 14 bp, D. melanogaster
cacatatatgtatg

SEQ ID NO: 601877 - DNA, 13 bp, D. melanogaster
cacatatattgta

SEQ ID NO: 601878 - DNA, 13 bp, D. melanogaster
cacatatatttta

SEQ ID NO: 601879 - DNA, 14 bp, D. melanogaster
cacatatatttttg

SEQ ID NO: 601880 - DNA, 13 bp, D. melanogaster
cacatatgaatat

SEQ ID NO: 601881 - DNA, 13 bp, D. melanogaster
cacatatgcatta

SEQ ID NO: 601882 - DNA, 14 bp, D. melanogaster
cacatatgcattac

SEQ ID NO: 601883 - DNA, 13 bp, D. melanogaster
cacatatgtacat

SEQ ID NO: 601884 - DNA, 14 bp, D. melanogaster
cacatatgtacata

SEQ ID NO: 601885 - DNA, 15 bp, D. melanogaster
cacatatgtacatat

SEQ ID NO: 601886 - DNA, 14 bp, D. melanogaster
cacatatgtacgta

SEQ ID NO: 601887 - DNA, 13 bp, D. melanogaster
cacatatgtatat

SEQ ID NO: 601888 - DNA, 13 bp, D. melanogaster
cacatatgtatgt

SEQ ID NO: 601889 - DNA, 14 bp, D. melanogaster
cacatatgtatgta

SEQ ID NO: 601890 - DNA, 13 bp, D. melanogaster
cacatattaaatt

SEQ ID NO: 601891 - DNA, 13 bp, D. melanogaster
cacatattatatg

SEQ ID NO: 601892 - DNA, 13 bp, D. melanogaster
cacatatttaact

SEQ ID NO: 601893 - DNA, 13 bp, D. melanogaster
cacatatttcaat

SEQ ID NO: 601894 - DNA, 13 bp, D. melanogaster
cacatatttcaca

SEQ ID NO: 601895 - DNA, 13 bp, D. melanogaster
cacatatttgtat

SEQ ID NO: 601896 - DNA, 13 bp, D. melanogaster
cacatattttatg

SEQ ID NO: 601897 - DNA, 14 bp, D. melanogaster
cacatattttgtaa

SEQ ID NO: 601898 - DNA, 13 bp, D. melanogaster
cacatcaaatcaa

SEQ ID NO: 601899 - DNA, 13 bp, D. melanogaster
cacatcaatgtca

SEQ ID NO: 601900 - DNA, 13 bp, D. melanogaster
cacatcacatcac

SEQ ID NO: 601901 - DNA, 14 bp, D. melanogaster
cacatcacatcaca

SEQ ID NO: 601902 - DNA, 13 bp, D. melanogaster
cacatcatatctt

SEQ ID NO: 601903 - DNA, 13 bp, D. melanogaster
cacatcatcatca

SEQ ID NO: 601904 - DNA, 13 bp, D. melanogaster
cacatcatctaca

SEQ ID NO: 601905 - DNA, 14 bp, D. melanogaster
cacatccacagcca

SEQ ID NO: 601906 - DNA, 13 bp, D. melanogaster
cacatccacatcc

SEQ ID NO: 601907 - DNA, 14 bp, D. melanogaster
cacatccacatcct

SEQ ID NO: 601908 - DNA, 13 bp, D. melanogaster
cacatccacatgc

SEQ ID NO: 601909 - DNA, 13 bp, D. melanogaster
cacatccaccagc

SEQ ID NO: 601910 - DNA, 13 bp, D. melanogaster
cacatccatatcc

SEQ ID NO: 601911 - DNA, 14 bp, D. melanogaster
cacatccatatcca

SEQ ID NO: 601912 - DNA, 13 bp, D. melanogaster
cacatccatttcc

SEQ ID NO: 601913 - DNA, 13 bp, D. melanogaster
cacatcccacatc

SEQ ID NO: 601914 - DNA, 13 bp, D. melanogaster
cacatccggtgtc

SEQ ID NO: 601915 - DNA, 14 bp, D. melanogaster
cacatcctcatcct

SEQ ID NO: 601916 - DNA, 13 bp, D. melanogaster
cacatcctgctca

SEQ ID NO: 601917 - DNA, 16 bp, D. melanogaster
cacatcctgctcaccg

SEQ ID NO: 601918 - DNA, 13 bp, D. melanogaster
cacatcctgctgc

SEQ ID NO: 601919 - DNA, 13 bp, D. melanogaster
cacatcgcacatc

SEQ ID NO: 601920 - DNA, 13 bp, D. melanogaster
cacatctacatct

SEQ ID NO: 601921 - DNA, 13 bp, D. melanogaster
cacatcttctggt

SEQ ID NO: 601922 - DNA, 13 bp, D. melanogaster
cacatcttcttcg

SEQ ID NO: 601923 - DNA, 13 bp, D. melanogaster
cacatgaagtgca

SEQ ID NO: 601924 - DNA, 13 bp, D. melanogaster
cacatgaatttca

SEQ ID NO: 601925 - DNA, 14 bp, D. melanogaster
cacatgaatttcat

SEQ ID NO: 601926 - DNA, 13 bp, D. melanogaster
cacatgacgtatg

SEQ ID NO: 601927 - DNA, 13 bp, D. melanogaster
cacatgcaaaaat

SEQ ID NO: 601928 - DNA, 13 bp, D. melanogaster
cacatgcaacaca

SEQ ID NO: 601929 - DNA, 13 bp, D. melanogaster
cacatgcacaaca

SEQ ID NO: 601930 - DNA, 14 bp, D. melanogaster
cacatgcacacatg

SEQ ID NO: 601931 - DNA, 13 bp, D. melanogaster
cacatgcacacgc

SEQ ID NO: 601932 - DNA, 14 bp, D. melanogaster
cacatgcacacgca

SEQ ID NO: 601933 - DNA, 14 bp, D. melanogaster
cacatgcacatgca

SEQ ID NO: 601934 - DNA, 14 bp, D. melanogaster
cacatgcacttaca

SEQ ID NO: 601935 - DNA, 13 bp, D. melanogaster
cacatgcatacac

SEQ ID NO: 601936 - DNA, 13 bp, D. melanogaster
cacatgcattttt

SEQ ID NO: 601937 - DNA, 13 bp, D. melanogaster
cacatgccaaaat

SEQ ID NO: 601938 - DNA, 13 bp, D. melanogaster
cacatgccacaca

SEQ ID NO: 601939 - DNA, 13 bp, D. melanogaster
cacatgccacatg

SEQ ID NO: 601940 - DNA, 13 bp, D. melanogaster
cacatggaaaaat

SEQ ID NO: 601941 - DNA, 13 bp, D. melanogaster
cacatggacatgg

SEQ ID NO: 601942 - DNA, 13 bp, D. melanogaster
cacatggccacat

SEQ ID NO: 601943 - DNA, 13 bp, D. melanogaster
cacatgtatctgt

SEQ ID NO: 601944 - DNA, 13 bp, D. melanogaster
cacatgtatgagc

SEQ ID NO: 601945 - DNA, 13 bp, D. melanogaster
cacatgtatttat

SEQ ID NO: 601946 - DNA, 13 bp, D. melanogaster
cacatgtgtgtgc

SEQ ID NO: 601947 - DNA, 13 bp, D. melanogaster
cacatgtgtgtgt

SEQ ID NO: 601948 - DNA, 14 bp, D. melanogaster
cacatgtgtgtgtg

SEQ ID NO: 601949 - DNA, 13 bp, D. melanogaster
cacatgttgctgc

SEQ ID NO: 601950 - DNA, 13 bp, D. melanogaster
cacattaaatatt

SEQ ID NO: 601951 - DNA, 13 bp, D. melanogaster
cacattaaattta

SEQ ID NO: 601952 - DNA, 13 bp, D. melanogaster
cacattaattaat

SEQ ID NO: 601953 - DNA, 13 bp, D. melanogaster
cacattaattttc

SEQ ID NO: 601954 - DNA, 13 bp, D. melanogaster
cacattacaaaac

SEQ ID NO: 601955 - DNA, 14 bp, D. melanogaster
cacattacaaaacc

SEQ ID NO: 601956 - DNA, 13 bp, D. melanogaster
cacattacacaca

SEQ ID NO: 601957 - DNA, 13 bp, D. melanogaster
cacattattttaa

SEQ ID NO: 601958 - DNA, 14 bp, D. melanogaster
cacattattttaat

SEQ ID NO: 601959 - DNA, 13 bp, D. melanogaster
cacattcaaatgc

SEQ ID NO: 601960 - DNA, 13 bp, D. melanogaster
cacattcacatcc

SEQ ID NO: 601961 - DNA, 14 bp, D. melanogaster
cacattcacatcca

SEQ ID NO: 601962 - DNA, 13 bp, D. melanogaster
cacattcacattt

SEQ ID NO: 601963 - DNA, 14 bp, D. melanogaster
cacattcatattca

SEQ ID NO: 601964 - DNA, 13 bp, D. melanogaster
cacattcatattt

SEQ ID NO: 601965 - DNA, 13 bp, D. melanogaster
cacattcatttgc

SEQ ID NO: 601966 - DNA, 13 bp, D. melanogaster
cacattccacatt

SEQ ID NO: 601967 - DNA, 13 bp, D. melanogaster
cacattccagttc

SEQ ID NO: 601968 - DNA, 13 bp, D. melanogaster
cacattcccattc

SEQ ID NO: 601969 - DNA, 13 bp, D. melanogaster
cacattctgcaaa

SEQ ID NO: 601970 - DNA, 15 bp, D. melanogaster
cacattctgcagttc

SEQ ID NO: 601971 - DNA, 14 bp, D. melanogaster
cacattgaactaca

SEQ ID NO: 601972 - DNA, 13 bp, D. melanogaster
cacattgccaatc

SEQ ID NO: 601973 - DNA, 13 bp, D. melanogaster
cacattgccttcg

SEQ ID NO: 601974 - DNA, 15 bp, D. melanogaster
cacattgcgtatacg

SEQ ID NO: 601975 - DNA, 13 bp, D. melanogaster
cacattgcgtatg

SEQ ID NO: 601976 - DNA, 13 bp, D. melanogaster
cacattgtggccc

SEQ ID NO: 601977 - DNA, 13 bp, D. melanogaster
cacatttaaaaat

SEQ ID NO: 601978 - DNA, 13 bp, D. melanogaster
cacatttaattac

SEQ ID NO: 601979 - DNA, 13 bp, D. melanogaster
cacatttaattat

SEQ ID NO: 601980 - DNA, 13 bp, D. melanogaster
cacatttaattgt

SEQ ID NO: 601981 - DNA, 13 bp, D. melanogaster
cacatttacacag

SEQ ID NO: 601982 - DNA, 13 bp, D. melanogaster
cacatttacattt

SEQ ID NO: 601983 - DNA, 13 bp, D. melanogaster
cacatttataatt

SEQ ID NO: 601984 - DNA, 13 bp, D. melanogaster
cacatttatatat

SEQ ID NO: 601985 - DNA, 13 bp, D. melanogaster
cacatttatattt

SEQ ID NO: 601986 - DNA, 14 bp, D. melanogaster
cacatttatattta

SEQ ID NO: 601987 - DNA, 13 bp, D. melanogaster
cacatttatcaaa

SEQ ID NO: 601988 - DNA, 13 bp, D. melanogaster
cacatttatttaa

SEQ ID NO: 601989 - DNA, 13 bp, D. melanogaster
cacatttcaaaat

SEQ ID NO: 601990 - DNA, 13 bp, D. melanogaster
cacatttcaattt

SEQ ID NO: 601991 - DNA, 13 bp, D. melanogaster
cacatttcattgc

SEQ ID NO: 601992 - DNA, 13 bp, D. melanogaster
cacatttcccaca

SEQ ID NO: 601993 - DNA, 13 bp, D. melanogaster
cacatttcccatt

SEQ ID NO: 601994 - DNA, 13 bp, D. melanogaster
cacatttccgtat

SEQ ID NO: 601995 - DNA, 13 bp, D. melanogaster
cacatttctggct

SEQ ID NO: 601996 - DNA, 13 bp, D. melanogaster
cacatttctttca

SEQ ID NO: 601997 - DNA, 13 bp, D. melanogaster
cacatttgcaacg

SEQ ID NO: 601998 - DNA, 13 bp, D. melanogaster
cacatttgcactt

SEQ ID NO: 601999 - DNA, 13 bp, D. melanogaster
cacatttgcataa

SEQ ID NO: 602000 - DNA, 13 bp, D. melanogaster
cacatttgcatat

SEQ ID NO: 602001 - DNA, 13 bp, D. melanogaster
cacatttgccaaa

SEQ ID NO: 602002 - DNA, 13 bp, D. melanogaster
cacatttgccaca

SEQ ID NO: 602003 - DNA, 13 bp, D. melanogaster
cacatttgccgac

SEQ ID NO: 602004 - DNA, 13 bp, D. melanogaster
cacatttgtatat

SEQ ID NO: 602005 - DNA, 13 bp, D. melanogaster
cacatttgtcaag

SEQ ID NO: 602006 - DNA, 13 bp, D. melanogaster
cacatttgtttgt

SEQ ID NO: 602007 - DNA, 13 bp, D. melanogaster
cacatttgttttt

SEQ ID NO: 602008 - DNA, 13 bp, D. melanogaster
cacattttattgg

SEQ ID NO: 602009 - DNA, 13 bp, D. melanogaster
cacattttcaaat

SEQ ID NO: 602010 - DNA, 13 bp, D. melanogaster
cacattttcactt

SEQ ID NO: 602011 - DNA, 13 bp, D. melanogaster
cacattttcatat

SEQ ID NO: 602012 - DNA, 14 bp, D. melanogaster
cacattttccaagc

SEQ ID NO: 602013 - DNA, 13 bp, D. melanogaster
cacattttccaca

SEQ ID NO: 602014 - DNA, 13 bp, D. melanogaster
cacattttccacc

SEQ ID NO: 602015 - DNA, 13 bp, D. melanogaster
cacattttccact

SEQ ID NO: 602016 - DNA, 13 bp, D. melanogaster
cacattttccagc

SEQ ID NO: 602017 - DNA, 13 bp, D. melanogaster
cacattttccgcc

SEQ ID NO: 602018 - DNA, 13 bp, D. melanogaster
cacattttcggac

SEQ ID NO: 602019 - DNA, 13 bp, D. melanogaster
cacattttctgca

SEQ ID NO: 602020 - DNA, 13 bp, D. melanogaster
cacattttgcata

SEQ ID NO: 602021 - DNA, 14 bp, D. melanogaster
cacattttggccaa

SEQ ID NO: 602022 - DNA, 13 bp, D. melanogaster
cacattttgtttg

SEQ ID NO: 602023 - DNA, 14 bp, D. melanogaster
cacattttgttttc

SEQ ID NO: 602024 - DNA, 13 bp, D. melanogaster
cacatttttaatt

SEQ ID NO: 602025 - DNA, 13 bp, D. melanogaster
cacatttttcact

SEQ ID NO: 602026 - DNA, 13 bp, D. melanogaster
cacatttttggca

SEQ ID NO: 602027 - DNA, 13 bp, D. melanogaster
cacatttttggga

SEQ ID NO: 602028 - DNA, 13 bp, D. melanogaster
cacatttttgtat

SEQ ID NO: 602029 - DNA, 13 bp, D. melanogaster
cacattttttgat

SEQ ID NO: 602030 - DNA, 13 bp, D. melanogaster
cacattttttgtt

SEQ ID NO: 602031 - DNA, 13 bp, D. melanogaster
cacatttttttaa

SEQ ID NO: 602032 - DNA, 13 bp, D. melanogaster
cacatttttttcc

SEQ ID NO: 602033 - DNA, 13 bp, D. melanogaster
cacatttttttcg

SEQ ID NO: 602034 - DNA, 14 bp, D. melanogaster
caccaaaaactacg

SEQ ID NO: 602035 - DNA, 13 bp, D. melanogaster
caccaaaaatatt

SEQ ID NO: 602036 - DNA, 13 bp, D. melanogaster
caccaaaatgcct

SEQ ID NO: 602037 - DNA, 13 bp, D. melanogaster
caccaaagaaagt

SEQ ID NO: 602038 - DNA, 14 bp, D. melanogaster
caccaaagaaggtg

SEQ ID NO: 602039 - DNA, 13 bp, D. melanogaster
caccaaagccata

SEQ ID NO: 602040 - DNA, 13 bp, D. melanogaster
caccaaattttta

SEQ ID NO: 602041 - DNA, 13 bp, D. melanogaster
caccaactcccag

SEQ ID NO: 602042 - DNA, 13 bp, D. melanogaster
caccaacttaaag

SEQ ID NO: 602043 - DNA, 14 bp, D. melanogaster
caccaagatattct

SEQ ID NO: 602044 - DNA, 13 bp, D. melanogaster
caccaagcgaaca

SEQ ID NO: 602045 - DNA, 13 bp, D. melanogaster
caccaaggacaac

SEQ ID NO: 602046 - DNA, 13 bp, D. melanogaster
caccaagtgaaca

SEQ ID NO: 602047 - DNA, 13 bp, D. melanogaster
caccaataccaat

SEQ ID NO: 602048 - DNA, 13 bp, D. melanogaster
caccaatcaaagc

SEQ ID NO: 602049 - DNA, 13 bp, D. melanogaster
caccaattgagaa

SEQ ID NO: 602050 - DNA, 13 bp, D. melanogaster
caccaccactatt

SEQ ID NO: 602051 - DNA, 13 bp, D. melanogaster
caccaccagacag

SEQ ID NO: 602052 - DNA, 13 bp, D. melanogaster
caccaccagcaat

SEQ ID NO: 602053 - DNA, 14 bp, D. melanogaster
caccaccagcaata

SEQ ID NO: 602054 - DNA, 13 bp, D. melanogaster
caccacccacatt

SEQ ID NO: 602055 - DNA, 14 bp, D. melanogaster
caccacccacattt

SEQ ID NO: 602056 - DNA, 13 bp, D. melanogaster
caccacccactcg

SEQ ID NO: 602057 - DNA, 13 bp, D. melanogaster
caccacccactgg

SEQ ID NO: 602058 - DNA, 13 bp, D. melanogaster
caccacccacttt

SEQ ID NO: 602059 - DNA, 14 bp, D. melanogaster
caccacccactttc

SEQ ID NO: 602060 - DNA, 14 bp, D. melanogaster
caccacccactttt

SEQ ID NO: 602061 - DNA, 13 bp, D. melanogaster
caccacccatcga

SEQ ID NO: 602062 - DNA, 13 bp, D. melanogaster
caccacccatcgc

SEQ ID NO: 602063 - DNA, 14 bp, D. melanogaster
caccaccctgcaca

SEQ ID NO: 602064 - DNA, 13 bp, D. melanogaster
caccactaaccat

SEQ ID NO: 602065 - DNA, 13 bp, D. melanogaster
caccactattttt

SEQ ID NO: 602066 - DNA, 14 bp, D. melanogaster
caccactgcaccac

SEQ ID NO: 602067 - DNA, 13 bp, D. melanogaster
caccacttaaaca

SEQ ID NO: 602068 - DNA, 13 bp, D. melanogaster
caccacttaacgt

SEQ ID NO: 602069 - DNA, 13 bp, D. melanogaster
caccagaatcaag

SEQ ID NO: 602070 - DNA, 13 bp, D. melanogaster
caccagagggtca

SEQ ID NO: 602071 - DNA, 13 bp, D. melanogaster
caccagcaataaa

SEQ ID NO: 602072 - DNA, 14 bp, D. melanogaster
caccagcaccacga

SEQ ID NO: 602073 - DNA, 14 bp, D. melanogaster
caccagcaccagca

SEQ ID NO: 602074 - DNA, 13 bp, D. melanogaster
caccagcaccatc

SEQ ID NO: 602075 - DNA, 14 bp, D. melanogaster
caccagcagcaaca

SEQ ID NO: 602076 - DNA, 13 bp, D. melanogaster
caccagcagtttc

SEQ ID NO: 602077 - DNA, 13 bp, D. melanogaster
caccagcattaac

SEQ ID NO: 602078 - DNA, 13 bp, D. melanogaster
caccagccaccag

SEQ ID NO: 602079 - DNA, 14 bp, D. melanogaster
caccagctgccaac

SEQ ID NO: 602080 - DNA, 13 bp, D. melanogaster
caccagtcgattt

SEQ ID NO: 602081 - DNA, 14 bp, D. melanogaster
caccatacaccata

SEQ ID NO: 602082 - DNA, 14 bp, D. melanogaster
caccatatatatat

SEQ ID NO: 602083 - DNA, 14 bp, D. melanogaster
caccatatttgaaa

SEQ ID NO: 602084 - DNA, 13 bp, D. melanogaster
caccatcaccatc

SEQ ID NO: 602085 - DNA, 14 bp, D. melanogaster
caccatcaccatca

SEQ ID NO: 602086 - DNA, 13 bp, D. melanogaster
caccatcaccatt

SEQ ID NO: 602087 - DNA, 13 bp, D. melanogaster
caccatcagccct

SEQ ID NO: 602088 - DNA, 13 bp, D. melanogaster
caccatcatcaaa

SEQ ID NO: 602089 - DNA, 13 bp, D. melanogaster
caccatcatcatt

SEQ ID NO: 602090 - DNA, 14 bp, D. melanogaster
caccatcattgaca

SEQ ID NO: 602091 - DNA, 13 bp, D. melanogaster
caccatcgagaat

SEQ ID NO: 602092 - DNA, 13 bp, D. melanogaster
caccatcgccatt

SEQ ID NO: 602093 - DNA, 13 bp, D. melanogaster
caccatctccatc

SEQ ID NO: 602094 - DNA, 13 bp, D. melanogaster
caccatgcaccat

SEQ ID NO: 602095 - DNA, 13 bp, D. melanogaster
caccatgccacac

SEQ ID NO: 602096 - DNA, 13 bp, D. melanogaster
caccatgcgaaaa

SEQ ID NO: 602097 - DNA, 13 bp, D. melanogaster
caccattaagctg

SEQ ID NO: 602098 - DNA, 13 bp, D. melanogaster
caccattaccatt

SEQ ID NO: 602099 - DNA, 13 bp, D. melanogaster
caccattcagttt

SEQ ID NO: 602100 - DNA, 13 bp, D. melanogaster
caccattcgccat

SEQ ID NO: 602101 - DNA, 13 bp, D. melanogaster
caccattgcacca

SEQ ID NO: 602102 - DNA, 14 bp, D. melanogaster
caccattgccgata

SEQ ID NO: 602103 - DNA, 13 bp, D. melanogaster
caccatttaaaaa

SEQ ID NO: 602104 - DNA, 13 bp, D. melanogaster
caccattttccac

SEQ ID NO: 602105 - DNA, 13 bp, D. melanogaster
caccattttcccc

SEQ ID NO: 602106 - DNA, 13 bp, D. melanogaster
cacccaaaaaagg

SEQ ID NO: 602107 - DNA, 13 bp, D. melanogaster
cacccaactgcaa

SEQ ID NO: 602108 - DNA, 13 bp, D. melanogaster
cacccacacaggc

SEQ ID NO: 602109 - DNA, 13 bp, D. melanogaster
cacccacacatat

SEQ ID NO: 602110 - DNA, 13 bp, D. melanogaster
cacccacactcgc

SEQ ID NO: 602111 - DNA, 13 bp, D. melanogaster
cacccacatgcaa

SEQ ID NO: 602112 - DNA, 13 bp, D. melanogaster
cacccacatttcc

SEQ ID NO: 602113 - DNA, 13 bp, D. melanogaster
cacccacatttga

SEQ ID NO: 602114 - DNA, 13 bp, D. melanogaster
cacccacattttc

SEQ ID NO: 602115 - DNA, 13 bp, D. melanogaster
cacccactcgcac

SEQ ID NO: 602116 - DNA, 13 bp, D. melanogaster
cacccactgccca

SEQ ID NO: 602117 - DNA, 13 bp, D. melanogaster
cacccacttgcca

SEQ ID NO: 602118 - DNA, 13 bp, D. melanogaster
cacccacttggcc

SEQ ID NO: 602119 - DNA, 13 bp, D. melanogaster
cacccactttgcc

SEQ ID NO: 602120 - DNA, 13 bp, D. melanogaster
cacccacttttca

SEQ ID NO: 602121 - DNA, 14 bp, D. melanogaster
cacccacttttcca

SEQ ID NO: 602122 - DNA, 13 bp, D. melanogaster
cacccacttttct

SEQ ID NO: 602123 - DNA, 13 bp, D. melanogaster
cacccagaaaaat

SEQ ID NO: 602124 - DNA, 13 bp, D. melanogaster
cacccagccagga

SEQ ID NO: 602125 - DNA, 13 bp, D. melanogaster
cacccagctgcgc

SEQ ID NO: 602126 - DNA, 13 bp, D. melanogaster
cacccaggacacc

SEQ ID NO: 602127 - DNA, 13 bp, D. melanogaster
cacccagtcaccc

SEQ ID NO: 602128 - DNA, 13 bp, D. melanogaster
cacccatacaaat

SEQ ID NO: 602129 - DNA, 13 bp, D. melanogaster
cacccatacccat

SEQ ID NO: 602130 - DNA, 13 bp, D. melanogaster
cacccatcgccca

SEQ ID NO: 602131 - DNA, 13 bp, D. melanogaster
cacccatgtcgcc

SEQ ID NO: 602132 - DNA, 13 bp, D. melanogaster
cacccatgtgttt

SEQ ID NO: 602133 - DNA, 13 bp, D. melanogaster
cacccatttccat

SEQ ID NO: 602134 - DNA, 13 bp, D. melanogaster
cacccatttgcca

SEQ ID NO: 602135 - DNA, 13 bp, D. melanogaster
cacccgaaagcga

SEQ ID NO: 602136 - DNA, 13 bp, D. melanogaster
cacccgaaatcag

SEQ ID NO: 602137 - DNA, 14 bp, D. melanogaster
caccctcgatcacg

SEQ ID NO: 602138 - DNA, 14 bp, D. melanogaster
caccctgaaaaaga

SEQ ID NO: 602139 - DNA, 13 bp, D. melanogaster
caccctgccccat

SEQ ID NO: 602140 - DNA, 13 bp, D. melanogaster
caccctgggctcc

SEQ ID NO: 602141 - DNA, 13 bp, D. melanogaster
caccgaaaaaaat

SEQ ID NO: 602142 - DNA, 13 bp, D. melanogaster
caccgaaaccgaa

SEQ ID NO: 602143 - DNA, 13 bp, D. melanogaster
caccgagaaaaat

SEQ ID NO: 602144 - DNA, 13 bp, D. melanogaster
caccgagaaatcg

SEQ ID NO: 602145 - DNA, 13 bp, D. melanogaster
caccgattttccc

SEQ ID NO: 602146 - DNA, 13 bp, D. melanogaster
caccgcagcaaca

SEQ ID NO: 602147 - DNA, 13 bp, D. melanogaster
caccgcagcagca

SEQ ID NO: 602148 - DNA, 13 bp, D. melanogaster
caccgcatccggc

SEQ ID NO: 602149 - DNA, 13 bp, D. melanogaster
caccgcatgtaca

SEQ ID NO: 602150 - DNA, 13 bp, D. melanogaster
caccgccagatgg

SEQ ID NO: 602151 - DNA, 13 bp, D. melanogaster
caccgccatcgcc

SEQ ID NO: 602152 - DNA, 13 bp, D. melanogaster
caccgcccacatt

SEQ ID NO: 602153 - DNA, 13 bp, D. melanogaster
caccgcccactgc

SEQ ID NO: 602154 - DNA, 13 bp, D. melanogaster
caccgcccactgg

SEQ ID NO: 602155 - DNA, 13 bp, D. melanogaster
caccgcccacttc

SEQ ID NO: 602156 - DNA, 14 bp, D. melanogaster
caccgcccatcgcc

SEQ ID NO: 602157 - DNA, 14 bp, D. melanogaster
caccggaaatgatc

SEQ ID NO: 602158 - DNA, 14 bp, D. melanogaster
caccggcaacagca

SEQ ID NO: 602159 - DNA, 13 bp, D. melanogaster
caccgtcatcatc

SEQ ID NO: 602160 - DNA, 13 bp, D. melanogaster
caccgttttgtgc

SEQ ID NO: 602161 - DNA, 13 bp, D. melanogaster
cacctaacaagct

SEQ ID NO: 602162 - DNA, 13 bp, D. melanogaster
cacctacaaaacg

SEQ ID NO: 602163 - DNA, 13 bp, D. melanogaster
cacctacatacat

SEQ ID NO: 602164 - DNA, 13 bp, D. melanogaster
cacctagacagaa

SEQ ID NO: 602165 - DNA, 13 bp, D. melanogaster
cacctccgccgat

SEQ ID NO: 602166 - DNA, 13 bp, D. melanogaster
cacctcctgctcc

SEQ ID NO: 602167 - DNA, 15 bp, D. melanogaster
cacctctagagccac

SEQ ID NO: 602168 - DNA, 13 bp, D. melanogaster
cacctctgcctct

SEQ ID NO: 602169 - DNA, 13 bp, D. melanogaster
cacctcttactca

SEQ ID NO: 602170 - DNA, 13 bp, D. melanogaster
cacctgcaaacat

SEQ ID NO: 602171 - DNA, 14 bp, D. melanogaster
cacctgccacgccc

SEQ ID NO: 602172 - DNA, 13 bp, D. melanogaster
cacctgcccacct

SEQ ID NO: 602173 - DNA, 13 bp, D. melanogaster
cacctgctgctgc

SEQ ID NO: 602174 - DNA, 13 bp, D. melanogaster
caccttcaactaa

SEQ ID NO: 602175 - DNA, 13 bp, D. melanogaster
caccttcagcagg

SEQ ID NO: 602176 - DNA, 13 bp, D. melanogaster
caccttcatataa

SEQ ID NO: 602177 - DNA, 13 bp, D. melanogaster
caccttggcaaaa

SEQ ID NO: 602178 - DNA, 13 bp, D. melanogaster
cacctttatcagc

SEQ ID NO: 602179 - DNA, 13 bp, D. melanogaster
cacctttcacctt

SEQ ID NO: 602180 - DNA, 13 bp, D. melanogaster
caccttttaaaac

SEQ ID NO: 602181 - DNA, 13 bp, D. melanogaster
cacctttttgttt

SEQ ID NO: 602182 - DNA, 13 bp, D. melanogaster
cacgaaaatagaa

SEQ ID NO: 602183 - DNA, 13 bp, D. melanogaster
cacgaaagtcact

SEQ ID NO: 602184 - DNA, 13 bp, D. melanogaster
cacgaaatcgaag

SEQ ID NO: 602185 - DNA, 13 bp, D. melanogaster
cacgaatgcaaat

SEQ ID NO: 602186 - DNA, 13 bp, D. melanogaster
cacgaatttattt

SEQ ID NO: 602187 - DNA, 13 bp, D. melanogaster
cacgaattttcca

SEQ ID NO: 602188 - DNA, 13 bp, D. melanogaster
cacgactttattc

SEQ ID NO: 602189 - DNA, 13 bp, D. melanogaster
cacgagaaatatt

SEQ ID NO: 602190 - DNA, 13 bp, D. melanogaster
cacgagcagcagc

SEQ ID NO: 602191 - DNA, 14 bp, D. melanogaster
cacgagttcaaaaa

SEQ ID NO: 602192 - DNA, 13 bp, D. melanogaster
cacgatcgcgttc

SEQ ID NO: 602193 - DNA, 13 bp, D. melanogaster
cacgatgatgatg

SEQ ID NO: 602194 - DNA, 14 bp, D. melanogaster
cacgatgatgatga

SEQ ID NO: 602195 - DNA, 14 bp, D. melanogaster
cacgattttttttt

SEQ ID NO: 602196 - DNA, 16 bp, D. melanogaster
cacgcaaacaactggc

SEQ ID NO: 602197 - DNA, 13 bp, D. melanogaster
cacgcaaataaaa

SEQ ID NO: 602198 - DNA, 13 bp, D. melanogaster
cacgcaacaaact

SEQ ID NO: 602199 - DNA, 13 bp, D. melanogaster
cacgcaataaaaa

SEQ ID NO: 602200 - DNA, 14 bp, D. melanogaster
cacgcacacacact

SEQ ID NO: 602201 - DNA, 14 bp, D. melanogaster
cacgcacacacaga

SEQ ID NO: 602202 - DNA, 14 bp, D. melanogaster
cacgcacacacatg

SEQ ID NO: 602203 - DNA, 14 bp, D. melanogaster
cacgcacacacatt

SEQ ID NO: 602204 - DNA, 13 bp, D. melanogaster
cacgcacacacga

SEQ ID NO: 602205 - DNA, 13 bp, D. melanogaster
cacgcacacagag

SEQ ID NO: 602206 - DNA, 13 bp, D. melanogaster
cacgcacacagcc

SEQ ID NO: 602207 - DNA, 14 bp, D. melanogaster
cacgcacacagcca

SEQ ID NO: 602208 - DNA, 13 bp, D. melanogaster
cacgcacacagtt

SEQ ID NO: 602209 - DNA, 13 bp, D. melanogaster
cacgcacacatag

SEQ ID NO: 602210 - DNA, 14 bp, D. melanogaster
cacgcacacatgca

SEQ ID NO: 602211 - DNA, 13 bp, D. melanogaster
cacgcacaccagc

SEQ ID NO: 602212 - DNA, 13 bp, D. melanogaster
cacgcacaccatc

SEQ ID NO: 602213 - DNA, 13 bp, D. melanogaster
cacgcacacgcag

SEQ ID NO: 602214 - DNA, 13 bp, D. melanogaster
cacgcacacgcat

SEQ ID NO: 602215 - DNA, 13 bp, D. melanogaster
cacgcacactcac

SEQ ID NO: 602216 - DNA, 14 bp, D. melanogaster
cacgcacactcaca

SEQ ID NO: 602217 - DNA, 14 bp, D. melanogaster
cacgcacactcgca

SEQ ID NO: 602218 - DNA, 13 bp, D. melanogaster
cacgcacactggc

SEQ ID NO: 602219 - DNA, 14 bp, D. melanogaster
cacgcacgcacaca

SEQ ID NO: 602220 - DNA, 14 bp, D. melanogaster
cacgcacgcacgca

SEQ ID NO: 602221 - DNA, 13 bp, D. melanogaster
cacgcacgcatac

SEQ ID NO: 602222 - DNA, 13 bp, D. melanogaster
cacgcactcacac

SEQ ID NO: 602223 - DNA, 13 bp, D. melanogaster
cacgcagaaaaat

SEQ ID NO: 602224 - DNA, 13 bp, D. melanogaster
cacgcagacacac

SEQ ID NO: 602225 - DNA, 13 bp, D. melanogaster
cacgcatacgcac

SEQ ID NO: 602226 - DNA, 13 bp, D. melanogaster
cacgcatgcgcag

SEQ ID NO: 602227 - DNA, 13 bp, D. melanogaster
cacgcatttttat

SEQ ID NO: 602228 - DNA, 13 bp, D. melanogaster
cacgccaattaat

SEQ ID NO: 602229 - DNA, 13 bp, D. melanogaster
cacgcccacaatt

SEQ ID NO: 602230 - DNA, 14 bp, D. melanogaster
cacgcccacaattt

SEQ ID NO: 602231 - DNA, 13 bp, D. melanogaster
cacgcccacactt

SEQ ID NO: 602232 - DNA, 14 bp, D. melanogaster
cacgcccacacttt

SEQ ID NO: 602233 - DNA, 14 bp, D. melanogaster
cacgcccacatttt

SEQ ID NO: 602234 - DNA, 13 bp, D. melanogaster
cacgcccacgcaa

SEQ ID NO: 602235 - DNA, 13 bp, D. melanogaster
cacgcccactcga

SEQ ID NO: 602236 - DNA, 13 bp, D. melanogaster
cacgcccactcta

SEQ ID NO: 602237 - DNA, 14 bp, D. melanogaster
cacgcccactctaa

SEQ ID NO: 602238 - DNA, 13 bp, D. melanogaster
cacgcccactggc

SEQ ID NO: 602239 - DNA, 13 bp, D. melanogaster
cacgcccacttct

SEQ ID NO: 602240 - DNA, 14 bp, D. melanogaster
cacgcccattctaa

SEQ ID NO: 602241 - DNA, 13 bp, D. melanogaster
cacgcccccattc

SEQ ID NO: 602242 - DNA, 13 bp, D. melanogaster
cacgcccccttcg

SEQ ID NO: 602243 - DNA, 13 bp, D. melanogaster
cacgcccccttgc

SEQ ID NO: 602244 - DNA, 14 bp, D. melanogaster
cacgcccccttttt

SEQ ID NO: 602245 - DNA, 13 bp, D. melanogaster
cacgccccttcgc

SEQ ID NO: 602246 - DNA, 13 bp, D. melanogaster
cacgccccttttc

SEQ ID NO: 602247 - DNA, 13 bp, D. melanogaster
cacgccgacatgg

SEQ ID NO: 602248 - DNA, 14 bp, D. melanogaster
cacgcgattaccat

SEQ ID NO: 602249 - DNA, 13 bp, D. melanogaster
cacgcgcacacac

SEQ ID NO: 602250 - DNA, 13 bp, D. melanogaster
cacgcgcacgcac

SEQ ID NO: 602251 - DNA, 13 bp, D. melanogaster
cacgcggctggcg

SEQ ID NO: 602252 - DNA, 13 bp, D. melanogaster
cacgcgtcgtatg

SEQ ID NO: 602253 - DNA, 13 bp, D. melanogaster
cacggaaagaaat

SEQ ID NO: 602254 - DNA, 13 bp, D. melanogaster
cacggaaataaat

SEQ ID NO: 602255 - DNA, 13 bp, D. melanogaster
cacggaaccattg

SEQ ID NO: 602256 - DNA, 14 bp, D. melanogaster
cacggacacacaca

SEQ ID NO: 602257 - DNA, 13 bp, D. melanogaster
cacggacacggac

SEQ ID NO: 602258 - DNA, 13 bp, D. melanogaster
cacggaccatggc

SEQ ID NO: 602259 - DNA, 13 bp, D. melanogaster
cacggacgcaagt

SEQ ID NO: 602260 - DNA, 13 bp, D. melanogaster
cacggactgcagc

SEQ ID NO: 602261 - DNA, 13 bp, D. melanogaster
cacggagagaaaa

SEQ ID NO: 602262 - DNA, 14 bp, D. melanogaster
cacggagcacggag

SEQ ID NO: 602263 - DNA, 13 bp, D. melanogaster
cacggatatctcc

SEQ ID NO: 602264 - DNA, 14 bp, D. melanogaster
cacggcaacaacaa

SEQ ID NO: 602265 - DNA, 13 bp, D. melanogaster
cacggcacacaca

SEQ ID NO: 602266 - DNA, 13 bp, D. melanogaster
cacggcagcaaca

SEQ ID NO: 602267 - DNA, 14 bp, D. melanogaster
cacggcagcaacaa

SEQ ID NO: 602268 - DNA, 14 bp, D. melanogaster
cacggcagcaacat

SEQ ID NO: 602269 - DNA, 13 bp, D. melanogaster
cacggcagcagca

SEQ ID NO: 602270 - DNA, 13 bp, D. melanogaster
cacggcatcctgc

SEQ ID NO: 602271 - DNA, 14 bp, D. melanogaster
cacggcattaactt

SEQ ID NO: 602272 - DNA, 14 bp, D. melanogaster
cacggccaacaatg

SEQ ID NO: 602273 - DNA, 13 bp, D. melanogaster
cacggccgatggc

SEQ ID NO: 602274 - DNA, 13 bp, D. melanogaster
cacggcgaaaaaa

SEQ ID NO: 602275 - DNA, 14 bp, D. melanogaster
cacggcgaaaaaat

SEQ ID NO: 602276 - DNA, 13 bp, D. melanogaster
cacggcgctccag

SEQ ID NO: 602277 - DNA, 13 bp, D. melanogaster
cacggcgtatacg

SEQ ID NO: 602278 - DNA, 14 bp, D. melanogaster
cacggcgtatacgt

SEQ ID NO: 602279 - DNA, 13 bp, D. melanogaster
cacggtaataaca

SEQ ID NO: 602280 - DNA, 13 bp, D. melanogaster
cacggtgtttgcc

SEQ ID NO: 602281 - DNA, 13 bp, D. melanogaster
cacgtacacacat

SEQ ID NO: 602282 - DNA, 13 bp, D. melanogaster
cacgtacatacat

SEQ ID NO: 602283 - DNA, 13 bp, D. melanogaster
cacgtacatatat

SEQ ID NO: 602284 - DNA, 14 bp, D. melanogaster
cacgtacatatgta

SEQ ID NO: 602285 - DNA, 13 bp, D. melanogaster
cacgtatgtatgt

SEQ ID NO: 602286 - DNA, 13 bp, D. melanogaster
cacgtattcactt

SEQ ID NO: 602287 - DNA, 13 bp, D. melanogaster
cacgtcatcggca

SEQ ID NO: 602288 - DNA, 13 bp, D. melanogaster
cacgtccacgtcc

SEQ ID NO: 602289 - DNA, 14 bp, D. melanogaster
cacgtccacgtcca

SEQ ID NO: 602290 - DNA, 13 bp, D. melanogaster
cacgtccagtttt

SEQ ID NO: 602291 - DNA, 13 bp, D. melanogaster
cacgtcgcccatg

SEQ ID NO: 602292 - DNA, 13 bp, D. melanogaster
cacgtcggtgatg

SEQ ID NO: 602293 - DNA, 13 bp, D. melanogaster
cacgtctctgttg

SEQ ID NO: 602294 - DNA, 13 bp, D. melanogaster
cacgtgccacgcc

SEQ ID NO: 602295 - DNA, 14 bp, D. melanogaster
cacgttgggcgcca

SEQ ID NO: 602296 - DNA, 13 bp, D. melanogaster
cacgtttgtattt

SEQ ID NO: 602297 - DNA, 13 bp, D. melanogaster
cacgtttttctgc

SEQ ID NO: 602298 - DNA, 14 bp, D. melanogaster
cacgtttttggcgt

SEQ ID NO: 602299 - DNA, 13 bp, D. melanogaster
cactaaagaacta

SEQ ID NO: 602300 - DNA, 13 bp, D. melanogaster
cactaaatcgaag

SEQ ID NO: 602301 - DNA, 13 bp, D. melanogaster
cactaaattcaaa

SEQ ID NO: 602302 - DNA, 14 bp, D. melanogaster
cactaacatattct

SEQ ID NO: 602303 - DNA, 14 bp, D. melanogaster
cactaagcgaaaaa

SEQ ID NO: 602304 - DNA, 13 bp, D. melanogaster
cactaataacttg

SEQ ID NO: 602305 - DNA, 13 bp, D. melanogaster
cactacagagcag

SEQ ID NO: 602306 - DNA, 13 bp, D. melanogaster
cactacatacata

SEQ ID NO: 602307 - DNA, 13 bp, D. melanogaster
cactaccactacc

SEQ ID NO: 602308 - DNA, 14 bp, D. melanogaster
cactaccactacca

SEQ ID NO: 602309 - DNA, 13 bp, D. melanogaster
cactactactact

SEQ ID NO: 602310 - DNA, 13 bp, D. melanogaster
cactactccaaca

SEQ ID NO: 602311 - DNA, 13 bp, D. melanogaster
cactagacccatt

SEQ ID NO: 602312 - DNA, 14 bp, D. melanogaster
cactagctgagtaa

SEQ ID NO: 602313 - DNA, 13 bp, D. melanogaster
cactatcaatcaa

SEQ ID NO: 602314 - DNA, 13 bp, D. melanogaster
cactatccactat

SEQ ID NO: 602315 - DNA, 13 bp, D. melanogaster
cactatcgccatc

SEQ ID NO: 602316 - DNA, 14 bp, D. melanogaster
cactattaagccat

SEQ ID NO: 602317 - DNA, 13 bp, D. melanogaster
cactattattata

SEQ ID NO: 602318 - DNA, 13 bp, D. melanogaster
cactattcactat

SEQ ID NO: 602319 - DNA, 14 bp, D. melanogaster
cactattcactatt

SEQ ID NO: 602320 - DNA, 13 bp, D. melanogaster
cactatttttacg

SEQ ID NO: 602321 - DNA, 13 bp, D. melanogaster
cactcaaaatgca

SEQ ID NO: 602322 - DNA, 13 bp, D. melanogaster
cactcaaacactc

SEQ ID NO: 602323 - DNA, 13 bp, D. melanogaster
cactcaaagaaat

SEQ ID NO: 602324 - DNA, 14 bp, D. melanogaster
cactcaaagaaatt

SEQ ID NO: 602325 - DNA, 13 bp, D. melanogaster
cactcaacaattt

SEQ ID NO: 602326 - DNA, 13 bp, D. melanogaster
cactcaactcttc

SEQ ID NO: 602327 - DNA, 13 bp, D. melanogaster
cactcaatttgca

SEQ ID NO: 602328 - DNA, 14 bp, D. melanogaster
cactcacacacact

SEQ ID NO: 602329 - DNA, 14 bp, D. melanogaster
cactcacacacaga

SEQ ID NO: 602330 - DNA, 14 bp, D. melanogaster
cactcacacacata

SEQ ID NO: 602331 - DNA, 13 bp, D. melanogaster
cactcacacacgc

SEQ ID NO: 602332 - DNA, 13 bp, D. melanogaster
cactcacacactc

SEQ ID NO: 602333 - DNA, 13 bp, D. melanogaster
cactcacacagac

SEQ ID NO: 602334 - DNA, 14 bp, D. melanogaster
cactcacacagaca

SEQ ID NO: 602335 - DNA, 13 bp, D. melanogaster
cactcacacaggc

SEQ ID NO: 602336 - DNA, 14 bp, D. melanogaster
cactcacacataca

SEQ ID NO: 602337 - DNA, 13 bp, D. melanogaster
cactcacacattt

SEQ ID NO: 602338 - DNA, 13 bp, D. melanogaster
cactcacactcac

SEQ ID NO: 602339 - DNA, 14 bp, D. melanogaster
cactcacactcaca

SEQ ID NO: 602340 - DNA, 13 bp, D. melanogaster
cactcacactcgc

SEQ ID NO: 602341 - DNA, 14 bp, D. melanogaster
cactcacactcgca

SEQ ID NO: 602342 - DNA, 13 bp, D. melanogaster
cactcacagatac

SEQ ID NO: 602343 - DNA, 14 bp, D. melanogaster
cactcacatacaca

SEQ ID NO: 602344 - DNA, 13 bp, D. melanogaster
cactcacatccac

SEQ ID NO: 602345 - DNA, 14 bp, D. melanogaster
cactcacattcaca

SEQ ID NO: 602346 - DNA, 13 bp, D. melanogaster
cactcacattcgc

SEQ ID NO: 602347 - DNA, 14 bp, D. melanogaster
cactcacgcacaca

SEQ ID NO: 602348 - DNA, 13 bp, D. melanogaster
cactcacgcacat

SEQ ID NO: 602349 - DNA, 13 bp, D. melanogaster
cactcactcaatc

SEQ ID NO: 602350 - DNA, 13 bp, D. melanogaster
cactcactcacac

SEQ ID NO: 602351 - DNA, 14 bp, D. melanogaster
cactcactcacaca

SEQ ID NO: 602352 - DNA, 13 bp, D. melanogaster
cactcactcacat

SEQ ID NO: 602353 - DNA, 13 bp, D. melanogaster
cactcactcactc

SEQ ID NO: 602354 - DNA, 14 bp, D. melanogaster
cactcactcactca

SEQ ID NO: 602355 - DNA, 13 bp, D. melanogaster
cactcactcgcac

SEQ ID NO: 602356 - DNA, 13 bp, D. melanogaster
cactcacttacac

SEQ ID NO: 602357 - DNA, 13 bp, D. melanogaster
cactcacttactc

SEQ ID NO: 602358 - DNA, 13 bp, D. melanogaster
cactcagaaaaaa

SEQ ID NO: 602359 - DNA, 13 bp, D. melanogaster
cactcagaagatt

SEQ ID NO: 602360 - DNA, 13 bp, D. melanogaster
cactcagcaaaaa

SEQ ID NO: 602361 - DNA, 14 bp, D. melanogaster
cactcagcaaaaat

SEQ ID NO: 602362 - DNA, 13 bp, D. melanogaster
cactcagccagcc

SEQ ID NO: 602363 - DNA, 13 bp, D. melanogaster
cactcagctgttc

SEQ ID NO: 602364 - DNA, 13 bp, D. melanogaster
cactcagtcagtc

SEQ ID NO: 602365 - DNA, 14 bp, D. melanogaster
cactcatacacaca

SEQ ID NO: 602366 - DNA, 13 bp, D. melanogaster
cactcatacgcac

SEQ ID NO: 602367 - DNA, 13 bp, D. melanogaster
cactcatgcacac

SEQ ID NO: 602368 - DNA, 14 bp, D. melanogaster
cactcattcactca

SEQ ID NO: 602369 - DNA, 14 bp, D. melanogaster
cactcattcattca

SEQ ID NO: 602370 - DNA, 13 bp, D. melanogaster
cactcattttcca

SEQ ID NO: 602371 - DNA, 14 bp, D. melanogaster
cactccactccact

SEQ ID NO: 602372 - DNA, 13 bp, D. melanogaster
cactccactccat

SEQ ID NO: 602373 - DNA, 14 bp, D. melanogaster
cactccactccatt

SEQ ID NO: 602374 - DNA, 13 bp, D. melanogaster
cactccacttcac

SEQ ID NO: 602375 - DNA, 14 bp, D. melanogaster
cactccacttcact

SEQ ID NO: 602376 - DNA, 13 bp, D. melanogaster
cactcccacactt

SEQ ID NO: 602377 - DNA, 13 bp, D. melanogaster
cactcccatttcc

SEQ ID NO: 602378 - DNA, 13 bp, D. melanogaster
cactcccgctgag

SEQ ID NO: 602379 - DNA, 13 bp, D. melanogaster
cactccctcgctg

SEQ ID NO: 602380 - DNA, 13 bp, D. melanogaster
cactccgaagtcc

SEQ ID NO: 602381 - DNA, 13 bp, D. melanogaster
cactccgctccac

SEQ ID NO: 602382 - DNA, 14 bp, D. melanogaster
cactcgaaaaaaaa

SEQ ID NO: 602383 - DNA, 13 bp, D. melanogaster
cactcgaaaaaag

SEQ ID NO: 602384 - DNA, 13 bp, D. melanogaster
cactcgaaataaa

SEQ ID NO: 602385 - DNA, 13 bp, D. melanogaster
cactcgaaggcaa

SEQ ID NO: 602386 - DNA, 13 bp, D. melanogaster
cactcgaatcgaa

SEQ ID NO: 602387 - DNA, 13 bp, D. melanogaster
cactcgacaaaaa

SEQ ID NO: 602388 - DNA, 13 bp, D. melanogaster
cactcgactccca

SEQ ID NO: 602389 - DNA, 14 bp, D. melanogaster
cactcgcacacact

SEQ ID NO: 602390 - DNA, 13 bp, D. melanogaster
cactcgcacaccc

SEQ ID NO: 602391 - DNA, 13 bp, D. melanogaster
cactcgcacacgc

SEQ ID NO: 602392 - DNA, 13 bp, D. melanogaster
cactcgcacactc

SEQ ID NO: 602393 - DNA, 14 bp, D. melanogaster
cactcgcactcaca

SEQ ID NO: 602394 - DNA, 13 bp, D. melanogaster
cactcgcactcgc

SEQ ID NO: 602395 - DNA, 14 bp, D. melanogaster
cactcgcactcgca

SEQ ID NO: 602396 - DNA, 13 bp, D. melanogaster
cactcgcattcgc

SEQ ID NO: 602397 - DNA, 14 bp, D. melanogaster
cactcgcattcgca

SEQ ID NO: 602398 - DNA, 13 bp, D. melanogaster
cactcgcgaattg

SEQ ID NO: 602399 - DNA, 13 bp, D. melanogaster
cactcgctgccgc

SEQ ID NO: 602400 - DNA, 13 bp, D. melanogaster
cactcggagaaaa

SEQ ID NO: 602401 - DNA, 13 bp, D. melanogaster
cactcggaggcag

SEQ ID NO: 602402 - DNA, 13 bp, D. melanogaster
cactcggcactcg

SEQ ID NO: 602403 - DNA, 13 bp, D. melanogaster
cactctactcact

SEQ ID NO: 602404 - DNA, 13 bp, D. melanogaster
cactctgcatttt

SEQ ID NO: 602405 - DNA, 14 bp, D. melanogaster
cactctgcattttg

SEQ ID NO: 602406 - DNA, 13 bp, D. melanogaster
cactctgggcgct

SEQ ID NO: 602407 - DNA, 13 bp, D. melanogaster
cactctttgtttt

SEQ ID NO: 602408 - DNA, 13 bp, D. melanogaster
cactcttttggcc

SEQ ID NO: 602409 - DNA, 13 bp, D. melanogaster
cactgaaaaatat

SEQ ID NO: 602410 - DNA, 13 bp, D. melanogaster
cactgaaaacaaa

SEQ ID NO: 602411 - DNA, 13 bp, D. melanogaster
cactgaaaacaat

SEQ ID NO: 602412 - DNA, 13 bp, D. melanogaster
cactgaaagaaaa

SEQ ID NO: 602413 - DNA, 14 bp, D. melanogaster
cactgaaagaaatt

SEQ ID NO: 602414 - DNA, 13 bp, D. melanogaster
cactgaacaaaat

SEQ ID NO: 602415 - DNA, 13 bp, D. melanogaster
cactgaacgaaaa

SEQ ID NO: 602416 - DNA, 13 bp, D. melanogaster
cactgacacacac

SEQ ID NO: 602417 - DNA, 13 bp, D. melanogaster
cactgactgactg

SEQ ID NO: 602418 - DNA, 14 bp, D. melanogaster
cactgagaaaaaaa

SEQ ID NO: 602419 - DNA, 14 bp, D. melanogaster
cactgagaaaaaca

SEQ ID NO: 602420 - DNA, 14 bp, D. melanogaster
cactgagaaaaact

SEQ ID NO: 602421 - DNA, 13 bp, D. melanogaster
cactgagaaaaat

SEQ ID NO: 602422 - DNA, 14 bp, D. melanogaster
cactgagaaaaatg

SEQ ID NO: 602423 - DNA, 13 bp, D. melanogaster
cactgagaaaata

SEQ ID NO: 602424 - DNA, 13 bp, D. melanogaster
cactgagagaaaa

SEQ ID NO: 602425 - DNA, 13 bp, D. melanogaster
cactgagcaaaat

SEQ ID NO: 602426 - DNA, 13 bp, D. melanogaster
cactgagcgaaaa

SEQ ID NO: 602427 - DNA, 13 bp, D. melanogaster
cactgagcgaaag

SEQ ID NO: 602428 - DNA, 13 bp, D. melanogaster
cactgagcgaaat

SEQ ID NO: 602429 - DNA, 13 bp, D. melanogaster
cactgaggaaaat

SEQ ID NO: 602430 - DNA, 13 bp, D. melanogaster
cactgagggaaaa

SEQ ID NO: 602431 - DNA, 13 bp, D. melanogaster
cactgataaaagt

SEQ ID NO: 602432 - DNA, 13 bp, D. melanogaster
cactgatgaaaaa

SEQ ID NO: 602433 - DNA, 14 bp, D. melanogaster
cactgcaaaaaaaa

SEQ ID NO: 602434 - DNA, 13 bp, D. melanogaster
cactgcaaacaaa

SEQ ID NO: 602435 - DNA, 13 bp, D. melanogaster
cactgcaaccgca

SEQ ID NO: 602436 - DNA, 14 bp, D. melanogaster
cactgcaagaaaaa

SEQ ID NO: 602437 - DNA, 14 bp, D. melanogaster
cactgcaagaaaat

SEQ ID NO: 602438 - DNA, 13 bp, D. melanogaster
cactgcaagaaat

SEQ ID NO: 602439 - DNA, 13 bp, D. melanogaster
cactgcaagtgca

SEQ ID NO: 602440 - DNA, 13 bp, D. melanogaster
cactgcaataaaa

SEQ ID NO: 602441 - DNA, 13 bp, D. melanogaster
cactgcacaaaat

SEQ ID NO: 602442 - DNA, 13 bp, D. melanogaster
cactgcactgcac

SEQ ID NO: 602443 - DNA, 13 bp, D. melanogaster
cactgcagcaaca

SEQ ID NO: 602444 - DNA, 14 bp, D. melanogaster
cactgcagcagcat

SEQ ID NO: 602445 - DNA, 13 bp, D. melanogaster
cactgcagctgca

SEQ ID NO: 602446 - DNA, 13 bp, D. melanogaster
cactgcatacttt

SEQ ID NO: 602447 - DNA, 14 bp, D. melanogaster
cactgcatactttt

SEQ ID NO: 602448 - DNA, 13 bp, D. melanogaster
cactgccaaaatt

SEQ ID NO: 602449 - DNA, 13 bp, D. melanogaster
cactgccacccac

SEQ ID NO: 602450 - DNA, 13 bp, D. melanogaster
cactgccacgccc

SEQ ID NO: 602451 - DNA, 14 bp, D. melanogaster
cactgccacgcccc

SEQ ID NO: 602452 - DNA, 13 bp, D. melanogaster
cactgccactccc

SEQ ID NO: 602453 - DNA, 13 bp, D. melanogaster
cactgccactgcc

SEQ ID NO: 602454 - DNA, 14 bp, D. melanogaster
cactgccactgccg

SEQ ID NO: 602455 - DNA, 13 bp, D. melanogaster
cactgccactggc

SEQ ID NO: 602456 - DNA, 13 bp, D. melanogaster
cactgccacttcc

SEQ ID NO: 602457 - DNA, 14 bp, D. melanogaster
cactgccacttcca

SEQ ID NO: 602458 - DNA, 13 bp, D. melanogaster
cactgccagaaaa

SEQ ID NO: 602459 - DNA, 13 bp, D. melanogaster
cactgccatttcc

SEQ ID NO: 602460 - DNA, 13 bp, D. melanogaster
cactgcctggtgc

SEQ ID NO: 602461 - DNA, 13 bp, D. melanogaster
cactgcgcaaaaa

SEQ ID NO: 602462 - DNA, 13 bp, D. melanogaster
cactgcgcgaaaa

SEQ ID NO: 602463 - DNA, 13 bp, D. melanogaster
cactgcggaaaaa

SEQ ID NO: 602464 - DNA, 13 bp, D. melanogaster
cactgcgtatgag

SEQ ID NO: 602465 - DNA, 14 bp, D. melanogaster
cactgcgtatgcgt

SEQ ID NO: 602466 - DNA, 13 bp, D. melanogaster
cactgcgtatgtg

SEQ ID NO: 602467 - DNA, 13 bp, D. melanogaster
cactgctaacggt

SEQ ID NO: 602468 - DNA, 13 bp, D. melanogaster
cactgctcaggct

SEQ ID NO: 602469 - DNA, 13 bp, D. melanogaster
cactgctgccttg

SEQ ID NO: 602470 - DNA, 13 bp, D. melanogaster
cactgctgctgca

SEQ ID NO: 602471 - DNA, 13 bp, D. melanogaster
cactgctttaaag

SEQ ID NO: 602472 - DNA, 13 bp, D. melanogaster
cactgcttttgtt

SEQ ID NO: 602473 - DNA, 13 bp, D. melanogaster
cactgcttttttt

SEQ ID NO: 602474 - DNA, 13 bp, D. melanogaster
cactggaaaaaaa

SEQ ID NO: 602475 - DNA, 14 bp, D. melanogaster
cactggaaaaaaat

SEQ ID NO: 602476 - DNA, 13 bp, D. melanogaster
cactggaaaaaac

SEQ ID NO: 602477 - DNA, 14 bp, D. melanogaster
cactggaaaaaaca

SEQ ID NO: 602478 - DNA, 13 bp, D. melanogaster
cactggaaaatat

SEQ ID NO: 602479 - DNA, 13 bp, D. melanogaster
cactggacactgg

SEQ ID NO: 602480 - DNA, 14 bp, D. melanogaster
cactggactggctg

SEQ ID NO: 602481 - DNA, 13 bp, D. melanogaster
cactggagaggcg

SEQ ID NO: 602482 - DNA, 13 bp, D. melanogaster
cactggaggatgt

SEQ ID NO: 602483 - DNA, 13 bp, D. melanogaster
cactggcaactgc

SEQ ID NO: 602484 - DNA, 13 bp, D. melanogaster
cactggcaactgg

SEQ ID NO: 602485 - DNA, 14 bp, D. melanogaster
cactggcacacaca

SEQ ID NO: 602486 - DNA, 13 bp, D. melanogaster
cactggcactggc

SEQ ID NO: 602487 - DNA, 13 bp, D. melanogaster
cactggcagaaaa

SEQ ID NO: 602488 - DNA, 13 bp, D. melanogaster
cactggccaaaaa

SEQ ID NO: 602489 - DNA, 13 bp, D. melanogaster
cactggccactgg

SEQ ID NO: 602490 - DNA, 13 bp, D. melanogaster
cactggccttcaa

SEQ ID NO: 602491 - DNA, 13 bp, D. melanogaster
cactgggaaaaaa

SEQ ID NO: 602492 - DNA, 13 bp, D. melanogaster
cactgggaaaaag

SEQ ID NO: 602493 - DNA, 14 bp, D. melanogaster
cactgggagaaatg

SEQ ID NO: 602494 - DNA, 13 bp, D. melanogaster
cactgggcaataa

SEQ ID NO: 602495 - DNA, 13 bp, D. melanogaster
cactgggcactgg

SEQ ID NO: 602496 - DNA, 13 bp, D. melanogaster
cactgggcgaaaa

SEQ ID NO: 602497 - DNA, 13 bp, D. melanogaster
cactgtaaaataa

SEQ ID NO: 602498 - DNA, 13 bp, D. melanogaster
cactgtacagtga

SEQ ID NO: 602499 - DNA, 13 bp, D. melanogaster
cactgtatgcgta

SEQ ID NO: 602500 - DNA, 13 bp, D. melanogaster
cactgtccgatgg

SEQ ID NO: 602501 - DNA, 13 bp, D. melanogaster
cactgtgcactgt

SEQ ID NO: 602502 - DNA, 13 bp, D. melanogaster
cactgtgcgaaaa

SEQ ID NO: 602503 - DNA, 13 bp, D. melanogaster
cactgtggaaaaa

SEQ ID NO: 602504 - DNA, 13 bp, D. melanogaster
cactgttaacagc

SEQ ID NO: 602505 - DNA, 13 bp, D. melanogaster
cactgttaagtga

SEQ ID NO: 602506 - DNA, 13 bp, D. melanogaster
cactgttgcttca

SEQ ID NO: 602507 - DNA, 13 bp, D. melanogaster
cacttaaaaaagg

SEQ ID NO: 602508 - DNA, 13 bp, D. melanogaster
cacttaaaaactt

SEQ ID NO: 602509 - DNA, 13 bp, D. melanogaster
cacttaaaattat

SEQ ID NO: 602510 - DNA, 13 bp, D. melanogaster
cacttaaacaatt

SEQ ID NO: 602511 - DNA, 13 bp, D. melanogaster
cacttaaagaaat

SEQ ID NO: 602512 - DNA, 13 bp, D. melanogaster
cacttaaatatat

SEQ ID NO: 602513 - DNA, 13 bp, D. melanogaster
cacttaaattaat

SEQ ID NO: 602514 - DNA, 13 bp, D. melanogaster
cacttaaatttat

SEQ ID NO: 602515 - DNA, 14 bp, D. melanogaster
cacttaaatttata

SEQ ID NO: 602516 - DNA, 13 bp, D. melanogaster
cacttaaatttta

SEQ ID NO: 602517 - DNA, 13 bp, D. melanogaster
cacttaagaaaaa

SEQ ID NO: 602518 - DNA, 14 bp, D. melanogaster
cacttaagaatcca

SEQ ID NO: 602519 - DNA, 13 bp, D. melanogaster
cacttaagttaaa

SEQ ID NO: 602520 - DNA, 14 bp, D. melanogaster
cacttaagttaaaa

SEQ ID NO: 602521 - DNA, 13 bp, D. melanogaster
cacttaatattaa

SEQ ID NO: 602522 - DNA, 13 bp, D. melanogaster
cacttaatggcca

SEQ ID NO: 602523 - DNA, 13 bp, D. melanogaster
cacttaattaaaa

SEQ ID NO: 602524 - DNA, 13 bp, D. melanogaster
cacttaattattt

SEQ ID NO: 602525 - DNA, 13 bp, D. melanogaster
cacttacacacac

SEQ ID NO: 602526 - DNA, 13 bp, D. melanogaster
cacttacacatac

SEQ ID NO: 602527 - DNA, 13 bp, D. melanogaster
cacttacgcacac

SEQ ID NO: 602528 - DNA, 13 bp, D. melanogaster
cacttagtatgca

SEQ ID NO: 602529 - DNA, 13 bp, D. melanogaster
cacttatactttg

SEQ ID NO: 602530 - DNA, 14 bp, D. melanogaster
cacttataggattt

SEQ ID NO: 602531 - DNA, 13 bp, D. melanogaster
cacttatatatgt

SEQ ID NO: 602532 - DNA, 13 bp, D. melanogaster
cacttatcgataa

SEQ ID NO: 602533 - DNA, 13 bp, D. melanogaster
cacttatgaatga

SEQ ID NO: 602534 - DNA, 14 bp, D. melanogaster
cacttatgtatgta

SEQ ID NO: 602535 - DNA, 13 bp, D. melanogaster
cacttatttttaa

SEQ ID NO: 602536 - DNA, 13 bp, D. melanogaster
cacttcaaaattt

SEQ ID NO: 602537 - DNA, 13 bp, D. melanogaster
cacttcaagcaaa

SEQ ID NO: 602538 - DNA, 13 bp, D. melanogaster
cacttcaattaaa

SEQ ID NO: 602539 - DNA, 13 bp, D. melanogaster
cacttcactccac

SEQ ID NO: 602540 - DNA, 13 bp, D. melanogaster
cacttcactccgc

SEQ ID NO: 602541 - DNA, 13 bp, D. melanogaster
cacttcacttcac

SEQ ID NO: 602542 - DNA, 13 bp, D. melanogaster
cacttcacttggc

SEQ ID NO: 602543 - DNA, 13 bp, D. melanogaster
cacttcacttttc

SEQ ID NO: 602544 - DNA, 13 bp, D. melanogaster
cacttcagtttga

SEQ ID NO: 602545 - DNA, 13 bp, D. melanogaster
cacttcagttttt

SEQ ID NO: 602546 - DNA, 13 bp, D. melanogaster
cacttcattagca

SEQ ID NO: 602547 - DNA, 13 bp, D. melanogaster
cacttcatttgaa

SEQ ID NO: 602548 - DNA, 13 bp, D. melanogaster
cacttcatttgcc

SEQ ID NO: 602549 - DNA, 13 bp, D. melanogaster
cacttcattttga

SEQ ID NO: 602550 - DNA, 13 bp, D. melanogaster
cacttccaagaat

SEQ ID NO: 602551 - DNA, 13 bp, D. melanogaster
cacttccacatcc

SEQ ID NO: 602552 - DNA, 13 bp, D. melanogaster
cacttccacttcc

SEQ ID NO: 602553 - DNA, 13 bp, D. melanogaster
cacttccacttgg

SEQ ID NO: 602554 - DNA, 13 bp, D. melanogaster
cacttccatttcc

SEQ ID NO: 602555 - DNA, 14 bp, D. melanogaster
cacttccatttcca

SEQ ID NO: 602556 - DNA, 13 bp, D. melanogaster
cacttccatttct

SEQ ID NO: 602557 - DNA, 13 bp, D. melanogaster
cacttccgcccac

SEQ ID NO: 602558 - DNA, 13 bp, D. melanogaster
cacttccgctggc

SEQ ID NO: 602559 - DNA, 13 bp, D. melanogaster
cacttccgcttcc

SEQ ID NO: 602560 - DNA, 13 bp, D. melanogaster
cacttccgtttcc

SEQ ID NO: 602561 - DNA, 14 bp, D. melanogaster
cacttccgtttccg

SEQ ID NO: 602562 - DNA, 13 bp, D. melanogaster
cacttcgaactgg

SEQ ID NO: 602563 - DNA, 13 bp, D. melanogaster
cacttctctattt

SEQ ID NO: 602564 - DNA, 14 bp, D. melanogaster
cacttctctatttg

SEQ ID NO: 602565 - DNA, 13 bp, D. melanogaster
cacttcttcttgg

SEQ ID NO: 602566 - DNA, 13 bp, D. melanogaster
cacttcttggcca

SEQ ID NO: 602567 - DNA, 13 bp, D. melanogaster
cacttgaaaaaaa

SEQ ID NO: 602568 - DNA, 14 bp, D. melanogaster
cacttgaaaaaaaa

SEQ ID NO: 602569 - DNA, 14 bp, D. melanogaster
cacttgaaaaaaat

SEQ ID NO: 602570 - DNA, 14 bp, D. melanogaster
cacttgaaaactat

SEQ ID NO: 602571 - DNA, 13 bp, D. melanogaster
cacttgaaaagtt

SEQ ID NO: 602572 - DNA, 13 bp, D. melanogaster
cacttgaaaatat

SEQ ID NO: 602573 - DNA, 13 bp, D. melanogaster
cacttgaaaattg

SEQ ID NO: 602574 - DNA, 13 bp, D. melanogaster
cacttgaaacaaa

SEQ ID NO: 602575 - DNA, 13 bp, D. melanogaster
cacttgaaacttt

SEQ ID NO: 602576 - DNA, 13 bp, D. melanogaster
cacttgaaataaa

SEQ ID NO: 602577 - DNA, 13 bp, D. melanogaster
cacttgaaatgga

SEQ ID NO: 602578 - DNA, 13 bp, D. melanogaster
cacttgaacaaaa

SEQ ID NO: 602579 - DNA, 13 bp, D. melanogaster
cacttgaatttca

SEQ ID NO: 602580 - DNA, 13 bp, D. melanogaster
cacttgaccaact

SEQ ID NO: 602581 - DNA, 13 bp, D. melanogaster
cacttgagacatt

SEQ ID NO: 602582 - DNA, 13 bp, D. melanogaster
cacttgagcaaat

SEQ ID NO: 602583 - DNA, 13 bp, D. melanogaster
cacttgagctgca

SEQ ID NO: 602584 - DNA, 13 bp, D. melanogaster
cacttgagctgct

SEQ ID NO: 602585 - DNA, 13 bp, D. melanogaster
cacttgatctggc

SEQ ID NO: 602586 - DNA, 13 bp, D. melanogaster
cacttgatttgat

SEQ ID NO: 602587 - DNA, 13 bp, D. melanogaster
cacttgcactttg

SEQ ID NO: 602588 - DNA, 13 bp, D. melanogaster
cacttgcactttt

SEQ ID NO: 602589 - DNA, 14 bp, D. melanogaster
cacttgcacttttt

SEQ ID NO: 602590 - DNA, 13 bp, D. melanogaster
cacttgcagctgc

SEQ ID NO: 602591 - DNA, 13 bp, D. melanogaster
cacttgcagttgc

SEQ ID NO: 602592 - DNA, 13 bp, D. melanogaster
cacttgcattttc

SEQ ID NO: 602593 - DNA, 13 bp, D. melanogaster
cacttgccacaaa

SEQ ID NO: 602594 - DNA, 13 bp, D. melanogaster
cacttgccacatt

SEQ ID NO: 602595 - DNA, 13 bp, D. melanogaster
cacttgccactcg

SEQ ID NO: 602596 - DNA, 14 bp, D. melanogaster
cacttgccacttgg

SEQ ID NO: 602597 - DNA, 13 bp, D. melanogaster
cacttgccatttg

SEQ ID NO: 602598 - DNA, 13 bp, D. melanogaster
cacttgccgattt

SEQ ID NO: 602599 - DNA, 13 bp, D. melanogaster
cacttggaaaaat

SEQ ID NO: 602600 - DNA, 13 bp, D. melanogaster
cacttggacttgg

SEQ ID NO: 602601 - DNA, 13 bp, D. melanogaster
cacttggagaaat

SEQ ID NO: 602602 - DNA, 13 bp, D. melanogaster
cacttggcacaca

SEQ ID NO: 602603 - DNA, 13 bp, D. melanogaster
cacttggcacttg

SEQ ID NO: 602604 - DNA, 14 bp, D. melanogaster
cacttggcacttgg

SEQ ID NO: 602605 - DNA, 13 bp, D. melanogaster
cacttggcacttt

SEQ ID NO: 602606 - DNA, 13 bp, D. melanogaster
cacttggcagctg

SEQ ID NO: 602607 - DNA, 13 bp, D. melanogaster
cacttggcataaa

SEQ ID NO: 602608 - DNA, 13 bp, D. melanogaster
cacttggccaaca

SEQ ID NO: 602609 - DNA, 13 bp, D. melanogaster
cacttggccaagt

SEQ ID NO: 602610 - DNA, 14 bp, D. melanogaster
cacttggccaagtt

SEQ ID NO: 602611 - DNA, 13 bp, D. melanogaster
cacttggccactt

SEQ ID NO: 602612 - DNA, 13 bp, D. melanogaster
cacttggccagca

SEQ ID NO: 602613 - DNA, 13 bp, D. melanogaster
cacttggccataa

SEQ ID NO: 602614 - DNA, 13 bp, D. melanogaster
cacttggccatgt

SEQ ID NO: 602615 - DNA, 13 bp, D. melanogaster
cacttggccattt

SEQ ID NO: 602616 - DNA, 13 bp, D. melanogaster
cacttggcgcaaa

SEQ ID NO: 602617 - DNA, 13 bp, D. melanogaster
cacttggctggca

SEQ ID NO: 602618 - DNA, 13 bp, D. melanogaster
cacttgggaaaaa

SEQ ID NO: 602619 - DNA, 14 bp, D. melanogaster
cacttgggagtttt

SEQ ID NO: 602620 - DNA, 13 bp, D. melanogaster
cacttggtttgaa

SEQ ID NO: 602621 - DNA, 13 bp, D. melanogaster
cacttgtaaataa

SEQ ID NO: 602622 - DNA, 14 bp, D. melanogaster
cacttgtaaataaa

SEQ ID NO: 602623 - DNA, 13 bp, D. melanogaster
cacttgttccgaa

SEQ ID NO: 602624 - DNA, 13 bp, D. melanogaster
cacttgttgctgc

SEQ ID NO: 602625 - DNA, 13 bp, D. melanogaster
cacttgtttattt

SEQ ID NO: 602626 - DNA, 13 bp, D. melanogaster
cacttgtttgttt

SEQ ID NO: 602627 - DNA, 14 bp, D. melanogaster
cacttgtttgtttt

SEQ ID NO: 602628 - DNA, 13 bp, D. melanogaster
cactttaaaaaca

SEQ ID NO: 602629 - DNA, 13 bp, D. melanogaster
cactttaaaagca

SEQ ID NO: 602630 - DNA, 13 bp, D. melanogaster
cactttaaaatgt

SEQ ID NO: 602631 - DNA, 13 bp, D. melanogaster
cactttaaatata

SEQ ID NO: 602632 - DNA, 13 bp, D. melanogaster
cactttaaatatt

SEQ ID NO: 602633 - DNA, 13 bp, D. melanogaster
cactttaaccaca

SEQ ID NO: 602634 - DNA, 13 bp, D. melanogaster
cactttaacgccc

SEQ ID NO: 602635 - DNA, 13 bp, D. melanogaster
cactttaattaat

SEQ ID NO: 602636 - DNA, 13 bp, D. melanogaster
cactttaattgca

SEQ ID NO: 602637 - DNA, 13 bp, D. melanogaster
cactttacacttt

SEQ ID NO: 602638 - DNA, 13 bp, D. melanogaster
cactttatgtgcg

SEQ ID NO: 602639 - DNA, 13 bp, D. melanogaster
cactttattgatg

SEQ ID NO: 602640 - DNA, 13 bp, D. melanogaster
cactttattgttt

SEQ ID NO: 602641 - DNA, 13 bp, D. melanogaster
cactttcaattgt

SEQ ID NO: 602642 - DNA, 13 bp, D. melanogaster
cactttcacccac

SEQ ID NO: 602643 - DNA, 13 bp, D. melanogaster
cactttcactgcc

SEQ ID NO: 602644 - DNA, 13 bp, D. melanogaster
cactttcactgct

SEQ ID NO: 602645 - DNA, 13 bp, D. melanogaster
cactttcactttc

SEQ ID NO: 602646 - DNA, 14 bp, D. melanogaster
cactttcacttttc

SEQ ID NO: 602647 - DNA, 13 bp, D. melanogaster
cactttccacttt

SEQ ID NO: 602648 - DNA, 13 bp, D. melanogaster
cactttccatggc

SEQ ID NO: 602649 - DNA, 13 bp, D. melanogaster
cactttccatttt

SEQ ID NO: 602650 - DNA, 13 bp, D. melanogaster
cactttccgcttt

SEQ ID NO: 602651 - DNA, 13 bp, D. melanogaster
cactttcgatttc

SEQ ID NO: 602652 - DNA, 13 bp, D. melanogaster
cactttcggtttc

SEQ ID NO: 602653 - DNA, 13 bp, D. melanogaster
cactttcggtttt

SEQ ID NO: 602654 - DNA, 13 bp, D. melanogaster
cactttcgttggc

SEQ ID NO: 602655 - DNA, 13 bp, D. melanogaster
cactttcgtttcg

SEQ ID NO: 602656 - DNA, 13 bp, D. melanogaster
cactttctactct

SEQ ID NO: 602657 - DNA, 14 bp, D. melanogaster
cactttctggcatt

SEQ ID NO: 602658 - DNA, 13 bp, D. melanogaster
cactttctttggt

SEQ ID NO: 602659 - DNA, 13 bp, D. melanogaster
cactttcttttgc

SEQ ID NO: 602660 - DNA, 13 bp, D. melanogaster
cactttgaaatgc

SEQ ID NO: 602661 - DNA, 13 bp, D. melanogaster
cactttgaaggcg

SEQ ID NO: 602662 - DNA, 13 bp, D. melanogaster
cactttgaggccc

SEQ ID NO: 602663 - DNA, 13 bp, D. melanogaster
cactttgcaaaag

SEQ ID NO: 602664 - DNA, 13 bp, D. melanogaster
cactttgcagctc

SEQ ID NO: 602665 - DNA, 13 bp, D. melanogaster
cactttgcatatt

SEQ ID NO: 602666 - DNA, 13 bp, D. melanogaster
cactttgcatgca

SEQ ID NO: 602667 - DNA, 13 bp, D. melanogaster
cactttgcattcg

SEQ ID NO: 602668 - DNA, 13 bp, D. melanogaster
cactttgcattta

SEQ ID NO: 602669 - DNA, 13 bp, D. melanogaster
cactttgcatttg

SEQ ID NO: 602670 - DNA, 14 bp, D. melanogaster
cactttgccacctt

SEQ ID NO: 602671 - DNA, 13 bp, D. melanogaster
cactttgccattt

SEQ ID NO: 602672 - DNA, 13 bp, D. melanogaster
cactttgcccgct

SEQ ID NO: 602673 - DNA, 13 bp, D. melanogaster
cactttgctgcaa

SEQ ID NO: 602674 - DNA, 13 bp, D. melanogaster
cactttggaacaa

SEQ ID NO: 602675 - DNA, 14 bp, D. melanogaster
cactttggaacaat

SEQ ID NO: 602676 - DNA, 13 bp, D. melanogaster
cactttggcactt

SEQ ID NO: 602677 - DNA, 13 bp, D. melanogaster
cactttggccaaa

SEQ ID NO: 602678 - DNA, 13 bp, D. melanogaster
cactttggccaca

SEQ ID NO: 602679 - DNA, 13 bp, D. melanogaster
cactttgtggcaa

SEQ ID NO: 602680 - DNA, 13 bp, D. melanogaster
cactttgttgcca

SEQ ID NO: 602681 - DNA, 13 bp, D. melanogaster
cactttgttgctg

SEQ ID NO: 602682 - DNA, 13 bp, D. melanogaster
cactttgttggcc

SEQ ID NO: 602683 - DNA, 13 bp, D. melanogaster
cactttgtttaca

SEQ ID NO: 602684 - DNA, 13 bp, D. melanogaster
cactttgtttttg

SEQ ID NO: 602685 - DNA, 13 bp, D. melanogaster
cacttttaaaatt

SEQ ID NO: 602686 - DNA, 13 bp, D. melanogaster
cacttttaaatgt

SEQ ID NO: 602687 - DNA, 13 bp, D. melanogaster
cacttttaagcaa

SEQ ID NO: 602688 - DNA, 13 bp, D. melanogaster
cacttttaatgtt

SEQ ID NO: 602689 - DNA, 13 bp, D. melanogaster
cacttttaattgt

SEQ ID NO: 602690 - DNA, 13 bp, D. melanogaster
cacttttatggca

SEQ ID NO: 602691 - DNA, 13 bp, D. melanogaster
cacttttattgaa

SEQ ID NO: 602692 - DNA, 13 bp, D. melanogaster
cacttttcaaatg

SEQ ID NO: 602693 - DNA, 13 bp, D. melanogaster
cacttttcacaca

SEQ ID NO: 602694 - DNA, 13 bp, D. melanogaster
cacttttcaccca

SEQ ID NO: 602695 - DNA, 13 bp, D. melanogaster
cacttttcacttg

SEQ ID NO: 602696 - DNA, 13 bp, D. melanogaster
cacttttcagcca

SEQ ID NO: 602697 - DNA, 13 bp, D. melanogaster
cacttttcatttc

SEQ ID NO: 602698 - DNA, 13 bp, D. melanogaster
cacttttcatttg

SEQ ID NO: 602699 - DNA, 13 bp, D. melanogaster
cacttttccaacc

SEQ ID NO: 602700 - DNA, 13 bp, D. melanogaster
cacttttccaccg

SEQ ID NO: 602701 - DNA, 13 bp, D. melanogaster
cacttttccacgc

SEQ ID NO: 602702 - DNA, 13 bp, D. melanogaster
cacttttccactt

SEQ ID NO: 602703 - DNA, 13 bp, D. melanogaster
cacttttccagcc

SEQ ID NO: 602704 - DNA, 13 bp, D. melanogaster
cacttttccattt

SEQ ID NO: 602705 - DNA, 13 bp, D. melanogaster
cacttttcccact

SEQ ID NO: 602706 - DNA, 13 bp, D. melanogaster
cacttttccgact

SEQ ID NO: 602707 - DNA, 13 bp, D. melanogaster
cacttttccttta

SEQ ID NO: 602708 - DNA, 13 bp, D. melanogaster
cacttttcgcatt

SEQ ID NO: 602709 - DNA, 13 bp, D. melanogaster
cacttttgaataa

SEQ ID NO: 602710 - DNA, 13 bp, D. melanogaster
cacttttgatttc

SEQ ID NO: 602711 - DNA, 13 bp, D. melanogaster
cacttttgcaact

SEQ ID NO: 602712 - DNA, 13 bp, D. melanogaster
cacttttgcagca

SEQ ID NO: 602713 - DNA, 13 bp, D. melanogaster
cacttttgccacc

SEQ ID NO: 602714 - DNA, 13 bp, D. melanogaster
cacttttgctttt

SEQ ID NO: 602715 - DNA, 13 bp, D. melanogaster
cacttttggaaaa

SEQ ID NO: 602716 - DNA, 13 bp, D. melanogaster
cacttttggccaa

SEQ ID NO: 602717 - DNA, 13 bp, D. melanogaster
cacttttggccag

SEQ ID NO: 602718 - DNA, 13 bp, D. melanogaster
cacttttggcttt

SEQ ID NO: 602719 - DNA, 13 bp, D. melanogaster
cacttttgtggcc

SEQ ID NO: 602720 - DNA, 13 bp, D. melanogaster
cacttttgttaac

SEQ ID NO: 602721 - DNA, 13 bp, D. melanogaster
cacttttgttgtt

SEQ ID NO: 602722 - DNA, 14 bp, D. melanogaster
cacttttgttgttt

SEQ ID NO: 602723 - DNA, 13 bp, D. melanogaster
cacttttgtttgc

SEQ ID NO: 602724 - DNA, 13 bp, D. melanogaster
cacttttgttttg

SEQ ID NO: 602725 - DNA, 13 bp, D. melanogaster
cactttttaaaaa

SEQ ID NO: 602726 - DNA, 14 bp, D. melanogaster
cactttttaatttc

SEQ ID NO: 602727 - DNA, 13 bp, D. melanogaster
cactttttagttg

SEQ ID NO: 602728 - DNA, 13 bp, D. melanogaster
cactttttcaaaa

SEQ ID NO: 602729 - DNA, 13 bp, D. melanogaster
cactttttccaca

SEQ ID NO: 602730 - DNA, 13 bp, D. melanogaster
cactttttgaaat

SEQ ID NO: 602731 - DNA, 13 bp, D. melanogaster
cactttttgaagt

SEQ ID NO: 602732 - DNA, 13 bp, D. melanogaster
cactttttgcagc

SEQ ID NO: 602733 - DNA, 13 bp, D. melanogaster
cactttttgcatt

SEQ ID NO: 602734 - DNA, 13 bp, D. melanogaster
cactttttggcca

SEQ ID NO: 602735 - DNA, 13 bp, D. melanogaster
cactttttgtatt

SEQ ID NO: 602736 - DNA, 13 bp, D. melanogaster
cactttttgttga

SEQ ID NO: 602737 - DNA, 13 bp, D. melanogaster
cactttttgtttg

SEQ ID NO: 602738 - DNA, 14 bp, D. melanogaster
cacttttttaaaaa

SEQ ID NO: 602739 - DNA, 14 bp, D. melanogaster
cacttttttataaa

SEQ ID NO: 602740 - DNA, 13 bp, D. melanogaster
cacttttttccca

SEQ ID NO: 602741 - DNA, 13 bp, D. melanogaster
cacttttttgcca

SEQ ID NO: 602742 - DNA, 13 bp, D. melanogaster
cacttttttggcc

SEQ ID NO: 602743 - DNA, 13 bp, D. melanogaster
cacttttttggtg

SEQ ID NO: 602744 - DNA, 13 bp, D. melanogaster
cactttttttgta

SEQ ID NO: 602745 - DNA, 13 bp, D. melanogaster
cacttttttttcg

SEQ ID NO: 602746 - DNA, 13 bp, D. melanogaster
cacttttttttgc

SEQ ID NO: 602747 - DNA, 13 bp, D. melanogaster
cagaaaaaaatgg

SEQ ID NO: 602748 - DNA, 14 bp, D. melanogaster
cagaaaaaatatat

SEQ ID NO: 602749 - DNA, 13 bp, D. melanogaster
cagaaaaaatgga

SEQ ID NO: 602750 - DNA, 13 bp, D. melanogaster
cagaaaaaccaat

SEQ ID NO: 602751 - DNA, 13 bp, D. melanogaster
cagaaaaacccga

SEQ ID NO: 602752 - DNA, 13 bp, D. melanogaster
cagaaaaatatat

SEQ ID NO: 602753 - DNA, 13 bp, D. melanogaster
cagaaaaatatga

SEQ ID NO: 602754 - DNA, 13 bp, D. melanogaster
cagaaaaatcgat

SEQ ID NO: 602755 - DNA, 13 bp, D. melanogaster
cagaaaaatgtat

SEQ ID NO: 602756 - DNA, 13 bp, D. melanogaster
cagaaaacaagcc

SEQ ID NO: 602757 - DNA, 13 bp, D. melanogaster
cagaaaacatttt

SEQ ID NO: 602758 - DNA, 14 bp, D. melanogaster
cagaaaacggaaat

SEQ ID NO: 602759 - DNA, 14 bp, D. melanogaster
cagaaaactagaat

SEQ ID NO: 602760 - DNA, 13 bp, D. melanogaster
cagaaaactgaaa

SEQ ID NO: 602761 - DNA, 13 bp, D. melanogaster
cagaaaactgttt

SEQ ID NO: 602762 - DNA, 13 bp, D. melanogaster
cagaaaactttga

SEQ ID NO: 602763 - DNA, 13 bp, D. melanogaster
cagaaaagtatgc

SEQ ID NO: 602764 - DNA, 14 bp, D. melanogaster
cagaaaagtcacaa

SEQ ID NO: 602765 - DNA, 13 bp, D. melanogaster
cagaaaagttctt

SEQ ID NO: 602766 - DNA, 14 bp, D. melanogaster
cagaaaataataat

SEQ ID NO: 602767 - DNA, 13 bp, D. melanogaster
cagaaaataatga

SEQ ID NO: 602768 - DNA, 13 bp, D. melanogaster
cagaaaatacata

SEQ ID NO: 602769 - DNA, 13 bp, D. melanogaster
cagaaaatattaa

SEQ ID NO: 602770 - DNA, 14 bp, D. melanogaster
cagaaaatatttat

SEQ ID NO: 602771 - DNA, 13 bp, D. melanogaster
cagaaaatcaaat

SEQ ID NO: 602772 - DNA, 13 bp, D. melanogaster
cagaaaatcaata

SEQ ID NO: 602773 - DNA, 13 bp, D. melanogaster
cagaaaatcgaaa

SEQ ID NO: 602774 - DNA, 13 bp, D. melanogaster
cagaaaatgacaa

SEQ ID NO: 602775 - DNA, 14 bp, D. melanogaster
cagaaaatgacaaa

SEQ ID NO: 602776 - DNA, 14 bp, D. melanogaster
cagaaaatgcaaaa

SEQ ID NO: 602777 - DNA, 13 bp, D. melanogaster
cagaaaatgtatt

SEQ ID NO: 602778 - DNA, 13 bp, D. melanogaster
cagaaacaacaat

SEQ ID NO: 602779 - DNA, 13 bp, D. melanogaster
cagaaacaatgcc

SEQ ID NO: 602780 - DNA, 13 bp, D. melanogaster
cagaaacaattaa

SEQ ID NO: 602781 - DNA, 14 bp, D. melanogaster
cagaaacacacttt

SEQ ID NO: 602782 - DNA, 14 bp, D. melanogaster
cagaaacagaaact

SEQ ID NO: 602783 - DNA, 13 bp, D. melanogaster
cagaaacagaaat

SEQ ID NO: 602784 - DNA, 13 bp, D. melanogaster
cagaaacagaatc

SEQ ID NO: 602785 - DNA, 13 bp, D. melanogaster
cagaaacagatac

SEQ ID NO: 602786 - DNA, 14 bp, D. melanogaster
cagaaacagcagca

SEQ ID NO: 602787 - DNA, 14 bp, D. melanogaster
cagaaacaggcagc

SEQ ID NO: 602788 - DNA, 13 bp, D. melanogaster
cagaaaccagttt

SEQ ID NO: 602789 - DNA, 13 bp, D. melanogaster
cagaaaccgaact

SEQ ID NO: 602790 - DNA, 13 bp, D. melanogaster
cagaaactgaaac

SEQ ID NO: 602791 - DNA, 14 bp, D. melanogaster
cagaaactgaaaca

SEQ ID NO: 602792 - DNA, 13 bp, D. melanogaster
cagaaagaaaatt

SEQ ID NO: 602793 - DNA, 13 bp, D. melanogaster
cagaaagaaatat

SEQ ID NO: 602794 - DNA, 13 bp, D. melanogaster
cagaaagaaattt

SEQ ID NO: 602795 - DNA, 13 bp, D. melanogaster
cagaaagagacgg

SEQ ID NO: 602796 - DNA, 13 bp, D. melanogaster
cagaaagagagcg

SEQ ID NO: 602797 - DNA, 14 bp, D. melanogaster
cagaaagagagggc

SEQ ID NO: 602798 - DNA, 13 bp, D. melanogaster
cagaaagccagaa

SEQ ID NO: 602799 - DNA, 14 bp, D. melanogaster
cagaaagccagaaa

SEQ ID NO: 602800 - DNA, 13 bp, D. melanogaster
cagaaagctgaaa

SEQ ID NO: 602801 - DNA, 13 bp, D. melanogaster
cagaaagtaaata

SEQ ID NO: 602802 - DNA, 13 bp, D. melanogaster
cagaaagtagttg

SEQ ID NO: 602803 - DNA, 13 bp, D. melanogaster
cagaaagtatgct

SEQ ID NO: 602804 - DNA, 13 bp, D. melanogaster
cagaaagtcaaaa

SEQ ID NO: 602805 - DNA, 14 bp, D. melanogaster
cagaaagtcaaaaa

SEQ ID NO: 602806 - DNA, 13 bp, D. melanogaster
cagaaataaatta

SEQ ID NO: 602807 - DNA, 13 bp, D. melanogaster
cagaaataaattc

SEQ ID NO: 602808 - DNA, 13 bp, D. melanogaster
cagaaatagaaac

SEQ ID NO: 602809 - DNA, 14 bp, D. melanogaster
cagaaatagaaata

SEQ ID NO: 602810 - DNA, 13 bp, D. melanogaster
cagaaatagattt

SEQ ID NO: 602811 - DNA, 13 bp, D. melanogaster
cagaaatatgaaa

SEQ ID NO: 602812 - DNA, 13 bp, D. melanogaster
cagaaatatgcaa

SEQ ID NO: 602813 - DNA, 13 bp, D. melanogaster
cagaaatcaaaac

SEQ ID NO: 602814 - DNA, 13 bp, D. melanogaster
cagaaatcaaaca

SEQ ID NO: 602815 - DNA, 13 bp, D. melanogaster
cagaaatcagaaa

SEQ ID NO: 602816 - DNA, 14 bp, D. melanogaster
cagaaatcagaaat

SEQ ID NO: 602817 - DNA, 13 bp, D. melanogaster
cagaaatcgcata

SEQ ID NO: 602818 - DNA, 13 bp, D. melanogaster
cagaaatcgccag

SEQ ID NO: 602819 - DNA, 13 bp, D. melanogaster
cagaaatgaaatg

SEQ ID NO: 602820 - DNA, 13 bp, D. melanogaster
cagaaatgcattt

SEQ ID NO: 602821 - DNA, 13 bp, D. melanogaster
cagaaatggaaaa

SEQ ID NO: 602822 - DNA, 13 bp, D. melanogaster
cagaaatggaaat

SEQ ID NO: 602823 - DNA, 13 bp, D. melanogaster
cagaaatggcaac

SEQ ID NO: 602824 - DNA, 14 bp, D. melanogaster
cagaaatggcaact

SEQ ID NO: 602825 - DNA, 13 bp, D. melanogaster
cagaaatggttct

SEQ ID NO: 602826 - DNA, 13 bp, D. melanogaster
cagaaatgtgaaa

SEQ ID NO: 602827 - DNA, 13 bp, D. melanogaster
cagaaattataaa

SEQ ID NO: 602828 - DNA, 13 bp, D. melanogaster
cagaaattatgtt

SEQ ID NO: 602829 - DNA, 13 bp, D. melanogaster
cagaaattattta

SEQ ID NO: 602830 - DNA, 14 bp, D. melanogaster
cagaaattcgtact

SEQ ID NO: 602831 - DNA, 13 bp, D. melanogaster
cagaaatttaaaa

SEQ ID NO: 602832 - DNA, 13 bp, D. melanogaster
cagaaatttacaa

SEQ ID NO: 602833 - DNA, 13 bp, D. melanogaster
cagaaatttccct

SEQ ID NO: 602834 - DNA, 13 bp, D. melanogaster
cagaaattttaaa

SEQ ID NO: 602835 - DNA, 13 bp, D. melanogaster
cagaaattttgtt

SEQ ID NO: 602836 - DNA, 14 bp, D. melanogaster
cagaacaactacaa

SEQ ID NO: 602837 - DNA, 13 bp, D. melanogaster
cagaacaagaatt

SEQ ID NO: 602838 - DNA, 13 bp, D. melanogaster
cagaacaagagtt

SEQ ID NO: 602839 - DNA, 15 bp, D. melanogaster
cagaacaagcattgg

SEQ ID NO: 602840 - DNA, 13 bp, D. melanogaster
cagaacacagaac

SEQ ID NO: 602841 - DNA, 13 bp, D. melanogaster
cagaacagtttca

SEQ ID NO: 602842 - DNA, 13 bp, D. melanogaster
cagaacatcgccc

SEQ ID NO: 602843 - DNA, 13 bp, D. melanogaster
cagaacatgtgct

SEQ ID NO: 602844 - DNA, 13 bp, D. melanogaster
cagaaccagaaac

SEQ ID NO: 602845 - DNA, 14 bp, D. melanogaster
cagaaccagaacca

SEQ ID NO: 602846 - DNA, 13 bp, D. melanogaster
cagaaccagaagc

SEQ ID NO: 602847 - DNA, 13 bp, D. melanogaster
cagaaccatttct

SEQ ID NO: 602848 - DNA, 13 bp, D. melanogaster
cagaacccagaac

SEQ ID NO: 602849 - DNA, 13 bp, D. melanogaster
cagaactaaccaa

SEQ ID NO: 602850 - DNA, 13 bp, D. melanogaster
cagaacttaaaaa

SEQ ID NO: 602851 - DNA, 13 bp, D. melanogaster
cagaactttcaac

SEQ ID NO: 602852 - DNA, 13 bp, D. melanogaster
cagaagacagaag

SEQ ID NO: 602853 - DNA, 13 bp, D. melanogaster
cagaagactcaca

SEQ ID NO: 602854 - DNA, 13 bp, D. melanogaster
cagaagagcaaca

SEQ ID NO: 602855 - DNA, 13 bp, D. melanogaster
cagaagagcgaag

SEQ ID NO: 602856 - DNA, 14 bp, D. melanogaster
cagaagagtctgca

SEQ ID NO: 602857 - DNA, 14 bp, D. melanogaster
cagaagatgtggat

SEQ ID NO: 602858 - DNA, 13 bp, D. melanogaster
cagaagcaaaagc

SEQ ID NO: 602859 - DNA, 14 bp, D. melanogaster
cagaagcaaaagca

SEQ ID NO: 602860 - DNA, 14 bp, D. melanogaster
cagaagcaacagca

SEQ ID NO: 602861 - DNA, 13 bp, D. melanogaster
cagaagcagacca

SEQ ID NO: 602862 - DNA, 13 bp, D. melanogaster
cagaagcagcaaa

SEQ ID NO: 602863 - DNA, 14 bp, D. melanogaster
cagaagcagcaaca

SEQ ID NO: 602864 - DNA, 14 bp, D. melanogaster
cagaagcagcagaa

SEQ ID NO: 602865 - DNA, 13 bp, D. melanogaster
cagaagcagcggc

SEQ ID NO: 602866 - DNA, 13 bp, D. melanogaster
cagaagcagctgc

SEQ ID NO: 602867 - DNA, 14 bp, D. melanogaster
cagaagcaggagca

SEQ ID NO: 602868 - DNA, 13 bp, D. melanogaster
cagaagccagaag

SEQ ID NO: 602869 - DNA, 13 bp, D. melanogaster
cagaagccgcagc

SEQ ID NO: 602870 - DNA, 13 bp, D. melanogaster
cagaagcggaaaa

SEQ ID NO: 602871 - DNA, 13 bp, D. melanogaster
cagaagcggcagc

SEQ ID NO: 602872 - DNA, 13 bp, D. melanogaster
cagaagctgaagc

SEQ ID NO: 602873 - DNA, 13 bp, D. melanogaster
cagaaggaaaagc

SEQ ID NO: 602874 - DNA, 13 bp, D. melanogaster
cagaaggaagcgt

SEQ ID NO: 602875 - DNA, 13 bp, D. melanogaster
cagaaggaggcca

SEQ ID NO: 602876 - DNA, 13 bp, D. melanogaster
cagaaggcagaag

SEQ ID NO: 602877 - DNA, 13 bp, D. melanogaster
cagaagggtatct

SEQ ID NO: 602878 - DNA, 13 bp, D. melanogaster
cagaagtattaaa

SEQ ID NO: 602879 - DNA, 13 bp, D. melanogaster
cagaagtggcagc

SEQ ID NO: 602880 - DNA, 14 bp, D. melanogaster
cagaagttcttaaa

SEQ ID NO: 602881 - DNA, 13 bp, D. melanogaster
cagaataaatata

SEQ ID NO: 602882 - DNA, 13 bp, D. melanogaster
cagaataatactt

SEQ ID NO: 602883 - DNA, 13 bp, D. melanogaster
cagaatcaaggac

SEQ ID NO: 602884 - DNA, 14 bp, D. melanogaster
cagaatcaattgca

SEQ ID NO: 602885 - DNA, 13 bp, D. melanogaster
cagaatcagaaac

SEQ ID NO: 602886 - DNA, 14 bp, D. melanogaster
cagaatcagaatca

SEQ ID NO: 602887 - DNA, 13 bp, D. melanogaster
cagaatcagaatg

SEQ ID NO: 602888 - DNA, 13 bp, D. melanogaster
cagaatcagacat

SEQ ID NO: 602889 - DNA, 13 bp, D. melanogaster
cagaatcagccaa

SEQ ID NO: 602890 - DNA, 13 bp, D. melanogaster
cagaatccacata

SEQ ID NO: 602891 - DNA, 13 bp, D. melanogaster
cagaatccgaatc

SEQ ID NO: 602892 - DNA, 13 bp, D. melanogaster
cagaatcgaaatc

SEQ ID NO: 602893 - DNA, 13 bp, D. melanogaster
cagaatcggaatc

SEQ ID NO: 602894 - DNA, 14 bp, D. melanogaster
cagaatcgtttccc

SEQ ID NO: 602895 - DNA, 13 bp, D. melanogaster
cagaatctgaatc

SEQ ID NO: 602896 - DNA, 13 bp, D. melanogaster
cagaatctgagca

SEQ ID NO: 602897 - DNA, 14 bp, D. melanogaster
cagaatctttgatt

SEQ ID NO: 602898 - DNA, 13 bp, D. melanogaster
cagaatgagaggc

SEQ ID NO: 602899 - DNA, 13 bp, D. melanogaster
cagaatgcaatga

SEQ ID NO: 602900 - DNA, 13 bp, D. melanogaster
cagaatgcacacc

SEQ ID NO: 602901 - DNA, 13 bp, D. melanogaster
cagaatggaaaaa

SEQ ID NO: 602902 - DNA, 13 bp, D. melanogaster
cagaatgtaatgt

SEQ ID NO: 602903 - DNA, 14 bp, D. melanogaster
cagaatgtggcagc

SEQ ID NO: 602904 - DNA, 14 bp, D. melanogaster
cagaattaatgaaa

SEQ ID NO: 602905 - DNA, 13 bp, D. melanogaster
cagaattatgaaa

SEQ ID NO: 602906 - DNA, 13 bp, D. melanogaster
cagaatttaatgt

SEQ ID NO: 602907 - DNA, 13 bp, D. melanogaster
cagaatttgcatt

SEQ ID NO: 602908 - DNA, 13 bp, D. melanogaster
cagaattttaaat

SEQ ID NO: 602909 - DNA, 13 bp, D. melanogaster
cagacaaaaatat

SEQ ID NO: 602910 - DNA, 13 bp, D. melanogaster
cagacaaaatatt

SEQ ID NO: 602911 - DNA, 13 bp, D. melanogaster
cagacaaacagac

SEQ ID NO: 602912 - DNA, 13 bp, D. melanogaster
cagacaaacgaga

SEQ ID NO: 602913 - DNA, 13 bp, D. melanogaster
cagacaaataaat

SEQ ID NO: 602914 - DNA, 13 bp, D. melanogaster
cagacaacagaca

SEQ ID NO: 602915 - DNA, 13 bp, D. melanogaster
cagacaataaaac

SEQ ID NO: 602916 - DNA, 14 bp, D. melanogaster
cagacaattatttt

SEQ ID NO: 602917 - DNA, 13 bp, D. melanogaster
cagacacacaaag

SEQ ID NO: 602918 - DNA, 14 bp, D. melanogaster
cagacacacacgca

SEQ ID NO: 602919 - DNA, 13 bp, D. melanogaster
cagacacacagac

SEQ ID NO: 602920 - DNA, 14 bp, D. melanogaster
cagacacacagaca

SEQ ID NO: 602921 - DNA, 13 bp, D. melanogaster
cagacacacagat

SEQ ID NO: 602922 - DNA, 14 bp, D. melanogaster
cagacacacagata

SEQ ID NO: 602923 - DNA, 13 bp, D. melanogaster
cagacacacgcac

SEQ ID NO: 602924 - DNA, 13 bp, D. melanogaster
cagacacagatac

SEQ ID NO: 602925 - DNA, 14 bp, D. melanogaster
cagacacagataca

SEQ ID NO: 602926 - DNA, 13 bp, D. melanogaster
cagacacgcacac

SEQ ID NO: 602927 - DNA, 13 bp, D. melanogaster
cagacagaaagag

SEQ ID NO: 602928 - DNA, 13 bp, D. melanogaster
cagacagacaaac

SEQ ID NO: 602929 - DNA, 14 bp, D. melanogaster
cagacagacacaca

SEQ ID NO: 602930 - DNA, 13 bp, D. melanogaster
cagacagacagaa

SEQ ID NO: 602931 - DNA, 13 bp, D. melanogaster
cagacagacagac

SEQ ID NO: 602932 - DNA, 14 bp, D. melanogaster
cagacagacagaca

SEQ ID NO: 602933 - DNA, 14 bp, D. melanogaster
cagacagacagacg

SEQ ID NO: 602934 - DNA, 13 bp, D. melanogaster
cagacagacagat

SEQ ID NO: 602935 - DNA, 14 bp, D. melanogaster
cagacagacagata

SEQ ID NO: 602936 - DNA, 13 bp, D. melanogaster
cagacagacggac

SEQ ID NO: 602937 - DNA, 14 bp, D. melanogaster
cagacagacggaca

SEQ ID NO: 602938 - DNA, 13 bp, D. melanogaster
cagacagagacag

SEQ ID NO: 602939 - DNA, 13 bp, D. melanogaster
cagacagagacgg

SEQ ID NO: 602940 - DNA, 14 bp, D. melanogaster
cagacagagagaga

SEQ ID NO: 602941 - DNA, 13 bp, D. melanogaster
cagacagccaaat

SEQ ID NO: 602942 - DNA, 13 bp, D. melanogaster
cagacaggcagac

SEQ ID NO: 602943 - DNA, 13 bp, D. melanogaster
cagacaggcaggc

SEQ ID NO: 602944 - DNA, 15 bp, D. melanogaster
cagacaggtaaatac

SEQ ID NO: 602945 - DNA, 13 bp, D. melanogaster
cagacatcgagcg

SEQ ID NO: 602946 - DNA, 13 bp, D. melanogaster
cagacattgatgg

SEQ ID NO: 602947 - DNA, 13 bp, D. melanogaster
cagaccaaagaca

SEQ ID NO: 602948 - DNA, 13 bp, D. melanogaster
cagaccagaccag

SEQ ID NO: 602949 - DNA, 14 bp, D. melanogaster
cagacccagaccca

SEQ ID NO: 602950 - DNA, 13 bp, D. melanogaster
cagaccctttttt

SEQ ID NO: 602951 - DNA, 13 bp, D. melanogaster
cagacgacaacga

SEQ ID NO: 602952 - DNA, 13 bp, D. melanogaster
cagacgcacacat

SEQ ID NO: 602953 - DNA, 13 bp, D. melanogaster
cagacgcagacac

SEQ ID NO: 602954 - DNA, 13 bp, D. melanogaster
cagacggacggac

SEQ ID NO: 602955 - DNA, 13 bp, D. melanogaster
cagacggattttg

SEQ ID NO: 602956 - DNA, 13 bp, D. melanogaster
cagacggattttt

SEQ ID NO: 602957 - DNA, 13 bp, D. melanogaster
cagactcacacac

SEQ ID NO: 602958 - DNA, 13 bp, D. melanogaster
cagactcagactc

SEQ ID NO: 602959 - DNA, 13 bp, D. melanogaster
cagactgcagact

SEQ ID NO: 602960 - DNA, 14 bp, D. melanogaster
cagactggaatgga

SEQ ID NO: 602961 - DNA, 13 bp, D. melanogaster
cagacttatcgtc

SEQ ID NO: 602962 - DNA, 13 bp, D. melanogaster
cagagaaaaaagt

SEQ ID NO: 602963 - DNA, 13 bp, D. melanogaster
cagagaaaaatgc

SEQ ID NO: 602964 - DNA, 13 bp, D. melanogaster
cagagaaaaatgt

SEQ ID NO: 602965 - DNA, 13 bp, D. melanogaster
cagagaaaacaat

SEQ ID NO: 602966 - DNA, 13 bp, D. melanogaster
cagagaaaattaa

SEQ ID NO: 602967 - DNA, 13 bp, D. melanogaster
cagagaaagaaat

SEQ ID NO: 602968 - DNA, 13 bp, D. melanogaster
cagagaaagagac

SEQ ID NO: 602969 - DNA, 14 bp, D. melanogaster
cagagaaagcaaac

SEQ ID NO: 602970 - DNA, 14 bp, D. melanogaster
cagagaaagccaag

SEQ ID NO: 602971 - DNA, 13 bp, D. melanogaster
cagagaaaggcca

SEQ ID NO: 602972 - DNA, 14 bp, D. melanogaster
cagagaactgcaag

SEQ ID NO: 602973 - DNA, 13 bp, D. melanogaster
cagagaactgcag

SEQ ID NO: 602974 - DNA, 14 bp, D. melanogaster
cagagaactgcagc

SEQ ID NO: 602975 - DNA, 13 bp, D. melanogaster
cagagaactggtt

SEQ ID NO: 602976 - DNA, 13 bp, D. melanogaster
cagagaaggaata

SEQ ID NO: 602977 - DNA, 13 bp, D. melanogaster
cagagaatggcaa

SEQ ID NO: 602978 - DNA, 13 bp, D. melanogaster
cagagacaaaagc

SEQ ID NO: 602979 - DNA, 14 bp, D. melanogaster
cagagacagagaga

SEQ ID NO: 602980 - DNA, 13 bp, D. melanogaster
cagagagaaaatc

SEQ ID NO: 602981 - DNA, 13 bp, D. melanogaster
cagagagaaaatg

SEQ ID NO: 602982 - DNA, 13 bp, D. melanogaster
cagagagacagac

SEQ ID NO: 602983 - DNA, 13 bp, D. melanogaster
cagagagagaaat

SEQ ID NO: 602984 - DNA, 13 bp, D. melanogaster
cagagagagccac

SEQ ID NO: 602985 - DNA, 13 bp, D. melanogaster
cagagagcgaaaa

SEQ ID NO: 602986 - DNA, 13 bp, D. melanogaster
cagagatacagat

SEQ ID NO: 602987 - DNA, 14 bp, D. melanogaster
cagagatacagata

SEQ ID NO: 602988 - DNA, 14 bp, D. melanogaster
cagagattggaaag

SEQ ID NO: 602989 - DNA, 13 bp, D. melanogaster
cagagattttgcg

SEQ ID NO: 602990 - DNA, 13 bp, D. melanogaster
cagagcaaacaca

SEQ ID NO: 602991 - DNA, 13 bp, D. melanogaster
cagagcaaaggag

SEQ ID NO: 602992 - DNA, 13 bp, D. melanogaster
cagagcaacagca

SEQ ID NO: 602993 - DNA, 13 bp, D. melanogaster
cagagcagagaaa

SEQ ID NO: 602994 - DNA, 13 bp, D. melanogaster
cagagcagagcaa

SEQ ID NO: 602995 - DNA, 13 bp, D. melanogaster
cagagcagagcag

SEQ ID NO: 602996 - DNA, 14 bp, D. melanogaster
cagagcagagcaga

SEQ ID NO: 602997 - DNA, 13 bp, D. melanogaster
cagagcagcaaaa

SEQ ID NO: 602998 - DNA, 13 bp, D. melanogaster
cagagcaggagct

SEQ ID NO: 602999 - DNA, 13 bp, D. melanogaster
cagagcatttgct

SEQ ID NO: 603000 - DNA, 13 bp, D. melanogaster
cagagccaaaaac

SEQ ID NO: 603001 - DNA, 13 bp, D. melanogaster
cagagccaacaca

SEQ ID NO: 603002 - DNA, 14 bp, D. melanogaster
cagagccagagcca

SEQ ID NO: 603003 - DNA, 13 bp, D. melanogaster
cagagcgagacgg

SEQ ID NO: 603004 - DNA, 13 bp, D. melanogaster
cagagcgagagag

SEQ ID NO: 603005 - DNA, 13 bp, D. melanogaster
cagagcgagaggg

SEQ ID NO: 603006 - DNA, 13 bp, D. melanogaster
cagagcgcaaaaa

SEQ ID NO: 603007 - DNA, 13 bp, D. melanogaster
cagagcgttgtgc

SEQ ID NO: 603008 - DNA, 13 bp, D. melanogaster
cagaggaagcaga

SEQ ID NO: 603009 - DNA, 13 bp, D. melanogaster
cagaggaatctct

SEQ ID NO: 603010 - DNA, 13 bp, D. melanogaster
cagaggagcagag

SEQ ID NO: 603011 - DNA, 13 bp, D. melanogaster
cagaggcaacggc

SEQ ID NO: 603012 - DNA, 13 bp, D. melanogaster
cagaggcagaggc

SEQ ID NO: 603013 - DNA, 14 bp, D. melanogaster
cagaggcagaggca

SEQ ID NO: 603014 - DNA, 13 bp, D. melanogaster
cagaggcagcgac

SEQ ID NO: 603015 - DNA, 13 bp, D. melanogaster
cagaggcagcggc

SEQ ID NO: 603016 - DNA, 13 bp, D. melanogaster
cagaggcagtggc

SEQ ID NO: 603017 - DNA, 13 bp, D. melanogaster
cagaggctttctt

SEQ ID NO: 603018 - DNA, 13 bp, D. melanogaster
cagaggggatgga

SEQ ID NO: 603019 - DNA, 13 bp, D. melanogaster
cagagggtcaaaa

SEQ ID NO: 603020 - DNA, 13 bp, D. melanogaster
cagaggtagacga

SEQ ID NO: 603021 - DNA, 13 bp, D. melanogaster
cagaggtggtcaa

SEQ ID NO: 603022 - DNA, 13 bp, D. melanogaster
cagagtcaaatgc

SEQ ID NO: 603023 - DNA, 13 bp, D. melanogaster
cagagtcagagtc

SEQ ID NO: 603024 - DNA, 13 bp, D. melanogaster
cagagtcctgatc

SEQ ID NO: 603025 - DNA, 13 bp, D. melanogaster
cagagtgccaaca

SEQ ID NO: 603026 - DNA, 13 bp, D. melanogaster
cagagttcagagt

SEQ ID NO: 603027 - DNA, 13 bp, D. melanogaster
cagagttcccagt

SEQ ID NO: 603028 - DNA, 13 bp, D. melanogaster
cagagttgccacc

SEQ ID NO: 603029 - DNA, 13 bp, D. melanogaster
cagagttttcatt

SEQ ID NO: 603030 - DNA, 14 bp, D. melanogaster
cagagttttcattg

SEQ ID NO: 603031 - DNA, 13 bp, D. melanogaster
cagagttttccca

SEQ ID NO: 603032 - DNA, 14 bp, D. melanogaster
cagataaaagatca

SEQ ID NO: 603033 - DNA, 13 bp, D. melanogaster
cagataaacaaac

SEQ ID NO: 603034 - DNA, 13 bp, D. melanogaster
cagataaatataa

SEQ ID NO: 603035 - DNA, 13 bp, D. melanogaster
cagataaatattt

SEQ ID NO: 603036 - DNA, 13 bp, D. melanogaster
cagataactaaca

SEQ ID NO: 603037 - DNA, 13 bp, D. melanogaster
cagatacaaaagt

SEQ ID NO: 603038 - DNA, 13 bp, D. melanogaster
cagatacaaatac

SEQ ID NO: 603039 - DNA, 13 bp, D. melanogaster
cagatacaaatgc

SEQ ID NO: 603040 - DNA, 13 bp, D. melanogaster
cagatacaaatgt

SEQ ID NO: 603041 - DNA, 13 bp, D. melanogaster
cagatacaaattg

SEQ ID NO: 603042 - DNA, 13 bp, D. melanogaster
cagatacacaaac

SEQ ID NO: 603043 - DNA, 14 bp, D. melanogaster
cagatacacacgca

SEQ ID NO: 603044 - DNA, 13 bp, D. melanogaster
cagatacacactc

SEQ ID NO: 603045 - DNA, 13 bp, D. melanogaster
cagatacagacac

SEQ ID NO: 603046 - DNA, 14 bp, D. melanogaster
cagatacagataca

SEQ ID NO: 603047 - DNA, 14 bp, D. melanogaster
cagatacagatacc

SEQ ID NO: 603048 - DNA, 14 bp, D. melanogaster
cagatacagatacg

SEQ ID NO: 603049 - DNA, 14 bp, D. melanogaster
cagatacagatact

SEQ ID NO: 603050 - DNA, 13 bp, D. melanogaster
cagatacagatat

SEQ ID NO: 603051 - DNA, 13 bp, D. melanogaster
cagatacatagat

SEQ ID NO: 603052 - DNA, 13 bp, D. melanogaster
cagatacattcgc

SEQ ID NO: 603053 - DNA, 14 bp, D. melanogaster
cagatacatttaca

SEQ ID NO: 603054 - DNA, 13 bp, D. melanogaster
cagatacatttgt

SEQ ID NO: 603055 - DNA, 13 bp, D. melanogaster
cagataccagata

SEQ ID NO: 603056 - DNA, 13 bp, D. melanogaster
cagatacccatta

SEQ ID NO: 603057 - DNA, 13 bp, D. melanogaster
cagatacccttta

SEQ ID NO: 603058 - DNA, 13 bp, D. melanogaster
cagatacggatac

SEQ ID NO: 603059 - DNA, 14 bp, D. melanogaster
cagatacggataca

SEQ ID NO: 603060 - DNA, 13 bp, D. melanogaster
cagatactcacac

SEQ ID NO: 603061 - DNA, 14 bp, D. melanogaster
cagatactcacaca

SEQ ID NO: 603062 - DNA, 13 bp, D. melanogaster
cagatacttttgc

SEQ ID NO: 603063 - DNA, 13 bp, D. melanogaster
cagatacttttgt

SEQ ID NO: 603064 - DNA, 13 bp, D. melanogaster
cagatactttttg

SEQ ID NO: 603065 - DNA, 13 bp, D. melanogaster
cagatagaaattc

SEQ ID NO: 603066 - DNA, 13 bp, D. melanogaster
cagatagagatac

SEQ ID NO: 603067 - DNA, 13 bp, D. melanogaster
cagatagatagat

SEQ ID NO: 603068 - DNA, 14 bp, D. melanogaster
cagatagatagata

SEQ ID NO: 603069 - DNA, 13 bp, D. melanogaster
cagatagcagata

SEQ ID NO: 603070 - DNA, 14 bp, D. melanogaster
cagatagccaaaaa

SEQ ID NO: 603071 - DNA, 13 bp, D. melanogaster
cagatagcgagag

SEQ ID NO: 603072 - DNA, 13 bp, D. melanogaster
cagatataaatat

SEQ ID NO: 603073 - DNA, 14 bp, D. melanogaster
cagatatagataca

SEQ ID NO: 603074 - DNA, 13 bp, D. melanogaster
cagatatagatat

SEQ ID NO: 603075 - DNA, 13 bp, D. melanogaster
cagatatatatat

SEQ ID NO: 603076 - DNA, 13 bp, D. melanogaster
cagatatatgtac

SEQ ID NO: 603077 - DNA, 13 bp, D. melanogaster
cagatatatgtat

SEQ ID NO: 603078 - DNA, 14 bp, D. melanogaster
cagatatatgtata

SEQ ID NO: 603079 - DNA, 13 bp, D. melanogaster
cagatatatttta

SEQ ID NO: 603080 - DNA, 13 bp, D. melanogaster
cagatatcagata

SEQ ID NO: 603081 - DNA, 13 bp, D. melanogaster
cagatatccaatt

SEQ ID NO: 603082 - DNA, 13 bp, D. melanogaster
cagatatgtatat

SEQ ID NO: 603083 - DNA, 13 bp, D. melanogaster
cagatattattca

SEQ ID NO: 603084 - DNA, 13 bp, D. melanogaster
cagatattccatt

SEQ ID NO: 603085 - DNA, 14 bp, D. melanogaster
cagatattccatta

SEQ ID NO: 603086 - DNA, 13 bp, D. melanogaster
cagatcaacacaa

SEQ ID NO: 603087 - DNA, 13 bp, D. melanogaster
cagatcaagcatt

SEQ ID NO: 603088 - DNA, 13 bp, D. melanogaster
cagatcaattttt

SEQ ID NO: 603089 - DNA, 14 bp, D. melanogaster
cagatcagatcaga

SEQ ID NO: 603090 - DNA, 14 bp, D. melanogaster
cagatcatttaaat

SEQ ID NO: 603091 - DNA, 13 bp, D. melanogaster
cagatccacatcc

SEQ ID NO: 603092 - DNA, 13 bp, D. melanogaster
cagatccagatcc

SEQ ID NO: 603093 - DNA, 13 bp, D. melanogaster
cagatcccagatc

SEQ ID NO: 603094 - DNA, 14 bp, D. melanogaster
cagatcccagatcc

SEQ ID NO: 603095 - DNA, 14 bp, D. melanogaster
cagatcgactcggc

SEQ ID NO: 603096 - DNA, 13 bp, D. melanogaster
cagatcgcttttt

SEQ ID NO: 603097 - DNA, 13 bp, D. melanogaster
cagatcggatcgg

SEQ ID NO: 603098 - DNA, 13 bp, D. melanogaster
cagatgaactccc

SEQ ID NO: 603099 - DNA, 14 bp, D. melanogaster
cagatgcaaatgca

SEQ ID NO: 603100 - DNA, 13 bp, D. melanogaster
cagatgcaaatgt

SEQ ID NO: 603101 - DNA, 13 bp, D. melanogaster
cagatgcacatgc

SEQ ID NO: 603102 - DNA, 14 bp, D. melanogaster
cagatgcagataca

SEQ ID NO: 603103 - DNA, 14 bp, D. melanogaster
cagatgcagatgca

SEQ ID NO: 603104 - DNA, 13 bp, D. melanogaster
cagatgcagatgt

SEQ ID NO: 603105 - DNA, 13 bp, D. melanogaster
cagatgcccagat

SEQ ID NO: 603106 - DNA, 13 bp, D. melanogaster
cagatgcggatac

SEQ ID NO: 603107 - DNA, 13 bp, D. melanogaster
cagatgcggatgc

SEQ ID NO: 603108 - DNA, 13 bp, D. melanogaster
cagatgctccaca

SEQ ID NO: 603109 - DNA, 14 bp, D. melanogaster
cagatgctgctgct

SEQ ID NO: 603110 - DNA, 13 bp, D. melanogaster
cagatggaattgt

SEQ ID NO: 603111 - DNA, 13 bp, D. melanogaster
cagatggagatgc

SEQ ID NO: 603112 - DNA, 13 bp, D. melanogaster
cagatggatggat

SEQ ID NO: 603113 - DNA, 13 bp, D. melanogaster
cagatgtatggaa

SEQ ID NO: 603114 - DNA, 13 bp, D. melanogaster
cagatgtgtgtgt

SEQ ID NO: 603115 - DNA, 13 bp, D. melanogaster
cagatgttaagtg

SEQ ID NO: 603116 - DNA, 14 bp, D. melanogaster
cagatgttccaatt

SEQ ID NO: 603117 - DNA, 13 bp, D. melanogaster
cagattaaataaa

SEQ ID NO: 603118 - DNA, 13 bp, D. melanogaster
cagattaagatct

SEQ ID NO: 603119 - DNA, 13 bp, D. melanogaster
cagattatttatt

SEQ ID NO: 603120 - DNA, 14 bp, D. melanogaster
cagattcagataca

SEQ ID NO: 603121 - DNA, 13 bp, D. melanogaster
cagattcagatgc

SEQ ID NO: 603122 - DNA, 14 bp, D. melanogaster
cagattcagatgca

SEQ ID NO: 603123 - DNA, 13 bp, D. melanogaster
cagattcagattc

SEQ ID NO: 603124 - DNA, 14 bp, D. melanogaster
cagattcagattcg

SEQ ID NO: 603125 - DNA, 13 bp, D. melanogaster
cagattcagattt

SEQ ID NO: 603126 - DNA, 13 bp, D. melanogaster
cagattcagtttc

SEQ ID NO: 603127 - DNA, 13 bp, D. melanogaster
cagattccagatt

SEQ ID NO: 603128 - DNA, 13 bp, D. melanogaster
cagattcccacct

SEQ ID NO: 603129 - DNA, 13 bp, D. melanogaster
cagattccgattc

SEQ ID NO: 603130 - DNA, 13 bp, D. melanogaster
cagattcggattc

SEQ ID NO: 603131 - DNA, 13 bp, D. melanogaster
cagattctagaga

SEQ ID NO: 603132 - DNA, 13 bp, D. melanogaster
cagattggcttaa

SEQ ID NO: 603133 - DNA, 13 bp, D. melanogaster
cagatttaaattc

SEQ ID NO: 603134 - DNA, 13 bp, D. melanogaster
cagatttatttaa

SEQ ID NO: 603135 - DNA, 13 bp, D. melanogaster
cagatttattttc

SEQ ID NO: 603136 - DNA, 13 bp, D. melanogaster
cagatttcagatt

SEQ ID NO: 603137 - DNA, 13 bp, D. melanogaster
cagatttcagcaa

SEQ ID NO: 603138 - DNA, 13 bp, D. melanogaster
cagatttgactgc

SEQ ID NO: 603139 - DNA, 13 bp, D. melanogaster
cagatttgggaaa

SEQ ID NO: 603140 - DNA, 13 bp, D. melanogaster
cagatttgtggaa

SEQ ID NO: 603141 - DNA, 13 bp, D. melanogaster
cagattttcattt

SEQ ID NO: 603142 - DNA, 13 bp, D. melanogaster
cagattttgtaaa

SEQ ID NO: 603143 - DNA, 13 bp, D. melanogaster
cagatttttaaat

SEQ ID NO: 603144 - DNA, 13 bp, D. melanogaster
cagattttttgtt

SEQ ID NO: 603145 - DNA, 13 bp, D. melanogaster
cagcaaaaaaatg

SEQ ID NO: 603146 - DNA, 14 bp, D. melanogaster
cagcaaaaaacgta

SEQ ID NO: 603147 - DNA, 13 bp, D. melanogaster
cagcaaaaagcga

SEQ ID NO: 603148 - DNA, 13 bp, D. melanogaster
cagcaaaaagttg

SEQ ID NO: 603149 - DNA, 13 bp, D. melanogaster
cagcaaaaataat

SEQ ID NO: 603150 - DNA, 13 bp, D. melanogaster
cagcaaaaatgta

SEQ ID NO: 603151 - DNA, 13 bp, D. melanogaster
cagcaaaaatttt

SEQ ID NO: 603152 - DNA, 13 bp, D. melanogaster
cagcaaaacagca

SEQ ID NO: 603153 - DNA, 13 bp, D. melanogaster
cagcaaaacgact

SEQ ID NO: 603154 - DNA, 13 bp, D. melanogaster
cagcaaaagaaat

SEQ ID NO: 603155 - DNA, 13 bp, D. melanogaster
cagcaaaagcaat

SEQ ID NO: 603156 - DNA, 13 bp, D. melanogaster
cagcaaaaggcaa

SEQ ID NO: 603157 - DNA, 13 bp, D. melanogaster
cagcaaaaggcag

SEQ ID NO: 603158 - DNA, 13 bp, D. melanogaster
cagcaaaagtcaa

SEQ ID NO: 603159 - DNA, 13 bp, D. melanogaster
cagcaaaagttaa

SEQ ID NO: 603160 - DNA, 13 bp, D. melanogaster
cagcaaaagtttt

SEQ ID NO: 603161 - DNA, 13 bp, D. melanogaster
cagcaaaataaat

SEQ ID NO: 603162 - DNA, 13 bp, D. melanogaster
cagcaaaataata

SEQ ID NO: 603163 - DNA, 13 bp, D. melanogaster
cagcaaaatgaaa

SEQ ID NO: 603164 - DNA, 13 bp, D. melanogaster
cagcaaacaaatt

SEQ ID NO: 603165 - DNA, 13 bp, D. melanogaster
cagcaaacaacat

SEQ ID NO: 603166 - DNA, 13 bp, D. melanogaster
cagcaaacaacga

SEQ ID NO: 603167 - DNA, 13 bp, D. melanogaster
cagcaaacagcaa

SEQ ID NO: 603168 - DNA, 13 bp, D. melanogaster
cagcaaacagcag

SEQ ID NO: 603169 - DNA, 13 bp, D. melanogaster
cagcaaacatttt

SEQ ID NO: 603170 - DNA, 13 bp, D. melanogaster
cagcaaacccaat

SEQ ID NO: 603171 - DNA, 13 bp, D. melanogaster
cagcaaacgaaag

SEQ ID NO: 603172 - DNA, 13 bp, D. melanogaster
cagcaaacgccac

SEQ ID NO: 603173 - DNA, 13 bp, D. melanogaster
cagcaaacggaaa

SEQ ID NO: 603174 - DNA, 13 bp, D. melanogaster
cagcaaacggcaa

SEQ ID NO: 603175 - DNA, 13 bp, D. melanogaster
cagcaaactaaaa

SEQ ID NO: 603176 - DNA, 13 bp, D. melanogaster
cagcaaactacag

SEQ ID NO: 603177 - DNA, 13 bp, D. melanogaster
cagcaaactgcaa

SEQ ID NO: 603178 - DNA, 13 bp, D. melanogaster
cagcaaagcaatt

SEQ ID NO: 603179 - DNA, 13 bp, D. melanogaster
cagcaaagcagca

SEQ ID NO: 603180 - DNA, 13 bp, D. melanogaster
cagcaaagctaag

SEQ ID NO: 603181 - DNA, 13 bp, D. melanogaster
cagcaaagctgag

SEQ ID NO: 603182 - DNA, 13 bp, D. melanogaster
cagcaaaggcaaa

SEQ ID NO: 603183 - DNA, 13 bp, D. melanogaster
cagcaaaggcaac

SEQ ID NO: 603184 - DNA, 13 bp, D. melanogaster
cagcaaaggcgaa

SEQ ID NO: 603185 - DNA, 13 bp, D. melanogaster
cagcaaataaaca

SEQ ID NO: 603186 - DNA, 13 bp, D. melanogaster
cagcaaataaata

SEQ ID NO: 603187 - DNA, 14 bp, D. melanogaster
cagcaaataaataa

SEQ ID NO: 603188 - DNA, 13 bp, D. melanogaster
cagcaaataaatc

SEQ ID NO: 603189 - DNA, 13 bp, D. melanogaster
cagcaaatacaaa

SEQ ID NO: 603190 - DNA, 13 bp, D. melanogaster
cagcaaatagttt

SEQ ID NO: 603191 - DNA, 13 bp, D. melanogaster
cagcaaatatttt

SEQ ID NO: 603192 - DNA, 13 bp, D. melanogaster
cagcaaatcaaag

SEQ ID NO: 603193 - DNA, 13 bp, D. melanogaster
cagcaaatcgaat

SEQ ID NO: 603194 - DNA, 13 bp, D. melanogaster
cagcaaatgaaaa

SEQ ID NO: 603195 - DNA, 14 bp, D. melanogaster
cagcaaatgcaatt

SEQ ID NO: 603196 - DNA, 13 bp, D. melanogaster
cagcaaatgcaca

SEQ ID NO: 603197 - DNA, 13 bp, D. melanogaster
cagcaaatgcatt

SEQ ID NO: 603198 - DNA, 13 bp, D. melanogaster
cagcaaatgccaa

SEQ ID NO: 603199 - DNA, 13 bp, D. melanogaster
cagcaaatgctgg

SEQ ID NO: 603200 - DNA, 13 bp, D. melanogaster
cagcaaatgtggc

SEQ ID NO: 603201 - DNA, 13 bp, D. melanogaster
cagcaaattaaac

SEQ ID NO: 603202 - DNA, 13 bp, D. melanogaster
cagcaaattaatt

SEQ ID NO: 603203 - DNA, 13 bp, D. melanogaster
cagcaaattgaaa

SEQ ID NO: 603204 - DNA, 14 bp, D. melanogaster
cagcaaattgaaat

SEQ ID NO: 603205 - DNA, 13 bp, D. melanogaster
cagcaaattgaat

SEQ ID NO: 603206 - DNA, 14 bp, D. melanogaster
cagcaaattgaatt

SEQ ID NO: 603207 - DNA, 13 bp, D. melanogaster
cagcaaattgatt

SEQ ID NO: 603208 - DNA, 13 bp, D. melanogaster
cagcaaattgctt

SEQ ID NO: 603209 - DNA, 13 bp, D. melanogaster
cagcaaattggca

SEQ ID NO: 603210 - DNA, 13 bp, D. melanogaster
cagcaaatttaat

SEQ ID NO: 603211 - DNA, 13 bp, D. melanogaster
cagcaaatttatg

SEQ ID NO: 603212 - DNA, 13 bp, D. melanogaster
cagcaaatttatt

SEQ ID NO: 603213 - DNA, 13 bp, D. melanogaster
cagcaacaaaagc

SEQ ID NO: 603214 - DNA, 13 bp, D. melanogaster
cagcaacaaaagg

SEQ ID NO: 603215 - DNA, 13 bp, D. melanogaster
cagcaacaaaata

SEQ ID NO: 603216 - DNA, 13 bp, D. melanogaster
cagcaacaaaatt

SEQ ID NO: 603217 - DNA, 13 bp, D. melanogaster
cagcaacaaacag

SEQ ID NO: 603218 - DNA, 13 bp, D. melanogaster
cagcaacaaagcc

SEQ ID NO: 603219 - DNA, 13 bp, D. melanogaster
cagcaacaaaggc

SEQ ID NO: 603220 - DNA, 14 bp, D. melanogaster
cagcaacaaaggca

SEQ ID NO: 603221 - DNA, 13 bp, D. melanogaster
cagcaacaaagtc

SEQ ID NO: 603222 - DNA, 13 bp, D. melanogaster
cagcaacaaatag

SEQ ID NO: 603223 - DNA, 13 bp, D. melanogaster
cagcaacaaatgt

SEQ ID NO: 603224 - DNA, 13 bp, D. melanogaster
cagcaacaacaag

SEQ ID NO: 603225 - DNA, 14 bp, D. melanogaster
cagcaacaacaagt

SEQ ID NO: 603226 - DNA, 13 bp, D. melanogaster
cagcaacaacaat

SEQ ID NO: 603227 - DNA, 14 bp, D. melanogaster
cagcaacaacaatt

SEQ ID NO: 603228 - DNA, 13 bp, D. melanogaster
cagcaacaacacg

SEQ ID NO: 603229 - DNA, 13 bp, D. melanogaster
cagcaacaacaga

SEQ ID NO: 603230 - DNA, 14 bp, D. melanogaster
cagcaacaacagcg

SEQ ID NO: 603231 - DNA, 14 bp, D. melanogaster
cagcaacaacagct

SEQ ID NO: 603232 - DNA, 13 bp, D. melanogaster
cagcaacaacata

SEQ ID NO: 603233 - DNA, 13 bp, D. melanogaster
cagcaacaacatc

SEQ ID NO: 603234 - DNA, 14 bp, D. melanogaster
cagcaacaacatcg

SEQ ID NO: 603235 - DNA, 13 bp, D. melanogaster
cagcaacaacatg

SEQ ID NO: 603236 - DNA, 13 bp, D. melanogaster
cagcaacaacatt

SEQ ID NO: 603237 - DNA, 13 bp, D. melanogaster
cagcaacaacgaa

SEQ ID NO: 603238 - DNA, 13 bp, D. melanogaster
cagcaacaacgag

SEQ ID NO: 603239 - DNA, 13 bp, D. melanogaster
cagcaacaacggc

SEQ ID NO: 603240 - DNA, 14 bp, D. melanogaster
cagcaacaacggca

SEQ ID NO: 603241 - DNA, 14 bp, D. melanogaster
cagcaacaactgca

SEQ ID NO: 603242 - DNA, 13 bp, D. melanogaster
cagcaacaacttg

SEQ ID NO: 603243 - DNA, 13 bp, D. melanogaster
cagcaacaagagc

SEQ ID NO: 603244 - DNA, 13 bp, D. melanogaster
cagcaacaaggac

SEQ ID NO: 603245 - DNA, 14 bp, D. melanogaster
cagcaacaataaaa

SEQ ID NO: 603246 - DNA, 13 bp, D. melanogaster
cagcaacaataac

SEQ ID NO: 603247 - DNA, 13 bp, D. melanogaster
cagcaacaataag

SEQ ID NO: 603248 - DNA, 13 bp, D. melanogaster
cagcaacaatgca

SEQ ID NO: 603249 - DNA, 13 bp, D. melanogaster
cagcaacaatggc

SEQ ID NO: 603250 - DNA, 14 bp, D. melanogaster
cagcaacaattgca

SEQ ID NO: 603251 - DNA, 13 bp, D. melanogaster
cagcaacacagca

SEQ ID NO: 603252 - DNA, 14 bp, D. melanogaster
cagcaacaccaatg

SEQ ID NO: 603253 - DNA, 13 bp, D. melanogaster
cagcaacagcaaa

SEQ ID NO: 603254 - DNA, 13 bp, D. melanogaster
cagcaacagcaat

SEQ ID NO: 603255 - DNA, 14 bp, D. melanogaster
cagcaacagcacca

SEQ ID NO: 603256 - DNA, 13 bp, D. melanogaster
cagcaacagcaga

SEQ ID NO: 603257 - DNA, 23 bp, D. melanogaster
cagcaacagcagcagcaacaaca

SEQ ID NO: 603258 - DNA, 14 bp, D. melanogaster
cagcaacagcagcc

SEQ ID NO: 603259 - DNA, 14 bp, D. melanogaster
cagcaacagcagcg

SEQ ID NO: 603260 - DNA, 14 bp, D. melanogaster
cagcaacagcagct

SEQ ID NO: 603261 - DNA, 13 bp, D. melanogaster
cagcaacagcagt

SEQ ID NO: 603262 - DNA, 18 bp, D. melanogaster
cagcaacagcagtagcaa

SEQ ID NO: 603263 - DNA, 13 bp, D. melanogaster
cagcaacagcatt

SEQ ID NO: 603264 - DNA, 13 bp, D. melanogaster
cagcaacagccgc

SEQ ID NO: 603265 - DNA, 14 bp, D. melanogaster
cagcaacagcggca

SEQ ID NO: 603266 - DNA, 13 bp, D. melanogaster
cagcaacaggaaa

SEQ ID NO: 603267 - DNA, 13 bp, D. melanogaster
cagcaacaggagc

SEQ ID NO: 603268 - DNA, 14 bp, D. melanogaster
cagcaacatcaacg

SEQ ID NO: 603269 - DNA, 13 bp, D. melanogaster
cagcaacatcagt

SEQ ID NO: 603270 - DNA, 14 bp, D. melanogaster
cagcaacatcatca

SEQ ID NO: 603271 - DNA, 14 bp, D. melanogaster
cagcaacatctgca

SEQ ID NO: 603272 - DNA, 13 bp, D. melanogaster
cagcaacatgaaa

SEQ ID NO: 603273 - DNA, 14 bp, D. melanogaster
cagcaacatgcaac

SEQ ID NO: 603274 - DNA, 14 bp, D. melanogaster
cagcaacatgttgc

SEQ ID NO: 603275 - DNA, 13 bp, D. melanogaster
cagcaaccagaaa

SEQ ID NO: 603276 - DNA, 14 bp, D. melanogaster
cagcaaccagcaac

SEQ ID NO: 603277 - DNA, 13 bp, D. melanogaster
cagcaacctgcaa

SEQ ID NO: 603278 - DNA, 13 bp, D. melanogaster
cagcaacggcaat

SEQ ID NO: 603279 - DNA, 13 bp, D. melanogaster
cagcaacgtatcc

SEQ ID NO: 603280 - DNA, 13 bp, D. melanogaster
cagcaactacaac

SEQ ID NO: 603281 - DNA, 13 bp, D. melanogaster
cagcaactgcaaa

SEQ ID NO: 603282 - DNA, 13 bp, D. melanogaster
cagcaacttaatt

SEQ ID NO: 603283 - DNA, 14 bp, D. melanogaster
cagcaacttgcaac

SEQ ID NO: 603284 - DNA, 13 bp, D. melanogaster
cagcaagaaaaat

SEQ ID NO: 603285 - DNA, 13 bp, D. melanogaster
cagcaagaaggca

SEQ ID NO: 603286 - DNA, 16 bp, D. melanogaster
cagcaagaaggcagca

SEQ ID NO: 603287 - DNA, 14 bp, D. melanogaster
cagcaagaattaaa

SEQ ID NO: 603288 - DNA, 13 bp, D. melanogaster
cagcaagcagcaa

SEQ ID NO: 603289 - DNA, 13 bp, D. melanogaster
cagcaagccaaca

SEQ ID NO: 603290 - DNA, 14 bp, D. melanogaster
cagcaagctgagca

SEQ ID NO: 603291 - DNA, 13 bp, D. melanogaster
cagcaaggagcag

SEQ ID NO: 603292 - DNA, 13 bp, D. melanogaster
cagcaaggagttt

SEQ ID NO: 603293 - DNA, 13 bp, D. melanogaster
cagcaaggcaaaa

SEQ ID NO: 603294 - DNA, 13 bp, D. melanogaster
cagcaagtgaaaa

SEQ ID NO: 603295 - DNA, 13 bp, D. melanogaster
cagcaagtgcatt

SEQ ID NO: 603296 - DNA, 13 bp, D. melanogaster
cagcaagtggaaa

SEQ ID NO: 603297 - DNA, 13 bp, D. melanogaster
cagcaataaattt

SEQ ID NO: 603298 - DNA, 13 bp, D. melanogaster
cagcaataacaaa

SEQ ID NO: 603299 - DNA, 13 bp, D. melanogaster
cagcaataacaac

SEQ ID NO: 603300 - DNA, 14 bp, D. melanogaster
cagcaataacaaca

SEQ ID NO: 603301 - DNA, 13 bp, D. melanogaster
cagcaataacaat

SEQ ID NO: 603302 - DNA, 13 bp, D. melanogaster
cagcaatagcaat

SEQ ID NO: 603303 - DNA, 13 bp, D. melanogaster
cagcaatagcagc

SEQ ID NO: 603304 - DNA, 14 bp, D. melanogaster
cagcaatagcagca

SEQ ID NO: 603305 - DNA, 13 bp, D. melanogaster
cagcaatatatct

SEQ ID NO: 603306 - DNA, 13 bp, D. melanogaster
cagcaatcaaaaa

SEQ ID NO: 603307 - DNA, 14 bp, D. melanogaster
cagcaatcaaaaat

SEQ ID NO: 603308 - DNA, 13 bp, D. melanogaster
cagcaatgaaaaa

SEQ ID NO: 603309 - DNA, 13 bp, D. melanogaster
cagcaatgcaaat

SEQ ID NO: 603310 - DNA, 13 bp, D. melanogaster
cagcaatggcaac

SEQ ID NO: 603311 - DNA, 14 bp, D. melanogaster
cagcaatggcaaca

SEQ ID NO: 603312 - DNA, 13 bp, D. melanogaster
cagcaatggctca

SEQ ID NO: 603313 - DNA, 13 bp, D. melanogaster
cagcaattaaaac

SEQ ID NO: 603314 - DNA, 13 bp, D. melanogaster
cagcaattaaaag

SEQ ID NO: 603315 - DNA, 13 bp, D. melanogaster
cagcaattaaatg

SEQ ID NO: 603316 - DNA, 13 bp, D. melanogaster
cagcaattaaggc

SEQ ID NO: 603317 - DNA, 13 bp, D. melanogaster
cagcaattataaa

SEQ ID NO: 603318 - DNA, 13 bp, D. melanogaster
cagcaattcaatt

SEQ ID NO: 603319 - DNA, 13 bp, D. melanogaster
cagcaattgaaaa

SEQ ID NO: 603320 - DNA, 13 bp, D. melanogaster
cagcaattgcaac

SEQ ID NO: 603321 - DNA, 13 bp, D. melanogaster
cagcaattgcaat

SEQ ID NO: 603322 - DNA, 13 bp, D. melanogaster
cagcaattgcagc

SEQ ID NO: 603323 - DNA, 13 bp, D. melanogaster
cagcaattgtttt

SEQ ID NO: 603324 - DNA, 13 bp, D. melanogaster
cagcaatttccac

SEQ ID NO: 603325 - DNA, 13 bp, D. melanogaster
cagcaatttgcat

SEQ ID NO: 603326 - DNA, 13 bp, D. melanogaster
cagcaatttgttg

SEQ ID NO: 603327 - DNA, 13 bp, D. melanogaster
cagcaattttcat

SEQ ID NO: 603328 - DNA, 13 bp, D. melanogaster
cagcacaaaaagt

SEQ ID NO: 603329 - DNA, 13 bp, D. melanogaster
cagcacaaggaca

SEQ ID NO: 603330 - DNA, 13 bp, D. melanogaster
cagcacaatatat

SEQ ID NO: 603331 - DNA, 14 bp, D. melanogaster
cagcacacacacat

SEQ ID NO: 603332 - DNA, 13 bp, D. melanogaster
cagcacaccatca

SEQ ID NO: 603333 - DNA, 13 bp, D. melanogaster
cagcacacgcaca

SEQ ID NO: 603334 - DNA, 13 bp, D. melanogaster
cagcacactcaca

SEQ ID NO: 603335 - DNA, 13 bp, D. melanogaster
cagcacagcacaa

SEQ ID NO: 603336 - DNA, 13 bp, D. melanogaster
cagcacagcacag

SEQ ID NO: 603337 - DNA, 14 bp, D. melanogaster
cagcacagcacagc

SEQ ID NO: 603338 - DNA, 13 bp, D. melanogaster
cagcacagcctta

SEQ ID NO: 603339 - DNA, 13 bp, D. melanogaster
cagcacattaaaa

SEQ ID NO: 603340 - DNA, 13 bp, D. melanogaster
cagcacatttccg

SEQ ID NO: 603341 - DNA, 13 bp, D. melanogaster
cagcaccaccagc

SEQ ID NO: 603342 - DNA, 14 bp, D. melanogaster
cagcaccaccagca

SEQ ID NO: 603343 - DNA, 13 bp, D. melanogaster
cagcaccaccatc

SEQ ID NO: 603344 - DNA, 14 bp, D. melanogaster
cagcaccacccact

SEQ ID NO: 603345 - DNA, 13 bp, D. melanogaster
cagcaccacgacc

SEQ ID NO: 603346 - DNA, 14 bp, D. melanogaster
cagcaccagcaaca

SEQ ID NO: 603347 - DNA, 13 bp, D. melanogaster
cagcaccagcaca

SEQ ID NO: 603348 - DNA, 18 bp, D. melanogaster
cagcaccagcaccagcat

SEQ ID NO: 603349 - DNA, 13 bp, D. melanogaster
cagcaccatcagc

SEQ ID NO: 603350 - DNA, 13 bp, D. melanogaster
cagcacgaaagtc

SEQ ID NO: 603351 - DNA, 14 bp, D. melanogaster
cagcacgaaagtca

SEQ ID NO: 603352 - DNA, 13 bp, D. melanogaster
cagcacgcacaca

SEQ ID NO: 603353 - DNA, 14 bp, D. melanogaster
cagcacgcacacac

SEQ ID NO: 603354 - DNA, 13 bp, D. melanogaster
cagcacggaaatt

SEQ ID NO: 603355 - DNA, 13 bp, D. melanogaster
cagcactcacaca

SEQ ID NO: 603356 - DNA, 13 bp, D. melanogaster
cagcactgaaaaa

SEQ ID NO: 603357 - DNA, 13 bp, D. melanogaster
cagcacttctttt

SEQ ID NO: 603358 - DNA, 13 bp, D. melanogaster
cagcacttggctg

SEQ ID NO: 603359 - DNA, 13 bp, D. melanogaster
cagcactttgcga

SEQ ID NO: 603360 - DNA, 13 bp, D. melanogaster
cagcagaaaaata

SEQ ID NO: 603361 - DNA, 13 bp, D. melanogaster
cagcagaaaaatg

SEQ ID NO: 603362 - DNA, 13 bp, D. melanogaster
cagcagaaatcaa

SEQ ID NO: 603363 - DNA, 13 bp, D. melanogaster
cagcagaacaaac

SEQ ID NO: 603364 - DNA, 14 bp, D. melanogaster
cagcagaacatgtg

SEQ ID NO: 603365 - DNA, 14 bp, D. melanogaster
cagcagaagcaaca

SEQ ID NO: 603366 - DNA, 13 bp, D. melanogaster
cagcagaagcaga

SEQ ID NO: 603367 - DNA, 14 bp, D. melanogaster
cagcagaagcagaa

SEQ ID NO: 603368 - DNA, 14 bp, D. melanogaster
cagcagaatataat

SEQ ID NO: 603369 - DNA, 13 bp, D. melanogaster
cagcagaatgcaa

SEQ ID NO: 603370 - DNA, 13 bp, D. melanogaster
cagcagacaaaac

SEQ ID NO: 603371 - DNA, 13 bp, D. melanogaster
cagcagacaaaca

SEQ ID NO: 603372 - DNA, 13 bp, D. melanogaster
cagcagacacaca

SEQ ID NO: 603373 - DNA, 13 bp, D. melanogaster
cagcagacagaca

SEQ ID NO: 603374 - DNA, 13 bp, D. melanogaster
cagcagacagcag

SEQ ID NO: 603375 - DNA, 13 bp, D. melanogaster
cagcagagcaaaa

SEQ ID NO: 603376 - DNA, 13 bp, D. melanogaster
cagcagagcaaca

SEQ ID NO: 603377 - DNA, 13 bp, D. melanogaster
cagcagagcagag

SEQ ID NO: 603378 - DNA, 13 bp, D. melanogaster
cagcagagcagca

SEQ ID NO: 603379 - DNA, 13 bp, D. melanogaster
cagcagaggcagc

SEQ ID NO: 603380 - DNA, 13 bp, D. melanogaster
cagcagagtcttc

SEQ ID NO: 603381 - DNA, 13 bp, D. melanogaster
cagcagataacta

SEQ ID NO: 603382 - DNA, 13 bp, D. melanogaster
cagcagatacaaa

SEQ ID NO: 603383 - DNA, 13 bp, D. melanogaster
cagcagatccaga

SEQ ID NO: 603384 - DNA, 13 bp, D. melanogaster
cagcagcaaaaca

SEQ ID NO: 603385 - DNA, 14 bp, D. melanogaster
cagcagcaaaatca

SEQ ID NO: 603386 - DNA, 13 bp, D. melanogaster
cagcagcaaacaa

SEQ ID NO: 603387 - DNA, 14 bp, D. melanogaster
cagcagcaaatgca

SEQ ID NO: 603388 - DNA, 14 bp, D. melanogaster
cagcagcaacaaac

SEQ ID NO: 603389 - DNA, 14 bp, D. melanogaster
cagcagcaacaaag

SEQ ID NO: 603390 - DNA, 38 bp, D. melanogaster
cagcagcaacaacagcagcaacagcagcagcaacaaca

SEQ ID NO: 603391 - DNA, 14 bp, D. melanogaster
cagcagcaacaacc

SEQ ID NO: 603392 - DNA, 13 bp, D. melanogaster
cagcagcaacaca

SEQ ID NO: 603393 - DNA, 14 bp, D. melanogaster
cagcagcaacacaa

SEQ ID NO: 603394 - DNA, 16 bp, D. melanogaster
cagcagcaacaccaat

SEQ ID NO: 603395 - DNA, 13 bp, D. melanogaster
cagcagcaacacg

SEQ ID NO: 603396 - DNA, 15 bp, D. melanogaster
cagcagcaacatcgc

SEQ ID NO: 603397 - DNA, 13 bp, D. melanogaster
cagcagcaacatg

SEQ ID NO: 603398 - DNA, 14 bp, D. melanogaster
cagcagcaacattg

SEQ ID NO: 603399 - DNA, 14 bp, D. melanogaster
cagcagcaacattt

SEQ ID NO: 603400 - DNA, 13 bp, D. melanogaster
cagcagcaacgac

SEQ ID NO: 603401 - DNA, 14 bp, D. melanogaster
cagcagcaactaca

SEQ ID NO: 603402 - DNA, 14 bp, D. melanogaster
cagcagcaactgca

SEQ ID NO: 603403 - DNA, 14 bp, D. melanogaster
cagcagcaatagca

SEQ ID NO: 603404 - DNA, 13 bp, D. melanogaster
cagcagcaattaa

SEQ ID NO: 603405 - DNA, 13 bp, D. melanogaster
cagcagcaatttg

SEQ ID NO: 603406 - DNA, 13 bp, D. melanogaster
cagcagcaatttt

SEQ ID NO: 603407 - DNA, 13 bp, D. melanogaster
cagcagcacaaca

SEQ ID NO: 603408 - DNA, 13 bp, D. melanogaster
cagcagcactgac

SEQ ID NO: 603409 - DNA, 13 bp, D. melanogaster
cagcagcagaaac

SEQ ID NO: 603410 - DNA, 13 bp, D. melanogaster
cagcagcagaaca

SEQ ID NO: 603411 - DNA, 13 bp, D. melanogaster
cagcagcagagga

SEQ ID NO: 603412 - DNA, 14 bp, D. melanogaster
cagcagcagcaaag

SEQ ID NO: 603413 - DNA, 15 bp, D. melanogaster
cagcagcagcaactg

SEQ ID NO: 603414 - DNA, 14 bp, D. melanogaster
cagcagcagcaatt

SEQ ID NO: 603415 - DNA, 14 bp, D. melanogaster
cagcagcagcacaa

SEQ ID NO: 603416 - DNA, 14 bp, D. melanogaster
cagcagcagcagac

SEQ ID NO: 603417 - DNA, 14 bp, D. melanogaster
cagcagcagcagat

SEQ ID NO: 603418 - DNA, 14 bp, D. melanogaster
cagcagcagcagca

SEQ ID NO: 603419 - DNA, 16 bp, D. melanogaster
cagcagcagcagtagc

SEQ ID NO: 603420 - DNA, 14 bp, D. melanogaster
cagcagcagcagtt

SEQ ID NO: 603421 - DNA, 13 bp, D. melanogaster
cagcagcagccaa

SEQ ID NO: 603422 - DNA, 13 bp, D. melanogaster
cagcagcagccac

SEQ ID NO: 603423 - DNA, 13 bp, D. melanogaster
cagcagcagcccg

SEQ ID NO: 603424 - DNA, 14 bp, D. melanogaster
cagcagcagccgcc

SEQ ID NO: 603425 - DNA, 14 bp, D. melanogaster
cagcagcagcgcca

SEQ ID NO: 603426 - DNA, 13 bp, D. melanogaster
cagcagcagcgct

SEQ ID NO: 603427 - DNA, 13 bp, D. melanogaster
cagcagcagcggc

SEQ ID NO: 603428 - DNA, 14 bp, D. melanogaster
cagcagcagcggca

SEQ ID NO: 603429 - DNA, 13 bp, D. melanogaster
cagcagcagcggg

SEQ ID NO: 603430 - DNA, 13 bp, D. melanogaster
cagcagcagcgtc

SEQ ID NO: 603431 - DNA, 13 bp, D. melanogaster
cagcagcagctaa

SEQ ID NO: 603432 - DNA, 13 bp, D. melanogaster
cagcagcagctac

SEQ ID NO: 603433 - DNA, 14 bp, D. melanogaster
cagcagcagctaca

SEQ ID NO: 603434 - DNA, 14 bp, D. melanogaster
cagcagcagctgct

SEQ ID NO: 603435 - DNA, 13 bp, D. melanogaster
cagcagcagctgg

SEQ ID NO: 603436 - DNA, 14 bp, D. melanogaster
cagcagcagctgtt

SEQ ID NO: 603437 - DNA, 13 bp, D. melanogaster
cagcagcagcttg

SEQ ID NO: 603438 - DNA, 14 bp, D. melanogaster
cagcagcaggaaca

SEQ ID NO: 603439 - DNA, 14 bp, D. melanogaster
cagcagcaggagca

SEQ ID NO: 603440 - DNA, 13 bp, D. melanogaster
cagcagcagtagt

SEQ ID NO: 603441 - DNA, 14 bp, D. melanogaster
cagcagcagtcgca

SEQ ID NO: 603442 - DNA, 13 bp, D. melanogaster
cagcagcagtcgt

SEQ ID NO: 603443 - DNA, 14 bp, D. melanogaster
cagcagcagtcgtt

SEQ ID NO: 603444 - DNA, 14 bp, D. melanogaster
cagcagcagtggca

SEQ ID NO: 603445 - DNA, 14 bp, D. melanogaster
cagcagcagttgca

SEQ ID NO: 603446 - DNA, 13 bp, D. melanogaster
cagcagcataaaa

SEQ ID NO: 603447 - DNA, 13 bp, D. melanogaster
cagcagcatcaga

SEQ ID NO: 603448 - DNA, 14 bp, D. melanogaster
cagcagcatcatca

SEQ ID NO: 603449 - DNA, 13 bp, D. melanogaster
cagcagcatcggc

SEQ ID NO: 603450 - DNA, 13 bp, D. melanogaster
cagcagcatctgc

SEQ ID NO: 603451 - DNA, 14 bp, D. melanogaster
cagcagcatctgga

SEQ ID NO: 603452 - DNA, 13 bp, D. melanogaster
cagcagcatttca

SEQ ID NO: 603453 - DNA, 13 bp, D. melanogaster
cagcagccaaaaa

SEQ ID NO: 603454 - DNA, 13 bp, D. melanogaster
cagcagccaaaag

SEQ ID NO: 603455 - DNA, 13 bp, D. melanogaster
cagcagccaaagc

SEQ ID NO: 603456 - DNA, 13 bp, D. melanogaster
cagcagccacaaa

SEQ ID NO: 603457 - DNA, 13 bp, D. melanogaster
cagcagccacaat

SEQ ID NO: 603458 - DNA, 13 bp, D. melanogaster
cagcagccagcaa

SEQ ID NO: 603459 - DNA, 13 bp, D. melanogaster
cagcagccagcag

SEQ ID NO: 603460 - DNA, 13 bp, D. melanogaster
cagcagccagcga

SEQ ID NO: 603461 - DNA, 13 bp, D. melanogaster
cagcagccatgcc

SEQ ID NO: 603462 - DNA, 13 bp, D. melanogaster
cagcagccgcaaa

SEQ ID NO: 603463 - DNA, 13 bp, D. melanogaster
cagcagccgcaga

SEQ ID NO: 603464 - DNA, 13 bp, D. melanogaster
cagcagccgccgc

SEQ ID NO: 603465 - DNA, 13 bp, D. melanogaster
cagcagccgttcc

SEQ ID NO: 603466 - DNA, 13 bp, D. melanogaster
cagcagcgaggga

SEQ ID NO: 603467 - DNA, 13 bp, D. melanogaster
cagcagcgcagca

SEQ ID NO: 603468 - DNA, 13 bp, D. melanogaster
cagcagcggaaaa

SEQ ID NO: 603469 - DNA, 14 bp, D. melanogaster
cagcagcggagcgg

SEQ ID NO: 603470 - DNA, 13 bp, D. melanogaster
cagcagcggcaaa

SEQ ID NO: 603471 - DNA, 13 bp, D. melanogaster
cagcagcggcaga

SEQ ID NO: 603472 - DNA, 15 bp, D. melanogaster
cagcagcggcagcaa

SEQ ID NO: 603473 - DNA, 13 bp, D. melanogaster
cagcagcgggaaa

SEQ ID NO: 603474 - DNA, 13 bp, D. melanogaster
cagcagctacaac

SEQ ID NO: 603475 - DNA, 13 bp, D. melanogaster
cagcagctacagt

SEQ ID NO: 603476 - DNA, 14 bp, D. melanogaster
cagcagctacagtg

SEQ ID NO: 603477 - DNA, 13 bp, D. melanogaster
cagcagctcagca

SEQ ID NO: 603478 - DNA, 13 bp, D. melanogaster
cagcagctcttac

SEQ ID NO: 603479 - DNA, 13 bp, D. melanogaster
cagcagctgccaa

SEQ ID NO: 603480 - DNA, 14 bp, D. melanogaster
cagcagctgctgcc

SEQ ID NO: 603481 - DNA, 13 bp, D. melanogaster
cagcagctggaaa

SEQ ID NO: 603482 - DNA, 13 bp, D. melanogaster
cagcagctggcaa

SEQ ID NO: 603483 - DNA, 13 bp, D. melanogaster
cagcagctgttgc

SEQ ID NO: 603484 - DNA, 13 bp, D. melanogaster
cagcagctgttgt

SEQ ID NO: 603485 - DNA, 13 bp, D. melanogaster
cagcagcttcctt

SEQ ID NO: 603486 - DNA, 14 bp, D. melanogaster
cagcagcttcctta

SEQ ID NO: 603487 - DNA, 13 bp, D. melanogaster
cagcagctttaaa

SEQ ID NO: 603488 - DNA, 13 bp, D. melanogaster
cagcaggaaaaag

SEQ ID NO: 603489 - DNA, 14 bp, D. melanogaster
cagcaggaaaaagg

SEQ ID NO: 603490 - DNA, 13 bp, D. melanogaster
cagcaggaaaaca

SEQ ID NO: 603491 - DNA, 13 bp, D. melanogaster
cagcaggaaaagc

SEQ ID NO: 603492 - DNA, 14 bp, D. melanogaster
cagcaggaaacaaa

SEQ ID NO: 603493 - DNA, 14 bp, D. melanogaster
cagcaggaacaaca

SEQ ID NO: 603494 - DNA, 14 bp, D. melanogaster
cagcaggaacagca

SEQ ID NO: 603495 - DNA, 13 bp, D. melanogaster
cagcaggaatcaa

SEQ ID NO: 603496 - DNA, 13 bp, D. melanogaster
cagcaggacaatg

SEQ ID NO: 603497 - DNA, 13 bp, D. melanogaster
cagcaggagcaga

SEQ ID NO: 603498 - DNA, 14 bp, D. melanogaster
cagcaggagcagaa

SEQ ID NO: 603499 - DNA, 13 bp, D. melanogaster
cagcaggaggagc

SEQ ID NO: 603500 - DNA, 14 bp, D. melanogaster
cagcaggaggagca

SEQ ID NO: 603501 - DNA, 13 bp, D. melanogaster
cagcaggataatg

SEQ ID NO: 603502 - DNA, 13 bp, D. melanogaster
cagcaggcacatc

SEQ ID NO: 603503 - DNA, 14 bp, D. melanogaster
cagcaggcacatca

SEQ ID NO: 603504 - DNA, 14 bp, D. melanogaster
cagcaggcagcaga

SEQ ID NO: 603505 - DNA, 15 bp, D. melanogaster
cagcaggcagcaggc

SEQ ID NO: 603506 - DNA, 13 bp, D. melanogaster
cagcaggcaggca

SEQ ID NO: 603507 - DNA, 13 bp, D. melanogaster
cagcaggcatttt

SEQ ID NO: 603508 - DNA, 13 bp, D. melanogaster
cagcaggcgaaaa

SEQ ID NO: 603509 - DNA, 13 bp, D. melanogaster
cagcaggcgactc

SEQ ID NO: 603510 - DNA, 13 bp, D. melanogaster
cagcagtaacaac

SEQ ID NO: 603511 - DNA, 13 bp, D. melanogaster
cagcagtaacagc

SEQ ID NO: 603512 - DNA, 14 bp, D. melanogaster
cagcagtagcaaca

SEQ ID NO: 603513 - DNA, 17 bp, D. melanogaster
cagcagtagcaacagca

SEQ ID NO: 603514 - DNA, 20 bp, D. melanogaster
cagcagtagcaacagcagca

SEQ ID NO: 603515 - DNA, 13 bp, D. melanogaster
cagcagtaggagc

SEQ ID NO: 603516 - DNA, 13 bp, D. melanogaster
cagcagtcagcag

SEQ ID NO: 603517 - DNA, 13 bp, D. melanogaster
cagcagtcgttcg

SEQ ID NO: 603518 - DNA, 13 bp, D. melanogaster
cagcagtggcaac

SEQ ID NO: 603519 - DNA, 14 bp, D. melanogaster
cagcagtggcaaca

SEQ ID NO: 603520 - DNA, 15 bp, D. melanogaster
cagcagtggcagcag

SEQ ID NO: 603521 - DNA, 13 bp, D. melanogaster
cagcagttcatcg

SEQ ID NO: 603522 - DNA, 14 bp, D. melanogaster
cagcagttgcagtt

SEQ ID NO: 603523 - DNA, 13 bp, D. melanogaster
cagcagttgttgt

SEQ ID NO: 603524 - DNA, 13 bp, D. melanogaster
cagcataaagaaa

SEQ ID NO: 603525 - DNA, 13 bp, D. melanogaster
cagcataaattat

SEQ ID NO: 603526 - DNA, 13 bp, D. melanogaster
cagcataattaaa

SEQ ID NO: 603527 - DNA, 13 bp, D. melanogaster
cagcatcaacaaa

SEQ ID NO: 603528 - DNA, 13 bp, D. melanogaster
cagcatcaacagc

SEQ ID NO: 603529 - DNA, 14 bp, D. melanogaster
cagcatcaacagca

SEQ ID NO: 603530 - DNA, 13 bp, D. melanogaster
cagcatcagcaac

SEQ ID NO: 603531 - DNA, 14 bp, D. melanogaster
cagcatcagcaaca

SEQ ID NO: 603532 - DNA, 13 bp, D. melanogaster
cagcatcagcatt

SEQ ID NO: 603533 - DNA, 14 bp, D. melanogaster
cagcatcatcatca

SEQ ID NO: 603534 - DNA, 13 bp, D. melanogaster
cagcatcatcatt

SEQ ID NO: 603535 - DNA, 13 bp, D. melanogaster
cagcatccagcat

SEQ ID NO: 603536 - DNA, 13 bp, D. melanogaster
cagcatccatcca

SEQ ID NO: 603537 - DNA, 13 bp, D. melanogaster
cagcatcccagca

SEQ ID NO: 603538 - DNA, 13 bp, D. melanogaster
cagcatccgcagc

SEQ ID NO: 603539 - DNA, 13 bp, D. melanogaster
cagcatcgtcatc

SEQ ID NO: 603540 - DNA, 13 bp, D. melanogaster
cagcatctacata

SEQ ID NO: 603541 - DNA, 13 bp, D. melanogaster
cagcatctagccg

SEQ ID NO: 603542 - DNA, 13 bp, D. melanogaster
cagcatctgcagc

SEQ ID NO: 603543 - DNA, 13 bp, D. melanogaster
cagcatgcttggc

SEQ ID NO: 603544 - DNA, 13 bp, D. melanogaster
cagcatggactgg

SEQ ID NO: 603545 - DNA, 13 bp, D. melanogaster
cagcattaaataa

SEQ ID NO: 603546 - DNA, 13 bp, D. melanogaster
cagcattaacaaa

SEQ ID NO: 603547 - DNA, 15 bp, D. melanogaster
cagcattcacacgcc

SEQ ID NO: 603548 - DNA, 13 bp, D. melanogaster
cagcattcagcat

SEQ ID NO: 603549 - DNA, 14 bp, D. melanogaster
cagcattcgattgg

SEQ ID NO: 603550 - DNA, 14 bp, D. melanogaster
cagcattcgtttat

SEQ ID NO: 603551 - DNA, 13 bp, D. melanogaster
cagcattgccagc

SEQ ID NO: 603552 - DNA, 13 bp, D. melanogaster
cagcatttattta

SEQ ID NO: 603553 - DNA, 13 bp, D. melanogaster
cagcatttccatt

SEQ ID NO: 603554 - DNA, 13 bp, D. melanogaster
cagcatttgcata

SEQ ID NO: 603555 - DNA, 13 bp, D. melanogaster
cagcatttgctgc

SEQ ID NO: 603556 - DNA, 13 bp, D. melanogaster
cagcatttgtgtg

SEQ ID NO: 603557 - DNA, 13 bp, D. melanogaster
cagcattttaaat

SEQ ID NO: 603558 - DNA, 13 bp, D. melanogaster
cagcattttaatt

SEQ ID NO: 603559 - DNA, 14 bp, D. melanogaster
cagcattttaatta

SEQ ID NO: 603560 - DNA, 13 bp, D. melanogaster
cagcattttccca

SEQ ID NO: 603561 - DNA, 13 bp, D. melanogaster
cagcattttgcat

SEQ ID NO: 603562 - DNA, 13 bp, D. melanogaster
cagcattttgggc

SEQ ID NO: 603563 - DNA, 14 bp, D. melanogaster
cagcattttgggca

SEQ ID NO: 603564 - DNA, 13 bp, D. melanogaster
cagcattttgttt

SEQ ID NO: 603565 - DNA, 13 bp, D. melanogaster
cagccaaaaagga

SEQ ID NO: 603566 - DNA, 13 bp, D. melanogaster
cagccaaaaatat

SEQ ID NO: 603567 - DNA, 13 bp, D. melanogaster
cagccaaaaatta

SEQ ID NO: 603568 - DNA, 13 bp, D. melanogaster
cagccaaaacaat

SEQ ID NO: 603569 - DNA, 14 bp, D. melanogaster
cagccaaaacaata

SEQ ID NO: 603570 - DNA, 13 bp, D. melanogaster
cagccaaaaggga

SEQ ID NO: 603571 - DNA, 13 bp, D. melanogaster
cagccaaaatgaa

SEQ ID NO: 603572 - DNA, 13 bp, D. melanogaster
cagccaaagcaaa

SEQ ID NO: 603573 - DNA, 13 bp, D. melanogaster
cagccaaaggaaa

SEQ ID NO: 603574 - DNA, 14 bp, D. melanogaster
cagccaaataaaat

SEQ ID NO: 603575 - DNA, 13 bp, D. melanogaster
cagccaaatcaaa

SEQ ID NO: 603576 - DNA, 14 bp, D. melanogaster
cagccaaatgaaaa

SEQ ID NO: 603577 - DNA, 13 bp, D. melanogaster
cagccaaatgaat

SEQ ID NO: 603578 - DNA, 13 bp, D. melanogaster
cagccaaatgcca

SEQ ID NO: 603579 - DNA, 13 bp, D. melanogaster
cagccaaatggca

SEQ ID NO: 603580 - DNA, 13 bp, D. melanogaster
cagccaaattgaa

SEQ ID NO: 603581 - DNA, 13 bp, D. melanogaster
cagccaacaaaat

SEQ ID NO: 603582 - DNA, 13 bp, D. melanogaster
cagccaacagcca

SEQ ID NO: 603583 - DNA, 14 bp, D. melanogaster
cagccaacagccaa

SEQ ID NO: 603584 - DNA, 13 bp, D. melanogaster
cagccaaccagcc

SEQ ID NO: 603585 - DNA, 14 bp, D. melanogaster
cagccaaccagcca

SEQ ID NO: 603586 - DNA, 13 bp, D. melanogaster
cagccaacgaaaa

SEQ ID NO: 603587 - DNA, 13 bp, D. melanogaster
cagccaactcaaa

SEQ ID NO: 603588 - DNA, 13 bp, D. melanogaster
cagccaagccaac

SEQ ID NO: 603589 - DNA, 13 bp, D. melanogaster
cagccaagcgaca

SEQ ID NO: 603590 - DNA, 14 bp, D. melanogaster
cagccaagcgacag

SEQ ID NO: 603591 - DNA, 13 bp, D. melanogaster
cagccaagtgcaa

SEQ ID NO: 603592 - DNA, 13 bp, D. melanogaster
cagccaagtgcag

SEQ ID NO: 603593 - DNA, 13 bp, D. melanogaster
cagccaagtgcca

SEQ ID NO: 603594 - DNA, 13 bp, D. melanogaster
cagccaagtgctg

SEQ ID NO: 603595 - DNA, 13 bp, D. melanogaster
cagccaagtggaa

SEQ ID NO: 603596 - DNA, 13 bp, D. melanogaster
cagccacaaaaag

SEQ ID NO: 603597 - DNA, 13 bp, D. melanogaster
cagccacaacaat

SEQ ID NO: 603598 - DNA, 14 bp, D. melanogaster
cagccacagccaca

SEQ ID NO: 603599 - DNA, 13 bp, D. melanogaster
cagccacatcaac

SEQ ID NO: 603600 - DNA, 13 bp, D. melanogaster
cagccacatccac

SEQ ID NO: 603601 - DNA, 13 bp, D. melanogaster
cagccacatgccg

SEQ ID NO: 603602 - DNA, 14 bp, D. melanogaster
cagccacatgccga

SEQ ID NO: 603603 - DNA, 13 bp, D. melanogaster
cagccacattcca

SEQ ID NO: 603604 - DNA, 14 bp, D. melanogaster
cagccacattccaa

SEQ ID NO: 603605 - DNA, 13 bp, D. melanogaster
cagccaccacatt

SEQ ID NO: 603606 - DNA, 14 bp, D. melanogaster
cagccaccagacgg

SEQ ID NO: 603607 - DNA, 13 bp, D. melanogaster
cagccacctgatg

SEQ ID NO: 603608 - DNA, 14 bp, D. melanogaster
cagccacgcccact

SEQ ID NO: 603609 - DNA, 13 bp, D. melanogaster
cagccacgcccct

SEQ ID NO: 603610 - DNA, 13 bp, D. melanogaster
cagccacgcctcc

SEQ ID NO: 603611 - DNA, 13 bp, D. melanogaster
cagccactgggga

SEQ ID NO: 603612 - DNA, 13 bp, D. melanogaster
cagccacttccat

SEQ ID NO: 603613 - DNA, 13 bp, D. melanogaster
cagccacttggca

SEQ ID NO: 603614 - DNA, 13 bp, D. melanogaster
cagccactttttt

SEQ ID NO: 603615 - DNA, 14 bp, D. melanogaster
cagccacttttttg

SEQ ID NO: 603616 - DNA, 15 bp, D. melanogaster
cagccacttttttgg

SEQ ID NO: 603617 - DNA, 13 bp, D. melanogaster
cagccagacagcc

SEQ ID NO: 603618 - DNA, 14 bp, D. melanogaster
cagccagaccccct

SEQ ID NO: 603619 - DNA, 13 bp, D. melanogaster
cagccagcaaaaa

SEQ ID NO: 603620 - DNA, 13 bp, D. melanogaster
cagccagcaaaag

SEQ ID NO: 603621 - DNA, 13 bp, D. melanogaster
cagccagcaaaca

SEQ ID NO: 603622 - DNA, 13 bp, D. melanogaster
cagccagcaattt

SEQ ID NO: 603623 - DNA, 13 bp, D. melanogaster
cagccagcagcag

SEQ ID NO: 603624 - DNA, 13 bp, D. melanogaster
cagccagcagcca

SEQ ID NO: 603625 - DNA, 13 bp, D. melanogaster
cagccagcagcga

SEQ ID NO: 603626 - DNA, 13 bp, D. melanogaster
cagccagcagctg

SEQ ID NO: 603627 - DNA, 13 bp, D. melanogaster
cagccagcatttt

SEQ ID NO: 603628 - DNA, 13 bp, D. melanogaster
cagccagccaacc

SEQ ID NO: 603629 - DNA, 14 bp, D. melanogaster
cagccagccaacca

SEQ ID NO: 603630 - DNA, 13 bp, D. melanogaster
cagccagccaact

SEQ ID NO: 603631 - DNA, 13 bp, D. melanogaster
cagccagccaagt

SEQ ID NO: 603632 - DNA, 13 bp, D. melanogaster
cagccagccactc

SEQ ID NO: 603633 - DNA, 13 bp, D. melanogaster
cagccagccagac

SEQ ID NO: 603634 - DNA, 13 bp, D. melanogaster
cagccagccagag

SEQ ID NO: 603635 - DNA, 14 bp, D. melanogaster
cagccagccagcaa

SEQ ID NO: 603636 - DNA, 13 bp, D. melanogaster
cagccagccagcc

SEQ ID NO: 603637 - DNA, 14 bp, D. melanogaster
cagccagccagcca

SEQ ID NO: 603638 - DNA, 13 bp, D. melanogaster
cagccagccagcg

SEQ ID NO: 603639 - DNA, 13 bp, D. melanogaster
cagccagccagga

SEQ ID NO: 603640 - DNA, 13 bp, D. melanogaster
cagccagccaggc

SEQ ID NO: 603641 - DNA, 14 bp, D. melanogaster
cagccagccaggca

SEQ ID NO: 603642 - DNA, 13 bp, D. melanogaster
cagccagccagtc

SEQ ID NO: 603643 - DNA, 13 bp, D. melanogaster
cagccagccagtt

SEQ ID NO: 603644 - DNA, 13 bp, D. melanogaster
cagccagccatcc

SEQ ID NO: 603645 - DNA, 13 bp, D. melanogaster
cagccagcgaaat

SEQ ID NO: 603646 - DNA, 13 bp, D. melanogaster
cagccagcgagca

SEQ ID NO: 603647 - DNA, 13 bp, D. melanogaster
cagccagcgattt

SEQ ID NO: 603648 - DNA, 13 bp, D. melanogaster
cagccagcggcaa

SEQ ID NO: 603649 - DNA, 14 bp, D. melanogaster
cagccagctagcca

SEQ ID NO: 603650 - DNA, 14 bp, D. melanogaster
cagccaggcagcca

SEQ ID NO: 603651 - DNA, 13 bp, D. melanogaster
cagccaggcaggc

SEQ ID NO: 603652 - DNA, 13 bp, D. melanogaster
cagccaggcagtc

SEQ ID NO: 603653 - DNA, 13 bp, D. melanogaster
cagccataaaaat

SEQ ID NO: 603654 - DNA, 13 bp, D. melanogaster
cagccataaatca

SEQ ID NO: 603655 - DNA, 13 bp, D. melanogaster
cagccataaattt

SEQ ID NO: 603656 - DNA, 13 bp, D. melanogaster
cagccatcaaaat

SEQ ID NO: 603657 - DNA, 13 bp, D. melanogaster
cagccatcaatca

SEQ ID NO: 603658 - DNA, 13 bp, D. melanogaster
cagccatcatcag

SEQ ID NO: 603659 - DNA, 14 bp, D. melanogaster
cagccatcatcaga

SEQ ID NO: 603660 - DNA, 13 bp, D. melanogaster
cagccatcatcat

SEQ ID NO: 603661 - DNA, 14 bp, D. melanogaster
cagccatcatcata

SEQ ID NO: 603662 - DNA, 13 bp, D. melanogaster
cagccatccagtc

SEQ ID NO: 603663 - DNA, 13 bp, D. melanogaster
cagccatccatcc

SEQ ID NO: 603664 - DNA, 14 bp, D. melanogaster
cagccatccgtcca

SEQ ID NO: 603665 - DNA, 13 bp, D. melanogaster
cagccattcagcc

SEQ ID NO: 603666 - DNA, 14 bp, D. melanogaster
cagccattcagcca

SEQ ID NO: 603667 - DNA, 13 bp, D. melanogaster
cagccatttattt

SEQ ID NO: 603668 - DNA, 13 bp, D. melanogaster
cagccatttccat

SEQ ID NO: 603669 - DNA, 13 bp, D. melanogaster
cagccatttgcca

SEQ ID NO: 603670 - DNA, 13 bp, D. melanogaster
cagccatttttct

SEQ ID NO: 603671 - DNA, 13 bp, D. melanogaster
cagcccaaaagta

SEQ ID NO: 603672 - DNA, 13 bp, D. melanogaster
cagcccaagaaaa

SEQ ID NO: 603673 - DNA, 13 bp, D. melanogaster
cagcccaatcaga

SEQ ID NO: 603674 - DNA, 13 bp, D. melanogaster
cagcccaatccgc

SEQ ID NO: 603675 - DNA, 13 bp, D. melanogaster
cagcccagcccag

SEQ ID NO: 603676 - DNA, 13 bp, D. melanogaster
cagccccaaaaag

SEQ ID NO: 603677 - DNA, 14 bp, D. melanogaster
cagccccaaccact

SEQ ID NO: 603678 - DNA, 13 bp, D. melanogaster
cagccccaacggc

SEQ ID NO: 603679 - DNA, 14 bp, D. melanogaster
cagccccgcccact

SEQ ID NO: 603680 - DNA, 13 bp, D. melanogaster
cagccccggaaaa

SEQ ID NO: 603681 - DNA, 13 bp, D. melanogaster
cagcccgaaaaaa

SEQ ID NO: 603682 - DNA, 13 bp, D. melanogaster
cagccgaaaaaag

SEQ ID NO: 603683 - DNA, 13 bp, D. melanogaster
cagccgaaaacaa

SEQ ID NO: 603684 - DNA, 13 bp, D. melanogaster
cagccgaaaagta

SEQ ID NO: 603685 - DNA, 13 bp, D. melanogaster
cagccgaaactaa

SEQ ID NO: 603686 - DNA, 13 bp, D. melanogaster
cagccgagacact

SEQ ID NO: 603687 - DNA, 13 bp, D. melanogaster
cagccgcaaaaaa

SEQ ID NO: 603688 - DNA, 13 bp, D. melanogaster
cagccgcaaaaac

SEQ ID NO: 603689 - DNA, 13 bp, D. melanogaster
cagccgcaaattt

SEQ ID NO: 603690 - DNA, 13 bp, D. melanogaster
cagccgcaacaaa

SEQ ID NO: 603691 - DNA, 13 bp, D. melanogaster
cagccgcacaaaa

SEQ ID NO: 603692 - DNA, 13 bp, D. melanogaster
cagccgcacacac

SEQ ID NO: 603693 - DNA, 14 bp, D. melanogaster
cagccgcagcaaca

SEQ ID NO: 603694 - DNA, 14 bp, D. melanogaster
cagccgcagcagca

SEQ ID NO: 603695 - DNA, 13 bp, D. melanogaster
cagccggaaaatg

SEQ ID NO: 603696 - DNA, 13 bp, D. melanogaster
cagcctactacaa

SEQ ID NO: 603697 - DNA, 13 bp, D. melanogaster
cagcctcttcgct

SEQ ID NO: 603698 - DNA, 13 bp, D. melanogaster
cagcctgcacagt

SEQ ID NO: 603699 - DNA, 13 bp, D. melanogaster
cagccttcagcct

SEQ ID NO: 603700 - DNA, 13 bp, D. melanogaster
cagcctttggctt

SEQ ID NO: 603701 - DNA, 14 bp, D. melanogaster
cagcctttggcttc

SEQ ID NO: 603702 - DNA, 13 bp, D. melanogaster
cagcgaaaaacat

SEQ ID NO: 603703 - DNA, 13 bp, D. melanogaster
cagcgaaaaatgt

SEQ ID NO: 603704 - DNA, 13 bp, D. melanogaster
cagcgaaaagcaa

SEQ ID NO: 603705 - DNA, 13 bp, D. melanogaster
cagcgaaaaggaa

SEQ ID NO: 603706 - DNA, 13 bp, D. melanogaster
cagcgaaaatatt

SEQ ID NO: 603707 - DNA, 13 bp, D. melanogaster
cagcgaaaattcc

SEQ ID NO: 603708 - DNA, 13 bp, D. melanogaster
cagcgaaacgaaa

SEQ ID NO: 603709 - DNA, 13 bp, D. melanogaster
cagcgaaactttg

SEQ ID NO: 603710 - DNA, 14 bp, D. melanogaster
cagcgaaagcaaaa

SEQ ID NO: 603711 - DNA, 13 bp, D. melanogaster
cagcgaaagcaac

SEQ ID NO: 603712 - DNA, 13 bp, D. melanogaster
cagcgaaagtttg

SEQ ID NO: 603713 - DNA, 14 bp, D. melanogaster
cagcgaaatgaaaa

SEQ ID NO: 603714 - DNA, 13 bp, D. melanogaster
cagcgaaatgcaa

SEQ ID NO: 603715 - DNA, 13 bp, D. melanogaster
cagcgaacaaatt

SEQ ID NO: 603716 - DNA, 13 bp, D. melanogaster
cagcgaacaacaa

SEQ ID NO: 603717 - DNA, 13 bp, D. melanogaster
cagcgaacacaac

SEQ ID NO: 603718 - DNA, 14 bp, D. melanogaster
cagcgaacacaaca

SEQ ID NO: 603719 - DNA, 13 bp, D. melanogaster
cagcgaacgacag

SEQ ID NO: 603720 - DNA, 13 bp, D. melanogaster
cagcgaacgtgga

SEQ ID NO: 603721 - DNA, 13 bp, D. melanogaster
cagcgaaggaaaa

SEQ ID NO: 603722 - DNA, 13 bp, D. melanogaster
cagcgaataaacg

SEQ ID NO: 603723 - DNA, 13 bp, D. melanogaster
cagcgaatgcaaa

SEQ ID NO: 603724 - DNA, 13 bp, D. melanogaster
cagcgacaaaaac

SEQ ID NO: 603725 - DNA, 13 bp, D. melanogaster
cagcgacaaaagc

SEQ ID NO: 603726 - DNA, 13 bp, D. melanogaster
cagcgacaacaaa

SEQ ID NO: 603727 - DNA, 13 bp, D. melanogaster
cagcgacaacaac

SEQ ID NO: 603728 - DNA, 13 bp, D. melanogaster
cagcgacaacaat

SEQ ID NO: 603729 - DNA, 13 bp, D. melanogaster
cagcgacaacagg

SEQ ID NO: 603730 - DNA, 14 bp, D. melanogaster
cagcgacaacgaca

SEQ ID NO: 603731 - DNA, 14 bp, D. melanogaster
cagcgacagcaaca

SEQ ID NO: 603732 - DNA, 13 bp, D. melanogaster
cagcgacagcgac

SEQ ID NO: 603733 - DNA, 13 bp, D. melanogaster
cagcgacagcggc

SEQ ID NO: 603734 - DNA, 13 bp, D. melanogaster
cagcgacattttt

SEQ ID NO: 603735 - DNA, 13 bp, D. melanogaster
cagcgacgacagc

SEQ ID NO: 603736 - DNA, 13 bp, D. melanogaster
cagcgacgccagc

SEQ ID NO: 603737 - DNA, 13 bp, D. melanogaster
cagcgacgccgac

SEQ ID NO: 603738 - DNA, 13 bp, D. melanogaster
cagcgacgtcgac

SEQ ID NO: 603739 - DNA, 13 bp, D. melanogaster
cagcgacgtcggc

SEQ ID NO: 603740 - DNA, 13 bp, D. melanogaster
cagcgactgcgac

SEQ ID NO: 603741 - DNA, 15 bp, D. melanogaster
cagcgagaacttagc

SEQ ID NO: 603742 - DNA, 13 bp, D. melanogaster
cagcgagcacaat

SEQ ID NO: 603743 - DNA, 13 bp, D. melanogaster
cagcgagcacagt

SEQ ID NO: 603744 - DNA, 13 bp, D. melanogaster
cagcgagggagtg

SEQ ID NO: 603745 - DNA, 13 bp, D. melanogaster
cagcgagtgccga

SEQ ID NO: 603746 - DNA, 13 bp, D. melanogaster
cagcgagtgtgtg

SEQ ID NO: 603747 - DNA, 13 bp, D. melanogaster
cagcgataagcgc

SEQ ID NO: 603748 - DNA, 14 bp, D. melanogaster
cagcgatagagaca

SEQ ID NO: 603749 - DNA, 13 bp, D. melanogaster
cagcgatttcaat

SEQ ID NO: 603750 - DNA, 13 bp, D. melanogaster
cagcgattttaat

SEQ ID NO: 603751 - DNA, 13 bp, D. melanogaster
cagcgcaattaac

SEQ ID NO: 603752 - DNA, 13 bp, D. melanogaster
cagcgcacaaatt

SEQ ID NO: 603753 - DNA, 13 bp, D. melanogaster
cagcgcacagtgg

SEQ ID NO: 603754 - DNA, 13 bp, D. melanogaster
cagcgcagaagtg

SEQ ID NO: 603755 - DNA, 13 bp, D. melanogaster
cagcgcagcaaaa

SEQ ID NO: 603756 - DNA, 13 bp, D. melanogaster
cagcgcagcaaca

SEQ ID NO: 603757 - DNA, 13 bp, D. melanogaster
cagcgcagcagta

SEQ ID NO: 603758 - DNA, 13 bp, D. melanogaster
cagcgcagcttga

SEQ ID NO: 603759 - DNA, 13 bp, D. melanogaster
cagcgcagtcgac

SEQ ID NO: 603760 - DNA, 13 bp, D. melanogaster
cagcgcagtgcat

SEQ ID NO: 603761 - DNA, 13 bp, D. melanogaster
cagcgcataaatc

SEQ ID NO: 603762 - DNA, 13 bp, D. melanogaster
cagcgccaaacga

SEQ ID NO: 603763 - DNA, 14 bp, D. melanogaster
cagcgccagttgcg

SEQ ID NO: 603764 - DNA, 13 bp, D. melanogaster
cagcgcccctcgg

SEQ ID NO: 603765 - DNA, 13 bp, D. melanogaster
cagcgcgagcatg

SEQ ID NO: 603766 - DNA, 14 bp, D. melanogaster
cagcgctatatgtt

SEQ ID NO: 603767 - DNA, 13 bp, D. melanogaster
cagcgctgccaac

SEQ ID NO: 603768 - DNA, 13 bp, D. melanogaster
cagcgctgccagc

SEQ ID NO: 603769 - DNA, 13 bp, D. melanogaster
cagcggaaaaaat

SEQ ID NO: 603770 - DNA, 13 bp, D. melanogaster
cagcggaaaattg

SEQ ID NO: 603771 - DNA, 14 bp, D. melanogaster
cagcggaagcggaa

SEQ ID NO: 603772 - DNA, 14 bp, D. melanogaster
cagcggagatattt

SEQ ID NO: 603773 - DNA, 13 bp, D. melanogaster
cagcggatcccaa

SEQ ID NO: 603774 - DNA, 13 bp, D. melanogaster
cagcggcaaaaaa

SEQ ID NO: 603775 - DNA, 13 bp, D. melanogaster
cagcggcaacaaa

SEQ ID NO: 603776 - DNA, 13 bp, D. melanogaster
cagcggcaacaag

SEQ ID NO: 603777 - DNA, 13 bp, D. melanogaster
cagcggcaacaat

SEQ ID NO: 603778 - DNA, 13 bp, D. melanogaster
cagcggcaacatc

SEQ ID NO: 603779 - DNA, 13 bp, D. melanogaster
cagcggcaataaa

SEQ ID NO: 603780 - DNA, 13 bp, D. melanogaster
cagcggcagaggc

SEQ ID NO: 603781 - DNA, 13 bp, D. melanogaster
cagcggcagcaaa

SEQ ID NO: 603782 - DNA, 14 bp, D. melanogaster
cagcggcagcaaca

SEQ ID NO: 603783 - DNA, 13 bp, D. melanogaster
cagcggcagcaga

SEQ ID NO: 603784 - DNA, 14 bp, D. melanogaster
cagcggcagcagca

SEQ ID NO: 603785 - DNA, 14 bp, D. melanogaster
cagcggcagcagct

SEQ ID NO: 603786 - DNA, 13 bp, D. melanogaster
cagcggcagcagt

SEQ ID NO: 603787 - DNA, 13 bp, D. melanogaster
cagcggcagcgaa

SEQ ID NO: 603788 - DNA, 14 bp, D. melanogaster
cagcggcagcgacg

SEQ ID NO: 603789 - DNA, 13 bp, D. melanogaster
cagcggcagcggc

SEQ ID NO: 603790 - DNA, 14 bp, D. melanogaster
cagcggcagcggca

SEQ ID NO: 603791 - DNA, 13 bp, D. melanogaster
cagcggcagtggc

SEQ ID NO: 603792 - DNA, 14 bp, D. melanogaster
cagcggcagtggca

SEQ ID NO: 603793 - DNA, 13 bp, D. melanogaster
cagcggcccaact

SEQ ID NO: 603794 - DNA, 13 bp, D. melanogaster
cagcggcgaagaa

SEQ ID NO: 603795 - DNA, 13 bp, D. melanogaster
cagcggcgcagca

SEQ ID NO: 603796 - DNA, 14 bp, D. melanogaster
cagcggcgcagcag

SEQ ID NO: 603797 - DNA, 13 bp, D. melanogaster
cagcggcggcagc

SEQ ID NO: 603798 - DNA, 13 bp, D. melanogaster
cagcggctgctgc

SEQ ID NO: 603799 - DNA, 13 bp, D. melanogaster
cagcggctttggc

SEQ ID NO: 603800 - DNA, 13 bp, D. melanogaster
cagcgggaaaatg

SEQ ID NO: 603801 - DNA, 13 bp, D. melanogaster
cagcgggagcagc

SEQ ID NO: 603802 - DNA, 13 bp, D. melanogaster
cagcggtttcccg

SEQ ID NO: 603803 - DNA, 16 bp, D. melanogaster
cagcgtatatatatat

SEQ ID NO: 603804 - DNA, 14 bp, D. melanogaster
cagcgtatgtaagt

SEQ ID NO: 603805 - DNA, 13 bp, D. melanogaster
cagcgtctttagc

SEQ ID NO: 603806 - DNA, 14 bp, D. melanogaster
cagcgttttttttt

SEQ ID NO: 603807 - DNA, 13 bp, D. melanogaster
cagctaaaaattt

SEQ ID NO: 603808 - DNA, 13 bp, D. melanogaster
cagctaaaacaaa

SEQ ID NO: 603809 - DNA, 13 bp, D. melanogaster
cagctaacaacaa

SEQ ID NO: 603810 - DNA, 13 bp, D. melanogaster
cagctaattaaaa

SEQ ID NO: 603811 - DNA, 13 bp, D. melanogaster
cagctaattgaaa

SEQ ID NO: 603812 - DNA, 13 bp, D. melanogaster
cagctacaaattg

SEQ ID NO: 603813 - DNA, 13 bp, D. melanogaster
cagctacaacaaa

SEQ ID NO: 603814 - DNA, 13 bp, D. melanogaster
cagctacaacaac

SEQ ID NO: 603815 - DNA, 14 bp, D. melanogaster
cagctacaacaaca

SEQ ID NO: 603816 - DNA, 13 bp, D. melanogaster
cagctacaacaat

SEQ ID NO: 603817 - DNA, 13 bp, D. melanogaster
cagctacagatac

SEQ ID NO: 603818 - DNA, 14 bp, D. melanogaster
cagctacagataca

SEQ ID NO: 603819 - DNA, 13 bp, D. melanogaster
cagctacagcagc

SEQ ID NO: 603820 - DNA, 13 bp, D. melanogaster
cagctacagctgc

SEQ ID NO: 603821 - DNA, 13 bp, D. melanogaster
cagctacagtgac

SEQ ID NO: 603822 - DNA, 13 bp, D. melanogaster
cagctaccagtgg

SEQ ID NO: 603823 - DNA, 13 bp, D. melanogaster
cagctataaaata

SEQ ID NO: 603824 - DNA, 13 bp, D. melanogaster
cagctataaatat

SEQ ID NO: 603825 - DNA, 13 bp, D. melanogaster
cagctattacttc

SEQ ID NO: 603826 - DNA, 13 bp, D. melanogaster
cagctcaaagaag

SEQ ID NO: 603827 - DNA, 13 bp, D. melanogaster
cagctcaacgtct

SEQ ID NO: 603828 - DNA, 13 bp, D. melanogaster
cagctcaactcaa

SEQ ID NO: 603829 - DNA, 13 bp, D. melanogaster
cagctcaagtggt

SEQ ID NO: 603830 - DNA, 13 bp, D. melanogaster
cagctcacagctc

SEQ ID NO: 603831 - DNA, 13 bp, D. melanogaster
cagctcaccagct

SEQ ID NO: 603832 - DNA, 14 bp, D. melanogaster
cagctcaccagctc

SEQ ID NO: 603833 - DNA, 13 bp, D. melanogaster
cagctcacctgct

SEQ ID NO: 603834 - DNA, 13 bp, D. melanogaster
cagctcagcaaat

SEQ ID NO: 603835 - DNA, 14 bp, D. melanogaster
cagctcagcaaata

SEQ ID NO: 603836 - DNA, 13 bp, D. melanogaster
cagctcagctcag

SEQ ID NO: 603837 - DNA, 14 bp, D. melanogaster
cagctcagctcagc

SEQ ID NO: 603838 - DNA, 13 bp, D. melanogaster
cagctcagttcag

SEQ ID NO: 603839 - DNA, 13 bp, D. melanogaster
cagctcatcccag

SEQ ID NO: 603840 - DNA, 13 bp, D. melanogaster
cagctcattagca

SEQ ID NO: 603841 - DNA, 13 bp, D. melanogaster
cagctcatttgca

SEQ ID NO: 603842 - DNA, 13 bp, D. melanogaster
cagctcatttggc

SEQ ID NO: 603843 - DNA, 13 bp, D. melanogaster
cagctccaactcc

SEQ ID NO: 603844 - DNA, 14 bp, D. melanogaster
cagctccaactcca

SEQ ID NO: 603845 - DNA, 13 bp, D. melanogaster
cagctccacagct

SEQ ID NO: 603846 - DNA, 13 bp, D. melanogaster
cagctccaccaca

SEQ ID NO: 603847 - DNA, 13 bp, D. melanogaster
cagctccagcagc

SEQ ID NO: 603848 - DNA, 13 bp, D. melanogaster
cagctccagctac

SEQ ID NO: 603849 - DNA, 13 bp, D. melanogaster
cagctccagctcc

SEQ ID NO: 603850 - DNA, 14 bp, D. melanogaster
cagctccagctcca

SEQ ID NO: 603851 - DNA, 13 bp, D. melanogaster
cagctccagctgc

SEQ ID NO: 603852 - DNA, 13 bp, D. melanogaster
cagctccagtcat

SEQ ID NO: 603853 - DNA, 13 bp, D. melanogaster
cagctccagttcc

SEQ ID NO: 603854 - DNA, 13 bp, D. melanogaster
cagctccatctcc

SEQ ID NO: 603855 - DNA, 14 bp, D. melanogaster
cagctccatctcca

SEQ ID NO: 603856 - DNA, 13 bp, D. melanogaster
cagctccattccc

SEQ ID NO: 603857 - DNA, 13 bp, D. melanogaster
cagctccgatggc

SEQ ID NO: 603858 - DNA, 13 bp, D. melanogaster
cagctcctccagc

SEQ ID NO: 603859 - DNA, 13 bp, D. melanogaster
cagctcctcctcc

SEQ ID NO: 603860 - DNA, 14 bp, D. melanogaster
cagctcctgcagca

SEQ ID NO: 603861 - DNA, 14 bp, D. melanogaster
cagctcctgctcct

SEQ ID NO: 603862 - DNA, 13 bp, D. melanogaster
cagctcctttggc

SEQ ID NO: 603863 - DNA, 13 bp, D. melanogaster
cagctccttttgc

SEQ ID NO: 603864 - DNA, 14 bp, D. melanogaster
cagctccttttgca

SEQ ID NO: 603865 - DNA, 13 bp, D. melanogaster
cagctcgaaaaaa

SEQ ID NO: 603866 - DNA, 13 bp, D. melanogaster
cagctcgaggcag

SEQ ID NO: 603867 - DNA, 14 bp, D. melanogaster
cagctcgaggcagc

SEQ ID NO: 603868 - DNA, 13 bp, D. melanogaster
cagctcggagcca

SEQ ID NO: 603869 - DNA, 13 bp, D. melanogaster
cagctctaaataa

SEQ ID NO: 603870 - DNA, 13 bp, D. melanogaster
cagctctcagctc

SEQ ID NO: 603871 - DNA, 13 bp, D. melanogaster
cagctctccagct

SEQ ID NO: 603872 - DNA, 13 bp, D. melanogaster
cagctctggtatt

SEQ ID NO: 603873 - DNA, 13 bp, D. melanogaster
cagctcttggcca

SEQ ID NO: 603874 - DNA, 14 bp, D. melanogaster
cagctcttttctac

SEQ ID NO: 603875 - DNA, 13 bp, D. melanogaster
cagctgaaaaaaa

SEQ ID NO: 603876 - DNA, 13 bp, D. melanogaster
cagctgaaaaatg

SEQ ID NO: 603877 - DNA, 13 bp, D. melanogaster
cagctgaaaagca

SEQ ID NO: 603878 - DNA, 13 bp, D. melanogaster
cagctgaaaagtt

SEQ ID NO: 603879 - DNA, 13 bp, D. melanogaster
cagctgaaagttg

SEQ ID NO: 603880 - DNA, 13 bp, D. melanogaster
cagctgaaataat

SEQ ID NO: 603881 - DNA, 13 bp, D. melanogaster
cagctgaatgttg

SEQ ID NO: 603882 - DNA, 13 bp, D. melanogaster
cagctgacaaccc

SEQ ID NO: 603883 - DNA, 13 bp, D. melanogaster
cagctgacagctg

SEQ ID NO: 603884 - DNA, 13 bp, D. melanogaster
cagctgacgcaag

SEQ ID NO: 603885 - DNA, 13 bp, D. melanogaster
cagctgaggcatt

SEQ ID NO: 603886 - DNA, 13 bp, D. melanogaster
cagctgagtgagg

SEQ ID NO: 603887 - DNA, 13 bp, D. melanogaster
cagctgatgatga

SEQ ID NO: 603888 - DNA, 13 bp, D. melanogaster
cagctgcaaaaaa

SEQ ID NO: 603889 - DNA, 14 bp, D. melanogaster
cagctgcaaaaaac

SEQ ID NO: 603890 - DNA, 13 bp, D. melanogaster
cagctgcaaaaag

SEQ ID NO: 603891 - DNA, 13 bp, D. melanogaster
cagctgcaaaata

SEQ ID NO: 603892 - DNA, 13 bp, D. melanogaster
cagctgcaaatgc

SEQ ID NO: 603893 - DNA, 13 bp, D. melanogaster
cagctgcaaattg

SEQ ID NO: 603894 - DNA, 13 bp, D. melanogaster
cagctgcaacaaa

SEQ ID NO: 603895 - DNA, 13 bp, D. melanogaster
cagctgcaagttg

SEQ ID NO: 603896 - DNA, 13 bp, D. melanogaster
cagctgcaattgg

SEQ ID NO: 603897 - DNA, 13 bp, D. melanogaster
cagctgcaatttt

SEQ ID NO: 603898 - DNA, 13 bp, D. melanogaster
cagctgcacaaat

SEQ ID NO: 603899 - DNA, 13 bp, D. melanogaster
cagctgcactttg

SEQ ID NO: 603900 - DNA, 13 bp, D. melanogaster
cagctgcagaggc

SEQ ID NO: 603901 - DNA, 13 bp, D. melanogaster
cagctgcagatac

SEQ ID NO: 603902 - DNA, 13 bp, D. melanogaster
cagctgcagatgc

SEQ ID NO: 603903 - DNA, 13 bp, D. melanogaster
cagctgcagcagg

SEQ ID NO: 603904 - DNA, 13 bp, D. melanogaster
cagctgcagctac

SEQ ID NO: 603905 - DNA, 13 bp, D. melanogaster
cagctgcagctga

SEQ ID NO: 603906 - DNA, 13 bp, D. melanogaster
cagctgcagctgc

SEQ ID NO: 603907 - DNA, 14 bp, D. melanogaster
cagctgcagctgcc

SEQ ID NO: 603908 - DNA, 13 bp, D. melanogaster
cagctgcagctgg

SEQ ID NO: 603909 - DNA, 13 bp, D. melanogaster
cagctgcagctgt

SEQ ID NO: 603910 - DNA, 13 bp, D. melanogaster
cagctgcagcttt

SEQ ID NO: 603911 - DNA, 13 bp, D. melanogaster
cagctgcagttga

SEQ ID NO: 603912 - DNA, 13 bp, D. melanogaster
cagctgcagttgg

SEQ ID NO: 603913 - DNA, 13 bp, D. melanogaster
cagctgcagtttc

SEQ ID NO: 603914 - DNA, 13 bp, D. melanogaster
cagctgcagtttt

SEQ ID NO: 603915 - DNA, 13 bp, D. melanogaster
cagctgcataaat

SEQ ID NO: 603916 - DNA, 13 bp, D. melanogaster
cagctgcatttaa

SEQ ID NO: 603917 - DNA, 13 bp, D. melanogaster
cagctgcatttgc

SEQ ID NO: 603918 - DNA, 13 bp, D. melanogaster
cagctgccaaaaa

SEQ ID NO: 603919 - DNA, 13 bp, D. melanogaster
cagctgccaaatg

SEQ ID NO: 603920 - DNA, 13 bp, D. melanogaster
cagctgccaactg

SEQ ID NO: 603921 - DNA, 13 bp, D. melanogaster
cagctgccaagtg

SEQ ID NO: 603922 - DNA, 13 bp, D. melanogaster
cagctgccaattg

SEQ ID NO: 603923 - DNA, 13 bp, D. melanogaster
cagctgccacatg

SEQ ID NO: 603924 - DNA, 13 bp, D. melanogaster
cagctgccacatt

SEQ ID NO: 603925 - DNA, 13 bp, D. melanogaster
cagctgccactgc

SEQ ID NO: 603926 - DNA, 13 bp, D. melanogaster
cagctgccagctg

SEQ ID NO: 603927 - DNA, 13 bp, D. melanogaster
cagctgccataaa

SEQ ID NO: 603928 - DNA, 16 bp, D. melanogaster
cagctgccgcaatgga

SEQ ID NO: 603929 - DNA, 13 bp, D. melanogaster
cagctgccgccgc

SEQ ID NO: 603930 - DNA, 13 bp, D. melanogaster
cagctgccgttga

SEQ ID NO: 603931 - DNA, 13 bp, D. melanogaster
cagctgcgactgc

SEQ ID NO: 603932 - DNA, 14 bp, D. melanogaster
cagctgcgcagcag

SEQ ID NO: 603933 - DNA, 14 bp, D. melanogaster
cagctgcgcagcat

SEQ ID NO: 603934 - DNA, 13 bp, D. melanogaster
cagctgctccagc

SEQ ID NO: 603935 - DNA, 13 bp, D. melanogaster
cagctgctcctgc

SEQ ID NO: 603936 - DNA, 13 bp, D. melanogaster
cagctgctctgct

SEQ ID NO: 603937 - DNA, 13 bp, D. melanogaster
cagctgctgcaaa

SEQ ID NO: 603938 - DNA, 13 bp, D. melanogaster
cagctgctgcact

SEQ ID NO: 603939 - DNA, 14 bp, D. melanogaster
cagctgctgcagct

SEQ ID NO: 603940 - DNA, 13 bp, D. melanogaster
cagctgctgcagt

SEQ ID NO: 603941 - DNA, 13 bp, D. melanogaster
cagctgctgcctg

SEQ ID NO: 603942 - DNA, 13 bp, D. melanogaster
cagctgctgctgc

SEQ ID NO: 603943 - DNA, 14 bp, D. melanogaster
cagctgctgctgca

SEQ ID NO: 603944 - DNA, 14 bp, D. melanogaster
cagctgctgctgct

SEQ ID NO: 603945 - DNA, 15 bp, D. melanogaster
cagctgctgctgctg

SEQ ID NO: 603946 - DNA, 13 bp, D. melanogaster
cagctgctgcttt

SEQ ID NO: 603947 - DNA, 13 bp, D. melanogaster
cagctgctggcaa

SEQ ID NO: 603948 - DNA, 13 bp, D. melanogaster
cagctgctggcca

SEQ ID NO: 603949 - DNA, 13 bp, D. melanogaster
cagctgctggctg

SEQ ID NO: 603950 - DNA, 14 bp, D. melanogaster
cagctgctgttgct

SEQ ID NO: 603951 - DNA, 13 bp, D. melanogaster
cagctgctgtttg

SEQ ID NO: 603952 - DNA, 14 bp, D. melanogaster
cagctgcttcttct

SEQ ID NO: 603953 - DNA, 13 bp, D. melanogaster
cagctggaaaagt

SEQ ID NO: 603954 - DNA, 13 bp, D. melanogaster
cagctggagctgg

SEQ ID NO: 603955 - DNA, 14 bp, D. melanogaster
cagctggagctgga

SEQ ID NO: 603956 - DNA, 13 bp, D. melanogaster
cagctggatgaca

SEQ ID NO: 603957 - DNA, 13 bp, D. melanogaster
cagctggcaaaag

SEQ ID NO: 603958 - DNA, 13 bp, D. melanogaster
cagctggcaaatg

SEQ ID NO: 603959 - DNA, 13 bp, D. melanogaster
cagctggcacagc

SEQ ID NO: 603960 - DNA, 13 bp, D. melanogaster
cagctggcagctg

SEQ ID NO: 603961 - DNA, 13 bp, D. melanogaster
cagctggcagttg

SEQ ID NO: 603962 - DNA, 13 bp, D. melanogaster
cagctggcgcgga

SEQ ID NO: 603963 - DNA, 13 bp, D. melanogaster
cagctggctggct

SEQ ID NO: 603964 - DNA, 13 bp, D. melanogaster
cagctgggaaaat

SEQ ID NO: 603965 - DNA, 13 bp, D. melanogaster
cagctgggcgtcg

SEQ ID NO: 603966 - DNA, 14 bp, D. melanogaster
cagctggtcatggg

SEQ ID NO: 603967 - DNA, 13 bp, D. melanogaster
cagctggtgcaaa

SEQ ID NO: 603968 - DNA, 13 bp, D. melanogaster
cagctggtggatg

SEQ ID NO: 603969 - DNA, 13 bp, D. melanogaster
cagctgtaaataa

SEQ ID NO: 603970 - DNA, 13 bp, D. melanogaster
cagctgtcaatcg

SEQ ID NO: 603971 - DNA, 13 bp, D. melanogaster
cagctgtcagctg

SEQ ID NO: 603972 - DNA, 13 bp, D. melanogaster
cagctgtcagtca

SEQ ID NO: 603973 - DNA, 14 bp, D. melanogaster
cagctgtgatcagt

SEQ ID NO: 603974 - DNA, 13 bp, D. melanogaster
cagctgtggtcaa

SEQ ID NO: 603975 - DNA, 13 bp, D. melanogaster
cagctgtgtgtgc

SEQ ID NO: 603976 - DNA, 13 bp, D. melanogaster
cagctgtgttcat

SEQ ID NO: 603977 - DNA, 14 bp, D. melanogaster
cagctgtgttcata

SEQ ID NO: 603978 - DNA, 13 bp, D. melanogaster
cagctgttaaagt

SEQ ID NO: 603979 - DNA, 14 bp, D. melanogaster
cagctgttcatgga

SEQ ID NO: 603980 - DNA, 13 bp, D. melanogaster
cagctgttcttgc

SEQ ID NO: 603981 - DNA, 13 bp, D. melanogaster
cagctgttgccaa

SEQ ID NO: 603982 - DNA, 14 bp, D. melanogaster
cagctgttgctgct

SEQ ID NO: 603983 - DNA, 13 bp, D. melanogaster
cagctgttggcca

SEQ ID NO: 603984 - DNA, 13 bp, D. melanogaster
cagctgtttgcca

SEQ ID NO: 603985 - DNA, 13 bp, D. melanogaster
cagctgtttgctg

SEQ ID NO: 603986 - DNA, 13 bp, D. melanogaster
cagctgttttaaa

SEQ ID NO: 603987 - DNA, 13 bp, D. melanogaster
cagctgttttggc

SEQ ID NO: 603988 - DNA, 13 bp, D. melanogaster
cagcttaaaattt

SEQ ID NO: 603989 - DNA, 13 bp, D. melanogaster
cagcttaaagaca

SEQ ID NO: 603990 - DNA, 13 bp, D. melanogaster
cagcttaaataaa

SEQ ID NO: 603991 - DNA, 13 bp, D. melanogaster
cagcttattgagg

SEQ ID NO: 603992 - DNA, 13 bp, D. melanogaster
cagcttcaacttc

SEQ ID NO: 603993 - DNA, 14 bp, D. melanogaster
cagcttcagctcca

SEQ ID NO: 603994 - DNA, 13 bp, D. melanogaster
cagcttcagcttc

SEQ ID NO: 603995 - DNA, 13 bp, D. melanogaster
cagcttcagcttt

SEQ ID NO: 603996 - DNA, 13 bp, D. melanogaster
cagcttcagttga

SEQ ID NO: 603997 - DNA, 13 bp, D. melanogaster
cagcttcattttc

SEQ ID NO: 603998 - DNA, 13 bp, D. melanogaster
cagcttcgattgc

SEQ ID NO: 603999 - DNA, 14 bp, D. melanogaster
cagcttcgattgcg

SEQ ID NO: 604000 - DNA, 13 bp, D. melanogaster
cagcttcttcttc

SEQ ID NO: 604001 - DNA, 13 bp, D. melanogaster
cagcttgctgcac

SEQ ID NO: 604002 - DNA, 13 bp, D. melanogaster
cagcttgtagttt

SEQ ID NO: 604003 - DNA, 13 bp, D. melanogaster
cagcttgttgttg

SEQ ID NO: 604004 - DNA, 14 bp, D. melanogaster
cagctttaaccaaa

SEQ ID NO: 604005 - DNA, 13 bp, D. melanogaster
cagctttaattaa

SEQ ID NO: 604006 - DNA, 13 bp, D. melanogaster
cagctttagcttt

SEQ ID NO: 604007 - DNA, 13 bp, D. melanogaster
cagctttagtttt

SEQ ID NO: 604008 - DNA, 13 bp, D. melanogaster
cagctttatttat

SEQ ID NO: 604009 - DNA, 13 bp, D. melanogaster
cagctttcccgac

SEQ ID NO: 604010 - DNA, 13 bp, D. melanogaster
cagctttcttaaa

SEQ ID NO: 604011 - DNA, 13 bp, D. melanogaster
cagctttgctggc

SEQ ID NO: 604012 - DNA, 13 bp, D. melanogaster
cagctttggtcaa

SEQ ID NO: 604013 - DNA, 13 bp, D. melanogaster
cagctttgtaaat

SEQ ID NO: 604014 - DNA, 13 bp, D. melanogaster
cagcttttcagtt

SEQ ID NO: 604015 - DNA, 13 bp, D. melanogaster
cagcttttccagc

SEQ ID NO: 604016 - DNA, 13 bp, D. melanogaster
cagcttttccatt

SEQ ID NO: 604017 - DNA, 13 bp, D. melanogaster
cagcttttcccgc

SEQ ID NO: 604018 - DNA, 13 bp, D. melanogaster
cagcttttggcca

SEQ ID NO: 604019 - DNA, 13 bp, D. melanogaster
cagcttttgtggc

SEQ ID NO: 604020 - DNA, 13 bp, D. melanogaster
cagctttttgttt

SEQ ID NO: 604021 - DNA, 13 bp, D. melanogaster
caggaaaactttt

SEQ ID NO: 604022 - DNA, 13 bp, D. melanogaster
caggaaaatggaa

SEQ ID NO: 604023 - DNA, 13 bp, D. melanogaster
caggaaaattcct

SEQ ID NO: 604024 - DNA, 13 bp, D. melanogaster
caggaaacaacag

SEQ ID NO: 604025 - DNA, 13 bp, D. melanogaster
caggaaacggaaa

SEQ ID NO: 604026 - DNA, 14 bp, D. melanogaster
caggaaacggaagt

SEQ ID NO: 604027 - DNA, 13 bp, D. melanogaster
caggaaatcaaaa

SEQ ID NO: 604028 - DNA, 14 bp, D. melanogaster
caggaaatcaaaaa

SEQ ID NO: 604029 - DNA, 13 bp, D. melanogaster
caggaaatgctga

SEQ ID NO: 604030 - DNA, 13 bp, D. melanogaster
caggaaattcaaa

SEQ ID NO: 604031 - DNA, 14 bp, D. melanogaster
caggaacaaaatca

SEQ ID NO: 604032 - DNA, 14 bp, D. melanogaster
caggaacaggagca

SEQ ID NO: 604033 - DNA, 14 bp, D. melanogaster
caggaacataaaca

SEQ ID NO: 604034 - DNA, 13 bp, D. melanogaster
caggaaccttaaa

SEQ ID NO: 604035 - DNA, 13 bp, D. melanogaster
caggaagataaaa

SEQ ID NO: 604036 - DNA, 13 bp, D. melanogaster
caggaagatcgat

SEQ ID NO: 604037 - DNA, 13 bp, D. melanogaster
caggaagcggaaa

SEQ ID NO: 604038 - DNA, 13 bp, D. melanogaster
caggaagctttca

SEQ ID NO: 604039 - DNA, 14 bp, D. melanogaster
caggaatatatata

SEQ ID NO: 604040 - DNA, 13 bp, D. melanogaster
caggaattatcca

SEQ ID NO: 604041 - DNA, 13 bp, D. melanogaster
caggaattgtatg

SEQ ID NO: 604042 - DNA, 14 bp, D. melanogaster
caggaatttctaga

SEQ ID NO: 604043 - DNA, 13 bp, D. melanogaster
caggacacaacaa

SEQ ID NO: 604044 - DNA, 13 bp, D. melanogaster
caggacacaggac

SEQ ID NO: 604045 - DNA, 13 bp, D. melanogaster
caggacaggacag

SEQ ID NO: 604046 - DNA, 13 bp, D. melanogaster
caggacattatca

SEQ ID NO: 604047 - DNA, 13 bp, D. melanogaster
caggaccaaggac

SEQ ID NO: 604048 - DNA, 13 bp, D. melanogaster
caggaccaccatt

SEQ ID NO: 604049 - DNA, 14 bp, D. melanogaster
caggaccaggacca

SEQ ID NO: 604050 - DNA, 15 bp, D. melanogaster
caggacctcacttcg

SEQ ID NO: 604051 - DNA, 13 bp, D. melanogaster
caggacgaaggac

SEQ ID NO: 604052 - DNA, 13 bp, D. melanogaster
caggacgaccaaa

SEQ ID NO: 604053 - DNA, 13 bp, D. melanogaster
caggacgagcagg

SEQ ID NO: 604054 - DNA, 13 bp, D. melanogaster
caggacgcaggac

SEQ ID NO: 604055 - DNA, 13 bp, D. melanogaster
caggactcaggac

SEQ ID NO: 604056 - DNA, 14 bp, D. melanogaster
caggactcgcagga

SEQ ID NO: 604057 - DNA, 13 bp, D. melanogaster
caggacttctttg

SEQ ID NO: 604058 - DNA, 13 bp, D. melanogaster
caggagaaaatta

SEQ ID NO: 604059 - DNA, 14 bp, D. melanogaster
caggagcaacaaca

SEQ ID NO: 604060 - DNA, 14 bp, D. melanogaster
caggagcaacagca

SEQ ID NO: 604061 - DNA, 13 bp, D. melanogaster
caggagcagaaac

SEQ ID NO: 604062 - DNA, 13 bp, D. melanogaster
caggagcagaagc

SEQ ID NO: 604063 - DNA, 13 bp, D. melanogaster
caggagcagcaca

SEQ ID NO: 604064 - DNA, 14 bp, D. melanogaster
caggagcagcagaa

SEQ ID NO: 604065 - DNA, 15 bp, D. melanogaster
caggagcagcagcag

SEQ ID NO: 604066 - DNA, 13 bp, D. melanogaster
caggagcagcagt

SEQ ID NO: 604067 - DNA, 13 bp, D. melanogaster
caggagcagcggc

SEQ ID NO: 604068 - DNA, 13 bp, D. melanogaster
caggagcaggacc

SEQ ID NO: 604069 - DNA, 14 bp, D. melanogaster
caggagcaggacca

SEQ ID NO: 604070 - DNA, 13 bp, D. melanogaster
caggagcaggagc

SEQ ID NO: 604071 - DNA, 14 bp, D. melanogaster
caggagcaggagca

SEQ ID NO: 604072 - DNA, 16 bp, D. melanogaster
caggagcaggagcagg

SEQ ID NO: 604073 - DNA, 14 bp, D. melanogaster
caggagcagggtgt

SEQ ID NO: 604074 - DNA, 13 bp, D. melanogaster
caggagctagcag

SEQ ID NO: 604075 - DNA, 13 bp, D. melanogaster
caggagctgcaac

SEQ ID NO: 604076 - DNA, 14 bp, D. melanogaster
caggagctggagca

SEQ ID NO: 604077 - DNA, 13 bp, D. melanogaster
caggaggagcagg

SEQ ID NO: 604078 - DNA, 13 bp, D. melanogaster
caggaggagcatt

SEQ ID NO: 604079 - DNA, 13 bp, D. melanogaster
caggaggaggagc

SEQ ID NO: 604080 - DNA, 14 bp, D. melanogaster
caggaggaggagca

SEQ ID NO: 604081 - DNA, 13 bp, D. melanogaster
caggatactgggg

SEQ ID NO: 604082 - DNA, 13 bp, D. melanogaster
caggatcaggatc

SEQ ID NO: 604083 - DNA, 13 bp, D. melanogaster
caggatccaggat

SEQ ID NO: 604084 - DNA, 13 bp, D. melanogaster
caggatccgaaac

SEQ ID NO: 604085 - DNA, 13 bp, D. melanogaster
caggatcttgggt

SEQ ID NO: 604086 - DNA, 13 bp, D. melanogaster
caggatgacaatt

SEQ ID NO: 604087 - DNA, 13 bp, D. melanogaster
caggatgcaggac

SEQ ID NO: 604088 - DNA, 13 bp, D. melanogaster
caggatgccagga

SEQ ID NO: 604089 - DNA, 14 bp, D. melanogaster
caggatgccgtgct

SEQ ID NO: 604090 - DNA, 14 bp, D. melanogaster
caggatggcaggat

SEQ ID NO: 604091 - DNA, 13 bp, D. melanogaster
caggattcaggat

SEQ ID NO: 604092 - DNA, 14 bp, D. melanogaster
caggattcaggatt

SEQ ID NO: 604093 - DNA, 13 bp, D. melanogaster
caggatttcttct

SEQ ID NO: 604094 - DNA, 13 bp, D. melanogaster
caggcaaaagcag

SEQ ID NO: 604095 - DNA, 14 bp, D. melanogaster
caggcaaacagaaa

SEQ ID NO: 604096 - DNA, 13 bp, D. melanogaster
caggcaaataaaa

SEQ ID NO: 604097 - DNA, 13 bp, D. melanogaster
caggcaaatcaaa

SEQ ID NO: 604098 - DNA, 13 bp, D. melanogaster
caggcaaatgcaa

SEQ ID NO: 604099 - DNA, 13 bp, D. melanogaster
caggcaacaacaa

SEQ ID NO: 604100 - DNA, 13 bp, D. melanogaster
caggcaactaagg

SEQ ID NO: 604101 - DNA, 13 bp, D. melanogaster
caggcacatcaca

SEQ ID NO: 604102 - DNA, 14 bp, D. melanogaster
caggcacattcaca

SEQ ID NO: 604103 - DNA, 13 bp, D. melanogaster
caggcacctggta

SEQ ID NO: 604104 - DNA, 13 bp, D. melanogaster
caggcacttttta

SEQ ID NO: 604105 - DNA, 13 bp, D. melanogaster
caggcagaagaaa

SEQ ID NO: 604106 - DNA, 13 bp, D. melanogaster
caggcagaaggaa

SEQ ID NO: 604107 - DNA, 13 bp, D. melanogaster
caggcagcaaaaa

SEQ ID NO: 604108 - DNA, 13 bp, D. melanogaster
caggcagcagaaa

SEQ ID NO: 604109 - DNA, 14 bp, D. melanogaster
caggcagcagcagc

SEQ ID NO: 604110 - DNA, 13 bp, D. melanogaster
caggcagccagcc

SEQ ID NO: 604111 - DNA, 14 bp, D. melanogaster
caggcagccagcca

SEQ ID NO: 604112 - DNA, 13 bp, D. melanogaster
caggcagccccaa

SEQ ID NO: 604113 - DNA, 13 bp, D. melanogaster
caggcagcgaaaa

SEQ ID NO: 604114 - DNA, 13 bp, D. melanogaster
caggcaggcagca

SEQ ID NO: 604115 - DNA, 13 bp, D. melanogaster
caggcagtcagtc

SEQ ID NO: 604116 - DNA, 14 bp, D. melanogaster
caggcagtcagtca

SEQ ID NO: 604117 - DNA, 13 bp, D. melanogaster
caggcataaatca

SEQ ID NO: 604118 - DNA, 13 bp, D. melanogaster
caggcattaaatt

SEQ ID NO: 604119 - DNA, 13 bp, D. melanogaster
caggcattacaag

SEQ ID NO: 604120 - DNA, 13 bp, D. melanogaster
caggcattccttt

SEQ ID NO: 604121 - DNA, 13 bp, D. melanogaster
caggcatttcatt

SEQ ID NO: 604122 - DNA, 13 bp, D. melanogaster
caggcatttgcat

SEQ ID NO: 604123 - DNA, 13 bp, D. melanogaster
caggccaaaaagc

SEQ ID NO: 604124 - DNA, 13 bp, D. melanogaster
caggccaaataaa

SEQ ID NO: 604125 - DNA, 13 bp, D. melanogaster
caggccaaatgcc

SEQ ID NO: 604126 - DNA, 13 bp, D. melanogaster
caggccaacatga

SEQ ID NO: 604127 - DNA, 13 bp, D. melanogaster
caggccaagaaaa

SEQ ID NO: 604128 - DNA, 13 bp, D. melanogaster
caggccaataaaa

SEQ ID NO: 604129 - DNA, 13 bp, D. melanogaster
caggccacctttt

SEQ ID NO: 604130 - DNA, 13 bp, D. melanogaster
caggccactatgc

SEQ ID NO: 604131 - DNA, 13 bp, D. melanogaster
caggccaggccag

SEQ ID NO: 604132 - DNA, 13 bp, D. melanogaster
caggcgaacagga

SEQ ID NO: 604133 - DNA, 13 bp, D. melanogaster
caggcgaagacct

SEQ ID NO: 604134 - DNA, 13 bp, D. melanogaster
caggcgactcggg

SEQ ID NO: 604135 - DNA, 13 bp, D. melanogaster
caggcgcagaaat

SEQ ID NO: 604136 - DNA, 13 bp, D. melanogaster
caggcggacggac

SEQ ID NO: 604137 - DNA, 13 bp, D. melanogaster
caggcggcaacaa

SEQ ID NO: 604138 - DNA, 13 bp, D. melanogaster
caggcggcaggca

SEQ ID NO: 604139 - DNA, 13 bp, D. melanogaster
caggcgtaaaact

SEQ ID NO: 604140 - DNA, 13 bp, D. melanogaster
caggcgttcgaag

SEQ ID NO: 604141 - DNA, 13 bp, D. melanogaster
cagggaaaaactt

SEQ ID NO: 604142 - DNA, 13 bp, D. melanogaster
cagggaaatggga

SEQ ID NO: 604143 - DNA, 13 bp, D. melanogaster
cagggacagggac

SEQ ID NO: 604144 - DNA, 13 bp, D. melanogaster
cagggaccagcga

SEQ ID NO: 604145 - DNA, 13 bp, D. melanogaster
cagggagcagaat

SEQ ID NO: 604146 - DNA, 13 bp, D. melanogaster
cagggagcgaaac

SEQ ID NO: 604147 - DNA, 13 bp, D. melanogaster
cagggcagggcag

SEQ ID NO: 604148 - DNA, 13 bp, D. melanogaster
cagggccaaaacc

SEQ ID NO: 604149 - DNA, 13 bp, D. melanogaster
cagggccacgccc

SEQ ID NO: 604150 - DNA, 14 bp, D. melanogaster
cagggccagatcga

SEQ ID NO: 604151 - DNA, 13 bp, D. melanogaster
cagggcgtatacg

SEQ ID NO: 604152 - DNA, 13 bp, D. melanogaster
caggggcggagtt

SEQ ID NO: 604153 - DNA, 14 bp, D. melanogaster
cagggggcgtggcc

SEQ ID NO: 604154 - DNA, 13 bp, D. melanogaster
caggggtcagggg

SEQ ID NO: 604155 - DNA, 13 bp, D. melanogaster
cagggttgccacc

SEQ ID NO: 604156 - DNA, 13 bp, D. melanogaster
cagggttgccagg

SEQ ID NO: 604157 - DNA, 13 bp, D. melanogaster
caggtaaacgaag

SEQ ID NO: 604158 - DNA, 13 bp, D. melanogaster
caggtaaatacgt

SEQ ID NO: 604159 - DNA, 13 bp, D. melanogaster
caggtagaagaaa

SEQ ID NO: 604160 - DNA, 13 bp, D. melanogaster
caggtcatattca

SEQ ID NO: 604161 - DNA, 13 bp, D. melanogaster
caggtcctggcaa

SEQ ID NO: 604162 - DNA, 13 bp, D. melanogaster
caggtcctggcca

SEQ ID NO: 604163 - DNA, 13 bp, D. melanogaster
caggtcgcactcc

SEQ ID NO: 604164 - DNA, 13 bp, D. melanogaster
caggtgagctgca

SEQ ID NO: 604165 - DNA, 13 bp, D. melanogaster
caggtgcagaaat

SEQ ID NO: 604166 - DNA, 13 bp, D. melanogaster
caggtgcctgtga

SEQ ID NO: 604167 - DNA, 13 bp, D. melanogaster
caggtggaaaatg

SEQ ID NO: 604168 - DNA, 13 bp, D. melanogaster
caggtggctgggc

SEQ ID NO: 604169 - DNA, 14 bp, D. melanogaster
caggtgggcgtggc

SEQ ID NO: 604170 - DNA, 13 bp, D. melanogaster
caggtgtcagctg

SEQ ID NO: 604171 - DNA, 13 bp, D. melanogaster
cagtaaaattgtt

SEQ ID NO: 604172 - DNA, 13 bp, D. melanogaster
cagtaaagatttt

SEQ ID NO: 604173 - DNA, 14 bp, D. melanogaster
cagtaaagtcatac

SEQ ID NO: 604174 - DNA, 13 bp, D. melanogaster
cagtaaataaata

SEQ ID NO: 604175 - DNA, 13 bp, D. melanogaster
cagtaaattaaaa

SEQ ID NO: 604176 - DNA, 13 bp, D. melanogaster
cagtaaattcaat

SEQ ID NO: 604177 - DNA, 13 bp, D. melanogaster
cagtaacagtaac

SEQ ID NO: 604178 - DNA, 13 bp, D. melanogaster
cagtaactgcggg

SEQ ID NO: 604179 - DNA, 13 bp, D. melanogaster
cagtaataataat

SEQ ID NO: 604180 - DNA, 14 bp, D. melanogaster
cagtaatatatcaa

SEQ ID NO: 604181 - DNA, 13 bp, D. melanogaster
cagtaattattat

SEQ ID NO: 604182 - DNA, 13 bp, D. melanogaster
cagtacaaataat

SEQ ID NO: 604183 - DNA, 13 bp, D. melanogaster
cagtacacacaca

SEQ ID NO: 604184 - DNA, 14 bp, D. melanogaster
cagtacagaaatga

SEQ ID NO: 604185 - DNA, 13 bp, D. melanogaster
cagtacagtacag

SEQ ID NO: 604186 - DNA, 14 bp, D. melanogaster
cagtaccagtacca

SEQ ID NO: 604187 - DNA, 13 bp, D. melanogaster
cagtacccagatt

SEQ ID NO: 604188 - DNA, 13 bp, D. melanogaster
cagtaccgtttgc

SEQ ID NO: 604189 - DNA, 13 bp, D. melanogaster
cagtacctgaatt

SEQ ID NO: 604190 - DNA, 13 bp, D. melanogaster
cagtacgaatttc

SEQ ID NO: 604191 - DNA, 13 bp, D. melanogaster
cagtactggaagc

SEQ ID NO: 604192 - DNA, 13 bp, D. melanogaster
cagtagaaaagga

SEQ ID NO: 604193 - DNA, 13 bp, D. melanogaster
cagtagcagcaac

SEQ ID NO: 604194 - DNA, 14 bp, D. melanogaster
cagtagcagcaaca

SEQ ID NO: 604195 - DNA, 14 bp, D. melanogaster
cagtagcagtagca

SEQ ID NO: 604196 - DNA, 13 bp, D. melanogaster
cagtagcattgtt

SEQ ID NO: 604197 - DNA, 13 bp, D. melanogaster
cagtagcttatgt

SEQ ID NO: 604198 - DNA, 14 bp, D. melanogaster
cagtagtagtagta

SEQ ID NO: 604199 - DNA, 13 bp, D. melanogaster
cagtagtccagat

SEQ ID NO: 604200 - DNA, 13 bp, D. melanogaster
cagtatatacgat

SEQ ID NO: 604201 - DNA, 13 bp, D. melanogaster
cagtatcacttca

SEQ ID NO: 604202 - DNA, 13 bp, D. melanogaster
cagtatctgtatc

SEQ ID NO: 604203 - DNA, 13 bp, D. melanogaster
cagtatctgtgtg

SEQ ID NO: 604204 - DNA, 13 bp, D. melanogaster
cagtattataata

SEQ ID NO: 604205 - DNA, 14 bp, D. melanogaster
cagtattgctttta

SEQ ID NO: 604206 - DNA, 13 bp, D. melanogaster
cagtattgttttt

SEQ ID NO: 604207 - DNA, 13 bp, D. melanogaster
cagtatttcagaa

SEQ ID NO: 604208 - DNA, 14 bp, D. melanogaster
cagtattttctcaa

SEQ ID NO: 604209 - DNA, 13 bp, D. melanogaster
cagtcaaaaatca

SEQ ID NO: 604210 - DNA, 13 bp, D. melanogaster
cagtcaaacattt

SEQ ID NO: 604211 - DNA, 13 bp, D. melanogaster
cagtcaacacgat

SEQ ID NO: 604212 - DNA, 13 bp, D. melanogaster
cagtcaagtcaag

SEQ ID NO: 604213 - DNA, 14 bp, D. melanogaster
cagtcaatcaatca

SEQ ID NO: 604214 - DNA, 13 bp, D. melanogaster
cagtcacacacac

SEQ ID NO: 604215 - DNA, 14 bp, D. melanogaster
cagtcacagtcaca

SEQ ID NO: 604216 - DNA, 13 bp, D. melanogaster
cagtcactcagtc

SEQ ID NO: 604217 - DNA, 13 bp, D. melanogaster
cagtcactttcgc

SEQ ID NO: 604218 - DNA, 13 bp, D. melanogaster
cagtcagacagtc

SEQ ID NO: 604219 - DNA, 13 bp, D. melanogaster
cagtcagcagtca

SEQ ID NO: 604220 - DNA, 14 bp, D. melanogaster
cagtcagccagcca

SEQ ID NO: 604221 - DNA, 13 bp, D. melanogaster
cagtcagccagtc

SEQ ID NO: 604222 - DNA, 14 bp, D. melanogaster
cagtcagccagtca

SEQ ID NO: 604223 - DNA, 13 bp, D. melanogaster
cagtcagtcaacc

SEQ ID NO: 604224 - DNA, 13 bp, D. melanogaster
cagtcagtcactc

SEQ ID NO: 604225 - DNA, 13 bp, D. melanogaster
cagtcagtcagac

SEQ ID NO: 604226 - DNA, 14 bp, D. melanogaster
cagtcagtcagtca

SEQ ID NO: 604227 - DNA, 14 bp, D. melanogaster
cagtcagtcagtcg

SEQ ID NO: 604228 - DNA, 13 bp, D. melanogaster
cagtcagtcagtt

SEQ ID NO: 604229 - DNA, 13 bp, D. melanogaster
cagtcagtcgagt

SEQ ID NO: 604230 - DNA, 13 bp, D. melanogaster
cagtcagtcgctg

SEQ ID NO: 604231 - DNA, 13 bp, D. melanogaster
cagtcagttggtc

SEQ ID NO: 604232 - DNA, 13 bp, D. melanogaster
cagtcatcataaa

SEQ ID NO: 604233 - DNA, 13 bp, D. melanogaster
cagtcatccagtc

SEQ ID NO: 604234 - DNA, 13 bp, D. melanogaster
cagtcatcgaagg

SEQ ID NO: 604235 - DNA, 13 bp, D. melanogaster
cagtcatctaatg

SEQ ID NO: 604236 - DNA, 13 bp, D. melanogaster
cagtccaaaaaca

SEQ ID NO: 604237 - DNA, 13 bp, D. melanogaster
cagtccagtccag

SEQ ID NO: 604238 - DNA, 14 bp, D. melanogaster
cagtccagtccagt

SEQ ID NO: 604239 - DNA, 14 bp, D. melanogaster
cagtcccaatccca

SEQ ID NO: 604240 - DNA, 13 bp, D. melanogaster
cagtcccattccc

SEQ ID NO: 604241 - DNA, 14 bp, D. melanogaster
cagtcgaaaaaaaa

SEQ ID NO: 604242 - DNA, 13 bp, D. melanogaster
cagtcgaaatcga

SEQ ID NO: 604243 - DNA, 13 bp, D. melanogaster
cagtcgagttctc

SEQ ID NO: 604244 - DNA, 13 bp, D. melanogaster
cagtcgcaaaaaa

SEQ ID NO: 604245 - DNA, 13 bp, D. melanogaster
cagtcgcagtcac

SEQ ID NO: 604246 - DNA, 13 bp, D. melanogaster
cagtcgcagtccc

SEQ ID NO: 604247 - DNA, 14 bp, D. melanogaster
cagtcgcagtccca

SEQ ID NO: 604248 - DNA, 13 bp, D. melanogaster
cagtcgcagttgc

SEQ ID NO: 604249 - DNA, 14 bp, D. melanogaster
cagtcgcagttgca

SEQ ID NO: 604250 - DNA, 13 bp, D. melanogaster
cagtcgctcagtt

SEQ ID NO: 604251 - DNA, 14 bp, D. melanogaster
cagtcgctcagttt

SEQ ID NO: 604252 - DNA, 13 bp, D. melanogaster
cagtcgctcgaaa

SEQ ID NO: 604253 - DNA, 13 bp, D. melanogaster
cagtcgctgcctc

SEQ ID NO: 604254 - DNA, 13 bp, D. melanogaster
cagtcggaaaatg

SEQ ID NO: 604255 - DNA, 13 bp, D. melanogaster
cagtcggcagtcg

SEQ ID NO: 604256 - DNA, 13 bp, D. melanogaster
cagtcggtcggtc

SEQ ID NO: 604257 - DNA, 14 bp, D. melanogaster
cagtctatatcaaa

SEQ ID NO: 604258 - DNA, 13 bp, D. melanogaster
cagtctcagtctc

SEQ ID NO: 604259 - DNA, 13 bp, D. melanogaster
cagtctggagcaa

SEQ ID NO: 604260 - DNA, 13 bp, D. melanogaster
cagtctgtacaaa

SEQ ID NO: 604261 - DNA, 14 bp, D. melanogaster
cagtcttcgggtgg

SEQ ID NO: 604262 - DNA, 13 bp, D. melanogaster
cagtctttatttg

SEQ ID NO: 604263 - DNA, 14 bp, D. melanogaster
cagtctttgttatt

SEQ ID NO: 604264 - DNA, 13 bp, D. melanogaster
cagtgaaaaaaag

SEQ ID NO: 604265 - DNA, 13 bp, D. melanogaster
cagtgaaaaaatg

SEQ ID NO: 604266 - DNA, 13 bp, D. melanogaster
cagtgaaaaatga

SEQ ID NO: 604267 - DNA, 13 bp, D. melanogaster
cagtgaaaataaa

SEQ ID NO: 604268 - DNA, 13 bp, D. melanogaster
cagtgaaagtgaa

SEQ ID NO: 604269 - DNA, 13 bp, D. melanogaster
cagtgaaataaat

SEQ ID NO: 604270 - DNA, 13 bp, D. melanogaster
cagtgaaatgttt

SEQ ID NO: 604271 - DNA, 13 bp, D. melanogaster
cagtgaagaaaaa

SEQ ID NO: 604272 - DNA, 13 bp, D. melanogaster
cagtgaatatgaa

SEQ ID NO: 604273 - DNA, 13 bp, D. melanogaster
cagtgacaccagc

SEQ ID NO: 604274 - DNA, 13 bp, D. melanogaster
cagtgagagaaaa

SEQ ID NO: 604275 - DNA, 13 bp, D. melanogaster
cagtgagagagag

SEQ ID NO: 604276 - DNA, 13 bp, D. melanogaster
cagtgagctttcg

SEQ ID NO: 604277 - DNA, 13 bp, D. melanogaster
cagtgatggacaa

SEQ ID NO: 604278 - DNA, 13 bp, D. melanogaster
cagtgcaaaaaat

SEQ ID NO: 604279 - DNA, 13 bp, D. melanogaster
cagtgcaaacaaa

SEQ ID NO: 604280 - DNA, 13 bp, D. melanogaster
cagtgcaaataaa

SEQ ID NO: 604281 - DNA, 13 bp, D. melanogaster
cagtgcaactgca

SEQ ID NO: 604282 - DNA, 13 bp, D. melanogaster
cagtgcaataaat

SEQ ID NO: 604283 - DNA, 13 bp, D. melanogaster
cagtgcacagtgg

SEQ ID NO: 604284 - DNA, 13 bp, D. melanogaster
cagtgcactgaaa

SEQ ID NO: 604285 - DNA, 13 bp, D. melanogaster
cagtgcagaaaaa

SEQ ID NO: 604286 - DNA, 13 bp, D. melanogaster
cagtgcagtgcag

SEQ ID NO: 604287 - DNA, 13 bp, D. melanogaster
cagtgcattagca

SEQ ID NO: 604288 - DNA, 13 bp, D. melanogaster
cagtgccaaaaat

SEQ ID NO: 604289 - DNA, 13 bp, D. melanogaster
cagtgccacatac

SEQ ID NO: 604290 - DNA, 14 bp, D. melanogaster
cagtgccacgcccc

SEQ ID NO: 604291 - DNA, 13 bp, D. melanogaster
cagtgccagtgcc

SEQ ID NO: 604292 - DNA, 14 bp, D. melanogaster
cagtgccagtgcca

SEQ ID NO: 604293 - DNA, 13 bp, D. melanogaster
cagtgcgtatgag

SEQ ID NO: 604294 - DNA, 13 bp, D. melanogaster
cagtgctaacgat

SEQ ID NO: 604295 - DNA, 14 bp, D. melanogaster
cagtgctatttttg

SEQ ID NO: 604296 - DNA, 13 bp, D. melanogaster
cagtgctcagtgc

SEQ ID NO: 604297 - DNA, 13 bp, D. melanogaster
cagtgctcgaaac

SEQ ID NO: 604298 - DNA, 13 bp, D. melanogaster
cagtgctgctgaa

SEQ ID NO: 604299 - DNA, 13 bp, D. melanogaster
cagtggaaaaaca

SEQ ID NO: 604300 - DNA, 13 bp, D. melanogaster
cagtggaaaatca

SEQ ID NO: 604301 - DNA, 13 bp, D. melanogaster
cagtggaaaccaa

SEQ ID NO: 604302 - DNA, 13 bp, D. melanogaster
cagtggacagtgg

SEQ ID NO: 604303 - DNA, 13 bp, D. melanogaster
cagtggagtcagt

SEQ ID NO: 604304 - DNA, 13 bp, D. melanogaster
cagtggatacact

SEQ ID NO: 604305 - DNA, 13 bp, D. melanogaster
cagtggcaaaaac

SEQ ID NO: 604306 - DNA, 13 bp, D. melanogaster
cagtggcaacaac

SEQ ID NO: 604307 - DNA, 13 bp, D. melanogaster
cagtggcaactgc

SEQ ID NO: 604308 - DNA, 14 bp, D. melanogaster
cagtggcagcaaca

SEQ ID NO: 604309 - DNA, 14 bp, D. melanogaster
cagtggcagcagca

SEQ ID NO: 604310 - DNA, 13 bp, D. melanogaster
cagtggcagccaa

SEQ ID NO: 604311 - DNA, 14 bp, D. melanogaster
cagtggcagcggca

SEQ ID NO: 604312 - DNA, 13 bp, D. melanogaster
cagtggcagtgcc

SEQ ID NO: 604313 - DNA, 14 bp, D. melanogaster
cagtggcagtggca

SEQ ID NO: 604314 - DNA, 13 bp, D. melanogaster
cagtggcagtggg

SEQ ID NO: 604315 - DNA, 14 bp, D. melanogaster
cagtggcagttgca

SEQ ID NO: 604316 - DNA, 13 bp, D. melanogaster
cagtggcatgttc

SEQ ID NO: 604317 - DNA, 13 bp, D. melanogaster
cagtggccagtgg

SEQ ID NO: 604318 - DNA, 13 bp, D. melanogaster
cagtggctcagtg

SEQ ID NO: 604319 - DNA, 14 bp, D. melanogaster
cagtggctcagtgg

SEQ ID NO: 604320 - DNA, 15 bp, D. melanogaster
cagtggctgccccac

SEQ ID NO: 604321 - DNA, 13 bp, D. melanogaster
cagtggctgtcaa

SEQ ID NO: 604322 - DNA, 13 bp, D. melanogaster
cagtgggcagtgg

SEQ ID NO: 604323 - DNA, 13 bp, D. melanogaster
cagtgggcgccag

SEQ ID NO: 604324 - DNA, 13 bp, D. melanogaster
cagtgggcggtgg

SEQ ID NO: 604325 - DNA, 14 bp, D. melanogaster
cagtgggcggtggg

SEQ ID NO: 604326 - DNA, 14 bp, D. melanogaster
cagtgggcgtggcc

SEQ ID NO: 604327 - DNA, 13 bp, D. melanogaster
cagtggggcaaat

SEQ ID NO: 604328 - DNA, 13 bp, D. melanogaster
cagtgggtggttg

SEQ ID NO: 604329 - DNA, 13 bp, D. melanogaster
cagtggtgggcat

SEQ ID NO: 604330 - DNA, 14 bp, D. melanogaster
cagtggtgggcatg

SEQ ID NO: 604331 - DNA, 13 bp, D. melanogaster
cagtgtatatatt

SEQ ID NO: 604332 - DNA, 13 bp, D. melanogaster
cagtgtccactgt

SEQ ID NO: 604333 - DNA, 13 bp, D. melanogaster
cagtgtcgttgtc

SEQ ID NO: 604334 - DNA, 13 bp, D. melanogaster
cagtgtctgtgtg

SEQ ID NO: 604335 - DNA, 13 bp, D. melanogaster
cagtgtgaccatg

SEQ ID NO: 604336 - DNA, 13 bp, D. melanogaster
cagtgtgaccgtt

SEQ ID NO: 604337 - DNA, 13 bp, D. melanogaster
cagtgtgtaaaca

SEQ ID NO: 604338 - DNA, 13 bp, D. melanogaster
cagtgtgtgagtg

SEQ ID NO: 604339 - DNA, 13 bp, D. melanogaster
cagtgtgtgtgtt

SEQ ID NO: 604340 - DNA, 13 bp, D. melanogaster
cagtgttgccaac

SEQ ID NO: 604341 - DNA, 13 bp, D. melanogaster
cagtgttggtaaa

SEQ ID NO: 604342 - DNA, 13 bp, D. melanogaster
cagtgttgttgtg

SEQ ID NO: 604343 - DNA, 13 bp, D. melanogaster
cagtgttgttttt

SEQ ID NO: 604344 - DNA, 13 bp, D. melanogaster
cagttaaaaatgt

SEQ ID NO: 604345 - DNA, 13 bp, D. melanogaster
cagttaaaagcga

SEQ ID NO: 604346 - DNA, 13 bp, D. melanogaster
cagttaaaataaa

SEQ ID NO: 604347 - DNA, 14 bp, D. melanogaster
cagttaaaataaag

SEQ ID NO: 604348 - DNA, 13 bp, D. melanogaster
cagttaaattcaa

SEQ ID NO: 604349 - DNA, 13 bp, D. melanogaster
cagttaataattt

SEQ ID NO: 604350 - DNA, 13 bp, D. melanogaster
cagttacagttac

SEQ ID NO: 604351 - DNA, 13 bp, D. melanogaster
cagttacgaaaaa

SEQ ID NO: 604352 - DNA, 13 bp, D. melanogaster
cagttactttaga

SEQ ID NO: 604353 - DNA, 13 bp, D. melanogaster
cagttagtactcc

SEQ ID NO: 604354 - DNA, 13 bp, D. melanogaster
cagttagtcattc

SEQ ID NO: 604355 - DNA, 13 bp, D. melanogaster
cagttagttagtt

SEQ ID NO: 604356 - DNA, 14 bp, D. melanogaster
cagttagttagtta

SEQ ID NO: 604357 - DNA, 13 bp, D. melanogaster
cagttatcagtta

SEQ ID NO: 604358 - DNA, 13 bp, D. melanogaster
cagttattatcag

SEQ ID NO: 604359 - DNA, 13 bp, D. melanogaster
cagttattcccac

SEQ ID NO: 604360 - DNA, 13 bp, D. melanogaster
cagttattccccg

SEQ ID NO: 604361 - DNA, 13 bp, D. melanogaster
cagttattctttc

SEQ ID NO: 604362 - DNA, 13 bp, D. melanogaster
cagttatttcttc

SEQ ID NO: 604363 - DNA, 13 bp, D. melanogaster
cagttatttttta

SEQ ID NO: 604364 - DNA, 13 bp, D. melanogaster
cagttcaaataaa

SEQ ID NO: 604365 - DNA, 13 bp, D. melanogaster
cagttcaatgcac

SEQ ID NO: 604366 - DNA, 13 bp, D. melanogaster
cagttcagcagag

SEQ ID NO: 604367 - DNA, 13 bp, D. melanogaster
cagttcagttcaa

SEQ ID NO: 604368 - DNA, 13 bp, D. melanogaster
cagttcagtttca

SEQ ID NO: 604369 - DNA, 14 bp, D. melanogaster
cagttccagttcca

SEQ ID NO: 604370 - DNA, 13 bp, D. melanogaster
cagttccagtttt

SEQ ID NO: 604371 - DNA, 13 bp, D. melanogaster
cagttcccagttt

SEQ ID NO: 604372 - DNA, 13 bp, D. melanogaster
cagttcctagctt

SEQ ID NO: 604373 - DNA, 13 bp, D. melanogaster
cagttcctcgaag

SEQ ID NO: 604374 - DNA, 13 bp, D. melanogaster
cagttcgaggagt

SEQ ID NO: 604375 - DNA, 13 bp, D. melanogaster
cagttcgattgga

SEQ ID NO: 604376 - DNA, 13 bp, D. melanogaster
cagttcgatttga

SEQ ID NO: 604377 - DNA, 13 bp, D. melanogaster
cagttcgcagttc

SEQ ID NO: 604378 - DNA, 13 bp, D. melanogaster
cagttcgcagttt

SEQ ID NO: 604379 - DNA, 13 bp, D. melanogaster
cagttcggttcag

SEQ ID NO: 604380 - DNA, 13 bp, D. melanogaster
cagttcggttcgg

SEQ ID NO: 604381 - DNA, 13 bp, D. melanogaster
cagttctcagttc

SEQ ID NO: 604382 - DNA, 14 bp, D. melanogaster
cagttctcagttct

SEQ ID NO: 604383 - DNA, 13 bp, D. melanogaster
cagttctctggtc

SEQ ID NO: 604384 - DNA, 14 bp, D. melanogaster
cagttctctggtca

SEQ ID NO: 604385 - DNA, 13 bp, D. melanogaster
cagttcttcccac

SEQ ID NO: 604386 - DNA, 13 bp, D. melanogaster
cagttcttttcta

SEQ ID NO: 604387 - DNA, 13 bp, D. melanogaster
cagttgaaattgc

SEQ ID NO: 604388 - DNA, 13 bp, D. melanogaster
cagttgaataaat

SEQ ID NO: 604389 - DNA, 13 bp, D. melanogaster
cagttgaattttt

SEQ ID NO: 604390 - DNA, 14 bp, D. melanogaster
cagttgacaatgaa

SEQ ID NO: 604391 - DNA, 13 bp, D. melanogaster
cagttgacatttg

SEQ ID NO: 604392 - DNA, 14 bp, D. melanogaster
cagttgatcaactg

SEQ ID NO: 604393 - DNA, 13 bp, D. melanogaster
cagttgatcgctg

SEQ ID NO: 604394 - DNA, 14 bp, D. melanogaster
cagttgatcgctgt

SEQ ID NO: 604395 - DNA, 13 bp, D. melanogaster
cagttgatgataa

SEQ ID NO: 604396 - DNA, 13 bp, D. melanogaster
cagttgcaaaaaa

SEQ ID NO: 604397 - DNA, 13 bp, D. melanogaster
cagttgcaaatgc

SEQ ID NO: 604398 - DNA, 13 bp, D. melanogaster
cagttgcaaattt

SEQ ID NO: 604399 - DNA, 14 bp, D. melanogaster
cagttgcaacagca

SEQ ID NO: 604400 - DNA, 13 bp, D. melanogaster
cagttgcaacttg

SEQ ID NO: 604401 - DNA, 13 bp, D. melanogaster
cagttgcaagtgc

SEQ ID NO: 604402 - DNA, 13 bp, D. melanogaster
cagttgcaattaa

SEQ ID NO: 604403 - DNA, 13 bp, D. melanogaster
cagttgcaattgt

SEQ ID NO: 604404 - DNA, 13 bp, D. melanogaster
cagttgcaatttg

SEQ ID NO: 604405 - DNA, 13 bp, D. melanogaster
cagttgcaccaaa

SEQ ID NO: 604406 - DNA, 14 bp, D. melanogaster
cagttgcacttgca

SEQ ID NO: 604407 - DNA, 13 bp, D. melanogaster
cagttgcagatac

SEQ ID NO: 604408 - DNA, 14 bp, D. melanogaster
cagttgcagataca

SEQ ID NO: 604409 - DNA, 13 bp, D. melanogaster
cagttgcagtggc

SEQ ID NO: 604410 - DNA, 13 bp, D. melanogaster
cagttgcagttgc

SEQ ID NO: 604411 - DNA, 14 bp, D. melanogaster
cagttgcagttgcc

SEQ ID NO: 604412 - DNA, 14 bp, D. melanogaster
cagttgcagttgct

SEQ ID NO: 604413 - DNA, 13 bp, D. melanogaster
cagttgcagttgt

SEQ ID NO: 604414 - DNA, 13 bp, D. melanogaster
cagttgcagtttg

SEQ ID NO: 604415 - DNA, 13 bp, D. melanogaster
cagttgcagtttt

SEQ ID NO: 604416 - DNA, 13 bp, D. melanogaster
cagttgcattcgc

SEQ ID NO: 604417 - DNA, 13 bp, D. melanogaster
cagttgcatttgc

SEQ ID NO: 604418 - DNA, 13 bp, D. melanogaster
cagttgcattttg

SEQ ID NO: 604419 - DNA, 13 bp, D. melanogaster
cagttgccactgc

SEQ ID NO: 604420 - DNA, 13 bp, D. melanogaster
cagttgccagtga

SEQ ID NO: 604421 - DNA, 14 bp, D. melanogaster
cagttgccagtgag

SEQ ID NO: 604422 - DNA, 13 bp, D. melanogaster
cagttgccagttg

SEQ ID NO: 604423 - DNA, 14 bp, D. melanogaster
cagttgccagttgc

SEQ ID NO: 604424 - DNA, 13 bp, D. melanogaster
cagttgccgatgc

SEQ ID NO: 604425 - DNA, 13 bp, D. melanogaster
cagttgccgctgc

SEQ ID NO: 604426 - DNA, 13 bp, D. melanogaster
cagttgccgttgc

SEQ ID NO: 604427 - DNA, 13 bp, D. melanogaster
cagttgccttggc

SEQ ID NO: 604428 - DNA, 13 bp, D. melanogaster
cagttgcctttgc

SEQ ID NO: 604429 - DNA, 13 bp, D. melanogaster
cagttgctcagtt

SEQ ID NO: 604430 - DNA, 14 bp, D. melanogaster
cagttgctctttga

SEQ ID NO: 604431 - DNA, 13 bp, D. melanogaster
cagttgctgcagt

SEQ ID NO: 604432 - DNA, 13 bp, D. melanogaster
cagttgctgctgt

SEQ ID NO: 604433 - DNA, 13 bp, D. melanogaster
cagttggaaaaac

SEQ ID NO: 604434 - DNA, 15 bp, D. melanogaster
cagttggaaaaataa

SEQ ID NO: 604435 - DNA, 13 bp, D. melanogaster
cagttggaaaagc

SEQ ID NO: 604436 - DNA, 13 bp, D. melanogaster
cagttggaaaata

SEQ ID NO: 604437 - DNA, 13 bp, D. melanogaster
cagttggagttgc

SEQ ID NO: 604438 - DNA, 13 bp, D. melanogaster
cagttggcaaaag

SEQ ID NO: 604439 - DNA, 13 bp, D. melanogaster
cagttggcaaaca

SEQ ID NO: 604440 - DNA, 13 bp, D. melanogaster
cagttggcagctg

SEQ ID NO: 604441 - DNA, 13 bp, D. melanogaster
cagttggcagttg

SEQ ID NO: 604442 - DNA, 14 bp, D. melanogaster
cagttggcagttgg

SEQ ID NO: 604443 - DNA, 13 bp, D. melanogaster
cagttggcagttt

SEQ ID NO: 604444 - DNA, 13 bp, D. melanogaster
cagttggccaaaa

SEQ ID NO: 604445 - DNA, 14 bp, D. melanogaster
cagttggccaaaaa

SEQ ID NO: 604446 - DNA, 13 bp, D. melanogaster
cagttggccaaca

SEQ ID NO: 604447 - DNA, 13 bp, D. melanogaster
cagttggccaact

SEQ ID NO: 604448 - DNA, 13 bp, D. melanogaster
cagttggccaaga

SEQ ID NO: 604449 - DNA, 13 bp, D. melanogaster
cagttggccaagt

SEQ ID NO: 604450 - DNA, 13 bp, D. melanogaster
cagttggccactt

SEQ ID NO: 604451 - DNA, 13 bp, D. melanogaster
cagttggccagtc

SEQ ID NO: 604452 - DNA, 13 bp, D. melanogaster
cagttggccagtt

SEQ ID NO: 604453 - DNA, 13 bp, D. melanogaster
cagttggccataa

SEQ ID NO: 604454 - DNA, 13 bp, D. melanogaster
cagttggctaaaa

SEQ ID NO: 604455 - DNA, 13 bp, D. melanogaster
cagttggcttaaa

SEQ ID NO: 604456 - DNA, 13 bp, D. melanogaster
cagttggcttggc

SEQ ID NO: 604457 - DNA, 13 bp, D. melanogaster
cagttggctttta

SEQ ID NO: 604458 - DNA, 13 bp, D. melanogaster
cagttgggaaaat

SEQ ID NO: 604459 - DNA, 13 bp, D. melanogaster
cagttgggccaaa

SEQ ID NO: 604460 - DNA, 13 bp, D. melanogaster
cagttgtattatt

SEQ ID NO: 604461 - DNA, 13 bp, D. melanogaster
cagttgtcagttg

SEQ ID NO: 604462 - DNA, 13 bp, D. melanogaster
cagttgtccatca

SEQ ID NO: 604463 - DNA, 13 bp, D. melanogaster
cagttgttcagtt

SEQ ID NO: 604464 - DNA, 13 bp, D. melanogaster
cagttgttctagt

SEQ ID NO: 604465 - DNA, 13 bp, D. melanogaster
cagttgttgctgt

SEQ ID NO: 604466 - DNA, 13 bp, D. melanogaster
cagttgttggagt

SEQ ID NO: 604467 - DNA, 13 bp, D. melanogaster
cagttgttggcca

SEQ ID NO: 604468 - DNA, 14 bp, D. melanogaster
cagttgttgttgcc

SEQ ID NO: 604469 - DNA, 13 bp, D. melanogaster
cagttgttgttgt

SEQ ID NO: 604470 - DNA, 13 bp, D. melanogaster
cagttgttgtttc

SEQ ID NO: 604471 - DNA, 13 bp, D. melanogaster
cagttgttgtttt

SEQ ID NO: 604472 - DNA, 13 bp, D. melanogaster
cagttgtttcccc

SEQ ID NO: 604473 - DNA, 13 bp, D. melanogaster
cagtttaaaaaca

SEQ ID NO: 604474 - DNA, 13 bp, D. melanogaster
cagtttaaaattg

SEQ ID NO: 604475 - DNA, 13 bp, D. melanogaster
cagtttaaatatt

SEQ ID NO: 604476 - DNA, 13 bp, D. melanogaster
cagtttacacatt

SEQ ID NO: 604477 - DNA, 13 bp, D. melanogaster
cagtttagtttag

SEQ ID NO: 604478 - DNA, 13 bp, D. melanogaster
cagtttatattac

SEQ ID NO: 604479 - DNA, 13 bp, D. melanogaster
cagtttattaaat

SEQ ID NO: 604480 - DNA, 14 bp, D. melanogaster
cagtttattgattt

SEQ ID NO: 604481 - DNA, 13 bp, D. melanogaster
cagtttatttatt

SEQ ID NO: 604482 - DNA, 13 bp, D. melanogaster
cagtttcaaataa

SEQ ID NO: 604483 - DNA, 13 bp, D. melanogaster
cagtttcaattta

SEQ ID NO: 604484 - DNA, 13 bp, D. melanogaster
cagtttcaatttc

SEQ ID NO: 604485 - DNA, 13 bp, D. melanogaster
cagtttcacaaaa

SEQ ID NO: 604486 - DNA, 13 bp, D. melanogaster
cagtttcagattc

SEQ ID NO: 604487 - DNA, 14 bp, D. melanogaster
cagtttcagcttca

SEQ ID NO: 604488 - DNA, 13 bp, D. melanogaster
cagtttcagtaga

SEQ ID NO: 604489 - DNA, 13 bp, D. melanogaster
cagtttcagttca

SEQ ID NO: 604490 - DNA, 14 bp, D. melanogaster
cagtttcagttcca

SEQ ID NO: 604491 - DNA, 13 bp, D. melanogaster
cagtttcagttgc

SEQ ID NO: 604492 - DNA, 14 bp, D. melanogaster
cagtttcagttgca

SEQ ID NO: 604493 - DNA, 13 bp, D. melanogaster
cagtttcagtttc

SEQ ID NO: 604494 - DNA, 13 bp, D. melanogaster
cagtttcagtttt

SEQ ID NO: 604495 - DNA, 14 bp, D. melanogaster
cagtttcagtttta

SEQ ID NO: 604496 - DNA, 13 bp, D. melanogaster
cagtttcatcttc

SEQ ID NO: 604497 - DNA, 14 bp, D. melanogaster
cagtttcattttca

SEQ ID NO: 604498 - DNA, 13 bp, D. melanogaster
cagtttcccagct

SEQ ID NO: 604499 - DNA, 13 bp, D. melanogaster
cagtttcctggcc

SEQ ID NO: 604500 - DNA, 13 bp, D. melanogaster
cagtttccttttg

SEQ ID NO: 604501 - DNA, 13 bp, D. melanogaster
cagtttcgtttcg

SEQ ID NO: 604502 - DNA, 13 bp, D. melanogaster
cagtttctgttgc

SEQ ID NO: 604503 - DNA, 13 bp, D. melanogaster
cagtttctgtttg

SEQ ID NO: 604504 - DNA, 13 bp, D. melanogaster
cagtttcttacaa

SEQ ID NO: 604505 - DNA, 14 bp, D. melanogaster
cagtttgaaattaa

SEQ ID NO: 604506 - DNA, 13 bp, D. melanogaster
cagtttgaacttg

SEQ ID NO: 604507 - DNA, 13 bp, D. melanogaster
cagtttgatttat

SEQ ID NO: 604508 - DNA, 13 bp, D. melanogaster
cagtttgcaattt

SEQ ID NO: 604509 - DNA, 13 bp, D. melanogaster
cagtttgcagctt

SEQ ID NO: 604510 - DNA, 13 bp, D. melanogaster
cagtttgcagttg

SEQ ID NO: 604511 - DNA, 13 bp, D. melanogaster
cagtttgcagttt

SEQ ID NO: 604512 - DNA, 13 bp, D. melanogaster
cagtttgccagtt

SEQ ID NO: 604513 - DNA, 13 bp, D. melanogaster
cagtttggaaaat

SEQ ID NO: 604514 - DNA, 13 bp, D. melanogaster
cagtttggccaca

SEQ ID NO: 604515 - DNA, 13 bp, D. melanogaster
cagtttggcttcc

SEQ ID NO: 604516 - DNA, 13 bp, D. melanogaster
cagtttggttttt

SEQ ID NO: 604517 - DNA, 15 bp, D. melanogaster
cagtttgtcaagaaa

SEQ ID NO: 604518 - DNA, 13 bp, D. melanogaster
cagtttgtcagtt

SEQ ID NO: 604519 - DNA, 13 bp, D. melanogaster
cagtttgtgtgtg

SEQ ID NO: 604520 - DNA, 13 bp, D. melanogaster
cagtttgtttggc

SEQ ID NO: 604521 - DNA, 13 bp, D. melanogaster
cagtttgttttta

SEQ ID NO: 604522 - DNA, 13 bp, D. melanogaster
cagttttacctct

SEQ ID NO: 604523 - DNA, 13 bp, D. melanogaster
cagttttagaaat

SEQ ID NO: 604524 - DNA, 13 bp, D. melanogaster
cagttttagtgtc

SEQ ID NO: 604525 - DNA, 13 bp, D. melanogaster
cagttttataatt

SEQ ID NO: 604526 - DNA, 13 bp, D. melanogaster
cagttttatttat

SEQ ID NO: 604527 - DNA, 13 bp, D. melanogaster
cagttttcaagtt

SEQ ID NO: 604528 - DNA, 13 bp, D. melanogaster
cagttttcaccca

SEQ ID NO: 604529 - DNA, 13 bp, D. melanogaster
cagttttcacttt

SEQ ID NO: 604530 - DNA, 13 bp, D. melanogaster
cagttttcagttt

SEQ ID NO: 604531 - DNA, 14 bp, D. melanogaster
cagttttcagtttg

SEQ ID NO: 604532 - DNA, 14 bp, D. melanogaster
cagttttcagtttt

SEQ ID NO: 604533 - DNA, 13 bp, D. melanogaster
cagttttcattgc

SEQ ID NO: 604534 - DNA, 13 bp, D. melanogaster
cagttttcatttt

SEQ ID NO: 604535 - DNA, 13 bp, D. melanogaster
cagttttccagct

SEQ ID NO: 604536 - DNA, 13 bp, D. melanogaster
cagttttccagtt

SEQ ID NO: 604537 - DNA, 13 bp, D. melanogaster
cagttttccattt

SEQ ID NO: 604538 - DNA, 13 bp, D. melanogaster
cagttttcccagc

SEQ ID NO: 604539 - DNA, 13 bp, D. melanogaster
cagttttcccagt

SEQ ID NO: 604540 - DNA, 13 bp, D. melanogaster
cagttttccccca

SEQ ID NO: 604541 - DNA, 13 bp, D. melanogaster
cagttttccgttt

SEQ ID NO: 604542 - DNA, 13 bp, D. melanogaster
cagttttcgatcg

SEQ ID NO: 604543 - DNA, 13 bp, D. melanogaster
cagttttcggttt

SEQ ID NO: 604544 - DNA, 13 bp, D. melanogaster
cagttttctattt

SEQ ID NO: 604545 - DNA, 13 bp, D. melanogaster
cagttttctgttt

SEQ ID NO: 604546 - DNA, 13 bp, D. melanogaster
cagttttcttggc

SEQ ID NO: 604547 - DNA, 13 bp, D. melanogaster
cagttttctttgt

SEQ ID NO: 604548 - DNA, 13 bp, D. melanogaster
cagttttgcatat

SEQ ID NO: 604549 - DNA, 13 bp, D. melanogaster
cagttttggacaa

SEQ ID NO: 604550 - DNA, 13 bp, D. melanogaster
cagttttgggtgg

SEQ ID NO: 604551 - DNA, 13 bp, D. melanogaster
cagttttggtttc

SEQ ID NO: 604552 - DNA, 14 bp, D. melanogaster
cagttttgtgcggt

SEQ ID NO: 604553 - DNA, 13 bp, D. melanogaster
cagttttgtgttt

SEQ ID NO: 604554 - DNA, 13 bp, D. melanogaster
cagttttgtttgc

SEQ ID NO: 604555 - DNA, 13 bp, D. melanogaster
cagtttttaaaaa

SEQ ID NO: 604556 - DNA, 13 bp, D. melanogaster
cagtttttaaatt

SEQ ID NO: 604557 - DNA, 13 bp, D. melanogaster
cagtttttagttt

SEQ ID NO: 604558 - DNA, 13 bp, D. melanogaster
cagtttttcaaac

SEQ ID NO: 604559 - DNA, 13 bp, D. melanogaster
cagtttttcagct

SEQ ID NO: 604560 - DNA, 13 bp, D. melanogaster
cagtttttcagtt

SEQ ID NO: 604561 - DNA, 13 bp, D. melanogaster
cagtttttccagc

SEQ ID NO: 604562 - DNA, 13 bp, D. melanogaster
cagtttttcccat

SEQ ID NO: 604563 - DNA, 13 bp, D. melanogaster
cagtttttggttt

SEQ ID NO: 604564 - DNA, 13 bp, D. melanogaster
cagtttttgtgtg

SEQ ID NO: 604565 - DNA, 13 bp, D. melanogaster
cagtttttgtttg

SEQ ID NO: 604566 - DNA, 13 bp, D. melanogaster
cagttttttgccc

SEQ ID NO: 604567 - DNA, 13 bp, D. melanogaster
cagtttttttgga

SEQ ID NO: 604568 - DNA, 13 bp, D. melanogaster
cataaaaaaccga

SEQ ID NO: 604569 - DNA, 13 bp, D. melanogaster
cataaaaaactga

SEQ ID NO: 604570 - DNA, 13 bp, D. melanogaster
cataaaaaatgca

SEQ ID NO: 604571 - DNA, 13 bp, D. melanogaster
cataaaaaattgt

SEQ ID NO: 604572 - DNA, 13 bp, D. melanogaster
cataaaaaccgaa

SEQ ID NO: 604573 - DNA, 13 bp, D. melanogaster
cataaaaacctat

SEQ ID NO: 604574 - DNA, 13 bp, D. melanogaster
cataaaaactaag

SEQ ID NO: 604575 - DNA, 13 bp, D. melanogaster
cataaaaagtgaa

SEQ ID NO: 604576 - DNA, 13 bp, D. melanogaster
cataaaaagtgca

SEQ ID NO: 604577 - DNA, 13 bp, D. melanogaster
cataaaaagtgtt

SEQ ID NO: 604578 - DNA, 13 bp, D. melanogaster
cataaaaatagta

SEQ ID NO: 604579 - DNA, 13 bp, D. melanogaster
cataaaaatcgca

SEQ ID NO: 604580 - DNA, 14 bp, D. melanogaster
cataaaaatgaaat

SEQ ID NO: 604581 - DNA, 14 bp, D. melanogaster
cataaaaatgcaat

SEQ ID NO: 604582 - DNA, 14 bp, D. melanogaster
cataaaaatgccaa

SEQ ID NO: 604583 - DNA, 13 bp, D. melanogaster
cataaaaatgcgc

SEQ ID NO: 604584 - DNA, 13 bp, D. melanogaster
cataaaaatggtt

SEQ ID NO: 604585 - DNA, 14 bp, D. melanogaster
cataaaaatgtcaa

SEQ ID NO: 604586 - DNA, 13 bp, D. melanogaster
cataaaaatgtcg

SEQ ID NO: 604587 - DNA, 13 bp, D. melanogaster
cataaaaatgttg

SEQ ID NO: 604588 - DNA, 13 bp, D. melanogaster
cataaaaattgca

SEQ ID NO: 604589 - DNA, 13 bp, D. melanogaster
cataaaacacttt

SEQ ID NO: 604590 - DNA, 13 bp, D. melanogaster
cataaaacatatt

SEQ ID NO: 604591 - DNA, 14 bp, D. melanogaster
cataaaacattttt

SEQ ID NO: 604592 - DNA, 13 bp, D. melanogaster
cataaaaccaatt

SEQ ID NO: 604593 - DNA, 13 bp, D. melanogaster
cataaaaccgaat

SEQ ID NO: 604594 - DNA, 13 bp, D. melanogaster
cataaaacgaatt

SEQ ID NO: 604595 - DNA, 13 bp, D. melanogaster
cataaaacgacaa

SEQ ID NO: 604596 - DNA, 13 bp, D. melanogaster
cataaaacgtttt

SEQ ID NO: 604597 - DNA, 13 bp, D. melanogaster
cataaaactgaaa

SEQ ID NO: 604598 - DNA, 14 bp, D. melanogaster
cataaaagattctt

SEQ ID NO: 604599 - DNA, 13 bp, D. melanogaster
cataaaagcaaat

SEQ ID NO: 604600 - DNA, 13 bp, D. melanogaster
cataaaagcattg

SEQ ID NO: 604601 - DNA, 13 bp, D. melanogaster
cataaaagccaac

SEQ ID NO: 604602 - DNA, 13 bp, D. melanogaster
cataaaatacatt

SEQ ID NO: 604603 - DNA, 14 bp, D. melanogaster
cataaaatacattt

SEQ ID NO: 604604 - DNA, 13 bp, D. melanogaster
cataaaatacgaa

SEQ ID NO: 604605 - DNA, 13 bp, D. melanogaster
cataaaatagata

SEQ ID NO: 604606 - DNA, 13 bp, D. melanogaster
cataaaatatgaa

SEQ ID NO: 604607 - DNA, 13 bp, D. melanogaster
cataaaatatgat

SEQ ID NO: 604608 - DNA, 13 bp, D. melanogaster
cataaaatatgca

SEQ ID NO: 604609 - DNA, 13 bp, D. melanogaster
cataaaatatgtg

SEQ ID NO: 604610 - DNA, 13 bp, D. melanogaster
cataaaatattca

SEQ ID NO: 604611 - DNA, 13 bp, D. melanogaster
cataaaatattgc

SEQ ID NO: 604612 - DNA, 13 bp, D. melanogaster
cataaaatccaat

SEQ ID NO: 604613 - DNA, 13 bp, D. melanogaster
cataaaatcgatt

SEQ ID NO: 604614 - DNA, 13 bp, D. melanogaster
cataaaatctaat

SEQ ID NO: 604615 - DNA, 13 bp, D. melanogaster
cataaaatgataa

SEQ ID NO: 604616 - DNA, 13 bp, D. melanogaster
cataaaatgcaaa

SEQ ID NO: 604617 - DNA, 13 bp, D. melanogaster
cataaaatgcaat

SEQ ID NO: 604618 - DNA, 13 bp, D. melanogaster
cataaaatgcaca

SEQ ID NO: 604619 - DNA, 13 bp, D. melanogaster
cataaaatgccat

SEQ ID NO: 604620 - DNA, 13 bp, D. melanogaster
cataaaatgtaaa

SEQ ID NO: 604621 - DNA, 13 bp, D. melanogaster
cataaaattagtt

SEQ ID NO: 604622 - DNA, 13 bp, D. melanogaster
cataaaattcaat

SEQ ID NO: 604623 - DNA, 13 bp, D. melanogaster
cataaaattcata

SEQ ID NO: 604624 - DNA, 13 bp, D. melanogaster
cataaaattgtat

SEQ ID NO: 604625 - DNA, 13 bp, D. melanogaster
cataaaattgtta

SEQ ID NO: 604626 - DNA, 13 bp, D. melanogaster
cataaaattgttt

SEQ ID NO: 604627 - DNA, 14 bp, D. melanogaster
cataaaatttgccc

SEQ ID NO: 604628 - DNA, 13 bp, D. melanogaster
cataaacaaaagt

SEQ ID NO: 604629 - DNA, 13 bp, D. melanogaster
cataaacaatatt

SEQ ID NO: 604630 - DNA, 13 bp, D. melanogaster
cataaacaatgca

SEQ ID NO: 604631 - DNA, 13 bp, D. melanogaster
cataaacaattga

SEQ ID NO: 604632 - DNA, 13 bp, D. melanogaster
cataaacaattta

SEQ ID NO: 604633 - DNA, 14 bp, D. melanogaster
cataaacaatttat

SEQ ID NO: 604634 - DNA, 13 bp, D. melanogaster
cataaacaatttg

SEQ ID NO: 604635 - DNA, 13 bp, D. melanogaster
cataaacatacat

SEQ ID NO: 604636 - DNA, 13 bp, D. melanogaster
cataaacatagca

SEQ ID NO: 604637 - DNA, 13 bp, D. melanogaster
cataaacattcct

SEQ ID NO: 604638 - DNA, 14 bp, D. melanogaster
cataaacattccta

SEQ ID NO: 604639 - DNA, 13 bp, D. melanogaster
cataaacatttaa

SEQ ID NO: 604640 - DNA, 13 bp, D. melanogaster
cataaacatttgt

SEQ ID NO: 604641 - DNA, 13 bp, D. melanogaster
cataaacattttt

SEQ ID NO: 604642 - DNA, 13 bp, D. melanogaster
cataaacgagcta

SEQ ID NO: 604643 - DNA, 13 bp, D. melanogaster
cataaactgcact

SEQ ID NO: 604644 - DNA, 13 bp, D. melanogaster
cataaactttatt

SEQ ID NO: 604645 - DNA, 13 bp, D. melanogaster
cataaagaaagtg

SEQ ID NO: 604646 - DNA, 13 bp, D. melanogaster
cataaagaatttt

SEQ ID NO: 604647 - DNA, 14 bp, D. melanogaster
cataaagaccaaaa

SEQ ID NO: 604648 - DNA, 13 bp, D. melanogaster
cataaagagtgca

SEQ ID NO: 604649 - DNA, 13 bp, D. melanogaster
cataaagcaaata

SEQ ID NO: 604650 - DNA, 13 bp, D. melanogaster
cataaagcataaa

SEQ ID NO: 604651 - DNA, 13 bp, D. melanogaster
cataaagcatttt

SEQ ID NO: 604652 - DNA, 13 bp, D. melanogaster
cataaagctttta

SEQ ID NO: 604653 - DNA, 13 bp, D. melanogaster
cataaaggtattg

SEQ ID NO: 604654 - DNA, 13 bp, D. melanogaster
cataaagtgcaca

SEQ ID NO: 604655 - DNA, 13 bp, D. melanogaster
cataaagttatta

SEQ ID NO: 604656 - DNA, 13 bp, D. melanogaster
cataaagtttttg

SEQ ID NO: 604657 - DNA, 13 bp, D. melanogaster
cataaataaacga

SEQ ID NO: 604658 - DNA, 13 bp, D. melanogaster
cataaataaagcc

SEQ ID NO: 604659 - DNA, 14 bp, D. melanogaster
cataaataaatgca

SEQ ID NO: 604660 - DNA, 13 bp, D. melanogaster
cataaataaattg

SEQ ID NO: 604661 - DNA, 13 bp, D. melanogaster
cataaataatgca

SEQ ID NO: 604662 - DNA, 14 bp, D. melanogaster
cataaataatgtta

SEQ ID NO: 604663 - DNA, 13 bp, D. melanogaster
cataaataattca

SEQ ID NO: 604664 - DNA, 13 bp, D. melanogaster
cataaataattga

SEQ ID NO: 604665 - DNA, 13 bp, D. melanogaster
cataaatacaatt

SEQ ID NO: 604666 - DNA, 13 bp, D. melanogaster
cataaatacattt

SEQ ID NO: 604667 - DNA, 14 bp, D. melanogaster
cataaataccagtt

SEQ ID NO: 604668 - DNA, 13 bp, D. melanogaster
cataaatactaat

SEQ ID NO: 604669 - DNA, 13 bp, D. melanogaster
cataaatatacat

SEQ ID NO: 604670 - DNA, 13 bp, D. melanogaster
cataaatatatgt

SEQ ID NO: 604671 - DNA, 14 bp, D. melanogaster
cataaatatatgta

SEQ ID NO: 604672 - DNA, 13 bp, D. melanogaster
cataaatatccat

SEQ ID NO: 604673 - DNA, 14 bp, D. melanogaster
cataaatatgcaaa

SEQ ID NO: 604674 - DNA, 13 bp, D. melanogaster
cataaatatgtaa

SEQ ID NO: 604675 - DNA, 14 bp, D. melanogaster
cataaatattcatt

SEQ ID NO: 604676 - DNA, 13 bp, D. melanogaster
cataaatattgtt

SEQ ID NO: 604677 - DNA, 13 bp, D. melanogaster
cataaatatttac

SEQ ID NO: 604678 - DNA, 14 bp, D. melanogaster
cataaatatttcaa

SEQ ID NO: 604679 - DNA, 13 bp, D. melanogaster
cataaatcaaatg

SEQ ID NO: 604680 - DNA, 13 bp, D. melanogaster
cataaatcaaatt

SEQ ID NO: 604681 - DNA, 13 bp, D. melanogaster
cataaatcaagtg

SEQ ID NO: 604682 - DNA, 13 bp, D. melanogaster
cataaatcaattg

SEQ ID NO: 604683 - DNA, 13 bp, D. melanogaster
cataaatcaattt

SEQ ID NO: 604684 - DNA, 13 bp, D. melanogaster
cataaatcagcat

SEQ ID NO: 604685 - DNA, 13 bp, D. melanogaster
cataaatcagttg

SEQ ID NO: 604686 - DNA, 13 bp, D. melanogaster
cataaatcatgca

SEQ ID NO: 604687 - DNA, 13 bp, D. melanogaster
cataaatcatttt

SEQ ID NO: 604688 - DNA, 14 bp, D. melanogaster
cataaatcattttc

SEQ ID NO: 604689 - DNA, 13 bp, D. melanogaster
cataaatctgaat

SEQ ID NO: 604690 - DNA, 13 bp, D. melanogaster
cataaatgaaatt

SEQ ID NO: 604691 - DNA, 13 bp, D. melanogaster
cataaatgcatat

SEQ ID NO: 604692 - DNA, 13 bp, D. melanogaster
cataaatgccaaa

SEQ ID NO: 604693 - DNA, 13 bp, D. melanogaster
cataaatgccgaa

SEQ ID NO: 604694 - DNA, 13 bp, D. melanogaster
cataaatgtaaaa

SEQ ID NO: 604695 - DNA, 13 bp, D. melanogaster
cataaatgtatat

SEQ ID NO: 604696 - DNA, 13 bp, D. melanogaster
cataaatgtatgt

SEQ ID NO: 604697 - DNA, 13 bp, D. melanogaster
cataaatgtcaaa

SEQ ID NO: 604698 - DNA, 13 bp, D. melanogaster
cataaatgtctat

SEQ ID NO: 604699 - DNA, 14 bp, D. melanogaster
cataaatgttgtct

SEQ ID NO: 604700 - DNA, 13 bp, D. melanogaster
cataaatgtttaa

SEQ ID NO: 604701 - DNA, 13 bp, D. melanogaster
cataaatgttttt

SEQ ID NO: 604702 - DNA, 13 bp, D. melanogaster
cataaattaaatg

SEQ ID NO: 604703 - DNA, 13 bp, D. melanogaster
cataaattaccaa

SEQ ID NO: 604704 - DNA, 13 bp, D. melanogaster
cataaattagcca

SEQ ID NO: 604705 - DNA, 13 bp, D. melanogaster
cataaattatcat

SEQ ID NO: 604706 - DNA, 14 bp, D. melanogaster
cataaattattcaa

SEQ ID NO: 604707 - DNA, 13 bp, D. melanogaster
cataaattcaatt

SEQ ID NO: 604708 - DNA, 13 bp, D. melanogaster
cataaattcatat

SEQ ID NO: 604709 - DNA, 13 bp, D. melanogaster
cataaattctaaa

SEQ ID NO: 604710 - DNA, 13 bp, D. melanogaster
cataaattcttga

SEQ ID NO: 604711 - DNA, 13 bp, D. melanogaster
cataaattgaatt

SEQ ID NO: 604712 - DNA, 13 bp, D. melanogaster
cataaattgattt

SEQ ID NO: 604713 - DNA, 13 bp, D. melanogaster
cataaattgccat

SEQ ID NO: 604714 - DNA, 13 bp, D. melanogaster
cataaattggcat

SEQ ID NO: 604715 - DNA, 13 bp, D. melanogaster
cataaattgttaa

SEQ ID NO: 604716 - DNA, 13 bp, D. melanogaster
cataaattgttcg

SEQ ID NO: 604717 - DNA, 13 bp, D. melanogaster
cataaatttatca

SEQ ID NO: 604718 - DNA, 13 bp, D. melanogaster
cataaatttccca

SEQ ID NO: 604719 - DNA, 13 bp, D. melanogaster
cataaatttcgat

SEQ ID NO: 604720 - DNA, 13 bp, D. melanogaster
cataaatttcttt

SEQ ID NO: 604721 - DNA, 13 bp, D. melanogaster
cataaatttgaaa

SEQ ID NO: 604722 - DNA, 13 bp, D. melanogaster
cataaatttgcac

SEQ ID NO: 604723 - DNA, 13 bp, D. melanogaster
cataaatttgcat

SEQ ID NO: 604724 - DNA, 13 bp, D. melanogaster
cataaattttaag

SEQ ID NO: 604725 - DNA, 13 bp, D. melanogaster
cataaattttgaa

SEQ ID NO: 604726 - DNA, 13 bp, D. melanogaster
cataaattttgtt

SEQ ID NO: 604727 - DNA, 13 bp, D. melanogaster
cataacaaaagtg

SEQ ID NO: 604728 - DNA, 13 bp, D. melanogaster
cataacaaaattt

SEQ ID NO: 604729 - DNA, 13 bp, D. melanogaster
cataacaaatatt

SEQ ID NO: 604730 - DNA, 13 bp, D. melanogaster
cataacaaatgac

SEQ ID NO: 604731 - DNA, 13 bp, D. melanogaster
cataacaaatttt

SEQ ID NO: 604732 - DNA, 13 bp, D. melanogaster
cataacaacagat

SEQ ID NO: 604733 - DNA, 14 bp, D. melanogaster
cataacataacata

SEQ ID NO: 604734 - DNA, 13 bp, D. melanogaster
cataacatatttt

SEQ ID NO: 604735 - DNA, 13 bp, D. melanogaster
cataacatttaaa

SEQ ID NO: 604736 - DNA, 13 bp, D. melanogaster
cataacctggcca

SEQ ID NO: 604737 - DNA, 14 bp, D. melanogaster
cataacctgttgta

SEQ ID NO: 604738 - DNA, 13 bp, D. melanogaster
cataactaattta

SEQ ID NO: 604739 - DNA, 13 bp, D. melanogaster
cataactgaatat

SEQ ID NO: 604740 - DNA, 13 bp, D. melanogaster
cataacttaaagg

SEQ ID NO: 604741 - DNA, 13 bp, D. melanogaster
cataacttagtta

SEQ ID NO: 604742 - DNA, 13 bp, D. melanogaster
cataacttggcca

SEQ ID NO: 604743 - DNA, 13 bp, D. melanogaster
cataagagcataa

SEQ ID NO: 604744 - DNA, 13 bp, D. melanogaster
cataagatatgaa

SEQ ID NO: 604745 - DNA, 13 bp, D. melanogaster
cataagcaaaaat

SEQ ID NO: 604746 - DNA, 13 bp, D. melanogaster
cataagcataaaa

SEQ ID NO: 604747 - DNA, 13 bp, D. melanogaster
cataagtataaag

SEQ ID NO: 604748 - DNA, 13 bp, D. melanogaster
cataagtatgcta

SEQ ID NO: 604749 - DNA, 13 bp, D. melanogaster
cataagtgaattt

SEQ ID NO: 604750 - DNA, 14 bp, D. melanogaster
cataagtgaatttt

SEQ ID NO: 604751 - DNA, 13 bp, D. melanogaster
cataagtgtgtgt

SEQ ID NO: 604752 - DNA, 14 bp, D. melanogaster
cataagtgtgtgtg

SEQ ID NO: 604753 - DNA, 13 bp, D. melanogaster
cataagtgtttgt

SEQ ID NO: 604754 - DNA, 14 bp, D. melanogaster
cataagtgtttgtt

SEQ ID NO: 604755 - DNA, 13 bp, D. melanogaster
cataagttaatat

SEQ ID NO: 604756 - DNA, 13 bp, D. melanogaster
cataataaaactt

SEQ ID NO: 604757 - DNA, 13 bp, D. melanogaster
cataataaatgtt

SEQ ID NO: 604758 - DNA, 13 bp, D. melanogaster
cataataataatg

SEQ ID NO: 604759 - DNA, 14 bp, D. melanogaster
cataataatcgcaa

SEQ ID NO: 604760 - DNA, 13 bp, D. melanogaster
cataataatttgt

SEQ ID NO: 604761 - DNA, 13 bp, D. melanogaster
cataataattttc

SEQ ID NO: 604762 - DNA, 13 bp, D. melanogaster
cataatagcaaca

SEQ ID NO: 604763 - DNA, 13 bp, D. melanogaster
cataatatataca

SEQ ID NO: 604764 - DNA, 13 bp, D. melanogaster
cataatatatgta

SEQ ID NO: 604765 - DNA, 13 bp, D. melanogaster
cataatattgtat

SEQ ID NO: 604766 - DNA, 13 bp, D. melanogaster
cataatatttttg

SEQ ID NO: 604767 - DNA, 13 bp, D. melanogaster
cataatcaaatat

SEQ ID NO: 604768 - DNA, 13 bp, D. melanogaster
cataatcaatcaa

SEQ ID NO: 604769 - DNA, 13 bp, D. melanogaster
cataatcataatc

SEQ ID NO: 604770 - DNA, 14 bp, D. melanogaster
cataatcataatca

SEQ ID NO: 604771 - DNA, 13 bp, D. melanogaster
cataatcatcatc

SEQ ID NO: 604772 - DNA, 13 bp, D. melanogaster
cataatcggaata

SEQ ID NO: 604773 - DNA, 13 bp, D. melanogaster
cataatctagtta

SEQ ID NO: 604774 - DNA, 13 bp, D. melanogaster
cataatcttgtta

SEQ ID NO: 604775 - DNA, 13 bp, D. melanogaster
cataatgataatg

SEQ ID NO: 604776 - DNA, 14 bp, D. melanogaster
cataatgatgatga

SEQ ID NO: 604777 - DNA, 13 bp, D. melanogaster
cataatgctttgt

SEQ ID NO: 604778 - DNA, 13 bp, D. melanogaster
cataattaactaa

SEQ ID NO: 604779 - DNA, 13 bp, D. melanogaster
cataattatgatc

SEQ ID NO: 604780 - DNA, 13 bp, D. melanogaster
cataattatgcca

SEQ ID NO: 604781 - DNA, 13 bp, D. melanogaster
cataattcaaatg

SEQ ID NO: 604782 - DNA, 13 bp, D. melanogaster
cataattcaatta

SEQ ID NO: 604783 - DNA, 13 bp, D. melanogaster
cataattcataat

SEQ ID NO: 604784 - DNA, 13 bp, D. melanogaster
cataattgaatta

SEQ ID NO: 604785 - DNA, 13 bp, D. melanogaster
cataattgatttt

SEQ ID NO: 604786 - DNA, 13 bp, D. melanogaster
cataattgtgttg

SEQ ID NO: 604787 - DNA, 13 bp, D. melanogaster
cataatttacaaa

SEQ ID NO: 604788 - DNA, 13 bp, D. melanogaster
cataatttatatg

SEQ ID NO: 604789 - DNA, 13 bp, D. melanogaster
cataatttatcaa

SEQ ID NO: 604790 - DNA, 13 bp, D. melanogaster
cataatttatgca

SEQ ID NO: 604791 - DNA, 13 bp, D. melanogaster
cataatttatggc

SEQ ID NO: 604792 - DNA, 13 bp, D. melanogaster
cataatttatgtg

SEQ ID NO: 604793 - DNA, 13 bp, D. melanogaster
cataatttgaaat

SEQ ID NO: 604794 - DNA, 13 bp, D. melanogaster
cataatttgcaaa

SEQ ID NO: 604795 - DNA, 13 bp, D. melanogaster
cataatttgtaaa

SEQ ID NO: 604796 - DNA, 13 bp, D. melanogaster
cataatttgtgct

SEQ ID NO: 604797 - DNA, 13 bp, D. melanogaster
cataatttgttta

SEQ ID NO: 604798 - DNA, 13 bp, D. melanogaster
cataattttaaac

SEQ ID NO: 604799 - DNA, 14 bp, D. melanogaster
cataattttattag

SEQ ID NO: 604800 - DNA, 13 bp, D. melanogaster
cataattttcgaa

SEQ ID NO: 604801 - DNA, 13 bp, D. melanogaster
cataattttctat

SEQ ID NO: 604802 - DNA, 13 bp, D. melanogaster
cataattttctcc

SEQ ID NO: 604803 - DNA, 13 bp, D. melanogaster
cataatttttgtt

SEQ ID NO: 604804 - DNA, 13 bp, D. melanogaster
catacaaaaaatg

SEQ ID NO: 604805 - DNA, 14 bp, D. melanogaster
catacaaaaaatga

SEQ ID NO: 604806 - DNA, 13 bp, D. melanogaster
catacaaaaactc

SEQ ID NO: 604807 - DNA, 13 bp, D. melanogaster
catacaaaaagag

SEQ ID NO: 604808 - DNA, 13 bp, D. melanogaster
catacaaaatctt

SEQ ID NO: 604809 - DNA, 13 bp, D. melanogaster
catacaaaatgta

SEQ ID NO: 604810 - DNA, 13 bp, D. melanogaster
catacaaacattt

SEQ ID NO: 604811 - DNA, 13 bp, D. melanogaster
catacaaatatgt

SEQ ID NO: 604812 - DNA, 13 bp, D. melanogaster
catacaaatcgaa

SEQ ID NO: 604813 - DNA, 14 bp, D. melanogaster
catacaaatgatca

SEQ ID NO: 604814 - DNA, 13 bp, D. melanogaster
catacaaatgcct

SEQ ID NO: 604815 - DNA, 14 bp, D. melanogaster
catacaaatgcctt

SEQ ID NO: 604816 - DNA, 13 bp, D. melanogaster
catacaaattaat

SEQ ID NO: 604817 - DNA, 13 bp, D. melanogaster
catacaaattatt

SEQ ID NO: 604818 - DNA, 14 bp, D. melanogaster
catacaaattgtaa

SEQ ID NO: 604819 - DNA, 13 bp, D. melanogaster
catacaaatttaa

SEQ ID NO: 604820 - DNA, 13 bp, D. melanogaster
catacaaatttga

SEQ ID NO: 604821 - DNA, 13 bp, D. melanogaster
catacaacaaatt

SEQ ID NO: 604822 - DNA, 13 bp, D. melanogaster
catacaaccataa

SEQ ID NO: 604823 - DNA, 14 bp, D. melanogaster
catacaatacaata

SEQ ID NO: 604824 - DNA, 13 bp, D. melanogaster
catacaattcctg

SEQ ID NO: 604825 - DNA, 13 bp, D. melanogaster
catacacaaacat

SEQ ID NO: 604826 - DNA, 14 bp, D. melanogaster
catacacaaacatg

SEQ ID NO: 604827 - DNA, 13 bp, D. melanogaster
catacacacaaat

SEQ ID NO: 604828 - DNA, 13 bp, D. melanogaster
catacacacaagc

SEQ ID NO: 604829 - DNA, 13 bp, D. melanogaster
catacacacacag

SEQ ID NO: 604830 - DNA, 13 bp, D. melanogaster
catacacacacat

SEQ ID NO: 604831 - DNA, 14 bp, D. melanogaster
catacacacacata

SEQ ID NO: 604832 - DNA, 13 bp, D. melanogaster
catacacacacgt

SEQ ID NO: 604833 - DNA, 13 bp, D. melanogaster
catacacacagac

SEQ ID NO: 604834 - DNA, 13 bp, D. melanogaster
catacacacatat

SEQ ID NO: 604835 - DNA, 14 bp, D. melanogaster
catacacacatata

SEQ ID NO: 604836 - DNA, 13 bp, D. melanogaster
catacacacatgt

SEQ ID NO: 604837 - DNA, 13 bp, D. melanogaster
catacacacattt

SEQ ID NO: 604838 - DNA, 13 bp, D. melanogaster
catacacacgcat

SEQ ID NO: 604839 - DNA, 13 bp, D. melanogaster
catacacactcac

SEQ ID NO: 604840 - DNA, 13 bp, D. melanogaster
catacacagaaaa

SEQ ID NO: 604841 - DNA, 14 bp, D. melanogaster
catacacatacaca

SEQ ID NO: 604842 - DNA, 13 bp, D. melanogaster
catacacatatac

SEQ ID NO: 604843 - DNA, 14 bp, D. melanogaster
catacacatataca

SEQ ID NO: 604844 - DNA, 13 bp, D. melanogaster
catacacatccac

SEQ ID NO: 604845 - DNA, 14 bp, D. melanogaster
catacacatgcaca

SEQ ID NO: 604846 - DNA, 13 bp, D. melanogaster
catacacatgcat

SEQ ID NO: 604847 - DNA, 13 bp, D. melanogaster
catacacatgtac

SEQ ID NO: 604848 - DNA, 13 bp, D. melanogaster
catacacccatcc

SEQ ID NO: 604849 - DNA, 13 bp, D. melanogaster
catacacgcacac

SEQ ID NO: 604850 - DNA, 13 bp, D. melanogaster
catacactcgcac

SEQ ID NO: 604851 - DNA, 13 bp, D. melanogaster
catacagaaaaat

SEQ ID NO: 604852 - DNA, 13 bp, D. melanogaster
catacagatacag

SEQ ID NO: 604853 - DNA, 14 bp, D. melanogaster
catacagttgtctg

SEQ ID NO: 604854 - DNA, 13 bp, D. melanogaster
catacataaatag

SEQ ID NO: 604855 - DNA, 14 bp, D. melanogaster
catacataaataga

SEQ ID NO: 604856 - DNA, 13 bp, D. melanogaster
catacataagtat

SEQ ID NO: 604857 - DNA, 13 bp, D. melanogaster
catacatacaaca

SEQ ID NO: 604858 - DNA, 14 bp, D. melanogaster
catacatacacaca

SEQ ID NO: 604859 - DNA, 15 bp, D. melanogaster
catacatacacatat

SEQ ID NO: 604860 - DNA, 14 bp, D. melanogaster
catacatacataga

SEQ ID NO: 604861 - DNA, 18 bp, D. melanogaster
catacatacatatacata

SEQ ID NO: 604862 - DNA, 17 bp, D. melanogaster
catacatacatatatac

SEQ ID NO: 604863 - DNA, 19 bp, D. melanogaster
catacatacatatatgtat

SEQ ID NO: 604864 - DNA, 16 bp, D. melanogaster
catacatacatatgtt

SEQ ID NO: 604865 - DNA, 13 bp, D. melanogaster
catacatacatct

SEQ ID NO: 604866 - DNA, 14 bp, D. melanogaster
catacatactcgta

SEQ ID NO: 604867 - DNA, 13 bp, D. melanogaster
catacatacttat

SEQ ID NO: 604868 - DNA, 13 bp, D. melanogaster
catacatagatac

SEQ ID NO: 604869 - DNA, 13 bp, D. melanogaster
catacataggtat

SEQ ID NO: 604870 - DNA, 13 bp, D. melanogaster
catacatatacaa

SEQ ID NO: 604871 - DNA, 14 bp, D. melanogaster
catacatatacaca

SEQ ID NO: 604872 - DNA, 14 bp, D. melanogaster
catacatatacata

SEQ ID NO: 604873 - DNA, 13 bp, D. melanogaster
catacatatactc

SEQ ID NO: 604874 - DNA, 13 bp, D. melanogaster
catacatatatac

SEQ ID NO: 604875 - DNA, 14 bp, D. melanogaster
catacatatatacc

SEQ ID NO: 604876 - DNA, 14 bp, D. melanogaster
catacatatatacg

SEQ ID NO: 604877 - DNA, 14 bp, D. melanogaster
catacatatatatc

SEQ ID NO: 604878 - DNA, 14 bp, D. melanogaster
catacatatatgaa

SEQ ID NO: 604879 - DNA, 14 bp, D. melanogaster
catacatatatgca

SEQ ID NO: 604880 - DNA, 15 bp, D. melanogaster
catacatatatgtac

SEQ ID NO: 604881 - DNA, 15 bp, D. melanogaster
catacatatatgtat

SEQ ID NO: 604882 - DNA, 13 bp, D. melanogaster
catacatatatta

SEQ ID NO: 604883 - DNA, 13 bp, D. melanogaster
catacatatattt

SEQ ID NO: 604884 - DNA, 14 bp, D. melanogaster
catacatatgcata

SEQ ID NO: 604885 - DNA, 14 bp, D. melanogaster
catacatatgtacg

SEQ ID NO: 604886 - DNA, 15 bp, D. melanogaster
catacatatgtataa

SEQ ID NO: 604887 - DNA, 14 bp, D. melanogaster
catacatatgtatc

SEQ ID NO: 604888 - DNA, 13 bp, D. melanogaster
catacatatgtct

SEQ ID NO: 604889 - DNA, 13 bp, D. melanogaster
catacatatgtga

SEQ ID NO: 604890 - DNA, 14 bp, D. melanogaster
catacatatgtgaa

SEQ ID NO: 604891 - DNA, 13 bp, D. melanogaster
catacatattaca

SEQ ID NO: 604892 - DNA, 13 bp, D. melanogaster
catacatatttgc

SEQ ID NO: 604893 - DNA, 13 bp, D. melanogaster
catacatattttc

SEQ ID NO: 604894 - DNA, 13 bp, D. melanogaster
catacatgcatac

SEQ ID NO: 604895 - DNA, 13 bp, D. melanogaster
catacattaatat

SEQ ID NO: 604896 - DNA, 13 bp, D. melanogaster
catacattcatat

SEQ ID NO: 604897 - DNA, 14 bp, D. melanogaster
catacatttaaaat

SEQ ID NO: 604898 - DNA, 13 bp, D. melanogaster
catacatttacac

SEQ ID NO: 604899 - DNA, 14 bp, D. melanogaster
catacatttacaca

SEQ ID NO: 604900 - DNA, 13 bp, D. melanogaster
catacatttcttt

SEQ ID NO: 604901 - DNA, 13 bp, D. melanogaster
catacatttgtat

SEQ ID NO: 604902 - DNA, 13 bp, D. melanogaster
catacattttctt

SEQ ID NO: 604903 - DNA, 13 bp, D. melanogaster
cataccataccat

SEQ ID NO: 604904 - DNA, 14 bp, D. melanogaster
cataccataccatc

SEQ ID NO: 604905 - DNA, 13 bp, D. melanogaster
catacccatacca

SEQ ID NO: 604906 - DNA, 14 bp, D. melanogaster
catacccataccca

SEQ ID NO: 604907 - DNA, 16 bp, D. melanogaster
catacccatacccata

SEQ ID NO: 604908 - DNA, 13 bp, D. melanogaster
catacccatgccc

SEQ ID NO: 604909 - DNA, 14 bp, D. melanogaster
catacccattccca

SEQ ID NO: 604910 - DNA, 13 bp, D. melanogaster
catacccatttac

SEQ ID NO: 604911 - DNA, 13 bp, D. melanogaster
cataccctcgcca

SEQ ID NO: 604912 - DNA, 13 bp, D. melanogaster
catacccttttac

SEQ ID NO: 604913 - DNA, 13 bp, D. melanogaster
cataccgctacac

SEQ ID NO: 604914 - DNA, 13 bp, D. melanogaster
catacctatataa

SEQ ID NO: 604915 - DNA, 13 bp, D. melanogaster
catacctcgctga

SEQ ID NO: 604916 - DNA, 14 bp, D. melanogaster
catacgagaacaaa

SEQ ID NO: 604917 - DNA, 13 bp, D. melanogaster
catacgatatttt

SEQ ID NO: 604918 - DNA, 13 bp, D. melanogaster
catacgatttttt

SEQ ID NO: 604919 - DNA, 14 bp, D. melanogaster
catacgcaacgttg

SEQ ID NO: 604920 - DNA, 13 bp, D. melanogaster
catacgcaatgtg

SEQ ID NO: 604921 - DNA, 14 bp, D. melanogaster
catacgcaatgtgg

SEQ ID NO: 604922 - DNA, 13 bp, D. melanogaster
catacgcaccgtg

SEQ ID NO: 604923 - DNA, 14 bp, D. melanogaster
catacgcaccgtgg

SEQ ID NO: 604924 - DNA, 14 bp, D. melanogaster
catacgcaccgttg

SEQ ID NO: 604925 - DNA, 13 bp, D. melanogaster
catacgcactgtg

SEQ ID NO: 604926 - DNA, 14 bp, D. melanogaster
catacgcactgttg

SEQ ID NO: 604927 - DNA, 13 bp, D. melanogaster
catacgcagtgtg

SEQ ID NO: 604928 - DNA, 14 bp, D. melanogaster
catacgcagtgtgg

SEQ ID NO: 604929 - DNA, 14 bp, D. melanogaster
catacgccacgttg

SEQ ID NO: 604930 - DNA, 13 bp, D. melanogaster
catacgccatgta

SEQ ID NO: 604931 - DNA, 13 bp, D. melanogaster
catacgccatgtg

SEQ ID NO: 604932 - DNA, 14 bp, D. melanogaster
catacgccatgtgg

SEQ ID NO: 604933 - DNA, 14 bp, D. melanogaster
catacgccatgttg

SEQ ID NO: 604934 - DNA, 13 bp, D. melanogaster
catacgccccatt

SEQ ID NO: 604935 - DNA, 13 bp, D. melanogaster
catacgccccgtt

SEQ ID NO: 604936 - DNA, 14 bp, D. melanogaster
catacgccccgttg

SEQ ID NO: 604937 - DNA, 14 bp, D. melanogaster
catacgccctgttg

SEQ ID NO: 604938 - DNA, 13 bp, D. melanogaster
catacgccgaatt

SEQ ID NO: 604939 - DNA, 13 bp, D. melanogaster
catacgccgcgtg

SEQ ID NO: 604940 - DNA, 14 bp, D. melanogaster
catacgccgtgttg

SEQ ID NO: 604941 - DNA, 14 bp, D. melanogaster
catacgcggcgtat

SEQ ID NO: 604942 - DNA, 14 bp, D. melanogaster
catacggacggaca

SEQ ID NO: 604943 - DNA, 13 bp, D. melanogaster
catacgtacatat

SEQ ID NO: 604944 - DNA, 13 bp, D. melanogaster
catacgtatatat

SEQ ID NO: 604945 - DNA, 14 bp, D. melanogaster
catacgtatatata

SEQ ID NO: 604946 - DNA, 14 bp, D. melanogaster
catacgtcggcgaa

SEQ ID NO: 604947 - DNA, 13 bp, D. melanogaster
catactatatata

SEQ ID NO: 604948 - DNA, 13 bp, D. melanogaster
catactcatttcc

SEQ ID NO: 604949 - DNA, 13 bp, D. melanogaster
catactccacggc

SEQ ID NO: 604950 - DNA, 13 bp, D. melanogaster
catactgaaaatt

SEQ ID NO: 604951 - DNA, 13 bp, D. melanogaster
catactgcaaact

SEQ ID NO: 604952 - DNA, 13 bp, D. melanogaster
catacttacatat

SEQ ID NO: 604953 - DNA, 13 bp, D. melanogaster
catacttctaaaa

SEQ ID NO: 604954 - DNA, 13 bp, D. melanogaster
catactttaatat

SEQ ID NO: 604955 - DNA, 13 bp, D. melanogaster
catactttctgtt

SEQ ID NO: 604956 - DNA, 13 bp, D. melanogaster
catactttgagat

SEQ ID NO: 604957 - DNA, 13 bp, D. melanogaster
catacttttagac

SEQ ID NO: 604958 - DNA, 13 bp, D. melanogaster
catacttttagga

SEQ ID NO: 604959 - DNA, 13 bp, D. melanogaster
catacttttcagc

SEQ ID NO: 604960 - DNA, 13 bp, D. melanogaster
catacttttgagc

SEQ ID NO: 604961 - DNA, 13 bp, D. melanogaster
catacttttgggc

SEQ ID NO: 604962 - DNA, 14 bp, D. melanogaster
catacttttgggct

SEQ ID NO: 604963 - DNA, 13 bp, D. melanogaster
catacttttgggg

SEQ ID NO: 604964 - DNA, 14 bp, D. melanogaster
catagaaaagtcat

SEQ ID NO: 604965 - DNA, 13 bp, D. melanogaster
catagaaacaaac

SEQ ID NO: 604966 - DNA, 13 bp, D. melanogaster
catagaaacatta

SEQ ID NO: 604967 - DNA, 13 bp, D. melanogaster
catagaaatacat

SEQ ID NO: 604968 - DNA, 13 bp, D. melanogaster
catagaaattgtt

SEQ ID NO: 604969 - DNA, 13 bp, D. melanogaster
catagaactttaa

SEQ ID NO: 604970 - DNA, 13 bp, D. melanogaster
catagaattagaa

SEQ ID NO: 604971 - DNA, 13 bp, D. melanogaster
catagagcttctc

SEQ ID NO: 604972 - DNA, 13 bp, D. melanogaster
catagatacagat

SEQ ID NO: 604973 - DNA, 13 bp, D. melanogaster
catagatacatac

SEQ ID NO: 604974 - DNA, 13 bp, D. melanogaster
catagatataatc

SEQ ID NO: 604975 - DNA, 14 bp, D. melanogaster
catagcaacaaagt

SEQ ID NO: 604976 - DNA, 13 bp, D. melanogaster
catagcaatgtat

SEQ ID NO: 604977 - DNA, 14 bp, D. melanogaster
catagcaatttgtt

SEQ ID NO: 604978 - DNA, 13 bp, D. melanogaster
catagcatacagc

SEQ ID NO: 604979 - DNA, 14 bp, D. melanogaster
catagcatactttt

SEQ ID NO: 604980 - DNA, 13 bp, D. melanogaster
catagccaatcta

SEQ ID NO: 604981 - DNA, 14 bp, D. melanogaster
catagccatagcca

SEQ ID NO: 604982 - DNA, 13 bp, D. melanogaster
catagcccacaaa

SEQ ID NO: 604983 - DNA, 13 bp, D. melanogaster
catagccgaaaat

SEQ ID NO: 604984 - DNA, 13 bp, D. melanogaster
catagcttcatta

SEQ ID NO: 604985 - DNA, 13 bp, D. melanogaster
cataggcacatac

SEQ ID NO: 604986 - DNA, 13 bp, D. melanogaster
cataggttttatt

SEQ ID NO: 604987 - DNA, 13 bp, D. melanogaster
catagtgaagcta

SEQ ID NO: 604988 - DNA, 13 bp, D. melanogaster
catagtttagttt

SEQ ID NO: 604989 - DNA, 13 bp, D. melanogaster
catagtttatttt

SEQ ID NO: 604990 - DNA, 14 bp, D. melanogaster
catagttttattat

SEQ ID NO: 604991 - DNA, 13 bp, D. melanogaster
catagttttcaac

SEQ ID NO: 604992 - DNA, 13 bp, D. melanogaster
catagtttttaaa

SEQ ID NO: 604993 - DNA, 13 bp, D. melanogaster
catataaaaaatg

SEQ ID NO: 604994 - DNA, 13 bp, D. melanogaster
catataaaagata

SEQ ID NO: 604995 - DNA, 13 bp, D. melanogaster
catataaaatgca

SEQ ID NO: 604996 - DNA, 13 bp, D. melanogaster
catataaaatgta

SEQ ID NO: 604997 - DNA, 13 bp, D. melanogaster
catataaaggaat

SEQ ID NO: 604998 - DNA, 14 bp, D. melanogaster
catataaagtatat

SEQ ID NO: 604999 - DNA, 13 bp, D. melanogaster
catataaatatgt

SEQ ID NO: 605000 - DNA, 13 bp, D. melanogaster
catataaatcaca

SEQ ID NO: 605001 - DNA, 13 bp, D. melanogaster
catataaatcata

SEQ ID NO: 605002 - DNA, 13 bp, D. melanogaster
catataaatgtat

SEQ ID NO: 605003 - DNA, 13 bp, D. melanogaster
catataacaatta

SEQ ID NO: 605004 - DNA, 13 bp, D. melanogaster
catataacatata

SEQ ID NO: 605005 - DNA, 13 bp, D. melanogaster
catatacaaacat

SEQ ID NO: 605006 - DNA, 13 bp, D. melanogaster
catatacaaatac

SEQ ID NO: 605007 - DNA, 14 bp, D. melanogaster
catatacaatatat

SEQ ID NO: 605008 - DNA, 13 bp, D. melanogaster
catatacaatatg

SEQ ID NO: 605009 - DNA, 14 bp, D. melanogaster
catatacacacaca

SEQ ID NO: 605010 - DNA, 15 bp, D. melanogaster
catatacacacacac

SEQ ID NO: 605011 - DNA, 13 bp, D. melanogaster
catatacacacat

SEQ ID NO: 605012 - DNA, 13 bp, D. melanogaster
catatacacatac

SEQ ID NO: 605013 - DNA, 14 bp, D. melanogaster
catatacacataca

SEQ ID NO: 605014 - DNA, 15 bp, D. melanogaster
catatacactgcact

SEQ ID NO: 605015 - DNA, 13 bp, D. melanogaster
catatacagaaat

SEQ ID NO: 605016 - DNA, 13 bp, D. melanogaster
catatacatacat

SEQ ID NO: 605017 - DNA, 14 bp, D. melanogaster
catatacatacata

SEQ ID NO: 605018 - DNA, 16 bp, D. melanogaster
catatacatacatatg

SEQ ID NO: 605019 - DNA, 14 bp, D. melanogaster
catatacatacatg

SEQ ID NO: 605020 - DNA, 13 bp, D. melanogaster
catatacatagtt

SEQ ID NO: 605021 - DNA, 13 bp, D. melanogaster
catatacatatac

SEQ ID NO: 605022 - DNA, 14 bp, D. melanogaster
catatacatataca

SEQ ID NO: 605023 - DNA, 15 bp, D. melanogaster
catatacatatacat

SEQ ID NO: 605024 - DNA, 14 bp, D. melanogaster
catatacatatatc

SEQ ID NO: 605025 - DNA, 14 bp, D. melanogaster
catatacatatgca

SEQ ID NO: 605026 - DNA, 14 bp, D. melanogaster
catatacatatgtg

SEQ ID NO: 605027 - DNA, 13 bp, D. melanogaster
catatacatgcat

SEQ ID NO: 605028 - DNA, 13 bp, D. melanogaster
catatacatgtac

SEQ ID NO: 605029 - DNA, 14 bp, D. melanogaster
catatacatgtgta

SEQ ID NO: 605030 - DNA, 13 bp, D. melanogaster
catatacatttat

SEQ ID NO: 605031 - DNA, 13 bp, D. melanogaster
catatacatttgt

SEQ ID NO: 605032 - DNA, 13 bp, D. melanogaster
catataccatata

SEQ ID NO: 605033 - DNA, 13 bp, D. melanogaster
catatacgagtat

SEQ ID NO: 605034 - DNA, 13 bp, D. melanogaster
catatacgcgttc

SEQ ID NO: 605035 - DNA, 13 bp, D. melanogaster
catatacttacat

SEQ ID NO: 605036 - DNA, 13 bp, D. melanogaster
catatagaaatca

SEQ ID NO: 605037 - DNA, 13 bp, D. melanogaster
catatagatgtaa

SEQ ID NO: 605038 - DNA, 13 bp, D. melanogaster
catatagcatata

SEQ ID NO: 605039 - DNA, 14 bp, D. melanogaster
catatagcatatat

SEQ ID NO: 605040 - DNA, 13 bp, D. melanogaster
catatagccatat

SEQ ID NO: 605041 - DNA, 13 bp, D. melanogaster
catatagtacata

SEQ ID NO: 605042 - DNA, 13 bp, D. melanogaster
catatagtatata

SEQ ID NO: 605043 - DNA, 13 bp, D. melanogaster
catatataagcat

SEQ ID NO: 605044 - DNA, 13 bp, D. melanogaster
catatatacaatt

SEQ ID NO: 605045 - DNA, 13 bp, D. melanogaster
catatatacacaa

SEQ ID NO: 605046 - DNA, 13 bp, D. melanogaster
catatatacacag

SEQ ID NO: 605047 - DNA, 13 bp, D. melanogaster
catatatacacat

SEQ ID NO: 605048 - DNA, 14 bp, D. melanogaster
catatatacacata

SEQ ID NO: 605049 - DNA, 18 bp, D. melanogaster
catatatacatacataca

SEQ ID NO: 605050 - DNA, 14 bp, D. melanogaster
catatatacatacg

SEQ ID NO: 605051 - DNA, 14 bp, D. melanogaster
catatataccatat

SEQ ID NO: 605052 - DNA, 13 bp, D. melanogaster
catatataccggc

SEQ ID NO: 605053 - DNA, 13 bp, D. melanogaster
catatatacgtgt

SEQ ID NO: 605054 - DNA, 13 bp, D. melanogaster
catatatagaaat

SEQ ID NO: 605055 - DNA, 13 bp, D. melanogaster
catatatagaata

SEQ ID NO: 605056 - DNA, 13 bp, D. melanogaster
catatatagtaca

SEQ ID NO: 605057 - DNA, 13 bp, D. melanogaster
catatatagtata

SEQ ID NO: 605058 - DNA, 14 bp, D. melanogaster
catatatagtatat

SEQ ID NO: 605059 - DNA, 13 bp, D. melanogaster
catatatataaac

SEQ ID NO: 605060 - DNA, 13 bp, D. melanogaster
catatatataaga

SEQ ID NO: 605061 - DNA, 14 bp, D. melanogaster
catatatatacaca

SEQ ID NO: 605062 - DNA, 13 bp, D. melanogaster
catatatatacag

SEQ ID NO: 605063 - DNA, 13 bp, D. melanogaster
catatatatacat

SEQ ID NO: 605064 - DNA, 14 bp, D. melanogaster
catatatatacata

SEQ ID NO: 605065 - DNA, 13 bp, D. melanogaster
catatatatagat

SEQ ID NO: 605066 - DNA, 13 bp, D. melanogaster
catatatatagta

SEQ ID NO: 605067 - DNA, 13 bp, D. melanogaster
catatatatatac

SEQ ID NO: 605068 - DNA, 14 bp, D. melanogaster
catatatatatacg

SEQ ID NO: 605069 - DNA, 13 bp, D. melanogaster
catatatatatag

SEQ ID NO: 605070 - DNA, 14 bp, D. melanogaster
catatatatataga

SEQ ID NO: 605071 - DNA, 13 bp, D. melanogaster
catatatatatgg

SEQ ID NO: 605072 - DNA, 13 bp, D. melanogaster
catatatatattg

SEQ ID NO: 605073 - DNA, 13 bp, D. melanogaster
catatatatgcac

SEQ ID NO: 605074 - DNA, 14 bp, D. melanogaster
catatatatgtaca

SEQ ID NO: 605075 - DNA, 13 bp, D. melanogaster
catatatatgtat

SEQ ID NO: 605076 - DNA, 13 bp, D. melanogaster
catatatatgtgt

SEQ ID NO: 605077 - DNA, 14 bp, D. melanogaster
catatatatgtgtg

SEQ ID NO: 605078 - DNA, 13 bp, D. melanogaster
catatatattcca

SEQ ID NO: 605079 - DNA, 14 bp, D. melanogaster
catatatattgtat

SEQ ID NO: 605080 - DNA, 13 bp, D. melanogaster
catatatattgtt

SEQ ID NO: 605081 - DNA, 14 bp, D. melanogaster
catatatattttgt

SEQ ID NO: 605082 - DNA, 14 bp, D. melanogaster
catatatatttttg

SEQ ID NO: 605083 - DNA, 13 bp, D. melanogaster
catatatcacaaa

SEQ ID NO: 605084 - DNA, 13 bp, D. melanogaster
catatatcatata

SEQ ID NO: 605085 - DNA, 13 bp, D. melanogaster
catatatccacat

SEQ ID NO: 605086 - DNA, 13 bp, D. melanogaster
catatatccatat

SEQ ID NO: 605087 - DNA, 13 bp, D. melanogaster
catatatcccaat

SEQ ID NO: 605088 - DNA, 13 bp, D. melanogaster
catatatcgaggg

SEQ ID NO: 605089 - DNA, 13 bp, D. melanogaster
catatatctatat

SEQ ID NO: 605090 - DNA, 14 bp, D. melanogaster
catatatctatata

SEQ ID NO: 605091 - DNA, 13 bp, D. melanogaster
catatatgataat

SEQ ID NO: 605092 - DNA, 13 bp, D. melanogaster
catatatgatata

SEQ ID NO: 605093 - DNA, 13 bp, D. melanogaster
catatatgattat

SEQ ID NO: 605094 - DNA, 13 bp, D. melanogaster
catatatgcataa

SEQ ID NO: 605095 - DNA, 13 bp, D. melanogaster
catatatgcatac

SEQ ID NO: 605096 - DNA, 14 bp, D. melanogaster
catatatgcatata

SEQ ID NO: 605097 - DNA, 15 bp, D. melanogaster
catatatgcatatgt

SEQ ID NO: 605098 - DNA, 13 bp, D. melanogaster
catatatgcattt

SEQ ID NO: 605099 - DNA, 14 bp, D. melanogaster
catatatgcgcata

SEQ ID NO: 605100 - DNA, 13 bp, D. melanogaster
catatatgctata

SEQ ID NO: 605101 - DNA, 14 bp, D. melanogaster
catatatgtacatt

SEQ ID NO: 605102 - DNA, 13 bp, D. melanogaster
catatatgtacgt

SEQ ID NO: 605103 - DNA, 13 bp, D. melanogaster
catatatgtactt

SEQ ID NO: 605104 - DNA, 13 bp, D. melanogaster
catatatgtagat

SEQ ID NO: 605105 - DNA, 13 bp, D. melanogaster
catatatgtataa

SEQ ID NO: 605106 - DNA, 13 bp, D. melanogaster
catatatgtatag

SEQ ID NO: 605107 - DNA, 13 bp, D. melanogaster
catatatgtatat

SEQ ID NO: 605108 - DNA, 14 bp, D. melanogaster
catatatgtatatt

SEQ ID NO: 605109 - DNA, 13 bp, D. melanogaster
catatatgtatgt

SEQ ID NO: 605110 - DNA, 14 bp, D. melanogaster
catatatgtatgtt

SEQ ID NO: 605111 - DNA, 13 bp, D. melanogaster
catatatgtatta

SEQ ID NO: 605112 - DNA, 14 bp, D. melanogaster
catatatgtattat

SEQ ID NO: 605113 - DNA, 13 bp, D. melanogaster
catatatgtgcat

SEQ ID NO: 605114 - DNA, 14 bp, D. melanogaster
catatatgtgcata

SEQ ID NO: 605115 - DNA, 13 bp, D. melanogaster
catatatgtgtat

SEQ ID NO: 605116 - DNA, 14 bp, D. melanogaster
catatatgtgtata

SEQ ID NO: 605117 - DNA, 13 bp, D. melanogaster
catatatgtttta

SEQ ID NO: 605118 - DNA, 13 bp, D. melanogaster
catatattatgta

SEQ ID NO: 605119 - DNA, 13 bp, D. melanogaster
catatattcatat

SEQ ID NO: 605120 - DNA, 14 bp, D. melanogaster
catatattcatatt

SEQ ID NO: 605121 - DNA, 13 bp, D. melanogaster
catatattccata

SEQ ID NO: 605122 - DNA, 13 bp, D. melanogaster
catatattctata

SEQ ID NO: 605123 - DNA, 13 bp, D. melanogaster
catatattgaata

SEQ ID NO: 605124 - DNA, 13 bp, D. melanogaster
catatattgtagt

SEQ ID NO: 605125 - DNA, 13 bp, D. melanogaster
catatattgtgct

SEQ ID NO: 605126 - DNA, 13 bp, D. melanogaster
catatatttcaaa

SEQ ID NO: 605127 - DNA, 14 bp, D. melanogaster
catatatttcatat

SEQ ID NO: 605128 - DNA, 13 bp, D. melanogaster
catatatttccat

SEQ ID NO: 605129 - DNA, 13 bp, D. melanogaster
catatatttctat

SEQ ID NO: 605130 - DNA, 13 bp, D. melanogaster
catatatttgttt

SEQ ID NO: 605131 - DNA, 13 bp, D. melanogaster
catatattttgaa

SEQ ID NO: 605132 - DNA, 13 bp, D. melanogaster
catatatttttag

SEQ ID NO: 605133 - DNA, 13 bp, D. melanogaster
catatatttttcg

SEQ ID NO: 605134 - DNA, 13 bp, D. melanogaster
catatatttttgg

SEQ ID NO: 605135 - DNA, 13 bp, D. melanogaster
catatcaaaatgg

SEQ ID NO: 605136 - DNA, 13 bp, D. melanogaster
catatcaaataat

SEQ ID NO: 605137 - DNA, 13 bp, D. melanogaster
catatcaaatata

SEQ ID NO: 605138 - DNA, 13 bp, D. melanogaster
catatcaaatatc

SEQ ID NO: 605139 - DNA, 13 bp, D. melanogaster
catatcaaatatt

SEQ ID NO: 605140 - DNA, 13 bp, D. melanogaster
catatcaaattgt

SEQ ID NO: 605141 - DNA, 13 bp, D. melanogaster
catatcatatcat

SEQ ID NO: 605142 - DNA, 14 bp, D. melanogaster
catatcatatcata

SEQ ID NO: 605143 - DNA, 14 bp, D. melanogaster
catatcatatcatt

SEQ ID NO: 605144 - DNA, 13 bp, D. melanogaster
catatcattttta

SEQ ID NO: 605145 - DNA, 14 bp, D. melanogaster
catatccacatcca

SEQ ID NO: 605146 - DNA, 13 bp, D. melanogaster
catatccataaac

SEQ ID NO: 605147 - DNA, 13 bp, D. melanogaster
catatccatatcc

SEQ ID NO: 605148 - DNA, 13 bp, D. melanogaster
catatccatatct

SEQ ID NO: 605149 - DNA, 13 bp, D. melanogaster
catatcctttggc

SEQ ID NO: 605150 - DNA, 14 bp, D. melanogaster
catatcgcttcacg

SEQ ID NO: 605151 - DNA, 13 bp, D. melanogaster
catatcggttaac

SEQ ID NO: 605152 - DNA, 13 bp, D. melanogaster
catatctacatat

SEQ ID NO: 605153 - DNA, 13 bp, D. melanogaster
catatctatattt

SEQ ID NO: 605154 - DNA, 13 bp, D. melanogaster
catatctcgctct

SEQ ID NO: 605155 - DNA, 13 bp, D. melanogaster
catatctgcaatg

SEQ ID NO: 605156 - DNA, 13 bp, D. melanogaster
catatgaacatat

SEQ ID NO: 605157 - DNA, 13 bp, D. melanogaster
catatgaatatgt

SEQ ID NO: 605158 - DNA, 13 bp, D. melanogaster
catatgaatatta

SEQ ID NO: 605159 - DNA, 13 bp, D. melanogaster
catatgaattcca

SEQ ID NO: 605160 - DNA, 13 bp, D. melanogaster
catatgattgtaa

SEQ ID NO: 605161 - DNA, 13 bp, D. melanogaster
catatgatttatg

SEQ ID NO: 605162 - DNA, 13 bp, D. melanogaster
catatgatttttg

SEQ ID NO: 605163 - DNA, 13 bp, D. melanogaster
catatgcaaaata

SEQ ID NO: 605164 - DNA, 13 bp, D. melanogaster
catatgcaaagtg

SEQ ID NO: 605165 - DNA, 13 bp, D. melanogaster
catatgcaaatat

SEQ ID NO: 605166 - DNA, 13 bp, D. melanogaster
catatgcaaatca

SEQ ID NO: 605167 - DNA, 13 bp, D. melanogaster
catatgcaaatga

SEQ ID NO: 605168 - DNA, 13 bp, D. melanogaster
catatgcaaatta

SEQ ID NO: 605169 - DNA, 13 bp, D. melanogaster
catatgcaaattg

SEQ ID NO: 605170 - DNA, 13 bp, D. melanogaster
catatgcaaattt

SEQ ID NO: 605171 - DNA, 14 bp, D. melanogaster
catatgcacataca

SEQ ID NO: 605172 - DNA, 13 bp, D. melanogaster
catatgcacatat

SEQ ID NO: 605173 - DNA, 13 bp, D. melanogaster
catatgcataaat

SEQ ID NO: 605174 - DNA, 13 bp, D. melanogaster
catatgcatacat

SEQ ID NO: 605175 - DNA, 14 bp, D. melanogaster
catatgcatatatg

SEQ ID NO: 605176 - DNA, 14 bp, D. melanogaster
catatgcatatgta

SEQ ID NO: 605177 - DNA, 13 bp, D. melanogaster
catatgcatattt

SEQ ID NO: 605178 - DNA, 13 bp, D. melanogaster
catatgcatgcag

SEQ ID NO: 605179 - DNA, 13 bp, D. melanogaster
catatgccatata

SEQ ID NO: 605180 - DNA, 13 bp, D. melanogaster
catatgctatatg

SEQ ID NO: 605181 - DNA, 13 bp, D. melanogaster
catatgctcaaaa

SEQ ID NO: 605182 - DNA, 13 bp, D. melanogaster
catatggcatatg

SEQ ID NO: 605183 - DNA, 13 bp, D. melanogaster
catatggtcgaaa

SEQ ID NO: 605184 - DNA, 13 bp, D. melanogaster
catatgtaaatag

SEQ ID NO: 605185 - DNA, 13 bp, D. melanogaster
catatgtaaatgc

SEQ ID NO: 605186 - DNA, 14 bp, D. melanogaster
catatgtacaatat

SEQ ID NO: 605187 - DNA, 14 bp, D. melanogaster
catatgtacataaa

SEQ ID NO: 605188 - DNA, 14 bp, D. melanogaster
catatgtacatacc

SEQ ID NO: 605189 - DNA, 13 bp, D. melanogaster
catatgtacatca

SEQ ID NO: 605190 - DNA, 13 bp, D. melanogaster
catatgtacatcc

SEQ ID NO: 605191 - DNA, 13 bp, D. melanogaster
catatgtacatgt

SEQ ID NO: 605192 - DNA, 14 bp, D. melanogaster
catatgtacatgta

SEQ ID NO: 605193 - DNA, 13 bp, D. melanogaster
catatgtactata

SEQ ID NO: 605194 - DNA, 14 bp, D. melanogaster
catatgtataaata

SEQ ID NO: 605195 - DNA, 13 bp, D. melanogaster
catatgtataatt

SEQ ID NO: 605196 - DNA, 13 bp, D. melanogaster
catatgtatacac

SEQ ID NO: 605197 - DNA, 13 bp, D. melanogaster
catatgtatataa

SEQ ID NO: 605198 - DNA, 13 bp, D. melanogaster
catatgtatatac

SEQ ID NO: 605199 - DNA, 14 bp, D. melanogaster
catatgtatatata

SEQ ID NO: 605200 - DNA, 14 bp, D. melanogaster
catatgtatatatg

SEQ ID NO: 605201 - DNA, 13 bp, D. melanogaster
catatgtatatga

SEQ ID NO: 605202 - DNA, 13 bp, D. melanogaster
catatgtatattc

SEQ ID NO: 605203 - DNA, 13 bp, D. melanogaster
catatgtatattg

SEQ ID NO: 605204 - DNA, 14 bp, D. melanogaster
catatgtatatttt

SEQ ID NO: 605205 - DNA, 14 bp, D. melanogaster
catatgtatctatg

SEQ ID NO: 605206 - DNA, 13 bp, D. melanogaster
catatgtatctgc

SEQ ID NO: 605207 - DNA, 14 bp, D. melanogaster
catatgtatgcaca

SEQ ID NO: 605208 - DNA, 13 bp, D. melanogaster
catatgtatgcat

SEQ ID NO: 605209 - DNA, 14 bp, D. melanogaster
catatgtatgcatg

SEQ ID NO: 605210 - DNA, 13 bp, D. melanogaster
catatgtatgcca

SEQ ID NO: 605211 - DNA, 13 bp, D. melanogaster
catatgtatgtaa

SEQ ID NO: 605212 - DNA, 14 bp, D. melanogaster
catatgtatgtaat

SEQ ID NO: 605213 - DNA, 13 bp, D. melanogaster
catatgtatgtag

SEQ ID NO: 605214 - DNA, 13 bp, D. melanogaster
catatgtatgtgc

SEQ ID NO: 605215 - DNA, 14 bp, D. melanogaster
catatgtatgtgtg

SEQ ID NO: 605216 - DNA, 14 bp, D. melanogaster
catatgtatgttta

SEQ ID NO: 605217 - DNA, 13 bp, D. melanogaster
catatgtatttaa

SEQ ID NO: 605218 - DNA, 13 bp, D. melanogaster
catatgtatttga

SEQ ID NO: 605219 - DNA, 13 bp, D. melanogaster
catatgtgcatat

SEQ ID NO: 605220 - DNA, 13 bp, D. melanogaster
catatgtgtatat

SEQ ID NO: 605221 - DNA, 14 bp, D. melanogaster
catatgtgtatgta

SEQ ID NO: 605222 - DNA, 13 bp, D. melanogaster
catatgtgtgggt

SEQ ID NO: 605223 - DNA, 14 bp, D. melanogaster
catatgtgtgtgca

SEQ ID NO: 605224 - DNA, 13 bp, D. melanogaster
catatgtgtgtgt

SEQ ID NO: 605225 - DNA, 13 bp, D. melanogaster
catatgttcatat

SEQ ID NO: 605226 - DNA, 13 bp, D. melanogaster
catatgtttatgt

SEQ ID NO: 605227 - DNA, 14 bp, D. melanogaster
catattaagtcaaa

SEQ ID NO: 605228 - DNA, 13 bp, D. melanogaster
catattaatcatt

SEQ ID NO: 605229 - DNA, 13 bp, D. melanogaster
catattaattaca

SEQ ID NO: 605230 - DNA, 13 bp, D. melanogaster
catattaattgtt

SEQ ID NO: 605231 - DNA, 13 bp, D. melanogaster
catattaattttc

SEQ ID NO: 605232 - DNA, 13 bp, D. melanogaster
catattacatacg

SEQ ID NO: 605233 - DNA, 13 bp, D. melanogaster
catattacgcata

SEQ ID NO: 605234 - DNA, 13 bp, D. melanogaster
catattactcata

SEQ ID NO: 605235 - DNA, 13 bp, D. melanogaster
catattagacaga

SEQ ID NO: 605236 - DNA, 13 bp, D. melanogaster
catattcatatat

SEQ ID NO: 605237 - DNA, 14 bp, D. melanogaster
catattcatatatt

SEQ ID NO: 605238 - DNA, 13 bp, D. melanogaster
catattcatatta

SEQ ID NO: 605239 - DNA, 13 bp, D. melanogaster
catattcatccgt

SEQ ID NO: 605240 - DNA, 13 bp, D. melanogaster
catattcattcat

SEQ ID NO: 605241 - DNA, 13 bp, D. melanogaster
catattcatttaa

SEQ ID NO: 605242 - DNA, 13 bp, D. melanogaster
catattcatttta

SEQ ID NO: 605243 - DNA, 13 bp, D. melanogaster
catattcattttg

SEQ ID NO: 605244 - DNA, 13 bp, D. melanogaster
catattccatata

SEQ ID NO: 605245 - DNA, 13 bp, D. melanogaster
catattcccatat

SEQ ID NO: 605246 - DNA, 13 bp, D. melanogaster
catattctatata

SEQ ID NO: 605247 - DNA, 13 bp, D. melanogaster
catattctcagat

SEQ ID NO: 605248 - DNA, 13 bp, D. melanogaster
catattcttaaaa

SEQ ID NO: 605249 - DNA, 13 bp, D. melanogaster
catattctttaag

SEQ ID NO: 605250 - DNA, 13 bp, D. melanogaster
catattgaaaagc

SEQ ID NO: 605251 - DNA, 13 bp, D. melanogaster
catattgaaaata

SEQ ID NO: 605252 - DNA, 13 bp, D. melanogaster
catattgaaattt

SEQ ID NO: 605253 - DNA, 13 bp, D. melanogaster
catattgcagaat

SEQ ID NO: 605254 - DNA, 13 bp, D. melanogaster
catattgctacga

SEQ ID NO: 605255 - DNA, 13 bp, D. melanogaster
catattggcaagg

SEQ ID NO: 605256 - DNA, 13 bp, D. melanogaster
catattgtacata

SEQ ID NO: 605257 - DNA, 13 bp, D. melanogaster
catattgtatata

SEQ ID NO: 605258 - DNA, 14 bp, D. melanogaster
catattgtatatat

SEQ ID NO: 605259 - DNA, 14 bp, D. melanogaster
catattgtatttta

SEQ ID NO: 605260 - DNA, 13 bp, D. melanogaster
catatttaaacat

SEQ ID NO: 605261 - DNA, 13 bp, D. melanogaster
catatttaaacta

SEQ ID NO: 605262 - DNA, 13 bp, D. melanogaster
catatttaacata

SEQ ID NO: 605263 - DNA, 13 bp, D. melanogaster
catatttaagata

SEQ ID NO: 605264 - DNA, 14 bp, D. melanogaster
catatttaagatat

SEQ ID NO: 605265 - DNA, 13 bp, D. melanogaster
catatttaagtta

SEQ ID NO: 605266 - DNA, 13 bp, D. melanogaster
catatttaatgtt

SEQ ID NO: 605267 - DNA, 13 bp, D. melanogaster
catatttaattga

SEQ ID NO: 605268 - DNA, 14 bp, D. melanogaster
catatttaattgaa

SEQ ID NO: 605269 - DNA, 13 bp, D. melanogaster
catatttaatttc

SEQ ID NO: 605270 - DNA, 13 bp, D. melanogaster
catatttaccttt

SEQ ID NO: 605271 - DNA, 13 bp, D. melanogaster
catatttactata

SEQ ID NO: 605272 - DNA, 14 bp, D. melanogaster
catatttagtatta

SEQ ID NO: 605273 - DNA, 13 bp, D. melanogaster
catatttataaac

SEQ ID NO: 605274 - DNA, 13 bp, D. melanogaster
catatttatatag

SEQ ID NO: 605275 - DNA, 14 bp, D. melanogaster
catatttatatgta

SEQ ID NO: 605276 - DNA, 13 bp, D. melanogaster
catatttatattc

SEQ ID NO: 605277 - DNA, 13 bp, D. melanogaster
catatttatgact

SEQ ID NO: 605278 - DNA, 13 bp, D. melanogaster
catatttatgcac

SEQ ID NO: 605279 - DNA, 13 bp, D. melanogaster
catatttatgtac

SEQ ID NO: 605280 - DNA, 14 bp, D. melanogaster
catatttatgtaca

SEQ ID NO: 605281 - DNA, 13 bp, D. melanogaster
catatttatgtag

SEQ ID NO: 605282 - DNA, 14 bp, D. melanogaster
catatttatgtatg

SEQ ID NO: 605283 - DNA, 13 bp, D. melanogaster
catatttattcaa

SEQ ID NO: 605284 - DNA, 13 bp, D. melanogaster
catatttattgct

SEQ ID NO: 605285 - DNA, 13 bp, D. melanogaster
catatttattgta

SEQ ID NO: 605286 - DNA, 13 bp, D. melanogaster
catatttattgtt

SEQ ID NO: 605287 - DNA, 13 bp, D. melanogaster
catatttatttca

SEQ ID NO: 605288 - DNA, 13 bp, D. melanogaster
catatttatttga

SEQ ID NO: 605289 - DNA, 13 bp, D. melanogaster
catatttcaaaat

SEQ ID NO: 605290 - DNA, 13 bp, D. melanogaster
catatttcattag

SEQ ID NO: 605291 - DNA, 13 bp, D. melanogaster
catatttcgtatt

SEQ ID NO: 605292 - DNA, 13 bp, D. melanogaster
catatttcgtttt

SEQ ID NO: 605293 - DNA, 13 bp, D. melanogaster
catatttgattta

SEQ ID NO: 605294 - DNA, 13 bp, D. melanogaster
catatttgatttt

SEQ ID NO: 605295 - DNA, 13 bp, D. melanogaster
catatttgcatat

SEQ ID NO: 605296 - DNA, 13 bp, D. melanogaster
catatttggccaa

SEQ ID NO: 605297 - DNA, 13 bp, D. melanogaster
catatttggctac

SEQ ID NO: 605298 - DNA, 13 bp, D. melanogaster
catatttgggcca

SEQ ID NO: 605299 - DNA, 14 bp, D. melanogaster
catatttgggccat

SEQ ID NO: 605300 - DNA, 13 bp, D. melanogaster
catatttgtaaat

SEQ ID NO: 605301 - DNA, 13 bp, D. melanogaster
catatttgtatat

SEQ ID NO: 605302 - DNA, 13 bp, D. melanogaster
catatttgttatt

SEQ ID NO: 605303 - DNA, 13 bp, D. melanogaster
catatttgttgtt

SEQ ID NO: 605304 - DNA, 13 bp, D. melanogaster
catatttgtttac

SEQ ID NO: 605305 - DNA, 13 bp, D. melanogaster
catatttgtttat

SEQ ID NO: 605306 - DNA, 13 bp, D. melanogaster
catattttagagt

SEQ ID NO: 605307 - DNA, 13 bp, D. melanogaster
catattttatcaa

SEQ ID NO: 605308 - DNA, 13 bp, D. melanogaster
catattttatttg

SEQ ID NO: 605309 - DNA, 13 bp, D. melanogaster
catattttcaaaa

SEQ ID NO: 605310 - DNA, 13 bp, D. melanogaster
catattttcacaa

SEQ ID NO: 605311 - DNA, 14 bp, D. melanogaster
catattttccattt

SEQ ID NO: 605312 - DNA, 13 bp, D. melanogaster
catattttcgatt

SEQ ID NO: 605313 - DNA, 13 bp, D. melanogaster
catattttctgcc

SEQ ID NO: 605314 - DNA, 13 bp, D. melanogaster
catattttgcaaa

SEQ ID NO: 605315 - DNA, 13 bp, D. melanogaster
catattttgcaca

SEQ ID NO: 605316 - DNA, 13 bp, D. melanogaster
catattttgccaa

SEQ ID NO: 605317 - DNA, 13 bp, D. melanogaster
catattttgtaat

SEQ ID NO: 605318 - DNA, 13 bp, D. melanogaster
catattttgtcaa

SEQ ID NO: 605319 - DNA, 13 bp, D. melanogaster
catattttgttca

SEQ ID NO: 605320 - DNA, 13 bp, D. melanogaster
catatttttgcat

SEQ ID NO: 605321 - DNA, 13 bp, D. melanogaster
catatttttgtga

SEQ ID NO: 605322 - DNA, 13 bp, D. melanogaster
catatttttgttg

SEQ ID NO: 605323 - DNA, 14 bp, D. melanogaster
catatttttgtttc

SEQ ID NO: 605324 - DNA, 13 bp, D. melanogaster
catattttttaca

SEQ ID NO: 605325 - DNA, 13 bp, D. melanogaster
catattttttcaa

SEQ ID NO: 605326 - DNA, 13 bp, D. melanogaster
catattttttcac

SEQ ID NO: 605327 - DNA, 14 bp, D. melanogaster
catattttttggca

SEQ ID NO: 605328 - DNA, 13 bp, D. melanogaster
catattttttgtg

SEQ ID NO: 605329 - DNA, 13 bp, D. melanogaster
catcaaaaactac

SEQ ID NO: 605330 - DNA, 13 bp, D. melanogaster
catcaaaatgaaa

SEQ ID NO: 605331 - DNA, 13 bp, D. melanogaster
catcaaaatgcat

SEQ ID NO: 605332 - DNA, 13 bp, D. melanogaster
catcaaaattaat

SEQ ID NO: 605333 - DNA, 13 bp, D. melanogaster
catcaaaatttca

SEQ ID NO: 605334 - DNA, 13 bp, D. melanogaster
catcaaaatttga

SEQ ID NO: 605335 - DNA, 13 bp, D. melanogaster
catcaaaatttgc

SEQ ID NO: 605336 - DNA, 14 bp, D. melanogaster
catcaaaatttgca

SEQ ID NO: 605337 - DNA, 13 bp, D. melanogaster
catcaaacattta

SEQ ID NO: 605338 - DNA, 14 bp, D. melanogaster
catcaaagagctaa

SEQ ID NO: 605339 - DNA, 13 bp, D. melanogaster
catcaaataatca

SEQ ID NO: 605340 - DNA, 14 bp, D. melanogaster
catcaaataatcag

SEQ ID NO: 605341 - DNA, 13 bp, D. melanogaster
catcaaatagaat

SEQ ID NO: 605342 - DNA, 14 bp, D. melanogaster
catcaaatagaatt

SEQ ID NO: 605343 - DNA, 13 bp, D. melanogaster
catcaaatattca

SEQ ID NO: 605344 - DNA, 13 bp, D. melanogaster
catcaaatcgaac

SEQ ID NO: 605345 - DNA, 14 bp, D. melanogaster
catcaaatgaattt

SEQ ID NO: 605346 - DNA, 13 bp, D. melanogaster
catcaaatgcaat

SEQ ID NO: 605347 - DNA, 13 bp, D. melanogaster
catcaaattctgg

SEQ ID NO: 605348 - DNA, 13 bp, D. melanogaster
catcaaattgcaa

SEQ ID NO: 605349 - DNA, 13 bp, D. melanogaster
catcaaatttaaa

SEQ ID NO: 605350 - DNA, 13 bp, D. melanogaster
catcaaattttaa

SEQ ID NO: 605351 - DNA, 13 bp, D. melanogaster
catcaacaacatc

SEQ ID NO: 605352 - DNA, 13 bp, D. melanogaster
catcaacagcaga

SEQ ID NO: 605353 - DNA, 14 bp, D. melanogaster
catcaacagcagaa

SEQ ID NO: 605354 - DNA, 13 bp, D. melanogaster
catcaacagctca

SEQ ID NO: 605355 - DNA, 13 bp, D. melanogaster
catcaacaggccc

SEQ ID NO: 605356 - DNA, 13 bp, D. melanogaster
catcaacatcaaa

SEQ ID NO: 605357 - DNA, 13 bp, D. melanogaster
catcaacatcaac

SEQ ID NO: 605358 - DNA, 13 bp, D. melanogaster
catcaacatcatc

SEQ ID NO: 605359 - DNA, 14 bp, D. melanogaster
catcaacatcatca

SEQ ID NO: 605360 - DNA, 13 bp, D. melanogaster
catcaacgtcatc

SEQ ID NO: 605361 - DNA, 14 bp, D. melanogaster
catcaactgaagct

SEQ ID NO: 605362 - DNA, 13 bp, D. melanogaster
catcaactgtctg

SEQ ID NO: 605363 - DNA, 13 bp, D. melanogaster
catcaagcatacg

SEQ ID NO: 605364 - DNA, 13 bp, D. melanogaster
catcaataaattt

SEQ ID NO: 605365 - DNA, 13 bp, D. melanogaster
catcaatataaat

SEQ ID NO: 605366 - DNA, 13 bp, D. melanogaster
catcaatatggct

SEQ ID NO: 605367 - DNA, 13 bp, D. melanogaster
catcaatcaaatg

SEQ ID NO: 605368 - DNA, 13 bp, D. melanogaster
catcaatcaatca

SEQ ID NO: 605369 - DNA, 13 bp, D. melanogaster
catcaatgaaaac

SEQ ID NO: 605370 - DNA, 14 bp, D. melanogaster
catcaatgaaaaca

SEQ ID NO: 605371 - DNA, 13 bp, D. melanogaster
catcaatgttatt

SEQ ID NO: 605372 - DNA, 14 bp, D. melanogaster
catcaattatttca

SEQ ID NO: 605373 - DNA, 13 bp, D. melanogaster
catcaattcaatt

SEQ ID NO: 605374 - DNA, 13 bp, D. melanogaster
catcaatttaatg

SEQ ID NO: 605375 - DNA, 13 bp, D. melanogaster
catcaatttaatt

SEQ ID NO: 605376 - DNA, 13 bp, D. melanogaster
catcaattttaat

SEQ ID NO: 605377 - DNA, 13 bp, D. melanogaster
catcacaaacatt

SEQ ID NO: 605378 - DNA, 13 bp, D. melanogaster
catcacaactatt

SEQ ID NO: 605379 - DNA, 13 bp, D. melanogaster
catcacacggcat

SEQ ID NO: 605380 - DNA, 13 bp, D. melanogaster
catcacactgaca

SEQ ID NO: 605381 - DNA, 13 bp, D. melanogaster
catcacatcacat

SEQ ID NO: 605382 - DNA, 14 bp, D. melanogaster
catcacatcacatc

SEQ ID NO: 605383 - DNA, 13 bp, D. melanogaster
catcacatcgcat

SEQ ID NO: 605384 - DNA, 13 bp, D. melanogaster
catcaccaaactt

SEQ ID NO: 605385 - DNA, 13 bp, D. melanogaster
catcaccaactta

SEQ ID NO: 605386 - DNA, 13 bp, D. melanogaster
catcaccaccaga

SEQ ID NO: 605387 - DNA, 13 bp, D. melanogaster
catcaccaccatc

SEQ ID NO: 605388 - DNA, 13 bp, D. melanogaster
catcaccatcaac

SEQ ID NO: 605389 - DNA, 13 bp, D. melanogaster
catcaccatcacc

SEQ ID NO: 605390 - DNA, 14 bp, D. melanogaster
catcaccatcacca

SEQ ID NO: 605391 - DNA, 13 bp, D. melanogaster
catcaccatcatc

SEQ ID NO: 605392 - DNA, 14 bp, D. melanogaster
catcaccatcatca

SEQ ID NO: 605393 - DNA, 14 bp, D. melanogaster
catcaccatcatcg

SEQ ID NO: 605394 - DNA, 13 bp, D. melanogaster
catcaccatcgcc

SEQ ID NO: 605395 - DNA, 14 bp, D. melanogaster
catcaccatcgcca

SEQ ID NO: 605396 - DNA, 13 bp, D. melanogaster
catcaccatctcc

SEQ ID NO: 605397 - DNA, 14 bp, D. melanogaster
catcaccatctcca

SEQ ID NO: 605398 - DNA, 13 bp, D. melanogaster
catcaccctttgg

SEQ ID NO: 605399 - DNA, 13 bp, D. melanogaster
catcaccggctgc

SEQ ID NO: 605400 - DNA, 13 bp, D. melanogaster
catcacgccatcg

SEQ ID NO: 605401 - DNA, 13 bp, D. melanogaster
catcacgtaccaa

SEQ ID NO: 605402 - DNA, 13 bp, D. melanogaster
catcacgtatacg

SEQ ID NO: 605403 - DNA, 13 bp, D. melanogaster
catcacgtcatcg

SEQ ID NO: 605404 - DNA, 13 bp, D. melanogaster
catcactgcccaa

SEQ ID NO: 605405 - DNA, 13 bp, D. melanogaster
catcacttcgaaa

SEQ ID NO: 605406 - DNA, 13 bp, D. melanogaster
catcagaaatcgc

SEQ ID NO: 605407 - DNA, 13 bp, D. melanogaster
catcagagacaaa

SEQ ID NO: 605408 - DNA, 13 bp, D. melanogaster
catcagataattg

SEQ ID NO: 605409 - DNA, 13 bp, D. melanogaster
catcagatacatt

SEQ ID NO: 605410 - DNA, 13 bp, D. melanogaster
catcagatagaaa

SEQ ID NO: 605411 - DNA, 13 bp, D. melanogaster
catcagcaacaca

SEQ ID NO: 605412 - DNA, 13 bp, D. melanogaster
catcagcaacatc

SEQ ID NO: 605413 - DNA, 13 bp, D. melanogaster
catcagcaattgt

SEQ ID NO: 605414 - DNA, 13 bp, D. melanogaster
catcagcaccacc

SEQ ID NO: 605415 - DNA, 13 bp, D. melanogaster
catcagcaccatc

SEQ ID NO: 605416 - DNA, 13 bp, D. melanogaster
catcagcagcaat

SEQ ID NO: 605417 - DNA, 13 bp, D. melanogaster
catcagcagcaga

SEQ ID NO: 605418 - DNA, 13 bp, D. melanogaster
catcagcagcagt

SEQ ID NO: 605419 - DNA, 13 bp, D. melanogaster
catcagcagcatc

SEQ ID NO: 605420 - DNA, 14 bp, D. melanogaster
catcagcagcatca

SEQ ID NO: 605421 - DNA, 13 bp, D. melanogaster
catcagcatcaac

SEQ ID NO: 605422 - DNA, 14 bp, D. melanogaster
catcagcatcaaca

SEQ ID NO: 605423 - DNA, 14 bp, D. melanogaster
catcagcatcagca

SEQ ID NO: 605424 - DNA, 15 bp, D. melanogaster
catcagcatcagcag

SEQ ID NO: 605425 - DNA, 13 bp, D. melanogaster
catcagcatcagt

SEQ ID NO: 605426 - DNA, 13 bp, D. melanogaster
catcagcatcatc

SEQ ID NO: 605427 - DNA, 14 bp, D. melanogaster
catcagcatcatca

SEQ ID NO: 605428 - DNA, 14 bp, D. melanogaster
catcagcatcatcg

SEQ ID NO: 605429 - DNA, 13 bp, D. melanogaster
catcagctgtttt

SEQ ID NO: 605430 - DNA, 13 bp, D. melanogaster
catcagcttcttc

SEQ ID NO: 605431 - DNA, 13 bp, D. melanogaster
catcaggaacaaa

SEQ ID NO: 605432 - DNA, 13 bp, D. melanogaster
catcagggttctc

SEQ ID NO: 605433 - DNA, 13 bp, D. melanogaster
catcaggtggctg

SEQ ID NO: 605434 - DNA, 13 bp, D. melanogaster
catcagtgacatt

SEQ ID NO: 605435 - DNA, 13 bp, D. melanogaster
catcataaaaatt

SEQ ID NO: 605436 - DNA, 13 bp, D. melanogaster
catcataaacaat

SEQ ID NO: 605437 - DNA, 14 bp, D. melanogaster
catcataaatggtt

SEQ ID NO: 605438 - DNA, 13 bp, D. melanogaster
catcatacgttgg

SEQ ID NO: 605439 - DNA, 13 bp, D. melanogaster
catcatattgcta

SEQ ID NO: 605440 - DNA, 13 bp, D. melanogaster
catcatcaaaatt

SEQ ID NO: 605441 - DNA, 13 bp, D. melanogaster
catcatcaacagc

SEQ ID NO: 605442 - DNA, 13 bp, D. melanogaster
catcatcaacatc

SEQ ID NO: 605443 - DNA, 13 bp, D. melanogaster
catcatcaacatt

SEQ ID NO: 605444 - DNA, 13 bp, D. melanogaster
catcatcaatcaa

SEQ ID NO: 605445 - DNA, 13 bp, D. melanogaster
catcatcaccacc

SEQ ID NO: 605446 - DNA, 14 bp, D. melanogaster
catcatcaccacca

SEQ ID NO: 605447 - DNA, 14 bp, D. melanogaster
catcatcaccatcg

SEQ ID NO: 605448 - DNA, 13 bp, D. melanogaster
catcatcagatga

SEQ ID NO: 605449 - DNA, 13 bp, D. melanogaster
catcatcagcaac

SEQ ID NO: 605450 - DNA, 13 bp, D. melanogaster
catcatcagcagt

SEQ ID NO: 605451 - DNA, 13 bp, D. melanogaster
catcatcagcatc

SEQ ID NO: 605452 - DNA, 14 bp, D. melanogaster
catcatcagcatca

SEQ ID NO: 605453 - DNA, 14 bp, D. melanogaster
catcatcataatca

SEQ ID NO: 605454 - DNA, 14 bp, D. melanogaster
catcatcatcaaca

SEQ ID NO: 605455 - DNA, 13 bp, D. melanogaster
catcatcatcaat

SEQ ID NO: 605456 - DNA, 13 bp, D. melanogaster
catcatcatcact

SEQ ID NO: 605457 - DNA, 14 bp, D. melanogaster
catcatcatcagcc

SEQ ID NO: 605458 - DNA, 13 bp, D. melanogaster
catcatcatcagt

SEQ ID NO: 605459 - DNA, 13 bp, D. melanogaster
catcatcatcata

SEQ ID NO: 605460 - DNA, 13 bp, D. melanogaster
catcatcatcatc

SEQ ID NO: 605461 - DNA, 14 bp, D. melanogaster
catcatcatcatca

SEQ ID NO: 605462 - DNA, 14 bp, D. melanogaster
catcatcatcatcc

SEQ ID NO: 605463 - DNA, 14 bp, D. melanogaster
catcatcatcatct

SEQ ID NO: 605464 - DNA, 13 bp, D. melanogaster
catcatcatcatt

SEQ ID NO: 605465 - DNA, 14 bp, D. melanogaster
catcatcatcattc

SEQ ID NO: 605466 - DNA, 14 bp, D. melanogaster
catcatcatcattt

SEQ ID NO: 605467 - DNA, 13 bp, D. melanogaster
catcatcatcccc

SEQ ID NO: 605468 - DNA, 13 bp, D. melanogaster
catcatcatccga

SEQ ID NO: 605469 - DNA, 13 bp, D. melanogaster
catcatcatcgat

SEQ ID NO: 605470 - DNA, 13 bp, D. melanogaster
catcatcatcgca

SEQ ID NO: 605471 - DNA, 13 bp, D. melanogaster
catcatcatcgcc

SEQ ID NO: 605472 - DNA, 14 bp, D. melanogaster
catcatcatcgcca

SEQ ID NO: 605473 - DNA, 14 bp, D. melanogaster
catcatcatcgccg

SEQ ID NO: 605474 - DNA, 13 bp, D. melanogaster
catcatcatcgct

SEQ ID NO: 605475 - DNA, 14 bp, D. melanogaster
catcatcatcggca

SEQ ID NO: 605476 - DNA, 13 bp, D. melanogaster
catcatcatcgta

SEQ ID NO: 605477 - DNA, 14 bp, D. melanogaster
catcatcatcgtct

SEQ ID NO: 605478 - DNA, 13 bp, D. melanogaster
catcatcatcgtg

SEQ ID NO: 605479 - DNA, 13 bp, D. melanogaster
catcatcatctcc

SEQ ID NO: 605480 - DNA, 13 bp, D. melanogaster
catcatcatctgc

SEQ ID NO: 605481 - DNA, 14 bp, D. melanogaster
catcatcatcttca

SEQ ID NO: 605482 - DNA, 14 bp, D. melanogaster
catcatcatgatca

SEQ ID NO: 605483 - DNA, 13 bp, D. melanogaster
catcatcattatg

SEQ ID NO: 605484 - DNA, 13 bp, D. melanogaster
catcatcattatt

SEQ ID NO: 605485 - DNA, 13 bp, D. melanogaster
catcatcattgtt

SEQ ID NO: 605486 - DNA, 13 bp, D. melanogaster
catcatcatttat

SEQ ID NO: 605487 - DNA, 13 bp, D. melanogaster
catcatcatttca

SEQ ID NO: 605488 - DNA, 13 bp, D. melanogaster
catcatcatttgc

SEQ ID NO: 605489 - DNA, 13 bp, D. melanogaster
catcatcatttgg

SEQ ID NO: 605490 - DNA, 13 bp, D. melanogaster
catcatcattttg

SEQ ID NO: 605491 - DNA, 13 bp, D. melanogaster
catcatcattttt

SEQ ID NO: 605492 - DNA, 14 bp, D. melanogaster
catcatcctcatca

SEQ ID NO: 605493 - DNA, 14 bp, D. melanogaster
catcatcgccatca

SEQ ID NO: 605494 - DNA, 13 bp, D. melanogaster
catcatcgccatt

SEQ ID NO: 605495 - DNA, 13 bp, D. melanogaster
catcatcggcatc

SEQ ID NO: 605496 - DNA, 13 bp, D. melanogaster
catcatcgtcagc

SEQ ID NO: 605497 - DNA, 13 bp, D. melanogaster
catcatcgtcatc

SEQ ID NO: 605498 - DNA, 14 bp, D. melanogaster
catcatcgtcatca

SEQ ID NO: 605499 - DNA, 13 bp, D. melanogaster
catcatcgtcatt

SEQ ID NO: 605500 - DNA, 14 bp, D. melanogaster
catcatcgtcgtca

SEQ ID NO: 605501 - DNA, 13 bp, D. melanogaster
catcatctacata

SEQ ID NO: 605502 - DNA, 14 bp, D. melanogaster
catcatctacatat

SEQ ID NO: 605503 - DNA, 13 bp, D. melanogaster
catcatctattaa

SEQ ID NO: 605504 - DNA, 13 bp, D. melanogaster
catcatctgcatc

SEQ ID NO: 605505 - DNA, 14 bp, D. melanogaster
catcatcttccatc

SEQ ID NO: 605506 - DNA, 13 bp, D. melanogaster
catcatcttttaa

SEQ ID NO: 605507 - DNA, 13 bp, D. melanogaster
catcatgatgatg

SEQ ID NO: 605508 - DNA, 13 bp, D. melanogaster
catcatgtggaac

SEQ ID NO: 605509 - DNA, 13 bp, D. melanogaster
catcattaaaatt

SEQ ID NO: 605510 - DNA, 14 bp, D. melanogaster
catcattacaattt

SEQ ID NO: 605511 - DNA, 13 bp, D. melanogaster
catcattagcatt

SEQ ID NO: 605512 - DNA, 13 bp, D. melanogaster
catcattatcatc

SEQ ID NO: 605513 - DNA, 13 bp, D. melanogaster
catcattatcgtc

SEQ ID NO: 605514 - DNA, 13 bp, D. melanogaster
catcattattata

SEQ ID NO: 605515 - DNA, 13 bp, D. melanogaster
catcattgtcatc

SEQ ID NO: 605516 - DNA, 13 bp, D. melanogaster
catcatttgattt

SEQ ID NO: 605517 - DNA, 13 bp, D. melanogaster
catcatttgcatg

SEQ ID NO: 605518 - DNA, 13 bp, D. melanogaster
catcatttttagt

SEQ ID NO: 605519 - DNA, 13 bp, D. melanogaster
catcatttttctg

SEQ ID NO: 605520 - DNA, 14 bp, D. melanogaster
catcatttttgttt

SEQ ID NO: 605521 - DNA, 13 bp, D. melanogaster
catccaaagagac

SEQ ID NO: 605522 - DNA, 13 bp, D. melanogaster
catccaaatatct

SEQ ID NO: 605523 - DNA, 13 bp, D. melanogaster
catccaacatcca

SEQ ID NO: 605524 - DNA, 14 bp, D. melanogaster
catccaaccatcca

SEQ ID NO: 605525 - DNA, 13 bp, D. melanogaster
catccaagcatcc

SEQ ID NO: 605526 - DNA, 13 bp, D. melanogaster
catccaatcattt

SEQ ID NO: 605527 - DNA, 13 bp, D. melanogaster
catccaattcgac

SEQ ID NO: 605528 - DNA, 14 bp, D. melanogaster
catccaattcgaca

SEQ ID NO: 605529 - DNA, 13 bp, D. melanogaster
catccacagccac

SEQ ID NO: 605530 - DNA, 13 bp, D. melanogaster
catccacatccaa

SEQ ID NO: 605531 - DNA, 13 bp, D. melanogaster
catccacatccac

SEQ ID NO: 605532 - DNA, 14 bp, D. melanogaster
catccacatccaca

SEQ ID NO: 605533 - DNA, 14 bp, D. melanogaster
catccacatccacg

SEQ ID NO: 605534 - DNA, 13 bp, D. melanogaster
catccacatccag

SEQ ID NO: 605535 - DNA, 14 bp, D. melanogaster
catccacatccata

SEQ ID NO: 605536 - DNA, 13 bp, D. melanogaster
catccacatccca

SEQ ID NO: 605537 - DNA, 13 bp, D. melanogaster
catccacatcctt

SEQ ID NO: 605538 - DNA, 13 bp, D. melanogaster
catccacatgcac

SEQ ID NO: 605539 - DNA, 13 bp, D. melanogaster
catccacttccac

SEQ ID NO: 605540 - DNA, 13 bp, D. melanogaster
catccagagcttt

SEQ ID NO: 605541 - DNA, 13 bp, D. melanogaster
catccagcatcca

SEQ ID NO: 605542 - DNA, 13 bp, D. melanogaster
catccagccaacc

SEQ ID NO: 605543 - DNA, 13 bp, D. melanogaster
catccagccaatg

SEQ ID NO: 605544 - DNA, 13 bp, D. melanogaster
catccagccaccc

SEQ ID NO: 605545 - DNA, 13 bp, D. melanogaster
catccagccagcc

SEQ ID NO: 605546 - DNA, 14 bp, D. melanogaster
catccagccagcca

SEQ ID NO: 605547 - DNA, 13 bp, D. melanogaster
catccagccatcc

SEQ ID NO: 605548 - DNA, 13 bp, D. melanogaster
catccagctgaat

SEQ ID NO: 605549 - DNA, 14 bp, D. melanogaster
catccagctgaatg

SEQ ID NO: 605550 - DNA, 13 bp, D. melanogaster
catccagctgcca

SEQ ID NO: 605551 - DNA, 13 bp, D. melanogaster
catccaggcatcc

SEQ ID NO: 605552 - DNA, 13 bp, D. melanogaster
catccaggtattc

SEQ ID NO: 605553 - DNA, 13 bp, D. melanogaster
catccagtcagcc

SEQ ID NO: 605554 - DNA, 14 bp, D. melanogaster
catccataccttcg

SEQ ID NO: 605555 - DNA, 13 bp, D. melanogaster
catccatatacag

SEQ ID NO: 605556 - DNA, 13 bp, D. melanogaster
catccatatccat

SEQ ID NO: 605557 - DNA, 13 bp, D. melanogaster
catccatcaatca

SEQ ID NO: 605558 - DNA, 14 bp, D. melanogaster
catccatccaacca

SEQ ID NO: 605559 - DNA, 13 bp, D. melanogaster
catccatccactc

SEQ ID NO: 605560 - DNA, 13 bp, D. melanogaster
catccatccagcc

SEQ ID NO: 605561 - DNA, 13 bp, D. melanogaster
catccatccatat

SEQ ID NO: 605562 - DNA, 13 bp, D. melanogaster
catccatccatcc

SEQ ID NO: 605563 - DNA, 14 bp, D. melanogaster
catccatccatcca

SEQ ID NO: 605564 - DNA, 14 bp, D. melanogaster
catccatccatccg

SEQ ID NO: 605565 - DNA, 13 bp, D. melanogaster
catccatccatct

SEQ ID NO: 605566 - DNA, 14 bp, D. melanogaster
catccatccatcta

SEQ ID NO: 605567 - DNA, 13 bp, D. melanogaster
catccattaaaat

SEQ ID NO: 605568 - DNA, 13 bp, D. melanogaster
catccattccatt

SEQ ID NO: 605569 - DNA, 13 bp, D. melanogaster
catccatttgatg

SEQ ID NO: 605570 - DNA, 13 bp, D. melanogaster
catcccaacatcc

SEQ ID NO: 605571 - DNA, 13 bp, D. melanogaster
catcccaatccca

SEQ ID NO: 605572 - DNA, 13 bp, D. melanogaster
catcccagagatg

SEQ ID NO: 605573 - DNA, 13 bp, D. melanogaster
catcccatattag

SEQ ID NO: 605574 - DNA, 14 bp, D. melanogaster
catcccatccatcc

SEQ ID NO: 605575 - DNA, 13 bp, D. melanogaster
catcccatcccgt

SEQ ID NO: 605576 - DNA, 14 bp, D. melanogaster
catcccatccgatc

SEQ ID NO: 605577 - DNA, 14 bp, D. melanogaster
catcccatcgcatc

SEQ ID NO: 605578 - DNA, 13 bp, D. melanogaster
catcccatctcat

SEQ ID NO: 605579 - DNA, 13 bp, D. melanogaster
catccccaaccag

SEQ ID NO: 605580 - DNA, 13 bp, D. melanogaster
catccccatccat

SEQ ID NO: 605581 - DNA, 14 bp, D. melanogaster
catccccatctcca

SEQ ID NO: 605582 - DNA, 13 bp, D. melanogaster
catcccgcatccc

SEQ ID NO: 605583 - DNA, 13 bp, D. melanogaster
catcccgctcgca

SEQ ID NO: 605584 - DNA, 13 bp, D. melanogaster
catcccggcatcc

SEQ ID NO: 605585 - DNA, 13 bp, D. melanogaster
catcccttacaga

SEQ ID NO: 605586 - DNA, 13 bp, D. melanogaster
catccgaatccga

SEQ ID NO: 605587 - DNA, 13 bp, D. melanogaster
catccgagcatcc

SEQ ID NO: 605588 - DNA, 13 bp, D. melanogaster
catccgatccgat

SEQ ID NO: 605589 - DNA, 13 bp, D. melanogaster
catccgcagccgc

SEQ ID NO: 605590 - DNA, 14 bp, D. melanogaster
catccgcagccgca

SEQ ID NO: 605591 - DNA, 14 bp, D. melanogaster
catccgcatccgca

SEQ ID NO: 605592 - DNA, 13 bp, D. melanogaster
catccgccatccg

SEQ ID NO: 605593 - DNA, 14 bp, D. melanogaster
catccgccccgttg

SEQ ID NO: 605594 - DNA, 13 bp, D. melanogaster
catccgcgtttgc

SEQ ID NO: 605595 - DNA, 13 bp, D. melanogaster
catccgctgccga

SEQ ID NO: 605596 - DNA, 13 bp, D. melanogaster
catccggtttctt

SEQ ID NO: 605597 - DNA, 13 bp, D. melanogaster
catccgtatccgt

SEQ ID NO: 605598 - DNA, 14 bp, D. melanogaster
catccgtatccgta

SEQ ID NO: 605599 - DNA, 13 bp, D. melanogaster
catccgtttccgc

SEQ ID NO: 605600 - DNA, 14 bp, D. melanogaster
catcctatgaggct

SEQ ID NO: 605601 - DNA, 13 bp, D. melanogaster
catcctcatcatc

SEQ ID NO: 605602 - DNA, 14 bp, D. melanogaster
catcctcatcatca

SEQ ID NO: 605603 - DNA, 13 bp, D. melanogaster
catcctcatccgc

SEQ ID NO: 605604 - DNA, 14 bp, D. melanogaster
catcctcatccgca

SEQ ID NO: 605605 - DNA, 13 bp, D. melanogaster
catcctcattctc

SEQ ID NO: 605606 - DNA, 13 bp, D. melanogaster
catcctcgtcctc

SEQ ID NO: 605607 - DNA, 13 bp, D. melanogaster
catcctcgtcctt

SEQ ID NO: 605608 - DNA, 13 bp, D. melanogaster
catcctgaatgcg

SEQ ID NO: 605609 - DNA, 13 bp, D. melanogaster
catcctgatgact

SEQ ID NO: 605610 - DNA, 14 bp, D. melanogaster
catcctgcatcctg

SEQ ID NO: 605611 - DNA, 13 bp, D. melanogaster
catcctgccatcc

SEQ ID NO: 605612 - DNA, 13 bp, D. melanogaster
catcctggcatcc

SEQ ID NO: 605613 - DNA, 14 bp, D. melanogaster
catcctggcatcct

SEQ ID NO: 605614 - DNA, 13 bp, D. melanogaster
catcctggccaaa

SEQ ID NO: 605615 - DNA, 13 bp, D. melanogaster
catccttactgca

SEQ ID NO: 605616 - DNA, 13 bp, D. melanogaster
catccttggcttt

SEQ ID NO: 605617 - DNA, 14 bp, D. melanogaster
catccttttaaaaa

SEQ ID NO: 605618 - DNA, 13 bp, D. melanogaster
catcgaaaataaa

SEQ ID NO: 605619 - DNA, 13 bp, D. melanogaster
catcgaaaatata

SEQ ID NO: 605620 - DNA, 13 bp, D. melanogaster
catcgaaatcgaa

SEQ ID NO: 605621 - DNA, 13 bp, D. melanogaster
catcgaaatggaa

SEQ ID NO: 605622 - DNA, 13 bp, D. melanogaster
catcgaatcgaat

SEQ ID NO: 605623 - DNA, 13 bp, D. melanogaster
catcgaattcagg

SEQ ID NO: 605624 - DNA, 13 bp, D. melanogaster
catcgacaacaac

SEQ ID NO: 605625 - DNA, 14 bp, D. melanogaster
catcgacaacaaca

SEQ ID NO: 605626 - DNA, 13 bp, D. melanogaster
catcgacaacatt

SEQ ID NO: 605627 - DNA, 14 bp, D. melanogaster
catcgacaacatta

SEQ ID NO: 605628 - DNA, 13 bp, D. melanogaster
catcgacatcatc

SEQ ID NO: 605629 - DNA, 13 bp, D. melanogaster
catcgacatcgac

SEQ ID NO: 605630 - DNA, 14 bp, D. melanogaster
catcgacatcgaca

SEQ ID NO: 605631 - DNA, 13 bp, D. melanogaster
catcgacattgag

SEQ ID NO: 605632 - DNA, 13 bp, D. melanogaster
catcgacgtaatg

SEQ ID NO: 605633 - DNA, 15 bp, D. melanogaster
catcgaggcattgtg

SEQ ID NO: 605634 - DNA, 13 bp, D. melanogaster
catcgatcatttg

SEQ ID NO: 605635 - DNA, 13 bp, D. melanogaster
catcgatgacaac

SEQ ID NO: 605636 - DNA, 14 bp, D. melanogaster
catcgatgtttttc

SEQ ID NO: 605637 - DNA, 13 bp, D. melanogaster
catcgattcaatt

SEQ ID NO: 605638 - DNA, 13 bp, D. melanogaster
catcgatttgcat

SEQ ID NO: 605639 - DNA, 13 bp, D. melanogaster
catcgattttcca

SEQ ID NO: 605640 - DNA, 14 bp, D. melanogaster
catcgcaagcattt

SEQ ID NO: 605641 - DNA, 13 bp, D. melanogaster
catcgcatcgaat

SEQ ID NO: 605642 - DNA, 14 bp, D. melanogaster
catcgcatcgcatc

SEQ ID NO: 605643 - DNA, 14 bp, D. melanogaster
catcgcatcgcatt

SEQ ID NO: 605644 - DNA, 13 bp, D. melanogaster
catcgcattttcc

SEQ ID NO: 605645 - DNA, 13 bp, D. melanogaster
catcgccaaagcc

SEQ ID NO: 605646 - DNA, 13 bp, D. melanogaster
catcgccatcacc

SEQ ID NO: 605647 - DNA, 13 bp, D. melanogaster
catcgccatcatc

SEQ ID NO: 605648 - DNA, 14 bp, D. melanogaster
catcgccatcatca

SEQ ID NO: 605649 - DNA, 13 bp, D. melanogaster
catcgccatcgca

SEQ ID NO: 605650 - DNA, 13 bp, D. melanogaster
catcgccatcgcc

SEQ ID NO: 605651 - DNA, 14 bp, D. melanogaster
catcgccatcgcca

SEQ ID NO: 605652 - DNA, 13 bp, D. melanogaster
catcgccatcgtc

SEQ ID NO: 605653 - DNA, 13 bp, D. melanogaster
catcgccatctcc

SEQ ID NO: 605654 - DNA, 13 bp, D. melanogaster
catcgcccaaaaa

SEQ ID NO: 605655 - DNA, 14 bp, D. melanogaster
catcgcccaaaaat

SEQ ID NO: 605656 - DNA, 14 bp, D. melanogaster
catcgcccatcgcc

SEQ ID NO: 605657 - DNA, 13 bp, D. melanogaster
catcgccttcgac

SEQ ID NO: 605658 - DNA, 13 bp, D. melanogaster
catcgccttttgt

SEQ ID NO: 605659 - DNA, 13 bp, D. melanogaster
catcgcggaattt

SEQ ID NO: 605660 - DNA, 13 bp, D. melanogaster
catcgctttaaag

SEQ ID NO: 605661 - DNA, 13 bp, D. melanogaster
catcggacagtga

SEQ ID NO: 605662 - DNA, 13 bp, D. melanogaster
catcggatcaggc

SEQ ID NO: 605663 - DNA, 14 bp, D. melanogaster
catcggatcaggca

SEQ ID NO: 605664 - DNA, 13 bp, D. melanogaster
catcggatcggat

SEQ ID NO: 605665 - DNA, 13 bp, D. melanogaster
catcggcaaatgt

SEQ ID NO: 605666 - DNA, 14 bp, D. melanogaster
catcggcatcggca

SEQ ID NO: 605667 - DNA, 13 bp, D. melanogaster
catcggccaaaca

SEQ ID NO: 605668 - DNA, 13 bp, D. melanogaster
catcgtcagcaaa

SEQ ID NO: 605669 - DNA, 14 bp, D. melanogaster
catcgtcatcagca

SEQ ID NO: 605670 - DNA, 13 bp, D. melanogaster
catcgtcatcatc

SEQ ID NO: 605671 - DNA, 14 bp, D. melanogaster
catcgtcatcatcg

SEQ ID NO: 605672 - DNA, 14 bp, D. melanogaster
catcgtcatcatct

SEQ ID NO: 605673 - DNA, 13 bp, D. melanogaster
catcgtcatcatg

SEQ ID NO: 605674 - DNA, 13 bp, D. melanogaster
catcgtcatcgcc

SEQ ID NO: 605675 - DNA, 14 bp, D. melanogaster
catcgtcatcgcca

SEQ ID NO: 605676 - DNA, 13 bp, D. melanogaster
catcgtcatcgtc

SEQ ID NO: 605677 - DNA, 14 bp, D. melanogaster
catcgtcatcgtca

SEQ ID NO: 605678 - DNA, 14 bp, D. melanogaster
catcgtcatcgtcg

SEQ ID NO: 605679 - DNA, 13 bp, D. melanogaster
catcgtccacatc

SEQ ID NO: 605680 - DNA, 13 bp, D. melanogaster
catcgtcgacttg

SEQ ID NO: 605681 - DNA, 13 bp, D. melanogaster
catcgtcgtcatc

SEQ ID NO: 605682 - DNA, 13 bp, D. melanogaster
catcgtcgtcgtt

SEQ ID NO: 605683 - DNA, 13 bp, D. melanogaster
catcgtgctgagc

SEQ ID NO: 605684 - DNA, 13 bp, D. melanogaster
catcgttgaattc

SEQ ID NO: 605685 - DNA, 13 bp, D. melanogaster
catcgtttcacaa

SEQ ID NO: 605686 - DNA, 13 bp, D. melanogaster
catctaaagcgaa

SEQ ID NO: 605687 - DNA, 13 bp, D. melanogaster
catctaatgagtt

SEQ ID NO: 605688 - DNA, 13 bp, D. melanogaster
catctacatctac

SEQ ID NO: 605689 - DNA, 14 bp, D. melanogaster
catctacatttaca

SEQ ID NO: 605690 - DNA, 13 bp, D. melanogaster
catctactatcca

SEQ ID NO: 605691 - DNA, 13 bp, D. melanogaster
catctatatacat

SEQ ID NO: 605692 - DNA, 14 bp, D. melanogaster
catctatatatata

SEQ ID NO: 605693 - DNA, 13 bp, D. melanogaster
catctatccatct

SEQ ID NO: 605694 - DNA, 13 bp, D. melanogaster
catctatctatct

SEQ ID NO: 605695 - DNA, 13 bp, D. melanogaster
catctatttttaa

SEQ ID NO: 605696 - DNA, 13 bp, D. melanogaster
catctcagagaaa

SEQ ID NO: 605697 - DNA, 13 bp, D. melanogaster
catctcagctttg

SEQ ID NO: 605698 - DNA, 13 bp, D. melanogaster
catctcatctcat

SEQ ID NO: 605699 - DNA, 14 bp, D. melanogaster
catctcatctcatc

SEQ ID NO: 605700 - DNA, 14 bp, D. melanogaster
catctccacctcca

SEQ ID NO: 605701 - DNA, 13 bp, D. melanogaster
catctccatcatc

SEQ ID NO: 605702 - DNA, 14 bp, D. melanogaster
catctccatcgcca

SEQ ID NO: 605703 - DNA, 13 bp, D. melanogaster
catctccatctcc

SEQ ID NO: 605704 - DNA, 14 bp, D. melanogaster
catctccatctcca

SEQ ID NO: 605705 - DNA, 14 bp, D. melanogaster
catctccatctgca

SEQ ID NO: 605706 - DNA, 13 bp, D. melanogaster
catctccatcttc

SEQ ID NO: 605707 - DNA, 13 bp, D. melanogaster
catctccatttcc

SEQ ID NO: 605708 - DNA, 14 bp, D. melanogaster
catctccatttcca

SEQ ID NO: 605709 - DNA, 13 bp, D. melanogaster
catctcccaaaat

SEQ ID NO: 605710 - DNA, 14 bp, D. melanogaster
catctcgctcgcac

SEQ ID NO: 605711 - DNA, 14 bp, D. melanogaster
catctcgctcgctc

SEQ ID NO: 605712 - DNA, 13 bp, D. melanogaster
catctctgggatg

SEQ ID NO: 605713 - DNA, 13 bp, D. melanogaster
catctctttcgcc

SEQ ID NO: 605714 - DNA, 13 bp, D. melanogaster
catctctttcgct

SEQ ID NO: 605715 - DNA, 13 bp, D. melanogaster
catctctttctgc

SEQ ID NO: 605716 - DNA, 13 bp, D. melanogaster
catctgatcactc

SEQ ID NO: 605717 - DNA, 13 bp, D. melanogaster
catctgcatctgg

SEQ ID NO: 605718 - DNA, 13 bp, D. melanogaster
catctgcatctgt

SEQ ID NO: 605719 - DNA, 13 bp, D. melanogaster
catctgccatcat

SEQ ID NO: 605720 - DNA, 13 bp, D. melanogaster
catctggcaacgc

SEQ ID NO: 605721 - DNA, 13 bp, D. melanogaster
catctggcggtgt

SEQ ID NO: 605722 - DNA, 14 bp, D. melanogaster
catctggcggtgtt

SEQ ID NO: 605723 - DNA, 13 bp, D. melanogaster
catctgtatctat

SEQ ID NO: 605724 - DNA, 13 bp, D. melanogaster
catctgtgtgtgt

SEQ ID NO: 605725 - DNA, 14 bp, D. melanogaster
catctgtgtgtgtg

SEQ ID NO: 605726 - DNA, 13 bp, D. melanogaster
catcttcatcact

SEQ ID NO: 605727 - DNA, 13 bp, D. melanogaster
catcttcatcatc

SEQ ID NO: 605728 - DNA, 13 bp, D. melanogaster
catcttcatcttc

SEQ ID NO: 605729 - DNA, 13 bp, D. melanogaster
catcttcattttc

SEQ ID NO: 605730 - DNA, 14 bp, D. melanogaster
catcttcgcattca

SEQ ID NO: 605731 - DNA, 13 bp, D. melanogaster
catcttctgttgt

SEQ ID NO: 605732 - DNA, 13 bp, D. melanogaster
catcttgcggcca

SEQ ID NO: 605733 - DNA, 13 bp, D. melanogaster
catcttgtggttc

SEQ ID NO: 605734 - DNA, 13 bp, D. melanogaster
catcttgttgttg

SEQ ID NO: 605735 - DNA, 13 bp, D. melanogaster
catctttaaacat

SEQ ID NO: 605736 - DNA, 13 bp, D. melanogaster
catctttacttta

SEQ ID NO: 605737 - DNA, 14 bp, D. melanogaster
catctttctaactt

SEQ ID NO: 605738 - DNA, 13 bp, D. melanogaster
catcttttcaatg

SEQ ID NO: 605739 - DNA, 13 bp, D. melanogaster
catcttttgatga

SEQ ID NO: 605740 - DNA, 13 bp, D. melanogaster
catctttttgttg

SEQ ID NO: 605741 - DNA, 13 bp, D. melanogaster
catgaaaaacatt

SEQ ID NO: 605742 - DNA, 14 bp, D. melanogaster
catgaaaaaccaaa

SEQ ID NO: 605743 - DNA, 13 bp, D. melanogaster
catgaaaaacttc

SEQ ID NO: 605744 - DNA, 14 bp, D. melanogaster
catgaaaaactttt

SEQ ID NO: 605745 - DNA, 13 bp, D. melanogaster
catgaaaaatgaa

SEQ ID NO: 605746 - DNA, 14 bp, D. melanogaster
catgaaaaatgcat

SEQ ID NO: 605747 - DNA, 13 bp, D. melanogaster
catgaaaaatgtg

SEQ ID NO: 605748 - DNA, 13 bp, D. melanogaster
catgaaaacgaaa

SEQ ID NO: 605749 - DNA, 13 bp, D. melanogaster
catgaaaaggctt

SEQ ID NO: 605750 - DNA, 13 bp, D. melanogaster
catgaaaatcaaa

SEQ ID NO: 605751 - DNA, 13 bp, D. melanogaster
catgaaaatgaaa

SEQ ID NO: 605752 - DNA, 13 bp, D. melanogaster
catgaaaatggaa

SEQ ID NO: 605753 - DNA, 13 bp, D. melanogaster
catgaaaattgca

SEQ ID NO: 605754 - DNA, 13 bp, D. melanogaster
catgaaaattgtt

SEQ ID NO: 605755 - DNA, 13 bp, D. melanogaster
catgaaatataaa

SEQ ID NO: 605756 - DNA, 13 bp, D. melanogaster
catgaaatatata

SEQ ID NO: 605757 - DNA, 14 bp, D. melanogaster
catgaaatatatat

SEQ ID NO: 605758 - DNA, 13 bp, D. melanogaster
catgaaatatatt

SEQ ID NO: 605759 - DNA, 13 bp, D. melanogaster
catgaaatgcttg

SEQ ID NO: 605760 - DNA, 13 bp, D. melanogaster
catgaaattgatt

SEQ ID NO: 605761 - DNA, 13 bp, D. melanogaster
catgaacacgaat

SEQ ID NO: 605762 - DNA, 13 bp, D. melanogaster
catgaaccaaatg

SEQ ID NO: 605763 - DNA, 13 bp, D. melanogaster
catgaactcaacg

SEQ ID NO: 605764 - DNA, 13 bp, D. melanogaster
catgaagttaatt

SEQ ID NO: 605765 - DNA, 13 bp, D. melanogaster
catgaataaaata

SEQ ID NO: 605766 - DNA, 13 bp, D. melanogaster
catgaataaaatt

SEQ ID NO: 605767 - DNA, 13 bp, D. melanogaster
catgaataatgca

SEQ ID NO: 605768 - DNA, 14 bp, D. melanogaster
catgaatatttatg

SEQ ID NO: 605769 - DNA, 14 bp, D. melanogaster
catgaatatttcaa

SEQ ID NO: 605770 - DNA, 13 bp, D. melanogaster
catgaatattttt

SEQ ID NO: 605771 - DNA, 14 bp, D. melanogaster
catgaatgaatgta

SEQ ID NO: 605772 - DNA, 13 bp, D. melanogaster
catgaatgatatt

SEQ ID NO: 605773 - DNA, 13 bp, D. melanogaster
catgaattattta

SEQ ID NO: 605774 - DNA, 13 bp, D. melanogaster
catgaattttatt

SEQ ID NO: 605775 - DNA, 13 bp, D. melanogaster
catgacacacaca

SEQ ID NO: 605776 - DNA, 13 bp, D. melanogaster
catgacataattg

SEQ ID NO: 605777 - DNA, 13 bp, D. melanogaster
catgacccagttc

SEQ ID NO: 605778 - DNA, 13 bp, D. melanogaster
catgacgatccaa

SEQ ID NO: 605779 - DNA, 13 bp, D. melanogaster
catgatcatcatc

SEQ ID NO: 605780 - DNA, 13 bp, D. melanogaster
catgatcgacaac

SEQ ID NO: 605781 - DNA, 13 bp, D. melanogaster
catgatgacgatg

SEQ ID NO: 605782 - DNA, 13 bp, D. melanogaster
catgatggaattt

SEQ ID NO: 605783 - DNA, 13 bp, D. melanogaster
catgattaatgat

SEQ ID NO: 605784 - DNA, 13 bp, D. melanogaster
catgattgaattt

SEQ ID NO: 605785 - DNA, 13 bp, D. melanogaster
catgcaaaataaa

SEQ ID NO: 605786 - DNA, 13 bp, D. melanogaster
catgcaaaataat

SEQ ID NO: 605787 - DNA, 13 bp, D. melanogaster
catgcaaaatgat

SEQ ID NO: 605788 - DNA, 13 bp, D. melanogaster
catgcaaaatgca

SEQ ID NO: 605789 - DNA, 13 bp, D. melanogaster
catgcaaaatgtt

SEQ ID NO: 605790 - DNA, 13 bp, D. melanogaster
catgcaaagtgca

SEQ ID NO: 605791 - DNA, 13 bp, D. melanogaster
catgcaaataaac

SEQ ID NO: 605792 - DNA, 13 bp, D. melanogaster
catgcaaatattt

SEQ ID NO: 605793 - DNA, 13 bp, D. melanogaster
catgcaaatcaat

SEQ ID NO: 605794 - DNA, 13 bp, D. melanogaster
catgcaaatcgaa

SEQ ID NO: 605795 - DNA, 13 bp, D. melanogaster
catgcaaatgaag

SEQ ID NO: 605796 - DNA, 14 bp, D. melanogaster
catgcaaatgagcc

SEQ ID NO: 605797 - DNA, 13 bp, D. melanogaster
catgcaaatgagt

SEQ ID NO: 605798 - DNA, 13 bp, D. melanogaster
catgcaaatgcaa

SEQ ID NO: 605799 - DNA, 13 bp, D. melanogaster
catgcaaatgcca

SEQ ID NO: 605800 - DNA, 13 bp, D. melanogaster
catgcaaatgttg

SEQ ID NO: 605801 - DNA, 13 bp, D. melanogaster
catgcaaattgca

SEQ ID NO: 605802 - DNA, 13 bp, D. melanogaster
catgcaaattgcc

SEQ ID NO: 605803 - DNA, 13 bp, D. melanogaster
catgcaaatttat

SEQ ID NO: 605804 - DNA, 15 bp, D. melanogaster
catgcaacagatcca

SEQ ID NO: 605805 - DNA, 13 bp, D. melanogaster
catgcaacagcaa

SEQ ID NO: 605806 - DNA, 13 bp, D. melanogaster
catgcacacgcac

SEQ ID NO: 605807 - DNA, 13 bp, D. melanogaster
catgcacatacac

SEQ ID NO: 605808 - DNA, 13 bp, D. melanogaster
catgcacatacat

SEQ ID NO: 605809 - DNA, 13 bp, D. melanogaster
catgcacatatat

SEQ ID NO: 605810 - DNA, 13 bp, D. melanogaster
catgcactgaaaa

SEQ ID NO: 605811 - DNA, 13 bp, D. melanogaster
catgcactgagaa

SEQ ID NO: 605812 - DNA, 13 bp, D. melanogaster
catgcacttatac

SEQ ID NO: 605813 - DNA, 13 bp, D. melanogaster
catgcagaaggca

SEQ ID NO: 605814 - DNA, 13 bp, D. melanogaster
catgcagattcta

SEQ ID NO: 605815 - DNA, 13 bp, D. melanogaster
catgcagcatgca

SEQ ID NO: 605816 - DNA, 13 bp, D. melanogaster
catgcataaatat

SEQ ID NO: 605817 - DNA, 13 bp, D. melanogaster
catgcataaattt

SEQ ID NO: 605818 - DNA, 13 bp, D. melanogaster
catgcatacacat

SEQ ID NO: 605819 - DNA, 13 bp, D. melanogaster
catgcatatatac

SEQ ID NO: 605820 - DNA, 14 bp, D. melanogaster
catgcatatataca

SEQ ID NO: 605821 - DNA, 13 bp, D. melanogaster
catgcatatatag

SEQ ID NO: 605822 - DNA, 13 bp, D. melanogaster
catgcatatatgt

SEQ ID NO: 605823 - DNA, 13 bp, D. melanogaster
catgcatatgcaa

SEQ ID NO: 605824 - DNA, 13 bp, D. melanogaster
catgcatatttat

SEQ ID NO: 605825 - DNA, 14 bp, D. melanogaster
catgcatatttatt

SEQ ID NO: 605826 - DNA, 13 bp, D. melanogaster
catgcatttcgaa

SEQ ID NO: 605827 - DNA, 13 bp, D. melanogaster
catgcattttaaa

SEQ ID NO: 605828 - DNA, 13 bp, D. melanogaster
catgcattttctt

SEQ ID NO: 605829 - DNA, 13 bp, D. melanogaster
catgcattttttt

SEQ ID NO: 605830 - DNA, 13 bp, D. melanogaster
catgccaaaaaaa

SEQ ID NO: 605831 - DNA, 13 bp, D. melanogaster
catgccaaatatt

SEQ ID NO: 605832 - DNA, 13 bp, D. melanogaster
catgccaaatgca

SEQ ID NO: 605833 - DNA, 15 bp, D. melanogaster
catgccaagcgtgtc

SEQ ID NO: 605834 - DNA, 13 bp, D. melanogaster
catgccaatgaaa

SEQ ID NO: 605835 - DNA, 13 bp, D. melanogaster
catgccaatgcca

SEQ ID NO: 605836 - DNA, 13 bp, D. melanogaster
catgccacaaaaa

SEQ ID NO: 605837 - DNA, 13 bp, D. melanogaster
catgccacatggc

SEQ ID NO: 605838 - DNA, 13 bp, D. melanogaster
catgccacctacg

SEQ ID NO: 605839 - DNA, 14 bp, D. melanogaster
catgccacgccccc

SEQ ID NO: 605840 - DNA, 14 bp, D. melanogaster
catgccactggtct

SEQ ID NO: 605841 - DNA, 13 bp, D. melanogaster
catgccataccat

SEQ ID NO: 605842 - DNA, 13 bp, D. melanogaster
catgccatgccat

SEQ ID NO: 605843 - DNA, 13 bp, D. melanogaster
catgccattccat

SEQ ID NO: 605844 - DNA, 13 bp, D. melanogaster
catgcccacaatg

SEQ ID NO: 605845 - DNA, 13 bp, D. melanogaster
catgcccacattt

SEQ ID NO: 605846 - DNA, 14 bp, D. melanogaster
catgcccaccactg

SEQ ID NO: 605847 - DNA, 13 bp, D. melanogaster
catgcccatccag

SEQ ID NO: 605848 - DNA, 13 bp, D. melanogaster
catgcccatgcca

SEQ ID NO: 605849 - DNA, 13 bp, D. melanogaster
catgcccatttcc

SEQ ID NO: 605850 - DNA, 13 bp, D. melanogaster
catgccgagcgca

SEQ ID NO: 605851 - DNA, 13 bp, D. melanogaster
catgcctaataaa

SEQ ID NO: 605852 - DNA, 13 bp, D. melanogaster
catgcctcgctca

SEQ ID NO: 605853 - DNA, 13 bp, D. melanogaster
catgcgacaacga

SEQ ID NO: 605854 - DNA, 13 bp, D. melanogaster
catgcgattacct

SEQ ID NO: 605855 - DNA, 13 bp, D. melanogaster
catgcgcatgcgc

SEQ ID NO: 605856 - DNA, 13 bp, D. melanogaster
catgcggcgcaaa

SEQ ID NO: 605857 - DNA, 13 bp, D. melanogaster
catgcgtgtgtgt

SEQ ID NO: 605858 - DNA, 13 bp, D. melanogaster
catgctcagcatt

SEQ ID NO: 605859 - DNA, 13 bp, D. melanogaster
catgctcgcgctg

SEQ ID NO: 605860 - DNA, 14 bp, D. melanogaster
catgctgctgctgc

SEQ ID NO: 605861 - DNA, 13 bp, D. melanogaster
catgcttaaaaat

SEQ ID NO: 605862 - DNA, 13 bp, D. melanogaster
catggaaaacttt

SEQ ID NO: 605863 - DNA, 13 bp, D. melanogaster
catggaaaataat

SEQ ID NO: 605864 - DNA, 13 bp, D. melanogaster
catggaaaatgca

SEQ ID NO: 605865 - DNA, 13 bp, D. melanogaster
catggaaagaaaa

SEQ ID NO: 605866 - DNA, 13 bp, D. melanogaster
catggaaagtgcc

SEQ ID NO: 605867 - DNA, 13 bp, D. melanogaster
catggaaatattt

SEQ ID NO: 605868 - DNA, 13 bp, D. melanogaster
catggaaatgaaa

SEQ ID NO: 605869 - DNA, 14 bp, D. melanogaster
catggaaatggaaa

SEQ ID NO: 605870 - DNA, 13 bp, D. melanogaster
catggaaatgtta

SEQ ID NO: 605871 - DNA, 13 bp, D. melanogaster
catggaaattaaa

SEQ ID NO: 605872 - DNA, 13 bp, D. melanogaster
catggaattcttt

SEQ ID NO: 605873 - DNA, 13 bp, D. melanogaster
catggacaacaaa

SEQ ID NO: 605874 - DNA, 13 bp, D. melanogaster
catggactacact

SEQ ID NO: 605875 - DNA, 13 bp, D. melanogaster
catggacttttta

SEQ ID NO: 605876 - DNA, 13 bp, D. melanogaster
catggagcatgga

SEQ ID NO: 605877 - DNA, 13 bp, D. melanogaster
catggaggaggag

SEQ ID NO: 605878 - DNA, 14 bp, D. melanogaster
catggaggcactgg

SEQ ID NO: 605879 - DNA, 13 bp, D. melanogaster
catggatatagat

SEQ ID NO: 605880 - DNA, 13 bp, D. melanogaster
catggatatggat

SEQ ID NO: 605881 - DNA, 13 bp, D. melanogaster
catggcaaaaaaa

SEQ ID NO: 605882 - DNA, 13 bp, D. melanogaster
catggcagccaaa

SEQ ID NO: 605883 - DNA, 13 bp, D. melanogaster
catggcatggcat

SEQ ID NO: 605884 - DNA, 13 bp, D. melanogaster
catggccaaaaca

SEQ ID NO: 605885 - DNA, 13 bp, D. melanogaster
catggccaacaca

SEQ ID NO: 605886 - DNA, 13 bp, D. melanogaster
catggccaacatg

SEQ ID NO: 605887 - DNA, 13 bp, D. melanogaster
catggccaacgca

SEQ ID NO: 605888 - DNA, 14 bp, D. melanogaster
catggccaacgcat

SEQ ID NO: 605889 - DNA, 13 bp, D. melanogaster
catggccatggcc

SEQ ID NO: 605890 - DNA, 13 bp, D. melanogaster
catggcctttaag

SEQ ID NO: 605891 - DNA, 13 bp, D. melanogaster
catggcgtatact

SEQ ID NO: 605892 - DNA, 14 bp, D. melanogaster
catggcgtatactt

SEQ ID NO: 605893 - DNA, 13 bp, D. melanogaster
catggcgtatgtg

SEQ ID NO: 605894 - DNA, 14 bp, D. melanogaster
catggcgtatgtgt

SEQ ID NO: 605895 - DNA, 13 bp, D. melanogaster
catggctaataaa

SEQ ID NO: 605896 - DNA, 13 bp, D. melanogaster
catgggtcaacaa

SEQ ID NO: 605897 - DNA, 13 bp, D. melanogaster
catgggtggaata

SEQ ID NO: 605898 - DNA, 14 bp, D. melanogaster
catgggtgtttcca

SEQ ID NO: 605899 - DNA, 13 bp, D. melanogaster
catggtcacactg

SEQ ID NO: 605900 - DNA, 13 bp, D. melanogaster
catgtaaaattta

SEQ ID NO: 605901 - DNA, 13 bp, D. melanogaster
catgtaaagtcaa

SEQ ID NO: 605902 - DNA, 13 bp, D. melanogaster
catgtaatcaacc

SEQ ID NO: 605903 - DNA, 13 bp, D. melanogaster
catgtaattattt

SEQ ID NO: 605904 - DNA, 13 bp, D. melanogaster
catgtaatttatt

SEQ ID NO: 605905 - DNA, 13 bp, D. melanogaster
catgtacaatata

SEQ ID NO: 605906 - DNA, 13 bp, D. melanogaster
catgtacataaaa

SEQ ID NO: 605907 - DNA, 13 bp, D. melanogaster
catgtacatacat

SEQ ID NO: 605908 - DNA, 13 bp, D. melanogaster
catgtacatatac

SEQ ID NO: 605909 - DNA, 14 bp, D. melanogaster
catgtacatatata

SEQ ID NO: 605910 - DNA, 14 bp, D. melanogaster
catgtacatatgta

SEQ ID NO: 605911 - DNA, 13 bp, D. melanogaster
catgtacatgtac

SEQ ID NO: 605912 - DNA, 13 bp, D. melanogaster
catgtacatgtgt

SEQ ID NO: 605913 - DNA, 13 bp, D. melanogaster
catgtaccaaata

SEQ ID NO: 605914 - DNA, 13 bp, D. melanogaster
catgtacgccttt

SEQ ID NO: 605915 - DNA, 13 bp, D. melanogaster
catgtacgtatgt

SEQ ID NO: 605916 - DNA, 13 bp, D. melanogaster
catgtatccaata

SEQ ID NO: 605917 - DNA, 13 bp, D. melanogaster
catgtatctgtat

SEQ ID NO: 605918 - DNA, 13 bp, D. melanogaster
catgtatgtacgt

SEQ ID NO: 605919 - DNA, 13 bp, D. melanogaster
catgtatgtatat

SEQ ID NO: 605920 - DNA, 14 bp, D. melanogaster
catgtatgtatata

SEQ ID NO: 605921 - DNA, 13 bp, D. melanogaster
catgtatgtatgc

SEQ ID NO: 605922 - DNA, 14 bp, D. melanogaster
catgtatgtatgta

SEQ ID NO: 605923 - DNA, 13 bp, D. melanogaster
catgtatgtgtgt

SEQ ID NO: 605924 - DNA, 13 bp, D. melanogaster
catgtccacgtcc

SEQ ID NO: 605925 - DNA, 13 bp, D. melanogaster
catgtccgaaatg

SEQ ID NO: 605926 - DNA, 13 bp, D. melanogaster
catgtccggaaat

SEQ ID NO: 605927 - DNA, 13 bp, D. melanogaster
catgtccgtatgt

SEQ ID NO: 605928 - DNA, 13 bp, D. melanogaster
catgtccgtctgt

SEQ ID NO: 605929 - DNA, 14 bp, D. melanogaster
catgtccgtctgtc

SEQ ID NO: 605930 - DNA, 13 bp, D. melanogaster
catgtccgttttt

SEQ ID NO: 605931 - DNA, 13 bp, D. melanogaster
catgtcctgcggc

SEQ ID NO: 605932 - DNA, 13 bp, D. melanogaster
catgtccttgcca

SEQ ID NO: 605933 - DNA, 13 bp, D. melanogaster
catgtcctttggc

SEQ ID NO: 605934 - DNA, 13 bp, D. melanogaster
catgtcgtatgag

SEQ ID NO: 605935 - DNA, 13 bp, D. melanogaster
catgtgaaataaa

SEQ ID NO: 605936 - DNA, 13 bp, D. melanogaster
catgtgaaatttg

SEQ ID NO: 605937 - DNA, 13 bp, D. melanogaster
catgtgcaacatg

SEQ ID NO: 605938 - DNA, 14 bp, D. melanogaster
catgtgccacgccc

SEQ ID NO: 605939 - DNA, 13 bp, D. melanogaster
catgtgcggcgcg

SEQ ID NO: 605940 - DNA, 13 bp, D. melanogaster
catgtggcaagca

SEQ ID NO: 605941 - DNA, 13 bp, D. melanogaster
catgtggcaagtg

SEQ ID NO: 605942 - DNA, 13 bp, D. melanogaster
catgtggcacgca

SEQ ID NO: 605943 - DNA, 14 bp, D. melanogaster
catgtggctggcta

SEQ ID NO: 605944 - DNA, 13 bp, D. melanogaster
catgtgggtgggt

SEQ ID NO: 605945 - DNA, 13 bp, D. melanogaster
catgtgggtgtgt

SEQ ID NO: 605946 - DNA, 13 bp, D. melanogaster
catgtgtatatat

SEQ ID NO: 605947 - DNA, 14 bp, D. melanogaster
catgtgtatgtatg

SEQ ID NO: 605948 - DNA, 13 bp, D. melanogaster
catgtgtgaacaa

SEQ ID NO: 605949 - DNA, 13 bp, D. melanogaster
catgtgtgcgagt

SEQ ID NO: 605950 - DNA, 13 bp, D. melanogaster
catgtgtgcgtgg

SEQ ID NO: 605951 - DNA, 14 bp, D. melanogaster
catgtgtgcgtgtg

SEQ ID NO: 605952 - DNA, 13 bp, D. melanogaster
catgtgtgtatat

SEQ ID NO: 605953 - DNA, 14 bp, D. melanogaster
catgtgtgtatgtg

SEQ ID NO: 605954 - DNA, 13 bp, D. melanogaster
catgtgtgtgtat

SEQ ID NO: 605955 - DNA, 14 bp, D. melanogaster
catgtgtgtgtgag

SEQ ID NO: 605956 - DNA, 13 bp, D. melanogaster
catgtgtgtttgt

SEQ ID NO: 605957 - DNA, 14 bp, D. melanogaster
catgtgtgtttgtg

SEQ ID NO: 605958 - DNA, 13 bp, D. melanogaster
catgtgtttttgt

SEQ ID NO: 605959 - DNA, 13 bp, D. melanogaster
catgttatttatg

SEQ ID NO: 605960 - DNA, 13 bp, D. melanogaster
catgttcagattt

SEQ ID NO: 605961 - DNA, 13 bp, D. melanogaster
catgttctacttt

SEQ ID NO: 605962 - DNA, 13 bp, D. melanogaster
catgttctagagg

SEQ ID NO: 605963 - DNA, 13 bp, D. melanogaster
catgttctcaatt

SEQ ID NO: 605964 - DNA, 13 bp, D. melanogaster
catgttgcacatg

SEQ ID NO: 605965 - DNA, 13 bp, D. melanogaster
catgttgcagctg

SEQ ID NO: 605966 - DNA, 13 bp, D. melanogaster
catgttgcatgca

SEQ ID NO: 605967 - DNA, 13 bp, D. melanogaster
catgttgccgctg

SEQ ID NO: 605968 - DNA, 13 bp, D. melanogaster
catgttgctgccg

SEQ ID NO: 605969 - DNA, 14 bp, D. melanogaster
catgttgctgctgc

SEQ ID NO: 605970 - DNA, 14 bp, D. melanogaster
catgttgctgctgt

SEQ ID NO: 605971 - DNA, 13 bp, D. melanogaster
catgttgctgttg

SEQ ID NO: 605972 - DNA, 14 bp, D. melanogaster
catgttgctgttgc

SEQ ID NO: 605973 - DNA, 13 bp, D. melanogaster
catgttggcaaaa

SEQ ID NO: 605974 - DNA, 13 bp, D. melanogaster
catgttggccatg

SEQ ID NO: 605975 - DNA, 13 bp, D. melanogaster
catgttgttgctg

SEQ ID NO: 605976 - DNA, 13 bp, D. melanogaster
catgtttaaaatg

SEQ ID NO: 605977 - DNA, 13 bp, D. melanogaster
catgtttattatt

SEQ ID NO: 605978 - DNA, 13 bp, D. melanogaster
catgtttcactaa

SEQ ID NO: 605979 - DNA, 13 bp, D. melanogaster
catgtttcttgta

SEQ ID NO: 605980 - DNA, 13 bp, D. melanogaster
catgtttgccatt

SEQ ID NO: 605981 - DNA, 13 bp, D. melanogaster
catgtttggcatt

SEQ ID NO: 605982 - DNA, 13 bp, D. melanogaster
catgtttgtgttt

SEQ ID NO: 605983 - DNA, 13 bp, D. melanogaster
catgtttgttgtt

SEQ ID NO: 605984 - DNA, 14 bp, D. melanogaster
catgtttgtttgtt

SEQ ID NO: 605985 - DNA, 13 bp, D. melanogaster
catgtttttctct

SEQ ID NO: 605986 - DNA, 13 bp, D. melanogaster
catgtttttgttg

SEQ ID NO: 605987 - DNA, 13 bp, D. melanogaster
cattaaaaaacgt

SEQ ID NO: 605988 - DNA, 13 bp, D. melanogaster
cattaaaaaagat

SEQ ID NO: 605989 - DNA, 13 bp, D. melanogaster
cattaaaaaagga

SEQ ID NO: 605990 - DNA, 13 bp, D. melanogaster
cattaaaaaccat

SEQ ID NO: 605991 - DNA, 13 bp, D. melanogaster
cattaaaaagcca

SEQ ID NO: 605992 - DNA, 13 bp, D. melanogaster
cattaaaaatcca

SEQ ID NO: 605993 - DNA, 14 bp, D. melanogaster
cattaaaaatgcat

SEQ ID NO: 605994 - DNA, 13 bp, D. melanogaster
cattaaaaatgta

SEQ ID NO: 605995 - DNA, 14 bp, D. melanogaster
cattaaaaatgtaa

SEQ ID NO: 605996 - DNA, 13 bp, D. melanogaster
cattaaaaattgt

SEQ ID NO: 605997 - DNA, 13 bp, D. melanogaster
cattaaaacatcc

SEQ ID NO: 605998 - DNA, 13 bp, D. melanogaster
cattaaaactgaa

SEQ ID NO: 605999 - DNA, 13 bp, D. melanogaster
cattaaaagcgca

SEQ ID NO: 606000 - DNA, 13 bp, D. melanogaster
cattaaaagtcaa

SEQ ID NO: 606001 - DNA, 13 bp, D. melanogaster
cattaaaagtcat

SEQ ID NO: 606002 - DNA, 13 bp, D. melanogaster
cattaaaagtgaa

SEQ ID NO: 606003 - DNA, 13 bp, D. melanogaster
cattaaaagttta

SEQ ID NO: 606004 - DNA, 13 bp, D. melanogaster
cattaaaatcaac

SEQ ID NO: 606005 - DNA, 13 bp, D. melanogaster
cattaaaatcatt

SEQ ID NO: 606006 - DNA, 14 bp, D. melanogaster
cattaaaatcattt

SEQ ID NO: 606007 - DNA, 13 bp, D. melanogaster
cattaaaatcgaa

SEQ ID NO: 606008 - DNA, 13 bp, D. melanogaster
cattaaaatcgca

SEQ ID NO: 606009 - DNA, 13 bp, D. melanogaster
cattaaaatcttt

SEQ ID NO: 606010 - DNA, 13 bp, D. melanogaster
cattaaaatgcaa

SEQ ID NO: 606011 - DNA, 14 bp, D. melanogaster
cattaaaatgcaat

SEQ ID NO: 606012 - DNA, 13 bp, D. melanogaster
cattaaaatgcca

SEQ ID NO: 606013 - DNA, 13 bp, D. melanogaster
cattaaaatgtaa

SEQ ID NO: 606014 - DNA, 13 bp, D. melanogaster
cattaaaatgtat

SEQ ID NO: 606015 - DNA, 14 bp, D. melanogaster
cattaaaatgtatt

SEQ ID NO: 606016 - DNA, 13 bp, D. melanogaster
cattaaaattcca

SEQ ID NO: 606017 - DNA, 13 bp, D. melanogaster
cattaaaattgat

SEQ ID NO: 606018 - DNA, 13 bp, D. melanogaster
cattaaaattgta

SEQ ID NO: 606019 - DNA, 13 bp, D. melanogaster
cattaaaattgtg

SEQ ID NO: 606020 - DNA, 13 bp, D. melanogaster
cattaaaattgtt

SEQ ID NO: 606021 - DNA, 14 bp, D. melanogaster
cattaaaatttcaa

SEQ ID NO: 606022 - DNA, 13 bp, D. melanogaster
cattaaacaaatt

SEQ ID NO: 606023 - DNA, 13 bp, D. melanogaster
cattaaacaatat

SEQ ID NO: 606024 - DNA, 13 bp, D. melanogaster
cattaaacataat

SEQ ID NO: 606025 - DNA, 13 bp, D. melanogaster
cattaaacattaa

SEQ ID NO: 606026 - DNA, 13 bp, D. melanogaster
cattaaacatttt

SEQ ID NO: 606027 - DNA, 13 bp, D. melanogaster
cattaaaccaatt

SEQ ID NO: 606028 - DNA, 14 bp, D. melanogaster
cattaaaccatcaa

SEQ ID NO: 606029 - DNA, 13 bp, D. melanogaster
cattaaactaaat

SEQ ID NO: 606030 - DNA, 13 bp, D. melanogaster
cattaaactagaa

SEQ ID NO: 606031 - DNA, 13 bp, D. melanogaster
cattaaactcatt

SEQ ID NO: 606032 - DNA, 13 bp, D. melanogaster
cattaaacttaaa

SEQ ID NO: 606033 - DNA, 14 bp, D. melanogaster
cattaaactttatt

SEQ ID NO: 606034 - DNA, 13 bp, D. melanogaster
cattaaagaggaa

SEQ ID NO: 606035 - DNA, 13 bp, D. melanogaster
cattaaagatttt

SEQ ID NO: 606036 - DNA, 13 bp, D. melanogaster
cattaaagcatct

SEQ ID NO: 606037 - DNA, 13 bp, D. melanogaster
cattaaagccaac

SEQ ID NO: 606038 - DNA, 13 bp, D. melanogaster
cattaaagtaaaa

SEQ ID NO: 606039 - DNA, 13 bp, D. melanogaster
cattaaagtgaaa

SEQ ID NO: 606040 - DNA, 13 bp, D. melanogaster
cattaaagtgtaa

SEQ ID NO: 606041 - DNA, 13 bp, D. melanogaster
cattaaagttaat

SEQ ID NO: 606042 - DNA, 13 bp, D. melanogaster
cattaaagttgca

SEQ ID NO: 606043 - DNA, 13 bp, D. melanogaster
cattaaatatgaa

SEQ ID NO: 606044 - DNA, 14 bp, D. melanogaster
cattaaatattttc

SEQ ID NO: 606045 - DNA, 13 bp, D. melanogaster
cattaaatcaatt

SEQ ID NO: 606046 - DNA, 13 bp, D. melanogaster
cattaaatgcgtt

SEQ ID NO: 606047 - DNA, 13 bp, D. melanogaster
cattaaatgggtt

SEQ ID NO: 606048 - DNA, 13 bp, D. melanogaster
cattaaatgtaat

SEQ ID NO: 606049 - DNA, 13 bp, D. melanogaster
cattaaatgtcaa

SEQ ID NO: 606050 - DNA, 13 bp, D. melanogaster
cattaaatgttta

SEQ ID NO: 606051 - DNA, 13 bp, D. melanogaster
cattaaattagtt

SEQ ID NO: 606052 - DNA, 13 bp, D. melanogaster
cattaaattcaat

SEQ ID NO: 606053 - DNA, 13 bp, D. melanogaster
cattaaattcatt

SEQ ID NO: 606054 - DNA, 13 bp, D. melanogaster
cattaaattctgc

SEQ ID NO: 606055 - DNA, 13 bp, D. melanogaster
cattaaattgtaa

SEQ ID NO: 606056 - DNA, 13 bp, D. melanogaster
cattaaattgtat

SEQ ID NO: 606057 - DNA, 13 bp, D. melanogaster
cattaaatttatg

SEQ ID NO: 606058 - DNA, 13 bp, D. melanogaster
cattaaatttgag

SEQ ID NO: 606059 - DNA, 14 bp, D. melanogaster
cattaaatttgatt

SEQ ID NO: 606060 - DNA, 13 bp, D. melanogaster
cattaaatttgtt

SEQ ID NO: 606061 - DNA, 13 bp, D. melanogaster
cattaacaaaacc

SEQ ID NO: 606062 - DNA, 13 bp, D. melanogaster
cattaacaacaac

SEQ ID NO: 606063 - DNA, 13 bp, D. melanogaster
cattaacaatttt

SEQ ID NO: 606064 - DNA, 13 bp, D. melanogaster
cattaacataaat

SEQ ID NO: 606065 - DNA, 13 bp, D. melanogaster
cattaacatccgc

SEQ ID NO: 606066 - DNA, 13 bp, D. melanogaster
cattaacatttaa

SEQ ID NO: 606067 - DNA, 13 bp, D. melanogaster
cattaacattttt

SEQ ID NO: 606068 - DNA, 13 bp, D. melanogaster
cattaaccaagtt

SEQ ID NO: 606069 - DNA, 13 bp, D. melanogaster
cattaacttaatt

SEQ ID NO: 606070 - DNA, 13 bp, D. melanogaster
cattaagacttaa

SEQ ID NO: 606071 - DNA, 13 bp, D. melanogaster
cattaagcattaa

SEQ ID NO: 606072 - DNA, 13 bp, D. melanogaster
cattaagctgcaa

SEQ ID NO: 606073 - DNA, 13 bp, D. melanogaster
cattaaggcagat

SEQ ID NO: 606074 - DNA, 13 bp, D. melanogaster
cattaagtaaaca

SEQ ID NO: 606075 - DNA, 13 bp, D. melanogaster
cattaagtaaatt

SEQ ID NO: 606076 - DNA, 14 bp, D. melanogaster
cattaagtatacgc

SEQ ID NO: 606077 - DNA, 13 bp, D. melanogaster
cattaagtcctta

SEQ ID NO: 606078 - DNA, 13 bp, D. melanogaster
cattaagttaatt

SEQ ID NO: 606079 - DNA, 13 bp, D. melanogaster
cattaagttggcc

SEQ ID NO: 606080 - DNA, 13 bp, D. melanogaster
cattaataatgca

SEQ ID NO: 606081 - DNA, 13 bp, D. melanogaster
cattaataattca

SEQ ID NO: 606082 - DNA, 13 bp, D. melanogaster
cattaatattcat

SEQ ID NO: 606083 - DNA, 13 bp, D. melanogaster
cattaatcaaata

SEQ ID NO: 606084 - DNA, 13 bp, D. melanogaster
cattaatcaaatg

SEQ ID NO: 606085 - DNA, 13 bp, D. melanogaster
cattaatgaataa

SEQ ID NO: 606086 - DNA, 13 bp, D. melanogaster
cattaatgttatt

SEQ ID NO: 606087 - DNA, 13 bp, D. melanogaster
cattaattatgca

SEQ ID NO: 606088 - DNA, 13 bp, D. melanogaster
cattaattgaaaa

SEQ ID NO: 606089 - DNA, 13 bp, D. melanogaster
cattaattgattg

SEQ ID NO: 606090 - DNA, 13 bp, D. melanogaster
cattaattgcaaa

SEQ ID NO: 606091 - DNA, 13 bp, D. melanogaster
cattaattgtggg

SEQ ID NO: 606092 - DNA, 13 bp, D. melanogaster
cattaatttatgt

SEQ ID NO: 606093 - DNA, 13 bp, D. melanogaster
cattaatttgtaa

SEQ ID NO: 606094 - DNA, 13 bp, D. melanogaster
cattaatttgtat

SEQ ID NO: 606095 - DNA, 13 bp, D. melanogaster
cattaattttatg

SEQ ID NO: 606096 - DNA, 13 bp, D. melanogaster
cattaattttgca

SEQ ID NO: 606097 - DNA, 13 bp, D. melanogaster
cattacaaatgca

SEQ ID NO: 606098 - DNA, 13 bp, D. melanogaster
cattacaaattat

SEQ ID NO: 606099 - DNA, 13 bp, D. melanogaster
cattacaataaag

SEQ ID NO: 606100 - DNA, 13 bp, D. melanogaster
cattacaattgta

SEQ ID NO: 606101 - DNA, 14 bp, D. melanogaster
cattacaattgtaa

SEQ ID NO: 606102 - DNA, 13 bp, D. melanogaster
cattacacatacg

SEQ ID NO: 606103 - DNA, 14 bp, D. melanogaster
cattacattctgca

SEQ ID NO: 606104 - DNA, 13 bp, D. melanogaster
cattacattttcg

SEQ ID NO: 606105 - DNA, 13 bp, D. melanogaster
cattaccaataaa

SEQ ID NO: 606106 - DNA, 13 bp, D. melanogaster
cattaccatcacc

SEQ ID NO: 606107 - DNA, 14 bp, D. melanogaster
cattaccattacca

SEQ ID NO: 606108 - DNA, 13 bp, D. melanogaster
cattaccctttgt

SEQ ID NO: 606109 - DNA, 13 bp, D. melanogaster
cattacctatcct

SEQ ID NO: 606110 - DNA, 13 bp, D. melanogaster
cattacgaatacc

SEQ ID NO: 606111 - DNA, 13 bp, D. melanogaster
cattacgcatacg

SEQ ID NO: 606112 - DNA, 13 bp, D. melanogaster
cattacgtcgatg

SEQ ID NO: 606113 - DNA, 13 bp, D. melanogaster
cattacgtctata

SEQ ID NO: 606114 - DNA, 13 bp, D. melanogaster
cattactcgtaga

SEQ ID NO: 606115 - DNA, 13 bp, D. melanogaster
cattacttaatta

SEQ ID NO: 606116 - DNA, 13 bp, D. melanogaster
cattagaaaaatt

SEQ ID NO: 606117 - DNA, 13 bp, D. melanogaster
cattagaatacaa

SEQ ID NO: 606118 - DNA, 14 bp, D. melanogaster
cattagatttccca

SEQ ID NO: 606119 - DNA, 13 bp, D. melanogaster
cattagcaataca

SEQ ID NO: 606120 - DNA, 13 bp, D. melanogaster
cattagcagcagc

SEQ ID NO: 606121 - DNA, 13 bp, D. melanogaster
cattagcataatt

SEQ ID NO: 606122 - DNA, 13 bp, D. melanogaster
cattagcattaaa

SEQ ID NO: 606123 - DNA, 13 bp, D. melanogaster
cattaggtttatc

SEQ ID NO: 606124 - DNA, 13 bp, D. melanogaster
cattataaaaatg

SEQ ID NO: 606125 - DNA, 13 bp, D. melanogaster
cattataaataca

SEQ ID NO: 606126 - DNA, 13 bp, D. melanogaster
cattataaattgt

SEQ ID NO: 606127 - DNA, 13 bp, D. melanogaster
cattataactatt

SEQ ID NO: 606128 - DNA, 13 bp, D. melanogaster
cattataattgaa

SEQ ID NO: 606129 - DNA, 13 bp, D. melanogaster
cattataggatat

SEQ ID NO: 606130 - DNA, 14 bp, D. melanogaster
cattatatgtatat

SEQ ID NO: 606131 - DNA, 13 bp, D. melanogaster
cattatattgtat

SEQ ID NO: 606132 - DNA, 13 bp, D. melanogaster
cattatatttaac

SEQ ID NO: 606133 - DNA, 14 bp, D. melanogaster
cattatattttgca

SEQ ID NO: 606134 - DNA, 13 bp, D. melanogaster
cattatcatcatc

SEQ ID NO: 606135 - DNA, 14 bp, D. melanogaster
cattatcatcatca

SEQ ID NO: 606136 - DNA, 14 bp, D. melanogaster
cattatcatcatcg

SEQ ID NO: 606137 - DNA, 13 bp, D. melanogaster
cattatcattatc

SEQ ID NO: 606138 - DNA, 14 bp, D. melanogaster
cattatcattatca

SEQ ID NO: 606139 - DNA, 14 bp, D. melanogaster
cattatccattatc

SEQ ID NO: 606140 - DNA, 13 bp, D. melanogaster
cattatctacaaa

SEQ ID NO: 606141 - DNA, 13 bp, D. melanogaster
cattatctcctat

SEQ ID NO: 606142 - DNA, 13 bp, D. melanogaster
cattatggcaatg

SEQ ID NO: 606143 - DNA, 13 bp, D. melanogaster
cattatggttttg

SEQ ID NO: 606144 - DNA, 13 bp, D. melanogaster
cattatgtaaatt

SEQ ID NO: 606145 - DNA, 13 bp, D. melanogaster
cattatgtttatt

SEQ ID NO: 606146 - DNA, 13 bp, D. melanogaster
cattattaaaact

SEQ ID NO: 606147 - DNA, 14 bp, D. melanogaster
cattattaaatcat

SEQ ID NO: 606148 - DNA, 13 bp, D. melanogaster
cattattataatg

SEQ ID NO: 606149 - DNA, 13 bp, D. melanogaster
cattattatcata

SEQ ID NO: 606150 - DNA, 13 bp, D. melanogaster
cattattatcatc

SEQ ID NO: 606151 - DNA, 13 bp, D. melanogaster
cattattatcatt

SEQ ID NO: 606152 - DNA, 13 bp, D. melanogaster
cattattatgcaa

SEQ ID NO: 606153 - DNA, 13 bp, D. melanogaster
cattattattagt

SEQ ID NO: 606154 - DNA, 13 bp, D. melanogaster
cattattatttcc

SEQ ID NO: 606155 - DNA, 13 bp, D. melanogaster
cattattcaaaaa

SEQ ID NO: 606156 - DNA, 13 bp, D. melanogaster
cattattcaatcg

SEQ ID NO: 606157 - DNA, 13 bp, D. melanogaster
cattattgaaatt

SEQ ID NO: 606158 - DNA, 13 bp, D. melanogaster
cattattgtgacc

SEQ ID NO: 606159 - DNA, 13 bp, D. melanogaster
cattattgttgtt

SEQ ID NO: 606160 - DNA, 13 bp, D. melanogaster
cattattgtttcg

SEQ ID NO: 606161 - DNA, 14 bp, D. melanogaster
cattatttatgata

SEQ ID NO: 606162 - DNA, 13 bp, D. melanogaster
cattatttattga

SEQ ID NO: 606163 - DNA, 13 bp, D. melanogaster
cattatttccatt

SEQ ID NO: 606164 - DNA, 13 bp, D. melanogaster
cattatttgttaa

SEQ ID NO: 606165 - DNA, 13 bp, D. melanogaster
cattattttaaga

SEQ ID NO: 606166 - DNA, 13 bp, D. melanogaster
cattattttccct

SEQ ID NO: 606167 - DNA, 13 bp, D. melanogaster
cattatttttgca

SEQ ID NO: 606168 - DNA, 13 bp, D. melanogaster
cattcaaaacatt

SEQ ID NO: 606169 - DNA, 14 bp, D. melanogaster
cattcaaaatagta

SEQ ID NO: 606170 - DNA, 13 bp, D. melanogaster
cattcaaaatgaa

SEQ ID NO: 606171 - DNA, 13 bp, D. melanogaster
cattcaaaattaa

SEQ ID NO: 606172 - DNA, 13 bp, D. melanogaster
cattcaaaattat

SEQ ID NO: 606173 - DNA, 13 bp, D. melanogaster
cattcaaaattca

SEQ ID NO: 606174 - DNA, 13 bp, D. melanogaster
cattcaaacacaa

SEQ ID NO: 606175 - DNA, 13 bp, D. melanogaster
cattcaaagtgca

SEQ ID NO: 606176 - DNA, 13 bp, D. melanogaster
cattcaaataaat

SEQ ID NO: 606177 - DNA, 13 bp, D. melanogaster
cattcaaataata

SEQ ID NO: 606178 - DNA, 13 bp, D. melanogaster
cattcaaatcaaa

SEQ ID NO: 606179 - DNA, 13 bp, D. melanogaster
cattcaaatcaat

SEQ ID NO: 606180 - DNA, 13 bp, D. melanogaster
cattcaaatgaat

SEQ ID NO: 606181 - DNA, 13 bp, D. melanogaster
cattcaaatgatt

SEQ ID NO: 606182 - DNA, 13 bp, D. melanogaster
cattcaaatgcca

SEQ ID NO: 606183 - DNA, 13 bp, D. melanogaster
cattcaaatggaa

SEQ ID NO: 606184 - DNA, 13 bp, D. melanogaster
cattcaaattaaa

SEQ ID NO: 606185 - DNA, 13 bp, D. melanogaster
cattcaaattcaa

SEQ ID NO: 606186 - DNA, 13 bp, D. melanogaster
cattcaaatttaa

SEQ ID NO: 606187 - DNA, 13 bp, D. melanogaster
cattcaaatttgg

SEQ ID NO: 606188 - DNA, 13 bp, D. melanogaster
cattcaacaaatt

SEQ ID NO: 606189 - DNA, 13 bp, D. melanogaster
cattcaacttgaa

SEQ ID NO: 606190 - DNA, 13 bp, D. melanogaster
cattcaaggagga

SEQ ID NO: 606191 - DNA, 13 bp, D. melanogaster
cattcaaggcata

SEQ ID NO: 606192 - DNA, 13 bp, D. melanogaster
cattcaagtttgg

SEQ ID NO: 606193 - DNA, 13 bp, D. melanogaster
cattcaatgcatt

SEQ ID NO: 606194 - DNA, 13 bp, D. melanogaster
cattcaattcaat

SEQ ID NO: 606195 - DNA, 14 bp, D. melanogaster
cattcaattgcaat

SEQ ID NO: 606196 - DNA, 13 bp, D. melanogaster
cattcaattggaa

SEQ ID NO: 606197 - DNA, 13 bp, D. melanogaster
cattcaatttgat

SEQ ID NO: 606198 - DNA, 13 bp, D. melanogaster
cattcaatttgca

SEQ ID NO: 606199 - DNA, 13 bp, D. melanogaster
cattcaatttgcc

SEQ ID NO: 606200 - DNA, 13 bp, D. melanogaster
cattcaatttgtt

SEQ ID NO: 606201 - DNA, 13 bp, D. melanogaster
cattcaatttttg

SEQ ID NO: 606202 - DNA, 13 bp, D. melanogaster
cattcacaaacat

SEQ ID NO: 606203 - DNA, 13 bp, D. melanogaster
cattcacacacac

SEQ ID NO: 606204 - DNA, 14 bp, D. melanogaster
cattcacacacaca

SEQ ID NO: 606205 - DNA, 13 bp, D. melanogaster
cattcacacacat

SEQ ID NO: 606206 - DNA, 13 bp, D. melanogaster
cattcacacgcac

SEQ ID NO: 606207 - DNA, 13 bp, D. melanogaster
cattcacactagc

SEQ ID NO: 606208 - DNA, 13 bp, D. melanogaster
cattcacatccac

SEQ ID NO: 606209 - DNA, 14 bp, D. melanogaster
cattcacatccaca

SEQ ID NO: 606210 - DNA, 13 bp, D. melanogaster
cattcacattcac

SEQ ID NO: 606211 - DNA, 14 bp, D. melanogaster
cattcacattcaca

SEQ ID NO: 606212 - DNA, 13 bp, D. melanogaster
cattcacattcgc

SEQ ID NO: 606213 - DNA, 13 bp, D. melanogaster
cattcactcactc

SEQ ID NO: 606214 - DNA, 13 bp, D. melanogaster
cattcacttttat

SEQ ID NO: 606215 - DNA, 13 bp, D. melanogaster
cattcagaaaata

SEQ ID NO: 606216 - DNA, 14 bp, D. melanogaster
cattcagaaataat

SEQ ID NO: 606217 - DNA, 13 bp, D. melanogaster
cattcagattcac

SEQ ID NO: 606218 - DNA, 13 bp, D. melanogaster
cattcagcattcg

SEQ ID NO: 606219 - DNA, 13 bp, D. melanogaster
cattcagcatttg

SEQ ID NO: 606220 - DNA, 13 bp, D. melanogaster
cattcagccattc

SEQ ID NO: 606221 - DNA, 13 bp, D. melanogaster
cattcagcgagca

SEQ ID NO: 606222 - DNA, 16 bp, D. melanogaster
cattcagctggatgac

SEQ ID NO: 606223 - DNA, 13 bp, D. melanogaster
cattcagctttaa

SEQ ID NO: 606224 - DNA, 13 bp, D. melanogaster
cattcagtatttt

SEQ ID NO: 606225 - DNA, 13 bp, D. melanogaster
cattcagtcagtc

SEQ ID NO: 606226 - DNA, 14 bp, D. melanogaster
cattcagtcagtca

SEQ ID NO: 606227 - DNA, 13 bp, D. melanogaster
cattcagttagtt

SEQ ID NO: 606228 - DNA, 13 bp, D. melanogaster
cattcagttcatt

SEQ ID NO: 606229 - DNA, 13 bp, D. melanogaster
cattcagttggcc

SEQ ID NO: 606230 - DNA, 13 bp, D. melanogaster
cattcagtttgca

SEQ ID NO: 606231 - DNA, 13 bp, D. melanogaster
cattcataaaact

SEQ ID NO: 606232 - DNA, 13 bp, D. melanogaster
cattcataaagag

SEQ ID NO: 606233 - DNA, 13 bp, D. melanogaster
cattcataattca

SEQ ID NO: 606234 - DNA, 13 bp, D. melanogaster
cattcataattga

SEQ ID NO: 606235 - DNA, 13 bp, D. melanogaster
cattcatatgcaa

SEQ ID NO: 606236 - DNA, 13 bp, D. melanogaster
cattcatattcat

SEQ ID NO: 606237 - DNA, 14 bp, D. melanogaster
cattcatattcatt

SEQ ID NO: 606238 - DNA, 13 bp, D. melanogaster
cattcatcaaaat

SEQ ID NO: 606239 - DNA, 13 bp, D. melanogaster
cattcatgaattt

SEQ ID NO: 606240 - DNA, 13 bp, D. melanogaster
cattcatgattga

SEQ ID NO: 606241 - DNA, 13 bp, D. melanogaster
cattcattaattt

SEQ ID NO: 606242 - DNA, 13 bp, D. melanogaster
cattcattattca

SEQ ID NO: 606243 - DNA, 13 bp, D. melanogaster
cattcattcaaat

SEQ ID NO: 606244 - DNA, 13 bp, D. melanogaster
cattcattcagtc

SEQ ID NO: 606245 - DNA, 13 bp, D. melanogaster
cattcattcatat

SEQ ID NO: 606246 - DNA, 13 bp, D. melanogaster
cattcattcattc

SEQ ID NO: 606247 - DNA, 14 bp, D. melanogaster
cattcattcattca

SEQ ID NO: 606248 - DNA, 14 bp, D. melanogaster
cattcattcattcg

SEQ ID NO: 606249 - DNA, 13 bp, D. melanogaster
cattcattgtttt

SEQ ID NO: 606250 - DNA, 13 bp, D. melanogaster
cattcatttcaaa

SEQ ID NO: 606251 - DNA, 13 bp, D. melanogaster
cattcatttcatt

SEQ ID NO: 606252 - DNA, 13 bp, D. melanogaster
cattcatttgcat

SEQ ID NO: 606253 - DNA, 13 bp, D. melanogaster
cattcatttggcc

SEQ ID NO: 606254 - DNA, 13 bp, D. melanogaster
cattcatttgttt

SEQ ID NO: 606255 - DNA, 13 bp, D. melanogaster
cattcattttaaa

SEQ ID NO: 606256 - DNA, 14 bp, D. melanogaster
cattcattttcatt

SEQ ID NO: 606257 - DNA, 13 bp, D. melanogaster
cattcattttcga

SEQ ID NO: 606258 - DNA, 14 bp, D. melanogaster
cattcattttcgat

SEQ ID NO: 606259 - DNA, 13 bp, D. melanogaster
cattcattttgaa

SEQ ID NO: 606260 - DNA, 13 bp, D. melanogaster
cattcattttggc

SEQ ID NO: 606261 - DNA, 14 bp, D. melanogaster
cattcattttttac

SEQ ID NO: 606262 - DNA, 14 bp, D. melanogaster
cattccaaaaggca

SEQ ID NO: 606263 - DNA, 13 bp, D. melanogaster
cattccaaagaat

SEQ ID NO: 606264 - DNA, 13 bp, D. melanogaster
cattccaattcca

SEQ ID NO: 606265 - DNA, 13 bp, D. melanogaster
cattccaattgga

SEQ ID NO: 606266 - DNA, 13 bp, D. melanogaster
cattccacaccac

SEQ ID NO: 606267 - DNA, 13 bp, D. melanogaster
cattccacttttg

SEQ ID NO: 606268 - DNA, 13 bp, D. melanogaster
cattccagcaatg

SEQ ID NO: 606269 - DNA, 14 bp, D. melanogaster
cattccagcaatgg

SEQ ID NO: 606270 - DNA, 13 bp, D. melanogaster
cattccagttctc

SEQ ID NO: 606271 - DNA, 13 bp, D. melanogaster
cattccataccat

SEQ ID NO: 606272 - DNA, 13 bp, D. melanogaster
cattccatattca

SEQ ID NO: 606273 - DNA, 13 bp, D. melanogaster
cattccatatttg

SEQ ID NO: 606274 - DNA, 14 bp, D. melanogaster
cattccatatttgg

SEQ ID NO: 606275 - DNA, 13 bp, D. melanogaster
cattccatgccat

SEQ ID NO: 606276 - DNA, 13 bp, D. melanogaster
cattccattcatt

SEQ ID NO: 606277 - DNA, 13 bp, D. melanogaster
cattccattccaa

SEQ ID NO: 606278 - DNA, 13 bp, D. melanogaster
cattccattccac

SEQ ID NO: 606279 - DNA, 14 bp, D. melanogaster
cattccattccact

SEQ ID NO: 606280 - DNA, 13 bp, D. melanogaster
cattccattccag

SEQ ID NO: 606281 - DNA, 13 bp, D. melanogaster
cattccattcccc

SEQ ID NO: 606282 - DNA, 13 bp, D. melanogaster
cattccattccct

SEQ ID NO: 606283 - DNA, 13 bp, D. melanogaster
cattccattccgc

SEQ ID NO: 606284 - DNA, 13 bp, D. melanogaster
cattccattcctt

SEQ ID NO: 606285 - DNA, 13 bp, D. melanogaster
cattccattcgat

SEQ ID NO: 606286 - DNA, 13 bp, D. melanogaster
cattccattctat

SEQ ID NO: 606287 - DNA, 13 bp, D. melanogaster
cattccatttccc

SEQ ID NO: 606288 - DNA, 13 bp, D. melanogaster
cattccatttgca

SEQ ID NO: 606289 - DNA, 13 bp, D. melanogaster
cattcccaaaaaa

SEQ ID NO: 606290 - DNA, 13 bp, D. melanogaster
cattcccaaggtg

SEQ ID NO: 606291 - DNA, 13 bp, D. melanogaster
cattcccacacac

SEQ ID NO: 606292 - DNA, 14 bp, D. melanogaster
cattcccataccca

SEQ ID NO: 606293 - DNA, 13 bp, D. melanogaster
cattcccatctcc

SEQ ID NO: 606294 - DNA, 13 bp, D. melanogaster
cattcccattcaa

SEQ ID NO: 606295 - DNA, 14 bp, D. melanogaster
cattcccattcgca

SEQ ID NO: 606296 - DNA, 13 bp, D. melanogaster
cattcccattctc

SEQ ID NO: 606297 - DNA, 14 bp, D. melanogaster
cattcccattctca

SEQ ID NO: 606298 - DNA, 14 bp, D. melanogaster
cattcccatttcca

SEQ ID NO: 606299 - DNA, 13 bp, D. melanogaster
cattcccattttg

SEQ ID NO: 606300 - DNA, 13 bp, D. melanogaster
cattccccatttc

SEQ ID NO: 606301 - DNA, 13 bp, D. melanogaster
cattcccgatgtc

SEQ ID NO: 606302 - DNA, 13 bp, D. melanogaster
cattccgaacagc

SEQ ID NO: 606303 - DNA, 13 bp, D. melanogaster
cattccgattccc

SEQ ID NO: 606304 - DNA, 13 bp, D. melanogaster
cattccgattccg

SEQ ID NO: 606305 - DNA, 13 bp, D. melanogaster
cattccgcccact

SEQ ID NO: 606306 - DNA, 13 bp, D. melanogaster
cattccggctttt

SEQ ID NO: 606307 - DNA, 13 bp, D. melanogaster
cattcctgcaatt

SEQ ID NO: 606308 - DNA, 13 bp, D. melanogaster
cattcgaaatgaa

SEQ ID NO: 606309 - DNA, 13 bp, D. melanogaster
cattcgaaattcg

SEQ ID NO: 606310 - DNA, 13 bp, D. melanogaster
cattcgaatacct

SEQ ID NO: 606311 - DNA, 13 bp, D. melanogaster
cattcgaattgaa

SEQ ID NO: 606312 - DNA, 13 bp, D. melanogaster
cattcgacattcg

SEQ ID NO: 606313 - DNA, 13 bp, D. melanogaster
cattcgagtggac

SEQ ID NO: 606314 - DNA, 14 bp, D. melanogaster
cattcgagtggaca

SEQ ID NO: 606315 - DNA, 13 bp, D. melanogaster
cattcgatatttg

SEQ ID NO: 606316 - DNA, 13 bp, D. melanogaster
cattcgattcatt

SEQ ID NO: 606317 - DNA, 14 bp, D. melanogaster
cattcgattcgatt

SEQ ID NO: 606318 - DNA, 13 bp, D. melanogaster
cattcgatttgtt

SEQ ID NO: 606319 - DNA, 13 bp, D. melanogaster
cattcgattttaa

SEQ ID NO: 606320 - DNA, 13 bp, D. melanogaster
cattcgattttat

SEQ ID NO: 606321 - DNA, 13 bp, D. melanogaster
cattcgcacaaat

SEQ ID NO: 606322 - DNA, 14 bp, D. melanogaster
cattcgcacaaatg

SEQ ID NO: 606323 - DNA, 13 bp, D. melanogaster
cattcgcacacat

SEQ ID NO: 606324 - DNA, 13 bp, D. melanogaster
cattcgcataaat

SEQ ID NO: 606325 - DNA, 14 bp, D. melanogaster
cattcgcatccgca

SEQ ID NO: 606326 - DNA, 14 bp, D. melanogaster
cattcgcattcaca

SEQ ID NO: 606327 - DNA, 13 bp, D. melanogaster
cattcgcattcca

SEQ ID NO: 606328 - DNA, 14 bp, D. melanogaster
cattcgcattccca

SEQ ID NO: 606329 - DNA, 13 bp, D. melanogaster
cattcgcattcga

SEQ ID NO: 606330 - DNA, 14 bp, D. melanogaster
cattcgcattcgca

SEQ ID NO: 606331 - DNA, 13 bp, D. melanogaster
cattcgcattcgg

SEQ ID NO: 606332 - DNA, 13 bp, D. melanogaster
cattcgcattcgt

SEQ ID NO: 606333 - DNA, 13 bp, D. melanogaster
cattcgcattgca

SEQ ID NO: 606334 - DNA, 13 bp, D. melanogaster
cattcgcatttat

SEQ ID NO: 606335 - DNA, 13 bp, D. melanogaster
cattcgcatttgg

SEQ ID NO: 606336 - DNA, 13 bp, D. melanogaster
cattcgcattttc

SEQ ID NO: 606337 - DNA, 13 bp, D. melanogaster
cattcgcattttg

SEQ ID NO: 606338 - DNA, 14 bp, D. melanogaster
cattcgccattaca

SEQ ID NO: 606339 - DNA, 13 bp, D. melanogaster
cattcgccattcg

SEQ ID NO: 606340 - DNA, 14 bp, D. melanogaster
cattcgccattcgc

SEQ ID NO: 606341 - DNA, 13 bp, D. melanogaster
cattcgctggcca

SEQ ID NO: 606342 - DNA, 13 bp, D. melanogaster
cattcggaaaatt

SEQ ID NO: 606343 - DNA, 14 bp, D. melanogaster
cattcggcattcgg

SEQ ID NO: 606344 - DNA, 13 bp, D. melanogaster
cattcggcatttg

SEQ ID NO: 606345 - DNA, 13 bp, D. melanogaster
cattcgggccatc

SEQ ID NO: 606346 - DNA, 14 bp, D. melanogaster
cattcgggccatca

SEQ ID NO: 606347 - DNA, 13 bp, D. melanogaster
cattcggtggcct

SEQ ID NO: 606348 - DNA, 13 bp, D. melanogaster
cattcggtggcgt

SEQ ID NO: 606349 - DNA, 14 bp, D. melanogaster
cattcgtgttccgt

SEQ ID NO: 606350 - DNA, 13 bp, D. melanogaster
cattcgtttcgtt

SEQ ID NO: 606351 - DNA, 13 bp, D. melanogaster
cattcgttttcat

SEQ ID NO: 606352 - DNA, 13 bp, D. melanogaster
cattcgttttgtt

SEQ ID NO: 606353 - DNA, 13 bp, D. melanogaster
cattcgtttttat

SEQ ID NO: 606354 - DNA, 13 bp, D. melanogaster
cattctaatgaac

SEQ ID NO: 606355 - DNA, 13 bp, D. melanogaster
cattctatagttt

SEQ ID NO: 606356 - DNA, 13 bp, D. melanogaster
cattctatttgtg

SEQ ID NO: 606357 - DNA, 13 bp, D. melanogaster
cattctcatcctc

SEQ ID NO: 606358 - DNA, 13 bp, D. melanogaster
cattctcgtattg

SEQ ID NO: 606359 - DNA, 14 bp, D. melanogaster
cattctctcagaaa

SEQ ID NO: 606360 - DNA, 13 bp, D. melanogaster
cattctgattctg

SEQ ID NO: 606361 - DNA, 14 bp, D. melanogaster
cattctgcaaaatg

SEQ ID NO: 606362 - DNA, 13 bp, D. melanogaster
cattctgcaatcc

SEQ ID NO: 606363 - DNA, 14 bp, D. melanogaster
cattctgcaatccc

SEQ ID NO: 606364 - DNA, 13 bp, D. melanogaster
cattctgcattct

SEQ ID NO: 606365 - DNA, 14 bp, D. melanogaster
cattctgcattctg

SEQ ID NO: 606366 - DNA, 13 bp, D. melanogaster
cattctgccaaag

SEQ ID NO: 606367 - DNA, 13 bp, D. melanogaster
cattctgctgtcc

SEQ ID NO: 606368 - DNA, 14 bp, D. melanogaster
cattctgctgtcca

SEQ ID NO: 606369 - DNA, 13 bp, D. melanogaster
cattctggccaaa

SEQ ID NO: 606370 - DNA, 13 bp, D. melanogaster
cattcttgagcaa

SEQ ID NO: 606371 - DNA, 13 bp, D. melanogaster
cattcttgccatc

SEQ ID NO: 606372 - DNA, 13 bp, D. melanogaster
cattcttgtaaac

SEQ ID NO: 606373 - DNA, 13 bp, D. melanogaster
cattctttgttgc

SEQ ID NO: 606374 - DNA, 13 bp, D. melanogaster
cattgaaaaaaga

SEQ ID NO: 606375 - DNA, 13 bp, D. melanogaster
cattgaaaaattt

SEQ ID NO: 606376 - DNA, 13 bp, D. melanogaster
cattgaaaacaaa

SEQ ID NO: 606377 - DNA, 13 bp, D. melanogaster
cattgaaaacatt

SEQ ID NO: 606378 - DNA, 13 bp, D. melanogaster
cattgaaaacgaa

SEQ ID NO: 606379 - DNA, 13 bp, D. melanogaster
cattgaaaagatg

SEQ ID NO: 606380 - DNA, 13 bp, D. melanogaster
cattgaaaagtat

SEQ ID NO: 606381 - DNA, 13 bp, D. melanogaster
cattgaaaatcaa

SEQ ID NO: 606382 - DNA, 13 bp, D. melanogaster
cattgaaaatgca

SEQ ID NO: 606383 - DNA, 13 bp, D. melanogaster
cattgaaaatgtt

SEQ ID NO: 606384 - DNA, 13 bp, D. melanogaster
cattgaaaattgc

SEQ ID NO: 606385 - DNA, 13 bp, D. melanogaster
cattgaaaatttg

SEQ ID NO: 606386 - DNA, 13 bp, D. melanogaster
cattgaaagtgaa

SEQ ID NO: 606387 - DNA, 13 bp, D. melanogaster
cattgaaatcgaa

SEQ ID NO: 606388 - DNA, 13 bp, D. melanogaster
cattgaaatgcca

SEQ ID NO: 606389 - DNA, 13 bp, D. melanogaster
cattgaaatgtat

SEQ ID NO: 606390 - DNA, 13 bp, D. melanogaster
cattgaaattata

SEQ ID NO: 606391 - DNA, 14 bp, D. melanogaster
cattgaaattgaat

SEQ ID NO: 606392 - DNA, 13 bp, D. melanogaster
cattgaaatttta

SEQ ID NO: 606393 - DNA, 13 bp, D. melanogaster
cattgaacttgaa

SEQ ID NO: 606394 - DNA, 13 bp, D. melanogaster
cattgaactttaa

SEQ ID NO: 606395 - DNA, 13 bp, D. melanogaster
cattgaagccaaa

SEQ ID NO: 606396 - DNA, 13 bp, D. melanogaster
cattgaatattta

SEQ ID NO: 606397 - DNA, 13 bp, D. melanogaster
cattgaatccatt

SEQ ID NO: 606398 - DNA, 13 bp, D. melanogaster
cattgaatgcatt

SEQ ID NO: 606399 - DNA, 13 bp, D. melanogaster
cattgaatggaaa

SEQ ID NO: 606400 - DNA, 13 bp, D. melanogaster
cattgaatgtttt

SEQ ID NO: 606401 - DNA, 13 bp, D. melanogaster
cattgaattaaat

SEQ ID NO: 606402 - DNA, 14 bp, D. melanogaster
cattgaattaaata

SEQ ID NO: 606403 - DNA, 13 bp, D. melanogaster
cattgaattgcat

SEQ ID NO: 606404 - DNA, 13 bp, D. melanogaster
cattgaatttcaa

SEQ ID NO: 606405 - DNA, 13 bp, D. melanogaster
cattgaatttgaa

SEQ ID NO: 606406 - DNA, 14 bp, D. melanogaster
cattgacattgaaa

SEQ ID NO: 606407 - DNA, 13 bp, D. melanogaster
cattgacattgtc

SEQ ID NO: 606408 - DNA, 13 bp, D. melanogaster
cattgaccacggc

SEQ ID NO: 606409 - DNA, 13 bp, D. melanogaster
cattgaccacttg

SEQ ID NO: 606410 - DNA, 13 bp, D. melanogaster
cattgatagggcc

SEQ ID NO: 606411 - DNA, 13 bp, D. melanogaster
cattgatcatatt

SEQ ID NO: 606412 - DNA, 14 bp, D. melanogaster
cattgatcatatta

SEQ ID NO: 606413 - DNA, 13 bp, D. melanogaster
cattgattcgcat

SEQ ID NO: 606414 - DNA, 13 bp, D. melanogaster
cattgattgtaat

SEQ ID NO: 606415 - DNA, 14 bp, D. melanogaster
cattgatttaatca

SEQ ID NO: 606416 - DNA, 13 bp, D. melanogaster
cattgatttcgat

SEQ ID NO: 606417 - DNA, 13 bp, D. melanogaster
cattgatttgttt

SEQ ID NO: 606418 - DNA, 13 bp, D. melanogaster
cattgattttgtt

SEQ ID NO: 606419 - DNA, 13 bp, D. melanogaster
cattgatttttat

SEQ ID NO: 606420 - DNA, 14 bp, D. melanogaster
cattgcaaatattt

SEQ ID NO: 606421 - DNA, 13 bp, D. melanogaster
cattgcaaatgaa

SEQ ID NO: 606422 - DNA, 13 bp, D. melanogaster
cattgcaactgca

SEQ ID NO: 606423 - DNA, 13 bp, D. melanogaster
cattgcaattgca

SEQ ID NO: 606424 - DNA, 13 bp, D. melanogaster
cattgcaattttg

SEQ ID NO: 606425 - DNA, 13 bp, D. melanogaster
cattgcagaatat

SEQ ID NO: 606426 - DNA, 13 bp, D. melanogaster
cattgcagcaggc

SEQ ID NO: 606427 - DNA, 13 bp, D. melanogaster
cattgcagcagtt

SEQ ID NO: 606428 - DNA, 13 bp, D. melanogaster
cattgcagctcca

SEQ ID NO: 606429 - DNA, 13 bp, D. melanogaster
cattgcagctgca

SEQ ID NO: 606430 - DNA, 13 bp, D. melanogaster
cattgcagttggc

SEQ ID NO: 606431 - DNA, 13 bp, D. melanogaster
cattgcatacttt

SEQ ID NO: 606432 - DNA, 14 bp, D. melanogaster
cattgcatactttt

SEQ ID NO: 606433 - DNA, 13 bp, D. melanogaster
cattgcatgttgg

SEQ ID NO: 606434 - DNA, 13 bp, D. melanogaster
cattgcattaaat

SEQ ID NO: 606435 - DNA, 13 bp, D. melanogaster
cattgcattctgc

SEQ ID NO: 606436 - DNA, 13 bp, D. melanogaster
cattgcattttgc

SEQ ID NO: 606437 - DNA, 13 bp, D. melanogaster
cattgcattttgg

SEQ ID NO: 606438 - DNA, 13 bp, D. melanogaster
cattgccaatgcc

SEQ ID NO: 606439 - DNA, 13 bp, D. melanogaster
cattgccacattg

SEQ ID NO: 606440 - DNA, 14 bp, D. melanogaster
cattgccagccaac

SEQ ID NO: 606441 - DNA, 13 bp, D. melanogaster
cattgccatcatc

SEQ ID NO: 606442 - DNA, 13 bp, D. melanogaster
cattgccatcgcc

SEQ ID NO: 606443 - DNA, 13 bp, D. melanogaster
cattgccatggcc

SEQ ID NO: 606444 - DNA, 13 bp, D. melanogaster
cattgccattcca

SEQ ID NO: 606445 - DNA, 13 bp, D. melanogaster
cattgccattgca

SEQ ID NO: 606446 - DNA, 14 bp, D. melanogaster
cattgccattgcca

SEQ ID NO: 606447 - DNA, 13 bp, D. melanogaster
cattgccattgtt

SEQ ID NO: 606448 - DNA, 13 bp, D. melanogaster
cattgccatttcc

SEQ ID NO: 606449 - DNA, 13 bp, D. melanogaster
cattgcccattgg

SEQ ID NO: 606450 - DNA, 13 bp, D. melanogaster
cattgccgagaaa

SEQ ID NO: 606451 - DNA, 13 bp, D. melanogaster
cattgcctacttt

SEQ ID NO: 606452 - DNA, 14 bp, D. melanogaster
cattgcctgcagaa

SEQ ID NO: 606453 - DNA, 13 bp, D. melanogaster
cattgccttcgtg

SEQ ID NO: 606454 - DNA, 13 bp, D. melanogaster
cattgcctttgcc

SEQ ID NO: 606455 - DNA, 13 bp, D. melanogaster
cattgcgcatacg

SEQ ID NO: 606456 - DNA, 13 bp, D. melanogaster
cattgcgccatat

SEQ ID NO: 606457 - DNA, 13 bp, D. melanogaster
cattgcgtatacg

SEQ ID NO: 606458 - DNA, 14 bp, D. melanogaster
cattgcgtatacgc

SEQ ID NO: 606459 - DNA, 13 bp, D. melanogaster
cattgctcttcaa

SEQ ID NO: 606460 - DNA, 13 bp, D. melanogaster
cattgctgatatc

SEQ ID NO: 606461 - DNA, 13 bp, D. melanogaster
cattgctgctggc

SEQ ID NO: 606462 - DNA, 13 bp, D. melanogaster
cattgctgttgtt

SEQ ID NO: 606463 - DNA, 13 bp, D. melanogaster
cattgctgttttt

SEQ ID NO: 606464 - DNA, 14 bp, D. melanogaster
cattgctttttatt

SEQ ID NO: 606465 - DNA, 14 bp, D. melanogaster
cattggaattttgc

SEQ ID NO: 606466 - DNA, 13 bp, D. melanogaster
cattggataccat

SEQ ID NO: 606467 - DNA, 13 bp, D. melanogaster
cattggcaaacaa

SEQ ID NO: 606468 - DNA, 13 bp, D. melanogaster
cattggcaacatt

SEQ ID NO: 606469 - DNA, 13 bp, D. melanogaster
cattggcaatttg

SEQ ID NO: 606470 - DNA, 13 bp, D. melanogaster
cattggcattgcc

SEQ ID NO: 606471 - DNA, 13 bp, D. melanogaster
cattggcattggc

SEQ ID NO: 606472 - DNA, 14 bp, D. melanogaster
cattggcattggca

SEQ ID NO: 606473 - DNA, 14 bp, D. melanogaster
cattggcattgttt

SEQ ID NO: 606474 - DNA, 13 bp, D. melanogaster
cattggcattttg

SEQ ID NO: 606475 - DNA, 13 bp, D. melanogaster
cattggccccaaa

SEQ ID NO: 606476 - DNA, 13 bp, D. melanogaster
cattggcgtttgt

SEQ ID NO: 606477 - DNA, 13 bp, D. melanogaster
cattggctggatg

SEQ ID NO: 606478 - DNA, 14 bp, D. melanogaster
cattggctttagct

SEQ ID NO: 606479 - DNA, 13 bp, D. melanogaster
cattgggattggg

SEQ ID NO: 606480 - DNA, 13 bp, D. melanogaster
cattgggccataa

SEQ ID NO: 606481 - DNA, 13 bp, D. melanogaster
cattgggtccctg

SEQ ID NO: 606482 - DNA, 13 bp, D. melanogaster
cattggtccactg

SEQ ID NO: 606483 - DNA, 13 bp, D. melanogaster
cattggttctggt

SEQ ID NO: 606484 - DNA, 13 bp, D. melanogaster
cattgtaaaatat

SEQ ID NO: 606485 - DNA, 13 bp, D. melanogaster
cattgtaaaatgt

SEQ ID NO: 606486 - DNA, 13 bp, D. melanogaster
cattgtaaacaaa

SEQ ID NO: 606487 - DNA, 13 bp, D. melanogaster
cattgtaaataaa

SEQ ID NO: 606488 - DNA, 13 bp, D. melanogaster
cattgtaacaaaa

SEQ ID NO: 606489 - DNA, 13 bp, D. melanogaster
cattgtaattata

SEQ ID NO: 606490 - DNA, 13 bp, D. melanogaster
cattgtacaattg

SEQ ID NO: 606491 - DNA, 13 bp, D. melanogaster
cattgtagaagag

SEQ ID NO: 606492 - DNA, 14 bp, D. melanogaster
cattgtagccacaa

SEQ ID NO: 606493 - DNA, 13 bp, D. melanogaster
cattgtattgatt

SEQ ID NO: 606494 - DNA, 13 bp, D. melanogaster
cattgtcaacaaa

SEQ ID NO: 606495 - DNA, 13 bp, D. melanogaster
cattgtcatcatc

SEQ ID NO: 606496 - DNA, 13 bp, D. melanogaster
cattgtccattgt

SEQ ID NO: 606497 - DNA, 13 bp, D. melanogaster
cattgtcctgctg

SEQ ID NO: 606498 - DNA, 13 bp, D. melanogaster
cattgtcgatttg

SEQ ID NO: 606499 - DNA, 13 bp, D. melanogaster
cattgtcgttgtc

SEQ ID NO: 606500 - DNA, 13 bp, D. melanogaster
cattgtgaaacta

SEQ ID NO: 606501 - DNA, 13 bp, D. melanogaster
cattgtgaaattc

SEQ ID NO: 606502 - DNA, 13 bp, D. melanogaster
cattgtgaacata

SEQ ID NO: 606503 - DNA, 13 bp, D. melanogaster
cattgtggccaaa

SEQ ID NO: 606504 - DNA, 13 bp, D. melanogaster
cattgtgggtaat

SEQ ID NO: 606505 - DNA, 13 bp, D. melanogaster
cattgtgtgccaa

SEQ ID NO: 606506 - DNA, 13 bp, D. melanogaster
cattgttgatatt

SEQ ID NO: 606507 - DNA, 13 bp, D. melanogaster
cattgttgcattg

SEQ ID NO: 606508 - DNA, 13 bp, D. melanogaster
cattgttgccatt

SEQ ID NO: 606509 - DNA, 13 bp, D. melanogaster
cattgttgctgtt

SEQ ID NO: 606510 - DNA, 13 bp, D. melanogaster
cattgttggccaa

SEQ ID NO: 606511 - DNA, 13 bp, D. melanogaster
cattgttggccat

SEQ ID NO: 606512 - DNA, 13 bp, D. melanogaster
cattgttggcttt

SEQ ID NO: 606513 - DNA, 13 bp, D. melanogaster
cattgttgtggca

SEQ ID NO: 606514 - DNA, 13 bp, D. melanogaster
cattgttgtgtgc

SEQ ID NO: 606515 - DNA, 13 bp, D. melanogaster
cattgttgttgct

SEQ ID NO: 606516 - DNA, 13 bp, D. melanogaster
cattgttgttggc

SEQ ID NO: 606517 - DNA, 13 bp, D. melanogaster
cattgttgttgtt

SEQ ID NO: 606518 - DNA, 13 bp, D. melanogaster
cattgtttaaata

SEQ ID NO: 606519 - DNA, 13 bp, D. melanogaster
cattgtttacatt

SEQ ID NO: 606520 - DNA, 13 bp, D. melanogaster
cattgtttctgtt

SEQ ID NO: 606521 - DNA, 13 bp, D. melanogaster
cattgtttgccca

SEQ ID NO: 606522 - DNA, 13 bp, D. melanogaster
cattgtttgggtg

SEQ ID NO: 606523 - DNA, 13 bp, D. melanogaster
cattgtttgtgtt

SEQ ID NO: 606524 - DNA, 13 bp, D. melanogaster
cattgttttatta

SEQ ID NO: 606525 - DNA, 13 bp, D. melanogaster
cattgttttcagt

SEQ ID NO: 606526 - DNA, 13 bp, D. melanogaster
cattgttttccac

SEQ ID NO: 606527 - DNA, 13 bp, D. melanogaster
cattgttttccat

SEQ ID NO: 606528 - DNA, 13 bp, D. melanogaster
cattgttttccct

SEQ ID NO: 606529 - DNA, 13 bp, D. melanogaster
cattgttttggcc

SEQ ID NO: 606530 - DNA, 13 bp, D. melanogaster
cattgttttggtt

SEQ ID NO: 606531 - DNA, 14 bp, D. melanogaster
cattgttttgttgg

SEQ ID NO: 606532 - DNA, 13 bp, D. melanogaster
cattgtttttata

SEQ ID NO: 606533 - DNA, 14 bp, D. melanogaster
cattgtttttatac

SEQ ID NO: 606534 - DNA, 13 bp, D. melanogaster
cattgtttttatc

SEQ ID NO: 606535 - DNA, 13 bp, D. melanogaster
cattgtttttgcc

SEQ ID NO: 606536 - DNA, 14 bp, D. melanogaster
cattgtttttgttg

SEQ ID NO: 606537 - DNA, 13 bp, D. melanogaster
catttaaaaacat

SEQ ID NO: 606538 - DNA, 13 bp, D. melanogaster
catttaaaaacta

SEQ ID NO: 606539 - DNA, 13 bp, D. melanogaster
catttaaaaatgc

SEQ ID NO: 606540 - DNA, 14 bp, D. melanogaster
catttaaaaattgt

SEQ ID NO: 606541 - DNA, 14 bp, D. melanogaster
catttaaaacaatt

SEQ ID NO: 606542 - DNA, 14 bp, D. melanogaster
catttaaaacattt

SEQ ID NO: 606543 - DNA, 13 bp, D. melanogaster
catttaaaagaaa

SEQ ID NO: 606544 - DNA, 13 bp, D. melanogaster
catttaaaagcat

SEQ ID NO: 606545 - DNA, 13 bp, D. melanogaster
catttaaaagtat

SEQ ID NO: 606546 - DNA, 13 bp, D. melanogaster
catttaaaagtca

SEQ ID NO: 606547 - DNA, 13 bp, D. melanogaster
catttaaaataca

SEQ ID NO: 606548 - DNA, 13 bp, D. melanogaster
catttaaaatcca

SEQ ID NO: 606549 - DNA, 13 bp, D. melanogaster
catttaaaatgat

SEQ ID NO: 606550 - DNA, 14 bp, D. melanogaster
catttaaaatgcat

SEQ ID NO: 606551 - DNA, 14 bp, D. melanogaster
catttaaaatgtat

SEQ ID NO: 606552 - DNA, 13 bp, D. melanogaster
catttaaaattag

SEQ ID NO: 606553 - DNA, 13 bp, D. melanogaster
catttaaaattca

SEQ ID NO: 606554 - DNA, 14 bp, D. melanogaster
catttaaaattcaa

SEQ ID NO: 606555 - DNA, 13 bp, D. melanogaster
catttaaacaaat

SEQ ID NO: 606556 - DNA, 13 bp, D. melanogaster
catttaaacataa

SEQ ID NO: 606557 - DNA, 13 bp, D. melanogaster
catttaaacttaa

SEQ ID NO: 606558 - DNA, 13 bp, D. melanogaster
catttaaagaaaa

SEQ ID NO: 606559 - DNA, 13 bp, D. melanogaster
catttaaagccaa

SEQ ID NO: 606560 - DNA, 13 bp, D. melanogaster
catttaaagcgta

SEQ ID NO: 606561 - DNA, 13 bp, D. melanogaster
catttaaaggcaa

SEQ ID NO: 606562 - DNA, 13 bp, D. melanogaster
catttaaagtgga

SEQ ID NO: 606563 - DNA, 13 bp, D. melanogaster
catttaaagttaa

SEQ ID NO: 606564 - DNA, 13 bp, D. melanogaster
catttaaagtttt

SEQ ID NO: 606565 - DNA, 13 bp, D. melanogaster
catttaaatatgc

SEQ ID NO: 606566 - DNA, 13 bp, D. melanogaster
catttaaatcact

SEQ ID NO: 606567 - DNA, 13 bp, D. melanogaster
catttaaatcata

SEQ ID NO: 606568 - DNA, 13 bp, D. melanogaster
catttaaatcatt

SEQ ID NO: 606569 - DNA, 13 bp, D. melanogaster
catttaaatgaaa

SEQ ID NO: 606570 - DNA, 13 bp, D. melanogaster
catttaaatgaat

SEQ ID NO: 606571 - DNA, 13 bp, D. melanogaster
catttaaatgcag

SEQ ID NO: 606572 - DNA, 13 bp, D. melanogaster
catttaaatgcat

SEQ ID NO: 606573 - DNA, 13 bp, D. melanogaster
catttaaatgtca

SEQ ID NO: 606574 - DNA, 13 bp, D. melanogaster
catttaaatgttg

SEQ ID NO: 606575 - DNA, 14 bp, D. melanogaster
catttaaattcaat

SEQ ID NO: 606576 - DNA, 13 bp, D. melanogaster
catttaaattgca

SEQ ID NO: 606577 - DNA, 14 bp, D. melanogaster
catttaaattgcaa

SEQ ID NO: 606578 - DNA, 13 bp, D. melanogaster
catttaaattgcc

SEQ ID NO: 606579 - DNA, 13 bp, D. melanogaster
catttaaattgtt

SEQ ID NO: 606580 - DNA, 13 bp, D. melanogaster
catttaaatttgt

SEQ ID NO: 606581 - DNA, 13 bp, D. melanogaster
catttaaattttg

SEQ ID NO: 606582 - DNA, 13 bp, D. melanogaster
catttaacaaaat

SEQ ID NO: 606583 - DNA, 13 bp, D. melanogaster
catttaacaataa

SEQ ID NO: 606584 - DNA, 14 bp, D. melanogaster
catttaacaatttt

SEQ ID NO: 606585 - DNA, 13 bp, D. melanogaster
catttaacagaca

SEQ ID NO: 606586 - DNA, 13 bp, D. melanogaster
catttaacataaa

SEQ ID NO: 606587 - DNA, 13 bp, D. melanogaster
catttaacattaa

SEQ ID NO: 606588 - DNA, 13 bp, D. melanogaster
catttaacattta

SEQ ID NO: 606589 - DNA, 14 bp, D. melanogaster
catttaacatttaa

SEQ ID NO: 606590 - DNA, 13 bp, D. melanogaster
catttaacatttt

SEQ ID NO: 606591 - DNA, 13 bp, D. melanogaster
catttaaccaatt

SEQ ID NO: 606592 - DNA, 13 bp, D. melanogaster
catttaactaatt

SEQ ID NO: 606593 - DNA, 13 bp, D. melanogaster
catttaagcaaat

SEQ ID NO: 606594 - DNA, 13 bp, D. melanogaster
catttaagcatta

SEQ ID NO: 606595 - DNA, 13 bp, D. melanogaster
catttaagccatt

SEQ ID NO: 606596 - DNA, 13 bp, D. melanogaster
catttaagtgcaa

SEQ ID NO: 606597 - DNA, 13 bp, D. melanogaster
catttaagtggaa

SEQ ID NO: 606598 - DNA, 13 bp, D. melanogaster
catttaataatca

SEQ ID NO: 606599 - DNA, 13 bp, D. melanogaster
catttaatagtta

SEQ ID NO: 606600 - DNA, 13 bp, D. melanogaster
catttaatagttt

SEQ ID NO: 606601 - DNA, 13 bp, D. melanogaster
catttaatatcat

SEQ ID NO: 606602 - DNA, 13 bp, D. melanogaster
catttaatatgaa

SEQ ID NO: 606603 - DNA, 13 bp, D. melanogaster
catttaatatgcg

SEQ ID NO: 606604 - DNA, 13 bp, D. melanogaster
catttaatgcaaa

SEQ ID NO: 606605 - DNA, 13 bp, D. melanogaster
catttaatgcaat

SEQ ID NO: 606606 - DNA, 13 bp, D. melanogaster
catttaatggaaa

SEQ ID NO: 606607 - DNA, 13 bp, D. melanogaster
catttaatggcca

SEQ ID NO: 606608 - DNA, 14 bp, D. melanogaster
catttaattaagtt

SEQ ID NO: 606609 - DNA, 13 bp, D. melanogaster
catttaattacaa

SEQ ID NO: 606610 - DNA, 13 bp, D. melanogaster
catttaattcaaa

SEQ ID NO: 606611 - DNA, 13 bp, D. melanogaster
catttaattcgat

SEQ ID NO: 606612 - DNA, 13 bp, D. melanogaster
catttaattgaga

SEQ ID NO: 606613 - DNA, 13 bp, D. melanogaster
catttaattggat

SEQ ID NO: 606614 - DNA, 14 bp, D. melanogaster
catttaatttcgtt

SEQ ID NO: 606615 - DNA, 13 bp, D. melanogaster
catttaatttgat

SEQ ID NO: 606616 - DNA, 13 bp, D. melanogaster
catttaatttgct

SEQ ID NO: 606617 - DNA, 13 bp, D. melanogaster
catttacaaaatg

SEQ ID NO: 606618 - DNA, 13 bp, D. melanogaster
catttacaaattt

SEQ ID NO: 606619 - DNA, 13 bp, D. melanogaster
catttacaattac

SEQ ID NO: 606620 - DNA, 13 bp, D. melanogaster
catttacacatca

SEQ ID NO: 606621 - DNA, 13 bp, D. melanogaster
catttacatacat

SEQ ID NO: 606622 - DNA, 14 bp, D. melanogaster
catttacatacata

SEQ ID NO: 606623 - DNA, 14 bp, D. melanogaster
catttacatacatc

SEQ ID NO: 606624 - DNA, 13 bp, D. melanogaster
catttacatatat

SEQ ID NO: 606625 - DNA, 14 bp, D. melanogaster
catttacatatata

SEQ ID NO: 606626 - DNA, 13 bp, D. melanogaster
catttacattcat

SEQ ID NO: 606627 - DNA, 13 bp, D. melanogaster
catttacattcgc

SEQ ID NO: 606628 - DNA, 13 bp, D. melanogaster
catttacatttaa

SEQ ID NO: 606629 - DNA, 13 bp, D. melanogaster
catttacatttac

SEQ ID NO: 606630 - DNA, 14 bp, D. melanogaster
catttacatttaca

SEQ ID NO: 606631 - DNA, 13 bp, D. melanogaster
catttacatttcg

SEQ ID NO: 606632 - DNA, 13 bp, D. melanogaster
catttacatttgc

SEQ ID NO: 606633 - DNA, 13 bp, D. melanogaster
catttacatttgt

SEQ ID NO: 606634 - DNA, 13 bp, D. melanogaster
catttacatttta

SEQ ID NO: 606635 - DNA, 13 bp, D. melanogaster
catttacattttg

SEQ ID NO: 606636 - DNA, 13 bp, D. melanogaster
catttacccagtt

SEQ ID NO: 606637 - DNA, 13 bp, D. melanogaster
catttactgctcg

SEQ ID NO: 606638 - DNA, 13 bp, D. melanogaster
catttactttaag

SEQ ID NO: 606639 - DNA, 13 bp, D. melanogaster
catttactttgca

SEQ ID NO: 606640 - DNA, 13 bp, D. melanogaster
catttacttttaa

SEQ ID NO: 606641 - DNA, 13 bp, D. melanogaster
catttagcattaa

SEQ ID NO: 606642 - DNA, 13 bp, D. melanogaster
catttagcattta

SEQ ID NO: 606643 - DNA, 13 bp, D. melanogaster
catttaggtattt

SEQ ID NO: 606644 - DNA, 13 bp, D. melanogaster
catttagtattat

SEQ ID NO: 606645 - DNA, 13 bp, D. melanogaster
catttagttattt

SEQ ID NO: 606646 - DNA, 13 bp, D. melanogaster
catttagtttaaa

SEQ ID NO: 606647 - DNA, 13 bp, D. melanogaster
catttagttttta

SEQ ID NO: 606648 - DNA, 13 bp, D. melanogaster
catttataaaaac

SEQ ID NO: 606649 - DNA, 13 bp, D. melanogaster
catttataacaat

SEQ ID NO: 606650 - DNA, 13 bp, D. melanogaster
catttataagttt

SEQ ID NO: 606651 - DNA, 13 bp, D. melanogaster
catttataattca

SEQ ID NO: 606652 - DNA, 14 bp, D. melanogaster
catttatacaaatt

SEQ ID NO: 606653 - DNA, 13 bp, D. melanogaster
catttatacaatt

SEQ ID NO: 606654 - DNA, 13 bp, D. melanogaster
catttatacatat

SEQ ID NO: 606655 - DNA, 14 bp, D. melanogaster
catttatacatata

SEQ ID NO: 606656 - DNA, 13 bp, D. melanogaster
catttataggatt

SEQ ID NO: 606657 - DNA, 13 bp, D. melanogaster
catttatataaac

SEQ ID NO: 606658 - DNA, 13 bp, D. melanogaster
catttatatacaa

SEQ ID NO: 606659 - DNA, 13 bp, D. melanogaster
catttatatacat

SEQ ID NO: 606660 - DNA, 14 bp, D. melanogaster
catttatatacata

SEQ ID NO: 606661 - DNA, 13 bp, D. melanogaster
catttatatatgt

SEQ ID NO: 606662 - DNA, 13 bp, D. melanogaster
catttatattcat

SEQ ID NO: 606663 - DNA, 13 bp, D. melanogaster
catttatcataat

SEQ ID NO: 606664 - DNA, 13 bp, D. melanogaster
catttatcattaa

SEQ ID NO: 606665 - DNA, 13 bp, D. melanogaster
catttatcattta

SEQ ID NO: 606666 - DNA, 13 bp, D. melanogaster
catttatcatttg

SEQ ID NO: 606667 - DNA, 13 bp, D. melanogaster
catttatctgcaa

SEQ ID NO: 606668 - DNA, 14 bp, D. melanogaster
catttatctgcaat

SEQ ID NO: 606669 - DNA, 13 bp, D. melanogaster
catttatgaaaat

SEQ ID NO: 606670 - DNA, 15 bp, D. melanogaster
catttatgctctttt

SEQ ID NO: 606671 - DNA, 13 bp, D. melanogaster
catttatgtacat

SEQ ID NO: 606672 - DNA, 14 bp, D. melanogaster
catttatgtacata

SEQ ID NO: 606673 - DNA, 13 bp, D. melanogaster
catttatgtatat

SEQ ID NO: 606674 - DNA, 13 bp, D. melanogaster
catttatgtatgt

SEQ ID NO: 606675 - DNA, 13 bp, D. melanogaster
catttattaacaa

SEQ ID NO: 606676 - DNA, 13 bp, D. melanogaster
catttattagttt

SEQ ID NO: 606677 - DNA, 13 bp, D. melanogaster
catttattatttg

SEQ ID NO: 606678 - DNA, 13 bp, D. melanogaster
catttattcaaaa

SEQ ID NO: 606679 - DNA, 13 bp, D. melanogaster
catttattccatt

SEQ ID NO: 606680 - DNA, 13 bp, D. melanogaster
catttattgaaaa

SEQ ID NO: 606681 - DNA, 14 bp, D. melanogaster
catttattgtattt

SEQ ID NO: 606682 - DNA, 13 bp, D. melanogaster
catttattgttgt

SEQ ID NO: 606683 - DNA, 13 bp, D. melanogaster
catttattgttta

SEQ ID NO: 606684 - DNA, 13 bp, D. melanogaster
catttatttaact

SEQ ID NO: 606685 - DNA, 13 bp, D. melanogaster
catttatttacaa

SEQ ID NO: 606686 - DNA, 13 bp, D. melanogaster
catttatttagtt

SEQ ID NO: 606687 - DNA, 13 bp, D. melanogaster
catttatttatac

SEQ ID NO: 606688 - DNA, 13 bp, D. melanogaster
catttatttcaaa

SEQ ID NO: 606689 - DNA, 13 bp, D. melanogaster
catttatttcact

SEQ ID NO: 606690 - DNA, 14 bp, D. melanogaster
catttatttgcatt

SEQ ID NO: 606691 - DNA, 13 bp, D. melanogaster
catttatttgtgc

SEQ ID NO: 606692 - DNA, 13 bp, D. melanogaster
catttattttcca

SEQ ID NO: 606693 - DNA, 14 bp, D. melanogaster
catttattttccat

SEQ ID NO: 606694 - DNA, 13 bp, D. melanogaster
catttattttgca

SEQ ID NO: 606695 - DNA, 13 bp, D. melanogaster
catttcaaaaaca

SEQ ID NO: 606696 - DNA, 13 bp, D. melanogaster
catttcaaaaact

SEQ ID NO: 606697 - DNA, 13 bp, D. melanogaster
catttcaaaaatg

SEQ ID NO: 606698 - DNA, 13 bp, D. melanogaster
catttcaaaacta

SEQ ID NO: 606699 - DNA, 13 bp, D. melanogaster
catttcaaaatga

SEQ ID NO: 606700 - DNA, 13 bp, D. melanogaster
catttcaaaattt

SEQ ID NO: 606701 - DNA, 13 bp, D. melanogaster
catttcaaagtgg

SEQ ID NO: 606702 - DNA, 13 bp, D. melanogaster
catttcaaatatt

SEQ ID NO: 606703 - DNA, 13 bp, D. melanogaster
catttcaaatgca

SEQ ID NO: 606704 - DNA, 13 bp, D. melanogaster
catttcaaatgcc

SEQ ID NO: 606705 - DNA, 13 bp, D. melanogaster
catttcaaatgct

SEQ ID NO: 606706 - DNA, 13 bp, D. melanogaster
catttcaaatgga

SEQ ID NO: 606707 - DNA, 13 bp, D. melanogaster
catttcaaattaa

SEQ ID NO: 606708 - DNA, 13 bp, D. melanogaster
catttcaaattat

SEQ ID NO: 606709 - DNA, 13 bp, D. melanogaster
catttcaaattca

SEQ ID NO: 606710 - DNA, 13 bp, D. melanogaster
catttcaaatttt

SEQ ID NO: 606711 - DNA, 13 bp, D. melanogaster
catttcaacaaat

SEQ ID NO: 606712 - DNA, 13 bp, D. melanogaster
catttcaacattt

SEQ ID NO: 606713 - DNA, 13 bp, D. melanogaster
catttcaaggttt

SEQ ID NO: 606714 - DNA, 13 bp, D. melanogaster
catttcaataaaa

SEQ ID NO: 606715 - DNA, 13 bp, D. melanogaster
catttcaataaat

SEQ ID NO: 606716 - DNA, 13 bp, D. melanogaster
catttcaatatgc

SEQ ID NO: 606717 - DNA, 13 bp, D. melanogaster
catttcaatgagc

SEQ ID NO: 606718 - DNA, 13 bp, D. melanogaster
catttcaatgcat

SEQ ID NO: 606719 - DNA, 13 bp, D. melanogaster
catttcaattaaa

SEQ ID NO: 606720 - DNA, 13 bp, D. melanogaster
catttcaattcca

SEQ ID NO: 606721 - DNA, 14 bp, D. melanogaster
catttcaattgaat

SEQ ID NO: 606722 - DNA, 13 bp, D. melanogaster
catttcaattgca

SEQ ID NO: 606723 - DNA, 14 bp, D. melanogaster
catttcaattgcat

SEQ ID NO: 606724 - DNA, 13 bp, D. melanogaster
catttcaattgga

SEQ ID NO: 606725 - DNA, 13 bp, D. melanogaster
catttcaatttat

SEQ ID NO: 606726 - DNA, 14 bp, D. melanogaster
catttcaatttgca

SEQ ID NO: 606727 - DNA, 13 bp, D. melanogaster
catttcaatttgt

SEQ ID NO: 606728 - DNA, 13 bp, D. melanogaster
catttcaattttc

SEQ ID NO: 606729 - DNA, 13 bp, D. melanogaster
catttcacaaaaa

SEQ ID NO: 606730 - DNA, 13 bp, D. melanogaster
catttcacaaatt

SEQ ID NO: 606731 - DNA, 13 bp, D. melanogaster
catttcacaatca

SEQ ID NO: 606732 - DNA, 13 bp, D. melanogaster
catttcacattta

SEQ ID NO: 606733 - DNA, 14 bp, D. melanogaster
catttcacatttca

SEQ ID NO: 606734 - DNA, 13 bp, D. melanogaster
catttcaccattt

SEQ ID NO: 606735 - DNA, 13 bp, D. melanogaster
catttcacttaag

SEQ ID NO: 606736 - DNA, 13 bp, D. melanogaster
catttcactttca

SEQ ID NO: 606737 - DNA, 13 bp, D. melanogaster
catttcacttttg

SEQ ID NO: 606738 - DNA, 14 bp, D. melanogaster
catttcagaccata

SEQ ID NO: 606739 - DNA, 13 bp, D. melanogaster
catttcataaaaa

SEQ ID NO: 606740 - DNA, 13 bp, D. melanogaster
catttcatacatt

SEQ ID NO: 606741 - DNA, 13 bp, D. melanogaster
catttcatcattt

SEQ ID NO: 606742 - DNA, 13 bp, D. melanogaster
catttcattcatt

SEQ ID NO: 606743 - DNA, 14 bp, D. melanogaster
catttcattccatt

SEQ ID NO: 606744 - DNA, 13 bp, D. melanogaster
catttcattgctg

SEQ ID NO: 606745 - DNA, 13 bp, D. melanogaster
catttcattgctt

SEQ ID NO: 606746 - DNA, 13 bp, D. melanogaster
catttcatttaca

SEQ ID NO: 606747 - DNA, 13 bp, D. melanogaster
catttcatttcaa

SEQ ID NO: 606748 - DNA, 13 bp, D. melanogaster
catttcatttcca

SEQ ID NO: 606749 - DNA, 13 bp, D. melanogaster
catttcatttcgc

SEQ ID NO: 606750 - DNA, 14 bp, D. melanogaster
catttcatttcgct

SEQ ID NO: 606751 - DNA, 13 bp, D. melanogaster
catttcatttgac

SEQ ID NO: 606752 - DNA, 13 bp, D. melanogaster
catttcatttgca

SEQ ID NO: 606753 - DNA, 14 bp, D. melanogaster
catttcatttgcat

SEQ ID NO: 606754 - DNA, 13 bp, D. melanogaster
catttcatttggc

SEQ ID NO: 606755 - DNA, 14 bp, D. melanogaster
catttcatttggtt

SEQ ID NO: 606756 - DNA, 13 bp, D. melanogaster
catttccaaaaaa

SEQ ID NO: 606757 - DNA, 13 bp, D. melanogaster
catttccaaatct

SEQ ID NO: 606758 - DNA, 13 bp, D. melanogaster
catttccaatgca

SEQ ID NO: 606759 - DNA, 13 bp, D. melanogaster
catttccaattgt

SEQ ID NO: 606760 - DNA, 13 bp, D. melanogaster
catttccaatttc

SEQ ID NO: 606761 - DNA, 13 bp, D. melanogaster
catttccaatttt

SEQ ID NO: 606762 - DNA, 13 bp, D. melanogaster
catttccacacac

SEQ ID NO: 606763 - DNA, 13 bp, D. melanogaster
catttccacatcc

SEQ ID NO: 606764 - DNA, 14 bp, D. melanogaster
catttccacatcca

SEQ ID NO: 606765 - DNA, 13 bp, D. melanogaster
catttccacattt

SEQ ID NO: 606766 - DNA, 14 bp, D. melanogaster
catttccacatttc

SEQ ID NO: 606767 - DNA, 14 bp, D. melanogaster
catttccacatttt

SEQ ID NO: 606768 - DNA, 13 bp, D. melanogaster
catttccaccatt

SEQ ID NO: 606769 - DNA, 13 bp, D. melanogaster
catttccatatat

SEQ ID NO: 606770 - DNA, 13 bp, D. melanogaster
catttccatatcc

SEQ ID NO: 606771 - DNA, 13 bp, D. melanogaster
catttccatattc

SEQ ID NO: 606772 - DNA, 14 bp, D. melanogaster
catttccatcatat

SEQ ID NO: 606773 - DNA, 13 bp, D. melanogaster
catttccatctcc

SEQ ID NO: 606774 - DNA, 14 bp, D. melanogaster
catttccatctcca

SEQ ID NO: 606775 - DNA, 13 bp, D. melanogaster
catttccatgttt

SEQ ID NO: 606776 - DNA, 14 bp, D. melanogaster
catttccatgtttc

SEQ ID NO: 606777 - DNA, 13 bp, D. melanogaster
catttccattcac

SEQ ID NO: 606778 - DNA, 14 bp, D. melanogaster
catttccattcatt

SEQ ID NO: 606779 - DNA, 13 bp, D. melanogaster
catttccattcca

SEQ ID NO: 606780 - DNA, 13 bp, D. melanogaster
catttccattcga

SEQ ID NO: 606781 - DNA, 13 bp, D. melanogaster
catttccattgtc

SEQ ID NO: 606782 - DNA, 13 bp, D. melanogaster
catttccatttcc

SEQ ID NO: 606783 - DNA, 14 bp, D. melanogaster
catttccatttcca

SEQ ID NO: 606784 - DNA, 13 bp, D. melanogaster
catttccattttc

SEQ ID NO: 606785 - DNA, 13 bp, D. melanogaster
catttcccaattt

SEQ ID NO: 606786 - DNA, 14 bp, D. melanogaster
catttcccaatttg

SEQ ID NO: 606787 - DNA, 13 bp, D. melanogaster
catttcccacttt

SEQ ID NO: 606788 - DNA, 13 bp, D. melanogaster
catttcccagcga

SEQ ID NO: 606789 - DNA, 13 bp, D. melanogaster
catttcccattcc

SEQ ID NO: 606790 - DNA, 13 bp, D. melanogaster
catttcccattgt

SEQ ID NO: 606791 - DNA, 13 bp, D. melanogaster
catttcccatttc

SEQ ID NO: 606792 - DNA, 13 bp, D. melanogaster
catttcccatttg

SEQ ID NO: 606793 - DNA, 13 bp, D. melanogaster
catttccccatct

SEQ ID NO: 606794 - DNA, 13 bp, D. melanogaster
catttccccattt

SEQ ID NO: 606795 - DNA, 13 bp, D. melanogaster
catttcccgcttt

SEQ ID NO: 606796 - DNA, 13 bp, D. melanogaster
catttcccgttca

SEQ ID NO: 606797 - DNA, 13 bp, D. melanogaster
catttccgcattt

SEQ ID NO: 606798 - DNA, 13 bp, D. melanogaster
catttccgctgcc

SEQ ID NO: 606799 - DNA, 13 bp, D. melanogaster
catttccgcttcc

SEQ ID NO: 606800 - DNA, 13 bp, D. melanogaster
catttccgctttt

SEQ ID NO: 606801 - DNA, 13 bp, D. melanogaster
catttccggtgtt

SEQ ID NO: 606802 - DNA, 13 bp, D. melanogaster
catttccgtatga

SEQ ID NO: 606803 - DNA, 14 bp, D. melanogaster
catttccgtttccg

SEQ ID NO: 606804 - DNA, 13 bp, D. melanogaster
catttcctcattt

SEQ ID NO: 606805 - DNA, 13 bp, D. melanogaster
catttcctgctcc

SEQ ID NO: 606806 - DNA, 13 bp, D. melanogaster
catttcctgtttt

SEQ ID NO: 606807 - DNA, 14 bp, D. melanogaster
catttccttaagtt

SEQ ID NO: 606808 - DNA, 13 bp, D. melanogaster
catttcctttggc

SEQ ID NO: 606809 - DNA, 13 bp, D. melanogaster
catttcctttggg

SEQ ID NO: 606810 - DNA, 13 bp, D. melanogaster
catttcgaaatgc

SEQ ID NO: 606811 - DNA, 13 bp, D. melanogaster
catttcgaaatgt

SEQ ID NO: 606812 - DNA, 13 bp, D. melanogaster
catttcgaatatt

SEQ ID NO: 606813 - DNA, 13 bp, D. melanogaster
catttcgaatgca

SEQ ID NO: 606814 - DNA, 13 bp, D. melanogaster
catttcgaattca

SEQ ID NO: 606815 - DNA, 13 bp, D. melanogaster
catttcgaattta

SEQ ID NO: 606816 - DNA, 13 bp, D. melanogaster
catttcgaatttc

SEQ ID NO: 606817 - DNA, 13 bp, D. melanogaster
catttcgatattt

SEQ ID NO: 606818 - DNA, 13 bp, D. melanogaster
catttcgattgtt

SEQ ID NO: 606819 - DNA, 13 bp, D. melanogaster
catttcgatttcg

SEQ ID NO: 606820 - DNA, 13 bp, D. melanogaster
catttcgcacttt

SEQ ID NO: 606821 - DNA, 13 bp, D. melanogaster
catttcgcattgc

SEQ ID NO: 606822 - DNA, 13 bp, D. melanogaster
catttcgcatttt

SEQ ID NO: 606823 - DNA, 13 bp, D. melanogaster
catttcgccagct

SEQ ID NO: 606824 - DNA, 13 bp, D. melanogaster
catttcgccattt

SEQ ID NO: 606825 - DNA, 13 bp, D. melanogaster
catttcgcctgct

SEQ ID NO: 606826 - DNA, 13 bp, D. melanogaster
catttcgctcagt

SEQ ID NO: 606827 - DNA, 14 bp, D. melanogaster
catttcgctcttgg

SEQ ID NO: 606828 - DNA, 13 bp, D. melanogaster
catttcgctggct

SEQ ID NO: 606829 - DNA, 13 bp, D. melanogaster
catttcggatttt

SEQ ID NO: 606830 - DNA, 13 bp, D. melanogaster
catttcgttgacc

SEQ ID NO: 606831 - DNA, 13 bp, D. melanogaster
catttcgttggct

SEQ ID NO: 606832 - DNA, 13 bp, D. melanogaster
catttcgttgttt

SEQ ID NO: 606833 - DNA, 13 bp, D. melanogaster
catttcgtttatt

SEQ ID NO: 606834 - DNA, 14 bp, D. melanogaster
catttcgtttattt

SEQ ID NO: 606835 - DNA, 13 bp, D. melanogaster
catttcgtttcat

SEQ ID NO: 606836 - DNA, 13 bp, D. melanogaster
catttcgtttcga

SEQ ID NO: 606837 - DNA, 13 bp, D. melanogaster
catttcgtttcgg

SEQ ID NO: 606838 - DNA, 13 bp, D. melanogaster
catttcgtttgca

SEQ ID NO: 606839 - DNA, 13 bp, D. melanogaster
catttcgtttggc

SEQ ID NO: 606840 - DNA, 14 bp, D. melanogaster
catttcgttttcat

SEQ ID NO: 606841 - DNA, 13 bp, D. melanogaster
catttcgttttgt

SEQ ID NO: 606842 - DNA, 13 bp, D. melanogaster
catttcgtttttg

SEQ ID NO: 606843 - DNA, 13 bp, D. melanogaster
catttctaaaaat

SEQ ID NO: 606844 - DNA, 13 bp, D. melanogaster
catttctaaatgt

SEQ ID NO: 606845 - DNA, 13 bp, D. melanogaster
catttctatatat

SEQ ID NO: 606846 - DNA, 14 bp, D. melanogaster
catttctatttgtt

SEQ ID NO: 606847 - DNA, 13 bp, D. melanogaster
catttctcgcagt

SEQ ID NO: 606848 - DNA, 13 bp, D. melanogaster
catttctctcagt

SEQ ID NO: 606849 - DNA, 13 bp, D. melanogaster
catttctgacatt

SEQ ID NO: 606850 - DNA, 13 bp, D. melanogaster
catttctgctcaa

SEQ ID NO: 606851 - DNA, 13 bp, D. melanogaster
catttctgtgtgc

SEQ ID NO: 606852 - DNA, 13 bp, D. melanogaster
catttcttaattg

SEQ ID NO: 606853 - DNA, 13 bp, D. melanogaster
catttcttatacc

SEQ ID NO: 606854 - DNA, 14 bp, D. melanogaster
catttctttaaaaa

SEQ ID NO: 606855 - DNA, 13 bp, D. melanogaster
catttctttccca

SEQ ID NO: 606856 - DNA, 13 bp, D. melanogaster
catttctttggcc

SEQ ID NO: 606857 - DNA, 13 bp, D. melanogaster
catttcttttcaa

SEQ ID NO: 606858 - DNA, 13 bp, D. melanogaster
catttcttttgct

SEQ ID NO: 606859 - DNA, 13 bp, D. melanogaster
catttcttttggc

SEQ ID NO: 606860 - DNA, 14 bp, D. melanogaster
catttgaaaaatat

SEQ ID NO: 606861 - DNA, 13 bp, D. melanogaster
catttgaaaacaa

SEQ ID NO: 606862 - DNA, 13 bp, D. melanogaster
catttgaaaagca

SEQ ID NO: 606863 - DNA, 13 bp, D. melanogaster
catttgaaaataa

SEQ ID NO: 606864 - DNA, 14 bp, D. melanogaster
catttgaaaataaa

SEQ ID NO: 606865 - DNA, 13 bp, D. melanogaster
catttgaaaatcg

SEQ ID NO: 606866 - DNA, 13 bp, D. melanogaster
catttgaaaatga

SEQ ID NO: 606867 - DNA, 13 bp, D. melanogaster
catttgaaagttt

SEQ ID NO: 606868 - DNA, 13 bp, D. melanogaster
catttgaaataca

SEQ ID NO: 606869 - DNA, 13 bp, D. melanogaster
catttgaaatatt

SEQ ID NO: 606870 - DNA, 13 bp, D. melanogaster
catttgaaatgaa

SEQ ID NO: 606871 - DNA, 13 bp, D. melanogaster
catttgaaattcg

SEQ ID NO: 606872 - DNA, 13 bp, D. melanogaster
catttgaataata

SEQ ID NO: 606873 - DNA, 13 bp, D. melanogaster
catttgaataatt

SEQ ID NO: 606874 - DNA, 13 bp, D. melanogaster
catttgaatattt

SEQ ID NO: 606875 - DNA, 13 bp, D. melanogaster
catttgaatgaaa

SEQ ID NO: 606876 - DNA, 13 bp, D. melanogaster
catttgaatgcat

SEQ ID NO: 606877 - DNA, 13 bp, D. melanogaster
catttgaatggca

SEQ ID NO: 606878 - DNA, 13 bp, D. melanogaster
catttgaattgat

SEQ ID NO: 606879 - DNA, 13 bp, D. melanogaster
catttgaattgca

SEQ ID NO: 606880 - DNA, 13 bp, D. melanogaster
catttgaatttat

SEQ ID NO: 606881 - DNA, 13 bp, D. melanogaster
catttgaatttcg

SEQ ID NO: 606882 - DNA, 13 bp, D. melanogaster
catttgacaagta

SEQ ID NO: 606883 - DNA, 13 bp, D. melanogaster
catttgacaattt

SEQ ID NO: 606884 - DNA, 13 bp, D. melanogaster
catttgacacatt

SEQ ID NO: 606885 - DNA, 13 bp, D. melanogaster
catttgacatttc

SEQ ID NO: 606886 - DNA, 13 bp, D. melanogaster
catttgacatttg

SEQ ID NO: 606887 - DNA, 13 bp, D. melanogaster
catttgacatttt

SEQ ID NO: 606888 - DNA, 13 bp, D. melanogaster
catttgaccattt

SEQ ID NO: 606889 - DNA, 13 bp, D. melanogaster
catttgactcgac

SEQ ID NO: 606890 - DNA, 13 bp, D. melanogaster
catttgactttga

SEQ ID NO: 606891 - DNA, 13 bp, D. melanogaster
catttgactttta

SEQ ID NO: 606892 - DNA, 13 bp, D. melanogaster
catttgatatatt

SEQ ID NO: 606893 - DNA, 13 bp, D. melanogaster
catttgatcattt

SEQ ID NO: 606894 - DNA, 13 bp, D. melanogaster
catttgattccat

SEQ ID NO: 606895 - DNA, 13 bp, D. melanogaster
catttgattgatg

SEQ ID NO: 606896 - DNA, 14 bp, D. melanogaster
catttgatttatgc

SEQ ID NO: 606897 - DNA, 13 bp, D. melanogaster
catttgatttatt

SEQ ID NO: 606898 - DNA, 13 bp, D. melanogaster
catttgatttgca

SEQ ID NO: 606899 - DNA, 13 bp, D. melanogaster
catttgatttgtt

SEQ ID NO: 606900 - DNA, 13 bp, D. melanogaster
catttgcaaaaat

SEQ ID NO: 606901 - DNA, 13 bp, D. melanogaster
catttgcaaaagt

SEQ ID NO: 606902 - DNA, 13 bp, D. melanogaster
catttgcaaacaa

SEQ ID NO: 606903 - DNA, 13 bp, D. melanogaster
catttgcaacatt

SEQ ID NO: 606904 - DNA, 13 bp, D. melanogaster
catttgcaattca

SEQ ID NO: 606905 - DNA, 13 bp, D. melanogaster
catttgcacacac

SEQ ID NO: 606906 - DNA, 13 bp, D. melanogaster
catttgcacattt

SEQ ID NO: 606907 - DNA, 13 bp, D. melanogaster
catttgcactttg

SEQ ID NO: 606908 - DNA, 13 bp, D. melanogaster
catttgcagcaaa

SEQ ID NO: 606909 - DNA, 13 bp, D. melanogaster
catttgcagcacc

SEQ ID NO: 606910 - DNA, 14 bp, D. melanogaster
catttgcagcacct

SEQ ID NO: 606911 - DNA, 13 bp, D. melanogaster
catttgcagtttg

SEQ ID NO: 606912 - DNA, 14 bp, D. melanogaster
catttgcataaatt

SEQ ID NO: 606913 - DNA, 14 bp, D. melanogaster
catttgcataacaa

SEQ ID NO: 606914 - DNA, 13 bp, D. melanogaster
catttgcataagc

SEQ ID NO: 606915 - DNA, 13 bp, D. melanogaster
catttgcatacaa

SEQ ID NO: 606916 - DNA, 13 bp, D. melanogaster
catttgcatacca

SEQ ID NO: 606917 - DNA, 13 bp, D. melanogaster
catttgcatagtt

SEQ ID NO: 606918 - DNA, 13 bp, D. melanogaster
catttgcatatca

SEQ ID NO: 606919 - DNA, 13 bp, D. melanogaster
catttgcatattc

SEQ ID NO: 606920 - DNA, 13 bp, D. melanogaster
catttgcatctga

SEQ ID NO: 606921 - DNA, 13 bp, D. melanogaster
catttgcatctgt

SEQ ID NO: 606922 - DNA, 13 bp, D. melanogaster
catttgcatgcaa

SEQ ID NO: 606923 - DNA, 13 bp, D. melanogaster
catttgcatgcag

SEQ ID NO: 606924 - DNA, 13 bp, D. melanogaster
catttgcatgctg

SEQ ID NO: 606925 - DNA, 13 bp, D. melanogaster
catttgcattcaa

SEQ ID NO: 606926 - DNA, 13 bp, D. melanogaster
catttgcattgca

SEQ ID NO: 606927 - DNA, 13 bp, D. melanogaster
catttgcattgcg

SEQ ID NO: 606928 - DNA, 13 bp, D. melanogaster
catttgcattggc

SEQ ID NO: 606929 - DNA, 14 bp, D. melanogaster
catttgcatttaca

SEQ ID NO: 606930 - DNA, 13 bp, D. melanogaster
catttgcatttat

SEQ ID NO: 606931 - DNA, 13 bp, D. melanogaster
catttgcatttcg

SEQ ID NO: 606932 - DNA, 13 bp, D. melanogaster
catttgcatttgc

SEQ ID NO: 606933 - DNA, 14 bp, D. melanogaster
catttgcatttgca

SEQ ID NO: 606934 - DNA, 14 bp, D. melanogaster
catttgcatttgcc

SEQ ID NO: 606935 - DNA, 13 bp, D. melanogaster
catttgcatttgt

SEQ ID NO: 606936 - DNA, 13 bp, D. melanogaster
catttgcatttta

SEQ ID NO: 606937 - DNA, 14 bp, D. melanogaster
catttgcattttaa

SEQ ID NO: 606938 - DNA, 13 bp, D. melanogaster
catttgcattttc

SEQ ID NO: 606939 - DNA, 13 bp, D. melanogaster
catttgcattttg

SEQ ID NO: 606940 - DNA, 14 bp, D. melanogaster
catttgcattttgc

SEQ ID NO: 606941 - DNA, 14 bp, D. melanogaster
catttgcattttgg

SEQ ID NO: 606942 - DNA, 13 bp, D. melanogaster
catttgccaaaca

SEQ ID NO: 606943 - DNA, 13 bp, D. melanogaster
catttgccaatta

SEQ ID NO: 606944 - DNA, 13 bp, D. melanogaster
catttgccaattg

SEQ ID NO: 606945 - DNA, 13 bp, D. melanogaster
catttgccacatt

SEQ ID NO: 606946 - DNA, 13 bp, D. melanogaster
catttgccacttt

SEQ ID NO: 606947 - DNA, 13 bp, D. melanogaster
catttgccagctg

SEQ ID NO: 606948 - DNA, 13 bp, D. melanogaster
catttgccatgca

SEQ ID NO: 606949 - DNA, 13 bp, D. melanogaster
catttgccattgc

SEQ ID NO: 606950 - DNA, 13 bp, D. melanogaster
catttgccatttg

SEQ ID NO: 606951 - DNA, 14 bp, D. melanogaster
catttgccattttc

SEQ ID NO: 606952 - DNA, 13 bp, D. melanogaster
catttgcccaact

SEQ ID NO: 606953 - DNA, 13 bp, D. melanogaster
catttgcccattt

SEQ ID NO: 606954 - DNA, 13 bp, D. melanogaster
catttgccgctca

SEQ ID NO: 606955 - DNA, 13 bp, D. melanogaster
catttgccgctgc

SEQ ID NO: 606956 - DNA, 13 bp, D. melanogaster
catttgccgcttg

SEQ ID NO: 606957 - DNA, 13 bp, D. melanogaster
catttgccggcca

SEQ ID NO: 606958 - DNA, 13 bp, D. melanogaster
catttgcgaaatt

SEQ ID NO: 606959 - DNA, 13 bp, D. melanogaster
catttgcggcatt

SEQ ID NO: 606960 - DNA, 13 bp, D. melanogaster
catttgctgattt

SEQ ID NO: 606961 - DNA, 13 bp, D. melanogaster
catttgctgcaaa

SEQ ID NO: 606962 - DNA, 13 bp, D. melanogaster
catttgctgcact

SEQ ID NO: 606963 - DNA, 13 bp, D. melanogaster
catttgctgcagc

SEQ ID NO: 606964 - DNA, 13 bp, D. melanogaster
catttgctgcatt

SEQ ID NO: 606965 - DNA, 13 bp, D. melanogaster
catttgctggcat

SEQ ID NO: 606966 - DNA, 13 bp, D. melanogaster
catttgcttgaaa

SEQ ID NO: 606967 - DNA, 13 bp, D. melanogaster
catttgcttggct

SEQ ID NO: 606968 - DNA, 13 bp, D. melanogaster
catttgctttaaa

SEQ ID NO: 606969 - DNA, 13 bp, D. melanogaster
catttgcttttct

SEQ ID NO: 606970 - DNA, 14 bp, D. melanogaster
catttgcttttgtt

SEQ ID NO: 606971 - DNA, 13 bp, D. melanogaster
catttggaaacat

SEQ ID NO: 606972 - DNA, 13 bp, D. melanogaster
catttggaaatta

SEQ ID NO: 606973 - DNA, 13 bp, D. melanogaster
catttggaatgca

SEQ ID NO: 606974 - DNA, 13 bp, D. melanogaster
catttggatttgg

SEQ ID NO: 606975 - DNA, 13 bp, D. melanogaster
catttggcaaacg

SEQ ID NO: 606976 - DNA, 14 bp, D. melanogaster
catttggcaaattg

SEQ ID NO: 606977 - DNA, 13 bp, D. melanogaster
catttggcaataa

SEQ ID NO: 606978 - DNA, 13 bp, D. melanogaster
catttggcactct

SEQ ID NO: 606979 - DNA, 13 bp, D. melanogaster
catttggcacttg

SEQ ID NO: 606980 - DNA, 13 bp, D. melanogaster
catttggcagcca

SEQ ID NO: 606981 - DNA, 13 bp, D. melanogaster
catttggcaggca

SEQ ID NO: 606982 - DNA, 13 bp, D. melanogaster
catttggcataat

SEQ ID NO: 606983 - DNA, 13 bp, D. melanogaster
catttggcattca

SEQ ID NO: 606984 - DNA, 13 bp, D. melanogaster
catttggcatttg

SEQ ID NO: 606985 - DNA, 13 bp, D. melanogaster
catttggcatttt

SEQ ID NO: 606986 - DNA, 13 bp, D. melanogaster
catttggccaaca

SEQ ID NO: 606987 - DNA, 13 bp, D. melanogaster
catttggccaacg

SEQ ID NO: 606988 - DNA, 13 bp, D. melanogaster
catttggccacaa

SEQ ID NO: 606989 - DNA, 13 bp, D. melanogaster
catttggccagaa

SEQ ID NO: 606990 - DNA, 13 bp, D. melanogaster
catttggccagcg

SEQ ID NO: 606991 - DNA, 13 bp, D. melanogaster
catttggccataa

SEQ ID NO: 606992 - DNA, 13 bp, D. melanogaster
catttggccattt

SEQ ID NO: 606993 - DNA, 13 bp, D. melanogaster
catttggcgaaaa

SEQ ID NO: 606994 - DNA, 13 bp, D. melanogaster
catttggctggca

SEQ ID NO: 606995 - DNA, 13 bp, D. melanogaster
catttggctggct

SEQ ID NO: 606996 - DNA, 14 bp, D. melanogaster
catttggctttggc

SEQ ID NO: 606997 - DNA, 13 bp, D. melanogaster
catttggcttttg

SEQ ID NO: 606998 - DNA, 13 bp, D. melanogaster
catttgggcttaa

SEQ ID NO: 606999 - DNA, 13 bp, D. melanogaster
catttgggtttgg

SEQ ID NO: 607000 - DNA, 13 bp, D. melanogaster
catttggtcaatc

SEQ ID NO: 607001 - DNA, 14 bp, D. melanogaster
catttggttaccat

SEQ ID NO: 607002 - DNA, 13 bp, D. melanogaster
catttggtttcgt

SEQ ID NO: 607003 - DNA, 13 bp, D. melanogaster
catttggttttca

SEQ ID NO: 607004 - DNA, 13 bp, D. melanogaster
catttgtaaaaaa

SEQ ID NO: 607005 - DNA, 13 bp, D. melanogaster
catttgtaaaata

SEQ ID NO: 607006 - DNA, 13 bp, D. melanogaster
catttgtaaataa

SEQ ID NO: 607007 - DNA, 13 bp, D. melanogaster
catttgtaaatat

SEQ ID NO: 607008 - DNA, 13 bp, D. melanogaster
catttgtacatat

SEQ ID NO: 607009 - DNA, 13 bp, D. melanogaster
catttgtacattt

SEQ ID NO: 607010 - DNA, 13 bp, D. melanogaster
catttgtactttg

SEQ ID NO: 607011 - DNA, 13 bp, D. melanogaster
catttgtatattt

SEQ ID NO: 607012 - DNA, 13 bp, D. melanogaster
catttgtatctgc

SEQ ID NO: 607013 - DNA, 13 bp, D. melanogaster
catttgtatgtaa

SEQ ID NO: 607014 - DNA, 13 bp, D. melanogaster
catttgtatgtgt

SEQ ID NO: 607015 - DNA, 13 bp, D. melanogaster
catttgtattaaa

SEQ ID NO: 607016 - DNA, 13 bp, D. melanogaster
catttgtatttat

SEQ ID NO: 607017 - DNA, 13 bp, D. melanogaster
catttgtatttct

SEQ ID NO: 607018 - DNA, 13 bp, D. melanogaster
catttgtatttgt

SEQ ID NO: 607019 - DNA, 14 bp, D. melanogaster
catttgtatttgta

SEQ ID NO: 607020 - DNA, 13 bp, D. melanogaster
catttgtattttg

SEQ ID NO: 607021 - DNA, 13 bp, D. melanogaster
catttgtccattt

SEQ ID NO: 607022 - DNA, 13 bp, D. melanogaster
catttgtctagtt

SEQ ID NO: 607023 - DNA, 13 bp, D. melanogaster
catttgtgaaaat

SEQ ID NO: 607024 - DNA, 13 bp, D. melanogaster
catttgtgaccca

SEQ ID NO: 607025 - DNA, 13 bp, D. melanogaster
catttgtgatttt

SEQ ID NO: 607026 - DNA, 13 bp, D. melanogaster
catttgtgcattt

SEQ ID NO: 607027 - DNA, 13 bp, D. melanogaster
catttgtgtccca

SEQ ID NO: 607028 - DNA, 13 bp, D. melanogaster
catttgtgtttgt

SEQ ID NO: 607029 - DNA, 13 bp, D. melanogaster
catttgttaatta

SEQ ID NO: 607030 - DNA, 13 bp, D. melanogaster
catttgttattat

SEQ ID NO: 607031 - DNA, 13 bp, D. melanogaster
catttgttattgt

SEQ ID NO: 607032 - DNA, 13 bp, D. melanogaster
catttgttcaaat

SEQ ID NO: 607033 - DNA, 13 bp, D. melanogaster
catttgttgagca

SEQ ID NO: 607034 - DNA, 14 bp, D. melanogaster
catttgttgagcat

SEQ ID NO: 607035 - DNA, 13 bp, D. melanogaster
catttgttgcctt

SEQ ID NO: 607036 - DNA, 13 bp, D. melanogaster
catttgttgctat

SEQ ID NO: 607037 - DNA, 13 bp, D. melanogaster
catttgttgcttt

SEQ ID NO: 607038 - DNA, 13 bp, D. melanogaster
catttgttggttt

SEQ ID NO: 607039 - DNA, 13 bp, D. melanogaster
catttgttgttcg

SEQ ID NO: 607040 - DNA, 13 bp, D. melanogaster
catttgttgttct

SEQ ID NO: 607041 - DNA, 13 bp, D. melanogaster
catttgttgttgc

SEQ ID NO: 607042 - DNA, 14 bp, D. melanogaster
catttgttgttgcc

SEQ ID NO: 607043 - DNA, 13 bp, D. melanogaster
catttgtttaatt

SEQ ID NO: 607044 - DNA, 14 bp, D. melanogaster
catttgtttgcatt

SEQ ID NO: 607045 - DNA, 13 bp, D. melanogaster
catttgtttgcca

SEQ ID NO: 607046 - DNA, 14 bp, D. melanogaster
catttgtttgccaa

SEQ ID NO: 607047 - DNA, 13 bp, D. melanogaster
catttgtttggct

SEQ ID NO: 607048 - DNA, 14 bp, D. melanogaster
catttgtttggctt

SEQ ID NO: 607049 - DNA, 13 bp, D. melanogaster
catttgttttccc

SEQ ID NO: 607050 - DNA, 13 bp, D. melanogaster
catttgttttctg

SEQ ID NO: 607051 - DNA, 14 bp, D. melanogaster
catttgttttggtt

SEQ ID NO: 607052 - DNA, 13 bp, D. melanogaster
catttgttttgta

SEQ ID NO: 607053 - DNA, 13 bp, D. melanogaster
catttgtttttcc

SEQ ID NO: 607054 - DNA, 13 bp, D. melanogaster
cattttaaaaact

SEQ ID NO: 607055 - DNA, 13 bp, D. melanogaster
cattttaaaactg

SEQ ID NO: 607056 - DNA, 13 bp, D. melanogaster
cattttaaaatca

SEQ ID NO: 607057 - DNA, 13 bp, D. melanogaster
cattttaaagaaa

SEQ ID NO: 607058 - DNA, 13 bp, D. melanogaster
cattttaaagcaa

SEQ ID NO: 607059 - DNA, 13 bp, D. melanogaster
cattttaaagttt

SEQ ID NO: 607060 - DNA, 13 bp, D. melanogaster
cattttaaataac

SEQ ID NO: 607061 - DNA, 13 bp, D. melanogaster
cattttaaatcaa

SEQ ID NO: 607062 - DNA, 13 bp, D. melanogaster
cattttaaatgat

SEQ ID NO: 607063 - DNA, 13 bp, D. melanogaster
cattttaaatgca

SEQ ID NO: 607064 - DNA, 14 bp, D. melanogaster
cattttaaatgttt

SEQ ID NO: 607065 - DNA, 13 bp, D. melanogaster
cattttaaattac

SEQ ID NO: 607066 - DNA, 13 bp, D. melanogaster
cattttaaattgt

SEQ ID NO: 607067 - DNA, 13 bp, D. melanogaster
cattttaacaaat

SEQ ID NO: 607068 - DNA, 13 bp, D. melanogaster
cattttaacaatt

SEQ ID NO: 607069 - DNA, 13 bp, D. melanogaster
cattttaacttaa

SEQ ID NO: 607070 - DNA, 13 bp, D. melanogaster
cattttaagcatt

SEQ ID NO: 607071 - DNA, 13 bp, D. melanogaster
cattttaagtaat

SEQ ID NO: 607072 - DNA, 13 bp, D. melanogaster
cattttaagttaa

SEQ ID NO: 607073 - DNA, 13 bp, D. melanogaster
cattttaatagtt

SEQ ID NO: 607074 - DNA, 13 bp, D. melanogaster
cattttaatgcaa

SEQ ID NO: 607075 - DNA, 13 bp, D. melanogaster
cattttaatggcc

SEQ ID NO: 607076 - DNA, 13 bp, D. melanogaster
cattttaatgttt

SEQ ID NO: 607077 - DNA, 14 bp, D. melanogaster
cattttaattgcca

SEQ ID NO: 607078 - DNA, 13 bp, D. melanogaster
cattttaattgga

SEQ ID NO: 607079 - DNA, 13 bp, D. melanogaster
cattttaattggt

SEQ ID NO: 607080 - DNA, 13 bp, D. melanogaster
cattttaattgtg

SEQ ID NO: 607081 - DNA, 13 bp, D. melanogaster
cattttaattgtt

SEQ ID NO: 607082 - DNA, 13 bp, D. melanogaster
cattttaatttcc

SEQ ID NO: 607083 - DNA, 13 bp, D. melanogaster
cattttacaaaaa

SEQ ID NO: 607084 - DNA, 13 bp, D. melanogaster
cattttacaatat

SEQ ID NO: 607085 - DNA, 13 bp, D. melanogaster
cattttacattaa

SEQ ID NO: 607086 - DNA, 13 bp, D. melanogaster
cattttacatttg

SEQ ID NO: 607087 - DNA, 14 bp, D. melanogaster
cattttaccatttt

SEQ ID NO: 607088 - DNA, 13 bp, D. melanogaster
cattttactttaa

SEQ ID NO: 607089 - DNA, 13 bp, D. melanogaster
cattttacttttg

SEQ ID NO: 607090 - DNA, 14 bp, D. melanogaster
cattttagaggaaa

SEQ ID NO: 607091 - DNA, 13 bp, D. melanogaster
cattttagtttcg

SEQ ID NO: 607092 - DNA, 14 bp, D. melanogaster
cattttagtttgtt

SEQ ID NO: 607093 - DNA, 13 bp, D. melanogaster
cattttataaact

SEQ ID NO: 607094 - DNA, 13 bp, D. melanogaster
cattttataactt

SEQ ID NO: 607095 - DNA, 13 bp, D. melanogaster
cattttatatatc

SEQ ID NO: 607096 - DNA, 13 bp, D. melanogaster
cattttatgtatt

SEQ ID NO: 607097 - DNA, 13 bp, D. melanogaster
cattttatgtgca

SEQ ID NO: 607098 - DNA, 13 bp, D. melanogaster
cattttattaagt

SEQ ID NO: 607099 - DNA, 13 bp, D. melanogaster
cattttattagat

SEQ ID NO: 607100 - DNA, 13 bp, D. melanogaster
cattttattcaaa

SEQ ID NO: 607101 - DNA, 13 bp, D. melanogaster
cattttattgatt

SEQ ID NO: 607102 - DNA, 13 bp, D. melanogaster
cattttattggca

SEQ ID NO: 607103 - DNA, 13 bp, D. melanogaster
cattttattggcc

SEQ ID NO: 607104 - DNA, 13 bp, D. melanogaster
cattttattggct

SEQ ID NO: 607105 - DNA, 13 bp, D. melanogaster
cattttatttaac

SEQ ID NO: 607106 - DNA, 14 bp, D. melanogaster
cattttatttccat

SEQ ID NO: 607107 - DNA, 14 bp, D. melanogaster
cattttatttccca

SEQ ID NO: 607108 - DNA, 13 bp, D. melanogaster
cattttatttgca

SEQ ID NO: 607109 - DNA, 13 bp, D. melanogaster
cattttatttgcc

SEQ ID NO: 607110 - DNA, 13 bp, D. melanogaster
cattttcaaaatt

SEQ ID NO: 607111 - DNA, 13 bp, D. melanogaster
cattttcaacagc

SEQ ID NO: 607112 - DNA, 13 bp, D. melanogaster
cattttcaagtgc

SEQ ID NO: 607113 - DNA, 13 bp, D. melanogaster
cattttcaataat

SEQ ID NO: 607114 - DNA, 13 bp, D. melanogaster
cattttcaatagt

SEQ ID NO: 607115 - DNA, 13 bp, D. melanogaster
cattttcaattaa

SEQ ID NO: 607116 - DNA, 14 bp, D. melanogaster
cattttcaattaat

SEQ ID NO: 607117 - DNA, 13 bp, D. melanogaster
cattttcaattgc

SEQ ID NO: 607118 - DNA, 13 bp, D. melanogaster
cattttcaatttg

SEQ ID NO: 607119 - DNA, 13 bp, D. melanogaster
cattttcacatcg

SEQ ID NO: 607120 - DNA, 13 bp, D. melanogaster
cattttcacattt

SEQ ID NO: 607121 - DNA, 14 bp, D. melanogaster
cattttcacatttt

SEQ ID NO: 607122 - DNA, 13 bp, D. melanogaster
cattttcactttc

SEQ ID NO: 607123 - DNA, 13 bp, D. melanogaster
cattttcataaac

SEQ ID NO: 607124 - DNA, 13 bp, D. melanogaster
cattttcataaat

SEQ ID NO: 607125 - DNA, 13 bp, D. melanogaster
cattttcataatt

SEQ ID NO: 607126 - DNA, 13 bp, D. melanogaster
cattttcatggca

SEQ ID NO: 607127 - DNA, 13 bp, D. melanogaster
cattttcatgttt

SEQ ID NO: 607128 - DNA, 14 bp, D. melanogaster
cattttcatgtttt

SEQ ID NO: 607129 - DNA, 13 bp, D. melanogaster
cattttcattaaa

SEQ ID NO: 607130 - DNA, 13 bp, D. melanogaster
cattttcattagc

SEQ ID NO: 607131 - DNA, 13 bp, D. melanogaster
cattttcattcca

SEQ ID NO: 607132 - DNA, 13 bp, D. melanogaster
cattttcattctc

SEQ ID NO: 607133 - DNA, 13 bp, D. melanogaster
cattttcatttaa

SEQ ID NO: 607134 - DNA, 13 bp, D. melanogaster
cattttcatttcc

SEQ ID NO: 607135 - DNA, 13 bp, D. melanogaster
cattttcatttcg

SEQ ID NO: 607136 - DNA, 14 bp, D. melanogaster
cattttcatttcgc

SEQ ID NO: 607137 - DNA, 13 bp, D. melanogaster
cattttcatttgc

SEQ ID NO: 607138 - DNA, 14 bp, D. melanogaster
cattttcatttgca

SEQ ID NO: 607139 - DNA, 13 bp, D. melanogaster
cattttcatttgt

SEQ ID NO: 607140 - DNA, 14 bp, D. melanogaster
cattttcattttca

SEQ ID NO: 607141 - DNA, 13 bp, D. melanogaster
cattttccaaaag

SEQ ID NO: 607142 - DNA, 13 bp, D. melanogaster
cattttccaaaca

SEQ ID NO: 607143 - DNA, 13 bp, D. melanogaster
cattttccaagcc

SEQ ID NO: 607144 - DNA, 13 bp, D. melanogaster
cattttccaattg

SEQ ID NO: 607145 - DNA, 14 bp, D. melanogaster
cattttccacattt

SEQ ID NO: 607146 - DNA, 13 bp, D. melanogaster
cattttccaccat

SEQ ID NO: 607147 - DNA, 13 bp, D. melanogaster
cattttccaccca

SEQ ID NO: 607148 - DNA, 13 bp, D. melanogaster
cattttccaccgc

SEQ ID NO: 607149 - DNA, 13 bp, D. melanogaster
cattttccacctg

SEQ ID NO: 607150 - DNA, 13 bp, D. melanogaster
cattttccagctt

SEQ ID NO: 607151 - DNA, 13 bp, D. melanogaster
cattttccagtgc

SEQ ID NO: 607152 - DNA, 13 bp, D. melanogaster
cattttccagttc

SEQ ID NO: 607153 - DNA, 13 bp, D. melanogaster
cattttccagttg

SEQ ID NO: 607154 - DNA, 13 bp, D. melanogaster
cattttccagttt

SEQ ID NO: 607155 - DNA, 13 bp, D. melanogaster
cattttccatatt

SEQ ID NO: 607156 - DNA, 13 bp, D. melanogaster
cattttccatctc

SEQ ID NO: 607157 - DNA, 13 bp, D. melanogaster
cattttccattaa

SEQ ID NO: 607158 - DNA, 13 bp, D. melanogaster
cattttccattca

SEQ ID NO: 607159 - DNA, 14 bp, D. melanogaster
cattttccattcca

SEQ ID NO: 607160 - DNA, 13 bp, D. melanogaster
cattttccatttc

SEQ ID NO: 607161 - DNA, 14 bp, D. melanogaster
cattttccatttcg

SEQ ID NO: 607162 - DNA, 13 bp, D. melanogaster
cattttcccagca

SEQ ID NO: 607163 - DNA, 13 bp, D. melanogaster
cattttcccagct

SEQ ID NO: 607164 - DNA, 13 bp, D. melanogaster
cattttcccaggc

SEQ ID NO: 607165 - DNA, 13 bp, D. melanogaster
cattttccccaac

SEQ ID NO: 607166 - DNA, 14 bp, D. melanogaster
cattttccccactt

SEQ ID NO: 607167 - DNA, 13 bp, D. melanogaster
cattttccccatc

SEQ ID NO: 607168 - DNA, 13 bp, D. melanogaster
cattttccccatt

SEQ ID NO: 607169 - DNA, 14 bp, D. melanogaster
cattttccccattt

SEQ ID NO: 607170 - DNA, 13 bp, D. melanogaster
cattttcccccat

SEQ ID NO: 607171 - DNA, 13 bp, D. melanogaster
cattttccccgcc

SEQ ID NO: 607172 - DNA, 13 bp, D. melanogaster
cattttccctgct

SEQ ID NO: 607173 - DNA, 13 bp, D. melanogaster
cattttccgaaaa

SEQ ID NO: 607174 - DNA, 13 bp, D. melanogaster
cattttccgactg

SEQ ID NO: 607175 - DNA, 13 bp, D. melanogaster
cattttccgactt

SEQ ID NO: 607176 - DNA, 13 bp, D. melanogaster
cattttccgcact

SEQ ID NO: 607177 - DNA, 13 bp, D. melanogaster
cattttccgccac

SEQ ID NO: 607178 - DNA, 13 bp, D. melanogaster
cattttccgccat

SEQ ID NO: 607179 - DNA, 13 bp, D. melanogaster
cattttccgctct

SEQ ID NO: 607180 - DNA, 13 bp, D. melanogaster
cattttccgcttt

SEQ ID NO: 607181 - DNA, 14 bp, D. melanogaster
cattttccgctttc

SEQ ID NO: 607182 - DNA, 13 bp, D. melanogaster
cattttccggcca

SEQ ID NO: 607183 - DNA, 13 bp, D. melanogaster
cattttccggctg

SEQ ID NO: 607184 - DNA, 13 bp, D. melanogaster
cattttccgggaa

SEQ ID NO: 607185 - DNA, 13 bp, D. melanogaster
cattttccgtttg

SEQ ID NO: 607186 - DNA, 13 bp, D. melanogaster
cattttcctcatt

SEQ ID NO: 607187 - DNA, 13 bp, D. melanogaster
cattttcctcgcc

SEQ ID NO: 607188 - DNA, 13 bp, D. melanogaster
cattttcctgcca

SEQ ID NO: 607189 - DNA, 13 bp, D. melanogaster
cattttcctgccc

SEQ ID NO: 607190 - DNA, 13 bp, D. melanogaster
cattttcctgctg

SEQ ID NO: 607191 - DNA, 13 bp, D. melanogaster
cattttcctgctt

SEQ ID NO: 607192 - DNA, 13 bp, D. melanogaster
cattttcctggcc

SEQ ID NO: 607193 - DNA, 13 bp, D. melanogaster
cattttcctttca

SEQ ID NO: 607194 - DNA, 13 bp, D. melanogaster
cattttcctttcg

SEQ ID NO: 607195 - DNA, 13 bp, D. melanogaster
cattttcgaaaaa

SEQ ID NO: 607196 - DNA, 13 bp, D. melanogaster
cattttcgaattt

SEQ ID NO: 607197 - DNA, 13 bp, D. melanogaster
cattttcgataag

SEQ ID NO: 607198 - DNA, 13 bp, D. melanogaster
cattttcgataat

SEQ ID NO: 607199 - DNA, 13 bp, D. melanogaster
cattttcgatttt

SEQ ID NO: 607200 - DNA, 13 bp, D. melanogaster
cattttcgcattt

SEQ ID NO: 607201 - DNA, 13 bp, D. melanogaster
cattttcgccaaa

SEQ ID NO: 607202 - DNA, 13 bp, D. melanogaster
cattttcgccagc

SEQ ID NO: 607203 - DNA, 13 bp, D. melanogaster
cattttcgccatt

SEQ ID NO: 607204 - DNA, 13 bp, D. melanogaster
cattttcgctttc

SEQ ID NO: 607205 - DNA, 13 bp, D. melanogaster
cattttcggcatt

SEQ ID NO: 607206 - DNA, 13 bp, D. melanogaster
cattttcggctgc

SEQ ID NO: 607207 - DNA, 13 bp, D. melanogaster
cattttcggtaag

SEQ ID NO: 607208 - DNA, 13 bp, D. melanogaster
cattttcgttggc

SEQ ID NO: 607209 - DNA, 13 bp, D. melanogaster
cattttcgtttta

SEQ ID NO: 607210 - DNA, 13 bp, D. melanogaster
cattttctaatta

SEQ ID NO: 607211 - DNA, 13 bp, D. melanogaster
cattttctataag

SEQ ID NO: 607212 - DNA, 13 bp, D. melanogaster
cattttctccatt

SEQ ID NO: 607213 - DNA, 13 bp, D. melanogaster
cattttctcgcag

SEQ ID NO: 607214 - DNA, 14 bp, D. melanogaster
cattttctgacttg

SEQ ID NO: 607215 - DNA, 13 bp, D. melanogaster
cattttcttgctg

SEQ ID NO: 607216 - DNA, 13 bp, D. melanogaster
cattttcttgttc

SEQ ID NO: 607217 - DNA, 13 bp, D. melanogaster
cattttctttaaa

SEQ ID NO: 607218 - DNA, 13 bp, D. melanogaster
cattttctttcag

SEQ ID NO: 607219 - DNA, 13 bp, D. melanogaster
cattttctttggc

SEQ ID NO: 607220 - DNA, 13 bp, D. melanogaster
cattttctttgtg

SEQ ID NO: 607221 - DNA, 14 bp, D. melanogaster
cattttgaaaaatg

SEQ ID NO: 607222 - DNA, 13 bp, D. melanogaster
cattttgaaaagt

SEQ ID NO: 607223 - DNA, 13 bp, D. melanogaster
cattttgaaaatg

SEQ ID NO: 607224 - DNA, 13 bp, D. melanogaster
cattttgaaaatt

SEQ ID NO: 607225 - DNA, 13 bp, D. melanogaster
cattttgaaactt

SEQ ID NO: 607226 - DNA, 13 bp, D. melanogaster
cattttgaacatt

SEQ ID NO: 607227 - DNA, 13 bp, D. melanogaster
cattttgaacttt

SEQ ID NO: 607228 - DNA, 13 bp, D. melanogaster
cattttgaatata

SEQ ID NO: 607229 - DNA, 13 bp, D. melanogaster
cattttgaatgcc

SEQ ID NO: 607230 - DNA, 13 bp, D. melanogaster
cattttgaattat

SEQ ID NO: 607231 - DNA, 13 bp, D. melanogaster
cattttgaattcc

SEQ ID NO: 607232 - DNA, 13 bp, D. melanogaster
cattttgacaaat

SEQ ID NO: 607233 - DNA, 13 bp, D. melanogaster
cattttgactggc

SEQ ID NO: 607234 - DNA, 13 bp, D. melanogaster
cattttgactttt

SEQ ID NO: 607235 - DNA, 13 bp, D. melanogaster
cattttgagagtt

SEQ ID NO: 607236 - DNA, 13 bp, D. melanogaster
cattttgatcttt

SEQ ID NO: 607237 - DNA, 13 bp, D. melanogaster
cattttgatggat

SEQ ID NO: 607238 - DNA, 13 bp, D. melanogaster
cattttgatggca

SEQ ID NO: 607239 - DNA, 13 bp, D. melanogaster
cattttgattaaa

SEQ ID NO: 607240 - DNA, 14 bp, D. melanogaster
cattttgattgatt

SEQ ID NO: 607241 - DNA, 13 bp, D. melanogaster
cattttgatttcc

SEQ ID NO: 607242 - DNA, 13 bp, D. melanogaster
cattttgatttga

SEQ ID NO: 607243 - DNA, 13 bp, D. melanogaster
cattttgatttgc

SEQ ID NO: 607244 - DNA, 14 bp, D. melanogaster
cattttgattttga

SEQ ID NO: 607245 - DNA, 13 bp, D. melanogaster
cattttgcaaaag

SEQ ID NO: 607246 - DNA, 14 bp, D. melanogaster
cattttgcaaaagt

SEQ ID NO: 607247 - DNA, 13 bp, D. melanogaster
cattttgcaaatt

SEQ ID NO: 607248 - DNA, 14 bp, D. melanogaster
cattttgcaatatt

SEQ ID NO: 607249 - DNA, 13 bp, D. melanogaster
cattttgcaatgg

SEQ ID NO: 607250 - DNA, 13 bp, D. melanogaster
cattttgcaatta

SEQ ID NO: 607251 - DNA, 14 bp, D. melanogaster
cattttgcaattat

SEQ ID NO: 607252 - DNA, 13 bp, D. melanogaster
cattttgcacttt

SEQ ID NO: 607253 - DNA, 13 bp, D. melanogaster
cattttgcagttg

SEQ ID NO: 607254 - DNA, 13 bp, D. melanogaster
cattttgcataca

SEQ ID NO: 607255 - DNA, 14 bp, D. melanogaster
cattttgcatattt

SEQ ID NO: 607256 - DNA, 13 bp, D. melanogaster
cattttgcatgcc

SEQ ID NO: 607257 - DNA, 13 bp, D. melanogaster
cattttgcatgtt

SEQ ID NO: 607258 - DNA, 13 bp, D. melanogaster
cattttgcattcg

SEQ ID NO: 607259 - DNA, 14 bp, D. melanogaster
cattttgcatttaa

SEQ ID NO: 607260 - DNA, 14 bp, D. melanogaster
cattttgcatttgc

SEQ ID NO: 607261 - DNA, 13 bp, D. melanogaster
cattttgcatttt

SEQ ID NO: 607262 - DNA, 14 bp, D. melanogaster
cattttgcattttg

SEQ ID NO: 607263 - DNA, 13 bp, D. melanogaster
cattttgccactt

SEQ ID NO: 607264 - DNA, 13 bp, D. melanogaster
cattttgccagct

SEQ ID NO: 607265 - DNA, 13 bp, D. melanogaster
cattttgccgctt

SEQ ID NO: 607266 - DNA, 13 bp, D. melanogaster
cattttgcctttg

SEQ ID NO: 607267 - DNA, 13 bp, D. melanogaster
cattttgcgtttg

SEQ ID NO: 607268 - DNA, 13 bp, D. melanogaster
cattttgctaatt

SEQ ID NO: 607269 - DNA, 13 bp, D. melanogaster
cattttgctcaat

SEQ ID NO: 607270 - DNA, 13 bp, D. melanogaster
cattttgctgccg

SEQ ID NO: 607271 - DNA, 13 bp, D. melanogaster
cattttgctggcc

SEQ ID NO: 607272 - DNA, 13 bp, D. melanogaster
cattttgcttttg

SEQ ID NO: 607273 - DNA, 13 bp, D. melanogaster
cattttggaaaaa

SEQ ID NO: 607274 - DNA, 13 bp, D. melanogaster
cattttggaaatt

SEQ ID NO: 607275 - DNA, 13 bp, D. melanogaster
cattttggattat

SEQ ID NO: 607276 - DNA, 13 bp, D. melanogaster
cattttggatttg

SEQ ID NO: 607277 - DNA, 13 bp, D. melanogaster
cattttggcaaca

SEQ ID NO: 607278 - DNA, 13 bp, D. melanogaster
cattttggcaatt

SEQ ID NO: 607279 - DNA, 13 bp, D. melanogaster
cattttggcagaa

SEQ ID NO: 607280 - DNA, 13 bp, D. melanogaster
cattttggcagca

SEQ ID NO: 607281 - DNA, 13 bp, D. melanogaster
cattttggcattt

SEQ ID NO: 607282 - DNA, 14 bp, D. melanogaster
cattttggccaaaa

SEQ ID NO: 607283 - DNA, 13 bp, D. melanogaster
cattttggccaac

SEQ ID NO: 607284 - DNA, 13 bp, D. melanogaster
cattttggccaat

SEQ ID NO: 607285 - DNA, 13 bp, D. melanogaster
cattttggccaca

SEQ ID NO: 607286 - DNA, 13 bp, D. melanogaster
cattttggccatt

SEQ ID NO: 607287 - DNA, 14 bp, D. melanogaster
cattttggccattt

SEQ ID NO: 607288 - DNA, 13 bp, D. melanogaster
cattttggctttg

SEQ ID NO: 607289 - DNA, 13 bp, D. melanogaster
cattttggggcaa

SEQ ID NO: 607290 - DNA, 13 bp, D. melanogaster
cattttgggtata

SEQ ID NO: 607291 - DNA, 13 bp, D. melanogaster
cattttggtattt

SEQ ID NO: 607292 - DNA, 13 bp, D. melanogaster
cattttggtgttt

SEQ ID NO: 607293 - DNA, 14 bp, D. melanogaster
cattttggtgtttc

SEQ ID NO: 607294 - DNA, 13 bp, D. melanogaster
cattttgtaaaat

SEQ ID NO: 607295 - DNA, 13 bp, D. melanogaster
cattttgtaaatg

SEQ ID NO: 607296 - DNA, 13 bp, D. melanogaster
cattttgtaattt

SEQ ID NO: 607297 - DNA, 13 bp, D. melanogaster
cattttgtacttt

SEQ ID NO: 607298 - DNA, 13 bp, D. melanogaster
cattttgtattat

SEQ ID NO: 607299 - DNA, 13 bp, D. melanogaster
cattttgtcaaat

SEQ ID NO: 607300 - DNA, 14 bp, D. melanogaster
cattttgtccgttt

SEQ ID NO: 607301 - DNA, 13 bp, D. melanogaster
cattttgtgatta

SEQ ID NO: 607302 - DNA, 13 bp, D. melanogaster
cattttgtgcaac

SEQ ID NO: 607303 - DNA, 13 bp, D. melanogaster
cattttgtgcaat

SEQ ID NO: 607304 - DNA, 13 bp, D. melanogaster
cattttgtggcaa

SEQ ID NO: 607305 - DNA, 13 bp, D. melanogaster
cattttgtggcat

SEQ ID NO: 607306 - DNA, 13 bp, D. melanogaster
cattttgtggcca

SEQ ID NO: 607307 - DNA, 13 bp, D. melanogaster
cattttgtggcgc

SEQ ID NO: 607308 - DNA, 13 bp, D. melanogaster
cattttgtggctg

SEQ ID NO: 607309 - DNA, 13 bp, D. melanogaster
cattttgtgtact

SEQ ID NO: 607310 - DNA, 13 bp, D. melanogaster
cattttgtgtatt

SEQ ID NO: 607311 - DNA, 13 bp, D. melanogaster
cattttgtgtggc

SEQ ID NO: 607312 - DNA, 13 bp, D. melanogaster
cattttgtgtgtg

SEQ ID NO: 607313 - DNA, 13 bp, D. melanogaster
cattttgttcatt

SEQ ID NO: 607314 - DNA, 13 bp, D. melanogaster
cattttgttcgtt

SEQ ID NO: 607315 - DNA, 13 bp, D. melanogaster
cattttgttgcaa

SEQ ID NO: 607316 - DNA, 13 bp, D. melanogaster
cattttgttgccg

SEQ ID NO: 607317 - DNA, 14 bp, D. melanogaster
cattttgttggcca

SEQ ID NO: 607318 - DNA, 13 bp, D. melanogaster
cattttgttgttg

SEQ ID NO: 607319 - DNA, 13 bp, D. melanogaster
cattttgtttact

SEQ ID NO: 607320 - DNA, 13 bp, D. melanogaster
cattttgtttata

SEQ ID NO: 607321 - DNA, 14 bp, D. melanogaster
cattttgtttataa

SEQ ID NO: 607322 - DNA, 13 bp, D. melanogaster
cattttgtttgca

SEQ ID NO: 607323 - DNA, 13 bp, D. melanogaster
cattttgtttgct

SEQ ID NO: 607324 - DNA, 13 bp, D. melanogaster
cattttgtttggc

SEQ ID NO: 607325 - DNA, 14 bp, D. melanogaster
cattttgtttggtt

SEQ ID NO: 607326 - DNA, 13 bp, D. melanogaster
cattttgtttgtg

SEQ ID NO: 607327 - DNA, 13 bp, D. melanogaster
cattttgttttcc

SEQ ID NO: 607328 - DNA, 13 bp, D. melanogaster
catttttaaaagt

SEQ ID NO: 607329 - DNA, 13 bp, D. melanogaster
catttttaaaatg

SEQ ID NO: 607330 - DNA, 13 bp, D. melanogaster
catttttaaagca

SEQ ID NO: 607331 - DNA, 13 bp, D. melanogaster
catttttaaatga

SEQ ID NO: 607332 - DNA, 13 bp, D. melanogaster
catttttaacgtt

SEQ ID NO: 607333 - DNA, 13 bp, D. melanogaster
catttttaagtaa

SEQ ID NO: 607334 - DNA, 13 bp, D. melanogaster
catttttaatcaa

SEQ ID NO: 607335 - DNA, 14 bp, D. melanogaster
catttttaatcaac

SEQ ID NO: 607336 - DNA, 13 bp, D. melanogaster
catttttaatgtt

SEQ ID NO: 607337 - DNA, 14 bp, D. melanogaster
catttttaattaag

SEQ ID NO: 607338 - DNA, 13 bp, D. melanogaster
catttttaattgt

SEQ ID NO: 607339 - DNA, 13 bp, D. melanogaster
catttttaatttg

SEQ ID NO: 607340 - DNA, 13 bp, D. melanogaster
catttttacaatt

SEQ ID NO: 607341 - DNA, 13 bp, D. melanogaster
catttttagacaa

SEQ ID NO: 607342 - DNA, 13 bp, D. melanogaster
catttttagcagc

SEQ ID NO: 607343 - DNA, 13 bp, D. melanogaster
catttttagccaa

SEQ ID NO: 607344 - DNA, 13 bp, D. melanogaster
catttttagcttt

SEQ ID NO: 607345 - DNA, 13 bp, D. melanogaster
catttttataagt

SEQ ID NO: 607346 - DNA, 13 bp, D. melanogaster
catttttatacaa

SEQ ID NO: 607347 - DNA, 13 bp, D. melanogaster
catttttataccc

SEQ ID NO: 607348 - DNA, 14 bp, D. melanogaster
catttttatacccg

SEQ ID NO: 607349 - DNA, 13 bp, D. melanogaster
catttttatagat

SEQ ID NO: 607350 - DNA, 13 bp, D. melanogaster
catttttatagca

SEQ ID NO: 607351 - DNA, 13 bp, D. melanogaster
catttttatcata

SEQ ID NO: 607352 - DNA, 13 bp, D. melanogaster
catttttatgaaa

SEQ ID NO: 607353 - DNA, 14 bp, D. melanogaster
catttttatgattt

SEQ ID NO: 607354 - DNA, 13 bp, D. melanogaster
catttttattcag

SEQ ID NO: 607355 - DNA, 13 bp, D. melanogaster
catttttattgcc

SEQ ID NO: 607356 - DNA, 13 bp, D. melanogaster
catttttattgta

SEQ ID NO: 607357 - DNA, 13 bp, D. melanogaster
catttttatttcg

SEQ ID NO: 607358 - DNA, 14 bp, D. melanogaster
catttttcaaaatg

SEQ ID NO: 607359 - DNA, 13 bp, D. melanogaster
catttttcaaagt

SEQ ID NO: 607360 - DNA, 13 bp, D. melanogaster
catttttcaaatc

SEQ ID NO: 607361 - DNA, 13 bp, D. melanogaster
catttttcaaatg

SEQ ID NO: 607362 - DNA, 13 bp, D. melanogaster
catttttcacacc

SEQ ID NO: 607363 - DNA, 13 bp, D. melanogaster
catttttcaccaa

SEQ ID NO: 607364 - DNA, 13 bp, D. melanogaster
catttttcactca

SEQ ID NO: 607365 - DNA, 13 bp, D. melanogaster
catttttcacttg

SEQ ID NO: 607366 - DNA, 13 bp, D. melanogaster
catttttcagctg

SEQ ID NO: 607367 - DNA, 13 bp, D. melanogaster
catttttcatgca

SEQ ID NO: 607368 - DNA, 13 bp, D. melanogaster
catttttcatgtg

SEQ ID NO: 607369 - DNA, 13 bp, D. melanogaster
catttttccgccc

SEQ ID NO: 607370 - DNA, 13 bp, D. melanogaster
catttttcgaaaa

SEQ ID NO: 607371 - DNA, 13 bp, D. melanogaster
catttttcgaaat

SEQ ID NO: 607372 - DNA, 13 bp, D. melanogaster
catttttcgagtg

SEQ ID NO: 607373 - DNA, 13 bp, D. melanogaster
catttttcgcaaa

SEQ ID NO: 607374 - DNA, 14 bp, D. melanogaster
catttttcgcaaat

SEQ ID NO: 607375 - DNA, 13 bp, D. melanogaster
catttttcgcatt

SEQ ID NO: 607376 - DNA, 13 bp, D. melanogaster
catttttcgccaa

SEQ ID NO: 607377 - DNA, 13 bp, D. melanogaster
catttttctacat

SEQ ID NO: 607378 - DNA, 13 bp, D. melanogaster
catttttctggca

SEQ ID NO: 607379 - DNA, 13 bp, D. melanogaster
catttttctggcc

SEQ ID NO: 607380 - DNA, 13 bp, D. melanogaster
catttttctttcg

SEQ ID NO: 607381 - DNA, 13 bp, D. melanogaster
catttttgaaaaa

SEQ ID NO: 607382 - DNA, 13 bp, D. melanogaster
catttttgaaatg

SEQ ID NO: 607383 - DNA, 13 bp, D. melanogaster
catttttgaacaa

SEQ ID NO: 607384 - DNA, 14 bp, D. melanogaster
catttttgaacaca

SEQ ID NO: 607385 - DNA, 13 bp, D. melanogaster
catttttgaacat

SEQ ID NO: 607386 - DNA, 13 bp, D. melanogaster
catttttgaacca

SEQ ID NO: 607387 - DNA, 14 bp, D. melanogaster
catttttgacattt

SEQ ID NO: 607388 - DNA, 13 bp, D. melanogaster
catttttgagaac

SEQ ID NO: 607389 - DNA, 13 bp, D. melanogaster
catttttgaggcc

SEQ ID NO: 607390 - DNA, 14 bp, D. melanogaster
catttttgaggcca

SEQ ID NO: 607391 - DNA, 13 bp, D. melanogaster
catttttgaggga

SEQ ID NO: 607392 - DNA, 13 bp, D. melanogaster
catttttgataag

SEQ ID NO: 607393 - DNA, 13 bp, D. melanogaster
catttttgcactt

SEQ ID NO: 607394 - DNA, 13 bp, D. melanogaster
catttttgcagtt

SEQ ID NO: 607395 - DNA, 13 bp, D. melanogaster
catttttgcatat

SEQ ID NO: 607396 - DNA, 13 bp, D. melanogaster
catttttgcattt

SEQ ID NO: 607397 - DNA, 13 bp, D. melanogaster
catttttgccaaa

SEQ ID NO: 607398 - DNA, 13 bp, D. melanogaster
catttttgccaac

SEQ ID NO: 607399 - DNA, 14 bp, D. melanogaster
catttttgccattt

SEQ ID NO: 607400 - DNA, 13 bp, D. melanogaster
catttttgcccat

SEQ ID NO: 607401 - DNA, 13 bp, D. melanogaster
catttttgctctc

SEQ ID NO: 607402 - DNA, 13 bp, D. melanogaster
catttttgctgct

SEQ ID NO: 607403 - DNA, 13 bp, D. melanogaster
catttttgcttaa

SEQ ID NO: 607404 - DNA, 13 bp, D. melanogaster
catttttggacaa

SEQ ID NO: 607405 - DNA, 15 bp, D. melanogaster
catttttggacaagg

SEQ ID NO: 607406 - DNA, 13 bp, D. melanogaster
catttttggccaa

SEQ ID NO: 607407 - DNA, 14 bp, D. melanogaster
catttttggccaag

SEQ ID NO: 607408 - DNA, 13 bp, D. melanogaster
catttttgggatt

SEQ ID NO: 607409 - DNA, 13 bp, D. melanogaster
catttttgggcaa

SEQ ID NO: 607410 - DNA, 13 bp, D. melanogaster
catttttgggcca

SEQ ID NO: 607411 - DNA, 13 bp, D. melanogaster
catttttggggct

SEQ ID NO: 607412 - DNA, 13 bp, D. melanogaster
catttttgggttt

SEQ ID NO: 607413 - DNA, 13 bp, D. melanogaster
catttttgtaata

SEQ ID NO: 607414 - DNA, 13 bp, D. melanogaster
catttttgtaatt

SEQ ID NO: 607415 - DNA, 13 bp, D. melanogaster
catttttgtgctg

SEQ ID NO: 607416 - DNA, 13 bp, D. melanogaster
catttttgtggct

SEQ ID NO: 607417 - DNA, 13 bp, D. melanogaster
catttttgtggta

SEQ ID NO: 607418 - DNA, 13 bp, D. melanogaster
catttttgtgtgt

SEQ ID NO: 607419 - DNA, 14 bp, D. melanogaster
catttttgtgtgtg

SEQ ID NO: 607420 - DNA, 13 bp, D. melanogaster
catttttgttaaa

SEQ ID NO: 607421 - DNA, 13 bp, D. melanogaster
catttttgttaat

SEQ ID NO: 607422 - DNA, 13 bp, D. melanogaster
catttttgttgca

SEQ ID NO: 607423 - DNA, 13 bp, D. melanogaster
catttttgttgcc

SEQ ID NO: 607424 - DNA, 14 bp, D. melanogaster
cattttttaaaagt

SEQ ID NO: 607425 - DNA, 13 bp, D. melanogaster
cattttttaaacc

SEQ ID NO: 607426 - DNA, 13 bp, D. melanogaster
cattttttaatca

SEQ ID NO: 607427 - DNA, 13 bp, D. melanogaster
cattttttagaca

SEQ ID NO: 607428 - DNA, 13 bp, D. melanogaster
cattttttatatg

SEQ ID NO: 607429 - DNA, 13 bp, D. melanogaster
cattttttatgat

SEQ ID NO: 607430 - DNA, 13 bp, D. melanogaster
cattttttatgca

SEQ ID NO: 607431 - DNA, 13 bp, D. melanogaster
cattttttatgct

SEQ ID NO: 607432 - DNA, 13 bp, D. melanogaster
cattttttatggc

SEQ ID NO: 607433 - DNA, 13 bp, D. melanogaster
cattttttatgtg

SEQ ID NO: 607434 - DNA, 13 bp, D. melanogaster
cattttttcaaaa

SEQ ID NO: 607435 - DNA, 13 bp, D. melanogaster
cattttttcctgt

SEQ ID NO: 607436 - DNA, 13 bp, D. melanogaster
cattttttgattg

SEQ ID NO: 607437 - DNA, 13 bp, D. melanogaster
cattttttgcaaa

SEQ ID NO: 607438 - DNA, 13 bp, D. melanogaster
cattttttgccac

SEQ ID NO: 607439 - DNA, 13 bp, D. melanogaster
cattttttgccat

SEQ ID NO: 607440 - DNA, 13 bp, D. melanogaster
cattttttgcgaa

SEQ ID NO: 607441 - DNA, 13 bp, D. melanogaster
cattttttggata

SEQ ID NO: 607442 - DNA, 13 bp, D. melanogaster
cattttttggcat

SEQ ID NO: 607443 - DNA, 13 bp, D. melanogaster
cattttttgtgct

SEQ ID NO: 607444 - DNA, 13 bp, D. melanogaster
cattttttgtgtg

SEQ ID NO: 607445 - DNA, 13 bp, D. melanogaster
cattttttgttgg

SEQ ID NO: 607446 - DNA, 14 bp, D. melanogaster
cattttttgttggc

SEQ ID NO: 607447 - DNA, 14 bp, D. melanogaster
catttttttaaaag

SEQ ID NO: 607448 - DNA, 13 bp, D. melanogaster
catttttttaagg

SEQ ID NO: 607449 - DNA, 13 bp, D. melanogaster
catttttttaatg

SEQ ID NO: 607450 - DNA, 13 bp, D. melanogaster
catttttttcaaa

SEQ ID NO: 607451 - DNA, 13 bp, D. melanogaster
catttttttcaca

SEQ ID NO: 607452 - DNA, 13 bp, D. melanogaster
catttttttccca

SEQ ID NO: 607453 - DNA, 14 bp, D. melanogaster
catttttttctgtg

SEQ ID NO: 607454 - DNA, 13 bp, D. melanogaster
catttttttgcaa

SEQ ID NO: 607455 - DNA, 13 bp, D. melanogaster
catttttttgcag

SEQ ID NO: 607456 - DNA, 13 bp, D. melanogaster
catttttttgcgc

SEQ ID NO: 607457 - DNA, 13 bp, D. melanogaster
cattttttttcgg

SEQ ID NO: 607458 - DNA, 13 bp, D. melanogaster
ccaaaaaaaattg

SEQ ID NO: 607459 - DNA, 13 bp, D. melanogaster
ccaaaaaaactgc

SEQ ID NO: 607460 - DNA, 14 bp, D. melanogaster
ccaaaaaaactgcc

SEQ ID NO: 607461 - DNA, 39 bp, D. melanogaster
ccaaaaaaaggcatctggatctgctggcacaaaggcaaa

SEQ ID NO: 607462 - DNA, 13 bp, D. melanogaster
ccaaaaaacattt

SEQ ID NO: 607463 - DNA, 13 bp, D. melanogaster
ccaaaaaactgat

SEQ ID NO: 607464 - DNA, 13 bp, D. melanogaster
ccaaaaaactttg

SEQ ID NO: 607465 - DNA, 13 bp, D. melanogaster
ccaaaaaactttt

SEQ ID NO: 607466 - DNA, 13 bp, D. melanogaster
ccaaaaaagcagc

SEQ ID NO: 607467 - DNA, 13 bp, D. melanogaster
ccaaaaaagtatt

SEQ ID NO: 607468 - DNA, 13 bp, D. melanogaster
ccaaaaaagtggc

SEQ ID NO: 607469 - DNA, 14 bp, D. melanogaster
ccaaaaaagtggct

SEQ ID NO: 607470 - DNA, 13 bp, D. melanogaster
ccaaaaaagtttc

SEQ ID NO: 607471 - DNA, 13 bp, D. melanogaster
ccaaaaaatatgc

SEQ ID NO: 607472 - DNA, 14 bp, D. melanogaster
ccaaaaaatatgtt

SEQ ID NO: 607473 - DNA, 13 bp, D. melanogaster
ccaaaaaatcgtg

SEQ ID NO: 607474 - DNA, 13 bp, D. melanogaster
ccaaaaaatgaag

SEQ ID NO: 607475 - DNA, 14 bp, D. melanogaster
ccaaaaaatgatcg

SEQ ID NO: 607476 - DNA, 13 bp, D. melanogaster
ccaaaaaatggga

SEQ ID NO: 607477 - DNA, 13 bp, D. melanogaster
ccaaaaacactgt

SEQ ID NO: 607478 - DNA, 13 bp, D. melanogaster
ccaaaaacacttt

SEQ ID NO: 607479 - DNA, 13 bp, D. melanogaster
ccaaaaacatttt

SEQ ID NO: 607480 - DNA, 13 bp, D. melanogaster
ccaaaaaccactt

SEQ ID NO: 607481 - DNA, 14 bp, D. melanogaster
ccaaaaaccgaaat

SEQ ID NO: 607482 - DNA, 13 bp, D. melanogaster
ccaaaaacgaaat

SEQ ID NO: 607483 - DNA, 13 bp, D. melanogaster
ccaaaaacgagag

SEQ ID NO: 607484 - DNA, 13 bp, D. melanogaster
ccaaaaacgattt

SEQ ID NO: 607485 - DNA, 13 bp, D. melanogaster
ccaaaaactatgc

SEQ ID NO: 607486 - DNA, 13 bp, D. melanogaster
ccaaaaactgaaa

SEQ ID NO: 607487 - DNA, 13 bp, D. melanogaster
ccaaaaactgtgc

SEQ ID NO: 607488 - DNA, 13 bp, D. melanogaster
ccaaaaacttgat

SEQ ID NO: 607489 - DNA, 13 bp, D. melanogaster
ccaaaaacttggc

SEQ ID NO: 607490 - DNA, 13 bp, D. melanogaster
ccaaaaacttgtt

SEQ ID NO: 607491 - DNA, 13 bp, D. melanogaster
ccaaaaactttgc

SEQ ID NO: 607492 - DNA, 13 bp, D. melanogaster
ccaaaaacttttc

SEQ ID NO: 607493 - DNA, 14 bp, D. melanogaster
ccaaaaacttttgc

SEQ ID NO: 607494 - DNA, 13 bp, D. melanogaster
ccaaaaagcaatt

SEQ ID NO: 607495 - DNA, 13 bp, D. melanogaster
ccaaaaagccaag

SEQ ID NO: 607496 - DNA, 13 bp, D. melanogaster
ccaaaaagccagc

SEQ ID NO: 607497 - DNA, 13 bp, D. melanogaster
ccaaaaagccgaa

SEQ ID NO: 607498 - DNA, 13 bp, D. melanogaster
ccaaaaaggaagc

SEQ ID NO: 607499 - DNA, 13 bp, D. melanogaster
ccaaaaaggacga

SEQ ID NO: 607500 - DNA, 13 bp, D. melanogaster
ccaaaaaggaggc

SEQ ID NO: 607501 - DNA, 13 bp, D. melanogaster
ccaaaaaggatat

SEQ ID NO: 607502 - DNA, 13 bp, D. melanogaster
ccaaaaaggcagc

SEQ ID NO: 607503 - DNA, 13 bp, D. melanogaster
ccaaaaaggccaa

SEQ ID NO: 607504 - DNA, 13 bp, D. melanogaster
ccaaaaagtattt

SEQ ID NO: 607505 - DNA, 13 bp, D. melanogaster
ccaaaaagtgcca

SEQ ID NO: 607506 - DNA, 13 bp, D. melanogaster
ccaaaaagtgtgc

SEQ ID NO: 607507 - DNA, 13 bp, D. melanogaster
ccaaaaagttaat

SEQ ID NO: 607508 - DNA, 13 bp, D. melanogaster
ccaaaaataaagg

SEQ ID NO: 607509 - DNA, 13 bp, D. melanogaster
ccaaaaataacgg

SEQ ID NO: 607510 - DNA, 13 bp, D. melanogaster
ccaaaaataattt

SEQ ID NO: 607511 - DNA, 13 bp, D. melanogaster
ccaaaaatagcca

SEQ ID NO: 607512 - DNA, 13 bp, D. melanogaster
ccaaaaatatcgc

SEQ ID NO: 607513 - DNA, 13 bp, D. melanogaster
ccaaaaatatgta

SEQ ID NO: 607514 - DNA, 13 bp, D. melanogaster
ccaaaaatattca

SEQ ID NO: 607515 - DNA, 14 bp, D. melanogaster
ccaaaaatcacagt

SEQ ID NO: 607516 - DNA, 13 bp, D. melanogaster
ccaaaaatgccaa

SEQ ID NO: 607517 - DNA, 13 bp, D. melanogaster
ccaaaaatgcgaa

SEQ ID NO: 607518 - DNA, 13 bp, D. melanogaster
ccaaaaatggaaa

SEQ ID NO: 607519 - DNA, 13 bp, D. melanogaster
ccaaaaatggaat

SEQ ID NO: 607520 - DNA, 13 bp, D. melanogaster
ccaaaaatggatt

SEQ ID NO: 607521 - DNA, 13 bp, D. melanogaster
ccaaaaatgtaga

SEQ ID NO: 607522 - DNA, 13 bp, D. melanogaster
ccaaaaatgtcaa

SEQ ID NO: 607523 - DNA, 13 bp, D. melanogaster
ccaaaaatgtggc

SEQ ID NO: 607524 - DNA, 13 bp, D. melanogaster
ccaaaaatgtggg

SEQ ID NO: 607525 - DNA, 13 bp, D. melanogaster
ccaaaaatgtttg

SEQ ID NO: 607526 - DNA, 14 bp, D. melanogaster
ccaaaaattaattt

SEQ ID NO: 607527 - DNA, 13 bp, D. melanogaster
ccaaaaattcaat

SEQ ID NO: 607528 - DNA, 13 bp, D. melanogaster
ccaaaaattggaa

SEQ ID NO: 607529 - DNA, 13 bp, D. melanogaster
ccaaaaatttatt

SEQ ID NO: 607530 - DNA, 13 bp, D. melanogaster
ccaaaaatttggc

SEQ ID NO: 607531 - DNA, 13 bp, D. melanogaster
ccaaaaatttgtt

SEQ ID NO: 607532 - DNA, 13 bp, D. melanogaster
ccaaaacaaaatg

SEQ ID NO: 607533 - DNA, 13 bp, D. melanogaster
ccaaaacaaactg

SEQ ID NO: 607534 - DNA, 13 bp, D. melanogaster
ccaaaacaaatgc

SEQ ID NO: 607535 - DNA, 13 bp, D. melanogaster
ccaaaacaaatgt

SEQ ID NO: 607536 - DNA, 13 bp, D. melanogaster
ccaaaacactttt

SEQ ID NO: 607537 - DNA, 14 bp, D. melanogaster
ccaaaacacttttt

SEQ ID NO: 607538 - DNA, 13 bp, D. melanogaster
ccaaaacatattt

SEQ ID NO: 607539 - DNA, 13 bp, D. melanogaster
ccaaaacattttg

SEQ ID NO: 607540 - DNA, 13 bp, D. melanogaster
ccaaaaccaaatg

SEQ ID NO: 607541 - DNA, 13 bp, D. melanogaster
ccaaaaccaattt

SEQ ID NO: 607542 - DNA, 13 bp, D. melanogaster
ccaaaacccattt

SEQ ID NO: 607543 - DNA, 13 bp, D. melanogaster
ccaaaaccgaatc

SEQ ID NO: 607544 - DNA, 13 bp, D. melanogaster
ccaaaacgaaacg

SEQ ID NO: 607545 - DNA, 13 bp, D. melanogaster
ccaaaacgaaatg

SEQ ID NO: 607546 - DNA, 13 bp, D. melanogaster
ccaaaacgaaccg

SEQ ID NO: 607547 - DNA, 13 bp, D. melanogaster
ccaaaacggtcac

SEQ ID NO: 607548 - DNA, 13 bp, D. melanogaster
ccaaaactcccga

SEQ ID NO: 607549 - DNA, 13 bp, D. melanogaster
ccaaaactgaaaa

SEQ ID NO: 607550 - DNA, 13 bp, D. melanogaster
ccaaaactgccac

SEQ ID NO: 607551 - DNA, 13 bp, D. melanogaster
ccaaaactgtcac

SEQ ID NO: 607552 - DNA, 13 bp, D. melanogaster
ccaaaacttgttt

SEQ ID NO: 607553 - DNA, 13 bp, D. melanogaster
ccaaaagaaaagt

SEQ ID NO: 607554 - DNA, 13 bp, D. melanogaster
ccaaaagaacttt

SEQ ID NO: 607555 - DNA, 13 bp, D. melanogaster
ccaaaagatacaa

SEQ ID NO: 607556 - DNA, 13 bp, D. melanogaster
ccaaaagatacat

SEQ ID NO: 607557 - DNA, 13 bp, D. melanogaster
ccaaaagattttc

SEQ ID NO: 607558 - DNA, 13 bp, D. melanogaster
ccaaaagcaaagc

SEQ ID NO: 607559 - DNA, 13 bp, D. melanogaster
ccaaaagcaataa

SEQ ID NO: 607560 - DNA, 13 bp, D. melanogaster
ccaaaagcaatta

SEQ ID NO: 607561 - DNA, 13 bp, D. melanogaster
ccaaaagcagaac

SEQ ID NO: 607562 - DNA, 13 bp, D. melanogaster
ccaaaagcagact

SEQ ID NO: 607563 - DNA, 13 bp, D. melanogaster
ccaaaagcataaa

SEQ ID NO: 607564 - DNA, 13 bp, D. melanogaster
ccaaaagcattta

SEQ ID NO: 607565 - DNA, 13 bp, D. melanogaster
ccaaaagccattt

SEQ ID NO: 607566 - DNA, 13 bp, D. melanogaster
ccaaaagcgaaat

SEQ ID NO: 607567 - DNA, 13 bp, D. melanogaster
ccaaaaggaaaat

SEQ ID NO: 607568 - DNA, 13 bp, D. melanogaster
ccaaaaggcacaa

SEQ ID NO: 607569 - DNA, 13 bp, D. melanogaster
ccaaaagggaaac

SEQ ID NO: 607570 - DNA, 13 bp, D. melanogaster
ccaaaaggggaaa

SEQ ID NO: 607571 - DNA, 13 bp, D. melanogaster
ccaaaagtatttc

SEQ ID NO: 607572 - DNA, 13 bp, D. melanogaster
ccaaaagtgaaag

SEQ ID NO: 607573 - DNA, 13 bp, D. melanogaster
ccaaaagtgaaat

SEQ ID NO: 607574 - DNA, 13 bp, D. melanogaster
ccaaaagtggcaa

SEQ ID NO: 607575 - DNA, 13 bp, D. melanogaster
ccaaaagtgggcg

SEQ ID NO: 607576 - DNA, 13 bp, D. melanogaster
ccaaaagttttgg

SEQ ID NO: 607577 - DNA, 13 bp, D. melanogaster
ccaaaagtttttc

SEQ ID NO: 607578 - DNA, 13 bp, D. melanogaster
ccaaaataaacag

SEQ ID NO: 607579 - DNA, 13 bp, D. melanogaster
ccaaaataacggt

SEQ ID NO: 607580 - DNA, 13 bp, D. melanogaster
ccaaaataccagg

SEQ ID NO: 607581 - DNA, 13 bp, D. melanogaster
ccaaaatagcaaa

SEQ ID NO: 607582 - DNA, 13 bp, D. melanogaster
ccaaaatatagag

SEQ ID NO: 607583 - DNA, 13 bp, D. melanogaster
ccaaaatatatat

SEQ ID NO: 607584 - DNA, 14 bp, D. melanogaster
ccaaaatatcctga

SEQ ID NO: 607585 - DNA, 13 bp, D. melanogaster
ccaaaatatgcaa

SEQ ID NO: 607586 - DNA, 13 bp, D. melanogaster
ccaaaatattcct

SEQ ID NO: 607587 - DNA, 14 bp, D. melanogaster
ccaaaatattttaa

SEQ ID NO: 607588 - DNA, 13 bp, D. melanogaster
ccaaaatcaatac

SEQ ID NO: 607589 - DNA, 13 bp, D. melanogaster
ccaaaatcaatcg

SEQ ID NO: 607590 - DNA, 14 bp, D. melanogaster
ccaaaatcaatcga

SEQ ID NO: 607591 - DNA, 13 bp, D. melanogaster
ccaaaatccaaag

SEQ ID NO: 607592 - DNA, 13 bp, D. melanogaster
ccaaaatcgaaaa

SEQ ID NO: 607593 - DNA, 13 bp, D. melanogaster
ccaaaatcgaaac

SEQ ID NO: 607594 - DNA, 13 bp, D. melanogaster
ccaaaatcgactg

SEQ ID NO: 607595 - DNA, 13 bp, D. melanogaster
ccaaaatgaaaat

SEQ ID NO: 607596 - DNA, 13 bp, D. melanogaster
ccaaaatgaattt

SEQ ID NO: 607597 - DNA, 13 bp, D. melanogaster
ccaaaatgcaatg

SEQ ID NO: 607598 - DNA, 13 bp, D. melanogaster
ccaaaatgcagac

SEQ ID NO: 607599 - DNA, 13 bp, D. melanogaster
ccaaaatgcagtt

SEQ ID NO: 607600 - DNA, 13 bp, D. melanogaster
ccaaaatgctgac

SEQ ID NO: 607601 - DNA, 13 bp, D. melanogaster
ccaaaatggaaat

SEQ ID NO: 607602 - DNA, 14 bp, D. melanogaster
ccaaaatggccaaa

SEQ ID NO: 607603 - DNA, 13 bp, D. melanogaster
ccaaaatggctgc

SEQ ID NO: 607604 - DNA, 13 bp, D. melanogaster
ccaaaatgggtct

SEQ ID NO: 607605 - DNA, 13 bp, D. melanogaster
ccaaaatggtggc

SEQ ID NO: 607606 - DNA, 14 bp, D. melanogaster
ccaaaatggtggcg

SEQ ID NO: 607607 - DNA, 13 bp, D. melanogaster
ccaaaatggtttt

SEQ ID NO: 607608 - DNA, 13 bp, D. melanogaster
ccaaaatgtatat

SEQ ID NO: 607609 - DNA, 13 bp, D. melanogaster
ccaaaatgtcctt

SEQ ID NO: 607610 - DNA, 13 bp, D. melanogaster
ccaaaatgtgttg

SEQ ID NO: 607611 - DNA, 13 bp, D. melanogaster
ccaaaatgttgca

SEQ ID NO: 607612 - DNA, 13 bp, D. melanogaster
ccaaaatgtttaa

SEQ ID NO: 607613 - DNA, 13 bp, D. melanogaster
ccaaaattgattt

SEQ ID NO: 607614 - DNA, 14 bp, D. melanogaster
ccaaaattgccaaa

SEQ ID NO: 607615 - DNA, 14 bp, D. melanogaster
ccaaaatttcaaaa

SEQ ID NO: 607616 - DNA, 13 bp, D. melanogaster
ccaaaattttgaa

SEQ ID NO: 607617 - DNA, 13 bp, D. melanogaster
ccaaacaaaaggc

SEQ ID NO: 607618 - DNA, 13 bp, D. melanogaster
ccaaacaaaatga

SEQ ID NO: 607619 - DNA, 13 bp, D. melanogaster
ccaaacaaaatgc

SEQ ID NO: 607620 - DNA, 13 bp, D. melanogaster
ccaaacaaatatt

SEQ ID NO: 607621 - DNA, 13 bp, D. melanogaster
ccaaacaaatgat

SEQ ID NO: 607622 - DNA, 14 bp, D. melanogaster
ccaaacaaatgatg

SEQ ID NO: 607623 - DNA, 13 bp, D. melanogaster
ccaaacaaatgcc

SEQ ID NO: 607624 - DNA, 13 bp, D. melanogaster
ccaaacaaatgtc

SEQ ID NO: 607625 - DNA, 13 bp, D. melanogaster
ccaaacaactttt

SEQ ID NO: 607626 - DNA, 14 bp, D. melanogaster
ccaaacaatggata

SEQ ID NO: 607627 - DNA, 13 bp, D. melanogaster
ccaaacaattctt

SEQ ID NO: 607628 - DNA, 13 bp, D. melanogaster
ccaaacacaattg

SEQ ID NO: 607629 - DNA, 13 bp, D. melanogaster
ccaaacactaata

SEQ ID NO: 607630 - DNA, 14 bp, D. melanogaster
ccaaacagaagcag

SEQ ID NO: 607631 - DNA, 13 bp, D. melanogaster
ccaaacagctgtt

SEQ ID NO: 607632 - DNA, 13 bp, D. melanogaster
ccaaacaggtgat

SEQ ID NO: 607633 - DNA, 13 bp, D. melanogaster
ccaaacagtgtca

SEQ ID NO: 607634 - DNA, 14 bp, D. melanogaster
ccaaacataaatgt

SEQ ID NO: 607635 - DNA, 13 bp, D. melanogaster
ccaaacatttgca

SEQ ID NO: 607636 - DNA, 13 bp, D. melanogaster
ccaaacatttttc

SEQ ID NO: 607637 - DNA, 13 bp, D. melanogaster
ccaaaccaggaaa

SEQ ID NO: 607638 - DNA, 13 bp, D. melanogaster
ccaaaccgaaatc

SEQ ID NO: 607639 - DNA, 13 bp, D. melanogaster
ccaaaccgaactg

SEQ ID NO: 607640 - DNA, 13 bp, D. melanogaster
ccaaaccgagctg

SEQ ID NO: 607641 - DNA, 13 bp, D. melanogaster
ccaaaccggtcac

SEQ ID NO: 607642 - DNA, 13 bp, D. melanogaster
ccaaaccggtggc

SEQ ID NO: 607643 - DNA, 13 bp, D. melanogaster
ccaaaccgtcatc

SEQ ID NO: 607644 - DNA, 13 bp, D. melanogaster
ccaaacgaaagac

SEQ ID NO: 607645 - DNA, 13 bp, D. melanogaster
ccaaacggatgcc

SEQ ID NO: 607646 - DNA, 13 bp, D. melanogaster
ccaaacggcggat

SEQ ID NO: 607647 - DNA, 13 bp, D. melanogaster
ccaaactaatttg

SEQ ID NO: 607648 - DNA, 13 bp, D. melanogaster
ccaaactaatttt

SEQ ID NO: 607649 - DNA, 13 bp, D. melanogaster
ccaaactgaaatt

SEQ ID NO: 607650 - DNA, 13 bp, D. melanogaster
ccaaactgcagct

SEQ ID NO: 607651 - DNA, 13 bp, D. melanogaster
ccaaactgcggga

SEQ ID NO: 607652 - DNA, 13 bp, D. melanogaster
ccaaactggataa

SEQ ID NO: 607653 - DNA, 13 bp, D. melanogaster
ccaaacttaaatg

SEQ ID NO: 607654 - DNA, 13 bp, D. melanogaster
ccaaacttttggc

SEQ ID NO: 607655 - DNA, 13 bp, D. melanogaster
ccaaagaaaatat

SEQ ID NO: 607656 - DNA, 14 bp, D. melanogaster
ccaaagaaaccact

SEQ ID NO: 607657 - DNA, 14 bp, D. melanogaster
ccaaagaaagtggg

SEQ ID NO: 607658 - DNA, 13 bp, D. melanogaster
ccaaagaaatagc

SEQ ID NO: 607659 - DNA, 14 bp, D. melanogaster
ccaaagaaatagct

SEQ ID NO: 607660 - DNA, 13 bp, D. melanogaster
ccaaagaaatatt

SEQ ID NO: 607661 - DNA, 13 bp, D. melanogaster
ccaaagaaatttg

SEQ ID NO: 607662 - DNA, 13 bp, D. melanogaster
ccaaagaacttct

SEQ ID NO: 607663 - DNA, 13 bp, D. melanogaster
ccaaagaataaag

SEQ ID NO: 607664 - DNA, 13 bp, D. melanogaster
ccaaagaatggga

SEQ ID NO: 607665 - DNA, 13 bp, D. melanogaster
ccaaagaattttt

SEQ ID NO: 607666 - DNA, 13 bp, D. melanogaster
ccaaagacacaag

SEQ ID NO: 607667 - DNA, 13 bp, D. melanogaster
ccaaagacactag

SEQ ID NO: 607668 - DNA, 13 bp, D. melanogaster
ccaaagacagcaa

SEQ ID NO: 607669 - DNA, 13 bp, D. melanogaster
ccaaagaccctag

SEQ ID NO: 607670 - DNA, 13 bp, D. melanogaster
ccaaagagccaaa

SEQ ID NO: 607671 - DNA, 13 bp, D. melanogaster
ccaaagatacaaa

SEQ ID NO: 607672 - DNA, 13 bp, D. melanogaster
ccaaagatttatg

SEQ ID NO: 607673 - DNA, 13 bp, D. melanogaster
ccaaagatttgtt

SEQ ID NO: 607674 - DNA, 13 bp, D. melanogaster
ccaaagcaaagtc

SEQ ID NO: 607675 - DNA, 13 bp, D. melanogaster
ccaaagcaaataa

SEQ ID NO: 607676 - DNA, 14 bp, D. melanogaster
ccaaagcaaataaa

SEQ ID NO: 607677 - DNA, 13 bp, D. melanogaster
ccaaagcaattaa

SEQ ID NO: 607678 - DNA, 13 bp, D. melanogaster
ccaaagcagcagc

SEQ ID NO: 607679 - DNA, 14 bp, D. melanogaster
ccaaagccaaaagc

SEQ ID NO: 607680 - DNA, 13 bp, D. melanogaster
ccaaagccaaaga

SEQ ID NO: 607681 - DNA, 14 bp, D. melanogaster
ccaaagccaaagca

SEQ ID NO: 607682 - DNA, 14 bp, D. melanogaster
ccaaagccaaagcc

SEQ ID NO: 607683 - DNA, 14 bp, D. melanogaster
ccaaagccaaagtc

SEQ ID NO: 607684 - DNA, 13 bp, D. melanogaster
ccaaagccagctg

SEQ ID NO: 607685 - DNA, 13 bp, D. melanogaster
ccaaagccaggaa

SEQ ID NO: 607686 - DNA, 14 bp, D. melanogaster
ccaaagccaggaaa

SEQ ID NO: 607687 - DNA, 13 bp, D. melanogaster
ccaaagccgaagc

SEQ ID NO: 607688 - DNA, 13 bp, D. melanogaster
ccaaagcttttcc

SEQ ID NO: 607689 - DNA, 13 bp, D. melanogaster
ccaaaggaaaacc

SEQ ID NO: 607690 - DNA, 13 bp, D. melanogaster
ccaaaggaaatgg

SEQ ID NO: 607691 - DNA, 13 bp, D. melanogaster
ccaaaggaattca

SEQ ID NO: 607692 - DNA, 13 bp, D. melanogaster
ccaaaggacacca

SEQ ID NO: 607693 - DNA, 13 bp, D. melanogaster
ccaaaggaccaaa

SEQ ID NO: 607694 - DNA, 13 bp, D. melanogaster
ccaaaggagcagc

SEQ ID NO: 607695 - DNA, 13 bp, D. melanogaster
ccaaaggcaacta

SEQ ID NO: 607696 - DNA, 13 bp, D. melanogaster
ccaaagggtaagc

SEQ ID NO: 607697 - DNA, 13 bp, D. melanogaster
ccaaagggtgatg

SEQ ID NO: 607698 - DNA, 13 bp, D. melanogaster
ccaaagtaaacaa

SEQ ID NO: 607699 - DNA, 13 bp, D. melanogaster
ccaaagtcaaaca

SEQ ID NO: 607700 - DNA, 13 bp, D. melanogaster
ccaaagtcatttg

SEQ ID NO: 607701 - DNA, 13 bp, D. melanogaster
ccaaagtgccaaa

SEQ ID NO: 607702 - DNA, 13 bp, D. melanogaster
ccaaagtgggcgg

SEQ ID NO: 607703 - DNA, 13 bp, D. melanogaster
ccaaagtgggtgg

SEQ ID NO: 607704 - DNA, 13 bp, D. melanogaster
ccaaagttgattt

SEQ ID NO: 607705 - DNA, 13 bp, D. melanogaster
ccaaagttttcca

SEQ ID NO: 607706 - DNA, 13 bp, D. melanogaster
ccaaagtttttga

SEQ ID NO: 607707 - DNA, 14 bp, D. melanogaster
ccaaataaaaatgt

SEQ ID NO: 607708 - DNA, 13 bp, D. melanogaster
ccaaataaaagtg

SEQ ID NO: 607709 - DNA, 14 bp, D. melanogaster
ccaaataaaagtgc

SEQ ID NO: 607710 - DNA, 14 bp, D. melanogaster
ccaaataaaattag

SEQ ID NO: 607711 - DNA, 14 bp, D. melanogaster
ccaaataaagataa

SEQ ID NO: 607712 - DNA, 13 bp, D. melanogaster
ccaaataaagcaa

SEQ ID NO: 607713 - DNA, 13 bp, D. melanogaster
ccaaataaatagg

SEQ ID NO: 607714 - DNA, 13 bp, D. melanogaster
ccaaataaatgaa

SEQ ID NO: 607715 - DNA, 13 bp, D. melanogaster
ccaaataaattca

SEQ ID NO: 607716 - DNA, 13 bp, D. melanogaster
ccaaataaattta

SEQ ID NO: 607717 - DNA, 13 bp, D. melanogaster
ccaaataatcttc

SEQ ID NO: 607718 - DNA, 13 bp, D. melanogaster
ccaaatacaagaa

SEQ ID NO: 607719 - DNA, 13 bp, D. melanogaster
ccaaataccaaat

SEQ ID NO: 607720 - DNA, 13 bp, D. melanogaster
ccaaatacgaaat

SEQ ID NO: 607721 - DNA, 13 bp, D. melanogaster
ccaaatactaatt

SEQ ID NO: 607722 - DNA, 13 bp, D. melanogaster
ccaaatactagtt

SEQ ID NO: 607723 - DNA, 13 bp, D. melanogaster
ccaaatactttac

SEQ ID NO: 607724 - DNA, 13 bp, D. melanogaster
ccaaatagaaaat

SEQ ID NO: 607725 - DNA, 14 bp, D. melanogaster
ccaaatagagcaga

SEQ ID NO: 607726 - DNA, 13 bp, D. melanogaster
ccaaatagccaac

SEQ ID NO: 607727 - DNA, 14 bp, D. melanogaster
ccaaatagccaact

SEQ ID NO: 607728 - DNA, 13 bp, D. melanogaster
ccaaatagttttt

SEQ ID NO: 607729 - DNA, 13 bp, D. melanogaster
ccaaatatagaat

SEQ ID NO: 607730 - DNA, 13 bp, D. melanogaster
ccaaatatatata

SEQ ID NO: 607731 - DNA, 13 bp, D. melanogaster
ccaaatatcttgg

SEQ ID NO: 607732 - DNA, 13 bp, D. melanogaster
ccaaatatggaat

SEQ ID NO: 607733 - DNA, 13 bp, D. melanogaster
ccaaatatgtaaa

SEQ ID NO: 607734 - DNA, 13 bp, D. melanogaster
ccaaatatgtatt

SEQ ID NO: 607735 - DNA, 14 bp, D. melanogaster
ccaaatattatcaa

SEQ ID NO: 607736 - DNA, 13 bp, D. melanogaster
ccaaatattgaaa

SEQ ID NO: 607737 - DNA, 13 bp, D. melanogaster
ccaaatatttata

SEQ ID NO: 607738 - DNA, 13 bp, D. melanogaster
ccaaatatttgta

SEQ ID NO: 607739 - DNA, 13 bp, D. melanogaster
ccaaatatttgtt

SEQ ID NO: 607740 - DNA, 13 bp, D. melanogaster
ccaaatattttca

SEQ ID NO: 607741 - DNA, 13 bp, D. melanogaster
ccaaatcaaaatc

SEQ ID NO: 607742 - DNA, 14 bp, D. melanogaster
ccaaatcaaaatgg

SEQ ID NO: 607743 - DNA, 13 bp, D. melanogaster
ccaaatcaaatcg

SEQ ID NO: 607744 - DNA, 13 bp, D. melanogaster
ccaaatcaaatgc

SEQ ID NO: 607745 - DNA, 13 bp, D. melanogaster
ccaaatcaagaga

SEQ ID NO: 607746 - DNA, 14 bp, D. melanogaster
ccaaatcaatatct

SEQ ID NO: 607747 - DNA, 13 bp, D. melanogaster
ccaaatcaattaa

SEQ ID NO: 607748 - DNA, 13 bp, D. melanogaster
ccaaatcattttt

SEQ ID NO: 607749 - DNA, 13 bp, D. melanogaster
ccaaatccaaagc

SEQ ID NO: 607750 - DNA, 13 bp, D. melanogaster
ccaaatccaattg

SEQ ID NO: 607751 - DNA, 13 bp, D. melanogaster
ccaaatccacatc

SEQ ID NO: 607752 - DNA, 13 bp, D. melanogaster
ccaaatccataaa

SEQ ID NO: 607753 - DNA, 13 bp, D. melanogaster
ccaaatcccaaat

SEQ ID NO: 607754 - DNA, 14 bp, D. melanogaster
ccaaatcccaatcc

SEQ ID NO: 607755 - DNA, 13 bp, D. melanogaster
ccaaatcccattt

SEQ ID NO: 607756 - DNA, 13 bp, D. melanogaster
ccaaatccgaaat

SEQ ID NO: 607757 - DNA, 13 bp, D. melanogaster
ccaaatccgaatc

SEQ ID NO: 607758 - DNA, 13 bp, D. melanogaster
ccaaatcctatta

SEQ ID NO: 607759 - DNA, 13 bp, D. melanogaster
ccaaatcgaaaaa

SEQ ID NO: 607760 - DNA, 13 bp, D. melanogaster
ccaaatcgaatta

SEQ ID NO: 607761 - DNA, 13 bp, D. melanogaster
ccaaatcgcattt

SEQ ID NO: 607762 - DNA, 13 bp, D. melanogaster
ccaaatcgcgtac

SEQ ID NO: 607763 - DNA, 13 bp, D. melanogaster
ccaaatgaaaacg

SEQ ID NO: 607764 - DNA, 14 bp, D. melanogaster
ccaaatgaaatgaa

SEQ ID NO: 607765 - DNA, 13 bp, D. melanogaster
ccaaatgaatggc

SEQ ID NO: 607766 - DNA, 13 bp, D. melanogaster
ccaaatgacaaat

SEQ ID NO: 607767 - DNA, 13 bp, D. melanogaster
ccaaatgagtttt

SEQ ID NO: 607768 - DNA, 13 bp, D. melanogaster
ccaaatgattttt

SEQ ID NO: 607769 - DNA, 14 bp, D. melanogaster
ccaaatgcaaaaat

SEQ ID NO: 607770 - DNA, 13 bp, D. melanogaster
ccaaatgcaaaat

SEQ ID NO: 607771 - DNA, 13 bp, D. melanogaster
ccaaatgcaacaa

SEQ ID NO: 607772 - DNA, 13 bp, D. melanogaster
ccaaatgcataaa

SEQ ID NO: 607773 - DNA, 13 bp, D. melanogaster
ccaaatgcatttg

SEQ ID NO: 607774 - DNA, 13 bp, D. melanogaster
ccaaatgccaaac

SEQ ID NO: 607775 - DNA, 13 bp, D. melanogaster
ccaaatgccaaat

SEQ ID NO: 607776 - DNA, 13 bp, D. melanogaster
ccaaatgccagca

SEQ ID NO: 607777 - DNA, 13 bp, D. melanogaster
ccaaatgccattt

SEQ ID NO: 607778 - DNA, 13 bp, D. melanogaster
ccaaatgctaatt

SEQ ID NO: 607779 - DNA, 13 bp, D. melanogaster
ccaaatggaaaat

SEQ ID NO: 607780 - DNA, 13 bp, D. melanogaster
ccaaatggaaatg

SEQ ID NO: 607781 - DNA, 14 bp, D. melanogaster
ccaaatggaaatgg

SEQ ID NO: 607782 - DNA, 13 bp, D. melanogaster
ccaaatggaaatt

SEQ ID NO: 607783 - DNA, 13 bp, D. melanogaster
ccaaatggcaaaa

SEQ ID NO: 607784 - DNA, 13 bp, D. melanogaster
ccaaatggcaaat

SEQ ID NO: 607785 - DNA, 13 bp, D. melanogaster
ccaaatggcaaca

SEQ ID NO: 607786 - DNA, 13 bp, D. melanogaster
ccaaatggcattc

SEQ ID NO: 607787 - DNA, 13 bp, D. melanogaster
ccaaatggccaac

SEQ ID NO: 607788 - DNA, 13 bp, D. melanogaster
ccaaatggccaat

SEQ ID NO: 607789 - DNA, 13 bp, D. melanogaster
ccaaatggccagc

SEQ ID NO: 607790 - DNA, 13 bp, D. melanogaster
ccaaatgggaaat

SEQ ID NO: 607791 - DNA, 14 bp, D. melanogaster
ccaaatgtaaaatc

SEQ ID NO: 607792 - DNA, 13 bp, D. melanogaster
ccaaatgtatgca

SEQ ID NO: 607793 - DNA, 13 bp, D. melanogaster
ccaaatgtcaaca

SEQ ID NO: 607794 - DNA, 13 bp, D. melanogaster
ccaaatgtggaat

SEQ ID NO: 607795 - DNA, 13 bp, D. melanogaster
ccaaatgtgtgtg

SEQ ID NO: 607796 - DNA, 13 bp, D. melanogaster
ccaaattaaaatc

SEQ ID NO: 607797 - DNA, 13 bp, D. melanogaster
ccaaattaattgc

SEQ ID NO: 607798 - DNA, 13 bp, D. melanogaster
ccaaattaatttg

SEQ ID NO: 607799 - DNA, 13 bp, D. melanogaster
ccaaattacctag

SEQ ID NO: 607800 - DNA, 13 bp, D. melanogaster
ccaaattacgcag

SEQ ID NO: 607801 - DNA, 13 bp, D. melanogaster
ccaaattatttgt

SEQ ID NO: 607802 - DNA, 13 bp, D. melanogaster
ccaaattcaaatg

SEQ ID NO: 607803 - DNA, 13 bp, D. melanogaster
ccaaattcaattt

SEQ ID NO: 607804 - DNA, 13 bp, D. melanogaster
ccaaattcatttc

SEQ ID NO: 607805 - DNA, 13 bp, D. melanogaster
ccaaattccaaat

SEQ ID NO: 607806 - DNA, 13 bp, D. melanogaster
ccaaattccaaga

SEQ ID NO: 607807 - DNA, 13 bp, D. melanogaster
ccaaattgaaatc

SEQ ID NO: 607808 - DNA, 13 bp, D. melanogaster
ccaaattgaaatg

SEQ ID NO: 607809 - DNA, 13 bp, D. melanogaster
ccaaattgaaatt

SEQ ID NO: 607810 - DNA, 13 bp, D. melanogaster
ccaaattgatgtg

SEQ ID NO: 607811 - DNA, 13 bp, D. melanogaster
ccaaattgattaa

SEQ ID NO: 607812 - DNA, 13 bp, D. melanogaster
ccaaattgattga

SEQ ID NO: 607813 - DNA, 13 bp, D. melanogaster
ccaaattgcaaat

SEQ ID NO: 607814 - DNA, 13 bp, D. melanogaster
ccaaattgcattt

SEQ ID NO: 607815 - DNA, 13 bp, D. melanogaster
ccaaattggccaa

SEQ ID NO: 607816 - DNA, 13 bp, D. melanogaster
ccaaattgttcag

SEQ ID NO: 607817 - DNA, 13 bp, D. melanogaster
ccaaattgttgtt

SEQ ID NO: 607818 - DNA, 13 bp, D. melanogaster
ccaaatttaaatt

SEQ ID NO: 607819 - DNA, 13 bp, D. melanogaster
ccaaatttcaatt

SEQ ID NO: 607820 - DNA, 13 bp, D. melanogaster
ccaaatttgaatg

SEQ ID NO: 607821 - DNA, 13 bp, D. melanogaster
ccaaatttgaatt

SEQ ID NO: 607822 - DNA, 13 bp, D. melanogaster
ccaaatttgcata

SEQ ID NO: 607823 - DNA, 13 bp, D. melanogaster
ccaaatttggcca

SEQ ID NO: 607824 - DNA, 13 bp, D. melanogaster
ccaaatttttaaa

SEQ ID NO: 607825 - DNA, 13 bp, D. melanogaster
ccaaatttttgga

SEQ ID NO: 607826 - DNA, 13 bp, D. melanogaster
ccaacaaaaaagt

SEQ ID NO: 607827 - DNA, 13 bp, D. melanogaster
ccaacaaaaaatg

SEQ ID NO: 607828 - DNA, 13 bp, D. melanogaster
ccaacaaaataga

SEQ ID NO: 607829 - DNA, 14 bp, D. melanogaster
ccaacaaaatagaa

SEQ ID NO: 607830 - DNA, 13 bp, D. melanogaster
ccaacaaagtttt

SEQ ID NO: 607831 - DNA, 13 bp, D. melanogaster
ccaacaaatgctt

SEQ ID NO: 607832 - DNA, 13 bp, D. melanogaster
ccaacaaattgaa

SEQ ID NO: 607833 - DNA, 13 bp, D. melanogaster
ccaacaaattgca

SEQ ID NO: 607834 - DNA, 13 bp, D. melanogaster
ccaacaacaagga

SEQ ID NO: 607835 - DNA, 13 bp, D. melanogaster
ccaacaacaagtg

SEQ ID NO: 607836 - DNA, 13 bp, D. melanogaster
ccaacaacaatgc

SEQ ID NO: 607837 - DNA, 13 bp, D. melanogaster
ccaacaacattaa

SEQ ID NO: 607838 - DNA, 14 bp, D. melanogaster
ccaacaacggcaat

SEQ ID NO: 607839 - DNA, 13 bp, D. melanogaster
ccaacaactgaac

SEQ ID NO: 607840 - DNA, 14 bp, D. melanogaster
ccaacaactgaacg

SEQ ID NO: 607841 - DNA, 13 bp, D. melanogaster
ccaacaacttaca

SEQ ID NO: 607842 - DNA, 13 bp, D. melanogaster
ccaacaagctgcc

SEQ ID NO: 607843 - DNA, 13 bp, D. melanogaster
ccaacaatgcaga

SEQ ID NO: 607844 - DNA, 14 bp, D. melanogaster
ccaacaatgttgaa

SEQ ID NO: 607845 - DNA, 13 bp, D. melanogaster
ccaacaattccaa

SEQ ID NO: 607846 - DNA, 13 bp, D. melanogaster
ccaacaatttcaa

SEQ ID NO: 607847 - DNA, 13 bp, D. melanogaster
ccaacaatttgca

SEQ ID NO: 607848 - DNA, 13 bp, D. melanogaster
ccaacacaaatgc

SEQ ID NO: 607849 - DNA, 13 bp, D. melanogaster
ccaacacatttat

SEQ ID NO: 607850 - DNA, 13 bp, D. melanogaster
ccaacacatttgc

SEQ ID NO: 607851 - DNA, 14 bp, D. melanogaster
ccaacacatttgcc

SEQ ID NO: 607852 - DNA, 13 bp, D. melanogaster
ccaacacctttcc

SEQ ID NO: 607853 - DNA, 13 bp, D. melanogaster
ccaacagacataa

SEQ ID NO: 607854 - DNA, 13 bp, D. melanogaster
ccaacagagtgga

SEQ ID NO: 607855 - DNA, 13 bp, D. melanogaster
ccaacagatgccg

SEQ ID NO: 607856 - DNA, 13 bp, D. melanogaster
ccaacagatggcg

SEQ ID NO: 607857 - DNA, 13 bp, D. melanogaster
ccaacagatttgc

SEQ ID NO: 607858 - DNA, 13 bp, D. melanogaster
ccaacagcaacag

SEQ ID NO: 607859 - DNA, 14 bp, D. melanogaster
ccaacagcaacagc

SEQ ID NO: 607860 - DNA, 14 bp, D. melanogaster
ccaacagccaacag

SEQ ID NO: 607861 - DNA, 13 bp, D. melanogaster
ccaacatcaagaa

SEQ ID NO: 607862 - DNA, 13 bp, D. melanogaster
ccaacatcagcat

SEQ ID NO: 607863 - DNA, 13 bp, D. melanogaster
ccaacatgcaatg

SEQ ID NO: 607864 - DNA, 13 bp, D. melanogaster
ccaacatgctgtg

SEQ ID NO: 607865 - DNA, 13 bp, D. melanogaster
ccaacatggcgag

SEQ ID NO: 607866 - DNA, 13 bp, D. melanogaster
ccaacattattac

SEQ ID NO: 607867 - DNA, 13 bp, D. melanogaster
ccaacatttttga

SEQ ID NO: 607868 - DNA, 13 bp, D. melanogaster
ccaaccaaaaatg

SEQ ID NO: 607869 - DNA, 14 bp, D. melanogaster
ccaaccaaaaatgt

SEQ ID NO: 607870 - DNA, 13 bp, D. melanogaster
ccaaccacggata

SEQ ID NO: 607871 - DNA, 13 bp, D. melanogaster
ccaaccagattga

SEQ ID NO: 607872 - DNA, 13 bp, D. melanogaster
ccaaccagccagc

SEQ ID NO: 607873 - DNA, 13 bp, D. melanogaster
ccaaccaggaatt

SEQ ID NO: 607874 - DNA, 13 bp, D. melanogaster
ccaaccatccatc

SEQ ID NO: 607875 - DNA, 13 bp, D. melanogaster
ccaaccatcctaa

SEQ ID NO: 607876 - DNA, 13 bp, D. melanogaster
ccaaccattatta

SEQ ID NO: 607877 - DNA, 13 bp, D. melanogaster
ccaaccgaacagg

SEQ ID NO: 607878 - DNA, 13 bp, D. melanogaster
ccaaccgaccgac

SEQ ID NO: 607879 - DNA, 13 bp, D. melanogaster
ccaaccgcccact

SEQ ID NO: 607880 - DNA, 13 bp, D. melanogaster
ccaacctaattat

SEQ ID NO: 607881 - DNA, 13 bp, D. melanogaster
ccaaccttaaaaa

SEQ ID NO: 607882 - DNA, 13 bp, D. melanogaster
ccaacgaacggtt

SEQ ID NO: 607883 - DNA, 13 bp, D. melanogaster
ccaacgattttaa

SEQ ID NO: 607884 - DNA, 15 bp, D. melanogaster
ccaacgcatcgccaa

SEQ ID NO: 607885 - DNA, 13 bp, D. melanogaster
ccaacgcattaga

SEQ ID NO: 607886 - DNA, 14 bp, D. melanogaster
ccaacgccagcaac

SEQ ID NO: 607887 - DNA, 13 bp, D. melanogaster
ccaacgctctgaa

SEQ ID NO: 607888 - DNA, 13 bp, D. melanogaster
ccaacggcacttg

SEQ ID NO: 607889 - DNA, 14 bp, D. melanogaster
ccaacgtcggacaa

SEQ ID NO: 607890 - DNA, 13 bp, D. melanogaster
ccaactaaaaatg

SEQ ID NO: 607891 - DNA, 13 bp, D. melanogaster
ccaactaattatc

SEQ ID NO: 607892 - DNA, 13 bp, D. melanogaster
ccaactaccaact

SEQ ID NO: 607893 - DNA, 13 bp, D. melanogaster
ccaactcaactca

SEQ ID NO: 607894 - DNA, 14 bp, D. melanogaster
ccaactccagctcc

SEQ ID NO: 607895 - DNA, 13 bp, D. melanogaster
ccaactcccaact

SEQ ID NO: 607896 - DNA, 13 bp, D. melanogaster
ccaactcgagaac

SEQ ID NO: 607897 - DNA, 13 bp, D. melanogaster
ccaactgaaaaaa

SEQ ID NO: 607898 - DNA, 13 bp, D. melanogaster
ccaactgcaaaac

SEQ ID NO: 607899 - DNA, 14 bp, D. melanogaster
ccaactgcaaaaca

SEQ ID NO: 607900 - DNA, 13 bp, D. melanogaster
ccaactgcaaact

SEQ ID NO: 607901 - DNA, 13 bp, D. melanogaster
ccaactgcaactt

SEQ ID NO: 607902 - DNA, 13 bp, D. melanogaster
ccaactgcaattg

SEQ ID NO: 607903 - DNA, 13 bp, D. melanogaster
ccaactgcagctc

SEQ ID NO: 607904 - DNA, 13 bp, D. melanogaster
ccaactgcagctg

SEQ ID NO: 607905 - DNA, 13 bp, D. melanogaster
ccaactgcagttg

SEQ ID NO: 607906 - DNA, 13 bp, D. melanogaster
ccaactgccaact

SEQ ID NO: 607907 - DNA, 13 bp, D. melanogaster
ccaactgcctgca

SEQ ID NO: 607908 - DNA, 13 bp, D. melanogaster
ccaactgctgctg

SEQ ID NO: 607909 - DNA, 13 bp, D. melanogaster
ccaactggccaac

SEQ ID NO: 607910 - DNA, 13 bp, D. melanogaster
ccaactggctggc

SEQ ID NO: 607911 - DNA, 13 bp, D. melanogaster
ccaactggtggtt

SEQ ID NO: 607912 - DNA, 13 bp, D. melanogaster
ccaactgttgcca

SEQ ID NO: 607913 - DNA, 15 bp, D. melanogaster
ccaacttaaactcaa

SEQ ID NO: 607914 - DNA, 13 bp, D. melanogaster
ccaacttcaacgg

SEQ ID NO: 607915 - DNA, 13 bp, D. melanogaster
ccaacttcatttg

SEQ ID NO: 607916 - DNA, 13 bp, D. melanogaster
ccaacttccaact

SEQ ID NO: 607917 - DNA, 13 bp, D. melanogaster
ccaacttgaaaat

SEQ ID NO: 607918 - DNA, 13 bp, D. melanogaster
ccaacttgcaact

SEQ ID NO: 607919 - DNA, 13 bp, D. melanogaster
ccaacttggccaa

SEQ ID NO: 607920 - DNA, 13 bp, D. melanogaster
ccaacttggtcga

SEQ ID NO: 607921 - DNA, 13 bp, D. melanogaster
ccaacttgttgtt

SEQ ID NO: 607922 - DNA, 13 bp, D. melanogaster
ccaactttatttg

SEQ ID NO: 607923 - DNA, 13 bp, D. melanogaster
ccaactttctgca

SEQ ID NO: 607924 - DNA, 13 bp, D. melanogaster
ccaactttggccg

SEQ ID NO: 607925 - DNA, 13 bp, D. melanogaster
ccaactttttgca

SEQ ID NO: 607926 - DNA, 13 bp, D. melanogaster
ccaactttttggg

SEQ ID NO: 607927 - DNA, 13 bp, D. melanogaster
ccaagaaaaaatc

SEQ ID NO: 607928 - DNA, 13 bp, D. melanogaster
ccaagaaaaagtt

SEQ ID NO: 607929 - DNA, 13 bp, D. melanogaster
ccaagaaaaatcc

SEQ ID NO: 607930 - DNA, 13 bp, D. melanogaster
ccaagaaaacctt

SEQ ID NO: 607931 - DNA, 13 bp, D. melanogaster
ccaagaaaatcgc

SEQ ID NO: 607932 - DNA, 14 bp, D. melanogaster
ccaagaaaatcgcc

SEQ ID NO: 607933 - DNA, 13 bp, D. melanogaster
ccaagaaattaaa

SEQ ID NO: 607934 - DNA, 13 bp, D. melanogaster
ccaagaacgctgc

SEQ ID NO: 607935 - DNA, 13 bp, D. melanogaster
ccaagaagaagat

SEQ ID NO: 607936 - DNA, 13 bp, D. melanogaster
ccaagaagaagtg

SEQ ID NO: 607937 - DNA, 13 bp, D. melanogaster
ccaagaagattgg

SEQ ID NO: 607938 - DNA, 13 bp, D. melanogaster
ccaagaagattta

SEQ ID NO: 607939 - DNA, 13 bp, D. melanogaster
ccaagaagccaaa

SEQ ID NO: 607940 - DNA, 14 bp, D. melanogaster
ccaagaagccgaaa

SEQ ID NO: 607941 - DNA, 14 bp, D. melanogaster
ccaagaagctaaaa

SEQ ID NO: 607942 - DNA, 13 bp, D. melanogaster
ccaagaagtactc

SEQ ID NO: 607943 - DNA, 13 bp, D. melanogaster
ccaagaatagaag

SEQ ID NO: 607944 - DNA, 13 bp, D. melanogaster
ccaagaatgctca

SEQ ID NO: 607945 - DNA, 14 bp, D. melanogaster
ccaagaatgctcat

SEQ ID NO: 607946 - DNA, 13 bp, D. melanogaster
ccaagaatttcgt

SEQ ID NO: 607947 - DNA, 13 bp, D. melanogaster
ccaagaatttgaa

SEQ ID NO: 607948 - DNA, 13 bp, D. melanogaster
ccaagacacattg

SEQ ID NO: 607949 - DNA, 13 bp, D. melanogaster
ccaagacatccga

SEQ ID NO: 607950 - DNA, 13 bp, D. melanogaster
ccaagaccaagac

SEQ ID NO: 607951 - DNA, 14 bp, D. melanogaster
ccaagaccaagacc

SEQ ID NO: 607952 - DNA, 13 bp, D. melanogaster
ccaagaccaagtc

SEQ ID NO: 607953 - DNA, 13 bp, D. melanogaster
ccaagacgacgat

SEQ ID NO: 607954 - DNA, 13 bp, D. melanogaster
ccaagacgcgcat

SEQ ID NO: 607955 - DNA, 13 bp, D. melanogaster
ccaagacggcggc

SEQ ID NO: 607956 - DNA, 13 bp, D. melanogaster
ccaagagaagagg

SEQ ID NO: 607957 - DNA, 13 bp, D. melanogaster
ccaagagcaatgc

SEQ ID NO: 607958 - DNA, 13 bp, D. melanogaster
ccaagagccaaaa

SEQ ID NO: 607959 - DNA, 13 bp, D. melanogaster
ccaagagcgaggc

SEQ ID NO: 607960 - DNA, 15 bp, D. melanogaster
ccaagaggcaggaat

SEQ ID NO: 607961 - DNA, 13 bp, D. melanogaster
ccaagaggtggag

SEQ ID NO: 607962 - DNA, 14 bp, D. melanogaster
ccaagatcatcaac

SEQ ID NO: 607963 - DNA, 13 bp, D. melanogaster
ccaagatcctgtc

SEQ ID NO: 607964 - DNA, 13 bp, D. melanogaster
ccaagcaaatcaa

SEQ ID NO: 607965 - DNA, 13 bp, D. melanogaster
ccaagcacaaagc

SEQ ID NO: 607966 - DNA, 13 bp, D. melanogaster
ccaagcactactc

SEQ ID NO: 607967 - DNA, 13 bp, D. melanogaster
ccaagcactggga

SEQ ID NO: 607968 - DNA, 13 bp, D. melanogaster
ccaagcagacgtt

SEQ ID NO: 607969 - DNA, 13 bp, D. melanogaster
ccaagcagccagc

SEQ ID NO: 607970 - DNA, 14 bp, D. melanogaster
ccaagcatttggcc

SEQ ID NO: 607971 - DNA, 13 bp, D. melanogaster
ccaagccaaaagc

SEQ ID NO: 607972 - DNA, 14 bp, D. melanogaster
ccaagccaagccaa

SEQ ID NO: 607973 - DNA, 13 bp, D. melanogaster
ccaagccaagccg

SEQ ID NO: 607974 - DNA, 14 bp, D. melanogaster
ccaagccaagtcaa

SEQ ID NO: 607975 - DNA, 13 bp, D. melanogaster
ccaagccaattat

SEQ ID NO: 607976 - DNA, 13 bp, D. melanogaster
ccaagccaggcca

SEQ ID NO: 607977 - DNA, 13 bp, D. melanogaster
ccaagcccaatcc

SEQ ID NO: 607978 - DNA, 13 bp, D. melanogaster
ccaagccgaaaag

SEQ ID NO: 607979 - DNA, 13 bp, D. melanogaster
ccaagctaaaaaa

SEQ ID NO: 607980 - DNA, 14 bp, D. melanogaster
ccaagctaaaggac

SEQ ID NO: 607981 - DNA, 13 bp, D. melanogaster
ccaagctccaagc

SEQ ID NO: 607982 - DNA, 13 bp, D. melanogaster
ccaagctctttaa

SEQ ID NO: 607983 - DNA, 13 bp, D. melanogaster
ccaagctgccact

SEQ ID NO: 607984 - DNA, 13 bp, D. melanogaster
ccaagctggccaa

SEQ ID NO: 607985 - DNA, 13 bp, D. melanogaster
ccaagcttggcga

SEQ ID NO: 607986 - DNA, 13 bp, D. melanogaster
ccaaggaaaaatc

SEQ ID NO: 607987 - DNA, 13 bp, D. melanogaster
ccaaggaattctg

SEQ ID NO: 607988 - DNA, 13 bp, D. melanogaster
ccaaggaccaagg

SEQ ID NO: 607989 - DNA, 14 bp, D. melanogaster
ccaaggaccaagga

SEQ ID NO: 607990 - DNA, 13 bp, D. melanogaster
ccaaggaggctca

SEQ ID NO: 607991 - DNA, 14 bp, D. melanogaster
ccaaggatcagcta

SEQ ID NO: 607992 - DNA, 13 bp, D. melanogaster
ccaaggatgccaa

SEQ ID NO: 607993 - DNA, 13 bp, D. melanogaster
ccaaggcaaacac

SEQ ID NO: 607994 - DNA, 13 bp, D. melanogaster
ccaaggcaaatgc

SEQ ID NO: 607995 - DNA, 13 bp, D. melanogaster
ccaaggtccaggc

SEQ ID NO: 607996 - DNA, 13 bp, D. melanogaster
ccaaggttataat

SEQ ID NO: 607997 - DNA, 13 bp, D. melanogaster
ccaagtcaagtcg

SEQ ID NO: 607998 - DNA, 13 bp, D. melanogaster
ccaagtcagaaaa

SEQ ID NO: 607999 - DNA, 13 bp, D. melanogaster
ccaagtccaagtc

SEQ ID NO: 608000 - DNA, 14 bp, D. melanogaster
ccaagtccaagtcc

SEQ ID NO: 608001 - DNA, 13 bp, D. melanogaster
ccaagtccaagtg

SEQ ID NO: 608002 - DNA, 13 bp, D. melanogaster
ccaagtccaagtt

SEQ ID NO: 608003 - DNA, 13 bp, D. melanogaster
ccaagtcgatctg

SEQ ID NO: 608004 - DNA, 13 bp, D. melanogaster
ccaagtctggaaa

SEQ ID NO: 608005 - DNA, 14 bp, D. melanogaster
ccaagtgaacaaat

SEQ ID NO: 608006 - DNA, 13 bp, D. melanogaster
ccaagtgagccgc

SEQ ID NO: 608007 - DNA, 13 bp, D. melanogaster
ccaagtgcagctg

SEQ ID NO: 608008 - DNA, 13 bp, D. melanogaster
ccaagtgccaagt

SEQ ID NO: 608009 - DNA, 14 bp, D. melanogaster
ccaagtgccaagtg

SEQ ID NO: 608010 - DNA, 13 bp, D. melanogaster
ccaagtggatgtt

SEQ ID NO: 608011 - DNA, 14 bp, D. melanogaster
ccaagtggcaagtg

SEQ ID NO: 608012 - DNA, 13 bp, D. melanogaster
ccaagtggccggg

SEQ ID NO: 608013 - DNA, 13 bp, D. melanogaster
ccaagtggcttca

SEQ ID NO: 608014 - DNA, 13 bp, D. melanogaster
ccaagtgggcgtg

SEQ ID NO: 608015 - DNA, 13 bp, D. melanogaster
ccaagtgtaagtg

SEQ ID NO: 608016 - DNA, 13 bp, D. melanogaster
ccaagtgtcaaaa

SEQ ID NO: 608017 - DNA, 14 bp, D. melanogaster
ccaagtgtgtgtgt

SEQ ID NO: 608018 - DNA, 13 bp, D. melanogaster
ccaagttatccaa

SEQ ID NO: 608019 - DNA, 13 bp, D. melanogaster
ccaagttcaagtg

SEQ ID NO: 608020 - DNA, 13 bp, D. melanogaster
ccaagttcagaaa

SEQ ID NO: 608021 - DNA, 13 bp, D. melanogaster
ccaagttccaagt

SEQ ID NO: 608022 - DNA, 13 bp, D. melanogaster
ccaagttcttttt

SEQ ID NO: 608023 - DNA, 13 bp, D. melanogaster
ccaagttgaagag

SEQ ID NO: 608024 - DNA, 14 bp, D. melanogaster
ccaagttgccaagt

SEQ ID NO: 608025 - DNA, 13 bp, D. melanogaster
ccaagttggtcca

SEQ ID NO: 608026 - DNA, 14 bp, D. melanogaster
ccaagttgtccgaa

SEQ ID NO: 608027 - DNA, 13 bp, D. melanogaster
ccaagtttacaca

SEQ ID NO: 608028 - DNA, 13 bp, D. melanogaster
ccaagtttttagt

SEQ ID NO: 608029 - DNA, 14 bp, D. melanogaster
ccaagttttttcaa

SEQ ID NO: 608030 - DNA, 13 bp, D. melanogaster
ccaataaaaaacg

SEQ ID NO: 608031 - DNA, 13 bp, D. melanogaster
ccaataaaaagtg

SEQ ID NO: 608032 - DNA, 13 bp, D. melanogaster
ccaataaaatgtg

SEQ ID NO: 608033 - DNA, 13 bp, D. melanogaster
ccaataaaatgtt

SEQ ID NO: 608034 - DNA, 14 bp, D. melanogaster
ccaataaaatgttt

SEQ ID NO: 608035 - DNA, 13 bp, D. melanogaster
ccaataaaattct

SEQ ID NO: 608036 - DNA, 13 bp, D. melanogaster
ccaataaacatag

SEQ ID NO: 608037 - DNA, 13 bp, D. melanogaster
ccaataaagaata

SEQ ID NO: 608038 - DNA, 13 bp, D. melanogaster
ccaataaatatgc

SEQ ID NO: 608039 - DNA, 13 bp, D. melanogaster
ccaataaatcact

SEQ ID NO: 608040 - DNA, 13 bp, D. melanogaster
ccaataaattaat

SEQ ID NO: 608041 - DNA, 13 bp, D. melanogaster
ccaataaatttgt

SEQ ID NO: 608042 - DNA, 14 bp, D. melanogaster
ccaataattttggt

SEQ ID NO: 608043 - DNA, 13 bp, D. melanogaster
ccaataccaatac

SEQ ID NO: 608044 - DNA, 14 bp, D. melanogaster
ccaataccaatacc

SEQ ID NO: 608045 - DNA, 13 bp, D. melanogaster
ccaataccgtgtg

SEQ ID NO: 608046 - DNA, 13 bp, D. melanogaster
ccaatactaacaa

SEQ ID NO: 608047 - DNA, 13 bp, D. melanogaster
ccaatactaacga

SEQ ID NO: 608048 - DNA, 13 bp, D. melanogaster
ccaatagcaaata

SEQ ID NO: 608049 - DNA, 13 bp, D. melanogaster
ccaatagcgccaa

SEQ ID NO: 608050 - DNA, 13 bp, D. melanogaster
ccaatatatatat

SEQ ID NO: 608051 - DNA, 14 bp, D. melanogaster
ccaatatatatata

SEQ ID NO: 608052 - DNA, 13 bp, D. melanogaster
ccaatatatattc

SEQ ID NO: 608053 - DNA, 13 bp, D. melanogaster
ccaatatattttt

SEQ ID NO: 608054 - DNA, 13 bp, D. melanogaster
ccaatatcaacaa

SEQ ID NO: 608055 - DNA, 13 bp, D. melanogaster
ccaatatctatca

SEQ ID NO: 608056 - DNA, 13 bp, D. melanogaster
ccaatatctatcg

SEQ ID NO: 608057 - DNA, 13 bp, D. melanogaster
ccaatatctattc

SEQ ID NO: 608058 - DNA, 13 bp, D. melanogaster
ccaatattgattt

SEQ ID NO: 608059 - DNA, 13 bp, D. melanogaster
ccaatatttgttt

SEQ ID NO: 608060 - DNA, 13 bp, D. melanogaster
ccaatattttatt

SEQ ID NO: 608061 - DNA, 13 bp, D. melanogaster
ccaatatttttta

SEQ ID NO: 608062 - DNA, 13 bp, D. melanogaster
ccaatcaaactgt

SEQ ID NO: 608063 - DNA, 13 bp, D. melanogaster
ccaatcaaagcaa

SEQ ID NO: 608064 - DNA, 13 bp, D. melanogaster
ccaatcacattgc

SEQ ID NO: 608065 - DNA, 13 bp, D. melanogaster
ccaatcacttttg

SEQ ID NO: 608066 - DNA, 14 bp, D. melanogaster
ccaatcagcagcat

SEQ ID NO: 608067 - DNA, 13 bp, D. melanogaster
ccaatccaaatcc

SEQ ID NO: 608068 - DNA, 13 bp, D. melanogaster
ccaatccaacaga

SEQ ID NO: 608069 - DNA, 13 bp, D. melanogaster
ccaatccaatccc

SEQ ID NO: 608070 - DNA, 13 bp, D. melanogaster
ccaatccaatccg

SEQ ID NO: 608071 - DNA, 14 bp, D. melanogaster
ccaatccaattcaa

SEQ ID NO: 608072 - DNA, 13 bp, D. melanogaster
ccaatccaattcc

SEQ ID NO: 608073 - DNA, 13 bp, D. melanogaster
ccaatccactcca

SEQ ID NO: 608074 - DNA, 13 bp, D. melanogaster
ccaatcccaatcc

SEQ ID NO: 608075 - DNA, 13 bp, D. melanogaster
ccaatcccaatgc

SEQ ID NO: 608076 - DNA, 13 bp, D. melanogaster
ccaatcccagtcc

SEQ ID NO: 608077 - DNA, 13 bp, D. melanogaster
ccaatcccatcca

SEQ ID NO: 608078 - DNA, 13 bp, D. melanogaster
ccaatcccattcc

SEQ ID NO: 608079 - DNA, 13 bp, D. melanogaster
ccaatccccaatc

SEQ ID NO: 608080 - DNA, 13 bp, D. melanogaster
ccaatccgaatcc

SEQ ID NO: 608081 - DNA, 13 bp, D. melanogaster
ccaatccgatccg

SEQ ID NO: 608082 - DNA, 13 bp, D. melanogaster
ccaatcctccaat

SEQ ID NO: 608083 - DNA, 13 bp, D. melanogaster
ccaatcgaatcga

SEQ ID NO: 608084 - DNA, 13 bp, D. melanogaster
ccaatcgaatgct

SEQ ID NO: 608085 - DNA, 14 bp, D. melanogaster
ccaatcgaatgctg

SEQ ID NO: 608086 - DNA, 14 bp, D. melanogaster
ccaatcgattggaa

SEQ ID NO: 608087 - DNA, 13 bp, D. melanogaster
ccaatctgcatat

SEQ ID NO: 608088 - DNA, 13 bp, D. melanogaster
ccaatctgtacaa

SEQ ID NO: 608089 - DNA, 14 bp, D. melanogaster
ccaatctgtacaaa

SEQ ID NO: 608090 - DNA, 14 bp, D. melanogaster
ccaatgaaaacaat

SEQ ID NO: 608091 - DNA, 13 bp, D. melanogaster
ccaatgaaaatga

SEQ ID NO: 608092 - DNA, 13 bp, D. melanogaster
ccaatgaaatgaa

SEQ ID NO: 608093 - DNA, 13 bp, D. melanogaster
ccaatgaagtgga

SEQ ID NO: 608094 - DNA, 13 bp, D. melanogaster
ccaatgatttaga

SEQ ID NO: 608095 - DNA, 13 bp, D. melanogaster
ccaatgcaaaaaa

SEQ ID NO: 608096 - DNA, 13 bp, D. melanogaster
ccaatgcaaatgg

SEQ ID NO: 608097 - DNA, 13 bp, D. melanogaster
ccaatgcaatgca

SEQ ID NO: 608098 - DNA, 13 bp, D. melanogaster
ccaatgcagtttt

SEQ ID NO: 608099 - DNA, 13 bp, D. melanogaster
ccaatgccaatgg

SEQ ID NO: 608100 - DNA, 13 bp, D. melanogaster
ccaatgccaccca

SEQ ID NO: 608101 - DNA, 13 bp, D. melanogaster
ccaatgccattgc

SEQ ID NO: 608102 - DNA, 13 bp, D. melanogaster
ccaatgccatttt

SEQ ID NO: 608103 - DNA, 13 bp, D. melanogaster
ccaatgcttctaa

SEQ ID NO: 608104 - DNA, 13 bp, D. melanogaster
ccaatggaagatg

SEQ ID NO: 608105 - DNA, 13 bp, D. melanogaster
ccaatggatcaga

SEQ ID NO: 608106 - DNA, 13 bp, D. melanogaster
ccaatggcaaaca

SEQ ID NO: 608107 - DNA, 13 bp, D. melanogaster
ccaatggccaatg

SEQ ID NO: 608108 - DNA, 13 bp, D. melanogaster
ccaatgggagtcg

SEQ ID NO: 608109 - DNA, 13 bp, D. melanogaster
ccaatggggaaca

SEQ ID NO: 608110 - DNA, 13 bp, D. melanogaster
ccaatggtatcaa

SEQ ID NO: 608111 - DNA, 13 bp, D. melanogaster
ccaatggtcgaaa

SEQ ID NO: 608112 - DNA, 14 bp, D. melanogaster
ccaatgtaataaat

SEQ ID NO: 608113 - DNA, 13 bp, D. melanogaster
ccaatgtgtgtgt

SEQ ID NO: 608114 - DNA, 13 bp, D. melanogaster
ccaatgttgatgc

SEQ ID NO: 608115 - DNA, 13 bp, D. melanogaster
ccaattaaaagca

SEQ ID NO: 608116 - DNA, 13 bp, D. melanogaster
ccaattaaaagtg

SEQ ID NO: 608117 - DNA, 13 bp, D. melanogaster
ccaattaaaatac

SEQ ID NO: 608118 - DNA, 13 bp, D. melanogaster
ccaattaaagttg

SEQ ID NO: 608119 - DNA, 13 bp, D. melanogaster
ccaattaaattgg

SEQ ID NO: 608120 - DNA, 13 bp, D. melanogaster
ccaattaagaaca

SEQ ID NO: 608121 - DNA, 14 bp, D. melanogaster
ccaattaagaacac

SEQ ID NO: 608122 - DNA, 13 bp, D. melanogaster
ccaattaataaac

SEQ ID NO: 608123 - DNA, 13 bp, D. melanogaster
ccaattaattaat

SEQ ID NO: 608124 - DNA, 13 bp, D. melanogaster
ccaattaattgaa

SEQ ID NO: 608125 - DNA, 13 bp, D. melanogaster
ccaattaccaatt

SEQ ID NO: 608126 - DNA, 13 bp, D. melanogaster
ccaattattttta

SEQ ID NO: 608127 - DNA, 13 bp, D. melanogaster
ccaattcaatttt

SEQ ID NO: 608128 - DNA, 13 bp, D. melanogaster
ccaattccaatcc

SEQ ID NO: 608129 - DNA, 13 bp, D. melanogaster
ccaattccatttt

SEQ ID NO: 608130 - DNA, 13 bp, D. melanogaster
ccaattcccaatt

SEQ ID NO: 608131 - DNA, 13 bp, D. melanogaster
ccaattcccattc

SEQ ID NO: 608132 - DNA, 13 bp, D. melanogaster
ccaattccgacaa

SEQ ID NO: 608133 - DNA, 14 bp, D. melanogaster
ccaattccgattcc

SEQ ID NO: 608134 - DNA, 13 bp, D. melanogaster
ccaattcgatttt

SEQ ID NO: 608135 - DNA, 13 bp, D. melanogaster
ccaattgaaatcg

SEQ ID NO: 608136 - DNA, 13 bp, D. melanogaster
ccaattgagaaca

SEQ ID NO: 608137 - DNA, 14 bp, D. melanogaster
ccaattgatcaaaa

SEQ ID NO: 608138 - DNA, 13 bp, D. melanogaster
ccaattgcagctg

SEQ ID NO: 608139 - DNA, 14 bp, D. melanogaster
ccaattgcagctgg

SEQ ID NO: 608140 - DNA, 13 bp, D. melanogaster
ccaattgcagttg

SEQ ID NO: 608141 - DNA, 13 bp, D. melanogaster
ccaattgccaaat

SEQ ID NO: 608142 - DNA, 13 bp, D. melanogaster
ccaattgccaatt

SEQ ID NO: 608143 - DNA, 14 bp, D. melanogaster
ccaattggcaattg

SEQ ID NO: 608144 - DNA, 13 bp, D. melanogaster
ccaattggccaaa

SEQ ID NO: 608145 - DNA, 13 bp, D. melanogaster
ccaattggccaat

SEQ ID NO: 608146 - DNA, 13 bp, D. melanogaster
ccaatttaataaa

SEQ ID NO: 608147 - DNA, 13 bp, D. melanogaster
ccaatttaatttt

SEQ ID NO: 608148 - DNA, 13 bp, D. melanogaster
ccaatttacaaac

SEQ ID NO: 608149 - DNA, 13 bp, D. melanogaster
ccaatttataaaa

SEQ ID NO: 608150 - DNA, 13 bp, D. melanogaster
ccaatttcaaatt

SEQ ID NO: 608151 - DNA, 13 bp, D. melanogaster
ccaatttccaatt

SEQ ID NO: 608152 - DNA, 13 bp, D. melanogaster
ccaatttcccgaa

SEQ ID NO: 608153 - DNA, 14 bp, D. melanogaster
ccaatttcccgaaa

SEQ ID NO: 608154 - DNA, 14 bp, D. melanogaster
ccaatttccgtgct

SEQ ID NO: 608155 - DNA, 13 bp, D. melanogaster
ccaatttcggttt

SEQ ID NO: 608156 - DNA, 13 bp, D. melanogaster
ccaatttcgttag

SEQ ID NO: 608157 - DNA, 13 bp, D. melanogaster
ccaatttgaatat

SEQ ID NO: 608158 - DNA, 13 bp, D. melanogaster
ccaatttgaatgc

SEQ ID NO: 608159 - DNA, 13 bp, D. melanogaster
ccaatttgagttg

SEQ ID NO: 608160 - DNA, 13 bp, D. melanogaster
ccaatttggattt

SEQ ID NO: 608161 - DNA, 14 bp, D. melanogaster
ccaatttgtaattt

SEQ ID NO: 608162 - DNA, 13 bp, D. melanogaster
ccaatttgtttgc

SEQ ID NO: 608163 - DNA, 14 bp, D. melanogaster
ccaattttacaatt

SEQ ID NO: 608164 - DNA, 13 bp, D. melanogaster
ccaattttagaag

SEQ ID NO: 608165 - DNA, 13 bp, D. melanogaster
ccaattttattaa

SEQ ID NO: 608166 - DNA, 13 bp, D. melanogaster
ccaattttattta

SEQ ID NO: 608167 - DNA, 13 bp, D. melanogaster
ccaattttccatt

SEQ ID NO: 608168 - DNA, 13 bp, D. melanogaster
ccaattttcccaa

SEQ ID NO: 608169 - DNA, 13 bp, D. melanogaster
ccaattttctata

SEQ ID NO: 608170 - DNA, 14 bp, D. melanogaster
ccaattttctatat

SEQ ID NO: 608171 - DNA, 13 bp, D. melanogaster
ccaattttggtca

SEQ ID NO: 608172 - DNA, 13 bp, D. melanogaster
ccaatttttaaca

SEQ ID NO: 608173 - DNA, 14 bp, D. melanogaster
ccaatttttttttg

SEQ ID NO: 608174 - DNA, 13 bp, D. melanogaster
ccacaaaaagcag

SEQ ID NO: 608175 - DNA, 14 bp, D. melanogaster
ccacaaaaatactt

SEQ ID NO: 608176 - DNA, 13 bp, D. melanogaster
ccacaaaaatgaa

SEQ ID NO: 608177 - DNA, 13 bp, D. melanogaster
ccacaaaaatgca

SEQ ID NO: 608178 - DNA, 13 bp, D. melanogaster
ccacaaaaatgtg

SEQ ID NO: 608179 - DNA, 13 bp, D. melanogaster
ccacaaaatatgc

SEQ ID NO: 608180 - DNA, 13 bp, D. melanogaster
ccacaaaatattt

SEQ ID NO: 608181 - DNA, 13 bp, D. melanogaster
ccacaaaatggca

SEQ ID NO: 608182 - DNA, 13 bp, D. melanogaster
ccacaaaatgtat

SEQ ID NO: 608183 - DNA, 13 bp, D. melanogaster
ccacaaaatgtgc

SEQ ID NO: 608184 - DNA, 13 bp, D. melanogaster
ccacaaaatgttg

SEQ ID NO: 608185 - DNA, 13 bp, D. melanogaster
ccacaaaatttca

SEQ ID NO: 608186 - DNA, 13 bp, D. melanogaster
ccacaaatctgat

SEQ ID NO: 608187 - DNA, 13 bp, D. melanogaster
ccacaaatgttgc

SEQ ID NO: 608188 - DNA, 13 bp, D. melanogaster
ccacaaattcaat

SEQ ID NO: 608189 - DNA, 14 bp, D. melanogaster
ccacaacccattat

SEQ ID NO: 608190 - DNA, 13 bp, D. melanogaster
ccacaacgcattt

SEQ ID NO: 608191 - DNA, 14 bp, D. melanogaster
ccacaactcactca

SEQ ID NO: 608192 - DNA, 13 bp, D. melanogaster
ccacaagccgtac

SEQ ID NO: 608193 - DNA, 13 bp, D. melanogaster
ccacaagcctttt

SEQ ID NO: 608194 - DNA, 13 bp, D. melanogaster
ccacaatgtccga

SEQ ID NO: 608195 - DNA, 13 bp, D. melanogaster
ccacaattaaatt

SEQ ID NO: 608196 - DNA, 13 bp, D. melanogaster
ccacaattcaata

SEQ ID NO: 608197 - DNA, 13 bp, D. melanogaster
ccacaatttatgc

SEQ ID NO: 608198 - DNA, 13 bp, D. melanogaster
ccacaatttgttt

SEQ ID NO: 608199 - DNA, 13 bp, D. melanogaster
ccacacaaatgtg

SEQ ID NO: 608200 - DNA, 13 bp, D. melanogaster
ccacacaaattgc

SEQ ID NO: 608201 - DNA, 13 bp, D. melanogaster
ccacacacacgta

SEQ ID NO: 608202 - DNA, 13 bp, D. melanogaster
ccacacacactcg

SEQ ID NO: 608203 - DNA, 13 bp, D. melanogaster
ccacacacacttg

SEQ ID NO: 608204 - DNA, 13 bp, D. melanogaster
ccacacacatatg

SEQ ID NO: 608205 - DNA, 13 bp, D. melanogaster
ccacacacttgca

SEQ ID NO: 608206 - DNA, 13 bp, D. melanogaster
ccacacacttttc

SEQ ID NO: 608207 - DNA, 13 bp, D. melanogaster
ccacacagacgca

SEQ ID NO: 608208 - DNA, 13 bp, D. melanogaster
ccacacagcagca

SEQ ID NO: 608209 - DNA, 14 bp, D. melanogaster
ccacacatacatat

SEQ ID NO: 608210 - DNA, 13 bp, D. melanogaster
ccacacatataca

SEQ ID NO: 608211 - DNA, 13 bp, D. melanogaster
ccacacatatata

SEQ ID NO: 608212 - DNA, 13 bp, D. melanogaster
ccacaccttttat

SEQ ID NO: 608213 - DNA, 14 bp, D. melanogaster
ccacacggcgtatg

SEQ ID NO: 608214 - DNA, 13 bp, D. melanogaster
ccacactatatcc

SEQ ID NO: 608215 - DNA, 14 bp, D. melanogaster
ccacactgcgtatg

SEQ ID NO: 608216 - DNA, 13 bp, D. melanogaster
ccacacttttgaa

SEQ ID NO: 608217 - DNA, 14 bp, D. melanogaster
ccacacttttgaaa

SEQ ID NO: 608218 - DNA, 13 bp, D. melanogaster
ccacacttttgca

SEQ ID NO: 608219 - DNA, 13 bp, D. melanogaster
ccacagacttttt

SEQ ID NO: 608220 - DNA, 13 bp, D. melanogaster
ccacagatacaga

SEQ ID NO: 608221 - DNA, 13 bp, D. melanogaster
ccacagatataaa

SEQ ID NO: 608222 - DNA, 13 bp, D. melanogaster
ccacagcaacaat

SEQ ID NO: 608223 - DNA, 13 bp, D. melanogaster
ccacagcagcaac

SEQ ID NO: 608224 - DNA, 14 bp, D. melanogaster
ccacagcagcaaca

SEQ ID NO: 608225 - DNA, 13 bp, D. melanogaster
ccacagcatggac

SEQ ID NO: 608226 - DNA, 13 bp, D. melanogaster
ccacagcatgttg

SEQ ID NO: 608227 - DNA, 13 bp, D. melanogaster
ccacagccttctt

SEQ ID NO: 608228 - DNA, 13 bp, D. melanogaster
ccacagctccaca

SEQ ID NO: 608229 - DNA, 13 bp, D. melanogaster
ccacagctgcagt

SEQ ID NO: 608230 - DNA, 13 bp, D. melanogaster
ccacagtcaaccg

SEQ ID NO: 608231 - DNA, 13 bp, D. melanogaster
ccacagtcaattt

SEQ ID NO: 608232 - DNA, 13 bp, D. melanogaster
ccacagtggtgac

SEQ ID NO: 608233 - DNA, 13 bp, D. melanogaster
ccacagtgttttt

SEQ ID NO: 608234 - DNA, 13 bp, D. melanogaster
ccacagttcttgg

SEQ ID NO: 608235 - DNA, 13 bp, D. melanogaster
ccacagttttagt

SEQ ID NO: 608236 - DNA, 13 bp, D. melanogaster
ccacataaatata

SEQ ID NO: 608237 - DNA, 13 bp, D. melanogaster
ccacatacacctc

SEQ ID NO: 608238 - DNA, 14 bp, D. melanogaster
ccacatacacctca

SEQ ID NO: 608239 - DNA, 13 bp, D. melanogaster
ccacatacatatg

SEQ ID NO: 608240 - DNA, 13 bp, D. melanogaster
ccacatacccatt

SEQ ID NO: 608241 - DNA, 13 bp, D. melanogaster
ccacatatacata

SEQ ID NO: 608242 - DNA, 13 bp, D. melanogaster
ccacatatccaca

SEQ ID NO: 608243 - DNA, 14 bp, D. melanogaster
ccacatatgtacat

SEQ ID NO: 608244 - DNA, 13 bp, D. melanogaster
ccacatatgtata

SEQ ID NO: 608245 - DNA, 13 bp, D. melanogaster
ccacatattttat

SEQ ID NO: 608246 - DNA, 13 bp, D. melanogaster
ccacatcaccatc

SEQ ID NO: 608247 - DNA, 13 bp, D. melanogaster
ccacatcatctac

SEQ ID NO: 608248 - DNA, 14 bp, D. melanogaster
ccacatcatctaca

SEQ ID NO: 608249 - DNA, 13 bp, D. melanogaster
ccacatccacatc

SEQ ID NO: 608250 - DNA, 14 bp, D. melanogaster
ccacatccacatca

SEQ ID NO: 608251 - DNA, 14 bp, D. melanogaster
ccacatccacatcg

SEQ ID NO: 608252 - DNA, 13 bp, D. melanogaster
ccacatccacatt

SEQ ID NO: 608253 - DNA, 13 bp, D. melanogaster
ccacatccacgtc

SEQ ID NO: 608254 - DNA, 14 bp, D. melanogaster
ccacatccacgtcc

SEQ ID NO: 608255 - DNA, 14 bp, D. melanogaster
ccacatccacttcc

SEQ ID NO: 608256 - DNA, 13 bp, D. melanogaster
ccacatccacttt

SEQ ID NO: 608257 - DNA, 13 bp, D. melanogaster
ccacatccatcca

SEQ ID NO: 608258 - DNA, 13 bp, D. melanogaster
ccacatcccacat

SEQ ID NO: 608259 - DNA, 15 bp, D. melanogaster
ccacatccgcatccg

SEQ ID NO: 608260 - DNA, 14 bp, D. melanogaster
ccacatcgtcagca

SEQ ID NO: 608261 - DNA, 14 bp, D. melanogaster
ccacatcgtcgacc

SEQ ID NO: 608262 - DNA, 13 bp, D. melanogaster
ccacatctacatc

SEQ ID NO: 608263 - DNA, 13 bp, D. melanogaster
ccacatcttcatc

SEQ ID NO: 608264 - DNA, 13 bp, D. melanogaster
ccacatgaatttc

SEQ ID NO: 608265 - DNA, 13 bp, D. melanogaster
ccacatgcacaca

SEQ ID NO: 608266 - DNA, 13 bp, D. melanogaster
ccacatgccacac

SEQ ID NO: 608267 - DNA, 13 bp, D. melanogaster
ccacatgccccat

SEQ ID NO: 608268 - DNA, 13 bp, D. melanogaster
ccacatgccgcat

SEQ ID NO: 608269 - DNA, 13 bp, D. melanogaster
ccacatggaattg

SEQ ID NO: 608270 - DNA, 13 bp, D. melanogaster
ccacatggccaca

SEQ ID NO: 608271 - DNA, 13 bp, D. melanogaster
ccacatgtgtgtg

SEQ ID NO: 608272 - DNA, 13 bp, D. melanogaster
ccacattatccca

SEQ ID NO: 608273 - DNA, 14 bp, D. melanogaster
ccacattcacatcc

SEQ ID NO: 608274 - DNA, 13 bp, D. melanogaster
ccacattctgcag

SEQ ID NO: 608275 - DNA, 13 bp, D. melanogaster
ccacattgccaca

SEQ ID NO: 608276 - DNA, 13 bp, D. melanogaster
ccacatttccaca

SEQ ID NO: 608277 - DNA, 13 bp, D. melanogaster
ccacatttgccga

SEQ ID NO: 608278 - DNA, 13 bp, D. melanogaster
ccacattttccac

SEQ ID NO: 608279 - DNA, 13 bp, D. melanogaster
ccacatttttgaa

SEQ ID NO: 608280 - DNA, 14 bp, D. melanogaster
ccacatttttgaac

SEQ ID NO: 608281 - DNA, 13 bp, D. melanogaster
ccaccaaaaattt

SEQ ID NO: 608282 - DNA, 13 bp, D. melanogaster
ccaccaaagccat

SEQ ID NO: 608283 - DNA, 14 bp, D. melanogaster
ccaccaaagggtca

SEQ ID NO: 608284 - DNA, 13 bp, D. melanogaster
ccaccaaccagat

SEQ ID NO: 608285 - DNA, 13 bp, D. melanogaster
ccaccaaggaggc

SEQ ID NO: 608286 - DNA, 14 bp, D. melanogaster
ccaccaattgagaa

SEQ ID NO: 608287 - DNA, 14 bp, D. melanogaster
ccaccaatttggat

SEQ ID NO: 608288 - DNA, 13 bp, D. melanogaster
ccaccacaattta

SEQ ID NO: 608289 - DNA, 13 bp, D. melanogaster
ccaccaccatcat

SEQ ID NO: 608290 - DNA, 14 bp, D. melanogaster
ccaccacccactgc

SEQ ID NO: 608291 - DNA, 14 bp, D. melanogaster
ccaccacccacttg

SEQ ID NO: 608292 - DNA, 13 bp, D. melanogaster
ccaccacccatcg

SEQ ID NO: 608293 - DNA, 13 bp, D. melanogaster
ccaccaccccagt

SEQ ID NO: 608294 - DNA, 13 bp, D. melanogaster
ccaccactatttt

SEQ ID NO: 608295 - DNA, 13 bp, D. melanogaster
ccaccacttttcc

SEQ ID NO: 608296 - DNA, 13 bp, D. melanogaster
ccaccagcaataa

SEQ ID NO: 608297 - DNA, 13 bp, D. melanogaster
ccaccagcagcaa

SEQ ID NO: 608298 - DNA, 14 bp, D. melanogaster
ccaccagcagcagc

SEQ ID NO: 608299 - DNA, 15 bp, D. melanogaster
ccaccagcagcagca

SEQ ID NO: 608300 - DNA, 13 bp, D. melanogaster
ccaccagcgacag

SEQ ID NO: 608301 - DNA, 13 bp, D. melanogaster
ccaccagctccac

SEQ ID NO: 608302 - DNA, 13 bp, D. melanogaster
ccaccagttggga

SEQ ID NO: 608303 - DNA, 13 bp, D. melanogaster
ccaccattcaaga

SEQ ID NO: 608304 - DNA, 13 bp, D. melanogaster
ccaccattcagtt

SEQ ID NO: 608305 - DNA, 13 bp, D. melanogaster
ccaccatttgaaa

SEQ ID NO: 608306 - DNA, 13 bp, D. melanogaster
ccaccattttggg

SEQ ID NO: 608307 - DNA, 14 bp, D. melanogaster
ccaccattttgggt

SEQ ID NO: 608308 - DNA, 13 bp, D. melanogaster
ccacccacatttc

SEQ ID NO: 608309 - DNA, 13 bp, D. melanogaster
ccacccactcagc

SEQ ID NO: 608310 - DNA, 13 bp, D. melanogaster
ccacccactcatt

SEQ ID NO: 608311 - DNA, 13 bp, D. melanogaster
ccacccactcgaa

SEQ ID NO: 608312 - DNA, 13 bp, D. melanogaster
ccacccactcgca

SEQ ID NO: 608313 - DNA, 13 bp, D. melanogaster
ccacccactgcac

SEQ ID NO: 608314 - DNA, 14 bp, D. melanogaster
ccacccactgcacc

SEQ ID NO: 608315 - DNA, 13 bp, D. melanogaster
ccacccactgcca

SEQ ID NO: 608316 - DNA, 14 bp, D. melanogaster
ccacccactgccac

SEQ ID NO: 608317 - DNA, 13 bp, D. melanogaster
ccacccactggcc

SEQ ID NO: 608318 - DNA, 13 bp, D. melanogaster
ccacccacttgaa

SEQ ID NO: 608319 - DNA, 13 bp, D. melanogaster
ccacccacttgcc

SEQ ID NO: 608320 - DNA, 13 bp, D. melanogaster
ccacccacttggc

SEQ ID NO: 608321 - DNA, 13 bp, D. melanogaster
ccacccactttct

SEQ ID NO: 608322 - DNA, 13 bp, D. melanogaster
ccacccactttta

SEQ ID NO: 608323 - DNA, 13 bp, D. melanogaster
ccacccacttttc

SEQ ID NO: 608324 - DNA, 13 bp, D. melanogaster
ccacccagccatc

SEQ ID NO: 608325 - DNA, 13 bp, D. melanogaster
ccacccagtcacc

SEQ ID NO: 608326 - DNA, 13 bp, D. melanogaster
ccacccatgtggc

SEQ ID NO: 608327 - DNA, 13 bp, D. melanogaster
ccacccattgcca

SEQ ID NO: 608328 - DNA, 13 bp, D. melanogaster
ccacccatttgcc

SEQ ID NO: 608329 - DNA, 13 bp, D. melanogaster
ccacccattttcc

SEQ ID NO: 608330 - DNA, 14 bp, D. melanogaster
ccacccgaagactg

SEQ ID NO: 608331 - DNA, 14 bp, D. melanogaster
ccacccgcttttcc

SEQ ID NO: 608332 - DNA, 13 bp, D. melanogaster
ccaccctcgatca

SEQ ID NO: 608333 - DNA, 13 bp, D. melanogaster
ccaccctcgatgc

SEQ ID NO: 608334 - DNA, 13 bp, D. melanogaster
ccaccgaatggca

SEQ ID NO: 608335 - DNA, 13 bp, D. melanogaster
ccaccgactgaaa

SEQ ID NO: 608336 - DNA, 13 bp, D. melanogaster
ccaccgcccactt

SEQ ID NO: 608337 - DNA, 14 bp, D. melanogaster
ccaccgcccacttt

SEQ ID NO: 608338 - DNA, 13 bp, D. melanogaster
ccaccgcccatcg

SEQ ID NO: 608339 - DNA, 14 bp, D. melanogaster
ccaccgcccatcgc

SEQ ID NO: 608340 - DNA, 13 bp, D. melanogaster
ccaccggaattcc

SEQ ID NO: 608341 - DNA, 13 bp, D. melanogaster
ccaccgtgtgctt

SEQ ID NO: 608342 - DNA, 13 bp, D. melanogaster
ccacctaaaaaga

SEQ ID NO: 608343 - DNA, 13 bp, D. melanogaster
ccacctacaaata

SEQ ID NO: 608344 - DNA, 13 bp, D. melanogaster
ccacctacgctga

SEQ ID NO: 608345 - DNA, 13 bp, D. melanogaster
ccacctccatttc

SEQ ID NO: 608346 - DNA, 13 bp, D. melanogaster
ccacctctgcctc

SEQ ID NO: 608347 - DNA, 13 bp, D. melanogaster
ccacctgcaccac

SEQ ID NO: 608348 - DNA, 14 bp, D. melanogaster
ccacctgcccacct

SEQ ID NO: 608349 - DNA, 13 bp, D. melanogaster
ccaccttctttgg

SEQ ID NO: 608350 - DNA, 13 bp, D. melanogaster
ccaccttgtgcaa

SEQ ID NO: 608351 - DNA, 13 bp, D. melanogaster
ccacgaccaagaa

SEQ ID NO: 608352 - DNA, 13 bp, D. melanogaster
ccacgaccacgac

SEQ ID NO: 608353 - DNA, 13 bp, D. melanogaster
ccacgagttcaaa

SEQ ID NO: 608354 - DNA, 13 bp, D. melanogaster
ccacgatgatgat

SEQ ID NO: 608355 - DNA, 13 bp, D. melanogaster
ccacgatgtgatg

SEQ ID NO: 608356 - DNA, 14 bp, D. melanogaster
ccacgcaacaaact

SEQ ID NO: 608357 - DNA, 13 bp, D. melanogaster
ccacgcacacgac

SEQ ID NO: 608358 - DNA, 13 bp, D. melanogaster
ccacgcatttcaa

SEQ ID NO: 608359 - DNA, 14 bp, D. melanogaster
ccacgcatttcaag

SEQ ID NO: 608360 - DNA, 13 bp, D. melanogaster
ccacgcccacaat

SEQ ID NO: 608361 - DNA, 14 bp, D. melanogaster
ccacgcccacaatt

SEQ ID NO: 608362 - DNA, 13 bp, D. melanogaster
ccacgcccacact

SEQ ID NO: 608363 - DNA, 13 bp, D. melanogaster
ccacgcccacatc

SEQ ID NO: 608364 - DNA, 13 bp, D. melanogaster
ccacgcccacatt

SEQ ID NO: 608365 - DNA, 13 bp, D. melanogaster
ccacgcccactca

SEQ ID NO: 608366 - DNA, 14 bp, D. melanogaster
ccacgcccactcaa

SEQ ID NO: 608367 - DNA, 14 bp, D. melanogaster
ccacgcccactcac

SEQ ID NO: 608368 - DNA, 13 bp, D. melanogaster
ccacgcccactct

SEQ ID NO: 608369 - DNA, 14 bp, D. melanogaster
ccacgcccactcta

SEQ ID NO: 608370 - DNA, 14 bp, D. melanogaster
ccacgcccactctt

SEQ ID NO: 608371 - DNA, 14 bp, D. melanogaster
ccacgcccactgcc

SEQ ID NO: 608372 - DNA, 13 bp, D. melanogaster
ccacgcccactgg

SEQ ID NO: 608373 - DNA, 13 bp, D. melanogaster
ccacgcccactta

SEQ ID NO: 608374 - DNA, 13 bp, D. melanogaster
ccacgcccacttg

SEQ ID NO: 608375 - DNA, 14 bp, D. melanogaster
ccacgcccactttt

SEQ ID NO: 608376 - DNA, 13 bp, D. melanogaster
ccacgcccatcgc

SEQ ID NO: 608377 - DNA, 13 bp, D. melanogaster
ccacgcccatttg

SEQ ID NO: 608378 - DNA, 13 bp, D. melanogaster
ccacgccccattt

SEQ ID NO: 608379 - DNA, 13 bp, D. melanogaster
ccacgccccctgg

SEQ ID NO: 608380 - DNA, 14 bp, D. melanogaster
ccacgccccctggc

SEQ ID NO: 608381 - DNA, 14 bp, D. melanogaster
ccacgcccccttcg

SEQ ID NO: 608382 - DNA, 14 bp, D. melanogaster
ccacgcccccttgg

SEQ ID NO: 608383 - DNA, 13 bp, D. melanogaster
ccacgcccccttt

SEQ ID NO: 608384 - DNA, 14 bp, D. melanogaster
ccacgccccctttt

SEQ ID NO: 608385 - DNA, 13 bp, D. melanogaster
ccacggacgacac

SEQ ID NO: 608386 - DNA, 14 bp, D. melanogaster
ccacggggcgtatg

SEQ ID NO: 608387 - DNA, 13 bp, D. melanogaster
ccacgtacacaca

SEQ ID NO: 608388 - DNA, 13 bp, D. melanogaster
ccacgtccacatc

SEQ ID NO: 608389 - DNA, 13 bp, D. melanogaster
ccacgtccactct

SEQ ID NO: 608390 - DNA, 15 bp, D. melanogaster
ccacgtccagttttt

SEQ ID NO: 608391 - DNA, 13 bp, D. melanogaster
ccacgtccatgtc

SEQ ID NO: 608392 - DNA, 13 bp, D. melanogaster
ccacgtcgcccat

SEQ ID NO: 608393 - DNA, 13 bp, D. melanogaster
ccacgttgaatct

SEQ ID NO: 608394 - DNA, 13 bp, D. melanogaster
ccacgtttttttt

SEQ ID NO: 608395 - DNA, 13 bp, D. melanogaster
ccactaaaaatat

SEQ ID NO: 608396 - DNA, 13 bp, D. melanogaster
ccactaacctctt

SEQ ID NO: 608397 - DNA, 13 bp, D. melanogaster
ccactacagaaca

SEQ ID NO: 608398 - DNA, 13 bp, D. melanogaster
ccactaccactac

SEQ ID NO: 608399 - DNA, 13 bp, D. melanogaster
ccactactactac

SEQ ID NO: 608400 - DNA, 14 bp, D. melanogaster
ccactactactact

SEQ ID NO: 608401 - DNA, 13 bp, D. melanogaster
ccactataacgcc

SEQ ID NO: 608402 - DNA, 13 bp, D. melanogaster
ccactatacacac

SEQ ID NO: 608403 - DNA, 13 bp, D. melanogaster
ccactatcaatca

SEQ ID NO: 608404 - DNA, 13 bp, D. melanogaster
ccactatgccact

SEQ ID NO: 608405 - DNA, 13 bp, D. melanogaster
ccactatggatgc

SEQ ID NO: 608406 - DNA, 13 bp, D. melanogaster
ccactatttttac

SEQ ID NO: 608407 - DNA, 14 bp, D. melanogaster
ccactcaactcttc

SEQ ID NO: 608408 - DNA, 13 bp, D. melanogaster
ccactcaagagag

SEQ ID NO: 608409 - DNA, 14 bp, D. melanogaster
ccactcacacacat

SEQ ID NO: 608410 - DNA, 13 bp, D. melanogaster
ccactcacactca

SEQ ID NO: 608411 - DNA, 13 bp, D. melanogaster
ccactcacccata

SEQ ID NO: 608412 - DNA, 13 bp, D. melanogaster
ccactcagccact

SEQ ID NO: 608413 - DNA, 13 bp, D. melanogaster
ccactccaacgcc

SEQ ID NO: 608414 - DNA, 13 bp, D. melanogaster
ccactccacttca

SEQ ID NO: 608415 - DNA, 13 bp, D. melanogaster
ccactccattcca

SEQ ID NO: 608416 - DNA, 14 bp, D. melanogaster
ccactcccactcta

SEQ ID NO: 608417 - DNA, 13 bp, D. melanogaster
ccactcccacttt

SEQ ID NO: 608418 - DNA, 13 bp, D. melanogaster
ccactcccctgga

SEQ ID NO: 608419 - DNA, 13 bp, D. melanogaster
ccactcccgaaag

SEQ ID NO: 608420 - DNA, 13 bp, D. melanogaster
ccactccctagaa

SEQ ID NO: 608421 - DNA, 14 bp, D. melanogaster
ccactccgaagtcc

SEQ ID NO: 608422 - DNA, 13 bp, D. melanogaster
ccactcctcggat

SEQ ID NO: 608423 - DNA, 13 bp, D. melanogaster
ccactcgaaggca

SEQ ID NO: 608424 - DNA, 14 bp, D. melanogaster
ccactcgaaggcaa

SEQ ID NO: 608425 - DNA, 14 bp, D. melanogaster
ccactcgaatggaa

SEQ ID NO: 608426 - DNA, 13 bp, D. melanogaster
ccactcgactcac

SEQ ID NO: 608427 - DNA, 13 bp, D. melanogaster
ccactcgactcca

SEQ ID NO: 608428 - DNA, 14 bp, D. melanogaster
ccactcgactccac

SEQ ID NO: 608429 - DNA, 13 bp, D. melanogaster
ccactcgattgct

SEQ ID NO: 608430 - DNA, 15 bp, D. melanogaster
ccactcgcagccggt

SEQ ID NO: 608431 - DNA, 13 bp, D. melanogaster
ccactctaacgcc

SEQ ID NO: 608432 - DNA, 14 bp, D. melanogaster
ccactctaacgccc

SEQ ID NO: 608433 - DNA, 13 bp, D. melanogaster
ccactctttttat

SEQ ID NO: 608434 - DNA, 13 bp, D. melanogaster
ccactgaaccacc

SEQ ID NO: 608435 - DNA, 13 bp, D. melanogaster
ccactgaaccact

SEQ ID NO: 608436 - DNA, 13 bp, D. melanogaster
ccactgacagtgg

SEQ ID NO: 608437 - DNA, 13 bp, D. melanogaster
ccactgactccac

SEQ ID NO: 608438 - DNA, 13 bp, D. melanogaster
ccactgagccact

SEQ ID NO: 608439 - DNA, 13 bp, D. melanogaster
ccactgatgatga

SEQ ID NO: 608440 - DNA, 13 bp, D. melanogaster
ccactgattgttt

SEQ ID NO: 608441 - DNA, 14 bp, D. melanogaster
ccactgattgtttc

SEQ ID NO: 608442 - DNA, 14 bp, D. melanogaster
ccactgcaccaccc

SEQ ID NO: 608443 - DNA, 13 bp, D. melanogaster
ccactgcaccatc

SEQ ID NO: 608444 - DNA, 13 bp, D. melanogaster
ccactgcagcagc

SEQ ID NO: 608445 - DNA, 13 bp, D. melanogaster
ccactgccacaca

SEQ ID NO: 608446 - DNA, 13 bp, D. melanogaster
ccactgccaccac

SEQ ID NO: 608447 - DNA, 13 bp, D. melanogaster
ccactgccaccca

SEQ ID NO: 608448 - DNA, 14 bp, D. melanogaster
ccactgccacccac

SEQ ID NO: 608449 - DNA, 13 bp, D. melanogaster
ccactgccaccgc

SEQ ID NO: 608450 - DNA, 14 bp, D. melanogaster
ccactgccaccgcc

SEQ ID NO: 608451 - DNA, 13 bp, D. melanogaster
ccactgccacgcc

SEQ ID NO: 608452 - DNA, 14 bp, D. melanogaster
ccactgccacgccc

SEQ ID NO: 608453 - DNA, 13 bp, D. melanogaster
ccactgccactcc

SEQ ID NO: 608454 - DNA, 13 bp, D. melanogaster
ccactgccactgc

SEQ ID NO: 608455 - DNA, 14 bp, D. melanogaster
ccactgccactgcc

SEQ ID NO: 608456 - DNA, 14 bp, D. melanogaster
ccactgccactgct

SEQ ID NO: 608457 - DNA, 13 bp, D. melanogaster
ccactgccactgg

SEQ ID NO: 608458 - DNA, 13 bp, D. melanogaster
ccactgccactgt

SEQ ID NO: 608459 - DNA, 13 bp, D. melanogaster
ccactgccacttt

SEQ ID NO: 608460 - DNA, 13 bp, D. melanogaster
ccactgccagtgc

SEQ ID NO: 608461 - DNA, 13 bp, D. melanogaster
ccactgcccactg

SEQ ID NO: 608462 - DNA, 13 bp, D. melanogaster
ccactgccgctgc

SEQ ID NO: 608463 - DNA, 13 bp, D. melanogaster
ccactgcctgggg

SEQ ID NO: 608464 - DNA, 13 bp, D. melanogaster
ccactgctccact

SEQ ID NO: 608465 - DNA, 13 bp, D. melanogaster
ccactgctgcctt

SEQ ID NO: 608466 - DNA, 13 bp, D. melanogaster
ccactggccactg

SEQ ID NO: 608467 - DNA, 13 bp, D. melanogaster
ccactgtcagtgg

SEQ ID NO: 608468 - DNA, 13 bp, D. melanogaster
ccactgtgcactg

SEQ ID NO: 608469 - DNA, 13 bp, D. melanogaster
ccactgtgcagcg

SEQ ID NO: 608470 - DNA, 13 bp, D. melanogaster
ccactgtgccaca

SEQ ID NO: 608471 - DNA, 13 bp, D. melanogaster
ccactgtgcgctg

SEQ ID NO: 608472 - DNA, 13 bp, D. melanogaster
ccactgtgctgca

SEQ ID NO: 608473 - DNA, 13 bp, D. melanogaster
ccactgtggagga

SEQ ID NO: 608474 - DNA, 13 bp, D. melanogaster
ccactgtgtgtgt

SEQ ID NO: 608475 - DNA, 14 bp, D. melanogaster
ccactgtgtgtgtg

SEQ ID NO: 608476 - DNA, 13 bp, D. melanogaster
ccacttaaaaaag

SEQ ID NO: 608477 - DNA, 13 bp, D. melanogaster
ccacttaagattg

SEQ ID NO: 608478 - DNA, 13 bp, D. melanogaster
ccacttaatttgc

SEQ ID NO: 608479 - DNA, 13 bp, D. melanogaster
ccacttatttcag

SEQ ID NO: 608480 - DNA, 13 bp, D. melanogaster
ccacttatttttg

SEQ ID NO: 608481 - DNA, 13 bp, D. melanogaster
ccacttcaacttc

SEQ ID NO: 608482 - DNA, 14 bp, D. melanogaster
ccacttcaacttcc

SEQ ID NO: 608483 - DNA, 13 bp, D. melanogaster
ccacttcactcca

SEQ ID NO: 608484 - DNA, 13 bp, D. melanogaster
ccacttcacttca

SEQ ID NO: 608485 - DNA, 14 bp, D. melanogaster
ccacttcacttcac

SEQ ID NO: 608486 - DNA, 13 bp, D. melanogaster
ccacttccaagaa

SEQ ID NO: 608487 - DNA, 13 bp, D. melanogaster
ccacttccaattc

SEQ ID NO: 608488 - DNA, 13 bp, D. melanogaster
ccacttccacatc

SEQ ID NO: 608489 - DNA, 13 bp, D. melanogaster
ccacttccacttc

SEQ ID NO: 608490 - DNA, 13 bp, D. melanogaster
ccacttccattat

SEQ ID NO: 608491 - DNA, 13 bp, D. melanogaster
ccacttccattcc

SEQ ID NO: 608492 - DNA, 13 bp, D. melanogaster
ccacttccattgc

SEQ ID NO: 608493 - DNA, 14 bp, D. melanogaster
ccacttccatttcc

SEQ ID NO: 608494 - DNA, 13 bp, D. melanogaster
ccacttccatttt

SEQ ID NO: 608495 - DNA, 13 bp, D. melanogaster
ccacttccgattt

SEQ ID NO: 608496 - DNA, 13 bp, D. melanogaster
ccacttccgtttc

SEQ ID NO: 608497 - DNA, 14 bp, D. melanogaster
ccacttccgtttcc

SEQ ID NO: 608498 - DNA, 14 bp, D. melanogaster
ccacttctcaatgt

SEQ ID NO: 608499 - DNA, 13 bp, D. melanogaster
ccacttgagctgc

SEQ ID NO: 608500 - DNA, 13 bp, D. melanogaster
ccacttgattttc

SEQ ID NO: 608501 - DNA, 13 bp, D. melanogaster
ccacttgcatcag

SEQ ID NO: 608502 - DNA, 13 bp, D. melanogaster
ccacttgccacac

SEQ ID NO: 608503 - DNA, 13 bp, D. melanogaster
ccacttgccaccc

SEQ ID NO: 608504 - DNA, 14 bp, D. melanogaster
ccacttgccaccca

SEQ ID NO: 608505 - DNA, 13 bp, D. melanogaster
ccacttgccactc

SEQ ID NO: 608506 - DNA, 13 bp, D. melanogaster
ccacttgccactt

SEQ ID NO: 608507 - DNA, 14 bp, D. melanogaster
ccacttgccacttg

SEQ ID NO: 608508 - DNA, 13 bp, D. melanogaster
ccacttgctaaat

SEQ ID NO: 608509 - DNA, 13 bp, D. melanogaster
ccacttggccaag

SEQ ID NO: 608510 - DNA, 13 bp, D. melanogaster
ccacttggccact

SEQ ID NO: 608511 - DNA, 13 bp, D. melanogaster
ccacttggccatt

SEQ ID NO: 608512 - DNA, 13 bp, D. melanogaster
ccacttggctggc

SEQ ID NO: 608513 - DNA, 13 bp, D. melanogaster
ccactttccactc

SEQ ID NO: 608514 - DNA, 13 bp, D. melanogaster
ccactttccactt

SEQ ID NO: 608515 - DNA, 13 bp, D. melanogaster
ccactttcccgcc

SEQ ID NO: 608516 - DNA, 13 bp, D. melanogaster
ccactttcgccca

SEQ ID NO: 608517 - DNA, 13 bp, D. melanogaster
ccactttctccac

SEQ ID NO: 608518 - DNA, 13 bp, D. melanogaster
ccactttgcactt

SEQ ID NO: 608519 - DNA, 13 bp, D. melanogaster
ccactttgccact

SEQ ID NO: 608520 - DNA, 13 bp, D. melanogaster
ccactttggcatt

SEQ ID NO: 608521 - DNA, 13 bp, D. melanogaster
ccactttggccag

SEQ ID NO: 608522 - DNA, 13 bp, D. melanogaster
ccactttgttggt

SEQ ID NO: 608523 - DNA, 13 bp, D. melanogaster
ccactttgttgtg

SEQ ID NO: 608524 - DNA, 13 bp, D. melanogaster
ccactttgtttgc

SEQ ID NO: 608525 - DNA, 13 bp, D. melanogaster
ccacttttccaaa

SEQ ID NO: 608526 - DNA, 13 bp, D. melanogaster
ccacttttccact

SEQ ID NO: 608527 - DNA, 13 bp, D. melanogaster
ccacttttccagc

SEQ ID NO: 608528 - DNA, 13 bp, D. melanogaster
ccacttttcccgc

SEQ ID NO: 608529 - DNA, 13 bp, D. melanogaster
ccacttttccgct

SEQ ID NO: 608530 - DNA, 13 bp, D. melanogaster
ccacttttccggc

SEQ ID NO: 608531 - DNA, 14 bp, D. melanogaster
ccacttttggccaa

SEQ ID NO: 608532 - DNA, 13 bp, D. melanogaster
ccagaaaaacccg

SEQ ID NO: 608533 - DNA, 14 bp, D. melanogaster
ccagaaaaacccga

SEQ ID NO: 608534 - DNA, 15 bp, D. melanogaster
ccagaaaaactaggc

SEQ ID NO: 608535 - DNA, 13 bp, D. melanogaster
ccagaaaaataat

SEQ ID NO: 608536 - DNA, 13 bp, D. melanogaster
ccagaaaaatata

SEQ ID NO: 608537 - DNA, 13 bp, D. melanogaster
ccagaaaaattat

SEQ ID NO: 608538 - DNA, 13 bp, D. melanogaster
ccagaaaatgcaa

SEQ ID NO: 608539 - DNA, 13 bp, D. melanogaster
ccagaaaccagaa

SEQ ID NO: 608540 - DNA, 13 bp, D. melanogaster
ccagaaagccaaa

SEQ ID NO: 608541 - DNA, 13 bp, D. melanogaster
ccagaaagtcaaa

SEQ ID NO: 608542 - DNA, 14 bp, D. melanogaster
ccagaaagtcaaaa

SEQ ID NO: 608543 - DNA, 13 bp, D. melanogaster
ccagaaagtgctc

SEQ ID NO: 608544 - DNA, 13 bp, D. melanogaster
ccagaaataaata

SEQ ID NO: 608545 - DNA, 13 bp, D. melanogaster
ccagaaataacaa

SEQ ID NO: 608546 - DNA, 14 bp, D. melanogaster
ccagaaatcgccag

SEQ ID NO: 608547 - DNA, 13 bp, D. melanogaster
ccagaaatgcaaa

SEQ ID NO: 608548 - DNA, 13 bp, D. melanogaster
ccagaacccagaa

SEQ ID NO: 608549 - DNA, 14 bp, D. melanogaster
ccagaacccagaac

SEQ ID NO: 608550 - DNA, 13 bp, D. melanogaster
ccagaagaagaag

SEQ ID NO: 608551 - DNA, 14 bp, D. melanogaster
ccagaagcagcagc

SEQ ID NO: 608552 - DNA, 13 bp, D. melanogaster
ccagaagtcaaat

SEQ ID NO: 608553 - DNA, 14 bp, D. melanogaster
ccagaagtggcagc

SEQ ID NO: 608554 - DNA, 13 bp, D. melanogaster
ccagaagtttgta

SEQ ID NO: 608555 - DNA, 13 bp, D. melanogaster
ccagaatccagaa

SEQ ID NO: 608556 - DNA, 13 bp, D. melanogaster
ccagaattcgaaa

SEQ ID NO: 608557 - DNA, 13 bp, D. melanogaster
ccagaatttctgc

SEQ ID NO: 608558 - DNA, 13 bp, D. melanogaster
ccagaatttgatg

SEQ ID NO: 608559 - DNA, 13 bp, D. melanogaster
ccagacaaacaga

SEQ ID NO: 608560 - DNA, 13 bp, D. melanogaster
ccagacaattcaa

SEQ ID NO: 608561 - DNA, 13 bp, D. melanogaster
ccagacagacaga

SEQ ID NO: 608562 - DNA, 13 bp, D. melanogaster
ccagacagttgga

SEQ ID NO: 608563 - DNA, 14 bp, D. melanogaster
ccagacagttggag

SEQ ID NO: 608564 - DNA, 13 bp, D. melanogaster
ccagaccagacca

SEQ ID NO: 608565 - DNA, 14 bp, D. melanogaster
ccagaccagaccag

SEQ ID NO: 608566 - DNA, 13 bp, D. melanogaster
ccagaccaggcca

SEQ ID NO: 608567 - DNA, 13 bp, D. melanogaster
ccagacgctggaa

SEQ ID NO: 608568 - DNA, 14 bp, D. melanogaster
ccagacgctggaaa

SEQ ID NO: 608569 - DNA, 14 bp, D. melanogaster
ccagactctgtcaa

SEQ ID NO: 608570 - DNA, 13 bp, D. melanogaster
ccagagaactgca

SEQ ID NO: 608571 - DNA, 13 bp, D. melanogaster
ccagagagagaga

SEQ ID NO: 608572 - DNA, 13 bp, D. melanogaster
ccagagagcaagt

SEQ ID NO: 608573 - DNA, 13 bp, D. melanogaster
ccagagccgagca

SEQ ID NO: 608574 - DNA, 15 bp, D. melanogaster
ccagagctccaggca

SEQ ID NO: 608575 - DNA, 13 bp, D. melanogaster
ccagagctgtatg

SEQ ID NO: 608576 - DNA, 13 bp, D. melanogaster
ccagaggatttta

SEQ ID NO: 608577 - DNA, 13 bp, D. melanogaster
ccagagttttccc

SEQ ID NO: 608578 - DNA, 13 bp, D. melanogaster
ccagatacccaga

SEQ ID NO: 608579 - DNA, 13 bp, D. melanogaster
ccagatagaaatt

SEQ ID NO: 608580 - DNA, 13 bp, D. melanogaster
ccagatcaaaagc

SEQ ID NO: 608581 - DNA, 13 bp, D. melanogaster
ccagatcaggaaa

SEQ ID NO: 608582 - DNA, 14 bp, D. melanogaster
ccagatccagatcc

SEQ ID NO: 608583 - DNA, 13 bp, D. melanogaster
ccagatcccagat

SEQ ID NO: 608584 - DNA, 14 bp, D. melanogaster
ccagatcccagatc

SEQ ID NO: 608585 - DNA, 13 bp, D. melanogaster
ccagatccccaac

SEQ ID NO: 608586 - DNA, 13 bp, D. melanogaster
ccagatgcctttt

SEQ ID NO: 608587 - DNA, 13 bp, D. melanogaster
ccagatggtaaag

SEQ ID NO: 608588 - DNA, 13 bp, D. melanogaster
ccagattcagatt

SEQ ID NO: 608589 - DNA, 13 bp, D. melanogaster
ccagattcatgta

SEQ ID NO: 608590 - DNA, 13 bp, D. melanogaster
ccagattccagat

SEQ ID NO: 608591 - DNA, 13 bp, D. melanogaster
ccagattggtttc

SEQ ID NO: 608592 - DNA, 13 bp, D. melanogaster
ccagcaaaaaata

SEQ ID NO: 608593 - DNA, 13 bp, D. melanogaster
ccagcaaaatggc

SEQ ID NO: 608594 - DNA, 13 bp, D. melanogaster
ccagcaaacaacg

SEQ ID NO: 608595 - DNA, 13 bp, D. melanogaster
ccagcaaagaaag

SEQ ID NO: 608596 - DNA, 14 bp, D. melanogaster
ccagcaaagaaagc

SEQ ID NO: 608597 - DNA, 13 bp, D. melanogaster
ccagcaaagctga

SEQ ID NO: 608598 - DNA, 13 bp, D. melanogaster
ccagcaaaggaat

SEQ ID NO: 608599 - DNA, 14 bp, D. melanogaster
ccagcaaaggaata

SEQ ID NO: 608600 - DNA, 13 bp, D. melanogaster
ccagcaaaggcaa

SEQ ID NO: 608601 - DNA, 13 bp, D. melanogaster
ccagcaaagtgca

SEQ ID NO: 608602 - DNA, 13 bp, D. melanogaster
ccagcaaataaaa

SEQ ID NO: 608603 - DNA, 13 bp, D. melanogaster
ccagcaaatgcaa

SEQ ID NO: 608604 - DNA, 13 bp, D. melanogaster
ccagcaaatttgc

SEQ ID NO: 608605 - DNA, 13 bp, D. melanogaster
ccagcaacaaaag

SEQ ID NO: 608606 - DNA, 13 bp, D. melanogaster
ccagcaacaaaat

SEQ ID NO: 608607 - DNA, 13 bp, D. melanogaster
ccagcaacaacag

SEQ ID NO: 608608 - DNA, 14 bp, D. melanogaster
ccagcaacaacagc

SEQ ID NO: 608609 - DNA, 13 bp, D. melanogaster
ccagcaacaagaa

SEQ ID NO: 608610 - DNA, 13 bp, D. melanogaster
ccagcaacagcaa

SEQ ID NO: 608611 - DNA, 14 bp, D. melanogaster
ccagcaacagcaac

SEQ ID NO: 608612 - DNA, 14 bp, D. melanogaster
ccagcaacagcaat

SEQ ID NO: 608613 - DNA, 13 bp, D. melanogaster
ccagcaacagcat

SEQ ID NO: 608614 - DNA, 13 bp, D. melanogaster
ccagcaacatgtt

SEQ ID NO: 608615 - DNA, 13 bp, D. melanogaster
ccagcaacttgtt

SEQ ID NO: 608616 - DNA, 13 bp, D. melanogaster
ccagcaactttca

SEQ ID NO: 608617 - DNA, 13 bp, D. melanogaster
ccagcaagatccc

SEQ ID NO: 608618 - DNA, 13 bp, D. melanogaster
ccagcaagctgag

SEQ ID NO: 608619 - DNA, 13 bp, D. melanogaster
ccagcaaggcaaa

SEQ ID NO: 608620 - DNA, 13 bp, D. melanogaster
ccagcaataaatt

SEQ ID NO: 608621 - DNA, 13 bp, D. melanogaster
ccagcaatctatt

SEQ ID NO: 608622 - DNA, 14 bp, D. melanogaster
ccagcaattagtta

SEQ ID NO: 608623 - DNA, 13 bp, D. melanogaster
ccagcaccagcac

SEQ ID NO: 608624 - DNA, 13 bp, D. melanogaster
ccagcaccagcat

SEQ ID NO: 608625 - DNA, 13 bp, D. melanogaster
ccagcacccagca

SEQ ID NO: 608626 - DNA, 13 bp, D. melanogaster
ccagcacgcacac

SEQ ID NO: 608627 - DNA, 13 bp, D. melanogaster
ccagcacttttcc

SEQ ID NO: 608628 - DNA, 14 bp, D. melanogaster
ccagcagaacggtc

SEQ ID NO: 608629 - DNA, 13 bp, D. melanogaster
ccagcagcaaaaa

SEQ ID NO: 608630 - DNA, 13 bp, D. melanogaster
ccagcagcaaatg

SEQ ID NO: 608631 - DNA, 13 bp, D. melanogaster
ccagcagcaacac

SEQ ID NO: 608632 - DNA, 13 bp, D. melanogaster
ccagcagcaacat

SEQ ID NO: 608633 - DNA, 16 bp, D. melanogaster
ccagcagcagcaacaa

SEQ ID NO: 608634 - DNA, 13 bp, D. melanogaster
ccagcagcagcac

SEQ ID NO: 608635 - DNA, 14 bp, D. melanogaster
ccagcagcagcaga

SEQ ID NO: 608636 - DNA, 13 bp, D. melanogaster
ccagcagcagcat

SEQ ID NO: 608637 - DNA, 13 bp, D. melanogaster
ccagcagcagcgg

SEQ ID NO: 608638 - DNA, 13 bp, D. melanogaster
ccagcagcaggag

SEQ ID NO: 608639 - DNA, 14 bp, D. melanogaster
ccagcagcaggagc

SEQ ID NO: 608640 - DNA, 13 bp, D. melanogaster
ccagcagccaaaa

SEQ ID NO: 608641 - DNA, 13 bp, D. melanogaster
ccagcagccagca

SEQ ID NO: 608642 - DNA, 14 bp, D. melanogaster
ccagcagccagcag

SEQ ID NO: 608643 - DNA, 13 bp, D. melanogaster
ccagcagcggagc

SEQ ID NO: 608644 - DNA, 13 bp, D. melanogaster
ccagcagcggcag

SEQ ID NO: 608645 - DNA, 13 bp, D. melanogaster
ccagcagctgctg

SEQ ID NO: 608646 - DNA, 13 bp, D. melanogaster
ccagcagcttcct

SEQ ID NO: 608647 - DNA, 14 bp, D. melanogaster
ccagcagcttcctt

SEQ ID NO: 608648 - DNA, 13 bp, D. melanogaster
ccagcagtttcct

SEQ ID NO: 608649 - DNA, 13 bp, D. melanogaster
ccagcatcattta

SEQ ID NO: 608650 - DNA, 13 bp, D. melanogaster
ccagcatccagca

SEQ ID NO: 608651 - DNA, 14 bp, D. melanogaster
ccagcatttgctgc

SEQ ID NO: 608652 - DNA, 13 bp, D. melanogaster
ccagcattttccc

SEQ ID NO: 608653 - DNA, 13 bp, D. melanogaster
ccagcattttctt

SEQ ID NO: 608654 - DNA, 13 bp, D. melanogaster
ccagccaaaaggg

SEQ ID NO: 608655 - DNA, 13 bp, D. melanogaster
ccagccaaccagc

SEQ ID NO: 608656 - DNA, 13 bp, D. melanogaster
ccagccaactcga

SEQ ID NO: 608657 - DNA, 13 bp, D. melanogaster
ccagccaagcaaa

SEQ ID NO: 608658 - DNA, 13 bp, D. melanogaster
ccagccaagtcaa

SEQ ID NO: 608659 - DNA, 13 bp, D. melanogaster
ccagccaagtgca

SEQ ID NO: 608660 - DNA, 13 bp, D. melanogaster
ccagccacattcc

SEQ ID NO: 608661 - DNA, 13 bp, D. melanogaster
ccagccacccact

SEQ ID NO: 608662 - DNA, 14 bp, D. melanogaster
ccagccacccactg

SEQ ID NO: 608663 - DNA, 13 bp, D. melanogaster
ccagccacccatc

SEQ ID NO: 608664 - DNA, 13 bp, D. melanogaster
ccagccaccggag

SEQ ID NO: 608665 - DNA, 13 bp, D. melanogaster
ccagccacttggc

SEQ ID NO: 608666 - DNA, 13 bp, D. melanogaster
ccagccagatcac

SEQ ID NO: 608667 - DNA, 13 bp, D. melanogaster
ccagccagcaaat

SEQ ID NO: 608668 - DNA, 13 bp, D. melanogaster
ccagccagccaaa

SEQ ID NO: 608669 - DNA, 13 bp, D. melanogaster
ccagccagccaag

SEQ ID NO: 608670 - DNA, 13 bp, D. melanogaster
ccagccagccact

SEQ ID NO: 608671 - DNA, 14 bp, D. melanogaster
ccagccagccagtc

SEQ ID NO: 608672 - DNA, 13 bp, D. melanogaster
ccagccagccatt

SEQ ID NO: 608673 - DNA, 13 bp, D. melanogaster
ccagccagcgagc

SEQ ID NO: 608674 - DNA, 13 bp, D. melanogaster
ccagccagctagc

SEQ ID NO: 608675 - DNA, 13 bp, D. melanogaster
ccagccaggagga

SEQ ID NO: 608676 - DNA, 13 bp, D. melanogaster
ccagccagtccag

SEQ ID NO: 608677 - DNA, 15 bp, D. melanogaster
ccagccagtccagtg

SEQ ID NO: 608678 - DNA, 14 bp, D. melanogaster
ccagccatccagtc

SEQ ID NO: 608679 - DNA, 13 bp, D. melanogaster
ccagcccaagtat

SEQ ID NO: 608680 - DNA, 13 bp, D. melanogaster
ccagcccaatcag

SEQ ID NO: 608681 - DNA, 14 bp, D. melanogaster
ccagcccaatccgc

SEQ ID NO: 608682 - DNA, 13 bp, D. melanogaster
ccagcccaccaat

SEQ ID NO: 608683 - DNA, 13 bp, D. melanogaster
ccagcccacttcc

SEQ ID NO: 608684 - DNA, 13 bp, D. melanogaster
ccagcccagcaat

SEQ ID NO: 608685 - DNA, 13 bp, D. melanogaster
ccagccttggcaa

SEQ ID NO: 608686 - DNA, 14 bp, D. melanogaster
ccagcgaataaacg

SEQ ID NO: 608687 - DNA, 14 bp, D. melanogaster
ccagcgaataaatt

SEQ ID NO: 608688 - DNA, 13 bp, D. melanogaster
ccagcgacaacaa

SEQ ID NO: 608689 - DNA, 13 bp, D. melanogaster
ccagcgacagttg

SEQ ID NO: 608690 - DNA, 13 bp, D. melanogaster
ccagcgccaaagc

SEQ ID NO: 608691 - DNA, 13 bp, D. melanogaster
ccagcggaagtga

SEQ ID NO: 608692 - DNA, 13 bp, D. melanogaster
ccagcggatggca

SEQ ID NO: 608693 - DNA, 13 bp, D. melanogaster
ccagcggcaaaaa

SEQ ID NO: 608694 - DNA, 13 bp, D. melanogaster
ccagcggcacgtc

SEQ ID NO: 608695 - DNA, 13 bp, D. melanogaster
ccagcggcagcag

SEQ ID NO: 608696 - DNA, 13 bp, D. melanogaster
ccagcggccagcg

SEQ ID NO: 608697 - DNA, 13 bp, D. melanogaster
ccagcgtcagcgc

SEQ ID NO: 608698 - DNA, 13 bp, D. melanogaster
ccagcgttttcca

SEQ ID NO: 608699 - DNA, 13 bp, D. melanogaster
ccagctaaaaaaa

SEQ ID NO: 608700 - DNA, 13 bp, D. melanogaster
ccagctaccagct

SEQ ID NO: 608701 - DNA, 13 bp, D. melanogaster
ccagctatccagc

SEQ ID NO: 608702 - DNA, 13 bp, D. melanogaster
ccagctcagcagc

SEQ ID NO: 608703 - DNA, 13 bp, D. melanogaster
ccagctcagctca

SEQ ID NO: 608704 - DNA, 14 bp, D. melanogaster
ccagctccagcttc

SEQ ID NO: 608705 - DNA, 14 bp, D. melanogaster
ccagctccatctcc

SEQ ID NO: 608706 - DNA, 13 bp, D. melanogaster
ccagctcccagct

SEQ ID NO: 608707 - DNA, 13 bp, D. melanogaster
ccagctcctcctc

SEQ ID NO: 608708 - DNA, 13 bp, D. melanogaster
ccagctcctcctg

SEQ ID NO: 608709 - DNA, 13 bp, D. melanogaster
ccagctcctgctc

SEQ ID NO: 608710 - DNA, 13 bp, D. melanogaster
ccagctcctttaa

SEQ ID NO: 608711 - DNA, 13 bp, D. melanogaster
ccagctccttttg

SEQ ID NO: 608712 - DNA, 13 bp, D. melanogaster
ccagctgaaaaat

SEQ ID NO: 608713 - DNA, 13 bp, D. melanogaster
ccagctgaaaagt

SEQ ID NO: 608714 - DNA, 13 bp, D. melanogaster
ccagctgaatgtt

SEQ ID NO: 608715 - DNA, 13 bp, D. melanogaster
ccagctgacacct

SEQ ID NO: 608716 - DNA, 13 bp, D. melanogaster
ccagctgagataa

SEQ ID NO: 608717 - DNA, 13 bp, D. melanogaster
ccagctgaggcat

SEQ ID NO: 608718 - DNA, 13 bp, D. melanogaster
ccagctgcaattg

SEQ ID NO: 608719 - DNA, 13 bp, D. melanogaster
ccagctgcagcag

SEQ ID NO: 608720 - DNA, 13 bp, D. melanogaster
ccagctgcagttg

SEQ ID NO: 608721 - DNA, 13 bp, D. melanogaster
ccagctgcatttt

SEQ ID NO: 608722 - DNA, 13 bp, D. melanogaster
ccagctgccaaca

SEQ ID NO: 608723 - DNA, 14 bp, D. melanogaster
ccagctgccaacaa

SEQ ID NO: 608724 - DNA, 13 bp, D. melanogaster
ccagctgccacat

SEQ ID NO: 608725 - DNA, 13 bp, D. melanogaster
ccagctgccacgc

SEQ ID NO: 608726 - DNA, 13 bp, D. melanogaster
ccagctgcctttt

SEQ ID NO: 608727 - DNA, 13 bp, D. melanogaster
ccagctgcgcagc

SEQ ID NO: 608728 - DNA, 13 bp, D. melanogaster
ccagctgctgttg

SEQ ID NO: 608729 - DNA, 13 bp, D. melanogaster
ccagctgtaaata

SEQ ID NO: 608730 - DNA, 13 bp, D. melanogaster
ccagcttcaggag

SEQ ID NO: 608731 - DNA, 13 bp, D. melanogaster
ccagcttccaata

SEQ ID NO: 608732 - DNA, 13 bp, D. melanogaster
ccagcttccagct

SEQ ID NO: 608733 - DNA, 13 bp, D. melanogaster
ccagcttcccaaa

SEQ ID NO: 608734 - DNA, 13 bp, D. melanogaster
ccagcttctttga

SEQ ID NO: 608735 - DNA, 13 bp, D. melanogaster
ccagcttttggcc

SEQ ID NO: 608736 - DNA, 13 bp, D. melanogaster
ccagctttttttt

SEQ ID NO: 608737 - DNA, 13 bp, D. melanogaster
ccaggaaaatgca

SEQ ID NO: 608738 - DNA, 13 bp, D. melanogaster
ccaggaaaccttc

SEQ ID NO: 608739 - DNA, 13 bp, D. melanogaster
ccaggaaattcaa

SEQ ID NO: 608740 - DNA, 13 bp, D. melanogaster
ccaggaattacaa

SEQ ID NO: 608741 - DNA, 13 bp, D. melanogaster
ccaggaccaagga

SEQ ID NO: 608742 - DNA, 13 bp, D. melanogaster
ccaggaccaggac

SEQ ID NO: 608743 - DNA, 14 bp, D. melanogaster
ccaggaccaggacc

SEQ ID NO: 608744 - DNA, 13 bp, D. melanogaster
ccaggacccagga

SEQ ID NO: 608745 - DNA, 13 bp, D. melanogaster
ccaggacgaagga

SEQ ID NO: 608746 - DNA, 13 bp, D. melanogaster
ccaggacgaggac

SEQ ID NO: 608747 - DNA, 13 bp, D. melanogaster
ccaggacgcagga

SEQ ID NO: 608748 - DNA, 13 bp, D. melanogaster
ccaggactccagg

SEQ ID NO: 608749 - DNA, 13 bp, D. melanogaster
ccaggagcaggag

SEQ ID NO: 608750 - DNA, 13 bp, D. melanogaster
ccaggagccagga

SEQ ID NO: 608751 - DNA, 13 bp, D. melanogaster
ccaggagcggcag

SEQ ID NO: 608752 - DNA, 13 bp, D. melanogaster
ccaggatactttt

SEQ ID NO: 608753 - DNA, 13 bp, D. melanogaster
ccaggatccagga

SEQ ID NO: 608754 - DNA, 13 bp, D. melanogaster
ccaggatgcagga

SEQ ID NO: 608755 - DNA, 13 bp, D. melanogaster
ccaggatgccagg

SEQ ID NO: 608756 - DNA, 14 bp, D. melanogaster
ccaggatgccagga

SEQ ID NO: 608757 - DNA, 13 bp, D. melanogaster
ccaggcaaacaaa

SEQ ID NO: 608758 - DNA, 13 bp, D. melanogaster
ccaggcaaataaa

SEQ ID NO: 608759 - DNA, 13 bp, D. melanogaster
ccaggcaacaaag

SEQ ID NO: 608760 - DNA, 13 bp, D. melanogaster
ccaggcacacaca

SEQ ID NO: 608761 - DNA, 13 bp, D. melanogaster
ccaggcagccagg

SEQ ID NO: 608762 - DNA, 13 bp, D. melanogaster
ccaggccaaaacc

SEQ ID NO: 608763 - DNA, 13 bp, D. melanogaster
ccaggccaaaact

SEQ ID NO: 608764 - DNA, 13 bp, D. melanogaster
ccaggccaaaatg

SEQ ID NO: 608765 - DNA, 13 bp, D. melanogaster
ccaggccaacaaa

SEQ ID NO: 608766 - DNA, 13 bp, D. melanogaster
ccaggccagacca

SEQ ID NO: 608767 - DNA, 13 bp, D. melanogaster
ccagggaaatgtt

SEQ ID NO: 608768 - DNA, 13 bp, D. melanogaster
ccagggagcgaaa

SEQ ID NO: 608769 - DNA, 13 bp, D. melanogaster
ccagggccaactt

SEQ ID NO: 608770 - DNA, 13 bp, D. melanogaster
ccagggttgccag

SEQ ID NO: 608771 - DNA, 13 bp, D. melanogaster
ccaggtgccagag

SEQ ID NO: 608772 - DNA, 13 bp, D. melanogaster
ccagtaaacattt

SEQ ID NO: 608773 - DNA, 13 bp, D. melanogaster
ccagtacacacga

SEQ ID NO: 608774 - DNA, 13 bp, D. melanogaster
ccagtagtgtcat

SEQ ID NO: 608775 - DNA, 14 bp, D. melanogaster
ccagtatccagtat

SEQ ID NO: 608776 - DNA, 13 bp, D. melanogaster
ccagtatgtagga

SEQ ID NO: 608777 - DNA, 14 bp, D. melanogaster
ccagtattgttttt

SEQ ID NO: 608778 - DNA, 13 bp, D. melanogaster
ccagtcagacttt

SEQ ID NO: 608779 - DNA, 13 bp, D. melanogaster
ccagtcagagagc

SEQ ID NO: 608780 - DNA, 13 bp, D. melanogaster
ccagtcagccagt

SEQ ID NO: 608781 - DNA, 13 bp, D. melanogaster
ccagtcagtcagc

SEQ ID NO: 608782 - DNA, 13 bp, D. melanogaster
ccagtccagtcca

SEQ ID NO: 608783 - DNA, 14 bp, D. melanogaster
ccagtccagtccag

SEQ ID NO: 608784 - DNA, 13 bp, D. melanogaster
ccagtcccaatcc

SEQ ID NO: 608785 - DNA, 13 bp, D. melanogaster
ccagtcccagtcc

SEQ ID NO: 608786 - DNA, 13 bp, D. melanogaster
ccagtcgcagtcg

SEQ ID NO: 608787 - DNA, 13 bp, D. melanogaster
ccagtcgccagtc

SEQ ID NO: 608788 - DNA, 13 bp, D. melanogaster
ccagtctgcacag

SEQ ID NO: 608789 - DNA, 13 bp, D. melanogaster
ccagtctgccagg

SEQ ID NO: 608790 - DNA, 14 bp, D. melanogaster
ccagtctggagcaa

SEQ ID NO: 608791 - DNA, 13 bp, D. melanogaster
ccagtgaccatca

SEQ ID NO: 608792 - DNA, 13 bp, D. melanogaster
ccagtgagcggga

SEQ ID NO: 608793 - DNA, 14 bp, D. melanogaster
ccagtgccagtgcc

SEQ ID NO: 608794 - DNA, 13 bp, D. melanogaster
ccagtgcccagtg

SEQ ID NO: 608795 - DNA, 14 bp, D. melanogaster
ccagtgcctccatg

SEQ ID NO: 608796 - DNA, 13 bp, D. melanogaster
ccagtggaaaatt

SEQ ID NO: 608797 - DNA, 13 bp, D. melanogaster
ccagtggcaacaa

SEQ ID NO: 608798 - DNA, 14 bp, D. melanogaster
ccagtgggcgtggc

SEQ ID NO: 608799 - DNA, 13 bp, D. melanogaster
ccagtgggtgggt

SEQ ID NO: 608800 - DNA, 13 bp, D. melanogaster
ccagtgggtggtg

SEQ ID NO: 608801 - DNA, 13 bp, D. melanogaster
ccagtgtgtgtgt

SEQ ID NO: 608802 - DNA, 14 bp, D. melanogaster
ccagttaaaataaa

SEQ ID NO: 608803 - DNA, 14 bp, D. melanogaster
ccagttatatcttt

SEQ ID NO: 608804 - DNA, 13 bp, D. melanogaster
ccagttcaaaatt

SEQ ID NO: 608805 - DNA, 13 bp, D. melanogaster
ccagttccaaggc

SEQ ID NO: 608806 - DNA, 14 bp, D. melanogaster
ccagttccacatga

SEQ ID NO: 608807 - DNA, 13 bp, D. melanogaster
ccagttccaccaa

SEQ ID NO: 608808 - DNA, 13 bp, D. melanogaster
ccagttcccagct

SEQ ID NO: 608809 - DNA, 13 bp, D. melanogaster
ccagttcccagtt

SEQ ID NO: 608810 - DNA, 14 bp, D. melanogaster
ccagttcccagttc

SEQ ID NO: 608811 - DNA, 13 bp, D. melanogaster
ccagttcgaagtg

SEQ ID NO: 608812 - DNA, 14 bp, D. melanogaster
ccagttcgaagtga

SEQ ID NO: 608813 - DNA, 13 bp, D. melanogaster
ccagttcgactcg

SEQ ID NO: 608814 - DNA, 14 bp, D. melanogaster
ccagttcgatttga

SEQ ID NO: 608815 - DNA, 13 bp, D. melanogaster
ccagttctcagcc

SEQ ID NO: 608816 - DNA, 14 bp, D. melanogaster
ccagttctcagccc

SEQ ID NO: 608817 - DNA, 13 bp, D. melanogaster
ccagttgatcaac

SEQ ID NO: 608818 - DNA, 13 bp, D. melanogaster
ccagttgcagctg

SEQ ID NO: 608819 - DNA, 14 bp, D. melanogaster
ccagttgcagttgc

SEQ ID NO: 608820 - DNA, 13 bp, D. melanogaster
ccagttgccagtt

SEQ ID NO: 608821 - DNA, 13 bp, D. melanogaster
ccagttgcccagt

SEQ ID NO: 608822 - DNA, 13 bp, D. melanogaster
ccagttggcaatt

SEQ ID NO: 608823 - DNA, 13 bp, D. melanogaster
ccagttggcagtt

SEQ ID NO: 608824 - DNA, 13 bp, D. melanogaster
ccagttggccaga

SEQ ID NO: 608825 - DNA, 13 bp, D. melanogaster
ccagttggccagc

SEQ ID NO: 608826 - DNA, 13 bp, D. melanogaster
ccagttggccagt

SEQ ID NO: 608827 - DNA, 13 bp, D. melanogaster
ccagttggccatt

SEQ ID NO: 608828 - DNA, 13 bp, D. melanogaster
ccagttggcttct

SEQ ID NO: 608829 - DNA, 14 bp, D. melanogaster
ccagttgggaaaat

SEQ ID NO: 608830 - DNA, 13 bp, D. melanogaster
ccagttgttgttg

SEQ ID NO: 608831 - DNA, 13 bp, D. melanogaster
ccagtttccagtt

SEQ ID NO: 608832 - DNA, 14 bp, D. melanogaster
ccagtttccagttt

SEQ ID NO: 608833 - DNA, 13 bp, D. melanogaster
ccagtttcttttt

SEQ ID NO: 608834 - DNA, 13 bp, D. melanogaster
ccagtttgaattt

SEQ ID NO: 608835 - DNA, 13 bp, D. melanogaster
ccagtttgccaag

SEQ ID NO: 608836 - DNA, 14 bp, D. melanogaster
ccagtttgccagtt

SEQ ID NO: 608837 - DNA, 13 bp, D. melanogaster
ccagtttgggctt

SEQ ID NO: 608838 - DNA, 13 bp, D. melanogaster
ccagtttggggca

SEQ ID NO: 608839 - DNA, 13 bp, D. melanogaster
ccagttttcagtt

SEQ ID NO: 608840 - DNA, 13 bp, D. melanogaster
ccagttttccttt

SEQ ID NO: 608841 - DNA, 13 bp, D. melanogaster
ccagtttttgcag

SEQ ID NO: 608842 - DNA, 13 bp, D. melanogaster
ccataaaaaagga

SEQ ID NO: 608843 - DNA, 13 bp, D. melanogaster
ccataaaaaagtt

SEQ ID NO: 608844 - DNA, 13 bp, D. melanogaster
ccataaaaatagc

SEQ ID NO: 608845 - DNA, 14 bp, D. melanogaster
ccataaaaatattt

SEQ ID NO: 608846 - DNA, 13 bp, D. melanogaster
ccataaaaatgtt

SEQ ID NO: 608847 - DNA, 14 bp, D. melanogaster
ccataaaaattcaa

SEQ ID NO: 608848 - DNA, 13 bp, D. melanogaster
ccataaaagcaaa

SEQ ID NO: 608849 - DNA, 13 bp, D. melanogaster
ccataaaagtgaa

SEQ ID NO: 608850 - DNA, 13 bp, D. melanogaster
ccataaaatatat

SEQ ID NO: 608851 - DNA, 13 bp, D. melanogaster
ccataaaattgca

SEQ ID NO: 608852 - DNA, 13 bp, D. melanogaster
ccataaacaatat

SEQ ID NO: 608853 - DNA, 13 bp, D. melanogaster
ccataaacattaa

SEQ ID NO: 608854 - DNA, 13 bp, D. melanogaster
ccataaacatttt

SEQ ID NO: 608855 - DNA, 13 bp, D. melanogaster
ccataaaccaaat

SEQ ID NO: 608856 - DNA, 13 bp, D. melanogaster
ccataaaccataa

SEQ ID NO: 608857 - DNA, 13 bp, D. melanogaster
ccataaacgcaat

SEQ ID NO: 608858 - DNA, 13 bp, D. melanogaster
ccataaatataca

SEQ ID NO: 608859 - DNA, 13 bp, D. melanogaster
ccataaatattta

SEQ ID NO: 608860 - DNA, 13 bp, D. melanogaster
ccataaatcaaag

SEQ ID NO: 608861 - DNA, 13 bp, D. melanogaster
ccataaatcagcg

SEQ ID NO: 608862 - DNA, 13 bp, D. melanogaster
ccataaatcattt

SEQ ID NO: 608863 - DNA, 14 bp, D. melanogaster
ccataaattaatta

SEQ ID NO: 608864 - DNA, 13 bp, D. melanogaster
ccataaattagca

SEQ ID NO: 608865 - DNA, 13 bp, D. melanogaster
ccataaattatgc

SEQ ID NO: 608866 - DNA, 13 bp, D. melanogaster
ccataaattcaat

SEQ ID NO: 608867 - DNA, 13 bp, D. melanogaster
ccataaattcatt

SEQ ID NO: 608868 - DNA, 13 bp, D. melanogaster
ccataaatttcca

SEQ ID NO: 608869 - DNA, 13 bp, D. melanogaster
ccataaatttgtg

SEQ ID NO: 608870 - DNA, 13 bp, D. melanogaster
ccataaattttgc

SEQ ID NO: 608871 - DNA, 13 bp, D. melanogaster
ccataacaataac

SEQ ID NO: 608872 - DNA, 13 bp, D. melanogaster
ccataaccataac

SEQ ID NO: 608873 - DNA, 13 bp, D. melanogaster
ccataactataaa

SEQ ID NO: 608874 - DNA, 14 bp, D. melanogaster
ccataactataaaa

SEQ ID NO: 608875 - DNA, 14 bp, D. melanogaster
ccataacttggcca

SEQ ID NO: 608876 - DNA, 13 bp, D. melanogaster
ccataagaaagaa

SEQ ID NO: 608877 - DNA, 13 bp, D. melanogaster
ccataatggccac

SEQ ID NO: 608878 - DNA, 15 bp, D. melanogaster
ccataatggccacca

SEQ ID NO: 608879 - DNA, 13 bp, D. melanogaster
ccataattattat

SEQ ID NO: 608880 - DNA, 13 bp, D. melanogaster
ccataatttatat

SEQ ID NO: 608881 - DNA, 13 bp, D. melanogaster
ccataatttatgc

SEQ ID NO: 608882 - DNA, 13 bp, D. melanogaster
ccatacaaatccc

SEQ ID NO: 608883 - DNA, 13 bp, D. melanogaster
ccatacaatagtc

SEQ ID NO: 608884 - DNA, 13 bp, D. melanogaster
ccatacaattttt

SEQ ID NO: 608885 - DNA, 13 bp, D. melanogaster
ccatacacaaaat

SEQ ID NO: 608886 - DNA, 14 bp, D. melanogaster
ccatacacaaaatc

SEQ ID NO: 608887 - DNA, 13 bp, D. melanogaster
ccatacacacata

SEQ ID NO: 608888 - DNA, 13 bp, D. melanogaster
ccatacaccatac

SEQ ID NO: 608889 - DNA, 13 bp, D. melanogaster
ccatacatataca

SEQ ID NO: 608890 - DNA, 13 bp, D. melanogaster
ccatacatatatg

SEQ ID NO: 608891 - DNA, 13 bp, D. melanogaster
ccatacatatgta

SEQ ID NO: 608892 - DNA, 14 bp, D. melanogaster
ccatacatatgtat

SEQ ID NO: 608893 - DNA, 13 bp, D. melanogaster
ccataccatacca

SEQ ID NO: 608894 - DNA, 14 bp, D. melanogaster
ccataccataccat

SEQ ID NO: 608895 - DNA, 13 bp, D. melanogaster
ccataccattcca

SEQ ID NO: 608896 - DNA, 13 bp, D. melanogaster
ccatacccatacc

SEQ ID NO: 608897 - DNA, 13 bp, D. melanogaster
ccatacccatatc

SEQ ID NO: 608898 - DNA, 13 bp, D. melanogaster
ccatacccattcc

SEQ ID NO: 608899 - DNA, 14 bp, D. melanogaster
ccatacccattccc

SEQ ID NO: 608900 - DNA, 14 bp, D. melanogaster
ccatacgatttttt

SEQ ID NO: 608901 - DNA, 13 bp, D. melanogaster
ccatactctgcca

SEQ ID NO: 608902 - DNA, 13 bp, D. melanogaster
ccatactctgctt

SEQ ID NO: 608903 - DNA, 13 bp, D. melanogaster
ccatagccatagc

SEQ ID NO: 608904 - DNA, 14 bp, D. melanogaster
ccatagccatagcc

SEQ ID NO: 608905 - DNA, 13 bp, D. melanogaster
ccatagccatata

SEQ ID NO: 608906 - DNA, 13 bp, D. melanogaster
ccatatacacaca

SEQ ID NO: 608907 - DNA, 13 bp, D. melanogaster
ccatatacataca

SEQ ID NO: 608908 - DNA, 14 bp, D. melanogaster
ccatatacatacat

SEQ ID NO: 608909 - DNA, 13 bp, D. melanogaster
ccatatacatata

SEQ ID NO: 608910 - DNA, 15 bp, D. melanogaster
ccatatacatatgta

SEQ ID NO: 608911 - DNA, 14 bp, D. melanogaster
ccatataccatata

SEQ ID NO: 608912 - DNA, 13 bp, D. melanogaster
ccatatactatat

SEQ ID NO: 608913 - DNA, 14 bp, D. melanogaster
ccatatagccatat

SEQ ID NO: 608914 - DNA, 13 bp, D. melanogaster
ccatatataaata

SEQ ID NO: 608915 - DNA, 13 bp, D. melanogaster
ccatatatagaaa

SEQ ID NO: 608916 - DNA, 13 bp, D. melanogaster
ccatatatataat

SEQ ID NO: 608917 - DNA, 13 bp, D. melanogaster
ccatatatataca

SEQ ID NO: 608918 - DNA, 13 bp, D. melanogaster
ccatatatatgta

SEQ ID NO: 608919 - DNA, 14 bp, D. melanogaster
ccatatatatgtat

SEQ ID NO: 608920 - DNA, 13 bp, D. melanogaster
ccatatatattta

SEQ ID NO: 608921 - DNA, 13 bp, D. melanogaster
ccatatatatttt

SEQ ID NO: 608922 - DNA, 13 bp, D. melanogaster
ccatatatcccaa

SEQ ID NO: 608923 - DNA, 13 bp, D. melanogaster
ccatatatgtatg

SEQ ID NO: 608924 - DNA, 13 bp, D. melanogaster
ccatatatttata

SEQ ID NO: 608925 - DNA, 13 bp, D. melanogaster
ccatatattttta

SEQ ID NO: 608926 - DNA, 13 bp, D. melanogaster
ccatatatttttg

SEQ ID NO: 608927 - DNA, 13 bp, D. melanogaster
ccatatcactttt

SEQ ID NO: 608928 - DNA, 13 bp, D. melanogaster
ccatatccatatc

SEQ ID NO: 608929 - DNA, 14 bp, D. melanogaster
ccatatccatatcc

SEQ ID NO: 608930 - DNA, 13 bp, D. melanogaster
ccatatcccatat

SEQ ID NO: 608931 - DNA, 14 bp, D. melanogaster
ccatatcccatatc

SEQ ID NO: 608932 - DNA, 13 bp, D. melanogaster
ccatatccgaaga

SEQ ID NO: 608933 - DNA, 13 bp, D. melanogaster
ccatatgcaaatc

SEQ ID NO: 608934 - DNA, 13 bp, D. melanogaster
ccatatgcatata

SEQ ID NO: 608935 - DNA, 13 bp, D. melanogaster
ccatatgtatgta

SEQ ID NO: 608936 - DNA, 13 bp, D. melanogaster
ccatattaaaaga

SEQ ID NO: 608937 - DNA, 13 bp, D. melanogaster
ccatattaaatat

SEQ ID NO: 608938 - DNA, 13 bp, D. melanogaster
ccatattccatat

SEQ ID NO: 608939 - DNA, 13 bp, D. melanogaster
ccatattggaagc

SEQ ID NO: 608940 - DNA, 13 bp, D. melanogaster
ccatattgggtta

SEQ ID NO: 608941 - DNA, 13 bp, D. melanogaster
ccatattggtttc

SEQ ID NO: 608942 - DNA, 13 bp, D. melanogaster
ccatatttaattt

SEQ ID NO: 608943 - DNA, 13 bp, D. melanogaster
ccatatttatata

SEQ ID NO: 608944 - DNA, 13 bp, D. melanogaster
ccatatttcactt

SEQ ID NO: 608945 - DNA, 14 bp, D. melanogaster
ccatatttttgaaa

SEQ ID NO: 608946 - DNA, 13 bp, D. melanogaster
ccatcaaaaattg

SEQ ID NO: 608947 - DNA, 13 bp, D. melanogaster
ccatcaaaatctg

SEQ ID NO: 608948 - DNA, 13 bp, D. melanogaster
ccatcaaacggct

SEQ ID NO: 608949 - DNA, 14 bp, D. melanogaster
ccatcaaacggctt

SEQ ID NO: 608950 - DNA, 13 bp, D. melanogaster
ccatcaaaggaat

SEQ ID NO: 608951 - DNA, 13 bp, D. melanogaster
ccatcaaatcaaa

SEQ ID NO: 608952 - DNA, 13 bp, D. melanogaster
ccatcaaatggat

SEQ ID NO: 608953 - DNA, 13 bp, D. melanogaster
ccatcaaattgaa

SEQ ID NO: 608954 - DNA, 13 bp, D. melanogaster
ccatcaaattgat

SEQ ID NO: 608955 - DNA, 13 bp, D. melanogaster
ccatcaacgccaa

SEQ ID NO: 608956 - DNA, 13 bp, D. melanogaster
ccatcaatcaaca

SEQ ID NO: 608957 - DNA, 14 bp, D. melanogaster
ccatcaatcaacaa

SEQ ID NO: 608958 - DNA, 13 bp, D. melanogaster
ccatcaatcaatc

SEQ ID NO: 608959 - DNA, 14 bp, D. melanogaster
ccatcaatcaatca

SEQ ID NO: 608960 - DNA, 13 bp, D. melanogaster
ccatcaatccatc

SEQ ID NO: 608961 - DNA, 13 bp, D. melanogaster
ccatcaatgtctg

SEQ ID NO: 608962 - DNA, 13 bp, D. melanogaster
ccatcaatttgtt

SEQ ID NO: 608963 - DNA, 13 bp, D. melanogaster
ccatcacagtcac

SEQ ID NO: 608964 - DNA, 14 bp, D. melanogaster
ccatcaccaaactt

SEQ ID NO: 608965 - DNA, 13 bp, D. melanogaster
ccatcaccatcac

SEQ ID NO: 608966 - DNA, 14 bp, D. melanogaster
ccatcaccatcgcc

SEQ ID NO: 608967 - DNA, 13 bp, D. melanogaster
ccatcaccatctc

SEQ ID NO: 608968 - DNA, 13 bp, D. melanogaster
ccatcacccatca

SEQ ID NO: 608969 - DNA, 13 bp, D. melanogaster
ccatcacgatatt

SEQ ID NO: 608970 - DNA, 13 bp, D. melanogaster
ccatcactgaagt

SEQ ID NO: 608971 - DNA, 13 bp, D. melanogaster
ccatcagcaacac

SEQ ID NO: 608972 - DNA, 13 bp, D. melanogaster
ccatcagcatcag

SEQ ID NO: 608973 - DNA, 13 bp, D. melanogaster
ccatcagccatca

SEQ ID NO: 608974 - DNA, 13 bp, D. melanogaster
ccatcagcccatc

SEQ ID NO: 608975 - DNA, 13 bp, D. melanogaster
ccatcagtcagtc

SEQ ID NO: 608976 - DNA, 13 bp, D. melanogaster
ccatcagtttcac

SEQ ID NO: 608977 - DNA, 13 bp, D. melanogaster
ccatcatcaaaat

SEQ ID NO: 608978 - DNA, 13 bp, D. melanogaster
ccatcatcaccat

SEQ ID NO: 608979 - DNA, 14 bp, D. melanogaster
ccatcatcaccatc

SEQ ID NO: 608980 - DNA, 13 bp, D. melanogaster
ccatcatcatata

SEQ ID NO: 608981 - DNA, 13 bp, D. melanogaster
ccatcatcatcaa

SEQ ID NO: 608982 - DNA, 14 bp, D. melanogaster
ccatcatcatcaac

SEQ ID NO: 608983 - DNA, 13 bp, D. melanogaster
ccatcatcatcac

SEQ ID NO: 608984 - DNA, 14 bp, D. melanogaster
ccatcatcatcacc

SEQ ID NO: 608985 - DNA, 13 bp, D. melanogaster
ccatcatcatcca

SEQ ID NO: 608986 - DNA, 13 bp, D. melanogaster
ccatcatcatcgt

SEQ ID NO: 608987 - DNA, 13 bp, D. melanogaster
ccatcatcgccat

SEQ ID NO: 608988 - DNA, 14 bp, D. melanogaster
ccatcatcgtcatc

SEQ ID NO: 608989 - DNA, 13 bp, D. melanogaster
ccatcattaaaat

SEQ ID NO: 608990 - DNA, 13 bp, D. melanogaster
ccatcattattaa

SEQ ID NO: 608991 - DNA, 13 bp, D. melanogaster
ccatcattgacag

SEQ ID NO: 608992 - DNA, 13 bp, D. melanogaster
ccatccaaattgt

SEQ ID NO: 608993 - DNA, 13 bp, D. melanogaster
ccatccaatccaa

SEQ ID NO: 608994 - DNA, 13 bp, D. melanogaster
ccatccagccaac

SEQ ID NO: 608995 - DNA, 13 bp, D. melanogaster
ccatccagccacc

SEQ ID NO: 608996 - DNA, 14 bp, D. melanogaster
ccatccagccatcc

SEQ ID NO: 608997 - DNA, 13 bp, D. melanogaster
ccatccatatcca

SEQ ID NO: 608998 - DNA, 14 bp, D. melanogaster
ccatccatccaacc

SEQ ID NO: 608999 - DNA, 13 bp, D. melanogaster
ccatccatccact

SEQ ID NO: 609000 - DNA, 13 bp, D. melanogaster
ccatccatccatc

SEQ ID NO: 609001 - DNA, 13 bp, D. melanogaster
ccatcccatccag

SEQ ID NO: 609002 - DNA, 13 bp, D. melanogaster
ccatcccatccat

SEQ ID NO: 609003 - DNA, 14 bp, D. melanogaster
ccatcccatccatc

SEQ ID NO: 609004 - DNA, 13 bp, D. melanogaster
ccatcccatctca

SEQ ID NO: 609005 - DNA, 14 bp, D. melanogaster
ccatcccattccat

SEQ ID NO: 609006 - DNA, 13 bp, D. melanogaster
ccatccctatcac

SEQ ID NO: 609007 - DNA, 13 bp, D. melanogaster
ccatccgcttttc

SEQ ID NO: 609008 - DNA, 13 bp, D. melanogaster
ccatcgaagggaa

SEQ ID NO: 609009 - DNA, 13 bp, D. melanogaster
ccatcgacatcga

SEQ ID NO: 609010 - DNA, 13 bp, D. melanogaster
ccatcgaccatcg

SEQ ID NO: 609011 - DNA, 13 bp, D. melanogaster
ccatcgagaataa

SEQ ID NO: 609012 - DNA, 13 bp, D. melanogaster
ccatcgatttgca

SEQ ID NO: 609013 - DNA, 13 bp, D. melanogaster
ccatcgccaagtt

SEQ ID NO: 609014 - DNA, 14 bp, D. melanogaster
ccatcgccatcacc

SEQ ID NO: 609015 - DNA, 13 bp, D. melanogaster
ccatcgccatcga

SEQ ID NO: 609016 - DNA, 14 bp, D. melanogaster
ccatcgccatcgca

SEQ ID NO: 609017 - DNA, 13 bp, D. melanogaster
ccatcgccatttt

SEQ ID NO: 609018 - DNA, 13 bp, D. melanogaster
ccatcgcccatcg

SEQ ID NO: 609019 - DNA, 13 bp, D. melanogaster
ccatcgcttttcc

SEQ ID NO: 609020 - DNA, 13 bp, D. melanogaster
ccatcggacagtg

SEQ ID NO: 609021 - DNA, 13 bp, D. melanogaster
ccatcgtcatcat

SEQ ID NO: 609022 - DNA, 14 bp, D. melanogaster
ccatcgtcatcatc

SEQ ID NO: 609023 - DNA, 13 bp, D. melanogaster
ccatcgtccatcg

SEQ ID NO: 609024 - DNA, 13 bp, D. melanogaster
ccatcgtcgactt

SEQ ID NO: 609025 - DNA, 13 bp, D. melanogaster
ccatcgtcgtcgt

SEQ ID NO: 609026 - DNA, 13 bp, D. melanogaster
ccatcgttgtgga

SEQ ID NO: 609027 - DNA, 13 bp, D. melanogaster
ccatctatccatc

SEQ ID NO: 609028 - DNA, 13 bp, D. melanogaster
ccatctatctatc

SEQ ID NO: 609029 - DNA, 13 bp, D. melanogaster
ccatctccatctg

SEQ ID NO: 609030 - DNA, 14 bp, D. melanogaster
ccatctccatcttc

SEQ ID NO: 609031 - DNA, 13 bp, D. melanogaster
ccatctccattcc

SEQ ID NO: 609032 - DNA, 13 bp, D. melanogaster
ccatctccgattt

SEQ ID NO: 609033 - DNA, 13 bp, D. melanogaster
ccatctcgctcgc

SEQ ID NO: 609034 - DNA, 13 bp, D. melanogaster
ccatctctgtcgc

SEQ ID NO: 609035 - DNA, 14 bp, D. melanogaster
ccatctcttaaaac

SEQ ID NO: 609036 - DNA, 13 bp, D. melanogaster
ccatctctttcgc

SEQ ID NO: 609037 - DNA, 13 bp, D. melanogaster
ccatctgcatctg

SEQ ID NO: 609038 - DNA, 13 bp, D. melanogaster
ccatctgctcctc

SEQ ID NO: 609039 - DNA, 13 bp, D. melanogaster
ccatctggcggtg

SEQ ID NO: 609040 - DNA, 13 bp, D. melanogaster
ccatctgggtgtt

SEQ ID NO: 609041 - DNA, 13 bp, D. melanogaster
ccatctgtctgtc

SEQ ID NO: 609042 - DNA, 14 bp, D. melanogaster
ccatcttcatcttc

SEQ ID NO: 609043 - DNA, 13 bp, D. melanogaster
ccatctttacgtt

SEQ ID NO: 609044 - DNA, 13 bp, D. melanogaster
ccatgaaaataaa

SEQ ID NO: 609045 - DNA, 13 bp, D. melanogaster
ccatgaatatttc

SEQ ID NO: 609046 - DNA, 13 bp, D. melanogaster
ccatgaattgcag

SEQ ID NO: 609047 - DNA, 13 bp, D. melanogaster
ccatgcaaatgag

SEQ ID NO: 609048 - DNA, 13 bp, D. melanogaster
ccatgcaatgttt

SEQ ID NO: 609049 - DNA, 13 bp, D. melanogaster
ccatgcaccatgc

SEQ ID NO: 609050 - DNA, 13 bp, D. melanogaster
ccatgcaccccag

SEQ ID NO: 609051 - DNA, 13 bp, D. melanogaster
ccatgccaacgag

SEQ ID NO: 609052 - DNA, 13 bp, D. melanogaster
ccatgccacacca

SEQ ID NO: 609053 - DNA, 13 bp, D. melanogaster
ccatgccaccgtg

SEQ ID NO: 609054 - DNA, 13 bp, D. melanogaster
ccatgccagtctg

SEQ ID NO: 609055 - DNA, 14 bp, D. melanogaster
ccatgccataccat

SEQ ID NO: 609056 - DNA, 13 bp, D. melanogaster
ccatgccatgcca

SEQ ID NO: 609057 - DNA, 13 bp, D. melanogaster
ccatgccattcca

SEQ ID NO: 609058 - DNA, 13 bp, D. melanogaster
ccatgcccatgcc

SEQ ID NO: 609059 - DNA, 14 bp, D. melanogaster
ccatgcccatgccc

SEQ ID NO: 609060 - DNA, 14 bp, D. melanogaster
ccatgcccattccc

SEQ ID NO: 609061 - DNA, 13 bp, D. melanogaster
ccatgcccatttc

SEQ ID NO: 609062 - DNA, 15 bp, D. melanogaster
ccatgcgaaaaattc

SEQ ID NO: 609063 - DNA, 13 bp, D. melanogaster
ccatgcggcaact

SEQ ID NO: 609064 - DNA, 13 bp, D. melanogaster
ccatgctccatgc

SEQ ID NO: 609065 - DNA, 13 bp, D. melanogaster
ccatggactgcag

SEQ ID NO: 609066 - DNA, 13 bp, D. melanogaster
ccatggccaaaaa

SEQ ID NO: 609067 - DNA, 13 bp, D. melanogaster
ccatggccaaaag

SEQ ID NO: 609068 - DNA, 13 bp, D. melanogaster
ccatggccatggc

SEQ ID NO: 609069 - DNA, 14 bp, D. melanogaster
ccatggccatggcc

SEQ ID NO: 609070 - DNA, 13 bp, D. melanogaster
ccatggccatggg

SEQ ID NO: 609071 - DNA, 14 bp, D. melanogaster
ccatggttcgagct

SEQ ID NO: 609072 - DNA, 13 bp, D. melanogaster
ccatgtccatgtc

SEQ ID NO: 609073 - DNA, 14 bp, D. melanogaster
ccatgtccatgtcc

SEQ ID NO: 609074 - DNA, 13 bp, D. melanogaster
ccatgtccgtttg

SEQ ID NO: 609075 - DNA, 13 bp, D. melanogaster
ccatgtccttgcc

SEQ ID NO: 609076 - DNA, 13 bp, D. melanogaster
ccatgtccttgtc

SEQ ID NO: 609077 - DNA, 13 bp, D. melanogaster
ccatgtgcgtgtg

SEQ ID NO: 609078 - DNA, 13 bp, D. melanogaster
ccatgtgtgcgtg

SEQ ID NO: 609079 - DNA, 13 bp, D. melanogaster
ccatgtgtgtgtg

SEQ ID NO: 609080 - DNA, 14 bp, D. melanogaster
ccatgtgtgtgtgt

SEQ ID NO: 609081 - DNA, 13 bp, D. melanogaster
ccatgtgtttaac

SEQ ID NO: 609082 - DNA, 13 bp, D. melanogaster
ccatgtgtttgtg

SEQ ID NO: 609083 - DNA, 14 bp, D. melanogaster
ccatgttgctgctg

SEQ ID NO: 609084 - DNA, 13 bp, D. melanogaster
ccatgtttcatta

SEQ ID NO: 609085 - DNA, 13 bp, D. melanogaster
ccatgtttgccca

SEQ ID NO: 609086 - DNA, 13 bp, D. melanogaster
ccattaaaaacta

SEQ ID NO: 609087 - DNA, 13 bp, D. melanogaster
ccattaaaaatat

SEQ ID NO: 609088 - DNA, 13 bp, D. melanogaster
ccattaaaacagg

SEQ ID NO: 609089 - DNA, 13 bp, D. melanogaster
ccattaaaaccag

SEQ ID NO: 609090 - DNA, 13 bp, D. melanogaster
ccattaaaatgaa

SEQ ID NO: 609091 - DNA, 13 bp, D. melanogaster
ccattaaacaaat

SEQ ID NO: 609092 - DNA, 13 bp, D. melanogaster
ccattaaatgaat

SEQ ID NO: 609093 - DNA, 13 bp, D. melanogaster
ccattaaatgcca

SEQ ID NO: 609094 - DNA, 13 bp, D. melanogaster
ccattaaatgttt

SEQ ID NO: 609095 - DNA, 13 bp, D. melanogaster
ccattaaattaaa

SEQ ID NO: 609096 - DNA, 13 bp, D. melanogaster
ccattaacaataa

SEQ ID NO: 609097 - DNA, 13 bp, D. melanogaster
ccattaactttaa

SEQ ID NO: 609098 - DNA, 13 bp, D. melanogaster
ccattaataataa

SEQ ID NO: 609099 - DNA, 13 bp, D. melanogaster
ccattaatttgtt

SEQ ID NO: 609100 - DNA, 13 bp, D. melanogaster
ccattacaaaatc

SEQ ID NO: 609101 - DNA, 13 bp, D. melanogaster
ccattaccacaat

SEQ ID NO: 609102 - DNA, 13 bp, D. melanogaster
ccattaccacact

SEQ ID NO: 609103 - DNA, 13 bp, D. melanogaster
ccattaccattac

SEQ ID NO: 609104 - DNA, 14 bp, D. melanogaster
ccattaccattacc

SEQ ID NO: 609105 - DNA, 13 bp, D. melanogaster
ccattaccatttc

SEQ ID NO: 609106 - DNA, 13 bp, D. melanogaster
ccattaccatttt

SEQ ID NO: 609107 - DNA, 13 bp, D. melanogaster
ccattacggcagc

SEQ ID NO: 609108 - DNA, 13 bp, D. melanogaster
ccattactaaaat

SEQ ID NO: 609109 - DNA, 14 bp, D. melanogaster
ccattactaaaatt

SEQ ID NO: 609110 - DNA, 13 bp, D. melanogaster
ccattataccaaa

SEQ ID NO: 609111 - DNA, 14 bp, D. melanogaster
ccattataccaaat

SEQ ID NO: 609112 - DNA, 13 bp, D. melanogaster
ccattatatcaat

SEQ ID NO: 609113 - DNA, 13 bp, D. melanogaster
ccattatccatta

SEQ ID NO: 609114 - DNA, 14 bp, D. melanogaster
ccattatccattat

SEQ ID NO: 609115 - DNA, 14 bp, D. melanogaster
ccattattcaaaaa

SEQ ID NO: 609116 - DNA, 13 bp, D. melanogaster
ccattatttccaa

SEQ ID NO: 609117 - DNA, 13 bp, D. melanogaster
ccattattttaaa

SEQ ID NO: 609118 - DNA, 13 bp, D. melanogaster
ccattcaaatgga

SEQ ID NO: 609119 - DNA, 13 bp, D. melanogaster
ccattcaaattga

SEQ ID NO: 609120 - DNA, 13 bp, D. melanogaster
ccattcaagacat

SEQ ID NO: 609121 - DNA, 13 bp, D. melanogaster
ccattcaagggtg

SEQ ID NO: 609122 - DNA, 13 bp, D. melanogaster
ccattcaattcaa

SEQ ID NO: 609123 - DNA, 13 bp, D. melanogaster
ccattcaatttaa

SEQ ID NO: 609124 - DNA, 13 bp, D. melanogaster
ccattcacattca

SEQ ID NO: 609125 - DNA, 13 bp, D. melanogaster
ccattcacattcc

SEQ ID NO: 609126 - DNA, 13 bp, D. melanogaster
ccattcaccattc

SEQ ID NO: 609127 - DNA, 14 bp, D. melanogaster
ccattcaccattca

SEQ ID NO: 609128 - DNA, 13 bp, D. melanogaster
ccattcacctaat

SEQ ID NO: 609129 - DNA, 14 bp, D. melanogaster
ccattcacttttat

SEQ ID NO: 609130 - DNA, 13 bp, D. melanogaster
ccattcagatagc

SEQ ID NO: 609131 - DNA, 13 bp, D. melanogaster
ccattcagccatt

SEQ ID NO: 609132 - DNA, 13 bp, D. melanogaster
ccattcatacaaa

SEQ ID NO: 609133 - DNA, 13 bp, D. melanogaster
ccattcatatcaa

SEQ ID NO: 609134 - DNA, 13 bp, D. melanogaster
ccattcatccatc

SEQ ID NO: 609135 - DNA, 13 bp, D. melanogaster
ccattcatccatt

SEQ ID NO: 609136 - DNA, 14 bp, D. melanogaster
ccattcattcattc

SEQ ID NO: 609137 - DNA, 13 bp, D. melanogaster
ccattcattgggc

SEQ ID NO: 609138 - DNA, 13 bp, D. melanogaster
ccattcatttgca

SEQ ID NO: 609139 - DNA, 13 bp, D. melanogaster
ccattcattttgt

SEQ ID NO: 609140 - DNA, 14 bp, D. melanogaster
ccattccaattcca

SEQ ID NO: 609141 - DNA, 14 bp, D. melanogaster
ccattccataccat

SEQ ID NO: 609142 - DNA, 13 bp, D. melanogaster
ccattccatccca

SEQ ID NO: 609143 - DNA, 13 bp, D. melanogaster
ccattccattcca

SEQ ID NO: 609144 - DNA, 14 bp, D. melanogaster
ccattccattccag

SEQ ID NO: 609145 - DNA, 14 bp, D. melanogaster
ccattccattccat

SEQ ID NO: 609146 - DNA, 13 bp, D. melanogaster
ccattccatttcc

SEQ ID NO: 609147 - DNA, 13 bp, D. melanogaster
ccattccatttcg

SEQ ID NO: 609148 - DNA, 13 bp, D. melanogaster
ccattccatttgc

SEQ ID NO: 609149 - DNA, 13 bp, D. melanogaster
ccattccatttgg

SEQ ID NO: 609150 - DNA, 13 bp, D. melanogaster
ccattccattttg

SEQ ID NO: 609151 - DNA, 13 bp, D. melanogaster
ccattccattttt

SEQ ID NO: 609152 - DNA, 13 bp, D. melanogaster
ccattcccaatcc

SEQ ID NO: 609153 - DNA, 13 bp, D. melanogaster
ccattcccacttc

SEQ ID NO: 609154 - DNA, 13 bp, D. melanogaster
ccattcccatacc

SEQ ID NO: 609155 - DNA, 14 bp, D. melanogaster
ccattcccataccc

SEQ ID NO: 609156 - DNA, 13 bp, D. melanogaster
ccattcccatcca

SEQ ID NO: 609157 - DNA, 13 bp, D. melanogaster
ccattcccatgcc

SEQ ID NO: 609158 - DNA, 13 bp, D. melanogaster
ccattcccattcc

SEQ ID NO: 609159 - DNA, 13 bp, D. melanogaster
ccattcccattcg

SEQ ID NO: 609160 - DNA, 14 bp, D. melanogaster
ccattcccattctc

SEQ ID NO: 609161 - DNA, 14 bp, D. melanogaster
ccattcccattgcc

SEQ ID NO: 609162 - DNA, 13 bp, D. melanogaster
ccattcccatttc

SEQ ID NO: 609163 - DNA, 13 bp, D. melanogaster
ccattcccgttcc

SEQ ID NO: 609164 - DNA, 14 bp, D. melanogaster
ccattcccgttccc

SEQ ID NO: 609165 - DNA, 13 bp, D. melanogaster
ccattccgattcc

SEQ ID NO: 609166 - DNA, 13 bp, D. melanogaster
ccattccgcccac

SEQ ID NO: 609167 - DNA, 13 bp, D. melanogaster
ccattcgagtgga

SEQ ID NO: 609168 - DNA, 13 bp, D. melanogaster
ccattcgattcga

SEQ ID NO: 609169 - DNA, 13 bp, D. melanogaster
ccattcgccattc

SEQ ID NO: 609170 - DNA, 14 bp, D. melanogaster
ccattcgccattcg

SEQ ID NO: 609171 - DNA, 13 bp, D. melanogaster
ccattcgccattt

SEQ ID NO: 609172 - DNA, 13 bp, D. melanogaster
ccattcgcccatt

SEQ ID NO: 609173 - DNA, 13 bp, D. melanogaster
ccattcgggccat

SEQ ID NO: 609174 - DNA, 13 bp, D. melanogaster
ccattctccattc

SEQ ID NO: 609175 - DNA, 14 bp, D. melanogaster
ccattctcgtattg

SEQ ID NO: 609176 - DNA, 13 bp, D. melanogaster
ccattctgttctt

SEQ ID NO: 609177 - DNA, 13 bp, D. melanogaster
ccattctgttttt

SEQ ID NO: 609178 - DNA, 13 bp, D. melanogaster
ccattgaaaattt

SEQ ID NO: 609179 - DNA, 13 bp, D. melanogaster
ccattgaaataaa

SEQ ID NO: 609180 - DNA, 13 bp, D. melanogaster
ccattgaaatata

SEQ ID NO: 609181 - DNA, 13 bp, D. melanogaster
ccattgaaatcaa

SEQ ID NO: 609182 - DNA, 13 bp, D. melanogaster
ccattgaaatctt

SEQ ID NO: 609183 - DNA, 13 bp, D. melanogaster
ccattgaaatgga

SEQ ID NO: 609184 - DNA, 13 bp, D. melanogaster
ccattgaaatgtg

SEQ ID NO: 609185 - DNA, 13 bp, D. melanogaster
ccattgaaatgtt

SEQ ID NO: 609186 - DNA, 13 bp, D. melanogaster
ccattgaaattgc

SEQ ID NO: 609187 - DNA, 13 bp, D. melanogaster
ccattgcaaattg

SEQ ID NO: 609188 - DNA, 13 bp, D. melanogaster
ccattgcaatggc

SEQ ID NO: 609189 - DNA, 13 bp, D. melanogaster
ccattgcaattgc

SEQ ID NO: 609190 - DNA, 13 bp, D. melanogaster
ccattgcagcagt

SEQ ID NO: 609191 - DNA, 13 bp, D. melanogaster
ccattgcattttc

SEQ ID NO: 609192 - DNA, 13 bp, D. melanogaster
ccattgccaaaaa

SEQ ID NO: 609193 - DNA, 13 bp, D. melanogaster
ccattgccaccca

SEQ ID NO: 609194 - DNA, 13 bp, D. melanogaster
ccattgccacgcc

SEQ ID NO: 609195 - DNA, 13 bp, D. melanogaster
ccattgccatggc

SEQ ID NO: 609196 - DNA, 13 bp, D. melanogaster
ccattgccattgc

SEQ ID NO: 609197 - DNA, 14 bp, D. melanogaster
ccattgccattgcc

SEQ ID NO: 609198 - DNA, 13 bp, D. melanogaster
ccattgccatttc

SEQ ID NO: 609199 - DNA, 13 bp, D. melanogaster
ccattgccgttgc

SEQ ID NO: 609200 - DNA, 13 bp, D. melanogaster
ccattgcggcagc

SEQ ID NO: 609201 - DNA, 13 bp, D. melanogaster
ccattgctggaat

SEQ ID NO: 609202 - DNA, 13 bp, D. melanogaster
ccattggcaattg

SEQ ID NO: 609203 - DNA, 13 bp, D. melanogaster
ccattggccattg

SEQ ID NO: 609204 - DNA, 14 bp, D. melanogaster
ccattggccattgg

SEQ ID NO: 609205 - DNA, 13 bp, D. melanogaster
ccattggccattt

SEQ ID NO: 609206 - DNA, 13 bp, D. melanogaster
ccattgtcaatgt

SEQ ID NO: 609207 - DNA, 13 bp, D. melanogaster
ccattgtcctgct

SEQ ID NO: 609208 - DNA, 13 bp, D. melanogaster
ccattgtgatctt

SEQ ID NO: 609209 - DNA, 14 bp, D. melanogaster
ccattgttgctgtt

SEQ ID NO: 609210 - DNA, 13 bp, D. melanogaster
ccattgttgtttt

SEQ ID NO: 609211 - DNA, 13 bp, D. melanogaster
ccattgtttattt

SEQ ID NO: 609212 - DNA, 13 bp, D. melanogaster
ccattgtttgggt

SEQ ID NO: 609213 - DNA, 13 bp, D. melanogaster
ccattgttttggc

SEQ ID NO: 609214 - DNA, 13 bp, D. melanogaster
ccattgtttttgt

SEQ ID NO: 609215 - DNA, 13 bp, D. melanogaster
ccatttaaaacta

SEQ ID NO: 609216 - DNA, 13 bp, D. melanogaster
ccatttaaaatgc

SEQ ID NO: 609217 - DNA, 13 bp, D. melanogaster
ccatttaaaatgt

SEQ ID NO: 609218 - DNA, 13 bp, D. melanogaster
ccatttaaagttt

SEQ ID NO: 609219 - DNA, 13 bp, D. melanogaster
ccatttaaatgta

SEQ ID NO: 609220 - DNA, 13 bp, D. melanogaster
ccatttaaatttg

SEQ ID NO: 609221 - DNA, 13 bp, D. melanogaster
ccatttaagcaat

SEQ ID NO: 609222 - DNA, 13 bp, D. melanogaster
ccatttaagttta

SEQ ID NO: 609223 - DNA, 13 bp, D. melanogaster
ccatttaattgct

SEQ ID NO: 609224 - DNA, 13 bp, D. melanogaster
ccatttacaaaat

SEQ ID NO: 609225 - DNA, 13 bp, D. melanogaster
ccatttacaaaga

SEQ ID NO: 609226 - DNA, 13 bp, D. melanogaster
ccatttacaattt

SEQ ID NO: 609227 - DNA, 13 bp, D. melanogaster
ccatttacatggc

SEQ ID NO: 609228 - DNA, 13 bp, D. melanogaster
ccatttacccatt

SEQ ID NO: 609229 - DNA, 14 bp, D. melanogaster
ccatttacttcgct

SEQ ID NO: 609230 - DNA, 13 bp, D. melanogaster
ccatttactttaa

SEQ ID NO: 609231 - DNA, 13 bp, D. melanogaster
ccatttataaata

SEQ ID NO: 609232 - DNA, 13 bp, D. melanogaster
ccatttatgatgc

SEQ ID NO: 609233 - DNA, 13 bp, D. melanogaster
ccatttatgccaa

SEQ ID NO: 609234 - DNA, 13 bp, D. melanogaster
ccatttatttaaa

SEQ ID NO: 609235 - DNA, 13 bp, D. melanogaster
ccatttatttttg

SEQ ID NO: 609236 - DNA, 13 bp, D. melanogaster
ccatttcaaatgt

SEQ ID NO: 609237 - DNA, 13 bp, D. melanogaster
ccatttcaatttc

SEQ ID NO: 609238 - DNA, 13 bp, D. melanogaster
ccatttcatttgc

SEQ ID NO: 609239 - DNA, 13 bp, D. melanogaster
ccatttccaatcc

SEQ ID NO: 609240 - DNA, 13 bp, D. melanogaster
ccatttccaattc

SEQ ID NO: 609241 - DNA, 13 bp, D. melanogaster
ccatttccacatc

SEQ ID NO: 609242 - DNA, 14 bp, D. melanogaster
ccatttccacatcc

SEQ ID NO: 609243 - DNA, 13 bp, D. melanogaster
ccatttccaccat

SEQ ID NO: 609244 - DNA, 14 bp, D. melanogaster
ccatttccaccgga

SEQ ID NO: 609245 - DNA, 13 bp, D. melanogaster
ccatttccacttc

SEQ ID NO: 609246 - DNA, 13 bp, D. melanogaster
ccatttccacttg

SEQ ID NO: 609247 - DNA, 13 bp, D. melanogaster
ccatttccacttt

SEQ ID NO: 609248 - DNA, 13 bp, D. melanogaster
ccatttccagttt

SEQ ID NO: 609249 - DNA, 13 bp, D. melanogaster
ccatttccattcc

SEQ ID NO: 609250 - DNA, 14 bp, D. melanogaster
ccatttccattccc

SEQ ID NO: 609251 - DNA, 13 bp, D. melanogaster
ccatttccattcg

SEQ ID NO: 609252 - DNA, 13 bp, D. melanogaster
ccatttccatttc

SEQ ID NO: 609253 - DNA, 14 bp, D. melanogaster
ccatttccatttcg

SEQ ID NO: 609254 - DNA, 14 bp, D. melanogaster
ccatttccatttgc

SEQ ID NO: 609255 - DNA, 14 bp, D. melanogaster
ccatttccatttgg

SEQ ID NO: 609256 - DNA, 14 bp, D. melanogaster
ccatttccattttc

SEQ ID NO: 609257 - DNA, 13 bp, D. melanogaster
ccatttcccacac

SEQ ID NO: 609258 - DNA, 13 bp, D. melanogaster
ccatttcccagca

SEQ ID NO: 609259 - DNA, 13 bp, D. melanogaster
ccatttcccagcc

SEQ ID NO: 609260 - DNA, 13 bp, D. melanogaster
ccatttcccagct

SEQ ID NO: 609261 - DNA, 13 bp, D. melanogaster
ccatttcccattt

SEQ ID NO: 609262 - DNA, 14 bp, D. melanogaster
ccatttcccatttc

SEQ ID NO: 609263 - DNA, 14 bp, D. melanogaster
ccatttcccatttg

SEQ ID NO: 609264 - DNA, 14 bp, D. melanogaster
ccatttcccatttt

SEQ ID NO: 609265 - DNA, 14 bp, D. melanogaster
ccatttccccattt

SEQ ID NO: 609266 - DNA, 13 bp, D. melanogaster
ccatttcccgctt

SEQ ID NO: 609267 - DNA, 13 bp, D. melanogaster
ccatttcccgttt

SEQ ID NO: 609268 - DNA, 13 bp, D. melanogaster
ccatttccctgcc

SEQ ID NO: 609269 - DNA, 13 bp, D. melanogaster
ccatttccgtttc

SEQ ID NO: 609270 - DNA, 14 bp, D. melanogaster
ccatttccgtttcc

SEQ ID NO: 609271 - DNA, 13 bp, D. melanogaster
ccatttccttggc

SEQ ID NO: 609272 - DNA, 13 bp, D. melanogaster
ccatttcgcattt

SEQ ID NO: 609273 - DNA, 13 bp, D. melanogaster
ccatttctaaatg

SEQ ID NO: 609274 - DNA, 13 bp, D. melanogaster
ccatttctatttc

SEQ ID NO: 609275 - DNA, 13 bp, D. melanogaster
ccatttctatttg

SEQ ID NO: 609276 - DNA, 13 bp, D. melanogaster
ccatttctcatct

SEQ ID NO: 609277 - DNA, 13 bp, D. melanogaster
ccatttgaaaaat

SEQ ID NO: 609278 - DNA, 13 bp, D. melanogaster
ccatttgaataat

SEQ ID NO: 609279 - DNA, 13 bp, D. melanogaster
ccatttgagtttg

SEQ ID NO: 609280 - DNA, 13 bp, D. melanogaster
ccatttgatttgc

SEQ ID NO: 609281 - DNA, 13 bp, D. melanogaster
ccatttgcaatta

SEQ ID NO: 609282 - DNA, 13 bp, D. melanogaster
ccatttgcataca

SEQ ID NO: 609283 - DNA, 13 bp, D. melanogaster
ccatttgcatgtg

SEQ ID NO: 609284 - DNA, 13 bp, D. melanogaster
ccatttgcattat

SEQ ID NO: 609285 - DNA, 13 bp, D. melanogaster
ccatttgccaaaa

SEQ ID NO: 609286 - DNA, 13 bp, D. melanogaster
ccatttgccaccc

SEQ ID NO: 609287 - DNA, 13 bp, D. melanogaster
ccatttgccagct

SEQ ID NO: 609288 - DNA, 13 bp, D. melanogaster
ccatttgccattt

SEQ ID NO: 609289 - DNA, 14 bp, D. melanogaster
ccatttgccatttt

SEQ ID NO: 609290 - DNA, 13 bp, D. melanogaster
ccatttgcctttg

SEQ ID NO: 609291 - DNA, 13 bp, D. melanogaster
ccatttgctattt

SEQ ID NO: 609292 - DNA, 13 bp, D. melanogaster
ccatttgctgagt

SEQ ID NO: 609293 - DNA, 13 bp, D. melanogaster
ccatttggcaaaa

SEQ ID NO: 609294 - DNA, 13 bp, D. melanogaster
ccatttggcactc

SEQ ID NO: 609295 - DNA, 13 bp, D. melanogaster
ccatttggcattg

SEQ ID NO: 609296 - DNA, 13 bp, D. melanogaster
ccatttggccacc

SEQ ID NO: 609297 - DNA, 13 bp, D. melanogaster
ccatttggccagg

SEQ ID NO: 609298 - DNA, 13 bp, D. melanogaster
ccatttggccata

SEQ ID NO: 609299 - DNA, 13 bp, D. melanogaster
ccatttggccatc

SEQ ID NO: 609300 - DNA, 13 bp, D. melanogaster
ccatttggctgcc

SEQ ID NO: 609301 - DNA, 13 bp, D. melanogaster
ccatttggctggc

SEQ ID NO: 609302 - DNA, 13 bp, D. melanogaster
ccatttggctttc

SEQ ID NO: 609303 - DNA, 13 bp, D. melanogaster
ccatttgtacagt

SEQ ID NO: 609304 - DNA, 13 bp, D. melanogaster
ccatttgtccatt

SEQ ID NO: 609305 - DNA, 13 bp, D. melanogaster
ccatttgtgtgtg

SEQ ID NO: 609306 - DNA, 13 bp, D. melanogaster
ccatttgttggct

SEQ ID NO: 609307 - DNA, 13 bp, D. melanogaster
ccatttgttgtga

SEQ ID NO: 609308 - DNA, 13 bp, D. melanogaster
ccatttgtttata

SEQ ID NO: 609309 - DNA, 13 bp, D. melanogaster
ccatttgtttggc

SEQ ID NO: 609310 - DNA, 13 bp, D. melanogaster
ccatttgtttgtt

SEQ ID NO: 609311 - DNA, 13 bp, D. melanogaster
ccatttgttttgg

SEQ ID NO: 609312 - DNA, 13 bp, D. melanogaster
ccattttaaaaca

SEQ ID NO: 609313 - DNA, 13 bp, D. melanogaster
ccattttaaataa

SEQ ID NO: 609314 - DNA, 13 bp, D. melanogaster
ccattttaaattc

SEQ ID NO: 609315 - DNA, 13 bp, D. melanogaster
ccattttaataac

SEQ ID NO: 609316 - DNA, 13 bp, D. melanogaster
ccattttacaaaa

SEQ ID NO: 609317 - DNA, 13 bp, D. melanogaster
ccattttaccatt

SEQ ID NO: 609318 - DNA, 13 bp, D. melanogaster
ccattttataata

SEQ ID NO: 609319 - DNA, 14 bp, D. melanogaster
ccattttatatttc

SEQ ID NO: 609320 - DNA, 13 bp, D. melanogaster
ccattttattccc

SEQ ID NO: 609321 - DNA, 13 bp, D. melanogaster
ccattttatttgt

SEQ ID NO: 609322 - DNA, 13 bp, D. melanogaster
ccattttcaaaaa

SEQ ID NO: 609323 - DNA, 13 bp, D. melanogaster
ccattttcaatat

SEQ ID NO: 609324 - DNA, 14 bp, D. melanogaster
ccattttcatattt

SEQ ID NO: 609325 - DNA, 13 bp, D. melanogaster
ccattttcattcc

SEQ ID NO: 609326 - DNA, 13 bp, D. melanogaster
ccattttcattgc

SEQ ID NO: 609327 - DNA, 14 bp, D. melanogaster
ccattttcatttcc

SEQ ID NO: 609328 - DNA, 13 bp, D. melanogaster
ccattttccaatt

SEQ ID NO: 609329 - DNA, 13 bp, D. melanogaster
ccattttccaccc

SEQ ID NO: 609330 - DNA, 13 bp, D. melanogaster
ccattttccactt

SEQ ID NO: 609331 - DNA, 13 bp, D. melanogaster
ccattttccagcc

SEQ ID NO: 609332 - DNA, 13 bp, D. melanogaster
ccattttccatat

SEQ ID NO: 609333 - DNA, 13 bp, D. melanogaster
ccattttccattt

SEQ ID NO: 609334 - DNA, 13 bp, D. melanogaster
ccattttcccatt

SEQ ID NO: 609335 - DNA, 13 bp, D. melanogaster
ccattttccccac

SEQ ID NO: 609336 - DNA, 14 bp, D. melanogaster
ccattttccccatt

SEQ ID NO: 609337 - DNA, 13 bp, D. melanogaster
ccattttcccgcc

SEQ ID NO: 609338 - DNA, 13 bp, D. melanogaster
ccattttccgccc

SEQ ID NO: 609339 - DNA, 13 bp, D. melanogaster
ccattttccgctc

SEQ ID NO: 609340 - DNA, 13 bp, D. melanogaster
ccattttccgctg

SEQ ID NO: 609341 - DNA, 13 bp, D. melanogaster
ccattttcctgct

SEQ ID NO: 609342 - DNA, 13 bp, D. melanogaster
ccattttcctggc

SEQ ID NO: 609343 - DNA, 13 bp, D. melanogaster
ccattttcgcatt

SEQ ID NO: 609344 - DNA, 13 bp, D. melanogaster
ccattttcgccca

SEQ ID NO: 609345 - DNA, 14 bp, D. melanogaster
ccattttctccatt

SEQ ID NO: 609346 - DNA, 13 bp, D. melanogaster
ccattttgatatg

SEQ ID NO: 609347 - DNA, 13 bp, D. melanogaster
ccattttgatttg

SEQ ID NO: 609348 - DNA, 13 bp, D. melanogaster
ccattttggccaa

SEQ ID NO: 609349 - DNA, 13 bp, D. melanogaster
ccattttggccag

SEQ ID NO: 609350 - DNA, 13 bp, D. melanogaster
ccattttggccat

SEQ ID NO: 609351 - DNA, 13 bp, D. melanogaster
ccatttttaaatt

SEQ ID NO: 609352 - DNA, 13 bp, D. melanogaster
ccatttttagcca

SEQ ID NO: 609353 - DNA, 14 bp, D. melanogaster
ccatttttagccaa

SEQ ID NO: 609354 - DNA, 13 bp, D. melanogaster
ccatttttatatg

SEQ ID NO: 609355 - DNA, 13 bp, D. melanogaster
ccatttttccgcc

SEQ ID NO: 609356 - DNA, 13 bp, D. melanogaster
ccatttttgccat

SEQ ID NO: 609357 - DNA, 13 bp, D. melanogaster
ccatttttgctct

SEQ ID NO: 609358 - DNA, 13 bp, D. melanogaster
ccatttttggaca

SEQ ID NO: 609359 - DNA, 13 bp, D. melanogaster
ccatttttgggca

SEQ ID NO: 609360 - DNA, 13 bp, D. melanogaster
ccattttttgccc

SEQ ID NO: 609361 - DNA, 13 bp, D. melanogaster
ccattttttgttg

SEQ ID NO: 609362 - DNA, 14 bp, D. melanogaster
cccaaaaaaaaggg

SEQ ID NO: 609363 - DNA, 13 bp, D. melanogaster
cccaaaaaaaggg

SEQ ID NO: 609364 - DNA, 13 bp, D. melanogaster
cccaaaaaaggca

SEQ ID NO: 609365 - DNA, 13 bp, D. melanogaster
cccaaaaaagtat

SEQ ID NO: 609366 - DNA, 13 bp, D. melanogaster
cccaaaaaatatg

SEQ ID NO: 609367 - DNA, 14 bp, D. melanogaster
cccaaaaaatatgt

SEQ ID NO: 609368 - DNA, 13 bp, D. melanogaster
cccaaaaacggaa

SEQ ID NO: 609369 - DNA, 13 bp, D. melanogaster
cccaaaaactttg

SEQ ID NO: 609370 - DNA, 13 bp, D. melanogaster
cccaaaaagatac

SEQ ID NO: 609371 - DNA, 13 bp, D. melanogaster
cccaaaaagctga

SEQ ID NO: 609372 - DNA, 14 bp, D. melanogaster
cccaaaaagctgat

SEQ ID NO: 609373 - DNA, 13 bp, D. melanogaster
cccaaaaaggcaa

SEQ ID NO: 609374 - DNA, 13 bp, D. melanogaster
cccaaaaagggaa

SEQ ID NO: 609375 - DNA, 13 bp, D. melanogaster
cccaaaaagtatg

SEQ ID NO: 609376 - DNA, 13 bp, D. melanogaster
cccaaaaagtcaa

SEQ ID NO: 609377 - DNA, 13 bp, D. melanogaster
cccaaaaagtggg

SEQ ID NO: 609378 - DNA, 13 bp, D. melanogaster
cccaaaaagttgg

SEQ ID NO: 609379 - DNA, 13 bp, D. melanogaster
cccaaaaagtttt

SEQ ID NO: 609380 - DNA, 13 bp, D. melanogaster
cccaaaaatagtt

SEQ ID NO: 609381 - DNA, 13 bp, D. melanogaster
cccaaaaatatat

SEQ ID NO: 609382 - DNA, 14 bp, D. melanogaster
cccaaaaatatatg

SEQ ID NO: 609383 - DNA, 13 bp, D. melanogaster
cccaaaaatggca

SEQ ID NO: 609384 - DNA, 13 bp, D. melanogaster
cccaaaaatgtaa

SEQ ID NO: 609385 - DNA, 13 bp, D. melanogaster
cccaaaaatgtga

SEQ ID NO: 609386 - DNA, 13 bp, D. melanogaster
cccaaaaattaat

SEQ ID NO: 609387 - DNA, 13 bp, D. melanogaster
cccaaaaatttca

SEQ ID NO: 609388 - DNA, 13 bp, D. melanogaster
cccaaaaatttgt

SEQ ID NO: 609389 - DNA, 13 bp, D. melanogaster
cccaaaacgaaat

SEQ ID NO: 609390 - DNA, 13 bp, D. melanogaster
cccaaaactcaat

SEQ ID NO: 609391 - DNA, 13 bp, D. melanogaster
cccaaaactccgc

SEQ ID NO: 609392 - DNA, 13 bp, D. melanogaster
cccaaaactgcat

SEQ ID NO: 609393 - DNA, 14 bp, D. melanogaster
cccaaaactgccac

SEQ ID NO: 609394 - DNA, 13 bp, D. melanogaster
cccaaaacttttg

SEQ ID NO: 609395 - DNA, 13 bp, D. melanogaster
cccaaaacttttt

SEQ ID NO: 609396 - DNA, 13 bp, D. melanogaster
cccaaaagaactt

SEQ ID NO: 609397 - DNA, 14 bp, D. melanogaster
cccaaaagcatttt

SEQ ID NO: 609398 - DNA, 13 bp, D. melanogaster
cccaaaagcgaaa

SEQ ID NO: 609399 - DNA, 13 bp, D. melanogaster
cccaaaatcagca

SEQ ID NO: 609400 - DNA, 14 bp, D. melanogaster
cccaaaatcagcaa

SEQ ID NO: 609401 - DNA, 13 bp, D. melanogaster
cccaaaatcattt

SEQ ID NO: 609402 - DNA, 13 bp, D. melanogaster
cccaaaatccgaa

SEQ ID NO: 609403 - DNA, 13 bp, D. melanogaster
cccaaaatgaaaa

SEQ ID NO: 609404 - DNA, 14 bp, D. melanogaster
cccaaaatgctgac

SEQ ID NO: 609405 - DNA, 13 bp, D. melanogaster
cccaaaatggtgg

SEQ ID NO: 609406 - DNA, 13 bp, D. melanogaster
cccaaaattgtaa

SEQ ID NO: 609407 - DNA, 13 bp, D. melanogaster
cccaaacaaatta

SEQ ID NO: 609408 - DNA, 13 bp, D. melanogaster
cccaaacaatgga

SEQ ID NO: 609409 - DNA, 13 bp, D. melanogaster
cccaaaccaaggg

SEQ ID NO: 609410 - DNA, 13 bp, D. melanogaster
cccaaacgatttt

SEQ ID NO: 609411 - DNA, 13 bp, D. melanogaster
cccaaactggtgt

SEQ ID NO: 609412 - DNA, 13 bp, D. melanogaster
cccaaagcaaata

SEQ ID NO: 609413 - DNA, 13 bp, D. melanogaster
cccaaagccaaag

SEQ ID NO: 609414 - DNA, 13 bp, D. melanogaster
cccaaaggaaatg

SEQ ID NO: 609415 - DNA, 13 bp, D. melanogaster
cccaaataagaag

SEQ ID NO: 609416 - DNA, 13 bp, D. melanogaster
cccaaatacaaat

SEQ ID NO: 609417 - DNA, 13 bp, D. melanogaster
cccaaatacgtca

SEQ ID NO: 609418 - DNA, 13 bp, D. melanogaster
cccaaatattata

SEQ ID NO: 609419 - DNA, 13 bp, D. melanogaster
cccaaatatttgc

SEQ ID NO: 609420 - DNA, 13 bp, D. melanogaster
cccaaatcaaaat

SEQ ID NO: 609421 - DNA, 14 bp, D. melanogaster
cccaaatcaaatcg

SEQ ID NO: 609422 - DNA, 13 bp, D. melanogaster
cccaaatccaaat

SEQ ID NO: 609423 - DNA, 13 bp, D. melanogaster
cccaaatccaatt

SEQ ID NO: 609424 - DNA, 13 bp, D. melanogaster
cccaaatcggaga

SEQ ID NO: 609425 - DNA, 14 bp, D. melanogaster
cccaaatcggagat

SEQ ID NO: 609426 - DNA, 13 bp, D. melanogaster
cccaaatgcattt

SEQ ID NO: 609427 - DNA, 13 bp, D. melanogaster
cccaaatggcaaa

SEQ ID NO: 609428 - DNA, 13 bp, D. melanogaster
cccaaattaattg

SEQ ID NO: 609429 - DNA, 13 bp, D. melanogaster
cccaaatttgaat

SEQ ID NO: 609430 - DNA, 13 bp, D. melanogaster
cccaaattttgca

SEQ ID NO: 609431 - DNA, 13 bp, D. melanogaster
cccaacactcttg

SEQ ID NO: 609432 - DNA, 13 bp, D. melanogaster
cccaacagaacta

SEQ ID NO: 609433 - DNA, 13 bp, D. melanogaster
cccaacagcctag

SEQ ID NO: 609434 - DNA, 13 bp, D. melanogaster
cccaaccacctag

SEQ ID NO: 609435 - DNA, 14 bp, D. melanogaster
cccaaccaggaatt

SEQ ID NO: 609436 - DNA, 13 bp, D. melanogaster
cccaacgatttta

SEQ ID NO: 609437 - DNA, 13 bp, D. melanogaster
cccaactaattat

SEQ ID NO: 609438 - DNA, 15 bp, D. melanogaster
cccaactgcaaaaca

SEQ ID NO: 609439 - DNA, 13 bp, D. melanogaster
cccaactgcattt

SEQ ID NO: 609440 - DNA, 14 bp, D. melanogaster
cccaacttcagcac

SEQ ID NO: 609441 - DNA, 14 bp, D. melanogaster
cccaagaaaaatcc

SEQ ID NO: 609442 - DNA, 13 bp, D. melanogaster
cccaagaaaatcg

SEQ ID NO: 609443 - DNA, 13 bp, D. melanogaster
cccaagaagattt

SEQ ID NO: 609444 - DNA, 13 bp, D. melanogaster
cccaagatcccat

SEQ ID NO: 609445 - DNA, 13 bp, D. melanogaster
cccaagcccaagt

SEQ ID NO: 609446 - DNA, 13 bp, D. melanogaster
cccaagcccaatc

SEQ ID NO: 609447 - DNA, 13 bp, D. melanogaster
cccaagccgaaaa

SEQ ID NO: 609448 - DNA, 13 bp, D. melanogaster
cccaagcctttgc

SEQ ID NO: 609449 - DNA, 13 bp, D. melanogaster
cccaagtcttggt

SEQ ID NO: 609450 - DNA, 13 bp, D. melanogaster
cccaatcagaatc

SEQ ID NO: 609451 - DNA, 13 bp, D. melanogaster
cccaatcatctat

SEQ ID NO: 609452 - DNA, 15 bp, D. melanogaster
cccaatcatctattg

SEQ ID NO: 609453 - DNA, 13 bp, D. melanogaster
cccaatccaacag

SEQ ID NO: 609454 - DNA, 13 bp, D. melanogaster
cccaatcccagtc

SEQ ID NO: 609455 - DNA, 14 bp, D. melanogaster
cccaatcccattcc

SEQ ID NO: 609456 - DNA, 13 bp, D. melanogaster
cccaatcccattt

SEQ ID NO: 609457 - DNA, 13 bp, D. melanogaster
cccaatccccaat

SEQ ID NO: 609458 - DNA, 13 bp, D. melanogaster
cccaatcccgatc

SEQ ID NO: 609459 - DNA, 13 bp, D. melanogaster
cccaatccgaaaa

SEQ ID NO: 609460 - DNA, 13 bp, D. melanogaster
cccaatccgaatc

SEQ ID NO: 609461 - DNA, 14 bp, D. melanogaster
cccaatccgaatcc

SEQ ID NO: 609462 - DNA, 13 bp, D. melanogaster
cccaatccgttaa

SEQ ID NO: 609463 - DNA, 14 bp, D. melanogaster
cccaatcctccaat

SEQ ID NO: 609464 - DNA, 13 bp, D. melanogaster
cccaatcgcaatc

SEQ ID NO: 609465 - DNA, 13 bp, D. melanogaster
cccaatctcaatc

SEQ ID NO: 609466 - DNA, 13 bp, D. melanogaster
cccaatggatcag

SEQ ID NO: 609467 - DNA, 13 bp, D. melanogaster
cccaatgggttgt

SEQ ID NO: 609468 - DNA, 13 bp, D. melanogaster
cccaattacccat

SEQ ID NO: 609469 - DNA, 14 bp, D. melanogaster
cccaattccaatcc

SEQ ID NO: 609470 - DNA, 14 bp, D. melanogaster
cccaattccaattc

SEQ ID NO: 609471 - DNA, 13 bp, D. melanogaster
cccaattgtgttt

SEQ ID NO: 609472 - DNA, 13 bp, D. melanogaster
cccaatttcccca

SEQ ID NO: 609473 - DNA, 14 bp, D. melanogaster
cccaatttccccaa

SEQ ID NO: 609474 - DNA, 13 bp, D. melanogaster
cccaatttcccga

SEQ ID NO: 609475 - DNA, 14 bp, D. melanogaster
cccaatttcccgaa

SEQ ID NO: 609476 - DNA, 13 bp, D. melanogaster
cccacaatgtcgg

SEQ ID NO: 609477 - DNA, 13 bp, D. melanogaster
cccacacactcgc

SEQ ID NO: 609478 - DNA, 14 bp, D. melanogaster
cccacacactcgca

SEQ ID NO: 609479 - DNA, 13 bp, D. melanogaster
cccacagctcgga

SEQ ID NO: 609480 - DNA, 13 bp, D. melanogaster
cccacatacccat

SEQ ID NO: 609481 - DNA, 14 bp, D. melanogaster
cccacatacccatt

SEQ ID NO: 609482 - DNA, 13 bp, D. melanogaster
cccacatccacat

SEQ ID NO: 609483 - DNA, 13 bp, D. melanogaster
cccacatcccgtt

SEQ ID NO: 609484 - DNA, 13 bp, D. melanogaster
cccacatttaaaa

SEQ ID NO: 609485 - DNA, 13 bp, D. melanogaster
cccacattttcca

SEQ ID NO: 609486 - DNA, 13 bp, D. melanogaster
cccacattttttt

SEQ ID NO: 609487 - DNA, 13 bp, D. melanogaster
cccaccaaagggt

SEQ ID NO: 609488 - DNA, 13 bp, D. melanogaster
cccaccaatttgg

SEQ ID NO: 609489 - DNA, 13 bp, D. melanogaster
cccacccactttt

SEQ ID NO: 609490 - DNA, 14 bp, D. melanogaster
cccacccatgtggc

SEQ ID NO: 609491 - DNA, 13 bp, D. melanogaster
cccacccattttc

SEQ ID NO: 609492 - DNA, 14 bp, D. melanogaster
cccaccgactgaaa

SEQ ID NO: 609493 - DNA, 13 bp, D. melanogaster
cccaccgattttc

SEQ ID NO: 609494 - DNA, 13 bp, D. melanogaster
cccacgcacacag

SEQ ID NO: 609495 - DNA, 13 bp, D. melanogaster
cccacgcacacat

SEQ ID NO: 609496 - DNA, 13 bp, D. melanogaster
cccactaagaata

SEQ ID NO: 609497 - DNA, 13 bp, D. melanogaster
cccactcacacgc

SEQ ID NO: 609498 - DNA, 13 bp, D. melanogaster
cccactccacggc

SEQ ID NO: 609499 - DNA, 13 bp, D. melanogaster
cccactcccattt

SEQ ID NO: 609500 - DNA, 13 bp, D. melanogaster
cccactcgaaggc

SEQ ID NO: 609501 - DNA, 14 bp, D. melanogaster
cccactgccacgcc

SEQ ID NO: 609502 - DNA, 13 bp, D. melanogaster
cccactgcccact

SEQ ID NO: 609503 - DNA, 13 bp, D. melanogaster
cccactgtgccgc

SEQ ID NO: 609504 - DNA, 13 bp, D. melanogaster
cccactgtgcgac

SEQ ID NO: 609505 - DNA, 13 bp, D. melanogaster
cccactgtgcgca

SEQ ID NO: 609506 - DNA, 13 bp, D. melanogaster
cccactgtgcggc

SEQ ID NO: 609507 - DNA, 13 bp, D. melanogaster
cccacttccgttt

SEQ ID NO: 609508 - DNA, 13 bp, D. melanogaster
cccacttggccac

SEQ ID NO: 609509 - DNA, 13 bp, D. melanogaster
cccactttcccgc

SEQ ID NO: 609510 - DNA, 13 bp, D. melanogaster
cccactttccgcc

SEQ ID NO: 609511 - DNA, 13 bp, D. melanogaster
cccactttctttg

SEQ ID NO: 609512 - DNA, 14 bp, D. melanogaster
cccactttctttgg

SEQ ID NO: 609513 - DNA, 13 bp, D. melanogaster
cccacttttccgc

SEQ ID NO: 609514 - DNA, 14 bp, D. melanogaster
cccacttttccgcc

SEQ ID NO: 609515 - DNA, 13 bp, D. melanogaster
cccactttttggc

SEQ ID NO: 609516 - DNA, 13 bp, D. melanogaster
cccagaaaaatga

SEQ ID NO: 609517 - DNA, 13 bp, D. melanogaster
cccagaaaaatta

SEQ ID NO: 609518 - DNA, 13 bp, D. melanogaster
cccagaaagtctg

SEQ ID NO: 609519 - DNA, 13 bp, D. melanogaster
cccagaacccaga

SEQ ID NO: 609520 - DNA, 13 bp, D. melanogaster
cccagacccagac

SEQ ID NO: 609521 - DNA, 13 bp, D. melanogaster
cccagaccccaga

SEQ ID NO: 609522 - DNA, 13 bp, D. melanogaster
cccagactcagac

SEQ ID NO: 609523 - DNA, 13 bp, D. melanogaster
cccagactccaac

SEQ ID NO: 609524 - DNA, 14 bp, D. melanogaster
cccagatcccagat

SEQ ID NO: 609525 - DNA, 13 bp, D. melanogaster
cccagatgaccaa

SEQ ID NO: 609526 - DNA, 13 bp, D. melanogaster
cccagcaatttgc

SEQ ID NO: 609527 - DNA, 14 bp, D. melanogaster
cccagcagcagcaa

SEQ ID NO: 609528 - DNA, 14 bp, D. melanogaster
cccagccacattcc

SEQ ID NO: 609529 - DNA, 14 bp, D. melanogaster
cccagccacccact

SEQ ID NO: 609530 - DNA, 13 bp, D. melanogaster
cccagccacctga

SEQ ID NO: 609531 - DNA, 13 bp, D. melanogaster
cccagccagccag

SEQ ID NO: 609532 - DNA, 14 bp, D. melanogaster
cccagccagccagc

SEQ ID NO: 609533 - DNA, 13 bp, D. melanogaster
cccagccagtcca

SEQ ID NO: 609534 - DNA, 13 bp, D. melanogaster
cccagcccagcaa

SEQ ID NO: 609535 - DNA, 13 bp, D. melanogaster
cccagctccaact

SEQ ID NO: 609536 - DNA, 14 bp, D. melanogaster
cccagctcccagct

SEQ ID NO: 609537 - DNA, 13 bp, D. melanogaster
cccagctcccagt

SEQ ID NO: 609538 - DNA, 13 bp, D. melanogaster
cccagctgacacc

SEQ ID NO: 609539 - DNA, 13 bp, D. melanogaster
cccaggacaccag

SEQ ID NO: 609540 - DNA, 13 bp, D. melanogaster
cccaggcagtggg

SEQ ID NO: 609541 - DNA, 13 bp, D. melanogaster
cccagtaatacga

SEQ ID NO: 609542 - DNA, 13 bp, D. melanogaster
cccagtccatgcc

SEQ ID NO: 609543 - DNA, 13 bp, D. melanogaster
cccagtcccaatc

SEQ ID NO: 609544 - DNA, 13 bp, D. melanogaster
cccagtcccagtc

SEQ ID NO: 609545 - DNA, 13 bp, D. melanogaster
cccagtccccagt

SEQ ID NO: 609546 - DNA, 13 bp, D. melanogaster
cccagtgccgaaa

SEQ ID NO: 609547 - DNA, 14 bp, D. melanogaster
cccagttcaaaatt

SEQ ID NO: 609548 - DNA, 13 bp, D. melanogaster
cccagttccaagt

SEQ ID NO: 609549 - DNA, 13 bp, D. melanogaster
cccagttccacat

SEQ ID NO: 609550 - DNA, 13 bp, D. melanogaster
cccagttccagtt

SEQ ID NO: 609551 - DNA, 13 bp, D. melanogaster
cccagttcccagt

SEQ ID NO: 609552 - DNA, 14 bp, D. melanogaster
cccagttcgaagtg

SEQ ID NO: 609553 - DNA, 13 bp, D. melanogaster
cccagttgccagt

SEQ ID NO: 609554 - DNA, 14 bp, D. melanogaster
cccagttgccagtt

SEQ ID NO: 609555 - DNA, 13 bp, D. melanogaster
cccagttggccag

SEQ ID NO: 609556 - DNA, 13 bp, D. melanogaster
cccagtttcagtt

SEQ ID NO: 609557 - DNA, 13 bp, D. melanogaster
cccagtttcccag

SEQ ID NO: 609558 - DNA, 13 bp, D. melanogaster
cccagtttgccaa

SEQ ID NO: 609559 - DNA, 13 bp, D. melanogaster
cccataaataata

SEQ ID NO: 609560 - DNA, 13 bp, D. melanogaster
cccataaatatgc

SEQ ID NO: 609561 - DNA, 13 bp, D. melanogaster
cccataacccata

SEQ ID NO: 609562 - DNA, 13 bp, D. melanogaster
cccataagacttt

SEQ ID NO: 609563 - DNA, 13 bp, D. melanogaster
cccataagctcga

SEQ ID NO: 609564 - DNA, 13 bp, D. melanogaster
cccatacaaatcc

SEQ ID NO: 609565 - DNA, 14 bp, D. melanogaster
cccatacccatgcc

SEQ ID NO: 609566 - DNA, 14 bp, D. melanogaster
cccatacccattcc

SEQ ID NO: 609567 - DNA, 13 bp, D. melanogaster
cccatatacaata

SEQ ID NO: 609568 - DNA, 14 bp, D. melanogaster
cccatatatacata

SEQ ID NO: 609569 - DNA, 14 bp, D. melanogaster
cccatatatgtatg

SEQ ID NO: 609570 - DNA, 13 bp, D. melanogaster
cccatccgatccg

SEQ ID NO: 609571 - DNA, 13 bp, D. melanogaster
cccatccgcccat

SEQ ID NO: 609572 - DNA, 13 bp, D. melanogaster
cccatcgcccatc

SEQ ID NO: 609573 - DNA, 13 bp, D. melanogaster
cccatctatagat

SEQ ID NO: 609574 - DNA, 13 bp, D. melanogaster
cccatgaccagct

SEQ ID NO: 609575 - DNA, 13 bp, D. melanogaster
cccatgccaccca

SEQ ID NO: 609576 - DNA, 13 bp, D. melanogaster
cccatgccccatg

SEQ ID NO: 609577 - DNA, 13 bp, D. melanogaster
cccatgtccatgt

SEQ ID NO: 609578 - DNA, 13 bp, D. melanogaster
cccatgtggcacg

SEQ ID NO: 609579 - DNA, 13 bp, D. melanogaster
cccatgttgccac

SEQ ID NO: 609580 - DNA, 13 bp, D. melanogaster
cccatgtttgccc

SEQ ID NO: 609581 - DNA, 13 bp, D. melanogaster
cccattaaaataa

SEQ ID NO: 609582 - DNA, 13 bp, D. melanogaster
cccattacaattg

SEQ ID NO: 609583 - DNA, 13 bp, D. melanogaster
cccattacccatt

SEQ ID NO: 609584 - DNA, 14 bp, D. melanogaster
cccattactaaaat

SEQ ID NO: 609585 - DNA, 13 bp, D. melanogaster
cccattactcgta

SEQ ID NO: 609586 - DNA, 13 bp, D. melanogaster
cccattcaaaaaa

SEQ ID NO: 609587 - DNA, 13 bp, D. melanogaster
cccattcattcat

SEQ ID NO: 609588 - DNA, 13 bp, D. melanogaster
cccattccactgc

SEQ ID NO: 609589 - DNA, 13 bp, D. melanogaster
cccattccatcca

SEQ ID NO: 609590 - DNA, 13 bp, D. melanogaster
cccattccattcc

SEQ ID NO: 609591 - DNA, 13 bp, D. melanogaster
cccattccatttg

SEQ ID NO: 609592 - DNA, 13 bp, D. melanogaster
cccattcccaaaa

SEQ ID NO: 609593 - DNA, 14 bp, D. melanogaster
cccattcccaatcc

SEQ ID NO: 609594 - DNA, 13 bp, D. melanogaster
cccattcccactt

SEQ ID NO: 609595 - DNA, 14 bp, D. melanogaster
cccattcccatttc

SEQ ID NO: 609596 - DNA, 13 bp, D. melanogaster
cccattccccaaa

SEQ ID NO: 609597 - DNA, 13 bp, D. melanogaster
cccattcccgttc

SEQ ID NO: 609598 - DNA, 13 bp, D. melanogaster
cccattctaacgc

SEQ ID NO: 609599 - DNA, 13 bp, D. melanogaster
cccattgaaaatt

SEQ ID NO: 609600 - DNA, 14 bp, D. melanogaster
cccattgccaccca

SEQ ID NO: 609601 - DNA, 13 bp, D. melanogaster
cccattgctggaa

SEQ ID NO: 609602 - DNA, 13 bp, D. melanogaster
cccattggcattc

SEQ ID NO: 609603 - DNA, 13 bp, D. melanogaster
cccattggggatc

SEQ ID NO: 609604 - DNA, 13 bp, D. melanogaster
cccattgttgttg

SEQ ID NO: 609605 - DNA, 13 bp, D. melanogaster
cccatttaattgt

SEQ ID NO: 609606 - DNA, 13 bp, D. melanogaster
cccatttacattt

SEQ ID NO: 609607 - DNA, 13 bp, D. melanogaster
cccatttatattt

SEQ ID NO: 609608 - DNA, 13 bp, D. melanogaster
cccatttatttat

SEQ ID NO: 609609 - DNA, 13 bp, D. melanogaster
cccatttcaaaca

SEQ ID NO: 609610 - DNA, 13 bp, D. melanogaster
cccatttcatttt

SEQ ID NO: 609611 - DNA, 13 bp, D. melanogaster
cccatttccaagc

SEQ ID NO: 609612 - DNA, 13 bp, D. melanogaster
cccatttccacca

SEQ ID NO: 609613 - DNA, 14 bp, D. melanogaster
cccatttccattcc

SEQ ID NO: 609614 - DNA, 13 bp, D. melanogaster
cccatttccattg

SEQ ID NO: 609615 - DNA, 13 bp, D. melanogaster
cccatttccattt

SEQ ID NO: 609616 - DNA, 14 bp, D. melanogaster
cccatttccatttc

SEQ ID NO: 609617 - DNA, 13 bp, D. melanogaster
cccatttcccagc

SEQ ID NO: 609618 - DNA, 13 bp, D. melanogaster
cccatttcccatc

SEQ ID NO: 609619 - DNA, 14 bp, D. melanogaster
cccatttcccattt

SEQ ID NO: 609620 - DNA, 13 bp, D. melanogaster
cccatttccccag

SEQ ID NO: 609621 - DNA, 13 bp, D. melanogaster
cccatttccccat

SEQ ID NO: 609622 - DNA, 13 bp, D. melanogaster
cccatttccctgc

SEQ ID NO: 609623 - DNA, 13 bp, D. melanogaster
cccatttcgattt

SEQ ID NO: 609624 - DNA, 13 bp, D. melanogaster
cccatttcgccca

SEQ ID NO: 609625 - DNA, 13 bp, D. melanogaster
cccatttgcatgc

SEQ ID NO: 609626 - DNA, 13 bp, D. melanogaster
cccatttgcattt

SEQ ID NO: 609627 - DNA, 13 bp, D. melanogaster
cccattttaataa

SEQ ID NO: 609628 - DNA, 13 bp, D. melanogaster
cccattttcattt

SEQ ID NO: 609629 - DNA, 13 bp, D. melanogaster
cccattttccacc

SEQ ID NO: 609630 - DNA, 13 bp, D. melanogaster
cccattttcccca

SEQ ID NO: 609631 - DNA, 13 bp, D. melanogaster
cccattttccgac

SEQ ID NO: 609632 - DNA, 13 bp, D. melanogaster
cccattttccgct

SEQ ID NO: 609633 - DNA, 13 bp, D. melanogaster
cccattttctttg

SEQ ID NO: 609634 - DNA, 13 bp, D. melanogaster
cccattttgggta

SEQ ID NO: 609635 - DNA, 13 bp, D. melanogaster
ccccaaaaacttt

SEQ ID NO: 609636 - DNA, 13 bp, D. melanogaster
ccccaaaaaggaa

SEQ ID NO: 609637 - DNA, 13 bp, D. melanogaster
ccccaaaaagggg

SEQ ID NO: 609638 - DNA, 13 bp, D. melanogaster
ccccaaaaagtgg

SEQ ID NO: 609639 - DNA, 14 bp, D. melanogaster
ccccaaaactccgc

SEQ ID NO: 609640 - DNA, 13 bp, D. melanogaster
ccccaaaatcagc

SEQ ID NO: 609641 - DNA, 14 bp, D. melanogaster
ccccaaaatcagca

SEQ ID NO: 609642 - DNA, 13 bp, D. melanogaster
ccccaaagtatgc

SEQ ID NO: 609643 - DNA, 13 bp, D. melanogaster
ccccaaatgcaaa

SEQ ID NO: 609644 - DNA, 13 bp, D. melanogaster
ccccaacaaatgc

SEQ ID NO: 609645 - DNA, 13 bp, D. melanogaster
ccccaactgcaaa

SEQ ID NO: 609646 - DNA, 13 bp, D. melanogaster
ccccaatcccaat

SEQ ID NO: 609647 - DNA, 13 bp, D. melanogaster
ccccaatccccag

SEQ ID NO: 609648 - DNA, 13 bp, D. melanogaster
ccccaccatgcat

SEQ ID NO: 609649 - DNA, 14 bp, D. melanogaster
ccccaccgacaaga

SEQ ID NO: 609650 - DNA, 13 bp, D. melanogaster
ccccactcctcgg

SEQ ID NO: 609651 - DNA, 13 bp, D. melanogaster
ccccagatgacca

SEQ ID NO: 609652 - DNA, 13 bp, D. melanogaster
ccccagctccagc

SEQ ID NO: 609653 - DNA, 13 bp, D. melanogaster
ccccaggcagtgg

SEQ ID NO: 609654 - DNA, 13 bp, D. melanogaster
ccccataactgtg

SEQ ID NO: 609655 - DNA, 13 bp, D. melanogaster
ccccatacccata

SEQ ID NO: 609656 - DNA, 14 bp, D. melanogaster
ccccatatatatat

SEQ ID NO: 609657 - DNA, 13 bp, D. melanogaster
ccccatatcaaaa

SEQ ID NO: 609658 - DNA, 13 bp, D. melanogaster
ccccatctcagag

SEQ ID NO: 609659 - DNA, 13 bp, D. melanogaster
ccccattccactg

SEQ ID NO: 609660 - DNA, 13 bp, D. melanogaster
ccccattccattc

SEQ ID NO: 609661 - DNA, 13 bp, D. melanogaster
ccccatttccatc

SEQ ID NO: 609662 - DNA, 13 bp, D. melanogaster
ccccattttccac

SEQ ID NO: 609663 - DNA, 13 bp, D. melanogaster
ccccattttccca

SEQ ID NO: 609664 - DNA, 13 bp, D. melanogaster
cccccaaggcagc

SEQ ID NO: 609665 - DNA, 13 bp, D. melanogaster
cccccatgggcaa

SEQ ID NO: 609666 - DNA, 13 bp, D. melanogaster
cccccgaaattct

SEQ ID NO: 609667 - DNA, 13 bp, D. melanogaster
cccccgcccattt

SEQ ID NO: 609668 - DNA, 13 bp, D. melanogaster
ccccgaaaaactt

SEQ ID NO: 609669 - DNA, 13 bp, D. melanogaster
ccccgcccacttg

SEQ ID NO: 609670 - DNA, 13 bp, D. melanogaster
ccccgcccacttt

SEQ ID NO: 609671 - DNA, 14 bp, D. melanogaster
ccccgcccactttc

SEQ ID NO: 609672 - DNA, 13 bp, D. melanogaster
ccccgccttatcg

SEQ ID NO: 609673 - DNA, 13 bp, D. melanogaster
ccccggaaaatac

SEQ ID NO: 609674 - DNA, 13 bp, D. melanogaster
ccccgtttcacag

SEQ ID NO: 609675 - DNA, 13 bp, D. melanogaster
cccctaccgtttt

SEQ ID NO: 609676 - DNA, 14 bp, D. melanogaster
cccctcaaaaataa

SEQ ID NO: 609677 - DNA, 13 bp, D. melanogaster
cccctcgactttc

SEQ ID NO: 609678 - DNA, 13 bp, D. melanogaster
cccctcgattttt

SEQ ID NO: 609679 - DNA, 13 bp, D. melanogaster
cccctgacccctg

SEQ ID NO: 609680 - DNA, 14 bp, D. melanogaster
cccctgatgagcat

SEQ ID NO: 609681 - DNA, 14 bp, D. melanogaster
cccctttcgagcac

SEQ ID NO: 609682 - DNA, 13 bp, D. melanogaster
cccctttgtgtcc

SEQ ID NO: 609683 - DNA, 13 bp, D. melanogaster
ccccttttggaaa

SEQ ID NO: 609684 - DNA, 13 bp, D. melanogaster
cccctttttttgg

SEQ ID NO: 609685 - DNA, 14 bp, D. melanogaster
cccctttttttggg

SEQ ID NO: 609686 - DNA, 13 bp, D. melanogaster
cccgaaaaaatcc

SEQ ID NO: 609687 - DNA, 14 bp, D. melanogaster
cccgaaaaaatccc

SEQ ID NO: 609688 - DNA, 13 bp, D. melanogaster
cccgaaaacacga

SEQ ID NO: 609689 - DNA, 13 bp, D. melanogaster
cccgaaaaccgaa

SEQ ID NO: 609690 - DNA, 13 bp, D. melanogaster
cccgaaaacgaaa

SEQ ID NO: 609691 - DNA, 13 bp, D. melanogaster
cccgaaaccgaaa

SEQ ID NO: 609692 - DNA, 14 bp, D. melanogaster
cccgaaagtaggca

SEQ ID NO: 609693 - DNA, 13 bp, D. melanogaster
cccgaaatacaaa

SEQ ID NO: 609694 - DNA, 13 bp, D. melanogaster
cccgaaatgaaat

SEQ ID NO: 609695 - DNA, 13 bp, D. melanogaster
cccgaaattcttc

SEQ ID NO: 609696 - DNA, 13 bp, D. melanogaster
cccgaagactgtg

SEQ ID NO: 609697 - DNA, 13 bp, D. melanogaster
cccgacttgatta

SEQ ID NO: 609698 - DNA, 13 bp, D. melanogaster
cccgaggccgttt

SEQ ID NO: 609699 - DNA, 13 bp, D. melanogaster
cccgatcccaatc

SEQ ID NO: 609700 - DNA, 14 bp, D. melanogaster
cccgatcccaatcc

SEQ ID NO: 609701 - DNA, 13 bp, D. melanogaster
cccgatccccgat

SEQ ID NO: 609702 - DNA, 14 bp, D. melanogaster
cccgatcccgatcc

SEQ ID NO: 609703 - DNA, 13 bp, D. melanogaster
cccgatcccgatt

SEQ ID NO: 609704 - DNA, 13 bp, D. melanogaster
cccgatgagaaga

SEQ ID NO: 609705 - DNA, 13 bp, D. melanogaster
cccgattcccgat

SEQ ID NO: 609706 - DNA, 13 bp, D. melanogaster
cccgattccgatt

SEQ ID NO: 609707 - DNA, 14 bp, D. melanogaster
cccgattccgattc

SEQ ID NO: 609708 - DNA, 14 bp, D. melanogaster
cccgcacacaaaat

SEQ ID NO: 609709 - DNA, 13 bp, D. melanogaster
cccgcagttactg

SEQ ID NO: 609710 - DNA, 13 bp, D. melanogaster
cccgcatagccat

SEQ ID NO: 609711 - DNA, 13 bp, D. melanogaster
cccgccactcgca

SEQ ID NO: 609712 - DNA, 13 bp, D. melanogaster
cccgccataaatg

SEQ ID NO: 609713 - DNA, 13 bp, D. melanogaster
cccgcccacttgg

SEQ ID NO: 609714 - DNA, 13 bp, D. melanogaster
cccgcgccgtgtt

SEQ ID NO: 609715 - DNA, 13 bp, D. melanogaster
cccgctacctcca

SEQ ID NO: 609716 - DNA, 14 bp, D. melanogaster
cccgctctattggc

SEQ ID NO: 609717 - DNA, 13 bp, D. melanogaster
cccgctgagagcg

SEQ ID NO: 609718 - DNA, 13 bp, D. melanogaster
cccgcttttccca

SEQ ID NO: 609719 - DNA, 13 bp, D. melanogaster
cccgcttttccgc

SEQ ID NO: 609720 - DNA, 14 bp, D. melanogaster
cccggaaaattcag

SEQ ID NO: 609721 - DNA, 13 bp, D. melanogaster
cccggcagcgggt

SEQ ID NO: 609722 - DNA, 13 bp, D. melanogaster
cccggttgagtgt

SEQ ID NO: 609723 - DNA, 13 bp, D. melanogaster
cccgtcagcaggc

SEQ ID NO: 609724 - DNA, 13 bp, D. melanogaster
cccgtctgggtcg

SEQ ID NO: 609725 - DNA, 13 bp, D. melanogaster
cccgtggagcgcc

SEQ ID NO: 609726 - DNA, 13 bp, D. melanogaster
cccgttactcgtt

SEQ ID NO: 609727 - DNA, 13 bp, D. melanogaster
cccgttcccattc

SEQ ID NO: 609728 - DNA, 15 bp, D. melanogaster
cccgttcccattccc

SEQ ID NO: 609729 - DNA, 13 bp, D. melanogaster
cccgtttgtttgc

SEQ ID NO: 609730 - DNA, 13 bp, D. melanogaster
cccgttttccaca

SEQ ID NO: 609731 - DNA, 13 bp, D. melanogaster
cccgttttttgct

SEQ ID NO: 609732 - DNA, 13 bp, D. melanogaster
ccctaaactaaaa

SEQ ID NO: 609733 - DNA, 13 bp, D. melanogaster
ccctaaagccgcc

SEQ ID NO: 609734 - DNA, 13 bp, D. melanogaster
ccctaactgaatg

SEQ ID NO: 609735 - DNA, 13 bp, D. melanogaster
ccctaccaaaggt

SEQ ID NO: 609736 - DNA, 14 bp, D. melanogaster
ccctataaaaaata

SEQ ID NO: 609737 - DNA, 13 bp, D. melanogaster
ccctatactcagt

SEQ ID NO: 609738 - DNA, 13 bp, D. melanogaster
ccctatatatata

SEQ ID NO: 609739 - DNA, 14 bp, D. melanogaster
ccctatatatatat

SEQ ID NO: 609740 - DNA, 13 bp, D. melanogaster
ccctatcactttt

SEQ ID NO: 609741 - DNA, 13 bp, D. melanogaster
ccctatccctatc

SEQ ID NO: 609742 - DNA, 14 bp, D. melanogaster
ccctattgtaatta

SEQ ID NO: 609743 - DNA, 13 bp, D. melanogaster
ccctcaaaaataa

SEQ ID NO: 609744 - DNA, 13 bp, D. melanogaster
ccctcaagatctg

SEQ ID NO: 609745 - DNA, 13 bp, D. melanogaster
ccctcaatgccct

SEQ ID NO: 609746 - DNA, 13 bp, D. melanogaster
ccctcgaccattg

SEQ ID NO: 609747 - DNA, 14 bp, D. melanogaster
ccctcgaccattgt

SEQ ID NO: 609748 - DNA, 13 bp, D. melanogaster
ccctcgataggaa

SEQ ID NO: 609749 - DNA, 13 bp, D. melanogaster
ccctcgatcacgg

SEQ ID NO: 609750 - DNA, 14 bp, D. melanogaster
ccctcgatgcactg

SEQ ID NO: 609751 - DNA, 13 bp, D. melanogaster
ccctcgattttcc

SEQ ID NO: 609752 - DNA, 13 bp, D. melanogaster
ccctgccacgcct

SEQ ID NO: 609753 - DNA, 13 bp, D. melanogaster
ccctgccattttc

SEQ ID NO: 609754 - DNA, 13 bp, D. melanogaster
ccctgccccataa

SEQ ID NO: 609755 - DNA, 13 bp, D. melanogaster
ccctgctcctgtc

SEQ ID NO: 609756 - DNA, 13 bp, D. melanogaster
ccctgcttccagt

SEQ ID NO: 609757 - DNA, 13 bp, D. melanogaster
ccctggaaaagag

SEQ ID NO: 609758 - DNA, 13 bp, D. melanogaster
ccctgtccctgtc

SEQ ID NO: 609759 - DNA, 13 bp, D. melanogaster
ccctgtccgtctg

SEQ ID NO: 609760 - DNA, 13 bp, D. melanogaster
ccctgtgtgcgtg

SEQ ID NO: 609761 - DNA, 13 bp, D. melanogaster
ccctgtttgtttg

SEQ ID NO: 609762 - DNA, 13 bp, D. melanogaster
cccttaaaatgga

SEQ ID NO: 609763 - DNA, 13 bp, D. melanogaster
cccttaacccctt

SEQ ID NO: 609764 - DNA, 13 bp, D. melanogaster
cccttaatgattt

SEQ ID NO: 609765 - DNA, 14 bp, D. melanogaster
cccttaatgatttt

SEQ ID NO: 609766 - DNA, 13 bp, D. melanogaster
cccttcacacctt

SEQ ID NO: 609767 - DNA, 13 bp, D. melanogaster
cccttcactttgc

SEQ ID NO: 609768 - DNA, 13 bp, D. melanogaster
cccttctccaagc

SEQ ID NO: 609769 - DNA, 13 bp, D. melanogaster
cccttctggaaga

SEQ ID NO: 609770 - DNA, 13 bp, D. melanogaster
cccttgagatatt

SEQ ID NO: 609771 - DNA, 13 bp, D. melanogaster
cccttgcagttct

SEQ ID NO: 609772 - DNA, 14 bp, D. melanogaster
cccttgccacgccc

SEQ ID NO: 609773 - DNA, 13 bp, D. melanogaster
cccttgccctatt

SEQ ID NO: 609774 - DNA, 13 bp, D. melanogaster
cccttgcctttcg

SEQ ID NO: 609775 - DNA, 13 bp, D. melanogaster
cccttgctcgaag

SEQ ID NO: 609776 - DNA, 13 bp, D. melanogaster
cccttggtttggg

SEQ ID NO: 609777 - DNA, 13 bp, D. melanogaster
cccttgtcaaagg

SEQ ID NO: 609778 - DNA, 13 bp, D. melanogaster
ccctttaaaattt

SEQ ID NO: 609779 - DNA, 13 bp, D. melanogaster
ccctttcccaagc

SEQ ID NO: 609780 - DNA, 13 bp, D. melanogaster
ccctttgcaagca

SEQ ID NO: 609781 - DNA, 13 bp, D. melanogaster
ccctttgccatcc

SEQ ID NO: 609782 - DNA, 13 bp, D. melanogaster
ccctttgcgagca

SEQ ID NO: 609783 - DNA, 14 bp, D. melanogaster
ccctttgcgagcag

SEQ ID NO: 609784 - DNA, 14 bp, D. melanogaster
cccttttaaatata

SEQ ID NO: 609785 - DNA, 13 bp, D. melanogaster
cccttttaattaa

SEQ ID NO: 609786 - DNA, 13 bp, D. melanogaster
cccttttctttaa

SEQ ID NO: 609787 - DNA, 14 bp, D. melanogaster
cccttttctttaaa

SEQ ID NO: 609788 - DNA, 13 bp, D. melanogaster
cccttttgccatt

SEQ ID NO: 609789 - DNA, 13 bp, D. melanogaster
cccttttgccgcc

SEQ ID NO: 609790 - DNA, 13 bp, D. melanogaster
cccttttggccac

SEQ ID NO: 609791 - DNA, 13 bp, D. melanogaster
cccttttggccca

SEQ ID NO: 609792 - DNA, 13 bp, D. melanogaster
cccttttggcttt

SEQ ID NO: 609793 - DNA, 13 bp, D. melanogaster
ccctttttccaca

SEQ ID NO: 609794 - DNA, 13 bp, D. melanogaster
ccctttttgccac

SEQ ID NO: 609795 - DNA, 13 bp, D. melanogaster
ccctttttggcca

SEQ ID NO: 609796 - DNA, 14 bp, D. melanogaster
ccctttttggccaa

SEQ ID NO: 609797 - DNA, 13 bp, D. melanogaster
cccttttttggcc

SEQ ID NO: 609798 - DNA, 13 bp, D. melanogaster
ccgaaaaaaaagt

SEQ ID NO: 609799 - DNA, 13 bp, D. melanogaster
ccgaaaaaatgca

SEQ ID NO: 609800 - DNA, 13 bp, D. melanogaster
ccgaaaaacatat

SEQ ID NO: 609801 - DNA, 13 bp, D. melanogaster
ccgaaaaagcata

SEQ ID NO: 609802 - DNA, 13 bp, D. melanogaster
ccgaaaaaggcaa

SEQ ID NO: 609803 - DNA, 13 bp, D. melanogaster
ccgaaaaatatat

SEQ ID NO: 609804 - DNA, 13 bp, D. melanogaster
ccgaaaaatttag

SEQ ID NO: 609805 - DNA, 13 bp, D. melanogaster
ccgaaaaccgaaa

SEQ ID NO: 609806 - DNA, 13 bp, D. melanogaster
ccgaaaagcgaaa

SEQ ID NO: 609807 - DNA, 13 bp, D. melanogaster
ccgaaaagtatgc

SEQ ID NO: 609808 - DNA, 14 bp, D. melanogaster
ccgaaaagtatgca

SEQ ID NO: 609809 - DNA, 14 bp, D. melanogaster
ccgaaaataaagaa

SEQ ID NO: 609810 - DNA, 13 bp, D. melanogaster
ccgaaaataactt

SEQ ID NO: 609811 - DNA, 13 bp, D. melanogaster
ccgaaaataagaa

SEQ ID NO: 609812 - DNA, 13 bp, D. melanogaster
ccgaaaatcgtct

SEQ ID NO: 609813 - DNA, 13 bp, D. melanogaster
ccgaaaatgattt

SEQ ID NO: 609814 - DNA, 14 bp, D. melanogaster
ccgaaaatgcgaaa

SEQ ID NO: 609815 - DNA, 13 bp, D. melanogaster
ccgaaaattatgc

SEQ ID NO: 609816 - DNA, 13 bp, D. melanogaster
ccgaaaattttcg

SEQ ID NO: 609817 - DNA, 13 bp, D. melanogaster
ccgaaacaatttt

SEQ ID NO: 609818 - DNA, 13 bp, D. melanogaster
ccgaaacagaaac

SEQ ID NO: 609819 - DNA, 13 bp, D. melanogaster
ccgaaaccaaagc

SEQ ID NO: 609820 - DNA, 13 bp, D. melanogaster
ccgaaaccaaatc

SEQ ID NO: 609821 - DNA, 13 bp, D. melanogaster
ccgaaacccgaaa

SEQ ID NO: 609822 - DNA, 13 bp, D. melanogaster
ccgaaaccgaaaa

SEQ ID NO: 609823 - DNA, 14 bp, D. melanogaster
ccgaaaccgaaacc

SEQ ID NO: 609824 - DNA, 13 bp, D. melanogaster
ccgaaaccgaaat

SEQ ID NO: 609825 - DNA, 13 bp, D. melanogaster
ccgaaaccgaagc

SEQ ID NO: 609826 - DNA, 13 bp, D. melanogaster
ccgaaaccgaatc

SEQ ID NO: 609827 - DNA, 13 bp, D. melanogaster
ccgaaacgaaacg

SEQ ID NO: 609828 - DNA, 13 bp, D. melanogaster
ccgaaactgaaac

SEQ ID NO: 609829 - DNA, 13 bp, D. melanogaster
ccgaaactgaatc

SEQ ID NO: 609830 - DNA, 13 bp, D. melanogaster
ccgaaagaaacca

SEQ ID NO: 609831 - DNA, 13 bp, D. melanogaster
ccgaaagagagag

SEQ ID NO: 609832 - DNA, 13 bp, D. melanogaster
ccgaaagcagacg

SEQ ID NO: 609833 - DNA, 13 bp, D. melanogaster
ccgaaagccaaaa

SEQ ID NO: 609834 - DNA, 13 bp, D. melanogaster
ccgaaagccaaac

SEQ ID NO: 609835 - DNA, 13 bp, D. melanogaster
ccgaaaggaaaac

SEQ ID NO: 609836 - DNA, 14 bp, D. melanogaster
ccgaaagtgaagaa

SEQ ID NO: 609837 - DNA, 14 bp, D. melanogaster
ccgaaataaacaaa

SEQ ID NO: 609838 - DNA, 13 bp, D. melanogaster
ccgaaataaatgg

SEQ ID NO: 609839 - DNA, 13 bp, D. melanogaster
ccgaaatcagttt

SEQ ID NO: 609840 - DNA, 13 bp, D. melanogaster
ccgaaatcgaaac

SEQ ID NO: 609841 - DNA, 13 bp, D. melanogaster
ccgaaatgaaaaa

SEQ ID NO: 609842 - DNA, 13 bp, D. melanogaster
ccgaaatgaaatg

SEQ ID NO: 609843 - DNA, 13 bp, D. melanogaster
ccgaaatgcaaac

SEQ ID NO: 609844 - DNA, 13 bp, D. melanogaster
ccgaaatgcaaat

SEQ ID NO: 609845 - DNA, 13 bp, D. melanogaster
ccgaaatggaaat

SEQ ID NO: 609846 - DNA, 13 bp, D. melanogaster
ccgaaatggcaaa

SEQ ID NO: 609847 - DNA, 13 bp, D. melanogaster
ccgaaattgaaat

SEQ ID NO: 609848 - DNA, 13 bp, D. melanogaster
ccgaacagggacc

SEQ ID NO: 609849 - DNA, 13 bp, D. melanogaster
ccgaacccgaatc

SEQ ID NO: 609850 - DNA, 13 bp, D. melanogaster
ccgaaccgaaacc

SEQ ID NO: 609851 - DNA, 13 bp, D. melanogaster
ccgaaccgatccg

SEQ ID NO: 609852 - DNA, 13 bp, D. melanogaster
ccgaacgactgct

SEQ ID NO: 609853 - DNA, 13 bp, D. melanogaster
ccgaagagataac

SEQ ID NO: 609854 - DNA, 13 bp, D. melanogaster
ccgaagcaaaaac

SEQ ID NO: 609855 - DNA, 13 bp, D. melanogaster
ccgaagccaaagc

SEQ ID NO: 609856 - DNA, 13 bp, D. melanogaster
ccgaataccacaa

SEQ ID NO: 609857 - DNA, 13 bp, D. melanogaster
ccgaatatttaat

SEQ ID NO: 609858 - DNA, 14 bp, D. melanogaster
ccgaatatttaatt

SEQ ID NO: 609859 - DNA, 13 bp, D. melanogaster
ccgaatcaatacg

SEQ ID NO: 609860 - DNA, 13 bp, D. melanogaster
ccgaatcagaatc

SEQ ID NO: 609861 - DNA, 13 bp, D. melanogaster
ccgaatcccaatc

SEQ ID NO: 609862 - DNA, 14 bp, D. melanogaster
ccgaatcccaatcc

SEQ ID NO: 609863 - DNA, 13 bp, D. melanogaster
ccgaatccgaatc

SEQ ID NO: 609864 - DNA, 14 bp, D. melanogaster
ccgaatccgaatcc

SEQ ID NO: 609865 - DNA, 14 bp, D. melanogaster
ccgaatccgaatct

SEQ ID NO: 609866 - DNA, 13 bp, D. melanogaster
ccgaatcgaatcg

SEQ ID NO: 609867 - DNA, 13 bp, D. melanogaster
ccgaatgaatgaa

SEQ ID NO: 609868 - DNA, 13 bp, D. melanogaster
ccgaatgccaaaa

SEQ ID NO: 609869 - DNA, 14 bp, D. melanogaster
ccgaatgccgaatg

SEQ ID NO: 609870 - DNA, 13 bp, D. melanogaster
ccgaatggcacaa

SEQ ID NO: 609871 - DNA, 14 bp, D. melanogaster
ccgaattcaaagaa

SEQ ID NO: 609872 - DNA, 13 bp, D. melanogaster
ccgaattcgaatt

SEQ ID NO: 609873 - DNA, 13 bp, D. melanogaster
ccgacaaaacgaa

SEQ ID NO: 609874 - DNA, 13 bp, D. melanogaster
ccgacattgtggg

SEQ ID NO: 609875 - DNA, 13 bp, D. melanogaster
ccgaccaaataca

SEQ ID NO: 609876 - DNA, 13 bp, D. melanogaster
ccgaccgaccgac

SEQ ID NO: 609877 - DNA, 13 bp, D. melanogaster
ccgacgaagcctt

SEQ ID NO: 609878 - DNA, 13 bp, D. melanogaster
ccgacgacgacga

SEQ ID NO: 609879 - DNA, 14 bp, D. melanogaster
ccgacgacgacgac

SEQ ID NO: 609880 - DNA, 14 bp, D. melanogaster
ccgactacggaatg

SEQ ID NO: 609881 - DNA, 13 bp, D. melanogaster
ccgactccgaaaa

SEQ ID NO: 609882 - DNA, 13 bp, D. melanogaster
ccgactccgactc

SEQ ID NO: 609883 - DNA, 13 bp, D. melanogaster
ccgactgactgac

SEQ ID NO: 609884 - DNA, 14 bp, D. melanogaster
ccgactgcgctgcc

SEQ ID NO: 609885 - DNA, 13 bp, D. melanogaster
ccgactgtctgtc

SEQ ID NO: 609886 - DNA, 14 bp, D. melanogaster
ccgacttaatcaac

SEQ ID NO: 609887 - DNA, 13 bp, D. melanogaster
ccgacttttcccc

SEQ ID NO: 609888 - DNA, 13 bp, D. melanogaster
ccgagaaatcggc

SEQ ID NO: 609889 - DNA, 13 bp, D. melanogaster
ccgagcaaataaa

SEQ ID NO: 609890 - DNA, 13 bp, D. melanogaster
ccgagcaagatgt

SEQ ID NO: 609891 - DNA, 14 bp, D. melanogaster
ccgagcgcaaaagt

SEQ ID NO: 609892 - DNA, 13 bp, D. melanogaster
ccgagctgaacaa

SEQ ID NO: 609893 - DNA, 13 bp, D. melanogaster
ccgagctgagctg

SEQ ID NO: 609894 - DNA, 13 bp, D. melanogaster
ccgaggaaattac

SEQ ID NO: 609895 - DNA, 13 bp, D. melanogaster
ccgaggagtgggg

SEQ ID NO: 609896 - DNA, 13 bp, D. melanogaster
ccgagggccaagt

SEQ ID NO: 609897 - DNA, 13 bp, D. melanogaster
ccgagtccgaatc

SEQ ID NO: 609898 - DNA, 13 bp, D. melanogaster
ccgagtcgatcta

SEQ ID NO: 609899 - DNA, 13 bp, D. melanogaster
ccgagtcgatctg

SEQ ID NO: 609900 - DNA, 14 bp, D. melanogaster
ccgagtcgatctgg

SEQ ID NO: 609901 - DNA, 14 bp, D. melanogaster
ccgagtggctaaag

SEQ ID NO: 609902 - DNA, 13 bp, D. melanogaster
ccgataaaaaaga

SEQ ID NO: 609903 - DNA, 13 bp, D. melanogaster
ccgataccgatac

SEQ ID NO: 609904 - DNA, 13 bp, D. melanogaster
ccgatagcaaaaa

SEQ ID NO: 609905 - DNA, 13 bp, D. melanogaster
ccgatattggttc

SEQ ID NO: 609906 - DNA, 13 bp, D. melanogaster
ccgatcccaatcc

SEQ ID NO: 609907 - DNA, 14 bp, D. melanogaster
ccgatcccaatccc

SEQ ID NO: 609908 - DNA, 13 bp, D. melanogaster
ccgatccccgatc

SEQ ID NO: 609909 - DNA, 14 bp, D. melanogaster
ccgatccccgatcc

SEQ ID NO: 609910 - DNA, 13 bp, D. melanogaster
ccgatcccgatcc

SEQ ID NO: 609911 - DNA, 14 bp, D. melanogaster
ccgatcccgatccc

SEQ ID NO: 609912 - DNA, 14 bp, D. melanogaster
ccgatcccgattcc

SEQ ID NO: 609913 - DNA, 13 bp, D. melanogaster
ccgatccgaaccg

SEQ ID NO: 609914 - DNA, 13 bp, D. melanogaster
ccgatccgatcca

SEQ ID NO: 609915 - DNA, 14 bp, D. melanogaster
ccgatccgatccca

SEQ ID NO: 609916 - DNA, 13 bp, D. melanogaster
ccgatccgatgcg

SEQ ID NO: 609917 - DNA, 13 bp, D. melanogaster
ccgatctcagcca

SEQ ID NO: 609918 - DNA, 13 bp, D. melanogaster
ccgatctccgatc

SEQ ID NO: 609919 - DNA, 14 bp, D. melanogaster
ccgatctcctttga

SEQ ID NO: 609920 - DNA, 13 bp, D. melanogaster
ccgatcttcattt

SEQ ID NO: 609921 - DNA, 13 bp, D. melanogaster
ccgatgagaagaa

SEQ ID NO: 609922 - DNA, 14 bp, D. melanogaster
ccgatgatgatgat

SEQ ID NO: 609923 - DNA, 13 bp, D. melanogaster
ccgatgccgatgc

SEQ ID NO: 609924 - DNA, 13 bp, D. melanogaster
ccgatgttgctgc

SEQ ID NO: 609925 - DNA, 13 bp, D. melanogaster
ccgattcaatgcg

SEQ ID NO: 609926 - DNA, 13 bp, D. melanogaster
ccgattcagattc

SEQ ID NO: 609927 - DNA, 13 bp, D. melanogaster
ccgattccaattc

SEQ ID NO: 609928 - DNA, 14 bp, D. melanogaster
ccgattccaattcc

SEQ ID NO: 609929 - DNA, 14 bp, D. melanogaster
ccgattcccattcc

SEQ ID NO: 609930 - DNA, 13 bp, D. melanogaster
ccgattccccgat

SEQ ID NO: 609931 - DNA, 13 bp, D. melanogaster
ccgattccgaatc

SEQ ID NO: 609932 - DNA, 14 bp, D. melanogaster
ccgattccgaatcc

SEQ ID NO: 609933 - DNA, 13 bp, D. melanogaster
ccgattccgatcc

SEQ ID NO: 609934 - DNA, 14 bp, D. melanogaster
ccgattccgatccc

SEQ ID NO: 609935 - DNA, 14 bp, D. melanogaster
ccgattccgattcc

SEQ ID NO: 609936 - DNA, 13 bp, D. melanogaster
ccgattcggattc

SEQ ID NO: 609937 - DNA, 13 bp, D. melanogaster
ccgatttaaccaa

SEQ ID NO: 609938 - DNA, 13 bp, D. melanogaster
ccgatttccaagc

SEQ ID NO: 609939 - DNA, 13 bp, D. melanogaster
ccgatttcggaag

SEQ ID NO: 609940 - DNA, 13 bp, D. melanogaster
ccgatttcggtag

SEQ ID NO: 609941 - DNA, 14 bp, D. melanogaster
ccgatttctgtggc

SEQ ID NO: 609942 - DNA, 13 bp, D. melanogaster
ccgatttgggttt

SEQ ID NO: 609943 - DNA, 13 bp, D. melanogaster
ccgattttccacc

SEQ ID NO: 609944 - DNA, 13 bp, D. melanogaster
ccgattttcccgc

SEQ ID NO: 609945 - DNA, 14 bp, D. melanogaster
ccgatttttaaaca

SEQ ID NO: 609946 - DNA, 13 bp, D. melanogaster
ccgatttttcaac

SEQ ID NO: 609947 - DNA, 13 bp, D. melanogaster
ccgcaaaatgtca

SEQ ID NO: 609948 - DNA, 13 bp, D. melanogaster
ccgcaaaatgtgt

SEQ ID NO: 609949 - DNA, 13 bp, D. melanogaster
ccgcaaatccgtg

SEQ ID NO: 609950 - DNA, 13 bp, D. melanogaster
ccgcaaatggaaa

SEQ ID NO: 609951 - DNA, 13 bp, D. melanogaster
ccgcaaatgtttt

SEQ ID NO: 609952 - DNA, 13 bp, D. melanogaster
ccgcaaattaatt

SEQ ID NO: 609953 - DNA, 13 bp, D. melanogaster
ccgcaaattgttg

SEQ ID NO: 609954 - DNA, 13 bp, D. melanogaster
ccgcaacagcaat

SEQ ID NO: 609955 - DNA, 14 bp, D. melanogaster
ccgcaacagcaatt

SEQ ID NO: 609956 - DNA, 14 bp, D. melanogaster
ccgcaacagcagca

SEQ ID NO: 609957 - DNA, 14 bp, D. melanogaster
ccgcaaggcaaaaa

SEQ ID NO: 609958 - DNA, 13 bp, D. melanogaster
ccgcaaggcagtg

SEQ ID NO: 609959 - DNA, 13 bp, D. melanogaster
ccgcaatgcaaat

SEQ ID NO: 609960 - DNA, 13 bp, D. melanogaster
ccgcaatggaatg

SEQ ID NO: 609961 - DNA, 13 bp, D. melanogaster
ccgcaattaaatc

SEQ ID NO: 609962 - DNA, 13 bp, D. melanogaster
ccgcaattaatta

SEQ ID NO: 609963 - DNA, 13 bp, D. melanogaster
ccgcaatttcttt

SEQ ID NO: 609964 - DNA, 13 bp, D. melanogaster
ccgcacaaacgca

SEQ ID NO: 609965 - DNA, 13 bp, D. melanogaster
ccgcacacaaaat

SEQ ID NO: 609966 - DNA, 13 bp, D. melanogaster
ccgcacacacacg

SEQ ID NO: 609967 - DNA, 13 bp, D. melanogaster
ccgcacacacatg

SEQ ID NO: 609968 - DNA, 13 bp, D. melanogaster
ccgcacacacgca

SEQ ID NO: 609969 - DNA, 13 bp, D. melanogaster
ccgcacacagata

SEQ ID NO: 609970 - DNA, 13 bp, D. melanogaster
ccgcacagtggga

SEQ ID NO: 609971 - DNA, 13 bp, D. melanogaster
ccgcacagtgggc

SEQ ID NO: 609972 - DNA, 13 bp, D. melanogaster
ccgcactcacaca

SEQ ID NO: 609973 - DNA, 13 bp, D. melanogaster
ccgcagaaaaacg

SEQ ID NO: 609974 - DNA, 14 bp, D. melanogaster
ccgcagatacagat

SEQ ID NO: 609975 - DNA, 13 bp, D. melanogaster
ccgcagcaacaac

SEQ ID NO: 609976 - DNA, 14 bp, D. melanogaster
ccgcagcaacaaca

SEQ ID NO: 609977 - DNA, 13 bp, D. melanogaster
ccgcagcagcaac

SEQ ID NO: 609978 - DNA, 13 bp, D. melanogaster
ccgcagcagcaat

SEQ ID NO: 609979 - DNA, 15 bp, D. melanogaster
ccgcagcagcagcaa

SEQ ID NO: 609980 - DNA, 13 bp, D. melanogaster
ccgcagcagccgc

SEQ ID NO: 609981 - DNA, 13 bp, D. melanogaster
ccgcagccaaaaa

SEQ ID NO: 609982 - DNA, 15 bp, D. melanogaster
ccgcagccgacaagg

SEQ ID NO: 609983 - DNA, 13 bp, D. melanogaster
ccgcaggacgaag

SEQ ID NO: 609984 - DNA, 13 bp, D. melanogaster
ccgcaggagcagc

SEQ ID NO: 609985 - DNA, 13 bp, D. melanogaster
ccgcatacaccaa

SEQ ID NO: 609986 - DNA, 13 bp, D. melanogaster
ccgcatcagcatc

SEQ ID NO: 609987 - DNA, 14 bp, D. melanogaster
ccgcatccacatcc

SEQ ID NO: 609988 - DNA, 13 bp, D. melanogaster
ccgcatccccatc

SEQ ID NO: 609989 - DNA, 14 bp, D. melanogaster
ccgcatccccatcc

SEQ ID NO: 609990 - DNA, 13 bp, D. melanogaster
ccgcatccgaatc

SEQ ID NO: 609991 - DNA, 14 bp, D. melanogaster
ccgcatccgaatcc

SEQ ID NO: 609992 - DNA, 13 bp, D. melanogaster
ccgcatccgtatc

SEQ ID NO: 609993 - DNA, 14 bp, D. melanogaster
ccgcatcctcatcc

SEQ ID NO: 609994 - DNA, 14 bp, D. melanogaster
ccgcatgtacagca

SEQ ID NO: 609995 - DNA, 13 bp, D. melanogaster
ccgcattgaatcg

SEQ ID NO: 609996 - DNA, 13 bp, D. melanogaster
ccgcattgtgaac

SEQ ID NO: 609997 - DNA, 13 bp, D. melanogaster
ccgcattttccgc

SEQ ID NO: 609998 - DNA, 13 bp, D. melanogaster
ccgccacacaact

SEQ ID NO: 609999 - DNA, 13 bp, D. melanogaster
ccgccacccactt

SEQ ID NO: 610000 - DNA, 13 bp, D. melanogaster
ccgccaggtggcg

SEQ ID NO: 610001 - DNA, 14 bp, D. melanogaster
ccgccatcagcaac

SEQ ID NO: 610002 - DNA, 13 bp, D. melanogaster
ccgccatcatcat

SEQ ID NO: 610003 - DNA, 14 bp, D. melanogaster
ccgccatcatcatc

SEQ ID NO: 610004 - DNA, 13 bp, D. melanogaster
ccgccatccgcca

SEQ ID NO: 610005 - DNA, 13 bp, D. melanogaster
ccgcccaaaactg

SEQ ID NO: 610006 - DNA, 13 bp, D. melanogaster
ccgcccactgcca

SEQ ID NO: 610007 - DNA, 13 bp, D. melanogaster
ccgcccacttggc

SEQ ID NO: 610008 - DNA, 13 bp, D. melanogaster
ccgcccactttgc

SEQ ID NO: 610009 - DNA, 13 bp, D. melanogaster
ccgcccactttgg

SEQ ID NO: 610010 - DNA, 14 bp, D. melanogaster
ccgcccacttttcc

SEQ ID NO: 610011 - DNA, 13 bp, D. melanogaster
ccgcccattttcc

SEQ ID NO: 610012 - DNA, 13 bp, D. melanogaster
ccgcccccttttg

SEQ ID NO: 610013 - DNA, 13 bp, D. melanogaster
ccgcccctgtttt

SEQ ID NO: 610014 - DNA, 13 bp, D. melanogaster
ccgccgaagcact

SEQ ID NO: 610015 - DNA, 13 bp, D. melanogaster
ccgccgcttttcc

SEQ ID NO: 610016 - DNA, 13 bp, D. melanogaster
ccgccgtcaccca

SEQ ID NO: 610017 - DNA, 13 bp, D. melanogaster
ccgccgtcgacag

SEQ ID NO: 610018 - DNA, 14 bp, D. melanogaster
ccgccgtcgacagc

SEQ ID NO: 610019 - DNA, 13 bp, D. melanogaster
ccgccgtctatgt

SEQ ID NO: 610020 - DNA, 13 bp, D. melanogaster
ccgcctcgttggc

SEQ ID NO: 610021 - DNA, 13 bp, D. melanogaster
ccgcctgaggaag

SEQ ID NO: 610022 - DNA, 14 bp, D. melanogaster
ccgccttatcgagg

SEQ ID NO: 610023 - DNA, 13 bp, D. melanogaster
ccgcgagaagagc

SEQ ID NO: 610024 - DNA, 13 bp, D. melanogaster
ccgcgtttgccca

SEQ ID NO: 610025 - DNA, 13 bp, D. melanogaster
ccgctaagttctc

SEQ ID NO: 610026 - DNA, 14 bp, D. melanogaster
ccgctcacacacac

SEQ ID NO: 610027 - DNA, 13 bp, D. melanogaster
ccgctcacacagt

SEQ ID NO: 610028 - DNA, 13 bp, D. melanogaster
ccgctccacatgc

SEQ ID NO: 610029 - DNA, 13 bp, D. melanogaster
ccgctccgctgct

SEQ ID NO: 610030 - DNA, 13 bp, D. melanogaster
ccgctctattggc

SEQ ID NO: 610031 - DNA, 13 bp, D. melanogaster
ccgctgatgctgc

SEQ ID NO: 610032 - DNA, 13 bp, D. melanogaster
ccgctgccactgc

SEQ ID NO: 610033 - DNA, 14 bp, D. melanogaster
ccgctgccatcaac

SEQ ID NO: 610034 - DNA, 13 bp, D. melanogaster
ccgctgccgttgc

SEQ ID NO: 610035 - DNA, 14 bp, D. melanogaster
ccgctgctcctggc

SEQ ID NO: 610036 - DNA, 13 bp, D. melanogaster
ccgctgctctctc

SEQ ID NO: 610037 - DNA, 13 bp, D. melanogaster
ccgctgctgctga

SEQ ID NO: 610038 - DNA, 13 bp, D. melanogaster
ccgctgctgcttc

SEQ ID NO: 610039 - DNA, 13 bp, D. melanogaster
ccgctgctggcgt

SEQ ID NO: 610040 - DNA, 14 bp, D. melanogaster
ccgctgctgttgtt

SEQ ID NO: 610041 - DNA, 13 bp, D. melanogaster
ccgctggcaaatg

SEQ ID NO: 610042 - DNA, 13 bp, D. melanogaster
ccgctggccaaat

SEQ ID NO: 610043 - DNA, 13 bp, D. melanogaster
ccgctggccatat

SEQ ID NO: 610044 - DNA, 13 bp, D. melanogaster
ccgctggccatgt

SEQ ID NO: 610045 - DNA, 13 bp, D. melanogaster
ccgctggctttga

SEQ ID NO: 610046 - DNA, 14 bp, D. melanogaster
ccgctgtcaaagaa

SEQ ID NO: 610047 - DNA, 14 bp, D. melanogaster
ccgctgtcgacggc

SEQ ID NO: 610048 - DNA, 13 bp, D. melanogaster
ccgctgtgtgtgt

SEQ ID NO: 610049 - DNA, 13 bp, D. melanogaster
ccgcttgaagaac

SEQ ID NO: 610050 - DNA, 13 bp, D. melanogaster
ccgctttcaaata

SEQ ID NO: 610051 - DNA, 13 bp, D. melanogaster
ccgctttcccagc

SEQ ID NO: 610052 - DNA, 13 bp, D. melanogaster
ccgctttcccgct

SEQ ID NO: 610053 - DNA, 13 bp, D. melanogaster
ccgctttgtgctt

SEQ ID NO: 610054 - DNA, 13 bp, D. melanogaster
ccgctttgtttgc

SEQ ID NO: 610055 - DNA, 13 bp, D. melanogaster
ccgcttttccagc

SEQ ID NO: 610056 - DNA, 14 bp, D. melanogaster
ccgcttttccagct

SEQ ID NO: 610057 - DNA, 13 bp, D. melanogaster
ccgcttttcccac

SEQ ID NO: 610058 - DNA, 13 bp, D. melanogaster
ccgcttttcccgc

SEQ ID NO: 610059 - DNA, 13 bp, D. melanogaster
ccgcttttccgac

SEQ ID NO: 610060 - DNA, 13 bp, D. melanogaster
ccgcttttccgct

SEQ ID NO: 610061 - DNA, 13 bp, D. melanogaster
ccgcttttccggc

SEQ ID NO: 610062 - DNA, 13 bp, D. melanogaster
ccgcttttccgtt

SEQ ID NO: 610063 - DNA, 13 bp, D. melanogaster
ccgcttttgcttt

SEQ ID NO: 610064 - DNA, 14 bp, D. melanogaster
ccgcttttgttgtt

SEQ ID NO: 610065 - DNA, 13 bp, D. melanogaster
ccgctttttgtgg

SEQ ID NO: 610066 - DNA, 13 bp, D. melanogaster
ccggaaaagccaa

SEQ ID NO: 610067 - DNA, 13 bp, D. melanogaster
ccggaaaattcag

SEQ ID NO: 610068 - DNA, 13 bp, D. melanogaster
ccggaaacggaaa

SEQ ID NO: 610069 - DNA, 13 bp, D. melanogaster
ccggaagaggaaa

SEQ ID NO: 610070 - DNA, 14 bp, D. melanogaster
ccggaagcagccat

SEQ ID NO: 610071 - DNA, 13 bp, D. melanogaster
ccggaatcggaat

SEQ ID NO: 610072 - DNA, 13 bp, D. melanogaster
ccggaattccaaa

SEQ ID NO: 610073 - DNA, 13 bp, D. melanogaster
ccggacattgccg

SEQ ID NO: 610074 - DNA, 13 bp, D. melanogaster
ccggagacgggaa

SEQ ID NO: 610075 - DNA, 13 bp, D. melanogaster
ccggagcaaacgg

SEQ ID NO: 610076 - DNA, 13 bp, D. melanogaster
ccggagccggatt

SEQ ID NO: 610077 - DNA, 13 bp, D. melanogaster
ccggatcttatta

SEQ ID NO: 610078 - DNA, 13 bp, D. melanogaster
ccggatgcggtgt

SEQ ID NO: 610079 - DNA, 13 bp, D. melanogaster
ccggattcccgcc

SEQ ID NO: 610080 - DNA, 13 bp, D. melanogaster
ccggattccggat

SEQ ID NO: 610081 - DNA, 13 bp, D. melanogaster
ccggcaaaaagtt

SEQ ID NO: 610082 - DNA, 13 bp, D. melanogaster
ccggcaacatgga

SEQ ID NO: 610083 - DNA, 13 bp, D. melanogaster
ccggcaattcaaa

SEQ ID NO: 610084 - DNA, 14 bp, D. melanogaster
ccggcacacacaca

SEQ ID NO: 610085 - DNA, 13 bp, D. melanogaster
ccggcaccaagga

SEQ ID NO: 610086 - DNA, 13 bp, D. melanogaster
ccggcagcagcaa

SEQ ID NO: 610087 - DNA, 13 bp, D. melanogaster
ccggcagcagcag

SEQ ID NO: 610088 - DNA, 13 bp, D. melanogaster
ccggcagcccgct

SEQ ID NO: 610089 - DNA, 13 bp, D. melanogaster
ccggcagcgcagc

SEQ ID NO: 610090 - DNA, 14 bp, D. melanogaster
ccggcagcgcagct

SEQ ID NO: 610091 - DNA, 13 bp, D. melanogaster
ccggcaggacctc

SEQ ID NO: 610092 - DNA, 13 bp, D. melanogaster
ccggccaaaaatc

SEQ ID NO: 610093 - DNA, 13 bp, D. melanogaster
ccggccaaatgct

SEQ ID NO: 610094 - DNA, 13 bp, D. melanogaster
ccggccaggaaac

SEQ ID NO: 610095 - DNA, 14 bp, D. melanogaster
ccggctgcaccgca

SEQ ID NO: 610096 - DNA, 13 bp, D. melanogaster
ccggctttgactg

SEQ ID NO: 610097 - DNA, 13 bp, D. melanogaster
ccgggaaatgagc

SEQ ID NO: 610098 - DNA, 14 bp, D. melanogaster
ccgggactgccagt

SEQ ID NO: 610099 - DNA, 13 bp, D. melanogaster
ccgggcaaacaaa

SEQ ID NO: 610100 - DNA, 13 bp, D. melanogaster
ccgggccataaat

SEQ ID NO: 610101 - DNA, 13 bp, D. melanogaster
ccgggtccgggtc

SEQ ID NO: 610102 - DNA, 13 bp, D. melanogaster
ccggtaaccacct

SEQ ID NO: 610103 - DNA, 13 bp, D. melanogaster
ccggtcacgccca

SEQ ID NO: 610104 - DNA, 14 bp, D. melanogaster
ccggtcacgcccac

SEQ ID NO: 610105 - DNA, 13 bp, D. melanogaster
ccggtggaaatgg

SEQ ID NO: 610106 - DNA, 13 bp, D. melanogaster
ccggtggctggag

SEQ ID NO: 610107 - DNA, 14 bp, D. melanogaster
ccgtaaaactaaaa

SEQ ID NO: 610108 - DNA, 13 bp, D. melanogaster
ccgtaaatgcccc

SEQ ID NO: 610109 - DNA, 13 bp, D. melanogaster
ccgtatccgaatc

SEQ ID NO: 610110 - DNA, 13 bp, D. melanogaster
ccgtatctgtatc

SEQ ID NO: 610111 - DNA, 13 bp, D. melanogaster
ccgtatgaacgtt

SEQ ID NO: 610112 - DNA, 13 bp, D. melanogaster
ccgtcaaaaagtg

SEQ ID NO: 610113 - DNA, 14 bp, D. melanogaster
ccgtcatcatcatc

SEQ ID NO: 610114 - DNA, 13 bp, D. melanogaster
ccgtccatctgtc

SEQ ID NO: 610115 - DNA, 14 bp, D. melanogaster
ccgtccgtaggtgg

SEQ ID NO: 610116 - DNA, 13 bp, D. melanogaster
ccgtccgtccgta

SEQ ID NO: 610117 - DNA, 13 bp, D. melanogaster
ccgtcgacatttc

SEQ ID NO: 610118 - DNA, 13 bp, D. melanogaster
ccgtcgatgttta

SEQ ID NO: 610119 - DNA, 13 bp, D. melanogaster
ccgtctccggcga

SEQ ID NO: 610120 - DNA, 13 bp, D. melanogaster
ccgtctcgctcgc

SEQ ID NO: 610121 - DNA, 13 bp, D. melanogaster
ccgtctctgtcgc

SEQ ID NO: 610122 - DNA, 13 bp, D. melanogaster
ccgtctctgtctc

SEQ ID NO: 610123 - DNA, 13 bp, D. melanogaster
ccgtctctttcgc

SEQ ID NO: 610124 - DNA, 13 bp, D. melanogaster
ccgtctcttttgc

SEQ ID NO: 610125 - DNA, 13 bp, D. melanogaster
ccgtctgtccgta

SEQ ID NO: 610126 - DNA, 13 bp, D. melanogaster
ccgtctgtccgtc

SEQ ID NO: 610127 - DNA, 13 bp, D. melanogaster
ccgtctgtctgcc

SEQ ID NO: 610128 - DNA, 13 bp, D. melanogaster
ccgtgaatctgaa

SEQ ID NO: 610129 - DNA, 13 bp, D. melanogaster
ccgtgatcgaggg

SEQ ID NO: 610130 - DNA, 13 bp, D. melanogaster
ccgtgattaatat

SEQ ID NO: 610131 - DNA, 13 bp, D. melanogaster
ccgtgcccagtgc

SEQ ID NO: 610132 - DNA, 14 bp, D. melanogaster
ccgtgcccagtgcc

SEQ ID NO: 610133 - DNA, 13 bp, D. melanogaster
ccgtgctgaattt

SEQ ID NO: 610134 - DNA, 13 bp, D. melanogaster
ccgtggagacggc

SEQ ID NO: 610135 - DNA, 13 bp, D. melanogaster
ccgtggagtatgg

SEQ ID NO: 610136 - DNA, 13 bp, D. melanogaster
ccgtggagtggga

SEQ ID NO: 610137 - DNA, 13 bp, D. melanogaster
ccgtgggaattaa

SEQ ID NO: 610138 - DNA, 13 bp, D. melanogaster
ccgtggtaaacaa

SEQ ID NO: 610139 - DNA, 13 bp, D. melanogaster
ccgtgtccgtgtc

SEQ ID NO: 610140 - DNA, 14 bp, D. melanogaster
ccgtgtccgtgtcc

SEQ ID NO: 610141 - DNA, 13 bp, D. melanogaster
ccgtgtgcgtgtg

SEQ ID NO: 610142 - DNA, 13 bp, D. melanogaster
ccgtgtgtgagtg

SEQ ID NO: 610143 - DNA, 13 bp, D. melanogaster
ccgttaatcaaac

SEQ ID NO: 610144 - DNA, 13 bp, D. melanogaster
ccgttcccatttc

SEQ ID NO: 610145 - DNA, 13 bp, D. melanogaster
ccgttcgccattc

SEQ ID NO: 610146 - DNA, 13 bp, D. melanogaster
ccgttcgttggcg

SEQ ID NO: 610147 - DNA, 13 bp, D. melanogaster
ccgttctgctgga

SEQ ID NO: 610148 - DNA, 13 bp, D. melanogaster
ccgttctgttctg

SEQ ID NO: 610149 - DNA, 13 bp, D. melanogaster
ccgttgacccctc

SEQ ID NO: 610150 - DNA, 14 bp, D. melanogaster
ccgttgccgttgcc

SEQ ID NO: 610151 - DNA, 13 bp, D. melanogaster
ccgttgtaatggc

SEQ ID NO: 610152 - DNA, 13 bp, D. melanogaster
ccgttgttgttgt

SEQ ID NO: 610153 - DNA, 13 bp, D. melanogaster
ccgtttcccattt

SEQ ID NO: 610154 - DNA, 13 bp, D. melanogaster
ccgtttccgttcc

SEQ ID NO: 610155 - DNA, 13 bp, D. melanogaster
ccgtttccgtttc

SEQ ID NO: 610156 - DNA, 13 bp, D. melanogaster
ccgtttccgtttt

SEQ ID NO: 610157 - DNA, 13 bp, D. melanogaster
ccgtttgccattc

SEQ ID NO: 610158 - DNA, 13 bp, D. melanogaster
ccgtttgccattt

SEQ ID NO: 610159 - DNA, 13 bp, D. melanogaster
ccgtttgcctttt

SEQ ID NO: 610160 - DNA, 13 bp, D. melanogaster
ccgtttgctgaaa

SEQ ID NO: 610161 - DNA, 13 bp, D. melanogaster
ccgtttggccaat

SEQ ID NO: 610162 - DNA, 13 bp, D. melanogaster
ccgtttggcctca

SEQ ID NO: 610163 - DNA, 13 bp, D. melanogaster
ccgtttgtaaata

SEQ ID NO: 610164 - DNA, 14 bp, D. melanogaster
ccgtttgtaaatat

SEQ ID NO: 610165 - DNA, 13 bp, D. melanogaster
ccgttttccattc

SEQ ID NO: 610166 - DNA, 13 bp, D. melanogaster
ccgttttccattt

SEQ ID NO: 610167 - DNA, 13 bp, D. melanogaster
ccgttttgcattt

SEQ ID NO: 610168 - DNA, 13 bp, D. melanogaster
ccgttttgccgat

SEQ ID NO: 610169 - DNA, 13 bp, D. melanogaster
ccgtttttccgaa

SEQ ID NO: 610170 - DNA, 13 bp, D. melanogaster
ccgttttttgctg

SEQ ID NO: 610171 - DNA, 13 bp, D. melanogaster
cctaaaaaatatt

SEQ ID NO: 610172 - DNA, 13 bp, D. melanogaster
cctaaaagtatgc

SEQ ID NO: 610173 - DNA, 13 bp, D. melanogaster
cctaaaatccgga

SEQ ID NO: 610174 - DNA, 13 bp, D. melanogaster
cctaaacatattt

SEQ ID NO: 610175 - DNA, 13 bp, D. melanogaster
cctaaacttaaaa

SEQ ID NO: 610176 - DNA, 13 bp, D. melanogaster
cctaaagaaataa

SEQ ID NO: 610177 - DNA, 14 bp, D. melanogaster
cctaaagccgccaa

SEQ ID NO: 610178 - DNA, 13 bp, D. melanogaster
cctaaaggccatc

SEQ ID NO: 610179 - DNA, 13 bp, D. melanogaster
cctaaagtacctg

SEQ ID NO: 610180 - DNA, 13 bp, D. melanogaster
cctaaagttttaa

SEQ ID NO: 610181 - DNA, 14 bp, D. melanogaster
cctaaatgaaataa

SEQ ID NO: 610182 - DNA, 14 bp, D. melanogaster
cctaaatgaggaaa

SEQ ID NO: 610183 - DNA, 13 bp, D. melanogaster
cctaagtcttttg

SEQ ID NO: 610184 - DNA, 15 bp, D. melanogaster
cctaagtttgtgttt

SEQ ID NO: 610185 - DNA, 13 bp, D. melanogaster
cctaataaacaat

SEQ ID NO: 610186 - DNA, 13 bp, D. melanogaster
cctaatactaaat

SEQ ID NO: 610187 - DNA, 13 bp, D. melanogaster
cctaatcctaccc

SEQ ID NO: 610188 - DNA, 13 bp, D. melanogaster
cctaatcctctcc

SEQ ID NO: 610189 - DNA, 13 bp, D. melanogaster
cctaattaatccc

SEQ ID NO: 610190 - DNA, 13 bp, D. melanogaster
cctaattattgca

SEQ ID NO: 610191 - DNA, 13 bp, D. melanogaster
cctaattccaata

SEQ ID NO: 610192 - DNA, 14 bp, D. melanogaster
cctaatttaaatta

SEQ ID NO: 610193 - DNA, 13 bp, D. melanogaster
cctaatttatgca

SEQ ID NO: 610194 - DNA, 13 bp, D. melanogaster
cctaatttgtttt

SEQ ID NO: 610195 - DNA, 13 bp, D. melanogaster
cctacaaatcggc

SEQ ID NO: 610196 - DNA, 13 bp, D. melanogaster
cctacagcatgaa

SEQ ID NO: 610197 - DNA, 13 bp, D. melanogaster
cctacatatgtat

SEQ ID NO: 610198 - DNA, 13 bp, D. melanogaster
cctacccttaaag

SEQ ID NO: 610199 - DNA, 13 bp, D. melanogaster
cctaccggctgcg

SEQ ID NO: 610200 - DNA, 14 bp, D. melanogaster
cctacctacctacc

SEQ ID NO: 610201 - DNA, 13 bp, D. melanogaster
cctacctctttgg

SEQ ID NO: 610202 - DNA, 13 bp, D. melanogaster
cctactactacta

SEQ ID NO: 610203 - DNA, 13 bp, D. melanogaster
cctactgcatact

SEQ ID NO: 610204 - DNA, 13 bp, D. melanogaster
cctacttcctcag

SEQ ID NO: 610205 - DNA, 13 bp, D. melanogaster
cctacttctcagc

SEQ ID NO: 610206 - DNA, 13 bp, D. melanogaster
cctactttcactt

SEQ ID NO: 610207 - DNA, 13 bp, D. melanogaster
cctagaataacaa

SEQ ID NO: 610208 - DNA, 13 bp, D. melanogaster
cctagatgatata

SEQ ID NO: 610209 - DNA, 14 bp, D. melanogaster
cctagcttccttgc

SEQ ID NO: 610210 - DNA, 14 bp, D. melanogaster
cctataaatattta

SEQ ID NO: 610211 - DNA, 13 bp, D. melanogaster
cctataactatgc

SEQ ID NO: 610212 - DNA, 13 bp, D. melanogaster
cctataatattta

SEQ ID NO: 610213 - DNA, 13 bp, D. melanogaster
cctatagactgta

SEQ ID NO: 610214 - DNA, 14 bp, D. melanogaster
cctatatatataca

SEQ ID NO: 610215 - DNA, 13 bp, D. melanogaster
cctatcattttta

SEQ ID NO: 610216 - DNA, 14 bp, D. melanogaster
cctatccaaatttc

SEQ ID NO: 610217 - DNA, 13 bp, D. melanogaster
cctatccctatcc

SEQ ID NO: 610218 - DNA, 13 bp, D. melanogaster
cctatctggactt

SEQ ID NO: 610219 - DNA, 13 bp, D. melanogaster
cctatctttatgg

SEQ ID NO: 610220 - DNA, 13 bp, D. melanogaster
cctatgtaaaatt

SEQ ID NO: 610221 - DNA, 13 bp, D. melanogaster
cctatgtatatgt

SEQ ID NO: 610222 - DNA, 13 bp, D. melanogaster
cctattatacatt

SEQ ID NO: 610223 - DNA, 13 bp, D. melanogaster
cctattcccattc

SEQ ID NO: 610224 - DNA, 13 bp, D. melanogaster
cctattgattttt

SEQ ID NO: 610225 - DNA, 13 bp, D. melanogaster
cctatttaaaaaa

SEQ ID NO: 610226 - DNA, 13 bp, D. melanogaster
cctatttgcatat

SEQ ID NO: 610227 - DNA, 14 bp, D. melanogaster
cctattttttgtgc

SEQ ID NO: 610228 - DNA, 13 bp, D. melanogaster
cctcaaaagtcat

SEQ ID NO: 610229 - DNA, 13 bp, D. melanogaster
cctcaaactaaac

SEQ ID NO: 610230 - DNA, 13 bp, D. melanogaster
cctcaactgcaat

SEQ ID NO: 610231 - DNA, 13 bp, D. melanogaster
cctcacatcctgc

SEQ ID NO: 610232 - DNA, 13 bp, D. melanogaster
cctcaccgatctc

SEQ ID NO: 610233 - DNA, 14 bp, D. melanogaster
cctcatcatcatca

SEQ ID NO: 610234 - DNA, 13 bp, D. melanogaster
cctcatcatcgtc

SEQ ID NO: 610235 - DNA, 13 bp, D. melanogaster
cctcatccacatc

SEQ ID NO: 610236 - DNA, 14 bp, D. melanogaster
cctcatcgacattg

SEQ ID NO: 610237 - DNA, 13 bp, D. melanogaster
cctcatctataca

SEQ ID NO: 610238 - DNA, 13 bp, D. melanogaster
cctcatctgcatc

SEQ ID NO: 610239 - DNA, 13 bp, D. melanogaster
cctcattttctca

SEQ ID NO: 610240 - DNA, 13 bp, D. melanogaster
cctcattttgtgc

SEQ ID NO: 610241 - DNA, 13 bp, D. melanogaster
cctccacagtggt

SEQ ID NO: 610242 - DNA, 13 bp, D. melanogaster
cctccaccaattt

SEQ ID NO: 610243 - DNA, 13 bp, D. melanogaster
cctccagctcctc

SEQ ID NO: 610244 - DNA, 14 bp, D. melanogaster
cctccagctcctcc

SEQ ID NO: 610245 - DNA, 13 bp, D. melanogaster
cctccagtttttg

SEQ ID NO: 610246 - DNA, 13 bp, D. melanogaster
cctccattttccg

SEQ ID NO: 610247 - DNA, 13 bp, D. melanogaster
cctcccagcccag

SEQ ID NO: 610248 - DNA, 14 bp, D. melanogaster
cctccccttaataa

SEQ ID NO: 610249 - DNA, 13 bp, D. melanogaster
cctcccgcttgcg

SEQ ID NO: 610250 - DNA, 13 bp, D. melanogaster
cctccgaaaaagc

SEQ ID NO: 610251 - DNA, 13 bp, D. melanogaster
cctccgattttcc

SEQ ID NO: 610252 - DNA, 13 bp, D. melanogaster
cctccgcccactt

SEQ ID NO: 610253 - DNA, 13 bp, D. melanogaster
cctccgttttcgt

SEQ ID NO: 610254 - DNA, 13 bp, D. melanogaster
cctcctgctccac

SEQ ID NO: 610255 - DNA, 13 bp, D. melanogaster
cctccttttggcc

SEQ ID NO: 610256 - DNA, 13 bp, D. melanogaster
cctcgaaatgggg

SEQ ID NO: 610257 - DNA, 13 bp, D. melanogaster
cctcgactatcag

SEQ ID NO: 610258 - DNA, 13 bp, D. melanogaster
cctcgccaacgaa

SEQ ID NO: 610259 - DNA, 13 bp, D. melanogaster
cctcgctgcagtc

SEQ ID NO: 610260 - DNA, 13 bp, D. melanogaster
cctcgctgctgtc

SEQ ID NO: 610261 - DNA, 13 bp, D. melanogaster
cctcggcagcagt

SEQ ID NO: 610262 - DNA, 13 bp, D. melanogaster
cctcggctactga

SEQ ID NO: 610263 - DNA, 13 bp, D. melanogaster
cctcgtcatcggc

SEQ ID NO: 610264 - DNA, 14 bp, D. melanogaster
cctcgtggatgtgg

SEQ ID NO: 610265 - DNA, 13 bp, D. melanogaster
cctcgttgaactc

SEQ ID NO: 610266 - DNA, 14 bp, D. melanogaster
cctcgttgagtttg

SEQ ID NO: 610267 - DNA, 13 bp, D. melanogaster
cctctaatttatt

SEQ ID NO: 610268 - DNA, 13 bp, D. melanogaster
cctctaccagcag

SEQ ID NO: 610269 - DNA, 13 bp, D. melanogaster
cctctattattat

SEQ ID NO: 610270 - DNA, 13 bp, D. melanogaster
cctctcactaatc

SEQ ID NO: 610271 - DNA, 13 bp, D. melanogaster
cctctcattctgt

SEQ ID NO: 610272 - DNA, 13 bp, D. melanogaster
cctctccgtttgc

SEQ ID NO: 610273 - DNA, 13 bp, D. melanogaster
cctctcgcagcgc

SEQ ID NO: 610274 - DNA, 13 bp, D. melanogaster
cctctcgctcact

SEQ ID NO: 610275 - DNA, 14 bp, D. melanogaster
cctctcgctcgcac

SEQ ID NO: 610276 - DNA, 13 bp, D. melanogaster
cctctcgctcgct

SEQ ID NO: 610277 - DNA, 13 bp, D. melanogaster
cctctcgctctca

SEQ ID NO: 610278 - DNA, 13 bp, D. melanogaster
cctctcgctctgc

SEQ ID NO: 610279 - DNA, 14 bp, D. melanogaster
cctctctgtcgcac

SEQ ID NO: 610280 - DNA, 14 bp, D. melanogaster
cctctctttctggc

SEQ ID NO: 610281 - DNA, 13 bp, D. melanogaster
cctctgcagctgc

SEQ ID NO: 610282 - DNA, 14 bp, D. melanogaster
cctctgccgctgcc

SEQ ID NO: 610283 - DNA, 14 bp, D. melanogaster
cctctgctctgttt

SEQ ID NO: 610284 - DNA, 13 bp, D. melanogaster
cctctggcgccca

SEQ ID NO: 610285 - DNA, 13 bp, D. melanogaster
cctctgtttccat

SEQ ID NO: 610286 - DNA, 13 bp, D. melanogaster
cctcttcgctttg

SEQ ID NO: 610287 - DNA, 13 bp, D. melanogaster
cctcttgccactt

SEQ ID NO: 610288 - DNA, 13 bp, D. melanogaster
cctctttcaacgc

SEQ ID NO: 610289 - DNA, 13 bp, D. melanogaster
cctctttggtgct

SEQ ID NO: 610290 - DNA, 13 bp, D. melanogaster
cctcttttggcga

SEQ ID NO: 610291 - DNA, 13 bp, D. melanogaster
cctgaaaacaaaa

SEQ ID NO: 610292 - DNA, 14 bp, D. melanogaster
cctgaaaacaaaaa

SEQ ID NO: 610293 - DNA, 14 bp, D. melanogaster
cctgaaaatgcaag

SEQ ID NO: 610294 - DNA, 14 bp, D. melanogaster
cctgaaagtaggca

SEQ ID NO: 610295 - DNA, 13 bp, D. melanogaster
cctgaaagtatgc

SEQ ID NO: 610296 - DNA, 13 bp, D. melanogaster
cctgaacccacaa

SEQ ID NO: 610297 - DNA, 13 bp, D. melanogaster
cctgaacctgaac

SEQ ID NO: 610298 - DNA, 13 bp, D. melanogaster
cctgaactacatt

SEQ ID NO: 610299 - DNA, 13 bp, D. melanogaster
cctgaatataaat

SEQ ID NO: 610300 - DNA, 15 bp, D. melanogaster
cctgaccaacttcaa

SEQ ID NO: 610301 - DNA, 13 bp, D. melanogaster
cctgataagttag

SEQ ID NO: 610302 - DNA, 13 bp, D. melanogaster
cctgataccatca

SEQ ID NO: 610303 - DNA, 13 bp, D. melanogaster
cctgatcaggaat

SEQ ID NO: 610304 - DNA, 13 bp, D. melanogaster
cctgatcgacttc

SEQ ID NO: 610305 - DNA, 13 bp, D. melanogaster
cctgatgagcatc

SEQ ID NO: 610306 - DNA, 13 bp, D. melanogaster
cctgatgctttcc

SEQ ID NO: 610307 - DNA, 13 bp, D. melanogaster
cctgatttaacat

SEQ ID NO: 610308 - DNA, 13 bp, D. melanogaster
cctgcaaatacca

SEQ ID NO: 610309 - DNA, 13 bp, D. melanogaster
cctgcaatatggt

SEQ ID NO: 610310 - DNA, 13 bp, D. melanogaster
cctgcaattgatt

SEQ ID NO: 610311 - DNA, 13 bp, D. melanogaster
cctgcaattgcaa

SEQ ID NO: 610312 - DNA, 13 bp, D. melanogaster
cctgcaattgctt

SEQ ID NO: 610313 - DNA, 13 bp, D. melanogaster
cctgcaccaacac

SEQ ID NO: 610314 - DNA, 13 bp, D. melanogaster
cctgcactatttc

SEQ ID NO: 610315 - DNA, 13 bp, D. melanogaster
cctgcagagccat

SEQ ID NO: 610316 - DNA, 13 bp, D. melanogaster
cctgcagctgcag

SEQ ID NO: 610317 - DNA, 13 bp, D. melanogaster
cctgcataaggcc

SEQ ID NO: 610318 - DNA, 13 bp, D. melanogaster
cctgcatcctgca

SEQ ID NO: 610319 - DNA, 14 bp, D. melanogaster
cctgcatgtgtgtg

SEQ ID NO: 610320 - DNA, 13 bp, D. melanogaster
cctgcattttccg

SEQ ID NO: 610321 - DNA, 13 bp, D. melanogaster
cctgccacccact

SEQ ID NO: 610322 - DNA, 13 bp, D. melanogaster
cctgccacctgcc

SEQ ID NO: 610323 - DNA, 13 bp, D. melanogaster
cctgccacgccca

SEQ ID NO: 610324 - DNA, 14 bp, D. melanogaster
cctgccacgcccac

SEQ ID NO: 610325 - DNA, 14 bp, D. melanogaster
cctgccacgcctcc

SEQ ID NO: 610326 - DNA, 13 bp, D. melanogaster
cctgccactgaca

SEQ ID NO: 610327 - DNA, 13 bp, D. melanogaster
cctgccactgcca

SEQ ID NO: 610328 - DNA, 13 bp, D. melanogaster
cctgccacttttc

SEQ ID NO: 610329 - DNA, 13 bp, D. melanogaster
cctgccagccagc

SEQ ID NO: 610330 - DNA, 13 bp, D. melanogaster
cctgccagtggca

SEQ ID NO: 610331 - DNA, 13 bp, D. melanogaster
cctgccatcctgc

SEQ ID NO: 610332 - DNA, 13 bp, D. melanogaster
cctgccatttggc

SEQ ID NO: 610333 - DNA, 13 bp, D. melanogaster
cctgccattttcc

SEQ ID NO: 610334 - DNA, 13 bp, D. melanogaster
cctgcccacctgc

SEQ ID NO: 610335 - DNA, 14 bp, D. melanogaster
cctgcccacctgcc

SEQ ID NO: 610336 - DNA, 13 bp, D. melanogaster
cctgcctcttgga

SEQ ID NO: 610337 - DNA, 13 bp, D. melanogaster
cctgcctgcctgc

SEQ ID NO: 610338 - DNA, 14 bp, D. melanogaster
cctgcctgcctgct

SEQ ID NO: 610339 - DNA, 13 bp, D. melanogaster
cctgcctgttttc

SEQ ID NO: 610340 - DNA, 14 bp, D. melanogaster
cctgcgaatgcgga

SEQ ID NO: 610341 - DNA, 13 bp, D. melanogaster
cctgcgagtcctg

SEQ ID NO: 610342 - DNA, 13 bp, D. melanogaster
cctgcgattgttt

SEQ ID NO: 610343 - DNA, 13 bp, D. melanogaster
cctgcgcttttcc

SEQ ID NO: 610344 - DNA, 13 bp, D. melanogaster
cctgcgtcctgcg

SEQ ID NO: 610345 - DNA, 14 bp, D. melanogaster
cctgctcaaatttt

SEQ ID NO: 610346 - DNA, 14 bp, D. melanogaster
cctgctcctccagc

SEQ ID NO: 610347 - DNA, 14 bp, D. melanogaster
cctgctcctgctgc

SEQ ID NO: 610348 - DNA, 16 bp, D. melanogaster
cctgctcctgctgctg

SEQ ID NO: 610349 - DNA, 13 bp, D. melanogaster
cctgctcctggca

SEQ ID NO: 610350 - DNA, 13 bp, D. melanogaster
cctgctcctggct

SEQ ID NO: 610351 - DNA, 13 bp, D. melanogaster
cctgctcctgtcg

SEQ ID NO: 610352 - DNA, 14 bp, D. melanogaster
cctgctcctgttcc

SEQ ID NO: 610353 - DNA, 13 bp, D. melanogaster
cctgctccttggc

SEQ ID NO: 610354 - DNA, 13 bp, D. melanogaster
cctgctcgggcgc

SEQ ID NO: 610355 - DNA, 13 bp, D. melanogaster
cctgctgaaggtg

SEQ ID NO: 610356 - DNA, 13 bp, D. melanogaster
cctgctgcagctg

SEQ ID NO: 610357 - DNA, 13 bp, D. melanogaster
cctgctgccttct

SEQ ID NO: 610358 - DNA, 13 bp, D. melanogaster
cctgctgcgagat

SEQ ID NO: 610359 - DNA, 13 bp, D. melanogaster
cctgctgcgccgc

SEQ ID NO: 610360 - DNA, 13 bp, D. melanogaster
cctgctgctcctg

SEQ ID NO: 610361 - DNA, 13 bp, D. melanogaster
cctgctgctcctt

SEQ ID NO: 610362 - DNA, 13 bp, D. melanogaster
cctgctgctgctc

SEQ ID NO: 610363 - DNA, 14 bp, D. melanogaster
cctgctgctgctcc

SEQ ID NO: 610364 - DNA, 13 bp, D. melanogaster
cctgctgctgctg

SEQ ID NO: 610365 - DNA, 14 bp, D. melanogaster
cctgctgctgctgt

SEQ ID NO: 610366 - DNA, 13 bp, D. melanogaster
cctgctgctgttg

SEQ ID NO: 610367 - DNA, 13 bp, D. melanogaster
cctgctgcttctg

SEQ ID NO: 610368 - DNA, 13 bp, D. melanogaster
cctgctgcttttc

SEQ ID NO: 610369 - DNA, 13 bp, D. melanogaster
cctggaaaatgtg

SEQ ID NO: 610370 - DNA, 13 bp, D. melanogaster
cctggaccttggt

SEQ ID NO: 610371 - DNA, 13 bp, D. melanogaster
cctggagcagtgc

SEQ ID NO: 610372 - DNA, 14 bp, D. melanogaster
cctggagcagtgca

SEQ ID NO: 610373 - DNA, 13 bp, D. melanogaster
cctggagccacct

SEQ ID NO: 610374 - DNA, 13 bp, D. melanogaster
cctggatttcttc

SEQ ID NO: 610375 - DNA, 13 bp, D. melanogaster
cctggcaaaagga

SEQ ID NO: 610376 - DNA, 13 bp, D. melanogaster
cctggcaaccctg

SEQ ID NO: 610377 - DNA, 13 bp, D. melanogaster
cctggcaacgttt

SEQ ID NO: 610378 - DNA, 13 bp, D. melanogaster
cctggcaagtttt

SEQ ID NO: 610379 - DNA, 13 bp, D. melanogaster
cctggcacatcct

SEQ ID NO: 610380 - DNA, 13 bp, D. melanogaster
cctggcatcctgc

SEQ ID NO: 610381 - DNA, 14 bp, D. melanogaster
cctggcatcctggc

SEQ ID NO: 610382 - DNA, 13 bp, D. melanogaster
cctggccaaaacc

SEQ ID NO: 610383 - DNA, 13 bp, D. melanogaster
cctggccaaaagc

SEQ ID NO: 610384 - DNA, 13 bp, D. melanogaster
cctggccaaagga

SEQ ID NO: 610385 - DNA, 13 bp, D. melanogaster
cctggccaaatcc

SEQ ID NO: 610386 - DNA, 13 bp, D. melanogaster
cctggccaacaac

SEQ ID NO: 610387 - DNA, 13 bp, D. melanogaster
cctggccagaaat

SEQ ID NO: 610388 - DNA, 13 bp, D. melanogaster
cctggccaggaca

SEQ ID NO: 610389 - DNA, 13 bp, D. melanogaster
cctggccaggcca

SEQ ID NO: 610390 - DNA, 13 bp, D. melanogaster
cctggccattgtt

SEQ ID NO: 610391 - DNA, 13 bp, D. melanogaster
cctggcccaaaag

SEQ ID NO: 610392 - DNA, 14 bp, D. melanogaster
cctggccttattga

SEQ ID NO: 610393 - DNA, 13 bp, D. melanogaster
cctggctcctggc

SEQ ID NO: 610394 - DNA, 13 bp, D. melanogaster
cctggctgccact

SEQ ID NO: 610395 - DNA, 13 bp, D. melanogaster
cctggctgctcct

SEQ ID NO: 610396 - DNA, 13 bp, D. melanogaster
cctggctggctgc

SEQ ID NO: 610397 - DNA, 13 bp, D. melanogaster
cctggctggctgg

SEQ ID NO: 610398 - DNA, 13 bp, D. melanogaster
cctggctttggaa

SEQ ID NO: 610399 - DNA, 13 bp, D. melanogaster
cctggcttttcct

SEQ ID NO: 610400 - DNA, 13 bp, D. melanogaster
cctgggaccacct

SEQ ID NO: 610401 - DNA, 13 bp, D. melanogaster
cctggtattttgg

SEQ ID NO: 610402 - DNA, 13 bp, D. melanogaster
cctgtacttattt

SEQ ID NO: 610403 - DNA, 13 bp, D. melanogaster
cctgtatctatta

SEQ ID NO: 610404 - DNA, 13 bp, D. melanogaster
cctgtatctgtat

SEQ ID NO: 610405 - DNA, 14 bp, D. melanogaster
cctgtatctgtatc

SEQ ID NO: 610406 - DNA, 13 bp, D. melanogaster
cctgtccctgtcc

SEQ ID NO: 610407 - DNA, 13 bp, D. melanogaster
cctgtctgtgtgt

SEQ ID NO: 610408 - DNA, 13 bp, D. melanogaster
cctgtgtcctgtg

SEQ ID NO: 610409 - DNA, 13 bp, D. melanogaster
cctgtgtctagaa

SEQ ID NO: 610410 - DNA, 13 bp, D. melanogaster
cctgtgtgtcctg

SEQ ID NO: 610411 - DNA, 13 bp, D. melanogaster
cctgttcaatggt

SEQ ID NO: 610412 - DNA, 14 bp, D. melanogaster
cctgttcctgttcc

SEQ ID NO: 610413 - DNA, 13 bp, D. melanogaster
cctgttgatcttc

SEQ ID NO: 610414 - DNA, 13 bp, D. melanogaster
cctgttgattgat

SEQ ID NO: 610415 - DNA, 14 bp, D. melanogaster
cctgtttagctttt

SEQ ID NO: 610416 - DNA, 13 bp, D. melanogaster
cctgtttctgttg

SEQ ID NO: 610417 - DNA, 13 bp, D. melanogaster
cctgttttaatgg

SEQ ID NO: 610418 - DNA, 13 bp, D. melanogaster
cctgttttcgcaa

SEQ ID NO: 610419 - DNA, 13 bp, D. melanogaster
cctgttttggcat

SEQ ID NO: 610420 - DNA, 13 bp, D. melanogaster
ccttaaaaatcaa

SEQ ID NO: 610421 - DNA, 13 bp, D. melanogaster
ccttaaaaatcgg

SEQ ID NO: 610422 - DNA, 13 bp, D. melanogaster
ccttaaaacttta

SEQ ID NO: 610423 - DNA, 14 bp, D. melanogaster
ccttaaaactttat

SEQ ID NO: 610424 - DNA, 13 bp, D. melanogaster
ccttaaaatataa

SEQ ID NO: 610425 - DNA, 13 bp, D. melanogaster
ccttaaaatcaaa

SEQ ID NO: 610426 - DNA, 13 bp, D. melanogaster
ccttaaagaagag

SEQ ID NO: 610427 - DNA, 13 bp, D. melanogaster
ccttaacatacaa

SEQ ID NO: 610428 - DNA, 13 bp, D. melanogaster
ccttaacccattt

SEQ ID NO: 610429 - DNA, 13 bp, D. melanogaster
ccttaaccccttg

SEQ ID NO: 610430 - DNA, 13 bp, D. melanogaster
ccttaaccctttg

SEQ ID NO: 610431 - DNA, 13 bp, D. melanogaster
ccttaagaagaat

SEQ ID NO: 610432 - DNA, 13 bp, D. melanogaster
ccttaagttgaat

SEQ ID NO: 610433 - DNA, 13 bp, D. melanogaster
ccttaagtttttc

SEQ ID NO: 610434 - DNA, 13 bp, D. melanogaster
ccttaattaatta

SEQ ID NO: 610435 - DNA, 14 bp, D. melanogaster
ccttaattaccatt

SEQ ID NO: 610436 - DNA, 13 bp, D. melanogaster
ccttaatttaaat

SEQ ID NO: 610437 - DNA, 13 bp, D. melanogaster
ccttacaaacttg

SEQ ID NO: 610438 - DNA, 13 bp, D. melanogaster
ccttacacacaca

SEQ ID NO: 610439 - DNA, 13 bp, D. melanogaster
ccttaccaaaaat

SEQ ID NO: 610440 - DNA, 13 bp, D. melanogaster
ccttacctttggt

SEQ ID NO: 610441 - DNA, 13 bp, D. melanogaster
ccttaggaaaact

SEQ ID NO: 610442 - DNA, 13 bp, D. melanogaster
ccttataaaaaat

SEQ ID NO: 610443 - DNA, 13 bp, D. melanogaster
ccttataaatgct

SEQ ID NO: 610444 - DNA, 13 bp, D. melanogaster
ccttataataaat

SEQ ID NO: 610445 - DNA, 13 bp, D. melanogaster
ccttatcatcatt

SEQ ID NO: 610446 - DNA, 14 bp, D. melanogaster
ccttatcatcattc

SEQ ID NO: 610447 - DNA, 13 bp, D. melanogaster
ccttatcggaact

SEQ ID NO: 610448 - DNA, 13 bp, D. melanogaster
ccttatgagcatt

SEQ ID NO: 610449 - DNA, 13 bp, D. melanogaster
ccttcaataaaaa

SEQ ID NO: 610450 - DNA, 13 bp, D. melanogaster
ccttcaatttcga

SEQ ID NO: 610451 - DNA, 13 bp, D. melanogaster
ccttcacacacac

SEQ ID NO: 610452 - DNA, 13 bp, D. melanogaster
ccttcaccttaga

SEQ ID NO: 610453 - DNA, 13 bp, D. melanogaster
ccttcagcaggca

SEQ ID NO: 610454 - DNA, 14 bp, D. melanogaster
ccttcagcaggcac

SEQ ID NO: 610455 - DNA, 13 bp, D. melanogaster
ccttcatgtggat

SEQ ID NO: 610456 - DNA, 13 bp, D. melanogaster
ccttccacgtttt

SEQ ID NO: 610457 - DNA, 13 bp, D. melanogaster
ccttcccttcgat

SEQ ID NO: 610458 - DNA, 14 bp, D. melanogaster
ccttccggagcaaa

SEQ ID NO: 610459 - DNA, 13 bp, D. melanogaster
ccttcctgcatct

SEQ ID NO: 610460 - DNA, 13 bp, D. melanogaster
ccttccttcagtg

SEQ ID NO: 610461 - DNA, 13 bp, D. melanogaster
ccttcgagtggaa

SEQ ID NO: 610462 - DNA, 14 bp, D. melanogaster
ccttcgcaagcatt

SEQ ID NO: 610463 - DNA, 13 bp, D. melanogaster
ccttcgcagccag

SEQ ID NO: 610464 - DNA, 13 bp, D. melanogaster
ccttcgccttcgc

SEQ ID NO: 610465 - DNA, 13 bp, D. melanogaster
ccttcgtcctccg

SEQ ID NO: 610466 - DNA, 13 bp, D. melanogaster
ccttcgtcctgcc

SEQ ID NO: 610467 - DNA, 13 bp, D. melanogaster
ccttcgtcctggc

SEQ ID NO: 610468 - DNA, 13 bp, D. melanogaster
ccttcgtcctgtg

SEQ ID NO: 610469 - DNA, 13 bp, D. melanogaster
ccttcgtcctgtt

SEQ ID NO: 610470 - DNA, 13 bp, D. melanogaster
ccttcgtccttgg

SEQ ID NO: 610471 - DNA, 14 bp, D. melanogaster
ccttctagctttta

SEQ ID NO: 610472 - DNA, 13 bp, D. melanogaster
ccttctccaagcc

SEQ ID NO: 610473 - DNA, 13 bp, D. melanogaster
ccttctcccgatt

SEQ ID NO: 610474 - DNA, 13 bp, D. melanogaster
ccttctctgccac

SEQ ID NO: 610475 - DNA, 13 bp, D. melanogaster
ccttctgcatgca

SEQ ID NO: 610476 - DNA, 13 bp, D. melanogaster
ccttctgtctgtt

SEQ ID NO: 610477 - DNA, 13 bp, D. melanogaster
ccttctgtgattt

SEQ ID NO: 610478 - DNA, 14 bp, D. melanogaster
ccttcttcaatcaa

SEQ ID NO: 610479 - DNA, 13 bp, D. melanogaster
ccttcttcctggc

SEQ ID NO: 610480 - DNA, 13 bp, D. melanogaster
ccttcttctatat

SEQ ID NO: 610481 - DNA, 13 bp, D. melanogaster
ccttcttctttaa

SEQ ID NO: 610482 - DNA, 13 bp, D. melanogaster
ccttcttgctggc

SEQ ID NO: 610483 - DNA, 14 bp, D. melanogaster
ccttgactggcagt

SEQ ID NO: 610484 - DNA, 13 bp, D. melanogaster
ccttgaggaactc

SEQ ID NO: 610485 - DNA, 13 bp, D. melanogaster
ccttgcagccatc

SEQ ID NO: 610486 - DNA, 13 bp, D. melanogaster
ccttgctttaagt

SEQ ID NO: 610487 - DNA, 13 bp, D. melanogaster
ccttggccaaggt

SEQ ID NO: 610488 - DNA, 13 bp, D. melanogaster
ccttgggattcga

SEQ ID NO: 610489 - DNA, 13 bp, D. melanogaster
ccttgtaaatgta

SEQ ID NO: 610490 - DNA, 13 bp, D. melanogaster
ccttgtttaatag

SEQ ID NO: 610491 - DNA, 14 bp, D. melanogaster
ccttgtttaatagc

SEQ ID NO: 610492 - DNA, 13 bp, D. melanogaster
cctttaaaatgta

SEQ ID NO: 610493 - DNA, 13 bp, D. melanogaster
cctttaaaatgtc

SEQ ID NO: 610494 - DNA, 13 bp, D. melanogaster
cctttaaaattga

SEQ ID NO: 610495 - DNA, 13 bp, D. melanogaster
cctttaagcattg

SEQ ID NO: 610496 - DNA, 14 bp, D. melanogaster
cctttaccttaaac

SEQ ID NO: 610497 - DNA, 13 bp, D. melanogaster
cctttactgaaat

SEQ ID NO: 610498 - DNA, 13 bp, D. melanogaster
cctttagctgtaa

SEQ ID NO: 610499 - DNA, 14 bp, D. melanogaster
cctttaggaaacaa

SEQ ID NO: 610500 - DNA, 13 bp, D. melanogaster
cctttatgtttat

SEQ ID NO: 610501 - DNA, 14 bp, D. melanogaster
cctttatgtttatt

SEQ ID NO: 610502 - DNA, 14 bp, D. melanogaster
cctttattatgtaa

SEQ ID NO: 610503 - DNA, 13 bp, D. melanogaster
cctttatttttga

SEQ ID NO: 610504 - DNA, 13 bp, D. melanogaster
cctttcaagttcc

SEQ ID NO: 610505 - DNA, 13 bp, D. melanogaster
cctttcataataa

SEQ ID NO: 610506 - DNA, 13 bp, D. melanogaster
cctttcattgtgt

SEQ ID NO: 610507 - DNA, 13 bp, D. melanogaster
cctttcatttata

SEQ ID NO: 610508 - DNA, 13 bp, D. melanogaster
cctttcatttcgc

SEQ ID NO: 610509 - DNA, 13 bp, D. melanogaster
cctttccaccagt

SEQ ID NO: 610510 - DNA, 13 bp, D. melanogaster
cctttccattttg

SEQ ID NO: 610511 - DNA, 13 bp, D. melanogaster
cctttcgatggct

SEQ ID NO: 610512 - DNA, 14 bp, D. melanogaster
cctttcgccggaga

SEQ ID NO: 610513 - DNA, 13 bp, D. melanogaster
cctttcgtttgtg

SEQ ID NO: 610514 - DNA, 13 bp, D. melanogaster
cctttctcaaaac

SEQ ID NO: 610515 - DNA, 14 bp, D. melanogaster
cctttctcaaaacg

SEQ ID NO: 610516 - DNA, 13 bp, D. melanogaster
cctttgaaaagta

SEQ ID NO: 610517 - DNA, 13 bp, D. melanogaster
cctttgacaaggg

SEQ ID NO: 610518 - DNA, 13 bp, D. melanogaster
cctttgattattt

SEQ ID NO: 610519 - DNA, 13 bp, D. melanogaster
cctttgcaagcag

SEQ ID NO: 610520 - DNA, 13 bp, D. melanogaster
cctttgcaggtcc

SEQ ID NO: 610521 - DNA, 13 bp, D. melanogaster
cctttgccatcct

SEQ ID NO: 610522 - DNA, 13 bp, D. melanogaster
cctttgctatcag

SEQ ID NO: 610523 - DNA, 13 bp, D. melanogaster
cctttgctcctgc

SEQ ID NO: 610524 - DNA, 13 bp, D. melanogaster
cctttgctgctgc

SEQ ID NO: 610525 - DNA, 13 bp, D. melanogaster
cctttgctttggc

SEQ ID NO: 610526 - DNA, 13 bp, D. melanogaster
cctttggaacacc

SEQ ID NO: 610527 - DNA, 13 bp, D. melanogaster
cctttggaatgtg

SEQ ID NO: 610528 - DNA, 13 bp, D. melanogaster
cctttggactgat

SEQ ID NO: 610529 - DNA, 13 bp, D. melanogaster
cctttggagaaat

SEQ ID NO: 610530 - DNA, 13 bp, D. melanogaster
cctttggccagga

SEQ ID NO: 610531 - DNA, 13 bp, D. melanogaster
cctttggccatcg

SEQ ID NO: 610532 - DNA, 13 bp, D. melanogaster
cctttggcctttt

SEQ ID NO: 610533 - DNA, 13 bp, D. melanogaster
cctttggcgacac

SEQ ID NO: 610534 - DNA, 13 bp, D. melanogaster
cctttggctttgc

SEQ ID NO: 610535 - DNA, 14 bp, D. melanogaster
cctttggtgggaat

SEQ ID NO: 610536 - DNA, 13 bp, D. melanogaster
cctttgtagatca

SEQ ID NO: 610537 - DNA, 13 bp, D. melanogaster
cctttgtatacta

SEQ ID NO: 610538 - DNA, 13 bp, D. melanogaster
cctttgtatttgc

SEQ ID NO: 610539 - DNA, 14 bp, D. melanogaster
cctttgtgccagca

SEQ ID NO: 610540 - DNA, 13 bp, D. melanogaster
cctttgtgtgtgc

SEQ ID NO: 610541 - DNA, 13 bp, D. melanogaster
cctttgtgtttgc

SEQ ID NO: 610542 - DNA, 13 bp, D. melanogaster
cctttgttaacac

SEQ ID NO: 610543 - DNA, 13 bp, D. melanogaster
cctttgttagcca

SEQ ID NO: 610544 - DNA, 13 bp, D. melanogaster
cctttgttgttgc

SEQ ID NO: 610545 - DNA, 13 bp, D. melanogaster
cctttgttttcat

SEQ ID NO: 610546 - DNA, 13 bp, D. melanogaster
ccttttaaaaact

SEQ ID NO: 610547 - DNA, 13 bp, D. melanogaster
ccttttaaaattt

SEQ ID NO: 610548 - DNA, 13 bp, D. melanogaster
ccttttaaataaa

SEQ ID NO: 610549 - DNA, 13 bp, D. melanogaster
ccttttaatttca

SEQ ID NO: 610550 - DNA, 13 bp, D. melanogaster
ccttttaccattt

SEQ ID NO: 610551 - DNA, 13 bp, D. melanogaster
ccttttactttac

SEQ ID NO: 610552 - DNA, 13 bp, D. melanogaster
ccttttatgccat

SEQ ID NO: 610553 - DNA, 14 bp, D. melanogaster
ccttttatgccata

SEQ ID NO: 610554 - DNA, 13 bp, D. melanogaster
ccttttccaccca

SEQ ID NO: 610555 - DNA, 13 bp, D. melanogaster
ccttttcctttgg

SEQ ID NO: 610556 - DNA, 14 bp, D. melanogaster
ccttttcctttggc

SEQ ID NO: 610557 - DNA, 13 bp, D. melanogaster
ccttttcgatttc

SEQ ID NO: 610558 - DNA, 13 bp, D. melanogaster
ccttttctttaaa

SEQ ID NO: 610559 - DNA, 13 bp, D. melanogaster
ccttttctttggc

SEQ ID NO: 610560 - DNA, 13 bp, D. melanogaster
ccttttgaacgga

SEQ ID NO: 610561 - DNA, 13 bp, D. melanogaster
ccttttgatcatg

SEQ ID NO: 610562 - DNA, 13 bp, D. melanogaster
ccttttgccaaat

SEQ ID NO: 610563 - DNA, 13 bp, D. melanogaster
ccttttgcctgtt

SEQ ID NO: 610564 - DNA, 13 bp, D. melanogaster
ccttttgcctttg

SEQ ID NO: 610565 - DNA, 13 bp, D. melanogaster
ccttttggaatgg

SEQ ID NO: 610566 - DNA, 13 bp, D. melanogaster
ccttttggccagc

SEQ ID NO: 610567 - DNA, 13 bp, D. melanogaster
ccttttggccatt

SEQ ID NO: 610568 - DNA, 13 bp, D. melanogaster
ccttttggcccaa

SEQ ID NO: 610569 - DNA, 13 bp, D. melanogaster
ccttttggccgct

SEQ ID NO: 610570 - DNA, 13 bp, D. melanogaster
ccttttggccttc

SEQ ID NO: 610571 - DNA, 13 bp, D. melanogaster
ccttttggccttt

SEQ ID NO: 610572 - DNA, 13 bp, D. melanogaster
ccttttggctgct

SEQ ID NO: 610573 - DNA, 13 bp, D. melanogaster
ccttttggctggt

SEQ ID NO: 610574 - DNA, 13 bp, D. melanogaster
ccttttgggccaa

SEQ ID NO: 610575 - DNA, 13 bp, D. melanogaster
ccttttgtaaatg

SEQ ID NO: 610576 - DNA, 13 bp, D. melanogaster
ccttttgtgtgcc

SEQ ID NO: 610577 - DNA, 13 bp, D. melanogaster
ccttttgttcgcc

SEQ ID NO: 610578 - DNA, 13 bp, D. melanogaster
ccttttgttggct

SEQ ID NO: 610579 - DNA, 13 bp, D. melanogaster
ccttttgtttggg

SEQ ID NO: 610580 - DNA, 13 bp, D. melanogaster
cctttttaaagaa

SEQ ID NO: 610581 - DNA, 13 bp, D. melanogaster
cctttttaaatgt

SEQ ID NO: 610582 - DNA, 13 bp, D. melanogaster
cctttttccagga

SEQ ID NO: 610583 - DNA, 13 bp, D. melanogaster
cctttttcccagc

SEQ ID NO: 610584 - DNA, 13 bp, D. melanogaster
cctttttgacttt

SEQ ID NO: 610585 - DNA, 13 bp, D. melanogaster
cctttttgccagc

SEQ ID NO: 610586 - DNA, 13 bp, D. melanogaster
cctttttggcact

SEQ ID NO: 610587 - DNA, 13 bp, D. melanogaster
cctttttggcagc

SEQ ID NO: 610588 - DNA, 13 bp, D. melanogaster
cctttttggccaa

SEQ ID NO: 610589 - DNA, 14 bp, D. melanogaster
cctttttggccaag

SEQ ID NO: 610590 - DNA, 14 bp, D. melanogaster
cctttttggccatt

SEQ ID NO: 610591 - DNA, 13 bp, D. melanogaster
cctttttggccgc

SEQ ID NO: 610592 - DNA, 13 bp, D. melanogaster
cctttttggtggc

SEQ ID NO: 610593 - DNA, 13 bp, D. melanogaster
cctttttggtggg

SEQ ID NO: 610594 - DNA, 13 bp, D. melanogaster
cctttttggtgta

SEQ ID NO: 610595 - DNA, 13 bp, D. melanogaster
cctttttgtaatt

SEQ ID NO: 610596 - DNA, 13 bp, D. melanogaster
cctttttgtggca

SEQ ID NO: 610597 - DNA, 13 bp, D. melanogaster
cctttttgtggcc

SEQ ID NO: 610598 - DNA, 13 bp, D. melanogaster
ccttttttatgaa

SEQ ID NO: 610599 - DNA, 13 bp, D. melanogaster
ccttttttgccat

SEQ ID NO: 610600 - DNA, 13 bp, D. melanogaster
ccttttttggcca

SEQ ID NO: 610601 - DNA, 14 bp, D. melanogaster
ccttttttggccaa

SEQ ID NO: 610602 - DNA, 13 bp, D. melanogaster
ccttttttttgca

SEQ ID NO: 610603 - DNA, 13 bp, D. melanogaster
cgaaaaaaacatc

SEQ ID NO: 610604 - DNA, 14 bp, D. melanogaster
cgaaaaaacggtag

SEQ ID NO: 610605 - DNA, 13 bp, D. melanogaster
cgaaaaaatcaat

SEQ ID NO: 610606 - DNA, 14 bp, D. melanogaster
cgaaaaaatcgaaa

SEQ ID NO: 610607 - DNA, 13 bp, D. melanogaster
cgaaaaaatcgtg

SEQ ID NO: 610608 - DNA, 13 bp, D. melanogaster
cgaaaaaatgtgt

SEQ ID NO: 610609 - DNA, 13 bp, D. melanogaster
cgaaaaaattatt

SEQ ID NO: 610610 - DNA, 13 bp, D. melanogaster
cgaaaaaattcaa

SEQ ID NO: 610611 - DNA, 14 bp, D. melanogaster
cgaaaaaattcaag

SEQ ID NO: 610612 - DNA, 13 bp, D. melanogaster
cgaaaaacaaatg

SEQ ID NO: 610613 - DNA, 13 bp, D. melanogaster
cgaaaaacaaatt

SEQ ID NO: 610614 - DNA, 13 bp, D. melanogaster
cgaaaaacaagtt

SEQ ID NO: 610615 - DNA, 13 bp, D. melanogaster
cgaaaaacacttt

SEQ ID NO: 610616 - DNA, 13 bp, D. melanogaster
cgaaaaactttga

SEQ ID NO: 610617 - DNA, 13 bp, D. melanogaster
cgaaaaacttttg

SEQ ID NO: 610618 - DNA, 13 bp, D. melanogaster
cgaaaaagaaatc

SEQ ID NO: 610619 - DNA, 13 bp, D. melanogaster
cgaaaaagtgcaa

SEQ ID NO: 610620 - DNA, 13 bp, D. melanogaster
cgaaaaagttcga

SEQ ID NO: 610621 - DNA, 13 bp, D. melanogaster
cgaaaaagttgaa

SEQ ID NO: 610622 - DNA, 13 bp, D. melanogaster
cgaaaaatacacg

SEQ ID NO: 610623 - DNA, 13 bp, D. melanogaster
cgaaaaatacgaa

SEQ ID NO: 610624 - DNA, 13 bp, D. melanogaster
cgaaaaatatgca

SEQ ID NO: 610625 - DNA, 13 bp, D. melanogaster
cgaaaaatattaa

SEQ ID NO: 610626 - DNA, 14 bp, D. melanogaster
cgaaaaatcaaaac

SEQ ID NO: 610627 - DNA, 14 bp, D. melanogaster
cgaaaaatcaaaat

SEQ ID NO: 610628 - DNA, 13 bp, D. melanogaster
cgaaaaatcaaga

SEQ ID NO: 610629 - DNA, 13 bp, D. melanogaster
cgaaaaatcaata

SEQ ID NO: 610630 - DNA, 13 bp, D. melanogaster
cgaaaaatcaatt

SEQ ID NO: 610631 - DNA, 13 bp, D. melanogaster
cgaaaaatcacaa

SEQ ID NO: 610632 - DNA, 13 bp, D. melanogaster
cgaaaaatccaaa

SEQ ID NO: 610633 - DNA, 13 bp, D. melanogaster
cgaaaaatcgaat

SEQ ID NO: 610634 - DNA, 13 bp, D. melanogaster
cgaaaaatgccaa

SEQ ID NO: 610635 - DNA, 13 bp, D. melanogaster
cgaaaaatggcaa

SEQ ID NO: 610636 - DNA, 13 bp, D. melanogaster
cgaaaaatggttt

SEQ ID NO: 610637 - DNA, 13 bp, D. melanogaster
cgaaaaattagca

SEQ ID NO: 610638 - DNA, 13 bp, D. melanogaster
cgaaaaattgaaa

SEQ ID NO: 610639 - DNA, 13 bp, D. melanogaster
cgaaaaattggca

SEQ ID NO: 610640 - DNA, 13 bp, D. melanogaster
cgaaaaattgttt

SEQ ID NO: 610641 - DNA, 13 bp, D. melanogaster
cgaaaacaaaatt

SEQ ID NO: 610642 - DNA, 13 bp, D. melanogaster
cgaaaacaaatca

SEQ ID NO: 610643 - DNA, 13 bp, D. melanogaster
cgaaaacaatcaa

SEQ ID NO: 610644 - DNA, 13 bp, D. melanogaster
cgaaaacaattaa

SEQ ID NO: 610645 - DNA, 13 bp, D. melanogaster
cgaaaacattaaa

SEQ ID NO: 610646 - DNA, 13 bp, D. melanogaster
cgaaaacattttc

SEQ ID NO: 610647 - DNA, 13 bp, D. melanogaster
cgaaaaccaaatg

SEQ ID NO: 610648 - DNA, 13 bp, D. melanogaster
cgaaaaccaataa

SEQ ID NO: 610649 - DNA, 13 bp, D. melanogaster
cgaaaaccagcag

SEQ ID NO: 610650 - DNA, 13 bp, D. melanogaster
cgaaaaccgaaac

SEQ ID NO: 610651 - DNA, 13 bp, D. melanogaster
cgaaaacgaaacc

SEQ ID NO: 610652 - DNA, 13 bp, D. melanogaster
cgaaaacgaaatc

SEQ ID NO: 610653 - DNA, 13 bp, D. melanogaster
cgaaaacgtttgc

SEQ ID NO: 610654 - DNA, 13 bp, D. melanogaster
cgaaaacgttttc

SEQ ID NO: 610655 - DNA, 13 bp, D. melanogaster
cgaaaactaattc

SEQ ID NO: 610656 - DNA, 13 bp, D. melanogaster
cgaaaactatttt

SEQ ID NO: 610657 - DNA, 14 bp, D. melanogaster
cgaaaactattttg

SEQ ID NO: 610658 - DNA, 14 bp, D. melanogaster
cgaaaactgaatgc

SEQ ID NO: 610659 - DNA, 13 bp, D. melanogaster
cgaaaacttttca

SEQ ID NO: 610660 - DNA, 13 bp, D. melanogaster
cgaaaacttttcc

SEQ ID NO: 610661 - DNA, 14 bp, D. melanogaster
cgaaaacttttgca

SEQ ID NO: 610662 - DNA, 13 bp, D. melanogaster
cgaaaagaaaact

SEQ ID NO: 610663 - DNA, 13 bp, D. melanogaster
cgaaaagaaatgc

SEQ ID NO: 610664 - DNA, 13 bp, D. melanogaster
cgaaaagcaaacc

SEQ ID NO: 610665 - DNA, 13 bp, D. melanogaster
cgaaaagcaaacg

SEQ ID NO: 610666 - DNA, 13 bp, D. melanogaster
cgaaaagcaaatg

SEQ ID NO: 610667 - DNA, 13 bp, D. melanogaster
cgaaaagcgaaac

SEQ ID NO: 610668 - DNA, 13 bp, D. melanogaster
cgaaaagcgaaag

SEQ ID NO: 610669 - DNA, 13 bp, D. melanogaster
cgaaaagcgaaat

SEQ ID NO: 610670 - DNA, 14 bp, D. melanogaster
cgaaaagcgaacga

SEQ ID NO: 610671 - DNA, 13 bp, D. melanogaster
cgaaaaggaaatg

SEQ ID NO: 610672 - DNA, 13 bp, D. melanogaster
cgaaaaggaaatt

SEQ ID NO: 610673 - DNA, 13 bp, D. melanogaster
cgaaaagtaacta

SEQ ID NO: 610674 - DNA, 13 bp, D. melanogaster
cgaaaagtagtga

SEQ ID NO: 610675 - DNA, 13 bp, D. melanogaster
cgaaaagtatgca

SEQ ID NO: 610676 - DNA, 13 bp, D. melanogaster
cgaaaagtatttt

SEQ ID NO: 610677 - DNA, 13 bp, D. melanogaster
cgaaaagtcaaca

SEQ ID NO: 610678 - DNA, 13 bp, D. melanogaster
cgaaaagtgggcg

SEQ ID NO: 610679 - DNA, 13 bp, D. melanogaster
cgaaaagttcaat

SEQ ID NO: 610680 - DNA, 13 bp, D. melanogaster
cgaaaagtttaat

SEQ ID NO: 610681 - DNA, 14 bp, D. melanogaster
cgaaaataaattaa

SEQ ID NO: 610682 - DNA, 13 bp, D. melanogaster
cgaaaatagtttt

SEQ ID NO: 610683 - DNA, 13 bp, D. melanogaster
cgaaaatataaac

SEQ ID NO: 610684 - DNA, 13 bp, D. melanogaster
cgaaaatataaat

SEQ ID NO: 610685 - DNA, 13 bp, D. melanogaster
cgaaaatataatt

SEQ ID NO: 610686 - DNA, 13 bp, D. melanogaster
cgaaaatatagat

SEQ ID NO: 610687 - DNA, 14 bp, D. melanogaster
cgaaaatatataaa

SEQ ID NO: 610688 - DNA, 13 bp, D. melanogaster
cgaaaatatatac

SEQ ID NO: 610689 - DNA, 13 bp, D. melanogaster
cgaaaatatcaaa

SEQ ID NO: 610690 - DNA, 13 bp, D. melanogaster
cgaaaatatcacg

SEQ ID NO: 610691 - DNA, 13 bp, D. melanogaster
cgaaaatatgcaa

SEQ ID NO: 610692 - DNA, 13 bp, D. melanogaster
cgaaaatattctt

SEQ ID NO: 610693 - DNA, 13 bp, D. melanogaster
cgaaaatattgaa

SEQ ID NO: 610694 - DNA, 13 bp, D. melanogaster
cgaaaatatttaa

SEQ ID NO: 610695 - DNA, 14 bp, D. melanogaster
cgaaaatatttttg

SEQ ID NO: 610696 - DNA, 14 bp, D. melanogaster
cgaaaatcaaaatt

SEQ ID NO: 610697 - DNA, 13 bp, D. melanogaster
cgaaaatcataaa

SEQ ID NO: 610698 - DNA, 13 bp, D. melanogaster
cgaaaatccaata

SEQ ID NO: 610699 - DNA, 13 bp, D. melanogaster
cgaaaatctgcaa

SEQ ID NO: 610700 - DNA, 13 bp, D. melanogaster
cgaaaatgaaaca

SEQ ID NO: 610701 - DNA, 13 bp, D. melanogaster
cgaaaatgaagaa

SEQ ID NO: 610702 - DNA, 14 bp, D. melanogaster
cgaaaatgaatgtg

SEQ ID NO: 610703 - DNA, 13 bp, D. melanogaster
cgaaaatgattta

SEQ ID NO: 610704 - DNA, 13 bp, D. melanogaster
cgaaaatgcgaaa

SEQ ID NO: 610705 - DNA, 13 bp, D. melanogaster
cgaaaatggccaa

SEQ ID NO: 610706 - DNA, 13 bp, D. melanogaster
cgaaaatggtttt

SEQ ID NO: 610707 - DNA, 13 bp, D. melanogaster
cgaaaatgtgtta

SEQ ID NO: 610708 - DNA, 13 bp, D. melanogaster
cgaaaatgtttaa

SEQ ID NO: 610709 - DNA, 13 bp, D. melanogaster
cgaaaatgtttgg

SEQ ID NO: 610710 - DNA, 13 bp, D. melanogaster
cgaaaatgttttg

SEQ ID NO: 610711 - DNA, 13 bp, D. melanogaster
cgaaaattaaata

SEQ ID NO: 610712 - DNA, 13 bp, D. melanogaster
cgaaaattatgca

SEQ ID NO: 610713 - DNA, 13 bp, D. melanogaster
cgaaaattattta

SEQ ID NO: 610714 - DNA, 13 bp, D. melanogaster
cgaaaattcatat

SEQ ID NO: 610715 - DNA, 13 bp, D. melanogaster
cgaaaattccgtt

SEQ ID NO: 610716 - DNA, 14 bp, D. melanogaster
cgaaaattccgttt

SEQ ID NO: 610717 - DNA, 13 bp, D. melanogaster
cgaaaattcgttt

SEQ ID NO: 610718 - DNA, 14 bp, D. melanogaster
cgaaaattgaccca

SEQ ID NO: 610719 - DNA, 13 bp, D. melanogaster
cgaaaattgcagc

SEQ ID NO: 610720 - DNA, 13 bp, D. melanogaster
cgaaaattggaaa

SEQ ID NO: 610721 - DNA, 13 bp, D. melanogaster
cgaaaattgtaaa

SEQ ID NO: 610722 - DNA, 14 bp, D. melanogaster
cgaaaattgttttt

SEQ ID NO: 610723 - DNA, 15 bp, D. melanogaster
cgaaaatttggccaa

SEQ ID NO: 610724 - DNA, 14 bp, D. melanogaster
cgaaaatttgttaa

SEQ ID NO: 610725 - DNA, 13 bp, D. melanogaster
cgaaaattttaat

SEQ ID NO: 610726 - DNA, 13 bp, D. melanogaster
cgaaaattttcga

SEQ ID NO: 610727 - DNA, 14 bp, D. melanogaster
cgaaaattttcgaa

SEQ ID NO: 610728 - DNA, 13 bp, D. melanogaster
cgaaacaaaaatg

SEQ ID NO: 610729 - DNA, 13 bp, D. melanogaster
cgaaacaaatatt

SEQ ID NO: 610730 - DNA, 13 bp, D. melanogaster
cgaaacaaatgaa

SEQ ID NO: 610731 - DNA, 13 bp, D. melanogaster
cgaaacaacaaat

SEQ ID NO: 610732 - DNA, 14 bp, D. melanogaster
cgaaacaacaaatt

SEQ ID NO: 610733 - DNA, 13 bp, D. melanogaster
cgaaacaataatg

SEQ ID NO: 610734 - DNA, 13 bp, D. melanogaster
cgaaacaatacag

SEQ ID NO: 610735 - DNA, 13 bp, D. melanogaster
cgaaacagtttta

SEQ ID NO: 610736 - DNA, 13 bp, D. melanogaster
cgaaaccaaaacg

SEQ ID NO: 610737 - DNA, 13 bp, D. melanogaster
cgaaaccaaagcc

SEQ ID NO: 610738 - DNA, 13 bp, D. melanogaster
cgaaaccaaatga

SEQ ID NO: 610739 - DNA, 13 bp, D. melanogaster
cgaaaccagtttg

SEQ ID NO: 610740 - DNA, 13 bp, D. melanogaster
cgaaaccgaaaca

SEQ ID NO: 610741 - DNA, 13 bp, D. melanogaster
cgaaaccgaaacg

SEQ ID NO: 610742 - DNA, 13 bp, D. melanogaster
cgaaaccgaagcc

SEQ ID NO: 610743 - DNA, 13 bp, D. melanogaster
cgaaacgaaaaat

SEQ ID NO: 610744 - DNA, 14 bp, D. melanogaster
cgaaacgaaaacga

SEQ ID NO: 610745 - DNA, 14 bp, D. melanogaster
cgaaacgaaacgag

SEQ ID NO: 610746 - DNA, 14 bp, D. melanogaster
cgaaacgaaacgga

SEQ ID NO: 610747 - DNA, 13 bp, D. melanogaster
cgaaacgaaactg

SEQ ID NO: 610748 - DNA, 13 bp, D. melanogaster
cgaaacgaaatca

SEQ ID NO: 610749 - DNA, 13 bp, D. melanogaster
cgaaacgaaatcg

SEQ ID NO: 610750 - DNA, 13 bp, D. melanogaster
cgaaacgaaatgg

SEQ ID NO: 610751 - DNA, 13 bp, D. melanogaster
cgaaacgaacgaa

SEQ ID NO: 610752 - DNA, 14 bp, D. melanogaster
cgaaacgaactgaa

SEQ ID NO: 610753 - DNA, 13 bp, D. melanogaster
cgaaacgaagcga

SEQ ID NO: 610754 - DNA, 14 bp, D. melanogaster
cgaaacgaatcgaa

SEQ ID NO: 610755 - DNA, 13 bp, D. melanogaster
cgaaacgcactgt

SEQ ID NO: 610756 - DNA, 14 bp, D. melanogaster
cgaaacgcactgta

SEQ ID NO: 610757 - DNA, 13 bp, D. melanogaster
cgaaacggaaatg

SEQ ID NO: 610758 - DNA, 13 bp, D. melanogaster
cgaaacgtaaaca

SEQ ID NO: 610759 - DNA, 13 bp, D. melanogaster
cgaaactaaaatg

SEQ ID NO: 610760 - DNA, 13 bp, D. melanogaster
cgaaactaattta

SEQ ID NO: 610761 - DNA, 13 bp, D. melanogaster
cgaaactagtttt

SEQ ID NO: 610762 - DNA, 13 bp, D. melanogaster
cgaaactatatcc

SEQ ID NO: 610763 - DNA, 13 bp, D. melanogaster
cgaaactattaaa

SEQ ID NO: 610764 - DNA, 13 bp, D. melanogaster
cgaaactattcga

SEQ ID NO: 610765 - DNA, 13 bp, D. melanogaster
cgaaactattgaa

SEQ ID NO: 610766 - DNA, 13 bp, D. melanogaster
cgaaactcaattt

SEQ ID NO: 610767 - DNA, 13 bp, D. melanogaster
cgaaactgaaaca

SEQ ID NO: 610768 - DNA, 13 bp, D. melanogaster
cgaaactgaaacc

SEQ ID NO: 610769 - DNA, 13 bp, D. melanogaster
cgaaactgaaatg

SEQ ID NO: 610770 - DNA, 14 bp, D. melanogaster
cgaaactgtgaaaa

SEQ ID NO: 610771 - DNA, 13 bp, D. melanogaster
cgaaacttatcag

SEQ ID NO: 610772 - DNA, 13 bp, D. melanogaster
cgaaacttttgcc

SEQ ID NO: 610773 - DNA, 13 bp, D. melanogaster
cgaaagaagttag

SEQ ID NO: 610774 - DNA, 14 bp, D. melanogaster
cgaaagaagttagc

SEQ ID NO: 610775 - DNA, 13 bp, D. melanogaster
cgaaagacttcat

SEQ ID NO: 610776 - DNA, 13 bp, D. melanogaster
cgaaagagacgga

SEQ ID NO: 610777 - DNA, 14 bp, D. melanogaster
cgaaagagacggca

SEQ ID NO: 610778 - DNA, 13 bp, D. melanogaster
cgaaagagagcgc

SEQ ID NO: 610779 - DNA, 13 bp, D. melanogaster
cgaaagagatgga

SEQ ID NO: 610780 - DNA, 13 bp, D. melanogaster
cgaaagagatggc

SEQ ID NO: 610781 - DNA, 14 bp, D. melanogaster
cgaaagagatggca

SEQ ID NO: 610782 - DNA, 13 bp, D. melanogaster
cgaaagagatggg

SEQ ID NO: 610783 - DNA, 13 bp, D. melanogaster
cgaaagagcgaga

SEQ ID NO: 610784 - DNA, 13 bp, D. melanogaster
cgaaagcaaaacc

SEQ ID NO: 610785 - DNA, 13 bp, D. melanogaster
cgaaagcaataaa

SEQ ID NO: 610786 - DNA, 13 bp, D. melanogaster
cgaaagcaatcaa

SEQ ID NO: 610787 - DNA, 13 bp, D. melanogaster
cgaaagcacacac

SEQ ID NO: 610788 - DNA, 14 bp, D. melanogaster
cgaaagcacacaca

SEQ ID NO: 610789 - DNA, 13 bp, D. melanogaster
cgaaagcactggc

SEQ ID NO: 610790 - DNA, 13 bp, D. melanogaster
cgaaagcattttg

SEQ ID NO: 610791 - DNA, 13 bp, D. melanogaster
cgaaagccaaaag

SEQ ID NO: 610792 - DNA, 13 bp, D. melanogaster
cgaaagccaaaca

SEQ ID NO: 610793 - DNA, 13 bp, D. melanogaster
cgaaagccacgga

SEQ ID NO: 610794 - DNA, 13 bp, D. melanogaster
cgaaagcgaaaat

SEQ ID NO: 610795 - DNA, 13 bp, D. melanogaster
cgaaagcgaaagg

SEQ ID NO: 610796 - DNA, 13 bp, D. melanogaster
cgaaagcgaaagt

SEQ ID NO: 610797 - DNA, 13 bp, D. melanogaster
cgaaagcgaaatt

SEQ ID NO: 610798 - DNA, 13 bp, D. melanogaster
cgaaagcgaacaa

SEQ ID NO: 610799 - DNA, 13 bp, D. melanogaster
cgaaagcgagaag

SEQ ID NO: 610800 - DNA, 13 bp, D. melanogaster
cgaaagctctaaa

SEQ ID NO: 610801 - DNA, 13 bp, D. melanogaster
cgaaagctggaaa

SEQ ID NO: 610802 - DNA, 13 bp, D. melanogaster
cgaaaggaacttg

SEQ ID NO: 610803 - DNA, 13 bp, D. melanogaster
cgaaaggacgaaa

SEQ ID NO: 610804 - DNA, 14 bp, D. melanogaster
cgaaaggcaaacaa

SEQ ID NO: 610805 - DNA, 13 bp, D. melanogaster
cgaaagtaataaa

SEQ ID NO: 610806 - DNA, 13 bp, D. melanogaster
cgaaagtaggcaa

SEQ ID NO: 610807 - DNA, 13 bp, D. melanogaster
cgaaagtcactaa

SEQ ID NO: 610808 - DNA, 13 bp, D. melanogaster
cgaaagtcatttg

SEQ ID NO: 610809 - DNA, 13 bp, D. melanogaster
cgaaagtgaaact

SEQ ID NO: 610810 - DNA, 13 bp, D. melanogaster
cgaaagtgaagaa

SEQ ID NO: 610811 - DNA, 13 bp, D. melanogaster
cgaaagtgggtgg

SEQ ID NO: 610812 - DNA, 13 bp, D. melanogaster
cgaaagtgtagga

SEQ ID NO: 610813 - DNA, 13 bp, D. melanogaster
cgaaagttgaaag

SEQ ID NO: 610814 - DNA, 13 bp, D. melanogaster
cgaaagtttttcc

SEQ ID NO: 610815 - DNA, 13 bp, D. melanogaster
cgaaataaataag

SEQ ID NO: 610816 - DNA, 14 bp, D. melanogaster
cgaaataaataagg

SEQ ID NO: 610817 - DNA, 13 bp, D. melanogaster
cgaaataaatggc

SEQ ID NO: 610818 - DNA, 14 bp, D. melanogaster
cgaaataaattaaa

SEQ ID NO: 610819 - DNA, 13 bp, D. melanogaster
cgaaataaccgct

SEQ ID NO: 610820 - DNA, 14 bp, D. melanogaster
cgaaataataaaat

SEQ ID NO: 610821 - DNA, 13 bp, D. melanogaster
cgaaatacaattt

SEQ ID NO: 610822 - DNA, 13 bp, D. melanogaster
cgaaatacgaaat

SEQ ID NO: 610823 - DNA, 13 bp, D. melanogaster
cgaaatattcaaa

SEQ ID NO: 610824 - DNA, 13 bp, D. melanogaster
cgaaatattttcg

SEQ ID NO: 610825 - DNA, 13 bp, D. melanogaster
cgaaatatttttt

SEQ ID NO: 610826 - DNA, 13 bp, D. melanogaster
cgaaatcaaaaca

SEQ ID NO: 610827 - DNA, 13 bp, D. melanogaster
cgaaatcaaaagt

SEQ ID NO: 610828 - DNA, 13 bp, D. melanogaster
cgaaatcaaactt

SEQ ID NO: 610829 - DNA, 13 bp, D. melanogaster
cgaaatcaaagcg

SEQ ID NO: 610830 - DNA, 13 bp, D. melanogaster
cgaaatcaaatcg

SEQ ID NO: 610831 - DNA, 13 bp, D. melanogaster
cgaaatcaagaag

SEQ ID NO: 610832 - DNA, 13 bp, D. melanogaster
cgaaatcaatcaa

SEQ ID NO: 610833 - DNA, 14 bp, D. melanogaster
cgaaatcaatcaaa

SEQ ID NO: 610834 - DNA, 13 bp, D. melanogaster
cgaaatcaattga

SEQ ID NO: 610835 - DNA, 13 bp, D. melanogaster
cgaaatcaatttg

SEQ ID NO: 610836 - DNA, 13 bp, D. melanogaster
cgaaatcaatttt

SEQ ID NO: 610837 - DNA, 13 bp, D. melanogaster
cgaaatcagtttt

SEQ ID NO: 610838 - DNA, 13 bp, D. melanogaster
cgaaatccgaaat

SEQ ID NO: 610839 - DNA, 13 bp, D. melanogaster
cgaaatcgaaaac

SEQ ID NO: 610840 - DNA, 13 bp, D. melanogaster
cgaaatcgaaaat

SEQ ID NO: 610841 - DNA, 13 bp, D. melanogaster
cgaaatcgaaatc

SEQ ID NO: 610842 - DNA, 14 bp, D. melanogaster
cgaaatcgaaatca

SEQ ID NO: 610843 - DNA, 13 bp, D. melanogaster
cgaaatcgaaatg

SEQ ID NO: 610844 - DNA, 13 bp, D. melanogaster
cgaaatcgaaatt

SEQ ID NO: 610845 - DNA, 14 bp, D. melanogaster
cgaaatcgaaattg

SEQ ID NO: 610846 - DNA, 13 bp, D. melanogaster
cgaaatcgaatcg

SEQ ID NO: 610847 - DNA, 13 bp, D. melanogaster
cgaaatcgagcgg

SEQ ID NO: 610848 - DNA, 13 bp, D. melanogaster
cgaaatcgggaga

SEQ ID NO: 610849 - DNA, 13 bp, D. melanogaster
cgaaatgaaaaca

SEQ ID NO: 610850 - DNA, 14 bp, D. melanogaster
cgaaatgaaaacga

SEQ ID NO: 610851 - DNA, 13 bp, D. melanogaster
cgaaatgaaaagc

SEQ ID NO: 610852 - DNA, 13 bp, D. melanogaster
cgaaatgaaaata

SEQ ID NO: 610853 - DNA, 13 bp, D. melanogaster
cgaaatgaaacaa

SEQ ID NO: 610854 - DNA, 13 bp, D. melanogaster
cgaaatgaaagaa

SEQ ID NO: 610855 - DNA, 13 bp, D. melanogaster
cgaaatgaaagca

SEQ ID NO: 610856 - DNA, 13 bp, D. melanogaster
cgaaatgaaaggc

SEQ ID NO: 610857 - DNA, 13 bp, D. melanogaster
cgaaatgaaattg

SEQ ID NO: 610858 - DNA, 13 bp, D. melanogaster
cgaaatgaacgtc

SEQ ID NO: 610859 - DNA, 13 bp, D. melanogaster
cgaaatgaagatc

SEQ ID NO: 610860 - DNA, 13 bp, D. melanogaster
cgaaatgaataat

SEQ ID NO: 610861 - DNA, 13 bp, D. melanogaster
cgaaatgaatttg

SEQ ID NO: 610862 - DNA, 13 bp, D. melanogaster
cgaaatgagaaat

SEQ ID NO: 610863 - DNA, 13 bp, D. melanogaster
cgaaatgcaaaaa

SEQ ID NO: 610864 - DNA, 13 bp, D. melanogaster
cgaaatgcaaaat

SEQ ID NO: 610865 - DNA, 13 bp, D. melanogaster
cgaaatgcaaaca

SEQ ID NO: 610866 - DNA, 13 bp, D. melanogaster
cgaaatgcaaatg

SEQ ID NO: 610867 - DNA, 13 bp, D. melanogaster
cgaaatgcaatta

SEQ ID NO: 610868 - DNA, 13 bp, D. melanogaster
cgaaatgccatac

SEQ ID NO: 610869 - DNA, 13 bp, D. melanogaster
cgaaatgcccaat

SEQ ID NO: 610870 - DNA, 13 bp, D. melanogaster
cgaaatgcgaaag

SEQ ID NO: 610871 - DNA, 13 bp, D. melanogaster
cgaaatgcggaaa

SEQ ID NO: 610872 - DNA, 13 bp, D. melanogaster
cgaaatggaaaag

SEQ ID NO: 610873 - DNA, 13 bp, D. melanogaster
cgaaatggaaaat

SEQ ID NO: 610874 - DNA, 13 bp, D. melanogaster
cgaaatggaaagc

SEQ ID NO: 610875 - DNA, 13 bp, D. melanogaster
cgaaatggaaatg

SEQ ID NO: 610876 - DNA, 14 bp, D. melanogaster
cgaaatggaaatga

SEQ ID NO: 610877 - DNA, 14 bp, D. melanogaster
cgaaatggaaatgg

SEQ ID NO: 610878 - DNA, 13 bp, D. melanogaster
cgaaatggctagc

SEQ ID NO: 610879 - DNA, 13 bp, D. melanogaster
cgaaatgggaatg

SEQ ID NO: 610880 - DNA, 13 bp, D. melanogaster
cgaaatggggaaa

SEQ ID NO: 610881 - DNA, 13 bp, D. melanogaster
cgaaatgggggaa

SEQ ID NO: 610882 - DNA, 13 bp, D. melanogaster
cgaaatgtaaaca

SEQ ID NO: 610883 - DNA, 13 bp, D. melanogaster
cgaaatgtaaata

SEQ ID NO: 610884 - DNA, 13 bp, D. melanogaster
cgaaatgtatttt

SEQ ID NO: 610885 - DNA, 13 bp, D. melanogaster
cgaaatgtccttg

SEQ ID NO: 610886 - DNA, 13 bp, D. melanogaster
cgaaatgtgaaat

SEQ ID NO: 610887 - DNA, 13 bp, D. melanogaster
cgaaatgtttgtt

SEQ ID NO: 610888 - DNA, 13 bp, D. melanogaster
cgaaatgttttta

SEQ ID NO: 610889 - DNA, 13 bp, D. melanogaster
cgaaattaaaaac

SEQ ID NO: 610890 - DNA, 13 bp, D. melanogaster
cgaaattaaatga

SEQ ID NO: 610891 - DNA, 14 bp, D. melanogaster
cgaaattaaatgaa

SEQ ID NO: 610892 - DNA, 13 bp, D. melanogaster
cgaaattaactaa

SEQ ID NO: 610893 - DNA, 13 bp, D. melanogaster
cgaaattaatttg

SEQ ID NO: 610894 - DNA, 13 bp, D. melanogaster
cgaaattagcaat

SEQ ID NO: 610895 - DNA, 13 bp, D. melanogaster
cgaaattagtaat

SEQ ID NO: 610896 - DNA, 13 bp, D. melanogaster
cgaaattataaaa

SEQ ID NO: 610897 - DNA, 13 bp, D. melanogaster
cgaaattataaat

SEQ ID NO: 610898 - DNA, 13 bp, D. melanogaster
cgaaattatataa

SEQ ID NO: 610899 - DNA, 13 bp, D. melanogaster
cgaaattattaaa

SEQ ID NO: 610900 - DNA, 13 bp, D. melanogaster
cgaaattatttag

SEQ ID NO: 610901 - DNA, 13 bp, D. melanogaster
cgaaattattttg

SEQ ID NO: 610902 - DNA, 13 bp, D. melanogaster
cgaaattcaaata

SEQ ID NO: 610903 - DNA, 13 bp, D. melanogaster
cgaaattcattta

SEQ ID NO: 610904 - DNA, 13 bp, D. melanogaster
cgaaattcgaaaa

SEQ ID NO: 610905 - DNA, 13 bp, D. melanogaster
cgaaattcgaaat

SEQ ID NO: 610906 - DNA, 13 bp, D. melanogaster
cgaaattcttctt

SEQ ID NO: 610907 - DNA, 14 bp, D. melanogaster
cgaaattcttggca

SEQ ID NO: 610908 - DNA, 13 bp, D. melanogaster
cgaaattgaaaca

SEQ ID NO: 610909 - DNA, 13 bp, D. melanogaster
cgaaattgaaagc

SEQ ID NO: 610910 - DNA, 13 bp, D. melanogaster
cgaaattgatatt

SEQ ID NO: 610911 - DNA, 13 bp, D. melanogaster
cgaaattggaagc

SEQ ID NO: 610912 - DNA, 13 bp, D. melanogaster
cgaaattggccaa

SEQ ID NO: 610913 - DNA, 14 bp, D. melanogaster
cgaaattggccaac

SEQ ID NO: 610914 - DNA, 13 bp, D. melanogaster
cgaaattgtaaaa

SEQ ID NO: 610915 - DNA, 13 bp, D. melanogaster
cgaaattgtttaa

SEQ ID NO: 610916 - DNA, 14 bp, D. melanogaster
cgaaatttatattt

SEQ ID NO: 610917 - DNA, 13 bp, D. melanogaster
cgaaatttcatca

SEQ ID NO: 610918 - DNA, 14 bp, D. melanogaster
cgaaatttgcattt

SEQ ID NO: 610919 - DNA, 13 bp, D. melanogaster
cgaaatttgtcgc

SEQ ID NO: 610920 - DNA, 13 bp, D. melanogaster
cgaaattttttca

SEQ ID NO: 610921 - DNA, 13 bp, D. melanogaster
cgaacaaaaaatc

SEQ ID NO: 610922 - DNA, 13 bp, D. melanogaster
cgaacaaaatata

SEQ ID NO: 610923 - DNA, 13 bp, D. melanogaster
cgaacaaactttt

SEQ ID NO: 610924 - DNA, 13 bp, D. melanogaster
cgaacaagccact

SEQ ID NO: 610925 - DNA, 13 bp, D. melanogaster
cgaacaataacaa

SEQ ID NO: 610926 - DNA, 13 bp, D. melanogaster
cgaacagaacaga

SEQ ID NO: 610927 - DNA, 13 bp, D. melanogaster
cgaacagctcttt

SEQ ID NO: 610928 - DNA, 14 bp, D. melanogaster
cgaacagctctttt

SEQ ID NO: 610929 - DNA, 13 bp, D. melanogaster
cgaacagctgatt

SEQ ID NO: 610930 - DNA, 13 bp, D. melanogaster
cgaacataaatca

SEQ ID NO: 610931 - DNA, 13 bp, D. melanogaster
cgaaccaaaccga

SEQ ID NO: 610932 - DNA, 14 bp, D. melanogaster
cgaaccaaaccgaa

SEQ ID NO: 610933 - DNA, 13 bp, D. melanogaster
cgaaccaaactga

SEQ ID NO: 610934 - DNA, 13 bp, D. melanogaster
cgaaccaatggaa

SEQ ID NO: 610935 - DNA, 13 bp, D. melanogaster
cgaaccaccgaac

SEQ ID NO: 610936 - DNA, 13 bp, D. melanogaster
cgaaccattttat

SEQ ID NO: 610937 - DNA, 13 bp, D. melanogaster
cgaacccagcttc

SEQ ID NO: 610938 - DNA, 13 bp, D. melanogaster
cgaacccgaaccc

SEQ ID NO: 610939 - DNA, 13 bp, D. melanogaster
cgaaccgaaccca

SEQ ID NO: 610940 - DNA, 13 bp, D. melanogaster
cgaaccgaactga

SEQ ID NO: 610941 - DNA, 14 bp, D. melanogaster
cgaaccgaactgaa

SEQ ID NO: 610942 - DNA, 13 bp, D. melanogaster
cgaaccgaagaaa

SEQ ID NO: 610943 - DNA, 13 bp, D. melanogaster
cgaaccgaagccg

SEQ ID NO: 610944 - DNA, 13 bp, D. melanogaster
cgaaccgaatcga

SEQ ID NO: 610945 - DNA, 14 bp, D. melanogaster
cgaaccgaatcgaa

SEQ ID NO: 610946 - DNA, 13 bp, D. melanogaster
cgaaccgattacc

SEQ ID NO: 610947 - DNA, 13 bp, D. melanogaster
cgaacgaaacaca

SEQ ID NO: 610948 - DNA, 13 bp, D. melanogaster
cgaacgaaacgaa

SEQ ID NO: 610949 - DNA, 13 bp, D. melanogaster
cgaacgaaataaa

SEQ ID NO: 610950 - DNA, 13 bp, D. melanogaster
cgaacgaacgaaa

SEQ ID NO: 610951 - DNA, 13 bp, D. melanogaster
cgaacgaacgaac

SEQ ID NO: 610952 - DNA, 13 bp, D. melanogaster
cgaacgagaaatt

SEQ ID NO: 610953 - DNA, 13 bp, D. melanogaster
cgaacgcgaaatt

SEQ ID NO: 610954 - DNA, 13 bp, D. melanogaster
cgaacgcgttcac

SEQ ID NO: 610955 - DNA, 13 bp, D. melanogaster
cgaacggaacgga

SEQ ID NO: 610956 - DNA, 13 bp, D. melanogaster
cgaacggacacat

SEQ ID NO: 610957 - DNA, 13 bp, D. melanogaster
cgaacggacagac

SEQ ID NO: 610958 - DNA, 13 bp, D. melanogaster
cgaacggacggac

SEQ ID NO: 610959 - DNA, 13 bp, D. melanogaster
cgaacgtcacatt

SEQ ID NO: 610960 - DNA, 13 bp, D. melanogaster
cgaactatttaag

SEQ ID NO: 610961 - DNA, 14 bp, D. melanogaster
cgaactatttaagc

SEQ ID NO: 610962 - DNA, 13 bp, D. melanogaster
cgaactcacacac

SEQ ID NO: 610963 - DNA, 13 bp, D. melanogaster
cgaactgaaaatg

SEQ ID NO: 610964 - DNA, 13 bp, D. melanogaster
cgaactgcaaatg

SEQ ID NO: 610965 - DNA, 13 bp, D. melanogaster
cgaactgcatcta

SEQ ID NO: 610966 - DNA, 13 bp, D. melanogaster
cgaactgcattcc

SEQ ID NO: 610967 - DNA, 13 bp, D. melanogaster
cgaactggaaaaa

SEQ ID NO: 610968 - DNA, 13 bp, D. melanogaster
cgaactggccatg

SEQ ID NO: 610969 - DNA, 13 bp, D. melanogaster
cgaactgtattca

SEQ ID NO: 610970 - DNA, 13 bp, D. melanogaster
cgaacttgaattt

SEQ ID NO: 610971 - DNA, 13 bp, D. melanogaster
cgaactttgaact

SEQ ID NO: 610972 - DNA, 13 bp, D. melanogaster
cgaacttttaatg

SEQ ID NO: 610973 - DNA, 13 bp, D. melanogaster
cgaactttttcga

SEQ ID NO: 610974 - DNA, 13 bp, D. melanogaster
cgaacttttttga

SEQ ID NO: 610975 - DNA, 13 bp, D. melanogaster
cgaagaaaaatca

SEQ ID NO: 610976 - DNA, 13 bp, D. melanogaster
cgaagaaaaatct

SEQ ID NO: 610977 - DNA, 13 bp, D. melanogaster
cgaagaaaagcca

SEQ ID NO: 610978 - DNA, 13 bp, D. melanogaster
cgaagaaatgaaa

SEQ ID NO: 610979 - DNA, 13 bp, D. melanogaster
cgaagaagaaatt

SEQ ID NO: 610980 - DNA, 13 bp, D. melanogaster
cgaagaagatgtg

SEQ ID NO: 610981 - DNA, 13 bp, D. melanogaster
cgaagaagcggag

SEQ ID NO: 610982 - DNA, 13 bp, D. melanogaster
cgaagacaatcaa

SEQ ID NO: 610983 - DNA, 13 bp, D. melanogaster
cgaagaccttaag

SEQ ID NO: 610984 - DNA, 13 bp, D. melanogaster
cgaagagaccaac

SEQ ID NO: 610985 - DNA, 13 bp, D. melanogaster
cgaagagataact

SEQ ID NO: 610986 - DNA, 13 bp, D. melanogaster
cgaagagtcatca

SEQ ID NO: 610987 - DNA, 13 bp, D. melanogaster
cgaagagtgtgaa

SEQ ID NO: 610988 - DNA, 14 bp, D. melanogaster
cgaagagtgtgaaa

SEQ ID NO: 610989 - DNA, 13 bp, D. melanogaster
cgaagagttcgaa

SEQ ID NO: 610990 - DNA, 13 bp, D. melanogaster
cgaagatatttcc

SEQ ID NO: 610991 - DNA, 13 bp, D. melanogaster
cgaagattaatag

SEQ ID NO: 610992 - DNA, 13 bp, D. melanogaster
cgaagcaaaaact

SEQ ID NO: 610993 - DNA, 14 bp, D. melanogaster
cgaagcaaaaactg

SEQ ID NO: 610994 - DNA, 13 bp, D. melanogaster
cgaagcagtccta

SEQ ID NO: 610995 - DNA, 13 bp, D. melanogaster
cgaagccaaacaa

SEQ ID NO: 610996 - DNA, 14 bp, D. melanogaster
cgaagccacccaaa

SEQ ID NO: 610997 - DNA, 13 bp, D. melanogaster
cgaagcctttgct

SEQ ID NO: 610998 - DNA, 13 bp, D. melanogaster
cgaagcgaaacga

SEQ ID NO: 610999 - DNA, 13 bp, D. melanogaster
cgaaggacgaagg

SEQ ID NO: 611000 - DNA, 13 bp, D. melanogaster
cgaaggagcagca

SEQ ID NO: 611001 - DNA, 13 bp, D. melanogaster
cgaaggcaaaaag

SEQ ID NO: 611002 - DNA, 13 bp, D. melanogaster
cgaaggcaaacat

SEQ ID NO: 611003 - DNA, 13 bp, D. melanogaster
cgaaggccacaaa

SEQ ID NO: 611004 - DNA, 13 bp, D. melanogaster
cgaaggcgaaggc

SEQ ID NO: 611005 - DNA, 14 bp, D. melanogaster
cgaaggcgaaggcg

SEQ ID NO: 611006 - DNA, 13 bp, D. melanogaster
cgaagtagaaaat

SEQ ID NO: 611007 - DNA, 13 bp, D. melanogaster
cgaagtcaaaaat

SEQ ID NO: 611008 - DNA, 13 bp, D. melanogaster
cgaagtcacagaa

SEQ ID NO: 611009 - DNA, 13 bp, D. melanogaster
cgaagtcgaagtc

SEQ ID NO: 611010 - DNA, 13 bp, D. melanogaster
cgaagtcgatttg

SEQ ID NO: 611011 - DNA, 13 bp, D. melanogaster
cgaagtgatgaag

SEQ ID NO: 611012 - DNA, 13 bp, D. melanogaster
cgaagtgcggaca

SEQ ID NO: 611013 - DNA, 13 bp, D. melanogaster
cgaagtgggcgtg

SEQ ID NO: 611014 - DNA, 14 bp, D. melanogaster
cgaagttacaacta

SEQ ID NO: 611015 - DNA, 13 bp, D. melanogaster
cgaagttgaaaat

SEQ ID NO: 611016 - DNA, 13 bp, D. melanogaster
cgaataaaagtaa

SEQ ID NO: 611017 - DNA, 13 bp, D. melanogaster
cgaataaaatcaa

SEQ ID NO: 611018 - DNA, 13 bp, D. melanogaster
cgaataaaattta

SEQ ID NO: 611019 - DNA, 14 bp, D. melanogaster
cgaataaattatta

SEQ ID NO: 611020 - DNA, 13 bp, D. melanogaster
cgaataactgaat

SEQ ID NO: 611021 - DNA, 13 bp, D. melanogaster
cgaataataaata

SEQ ID NO: 611022 - DNA, 13 bp, D. melanogaster
cgaatacaaatac

SEQ ID NO: 611023 - DNA, 13 bp, D. melanogaster
cgaatacagcaac

SEQ ID NO: 611024 - DNA, 13 bp, D. melanogaster
cgaatacgaatac

SEQ ID NO: 611025 - DNA, 13 bp, D. melanogaster
cgaatacgaatcc

SEQ ID NO: 611026 - DNA, 14 bp, D. melanogaster
cgaatacgaatccg

SEQ ID NO: 611027 - DNA, 13 bp, D. melanogaster
cgaatataattaa

SEQ ID NO: 611028 - DNA, 13 bp, D. melanogaster
cgaatatagtata

SEQ ID NO: 611029 - DNA, 13 bp, D. melanogaster
cgaatatatacat

SEQ ID NO: 611030 - DNA, 13 bp, D. melanogaster
cgaatatatatat

SEQ ID NO: 611031 - DNA, 14 bp, D. melanogaster
cgaatatatttaaa

SEQ ID NO: 611032 - DNA, 13 bp, D. melanogaster
cgaatatctcaaa

SEQ ID NO: 611033 - DNA, 13 bp, D. melanogaster
cgaatatttaatt

SEQ ID NO: 611034 - DNA, 14 bp, D. melanogaster
cgaatcaaatcaaa

SEQ ID NO: 611035 - DNA, 14 bp, D. melanogaster
cgaatcaaatcgaa

SEQ ID NO: 611036 - DNA, 13 bp, D. melanogaster
cgaatcaattgaa

SEQ ID NO: 611037 - DNA, 13 bp, D. melanogaster
cgaatccaaatcg

SEQ ID NO: 611038 - DNA, 13 bp, D. melanogaster
cgaatccaatcca

SEQ ID NO: 611039 - DNA, 13 bp, D. melanogaster
cgaatccgaatca

SEQ ID NO: 611040 - DNA, 14 bp, D. melanogaster
cgaatccgaatccg

SEQ ID NO: 611041 - DNA, 14 bp, D. melanogaster
cgaatccgaatctg

SEQ ID NO: 611042 - DNA, 13 bp, D. melanogaster
cgaatccgaatgc

SEQ ID NO: 611043 - DNA, 13 bp, D. melanogaster
cgaatccgtatcc

SEQ ID NO: 611044 - DNA, 13 bp, D. melanogaster
cgaatcgaaaatt

SEQ ID NO: 611045 - DNA, 14 bp, D. melanogaster
cgaatcgaaacgaa

SEQ ID NO: 611046 - DNA, 13 bp, D. melanogaster
cgaatcgaaatca

SEQ ID NO: 611047 - DNA, 13 bp, D. melanogaster
cgaatcgaatcaa

SEQ ID NO: 611048 - DNA, 14 bp, D. melanogaster
cgaatcgaatcgaa

SEQ ID NO: 611049 - DNA, 14 bp, D. melanogaster
cgaatcgaatcgag

SEQ ID NO: 611050 - DNA, 14 bp, D. melanogaster
cgaatcgaatcgga

SEQ ID NO: 611051 - DNA, 13 bp, D. melanogaster
cgaatcgaatgga

SEQ ID NO: 611052 - DNA, 14 bp, D. melanogaster
cgaatcgaattgaa

SEQ ID NO: 611053 - DNA, 13 bp, D. melanogaster
cgaatcgagccgt

SEQ ID NO: 611054 - DNA, 13 bp, D. melanogaster
cgaatcgattcga

SEQ ID NO: 611055 - DNA, 13 bp, D. melanogaster
cgaatcgcctgac

SEQ ID NO: 611056 - DNA, 13 bp, D. melanogaster
cgaatctcggtca

SEQ ID NO: 611057 - DNA, 13 bp, D. melanogaster
cgaatgaaaaatg

SEQ ID NO: 611058 - DNA, 13 bp, D. melanogaster
cgaatgaaaatga

SEQ ID NO: 611059 - DNA, 13 bp, D. melanogaster
cgaatgagagtag

SEQ ID NO: 611060 - DNA, 13 bp, D. melanogaster
cgaatgcaaaata

SEQ ID NO: 611061 - DNA, 13 bp, D. melanogaster
cgaatgcaaacaa

SEQ ID NO: 611062 - DNA, 13 bp, D. melanogaster
cgaatgcaactgc

SEQ ID NO: 611063 - DNA, 13 bp, D. melanogaster
cgaatgcaataaa

SEQ ID NO: 611064 - DNA, 13 bp, D. melanogaster
cgaatgcatcatt

SEQ ID NO: 611065 - DNA, 13 bp, D. melanogaster
cgaatgcatttgc

SEQ ID NO: 611066 - DNA, 13 bp, D. melanogaster
cgaatgcattttg

SEQ ID NO: 611067 - DNA, 13 bp, D. melanogaster
cgaatgccaaaac

SEQ ID NO: 611068 - DNA, 13 bp, D. melanogaster
cgaatgccaaata

SEQ ID NO: 611069 - DNA, 13 bp, D. melanogaster
cgaatgccaaatg

SEQ ID NO: 611070 - DNA, 13 bp, D. melanogaster
cgaatgccatttg

SEQ ID NO: 611071 - DNA, 13 bp, D. melanogaster
cgaatgccgaatg

SEQ ID NO: 611072 - DNA, 13 bp, D. melanogaster
cgaatgcgaaaat

SEQ ID NO: 611073 - DNA, 14 bp, D. melanogaster
cgaatgcgaatgtg

SEQ ID NO: 611074 - DNA, 13 bp, D. melanogaster
cgaatgcggctgc

SEQ ID NO: 611075 - DNA, 14 bp, D. melanogaster
cgaatgctaaagct

SEQ ID NO: 611076 - DNA, 13 bp, D. melanogaster
cgaatgctgcgca

SEQ ID NO: 611077 - DNA, 13 bp, D. melanogaster
cgaatggaaaaaa

SEQ ID NO: 611078 - DNA, 13 bp, D. melanogaster
cgaatggaaaacg

SEQ ID NO: 611079 - DNA, 13 bp, D. melanogaster
cgaatggaaaatg

SEQ ID NO: 611080 - DNA, 14 bp, D. melanogaster
cgaatggaaaatgg

SEQ ID NO: 611081 - DNA, 14 bp, D. melanogaster
cgaatggaaatgga

SEQ ID NO: 611082 - DNA, 13 bp, D. melanogaster
cgaatggaacatt

SEQ ID NO: 611083 - DNA, 13 bp, D. melanogaster
cgaatggaatgga

SEQ ID NO: 611084 - DNA, 13 bp, D. melanogaster
cgaatggcaaacg

SEQ ID NO: 611085 - DNA, 13 bp, D. melanogaster
cgaatggcattca

SEQ ID NO: 611086 - DNA, 13 bp, D. melanogaster
cgaatggcatttg

SEQ ID NO: 611087 - DNA, 13 bp, D. melanogaster
cgaatggccaaat

SEQ ID NO: 611088 - DNA, 13 bp, D. melanogaster
cgaatgtcctggc

SEQ ID NO: 611089 - DNA, 13 bp, D. melanogaster
cgaatgtcgaatg

SEQ ID NO: 611090 - DNA, 13 bp, D. melanogaster
cgaatgtgtgtgt

SEQ ID NO: 611091 - DNA, 14 bp, D. melanogaster
cgaatgtgtgtgtg

SEQ ID NO: 611092 - DNA, 13 bp, D. melanogaster
cgaatgttaaaga

SEQ ID NO: 611093 - DNA, 13 bp, D. melanogaster
cgaatgttttatt

SEQ ID NO: 611094 - DNA, 13 bp, D. melanogaster
cgaattaaataaa

SEQ ID NO: 611095 - DNA, 13 bp, D. melanogaster
cgaattaaatgcg

SEQ ID NO: 611096 - DNA, 13 bp, D. melanogaster
cgaattaaattaa

SEQ ID NO: 611097 - DNA, 13 bp, D. melanogaster
cgaattaatagaa

SEQ ID NO: 611098 - DNA, 13 bp, D. melanogaster
cgaattaatattt

SEQ ID NO: 611099 - DNA, 13 bp, D. melanogaster
cgaattacttgaa

SEQ ID NO: 611100 - DNA, 13 bp, D. melanogaster
cgaattagacttt

SEQ ID NO: 611101 - DNA, 13 bp, D. melanogaster
cgaattagtgaaa

SEQ ID NO: 611102 - DNA, 14 bp, D. melanogaster
cgaattattattat

SEQ ID NO: 611103 - DNA, 13 bp, D. melanogaster
cgaattattcaaa

SEQ ID NO: 611104 - DNA, 13 bp, D. melanogaster
cgaattcaaaagt

SEQ ID NO: 611105 - DNA, 13 bp, D. melanogaster
cgaattcaaagaa

SEQ ID NO: 611106 - DNA, 13 bp, D. melanogaster
cgaattcaaattg

SEQ ID NO: 611107 - DNA, 13 bp, D. melanogaster
cgaattcaacgag

SEQ ID NO: 611108 - DNA, 13 bp, D. melanogaster
cgaattccacgga

SEQ ID NO: 611109 - DNA, 13 bp, D. melanogaster
cgaattcccattt

SEQ ID NO: 611110 - DNA, 13 bp, D. melanogaster
cgaattcgaattc

SEQ ID NO: 611111 - DNA, 14 bp, D. melanogaster
cgaattcgaattcg

SEQ ID NO: 611112 - DNA, 13 bp, D. melanogaster
cgaattcgatttc

SEQ ID NO: 611113 - DNA, 13 bp, D. melanogaster
cgaattcttgctt

SEQ ID NO: 611114 - DNA, 13 bp, D. melanogaster
cgaattgaatttt

SEQ ID NO: 611115 - DNA, 13 bp, D. melanogaster
cgaattgcatttt

SEQ ID NO: 611116 - DNA, 14 bp, D. melanogaster
cgaattgtttaaat

SEQ ID NO: 611117 - DNA, 13 bp, D. melanogaster
cgaatttaaaata

SEQ ID NO: 611118 - DNA, 13 bp, D. melanogaster
cgaatttaaataa

SEQ ID NO: 611119 - DNA, 13 bp, D. melanogaster
cgaatttacatat

SEQ ID NO: 611120 - DNA, 13 bp, D. melanogaster
cgaatttagaata

SEQ ID NO: 611121 - DNA, 13 bp, D. melanogaster
cgaatttatttat

SEQ ID NO: 611122 - DNA, 13 bp, D. melanogaster
cgaatttcaattt

SEQ ID NO: 611123 - DNA, 13 bp, D. melanogaster
cgaatttcacgca

SEQ ID NO: 611124 - DNA, 14 bp, D. melanogaster
cgaatttcacgcaa

SEQ ID NO: 611125 - DNA, 13 bp, D. melanogaster
cgaatttcgaaaa

SEQ ID NO: 611126 - DNA, 13 bp, D. melanogaster
cgaatttcgattt

SEQ ID NO: 611127 - DNA, 13 bp, D. melanogaster
cgaatttcggtca

SEQ ID NO: 611128 - DNA, 14 bp, D. melanogaster
cgaatttcggtcat

SEQ ID NO: 611129 - DNA, 13 bp, D. melanogaster
cgaatttgaattt

SEQ ID NO: 611130 - DNA, 13 bp, D. melanogaster
cgaatttgacaaa

SEQ ID NO: 611131 - DNA, 13 bp, D. melanogaster
cgaatttgtattt

SEQ ID NO: 611132 - DNA, 13 bp, D. melanogaster
cgaatttgtcagc

SEQ ID NO: 611133 - DNA, 14 bp, D. melanogaster
cgaattttaaatac

SEQ ID NO: 611134 - DNA, 13 bp, D. melanogaster
cgaattttgtata

SEQ ID NO: 611135 - DNA, 14 bp, D. melanogaster
cgaatttttaaaaa

SEQ ID NO: 611136 - DNA, 13 bp, D. melanogaster
cgaatttttcaac

SEQ ID NO: 611137 - DNA, 13 bp, D. melanogaster
cgaatttttgatt

SEQ ID NO: 611138 - DNA, 13 bp, D. melanogaster
cgaatttttgtta

SEQ ID NO: 611139 - DNA, 13 bp, D. melanogaster
cgaattttttaaa

SEQ ID NO: 611140 - DNA, 13 bp, D. melanogaster
cgacaaaaacccg

SEQ ID NO: 611141 - DNA, 13 bp, D. melanogaster
cgacaaaagtaaa

SEQ ID NO: 611142 - DNA, 14 bp, D. melanogaster
cgacaaacatccaa

SEQ ID NO: 611143 - DNA, 13 bp, D. melanogaster
cgacaaacgacaa

SEQ ID NO: 611144 - DNA, 13 bp, D. melanogaster
cgacaaacttgaa

SEQ ID NO: 611145 - DNA, 13 bp, D. melanogaster
cgacaaagcaaac

SEQ ID NO: 611146 - DNA, 13 bp, D. melanogaster
cgacaaatggcca

SEQ ID NO: 611147 - DNA, 13 bp, D. melanogaster
cgacaaattaaaa

SEQ ID NO: 611148 - DNA, 13 bp, D. melanogaster
cgacaaattcagc

SEQ ID NO: 611149 - DNA, 13 bp, D. melanogaster
cgacaacaacaag

SEQ ID NO: 611150 - DNA, 13 bp, D. melanogaster
cgacaacaacaat

SEQ ID NO: 611151 - DNA, 13 bp, D. melanogaster
cgacaacaacagc

SEQ ID NO: 611152 - DNA, 13 bp, D. melanogaster
cgacaacaacatc

SEQ ID NO: 611153 - DNA, 13 bp, D. melanogaster
cgacaacaataac

SEQ ID NO: 611154 - DNA, 14 bp, D. melanogaster
cgacaacaataaca

SEQ ID NO: 611155 - DNA, 13 bp, D. melanogaster
cgacaacaatggc

SEQ ID NO: 611156 - DNA, 13 bp, D. melanogaster
cgacaacagagga

SEQ ID NO: 611157 - DNA, 13 bp, D. melanogaster
cgacaacagcaac

SEQ ID NO: 611158 - DNA, 13 bp, D. melanogaster
cgacaacggcaac

SEQ ID NO: 611159 - DNA, 13 bp, D. melanogaster
cgacaactacttt

SEQ ID NO: 611160 - DNA, 13 bp, D. melanogaster
cgacaagaactgc

SEQ ID NO: 611161 - DNA, 13 bp, D. melanogaster
cgacaagtgcagc

SEQ ID NO: 611162 - DNA, 13 bp, D. melanogaster
cgacaatcagtca

SEQ ID NO: 611163 - DNA, 13 bp, D. melanogaster
cgacaatcttgga

SEQ ID NO: 611164 - DNA, 14 bp, D. melanogaster
cgacaatgagacga

SEQ ID NO: 611165 - DNA, 13 bp, D. melanogaster
cgacaatgccatc

SEQ ID NO: 611166 - DNA, 13 bp, D. melanogaster
cgacaatttactg

SEQ ID NO: 611167 - DNA, 13 bp, D. melanogaster
cgacaccaccctc

SEQ ID NO: 611168 - DNA, 13 bp, D. melanogaster
cgacaccagccac

SEQ ID NO: 611169 - DNA, 13 bp, D. melanogaster
cgacacgcacaca

SEQ ID NO: 611170 - DNA, 13 bp, D. melanogaster
cgacagacaaaag

SEQ ID NO: 611171 - DNA, 13 bp, D. melanogaster
cgacagaggaagc

SEQ ID NO: 611172 - DNA, 13 bp, D. melanogaster
cgacagcaacaaa

SEQ ID NO: 611173 - DNA, 13 bp, D. melanogaster
cgacagcagcaac

SEQ ID NO: 611174 - DNA, 14 bp, D. melanogaster
cgacagcagcaaca

SEQ ID NO: 611175 - DNA, 13 bp, D. melanogaster
cgacagcagctgc

SEQ ID NO: 611176 - DNA, 13 bp, D. melanogaster
cgacagccacaaa

SEQ ID NO: 611177 - DNA, 13 bp, D. melanogaster
cgacagcgacgcc

SEQ ID NO: 611178 - DNA, 13 bp, D. melanogaster
cgacagcggcagc

SEQ ID NO: 611179 - DNA, 14 bp, D. melanogaster
cgacagtgtggagg

SEQ ID NO: 611180 - DNA, 13 bp, D. melanogaster
cgacagtttgaaa

SEQ ID NO: 611181 - DNA, 14 bp, D. melanogaster
cgacagtttgaaag

SEQ ID NO: 611182 - DNA, 13 bp, D. melanogaster
cgacataatgtgg

SEQ ID NO: 611183 - DNA, 13 bp, D. melanogaster
cgacatagtaaat

SEQ ID NO: 611184 - DNA, 13 bp, D. melanogaster
cgacatatacata

SEQ ID NO: 611185 - DNA, 13 bp, D. melanogaster
cgacatcatcatc

SEQ ID NO: 611186 - DNA, 13 bp, D. melanogaster
cgacatcgacatc

SEQ ID NO: 611187 - DNA, 14 bp, D. melanogaster
cgacatcgacatcg

SEQ ID NO: 611188 - DNA, 13 bp, D. melanogaster
cgacattacggcg

SEQ ID NO: 611189 - DNA, 13 bp, D. melanogaster
cgacattatttac

SEQ ID NO: 611190 - DNA, 14 bp, D. melanogaster
cgacatttcagctt

SEQ ID NO: 611191 - DNA, 13 bp, D. melanogaster
cgacattttggcc

SEQ ID NO: 611192 - DNA, 13 bp, D. melanogaster
cgaccaaatccct

SEQ ID NO: 611193 - DNA, 14 bp, D. melanogaster
cgaccaataaaatt

SEQ ID NO: 611194 - DNA, 13 bp, D. melanogaster
cgaccaattagtc

SEQ ID NO: 611195 - DNA, 14 bp, D. melanogaster
cgaccacgcccact

SEQ ID NO: 611196 - DNA, 14 bp, D. melanogaster
cgaccacgccccct

SEQ ID NO: 611197 - DNA, 13 bp, D. melanogaster
cgaccacgcccct

SEQ ID NO: 611198 - DNA, 13 bp, D. melanogaster
cgaccactgtatc

SEQ ID NO: 611199 - DNA, 15 bp, D. melanogaster
cgaccagactacgtt

SEQ ID NO: 611200 - DNA, 15 bp, D. melanogaster
cgaccatcaccagtc

SEQ ID NO: 611201 - DNA, 13 bp, D. melanogaster
cgaccatcgacca

SEQ ID NO: 611202 - DNA, 13 bp, D. melanogaster
cgacccaatcctc

SEQ ID NO: 611203 - DNA, 13 bp, D. melanogaster
cgacccactgtgc

SEQ ID NO: 611204 - DNA, 13 bp, D. melanogaster
cgaccccgatttt

SEQ ID NO: 611205 - DNA, 13 bp, D. melanogaster
cgaccgaacaacc

SEQ ID NO: 611206 - DNA, 14 bp, D. melanogaster
cgaccgaccgacca

SEQ ID NO: 611207 - DNA, 13 bp, D. melanogaster
cgaccgttgctta

SEQ ID NO: 611208 - DNA, 13 bp, D. melanogaster
cgacctccaaaca

SEQ ID NO: 611209 - DNA, 13 bp, D. melanogaster
cgacctctgaccc

SEQ ID NO: 611210 - DNA, 13 bp, D. melanogaster
cgacctcttcaat

SEQ ID NO: 611211 - DNA, 13 bp, D. melanogaster
cgacgaaaactat

SEQ ID NO: 611212 - DNA, 13 bp, D. melanogaster
cgacgaacgaaac

SEQ ID NO: 611213 - DNA, 13 bp, D. melanogaster
cgacgacagcaac

SEQ ID NO: 611214 - DNA, 13 bp, D. melanogaster
cgacgacgacagc

SEQ ID NO: 611215 - DNA, 13 bp, D. melanogaster
cgacgacgacgac

SEQ ID NO: 611216 - DNA, 13 bp, D. melanogaster
cgacgacgacgat

SEQ ID NO: 611217 - DNA, 13 bp, D. melanogaster
cgacgacgacgcc

SEQ ID NO: 611218 - DNA, 14 bp, D. melanogaster
cgacgacgacggcg

SEQ ID NO: 611219 - DNA, 13 bp, D. melanogaster
cgacgacgactgc

SEQ ID NO: 611220 - DNA, 13 bp, D. melanogaster
cgacgacgatgac

SEQ ID NO: 611221 - DNA, 14 bp, D. melanogaster
cgacgacgatgacg

SEQ ID NO: 611222 - DNA, 13 bp, D. melanogaster
cgacgacggcgac

SEQ ID NO: 611223 - DNA, 13 bp, D. melanogaster
cgacgacttcttc

SEQ ID NO: 611224 - DNA, 13 bp, D. melanogaster
cgacgatcagcgc

SEQ ID NO: 611225 - DNA, 13 bp, D. melanogaster
cgacgatgatgat

SEQ ID NO: 611226 - DNA, 13 bp, D. melanogaster
cgacgcacacaca

SEQ ID NO: 611227 - DNA, 13 bp, D. melanogaster
cgacgccgactgc

SEQ ID NO: 611228 - DNA, 14 bp, D. melanogaster
cgacgccgactgcg

SEQ ID NO: 611229 - DNA, 14 bp, D. melanogaster
cgacgccggcagag

SEQ ID NO: 611230 - DNA, 14 bp, D. melanogaster
cgacgccggcagcg

SEQ ID NO: 611231 - DNA, 13 bp, D. melanogaster
cgacgcctgctgc

SEQ ID NO: 611232 - DNA, 13 bp, D. melanogaster
cgacggcgacgtc

SEQ ID NO: 611233 - DNA, 13 bp, D. melanogaster
cgacggcggcagc

SEQ ID NO: 611234 - DNA, 13 bp, D. melanogaster
cgacggcggcgca

SEQ ID NO: 611235 - DNA, 13 bp, D. melanogaster
cgacggctgcctt

SEQ ID NO: 611236 - DNA, 13 bp, D. melanogaster
cgacggttgttaa

SEQ ID NO: 611237 - DNA, 14 bp, D. melanogaster
cgacgtcgacagcg

SEQ ID NO: 611238 - DNA, 13 bp, D. melanogaster
cgacgtcgacgca

SEQ ID NO: 611239 - DNA, 13 bp, D. melanogaster
cgacgtcgacggc

SEQ ID NO: 611240 - DNA, 13 bp, D. melanogaster
cgacgtcgacgtc

SEQ ID NO: 611241 - DNA, 14 bp, D. melanogaster
cgacgtcgacgtcg

SEQ ID NO: 611242 - DNA, 13 bp, D. melanogaster
cgacgtcgactgc

SEQ ID NO: 611243 - DNA, 14 bp, D. melanogaster
cgacgtcgactgcg

SEQ ID NO: 611244 - DNA, 13 bp, D. melanogaster
cgacgtcgctgcc

SEQ ID NO: 611245 - DNA, 14 bp, D. melanogaster
cgacgtcgctgccg

SEQ ID NO: 611246 - DNA, 13 bp, D. melanogaster
cgacgtcgctgct

SEQ ID NO: 611247 - DNA, 13 bp, D. melanogaster
cgacgtcggcaga

SEQ ID NO: 611248 - DNA, 13 bp, D. melanogaster
cgacgtcggcagc

SEQ ID NO: 611249 - DNA, 14 bp, D. melanogaster
cgacgtcggcagcg

SEQ ID NO: 611250 - DNA, 13 bp, D. melanogaster
cgacgtctgctac

SEQ ID NO: 611251 - DNA, 13 bp, D. melanogaster
cgacgtgagcatg

SEQ ID NO: 611252 - DNA, 13 bp, D. melanogaster
cgacgtttgccat

SEQ ID NO: 611253 - DNA, 14 bp, D. melanogaster
cgacgtttgccatc

SEQ ID NO: 611254 - DNA, 13 bp, D. melanogaster
cgactacaacaac

SEQ ID NO: 611255 - DNA, 13 bp, D. melanogaster
cgactacagaaaa

SEQ ID NO: 611256 - DNA, 13 bp, D. melanogaster
cgactaccagata

SEQ ID NO: 611257 - DNA, 13 bp, D. melanogaster
cgactacgacgac

SEQ ID NO: 611258 - DNA, 14 bp, D. melanogaster
cgactatagcattt

SEQ ID NO: 611259 - DNA, 13 bp, D. melanogaster
cgactatagcgtt

SEQ ID NO: 611260 - DNA, 14 bp, D. melanogaster
cgactatcagatac

SEQ ID NO: 611261 - DNA, 14 bp, D. melanogaster
cgactattagatac

SEQ ID NO: 611262 - DNA, 13 bp, D. melanogaster
cgactcaactcga

SEQ ID NO: 611263 - DNA, 13 bp, D. melanogaster
cgactcccaccag

SEQ ID NO: 611264 - DNA, 13 bp, D. melanogaster
cgactccgactcc

SEQ ID NO: 611265 - DNA, 13 bp, D. melanogaster
cgactcgactatt

SEQ ID NO: 611266 - DNA, 13 bp, D. melanogaster
cgactcgattcga

SEQ ID NO: 611267 - DNA, 13 bp, D. melanogaster
cgactcgttttta

SEQ ID NO: 611268 - DNA, 13 bp, D. melanogaster
cgactctgcagtt

SEQ ID NO: 611269 - DNA, 14 bp, D. melanogaster
cgactgactgccgc

SEQ ID NO: 611270 - DNA, 14 bp, D. melanogaster
cgactgactttctt

SEQ ID NO: 611271 - DNA, 13 bp, D. melanogaster
cgactgcaactgc

SEQ ID NO: 611272 - DNA, 13 bp, D. melanogaster
cgactgcgactgc

SEQ ID NO: 611273 - DNA, 14 bp, D. melanogaster
cgactgcgactgcg

SEQ ID NO: 611274 - DNA, 13 bp, D. melanogaster
cgactgcgctgcc

SEQ ID NO: 611275 - DNA, 13 bp, D. melanogaster
cgactgcggcaga

SEQ ID NO: 611276 - DNA, 13 bp, D. melanogaster
cgactggtgatgg

SEQ ID NO: 611277 - DNA, 14 bp, D. melanogaster
cgactggtgatggt

SEQ ID NO: 611278 - DNA, 13 bp, D. melanogaster
cgactgtgtggtt

SEQ ID NO: 611279 - DNA, 13 bp, D. melanogaster
cgactgtttttgc

SEQ ID NO: 611280 - DNA, 13 bp, D. melanogaster
cgacttaatcaac

SEQ ID NO: 611281 - DNA, 13 bp, D. melanogaster
cgacttcaagttc

SEQ ID NO: 611282 - DNA, 13 bp, D. melanogaster
cgacttccccgac

SEQ ID NO: 611283 - DNA, 13 bp, D. melanogaster
cgacttcgacttc

SEQ ID NO: 611284 - DNA, 13 bp, D. melanogaster
cgacttctttagt

SEQ ID NO: 611285 - DNA, 13 bp, D. melanogaster
cgacttttccgac

SEQ ID NO: 611286 - DNA, 13 bp, D. melanogaster
cgacttttgttgt

SEQ ID NO: 611287 - DNA, 13 bp, D. melanogaster
cgactttttccat

SEQ ID NO: 611288 - DNA, 13 bp, D. melanogaster
cgagaaatgaaaa

SEQ ID NO: 611289 - DNA, 13 bp, D. melanogaster
cgagaacaaagta

SEQ ID NO: 611290 - DNA, 13 bp, D. melanogaster
cgagaacgagaac

SEQ ID NO: 611291 - DNA, 14 bp, D. melanogaster
cgagaagagcacaa

SEQ ID NO: 611292 - DNA, 13 bp, D. melanogaster
cgagaagcataca

SEQ ID NO: 611293 - DNA, 13 bp, D. melanogaster
cgagaagttgtac

SEQ ID NO: 611294 - DNA, 13 bp, D. melanogaster
cgagaatcgagaa

SEQ ID NO: 611295 - DNA, 13 bp, D. melanogaster
cgagacaaattgg

SEQ ID NO: 611296 - DNA, 13 bp, D. melanogaster
cgagacgagacga

SEQ ID NO: 611297 - DNA, 14 bp, D. melanogaster
cgagacgagacgag

SEQ ID NO: 611298 - DNA, 13 bp, D. melanogaster
cgagagagcgaga

SEQ ID NO: 611299 - DNA, 14 bp, D. melanogaster
cgagagagcgagag

SEQ ID NO: 611300 - DNA, 13 bp, D. melanogaster
cgagagagcggag

SEQ ID NO: 611301 - DNA, 13 bp, D. melanogaster
cgagagcatcaac

SEQ ID NO: 611302 - DNA, 13 bp, D. melanogaster
cgagagccgagcg

SEQ ID NO: 611303 - DNA, 13 bp, D. melanogaster
cgagagcgagaga

SEQ ID NO: 611304 - DNA, 14 bp, D. melanogaster
cgagagcgagagag

SEQ ID NO: 611305 - DNA, 13 bp, D. melanogaster
cgagagctgcctg

SEQ ID NO: 611306 - DNA, 13 bp, D. melanogaster
cgagagcttcaat

SEQ ID NO: 611307 - DNA, 13 bp, D. melanogaster
cgagaggcactca

SEQ ID NO: 611308 - DNA, 14 bp, D. melanogaster
cgagagtgtgtgtg

SEQ ID NO: 611309 - DNA, 13 bp, D. melanogaster
cgagatctcagga

SEQ ID NO: 611310 - DNA, 13 bp, D. melanogaster
cgagatggccaac

SEQ ID NO: 611311 - DNA, 13 bp, D. melanogaster
cgagattcgagat

SEQ ID NO: 611312 - DNA, 13 bp, D. melanogaster
cgagatttgcata

SEQ ID NO: 611313 - DNA, 14 bp, D. melanogaster
cgagcaacaacaac

SEQ ID NO: 611314 - DNA, 13 bp, D. melanogaster
cgagcaacagtat

SEQ ID NO: 611315 - DNA, 13 bp, D. melanogaster
cgagcaagaaaac

SEQ ID NO: 611316 - DNA, 13 bp, D. melanogaster
cgagcaatatcag

SEQ ID NO: 611317 - DNA, 13 bp, D. melanogaster
cgagcacacacac

SEQ ID NO: 611318 - DNA, 13 bp, D. melanogaster
cgagcagcaaaaa

SEQ ID NO: 611319 - DNA, 14 bp, D. melanogaster
cgagcagcagcagc

SEQ ID NO: 611320 - DNA, 13 bp, D. melanogaster
cgagcagtttgct

SEQ ID NO: 611321 - DNA, 14 bp, D. melanogaster
cgagcagtttgctt

SEQ ID NO: 611322 - DNA, 13 bp, D. melanogaster
cgagcatatgcta

SEQ ID NO: 611323 - DNA, 13 bp, D. melanogaster
cgagccaagccaa

SEQ ID NO: 611324 - DNA, 14 bp, D. melanogaster
cgagccatttcaaa

SEQ ID NO: 611325 - DNA, 13 bp, D. melanogaster
cgagcgaaaagcg

SEQ ID NO: 611326 - DNA, 13 bp, D. melanogaster
cgagcgaaagaga

SEQ ID NO: 611327 - DNA, 13 bp, D. melanogaster
cgagcgactgagt

SEQ ID NO: 611328 - DNA, 13 bp, D. melanogaster
cgagcgagacggc

SEQ ID NO: 611329 - DNA, 14 bp, D. melanogaster
cgagcgagcgagag

SEQ ID NO: 611330 - DNA, 13 bp, D. melanogaster
cgagcgtgcttaa

SEQ ID NO: 611331 - DNA, 13 bp, D. melanogaster
cgagctaaacata

SEQ ID NO: 611332 - DNA, 14 bp, D. melanogaster
cgagctcaacgagg

SEQ ID NO: 611333 - DNA, 13 bp, D. melanogaster
cgagctgagctga

SEQ ID NO: 611334 - DNA, 13 bp, D. melanogaster
cgagctggaaaaa

SEQ ID NO: 611335 - DNA, 13 bp, D. melanogaster
cgagctggcaaac

SEQ ID NO: 611336 - DNA, 14 bp, D. melanogaster
cgagctgtggggca

SEQ ID NO: 611337 - DNA, 13 bp, D. melanogaster
cgagctttttccg

SEQ ID NO: 611338 - DNA, 13 bp, D. melanogaster
cgaggaactgcaa

SEQ ID NO: 611339 - DNA, 14 bp, D. melanogaster
cgaggaagatagga

SEQ ID NO: 611340 - DNA, 13 bp, D. melanogaster
cgaggagcaggag

SEQ ID NO: 611341 - DNA, 13 bp, D. melanogaster
cgaggaggagagc

SEQ ID NO: 611342 - DNA, 13 bp, D. melanogaster
cgaggaggagcag

SEQ ID NO: 611343 - DNA, 14 bp, D. melanogaster
cgaggcacttaaaa

SEQ ID NO: 611344 - DNA, 13 bp, D. melanogaster
cgaggccaacttg

SEQ ID NO: 611345 - DNA, 13 bp, D. melanogaster
cgaggcgaggcga

SEQ ID NO: 611346 - DNA, 13 bp, D. melanogaster
cgaggcggcactc

SEQ ID NO: 611347 - DNA, 13 bp, D. melanogaster
cgaggcttatgcc

SEQ ID NO: 611348 - DNA, 13 bp, D. melanogaster
cgagggaaaacaa

SEQ ID NO: 611349 - DNA, 13 bp, D. melanogaster
cgagggcgtggca

SEQ ID NO: 611350 - DNA, 13 bp, D. melanogaster
cgaggggcaaaaa

SEQ ID NO: 611351 - DNA, 14 bp, D. melanogaster
cgagtaacgggtat

SEQ ID NO: 611352 - DNA, 13 bp, D. melanogaster
cgagtaactggaa

SEQ ID NO: 611353 - DNA, 13 bp, D. melanogaster
cgagtacaagagt

SEQ ID NO: 611354 - DNA, 13 bp, D. melanogaster
cgagtactttgca

SEQ ID NO: 611355 - DNA, 16 bp, D. melanogaster
cgagtactttgcacaa

SEQ ID NO: 611356 - DNA, 13 bp, D. melanogaster
cgagtatctgtat

SEQ ID NO: 611357 - DNA, 14 bp, D. melanogaster
cgagtatctgtatc

SEQ ID NO: 611358 - DNA, 13 bp, D. melanogaster
cgagtccatattg

SEQ ID NO: 611359 - DNA, 13 bp, D. melanogaster
cgagtccgagtcc

SEQ ID NO: 611360 - DNA, 14 bp, D. melanogaster
cgagtccgagtccg

SEQ ID NO: 611361 - DNA, 14 bp, D. melanogaster
cgagtcgaactggc

SEQ ID NO: 611362 - DNA, 13 bp, D. melanogaster
cgagtcgagtcga

SEQ ID NO: 611363 - DNA, 14 bp, D. melanogaster
cgagtcgagtcgag

SEQ ID NO: 611364 - DNA, 14 bp, D. melanogaster
cgagtcgatctgac

SEQ ID NO: 611365 - DNA, 13 bp, D. melanogaster
cgagtcgcagccg

SEQ ID NO: 611366 - DNA, 13 bp, D. melanogaster
cgagtgaaagaga

SEQ ID NO: 611367 - DNA, 13 bp, D. melanogaster
cgagtgaaataaa

SEQ ID NO: 611368 - DNA, 13 bp, D. melanogaster
cgagtgcaaaaag

SEQ ID NO: 611369 - DNA, 13 bp, D. melanogaster
cgagtgcaaaaga

SEQ ID NO: 611370 - DNA, 13 bp, D. melanogaster
cgagtgcaacaaa

SEQ ID NO: 611371 - DNA, 13 bp, D. melanogaster
cgagtgcacttgc

SEQ ID NO: 611372 - DNA, 13 bp, D. melanogaster
cgagtgccgagaa

SEQ ID NO: 611373 - DNA, 14 bp, D. melanogaster
cgagtgccgagaac

SEQ ID NO: 611374 - DNA, 13 bp, D. melanogaster
cgagtgccgagtg

SEQ ID NO: 611375 - DNA, 13 bp, D. melanogaster
cgagtgccgcctc

SEQ ID NO: 611376 - DNA, 13 bp, D. melanogaster
cgagtgcgagcga

SEQ ID NO: 611377 - DNA, 14 bp, D. melanogaster
cgagtgcgagtgcg

SEQ ID NO: 611378 - DNA, 13 bp, D. melanogaster
cgagtgcgagtgt

SEQ ID NO: 611379 - DNA, 13 bp, D. melanogaster
cgagtggaaaata

SEQ ID NO: 611380 - DNA, 13 bp, D. melanogaster
cgagtggcagcca

SEQ ID NO: 611381 - DNA, 13 bp, D. melanogaster
cgagtggcgagtg

SEQ ID NO: 611382 - DNA, 13 bp, D. melanogaster
cgagtggctaaag

SEQ ID NO: 611383 - DNA, 14 bp, D. melanogaster
cgagtgggcgtggc

SEQ ID NO: 611384 - DNA, 13 bp, D. melanogaster
cgagtgggtggca

SEQ ID NO: 611385 - DNA, 13 bp, D. melanogaster
cgagtgggtggct

SEQ ID NO: 611386 - DNA, 13 bp, D. melanogaster
cgagtgggtgggt

SEQ ID NO: 611387 - DNA, 13 bp, D. melanogaster
cgagtgggtggtg

SEQ ID NO: 611388 - DNA, 13 bp, D. melanogaster
cgagtggtctcgt

SEQ ID NO: 611389 - DNA, 13 bp, D. melanogaster
cgagtgtgcgagt

SEQ ID NO: 611390 - DNA, 13 bp, D. melanogaster
cgagtgtgtgagt

SEQ ID NO: 611391 - DNA, 13 bp, D. melanogaster
cgagtgtgtgtat

SEQ ID NO: 611392 - DNA, 13 bp, D. melanogaster
cgagtgtgtgtgc

SEQ ID NO: 611393 - DNA, 14 bp, D. melanogaster
cgagtgtgtgtgct

SEQ ID NO: 611394 - DNA, 14 bp, D. melanogaster
cgagtgtttgtgtg

SEQ ID NO: 611395 - DNA, 13 bp, D. melanogaster
cgagttcaaaaag

SEQ ID NO: 611396 - DNA, 13 bp, D. melanogaster
cgagttcctcgac

SEQ ID NO: 611397 - DNA, 13 bp, D. melanogaster
cgagttcgagtcc

SEQ ID NO: 611398 - DNA, 13 bp, D. melanogaster
cgagttcgttgcc

SEQ ID NO: 611399 - DNA, 13 bp, D. melanogaster
cgagtttaaattg

SEQ ID NO: 611400 - DNA, 13 bp, D. melanogaster
cgagtttcccgac

SEQ ID NO: 611401 - DNA, 14 bp, D. melanogaster
cgagtttcggcagg

SEQ ID NO: 611402 - DNA, 13 bp, D. melanogaster
cgagtttctcgac

SEQ ID NO: 611403 - DNA, 13 bp, D. melanogaster
cgataaaaacgtc

SEQ ID NO: 611404 - DNA, 14 bp, D. melanogaster
cgataaaaataaag

SEQ ID NO: 611405 - DNA, 13 bp, D. melanogaster
cgataaaaattta

SEQ ID NO: 611406 - DNA, 13 bp, D. melanogaster
cgataaagttttt

SEQ ID NO: 611407 - DNA, 13 bp, D. melanogaster
cgataacgataac

SEQ ID NO: 611408 - DNA, 13 bp, D. melanogaster
cgataacttcgat

SEQ ID NO: 611409 - DNA, 13 bp, D. melanogaster
cgataagaaattc

SEQ ID NO: 611410 - DNA, 13 bp, D. melanogaster
cgataataacctg

SEQ ID NO: 611411 - DNA, 13 bp, D. melanogaster
cgataataataat

SEQ ID NO: 611412 - DNA, 13 bp, D. melanogaster
cgataatatttgt

SEQ ID NO: 611413 - DNA, 13 bp, D. melanogaster
cgataatgatgat

SEQ ID NO: 611414 - DNA, 14 bp, D. melanogaster
cgataatgatgatg

SEQ ID NO: 611415 - DNA, 13 bp, D. melanogaster
cgataccgatacc

SEQ ID NO: 611416 - DNA, 14 bp, D. melanogaster
cgatacgatacgat

SEQ ID NO: 611417 - DNA, 14 bp, D. melanogaster
cgatacgatgcgat

SEQ ID NO: 611418 - DNA, 13 bp, D. melanogaster
cgatacgcagaaa

SEQ ID NO: 611419 - DNA, 13 bp, D. melanogaster
cgatagaaagata

SEQ ID NO: 611420 - DNA, 13 bp, D. melanogaster
cgatagagagaga

SEQ ID NO: 611421 - DNA, 14 bp, D. melanogaster
cgatagagagagag

SEQ ID NO: 611422 - DNA, 13 bp, D. melanogaster
cgatagtcaatta

SEQ ID NO: 611423 - DNA, 13 bp, D. melanogaster
cgatataaataaa

SEQ ID NO: 611424 - DNA, 13 bp, D. melanogaster
cgatatacatatg

SEQ ID NO: 611425 - DNA, 13 bp, D. melanogaster
cgatatacgatat

SEQ ID NO: 611426 - DNA, 13 bp, D. melanogaster
cgatatatgtata

SEQ ID NO: 611427 - DNA, 13 bp, D. melanogaster
cgatatcaacgga

SEQ ID NO: 611428 - DNA, 13 bp, D. melanogaster
cgatatctgaaac

SEQ ID NO: 611429 - DNA, 13 bp, D. melanogaster
cgatatgagccat

SEQ ID NO: 611430 - DNA, 13 bp, D. melanogaster
cgatatgtgtgca

SEQ ID NO: 611431 - DNA, 13 bp, D. melanogaster
cgatatgtttatt

SEQ ID NO: 611432 - DNA, 13 bp, D. melanogaster
cgatattggttct

SEQ ID NO: 611433 - DNA, 13 bp, D. melanogaster
cgatcaacccact

SEQ ID NO: 611434 - DNA, 13 bp, D. melanogaster
cgatcaccgattt

SEQ ID NO: 611435 - DNA, 13 bp, D. melanogaster
cgatcagcgccga

SEQ ID NO: 611436 - DNA, 13 bp, D. melanogaster
cgatcatatttaa

SEQ ID NO: 611437 - DNA, 14 bp, D. melanogaster
cgatcattttcatc

SEQ ID NO: 611438 - DNA, 13 bp, D. melanogaster
cgatccaatccaa

SEQ ID NO: 611439 - DNA, 13 bp, D. melanogaster
cgatccaatccga

SEQ ID NO: 611440 - DNA, 13 bp, D. melanogaster
cgatccaccgatc

SEQ ID NO: 611441 - DNA, 13 bp, D. melanogaster
cgatccatcgatc

SEQ ID NO: 611442 - DNA, 14 bp, D. melanogaster
cgatcccaatccca

SEQ ID NO: 611443 - DNA, 13 bp, D. melanogaster
cgatcccatccca

SEQ ID NO: 611444 - DNA, 13 bp, D. melanogaster
cgatcccatccga

SEQ ID NO: 611445 - DNA, 13 bp, D. melanogaster
cgatcccgaaatt

SEQ ID NO: 611446 - DNA, 13 bp, D. melanogaster
cgatcccgatccc

SEQ ID NO: 611447 - DNA, 14 bp, D. melanogaster
cgatcccgatccca

SEQ ID NO: 611448 - DNA, 13 bp, D. melanogaster
cgatcccgattcc

SEQ ID NO: 611449 - DNA, 13 bp, D. melanogaster
cgatccgaaccga

SEQ ID NO: 611450 - DNA, 13 bp, D. melanogaster
cgatccgatacga

SEQ ID NO: 611451 - DNA, 13 bp, D. melanogaster
cgatccgatccaa

SEQ ID NO: 611452 - DNA, 14 bp, D. melanogaster
cgatccgatccaat

SEQ ID NO: 611453 - DNA, 13 bp, D. melanogaster
cgatccgatccga

SEQ ID NO: 611454 - DNA, 13 bp, D. melanogaster
cgatccgatgcga

SEQ ID NO: 611455 - DNA, 13 bp, D. melanogaster
cgatccgattcga

SEQ ID NO: 611456 - DNA, 14 bp, D. melanogaster
cgatccgattcgat

SEQ ID NO: 611457 - DNA, 13 bp, D. melanogaster
cgatcgatcgatc

SEQ ID NO: 611458 - DNA, 14 bp, D. melanogaster
cgatcgatcgatca

SEQ ID NO: 611459 - DNA, 13 bp, D. melanogaster
cgatcgatcgatt

SEQ ID NO: 611460 - DNA, 14 bp, D. melanogaster
cgatcgatcgattg

SEQ ID NO: 611461 - DNA, 13 bp, D. melanogaster
cgatcgcaaggca

SEQ ID NO: 611462 - DNA, 13 bp, D. melanogaster
cgatcgcgatcgc

SEQ ID NO: 611463 - DNA, 13 bp, D. melanogaster
cgatcggtgctgc

SEQ ID NO: 611464 - DNA, 13 bp, D. melanogaster
cgatctcagccac

SEQ ID NO: 611465 - DNA, 13 bp, D. melanogaster
cgatctccgatct

SEQ ID NO: 611466 - DNA, 13 bp, D. melanogaster
cgatctcctttga

SEQ ID NO: 611467 - DNA, 13 bp, D. melanogaster
cgatctgaggact

SEQ ID NO: 611468 - DNA, 13 bp, D. melanogaster
cgatctgcgatct

SEQ ID NO: 611469 - DNA, 14 bp, D. melanogaster
cgatctggccatgt

SEQ ID NO: 611470 - DNA, 13 bp, D. melanogaster
cgatctggccctg

SEQ ID NO: 611471 - DNA, 13 bp, D. melanogaster
cgatctggtcatg

SEQ ID NO: 611472 - DNA, 13 bp, D. melanogaster
cgatcttcttcta

SEQ ID NO: 611473 - DNA, 13 bp, D. melanogaster
cgatgaaaatgaa

SEQ ID NO: 611474 - DNA, 13 bp, D. melanogaster
cgatgaaaccaat

SEQ ID NO: 611475 - DNA, 13 bp, D. melanogaster
cgatgaactgctg

SEQ ID NO: 611476 - DNA, 13 bp, D. melanogaster
cgatgaaggagtg

SEQ ID NO: 611477 - DNA, 13 bp, D. melanogaster
cgatgacgacaac

SEQ ID NO: 611478 - DNA, 13 bp, D. melanogaster
cgatgacgacgac

SEQ ID NO: 611479 - DNA, 14 bp, D. melanogaster
cgatgacgacgaca

SEQ ID NO: 611480 - DNA, 13 bp, D. melanogaster
cgatgacgaggca

SEQ ID NO: 611481 - DNA, 14 bp, D. melanogaster
cgatgacgaggcag

SEQ ID NO: 611482 - DNA, 13 bp, D. melanogaster
cgatgacgatgac

SEQ ID NO: 611483 - DNA, 13 bp, D. melanogaster
cgatgacgtgatg

SEQ ID NO: 611484 - DNA, 13 bp, D. melanogaster
cgatgataatgat

SEQ ID NO: 611485 - DNA, 14 bp, D. melanogaster
cgatgataatgatg

SEQ ID NO: 611486 - DNA, 13 bp, D. melanogaster
cgatgatgataat

SEQ ID NO: 611487 - DNA, 14 bp, D. melanogaster
cgatgatgataatg

SEQ ID NO: 611488 - DNA, 14 bp, D. melanogaster
cgatgatgatgatt

SEQ ID NO: 611489 - DNA, 13 bp, D. melanogaster
cgatgatgatggg

SEQ ID NO: 611490 - DNA, 14 bp, D. melanogaster
cgatgatgctgatg

SEQ ID NO: 611491 - DNA, 13 bp, D. melanogaster
cgatgatggtgat

SEQ ID NO: 611492 - DNA, 13 bp, D. melanogaster
cgatgatttgttt

SEQ ID NO: 611493 - DNA, 13 bp, D. melanogaster
cgatgcactgcgc

SEQ ID NO: 611494 - DNA, 13 bp, D. melanogaster
cgatgcagcaaac

SEQ ID NO: 611495 - DNA, 13 bp, D. melanogaster
cgatgccactttg

SEQ ID NO: 611496 - DNA, 13 bp, D. melanogaster
cgatgccgatgcc

SEQ ID NO: 611497 - DNA, 13 bp, D. melanogaster
cgatgcgatccga

SEQ ID NO: 611498 - DNA, 13 bp, D. melanogaster
cgatgcgatgcca

SEQ ID NO: 611499 - DNA, 13 bp, D. melanogaster
cgatgcgattcga

SEQ ID NO: 611500 - DNA, 13 bp, D. melanogaster
cgatgcggtttcc

SEQ ID NO: 611501 - DNA, 14 bp, D. melanogaster
cgatgcgttggcca

SEQ ID NO: 611502 - DNA, 13 bp, D. melanogaster
cgatgctgatgat

SEQ ID NO: 611503 - DNA, 13 bp, D. melanogaster
cgatgctgctgct

SEQ ID NO: 611504 - DNA, 13 bp, D. melanogaster
cgatggaaattta

SEQ ID NO: 611505 - DNA, 13 bp, D. melanogaster
cgatggaatctgt

SEQ ID NO: 611506 - DNA, 13 bp, D. melanogaster
cgatggacgatgg

SEQ ID NO: 611507 - DNA, 13 bp, D. melanogaster
cgatggcaaacaa

SEQ ID NO: 611508 - DNA, 13 bp, D. melanogaster
cgatggcaaatta

SEQ ID NO: 611509 - DNA, 13 bp, D. melanogaster
cgatggcattaag

SEQ ID NO: 611510 - DNA, 13 bp, D. melanogaster
cgatggccaaaac

SEQ ID NO: 611511 - DNA, 13 bp, D. melanogaster
cgatggccaaaag

SEQ ID NO: 611512 - DNA, 14 bp, D. melanogaster
cgatggcgatggca

SEQ ID NO: 611513 - DNA, 14 bp, D. melanogaster
cgatggcgatggct

SEQ ID NO: 611514 - DNA, 13 bp, D. melanogaster
cgatggcgatggg

SEQ ID NO: 611515 - DNA, 13 bp, D. melanogaster
cgatggcgtgatg

SEQ ID NO: 611516 - DNA, 13 bp, D. melanogaster
cgatgggcggtgg

SEQ ID NO: 611517 - DNA, 13 bp, D. melanogaster
cgatgggcgtggc

SEQ ID NO: 611518 - DNA, 14 bp, D. melanogaster
cgatgggcgtggca

SEQ ID NO: 611519 - DNA, 13 bp, D. melanogaster
cgatggtcgatgg

SEQ ID NO: 611520 - DNA, 13 bp, D. melanogaster
cgatggtgatgat

SEQ ID NO: 611521 - DNA, 14 bp, D. melanogaster
cgatggtgatgatg

SEQ ID NO: 611522 - DNA, 13 bp, D. melanogaster
cgatggtgttgtg

SEQ ID NO: 611523 - DNA, 14 bp, D. melanogaster
cgatgtcgatgtcg

SEQ ID NO: 611524 - DNA, 13 bp, D. melanogaster
cgatgtgaaaatg

SEQ ID NO: 611525 - DNA, 13 bp, D. melanogaster
cgatgtgatgctg

SEQ ID NO: 611526 - DNA, 13 bp, D. melanogaster
cgatgttgctgct

SEQ ID NO: 611527 - DNA, 13 bp, D. melanogaster
cgatgttgttgtt

SEQ ID NO: 611528 - DNA, 13 bp, D. melanogaster
cgattaatgttga

SEQ ID NO: 611529 - DNA, 13 bp, D. melanogaster
cgattacgattac

SEQ ID NO: 611530 - DNA, 13 bp, D. melanogaster
cgattatcgccaa

SEQ ID NO: 611531 - DNA, 13 bp, D. melanogaster
cgattattacaat

SEQ ID NO: 611532 - DNA, 13 bp, D. melanogaster
cgattattatgcc

SEQ ID NO: 611533 - DNA, 13 bp, D. melanogaster
cgattatttcgat

SEQ ID NO: 611534 - DNA, 13 bp, D. melanogaster
cgattatttgaag

SEQ ID NO: 611535 - DNA, 14 bp, D. melanogaster
cgattcaattcgat

SEQ ID NO: 611536 - DNA, 13 bp, D. melanogaster
cgattcataagcc

SEQ ID NO: 611537 - DNA, 13 bp, D. melanogaster
cgattccaattcc

SEQ ID NO: 611538 - DNA, 13 bp, D. melanogaster
cgattccagcttt

SEQ ID NO: 611539 - DNA, 13 bp, D. melanogaster
cgattcccaaatt

SEQ ID NO: 611540 - DNA, 13 bp, D. melanogaster
cgattcccattcc

SEQ ID NO: 611541 - DNA, 14 bp, D. melanogaster
cgattcccgattcc

SEQ ID NO: 611542 - DNA, 13 bp, D. melanogaster
cgattccgagtcc

SEQ ID NO: 611543 - DNA, 13 bp, D. melanogaster
cgattccgatccc

SEQ ID NO: 611544 - DNA, 13 bp, D. melanogaster
cgattccgatgcc

SEQ ID NO: 611545 - DNA, 13 bp, D. melanogaster
cgattccgattca

SEQ ID NO: 611546 - DNA, 14 bp, D. melanogaster
cgattccgattccc

SEQ ID NO: 611547 - DNA, 14 bp, D. melanogaster
cgattccgattctg

SEQ ID NO: 611548 - DNA, 13 bp, D. melanogaster
cgattcgaatcga

SEQ ID NO: 611549 - DNA, 14 bp, D. melanogaster
cgattcgattcaat

SEQ ID NO: 611550 - DNA, 13 bp, D. melanogaster
cgattcgattcca

SEQ ID NO: 611551 - DNA, 14 bp, D. melanogaster
cgattcgattcgat

SEQ ID NO: 611552 - DNA, 13 bp, D. melanogaster
cgattcgattcgg

SEQ ID NO: 611553 - DNA, 14 bp, D. melanogaster
cgattcgattcggt

SEQ ID NO: 611554 - DNA, 13 bp, D. melanogaster
cgattcgatttga

SEQ ID NO: 611555 - DNA, 13 bp, D. melanogaster
cgattcggatttg

SEQ ID NO: 611556 - DNA, 13 bp, D. melanogaster
cgattcggttcgg

SEQ ID NO: 611557 - DNA, 13 bp, D. melanogaster
cgattcggtttcg

SEQ ID NO: 611558 - DNA, 13 bp, D. melanogaster
cgattcgtttcga

SEQ ID NO: 611559 - DNA, 14 bp, D. melanogaster
cgattcgtttcgat

SEQ ID NO: 611560 - DNA, 13 bp, D. melanogaster
cgattctcgattc

SEQ ID NO: 611561 - DNA, 13 bp, D. melanogaster
cgattctgcccgc

SEQ ID NO: 611562 - DNA, 14 bp, D. melanogaster
cgattgattgattg

SEQ ID NO: 611563 - DNA, 13 bp, D. melanogaster
cgattgcagctgc

SEQ ID NO: 611564 - DNA, 13 bp, D. melanogaster
cgattgccatttg

SEQ ID NO: 611565 - DNA, 14 bp, D. melanogaster
cgattgccatttgg

SEQ ID NO: 611566 - DNA, 13 bp, D. melanogaster
cgattgcgattcc

SEQ ID NO: 611567 - DNA, 13 bp, D. melanogaster
cgattgcgattgc

SEQ ID NO: 611568 - DNA, 13 bp, D. melanogaster
cgattgctatata

SEQ ID NO: 611569 - DNA, 14 bp, D. melanogaster
cgattggaaattta

SEQ ID NO: 611570 - DNA, 13 bp, D. melanogaster
cgattgggattgg

SEQ ID NO: 611571 - DNA, 13 bp, D. melanogaster
cgattgtatttgc

SEQ ID NO: 611572 - DNA, 13 bp, D. melanogaster
cgattgttattcg

SEQ ID NO: 611573 - DNA, 14 bp, D. melanogaster
cgattgttatttaa

SEQ ID NO: 611574 - DNA, 13 bp, D. melanogaster
cgattgttgttgt

SEQ ID NO: 611575 - DNA, 13 bp, D. melanogaster
cgattgttttcga

SEQ ID NO: 611576 - DNA, 13 bp, D. melanogaster
cgatttaaatata

SEQ ID NO: 611577 - DNA, 13 bp, D. melanogaster
cgatttaaatcca

SEQ ID NO: 611578 - DNA, 13 bp, D. melanogaster
cgatttaatttga

SEQ ID NO: 611579 - DNA, 13 bp, D. melanogaster
cgatttatgtttg

SEQ ID NO: 611580 - DNA, 13 bp, D. melanogaster
cgatttattttgt

SEQ ID NO: 611581 - DNA, 13 bp, D. melanogaster
cgatttcaagcgg

SEQ ID NO: 611582 - DNA, 13 bp, D. melanogaster
cgatttcaatggc

SEQ ID NO: 611583 - DNA, 13 bp, D. melanogaster
cgatttcacgcac

SEQ ID NO: 611584 - DNA, 13 bp, D. melanogaster
cgatttcatcatc

SEQ ID NO: 611585 - DNA, 13 bp, D. melanogaster
cgatttcattatt

SEQ ID NO: 611586 - DNA, 13 bp, D. melanogaster
cgatttcattcaa

SEQ ID NO: 611587 - DNA, 13 bp, D. melanogaster
cgatttcattttc

SEQ ID NO: 611588 - DNA, 13 bp, D. melanogaster
cgatttccgacaa

SEQ ID NO: 611589 - DNA, 14 bp, D. melanogaster
cgatttccgacaat

SEQ ID NO: 611590 - DNA, 13 bp, D. melanogaster
cgatttccgattt

SEQ ID NO: 611591 - DNA, 13 bp, D. melanogaster
cgatttcgattcc

SEQ ID NO: 611592 - DNA, 13 bp, D. melanogaster
cgatttcgattcg

SEQ ID NO: 611593 - DNA, 14 bp, D. melanogaster
cgatttcgatttca

SEQ ID NO: 611594 - DNA, 13 bp, D. melanogaster
cgatttcgatttt

SEQ ID NO: 611595 - DNA, 14 bp, D. melanogaster
cgatttcgattttg

SEQ ID NO: 611596 - DNA, 13 bp, D. melanogaster
cgatttcgttttt

SEQ ID NO: 611597 - DNA, 13 bp, D. melanogaster
cgatttctgatga

SEQ ID NO: 611598 - DNA, 13 bp, D. melanogaster
cgatttctgtggc

SEQ ID NO: 611599 - DNA, 14 bp, D. melanogaster
cgatttctgtggcg

SEQ ID NO: 611600 - DNA, 13 bp, D. melanogaster
cgatttgatgaaa

SEQ ID NO: 611601 - DNA, 13 bp, D. melanogaster
cgatttgatttcg

SEQ ID NO: 611602 - DNA, 14 bp, D. melanogaster
cgatttgatttgat

SEQ ID NO: 611603 - DNA, 13 bp, D. melanogaster
cgatttgatttgg

SEQ ID NO: 611604 - DNA, 13 bp, D. melanogaster
cgatttgattttg

SEQ ID NO: 611605 - DNA, 13 bp, D. melanogaster
cgatttgcattcg

SEQ ID NO: 611606 - DNA, 14 bp, D. melanogaster
cgatttgcatttaa

SEQ ID NO: 611607 - DNA, 13 bp, D. melanogaster
cgatttgccaaaa

SEQ ID NO: 611608 - DNA, 13 bp, D. melanogaster
cgatttggattcg

SEQ ID NO: 611609 - DNA, 13 bp, D. melanogaster
cgatttggatttt

SEQ ID NO: 611610 - DNA, 13 bp, D. melanogaster
cgatttggccaaa

SEQ ID NO: 611611 - DNA, 13 bp, D. melanogaster
cgatttgggtttc

SEQ ID NO: 611612 - DNA, 14 bp, D. melanogaster
cgatttgggtttca

SEQ ID NO: 611613 - DNA, 13 bp, D. melanogaster
cgatttgtgggcg

SEQ ID NO: 611614 - DNA, 13 bp, D. melanogaster
cgatttgttgttg

SEQ ID NO: 611615 - DNA, 13 bp, D. melanogaster
cgatttgtttgct

SEQ ID NO: 611616 - DNA, 13 bp, D. melanogaster
cgatttgtttgtg

SEQ ID NO: 611617 - DNA, 13 bp, D. melanogaster
cgatttgtttgtt

SEQ ID NO: 611618 - DNA, 13 bp, D. melanogaster
cgattttaagcac

SEQ ID NO: 611619 - DNA, 13 bp, D. melanogaster
cgattttataaaa

SEQ ID NO: 611620 - DNA, 13 bp, D. melanogaster
cgattttcaaatg

SEQ ID NO: 611621 - DNA, 13 bp, D. melanogaster
cgattttcaatta

SEQ ID NO: 611622 - DNA, 13 bp, D. melanogaster
cgattttcatttt

SEQ ID NO: 611623 - DNA, 13 bp, D. melanogaster
cgattttccaccg

SEQ ID NO: 611624 - DNA, 13 bp, D. melanogaster
cgattttcccacc

SEQ ID NO: 611625 - DNA, 13 bp, D. melanogaster
cgattttcccagc

SEQ ID NO: 611626 - DNA, 13 bp, D. melanogaster
cgattttcctttt

SEQ ID NO: 611627 - DNA, 14 bp, D. melanogaster
cgattttccttttt

SEQ ID NO: 611628 - DNA, 13 bp, D. melanogaster
cgattttcgcatt

SEQ ID NO: 611629 - DNA, 13 bp, D. melanogaster
cgattttcttggg

SEQ ID NO: 611630 - DNA, 13 bp, D. melanogaster
cgattttgatttg

SEQ ID NO: 611631 - DNA, 13 bp, D. melanogaster
cgattttgcaatt

SEQ ID NO: 611632 - DNA, 13 bp, D. melanogaster
cgattttggccat

SEQ ID NO: 611633 - DNA, 13 bp, D. melanogaster
cgattttgtgcgg

SEQ ID NO: 611634 - DNA, 13 bp, D. melanogaster
cgattttgttatt

SEQ ID NO: 611635 - DNA, 13 bp, D. melanogaster
cgattttgttgct

SEQ ID NO: 611636 - DNA, 13 bp, D. melanogaster
cgattttgttgtt

SEQ ID NO: 611637 - DNA, 13 bp, D. melanogaster
cgatttttaaaat

SEQ ID NO: 611638 - DNA, 13 bp, D. melanogaster
cgatttttcaaaa

SEQ ID NO: 611639 - DNA, 13 bp, D. melanogaster
cgatttttcttct

SEQ ID NO: 611640 - DNA, 14 bp, D. melanogaster
cgattttttcaact

SEQ ID NO: 611641 - DNA, 13 bp, D. melanogaster
cgattttttcatc

SEQ ID NO: 611642 - DNA, 13 bp, D. melanogaster
cgattttttcgcc

SEQ ID NO: 611643 - DNA, 13 bp, D. melanogaster
cgcaaaaaatcaa

SEQ ID NO: 611644 - DNA, 13 bp, D. melanogaster
cgcaaaaagcaca

SEQ ID NO: 611645 - DNA, 13 bp, D. melanogaster
cgcaaaaagcagc

SEQ ID NO: 611646 - DNA, 13 bp, D. melanogaster
cgcaaaaagccaa

SEQ ID NO: 611647 - DNA, 13 bp, D. melanogaster
cgcaaaaagcgaa

SEQ ID NO: 611648 - DNA, 13 bp, D. melanogaster
cgcaaaacaaatt

SEQ ID NO: 611649 - DNA, 13 bp, D. melanogaster
cgcaaaactttca

SEQ ID NO: 611650 - DNA, 13 bp, D. melanogaster
cgcaaaacttttg

SEQ ID NO: 611651 - DNA, 13 bp, D. melanogaster
cgcaaaagaagat

SEQ ID NO: 611652 - DNA, 13 bp, D. melanogaster
cgcaaaagcaaca

SEQ ID NO: 611653 - DNA, 13 bp, D. melanogaster
cgcaaaagccaaa

SEQ ID NO: 611654 - DNA, 13 bp, D. melanogaster
cgcaaaataaaca

SEQ ID NO: 611655 - DNA, 13 bp, D. melanogaster
cgcaaaatatttg

SEQ ID NO: 611656 - DNA, 13 bp, D. melanogaster
cgcaaaatgcaaa

SEQ ID NO: 611657 - DNA, 13 bp, D. melanogaster
cgcaaaatggcaa

SEQ ID NO: 611658 - DNA, 13 bp, D. melanogaster
cgcaaaatgtcaa

SEQ ID NO: 611659 - DNA, 13 bp, D. melanogaster
cgcaaaattaatt

SEQ ID NO: 611660 - DNA, 14 bp, D. melanogaster
cgcaaacccaaatc

SEQ ID NO: 611661 - DNA, 13 bp, D. melanogaster
cgcaaacggtact

SEQ ID NO: 611662 - DNA, 13 bp, D. melanogaster
cgcaaactaaaaa

SEQ ID NO: 611663 - DNA, 13 bp, D. melanogaster
cgcaaactgcccc

SEQ ID NO: 611664 - DNA, 13 bp, D. melanogaster
cgcaaagggaaca

SEQ ID NO: 611665 - DNA, 14 bp, D. melanogaster
cgcaaagtatgcaa

SEQ ID NO: 611666 - DNA, 13 bp, D. melanogaster
cgcaaataaacaa

SEQ ID NO: 611667 - DNA, 13 bp, D. melanogaster
cgcaaataaattg

SEQ ID NO: 611668 - DNA, 13 bp, D. melanogaster
cgcaaatattttg

SEQ ID NO: 611669 - DNA, 13 bp, D. melanogaster
cgcaaatcccgct

SEQ ID NO: 611670 - DNA, 13 bp, D. melanogaster
cgcaaatgaaaat

SEQ ID NO: 611671 - DNA, 13 bp, D. melanogaster
cgcaaatgcaaaa

SEQ ID NO: 611672 - DNA, 13 bp, D. melanogaster
cgcaaatggaaat

SEQ ID NO: 611673 - DNA, 13 bp, D. melanogaster
cgcaaatggcgtt

SEQ ID NO: 611674 - DNA, 13 bp, D. melanogaster
cgcaaatgtgtgt

SEQ ID NO: 611675 - DNA, 13 bp, D. melanogaster
cgcaaatgtttgt

SEQ ID NO: 611676 - DNA, 14 bp, D. melanogaster
cgcaaatgtttgtg

SEQ ID NO: 611677 - DNA, 13 bp, D. melanogaster
cgcaaatgttttg

SEQ ID NO: 611678 - DNA, 13 bp, D. melanogaster
cgcaaattaaaag

SEQ ID NO: 611679 - DNA, 13 bp, D. melanogaster
cgcaaattatttt

SEQ ID NO: 611680 - DNA, 13 bp, D. melanogaster
cgcaaattcaatt

SEQ ID NO: 611681 - DNA, 13 bp, D. melanogaster
cgcaaattgcaat

SEQ ID NO: 611682 - DNA, 13 bp, D. melanogaster
cgcaacaaatatt

SEQ ID NO: 611683 - DNA, 13 bp, D. melanogaster
cgcaacaaatgaa

SEQ ID NO: 611684 - DNA, 14 bp, D. melanogaster
cgcaacaacagcaa

SEQ ID NO: 611685 - DNA, 13 bp, D. melanogaster
cgcaacaagcgac

SEQ ID NO: 611686 - DNA, 13 bp, D. melanogaster
cgcaacaataaca

SEQ ID NO: 611687 - DNA, 14 bp, D. melanogaster
cgcaacaataacaa

SEQ ID NO: 611688 - DNA, 13 bp, D. melanogaster
cgcaacatggtca

SEQ ID NO: 611689 - DNA, 13 bp, D. melanogaster
cgcaacgcaacgc

SEQ ID NO: 611690 - DNA, 14 bp, D. melanogaster
cgcaacgcaacgca

SEQ ID NO: 611691 - DNA, 13 bp, D. melanogaster
cgcaactggcgct

SEQ ID NO: 611692 - DNA, 14 bp, D. melanogaster
cgcaactggcgctg

SEQ ID NO: 611693 - DNA, 13 bp, D. melanogaster
cgcaagaaaacta

SEQ ID NO: 611694 - DNA, 13 bp, D. melanogaster
cgcaagaacaaca

SEQ ID NO: 611695 - DNA, 13 bp, D. melanogaster
cgcaagcacacac

SEQ ID NO: 611696 - DNA, 13 bp, D. melanogaster
cgcaagcgggagg

SEQ ID NO: 611697 - DNA, 13 bp, D. melanogaster
cgcaagtgtgtgt

SEQ ID NO: 611698 - DNA, 13 bp, D. melanogaster
cgcaagtttgttg

SEQ ID NO: 611699 - DNA, 13 bp, D. melanogaster
cgcaataaattaa

SEQ ID NO: 611700 - DNA, 13 bp, D. melanogaster
cgcaataacatcg

SEQ ID NO: 611701 - DNA, 13 bp, D. melanogaster
cgcaatccactca

SEQ ID NO: 611702 - DNA, 13 bp, D. melanogaster
cgcaatcgaagct

SEQ ID NO: 611703 - DNA, 13 bp, D. melanogaster
cgcaatgccgtgt

SEQ ID NO: 611704 - DNA, 13 bp, D. melanogaster
cgcaatggaaatg

SEQ ID NO: 611705 - DNA, 13 bp, D. melanogaster
cgcaattgaattt

SEQ ID NO: 611706 - DNA, 13 bp, D. melanogaster
cgcaattgttgtt

SEQ ID NO: 611707 - DNA, 13 bp, D. melanogaster
cgcaattttcttt

SEQ ID NO: 611708 - DNA, 13 bp, D. melanogaster
cgcaattttttta

SEQ ID NO: 611709 - DNA, 14 bp, D. melanogaster
cgcaatttttttat

SEQ ID NO: 611710 - DNA, 14 bp, D. melanogaster
cgcacaaaaaatag

SEQ ID NO: 611711 - DNA, 13 bp, D. melanogaster
cgcacaaaactgt

SEQ ID NO: 611712 - DNA, 13 bp, D. melanogaster
cgcacaaaatcgg

SEQ ID NO: 611713 - DNA, 13 bp, D. melanogaster
cgcacaaatattt

SEQ ID NO: 611714 - DNA, 13 bp, D. melanogaster
cgcacaaatttcc

SEQ ID NO: 611715 - DNA, 13 bp, D. melanogaster
cgcacacaaaatg

SEQ ID NO: 611716 - DNA, 13 bp, D. melanogaster
cgcacacaaacgc

SEQ ID NO: 611717 - DNA, 13 bp, D. melanogaster
cgcacacaaataa

SEQ ID NO: 611718 - DNA, 13 bp, D. melanogaster
cgcacacaaattg

SEQ ID NO: 611719 - DNA, 14 bp, D. melanogaster
cgcacacaagcaca

SEQ ID NO: 611720 - DNA, 13 bp, D. melanogaster
cgcacacaagcgc

SEQ ID NO: 611721 - DNA, 13 bp, D. melanogaster
cgcacacaatcgc

SEQ ID NO: 611722 - DNA, 13 bp, D. melanogaster
cgcacacacacat

SEQ ID NO: 611723 - DNA, 13 bp, D. melanogaster
cgcacacacacct

SEQ ID NO: 611724 - DNA, 14 bp, D. melanogaster
cgcacacacacgca

SEQ ID NO: 611725 - DNA, 13 bp, D. melanogaster
cgcacacacactc

SEQ ID NO: 611726 - DNA, 13 bp, D. melanogaster
cgcacacacactg

SEQ ID NO: 611727 - DNA, 13 bp, D. melanogaster
cgcacacacagaa

SEQ ID NO: 611728 - DNA, 13 bp, D. melanogaster
cgcacacacagac

SEQ ID NO: 611729 - DNA, 13 bp, D. melanogaster
cgcacacacatgc

SEQ ID NO: 611730 - DNA, 13 bp, D. melanogaster
cgcacacacgcac

SEQ ID NO: 611731 - DNA, 14 bp, D. melanogaster
cgcacacacgcaca

SEQ ID NO: 611732 - DNA, 13 bp, D. melanogaster
cgcacacacgcgc

SEQ ID NO: 611733 - DNA, 14 bp, D. melanogaster
cgcacacacgcgca

SEQ ID NO: 611734 - DNA, 13 bp, D. melanogaster
cgcacacacgctc

SEQ ID NO: 611735 - DNA, 13 bp, D. melanogaster
cgcacacactcac

SEQ ID NO: 611736 - DNA, 14 bp, D. melanogaster
cgcacacactcgca

SEQ ID NO: 611737 - DNA, 13 bp, D. melanogaster
cgcacacactggc

SEQ ID NO: 611738 - DNA, 14 bp, D. melanogaster
cgcacacacttaca

SEQ ID NO: 611739 - DNA, 13 bp, D. melanogaster
cgcacacagacag

SEQ ID NO: 611740 - DNA, 13 bp, D. melanogaster
cgcacacagacgc

SEQ ID NO: 611741 - DNA, 13 bp, D. melanogaster
cgcacacagatgc

SEQ ID NO: 611742 - DNA, 14 bp, D. melanogaster
cgcacacagatgca

SEQ ID NO: 611743 - DNA, 13 bp, D. melanogaster
cgcacacagctgc

SEQ ID NO: 611744 - DNA, 13 bp, D. melanogaster
cgcacacatgcaa

SEQ ID NO: 611745 - DNA, 13 bp, D. melanogaster
cgcacacatgcag

SEQ ID NO: 611746 - DNA, 13 bp, D. melanogaster
cgcacacgcacac

SEQ ID NO: 611747 - DNA, 14 bp, D. melanogaster
cgcacacgcacaca

SEQ ID NO: 611748 - DNA, 14 bp, D. melanogaster
cgcacacgcacact

SEQ ID NO: 611749 - DNA, 14 bp, D. melanogaster
cgcacacgcacgca

SEQ ID NO: 611750 - DNA, 13 bp, D. melanogaster
cgcacactcacac

SEQ ID NO: 611751 - DNA, 13 bp, D. melanogaster
cgcacactcactc

SEQ ID NO: 611752 - DNA, 13 bp, D. melanogaster
cgcacactcgcac

SEQ ID NO: 611753 - DNA, 13 bp, D. melanogaster
cgcacacttgcac

SEQ ID NO: 611754 - DNA, 13 bp, D. melanogaster
cgcacagacacac

SEQ ID NO: 611755 - DNA, 13 bp, D. melanogaster
cgcacagatacga

SEQ ID NO: 611756 - DNA, 13 bp, D. melanogaster
cgcacagcacgaa

SEQ ID NO: 611757 - DNA, 14 bp, D. melanogaster
cgcacagtttcgtg

SEQ ID NO: 611758 - DNA, 13 bp, D. melanogaster
cgcacataaattt

SEQ ID NO: 611759 - DNA, 13 bp, D. melanogaster
cgcacatacacac

SEQ ID NO: 611760 - DNA, 13 bp, D. melanogaster
cgcacatacatat

SEQ ID NO: 611761 - DNA, 13 bp, D. melanogaster
cgcacatattccc

SEQ ID NO: 611762 - DNA, 13 bp, D. melanogaster
cgcacatttcggt

SEQ ID NO: 611763 - DNA, 13 bp, D. melanogaster
cgcaccctctacg

SEQ ID NO: 611764 - DNA, 13 bp, D. melanogaster
cgcacgcacgcac

SEQ ID NO: 611765 - DNA, 13 bp, D. melanogaster
cgcactcacacac

SEQ ID NO: 611766 - DNA, 14 bp, D. melanogaster
cgcactcacacaca

SEQ ID NO: 611767 - DNA, 13 bp, D. melanogaster
cgcactcgactcc

SEQ ID NO: 611768 - DNA, 13 bp, D. melanogaster
cgcactgcaaact

SEQ ID NO: 611769 - DNA, 13 bp, D. melanogaster
cgcacttaattaa

SEQ ID NO: 611770 - DNA, 13 bp, D. melanogaster
cgcacttttaatt

SEQ ID NO: 611771 - DNA, 13 bp, D. melanogaster
cgcagaaaacgtg

SEQ ID NO: 611772 - DNA, 13 bp, D. melanogaster
cgcagaacaagca

SEQ ID NO: 611773 - DNA, 14 bp, D. melanogaster
cgcagaatcagcca

SEQ ID NO: 611774 - DNA, 13 bp, D. melanogaster
cgcagaatgagcc

SEQ ID NO: 611775 - DNA, 13 bp, D. melanogaster
cgcagacacacac

SEQ ID NO: 611776 - DNA, 13 bp, D. melanogaster
cgcagacatcgag

SEQ ID NO: 611777 - DNA, 13 bp, D. melanogaster
cgcagacgaagct

SEQ ID NO: 611778 - DNA, 13 bp, D. melanogaster
cgcagaggaaatt

SEQ ID NO: 611779 - DNA, 13 bp, D. melanogaster
cgcagatacaaag

SEQ ID NO: 611780 - DNA, 13 bp, D. melanogaster
cgcagatacagat

SEQ ID NO: 611781 - DNA, 13 bp, D. melanogaster
cgcagatactgaa

SEQ ID NO: 611782 - DNA, 13 bp, D. melanogaster
cgcagatgcagat

SEQ ID NO: 611783 - DNA, 13 bp, D. melanogaster
cgcagcaaatgaa

SEQ ID NO: 611784 - DNA, 13 bp, D. melanogaster
cgcagcaaatgct

SEQ ID NO: 611785 - DNA, 14 bp, D. melanogaster
cgcagcaaatgctg

SEQ ID NO: 611786 - DNA, 13 bp, D. melanogaster
cgcagcaacaaaa

SEQ ID NO: 611787 - DNA, 14 bp, D. melanogaster
cgcagcaacaacaa

SEQ ID NO: 611788 - DNA, 13 bp, D. melanogaster
cgcagcaacaata

SEQ ID NO: 611789 - DNA, 14 bp, D. melanogaster
cgcagcaacaataa

SEQ ID NO: 611790 - DNA, 13 bp, D. melanogaster
cgcagcacaaaaa

SEQ ID NO: 611791 - DNA, 13 bp, D. melanogaster
cgcagcacacaaa

SEQ ID NO: 611792 - DNA, 13 bp, D. melanogaster
cgcagcagaacga

SEQ ID NO: 611793 - DNA, 14 bp, D. melanogaster
cgcagcagcaacaa

SEQ ID NO: 611794 - DNA, 14 bp, D. melanogaster
cgcagcagcaacat

SEQ ID NO: 611795 - DNA, 15 bp, D. melanogaster
cgcagcagcaacatc

SEQ ID NO: 611796 - DNA, 14 bp, D. melanogaster
cgcagcagcagcaa

SEQ ID NO: 611797 - DNA, 13 bp, D. melanogaster
cgcagcagcagcc

SEQ ID NO: 611798 - DNA, 13 bp, D. melanogaster
cgcagcagcagcg

SEQ ID NO: 611799 - DNA, 13 bp, D. melanogaster
cgcagcagcggca

SEQ ID NO: 611800 - DNA, 14 bp, D. melanogaster
cgcagcagcggcag

SEQ ID NO: 611801 - DNA, 13 bp, D. melanogaster
cgcagcaggaaac

SEQ ID NO: 611802 - DNA, 13 bp, D. melanogaster
cgcagcaggagca

SEQ ID NO: 611803 - DNA, 13 bp, D. melanogaster
cgcagcatcagca

SEQ ID NO: 611804 - DNA, 13 bp, D. melanogaster
cgcagccaaaaaa

SEQ ID NO: 611805 - DNA, 14 bp, D. melanogaster
cgcagccactattc

SEQ ID NO: 611806 - DNA, 13 bp, D. melanogaster
cgcagccataaaa

SEQ ID NO: 611807 - DNA, 13 bp, D. melanogaster
cgcagccatcatc

SEQ ID NO: 611808 - DNA, 13 bp, D. melanogaster
cgcagccgcagca

SEQ ID NO: 611809 - DNA, 13 bp, D. melanogaster
cgcagcgcaaaaa

SEQ ID NO: 611810 - DNA, 13 bp, D. melanogaster
cgcagcgcaagtt

SEQ ID NO: 611811 - DNA, 13 bp, D. melanogaster
cgcagcgccaaac

SEQ ID NO: 611812 - DNA, 14 bp, D. melanogaster
cgcagcgccagttg

SEQ ID NO: 611813 - DNA, 13 bp, D. melanogaster
cgcagcggcagca

SEQ ID NO: 611814 - DNA, 13 bp, D. melanogaster
cgcagcgggaaaa

SEQ ID NO: 611815 - DNA, 13 bp, D. melanogaster
cgcagcgggtgac

SEQ ID NO: 611816 - DNA, 13 bp, D. melanogaster
cgcagcgtcgtta

SEQ ID NO: 611817 - DNA, 13 bp, D. melanogaster
cgcagctatattt

SEQ ID NO: 611818 - DNA, 13 bp, D. melanogaster
cgcagctcgcagc

SEQ ID NO: 611819 - DNA, 13 bp, D. melanogaster
cgcagctgcagca

SEQ ID NO: 611820 - DNA, 13 bp, D. melanogaster
cgcagctgcagtt

SEQ ID NO: 611821 - DNA, 13 bp, D. melanogaster
cgcagctggaaaa

SEQ ID NO: 611822 - DNA, 13 bp, D. melanogaster
cgcaggaaaagaa

SEQ ID NO: 611823 - DNA, 13 bp, D. melanogaster
cgcaggacgaagg

SEQ ID NO: 611824 - DNA, 14 bp, D. melanogaster
cgcaggacgaagga

SEQ ID NO: 611825 - DNA, 13 bp, D. melanogaster
cgcaggagaaaat

SEQ ID NO: 611826 - DNA, 13 bp, D. melanogaster
cgcaggcacacac

SEQ ID NO: 611827 - DNA, 13 bp, D. melanogaster
cgcaggcttacca

SEQ ID NO: 611828 - DNA, 13 bp, D. melanogaster
cgcagggcaacaa

SEQ ID NO: 611829 - DNA, 13 bp, D. melanogaster
cgcaggtgaaaaa

SEQ ID NO: 611830 - DNA, 13 bp, D. melanogaster
cgcagtcgacgtc

SEQ ID NO: 611831 - DNA, 14 bp, D. melanogaster
cgcagtcgacgtcg

SEQ ID NO: 611832 - DNA, 13 bp, D. melanogaster
cgcagtcgcagta

SEQ ID NO: 611833 - DNA, 14 bp, D. melanogaster
cgcagtcgcagtat

SEQ ID NO: 611834 - DNA, 13 bp, D. melanogaster
cgcagtcgcagtc

SEQ ID NO: 611835 - DNA, 14 bp, D. melanogaster
cgcagtcgcagtcg

SEQ ID NO: 611836 - DNA, 13 bp, D. melanogaster
cgcagtcggcgtc

SEQ ID NO: 611837 - DNA, 14 bp, D. melanogaster
cgcagtcggcgtcg

SEQ ID NO: 611838 - DNA, 13 bp, D. melanogaster
cgcagtgcaagtt

SEQ ID NO: 611839 - DNA, 14 bp, D. melanogaster
cgcagtgcatcgag

SEQ ID NO: 611840 - DNA, 13 bp, D. melanogaster
cgcagttactgca

SEQ ID NO: 611841 - DNA, 13 bp, D. melanogaster
cgcagttgttgtt

SEQ ID NO: 611842 - DNA, 13 bp, D. melanogaster
cgcataaaaacaa

SEQ ID NO: 611843 - DNA, 13 bp, D. melanogaster
cgcataaaaagca

SEQ ID NO: 611844 - DNA, 13 bp, D. melanogaster
cgcataaaattta

SEQ ID NO: 611845 - DNA, 13 bp, D. melanogaster
cgcataaaatttt

SEQ ID NO: 611846 - DNA, 13 bp, D. melanogaster
cgcataaatattt

SEQ ID NO: 611847 - DNA, 13 bp, D. melanogaster
cgcataacaataa

SEQ ID NO: 611848 - DNA, 13 bp, D. melanogaster
cgcataacagaca

SEQ ID NO: 611849 - DNA, 13 bp, D. melanogaster
cgcatacatatgc

SEQ ID NO: 611850 - DNA, 14 bp, D. melanogaster
cgcatacgacacgt

SEQ ID NO: 611851 - DNA, 14 bp, D. melanogaster
cgcatacgacgcgt

SEQ ID NO: 611852 - DNA, 13 bp, D. melanogaster
cgcatacgcaacg

SEQ ID NO: 611853 - DNA, 14 bp, D. melanogaster
cgcatacgcaacgt

SEQ ID NO: 611854 - DNA, 14 bp, D. melanogaster
cgcatacgcaatgt

SEQ ID NO: 611855 - DNA, 14 bp, D. melanogaster
cgcatacgcactgt

SEQ ID NO: 611856 - DNA, 13 bp, D. melanogaster
cgcatacgccaca

SEQ ID NO: 611857 - DNA, 13 bp, D. melanogaster
cgcatacgccacc

SEQ ID NO: 611858 - DNA, 14 bp, D. melanogaster
cgcatacgccacgt

SEQ ID NO: 611859 - DNA, 14 bp, D. melanogaster
cgcatacgccatgt

SEQ ID NO: 611860 - DNA, 13 bp, D. melanogaster
cgcatacgccccg

SEQ ID NO: 611861 - DNA, 14 bp, D. melanogaster
cgcatatatgtata

SEQ ID NO: 611862 - DNA, 13 bp, D. melanogaster
cgcatatgcaaat

SEQ ID NO: 611863 - DNA, 13 bp, D. melanogaster
cgcatatgtaaat

SEQ ID NO: 611864 - DNA, 13 bp, D. melanogaster
cgcatattttttt

SEQ ID NO: 611865 - DNA, 13 bp, D. melanogaster
cgcatcagaaaaa

SEQ ID NO: 611866 - DNA, 14 bp, D. melanogaster
cgcatcatcatcat

SEQ ID NO: 611867 - DNA, 13 bp, D. melanogaster
cgcatcatgtgga

SEQ ID NO: 611868 - DNA, 13 bp, D. melanogaster
cgcatccacatcc

SEQ ID NO: 611869 - DNA, 14 bp, D. melanogaster
cgcatccacatcca

SEQ ID NO: 611870 - DNA, 13 bp, D. melanogaster
cgcatccagaagt

SEQ ID NO: 611871 - DNA, 13 bp, D. melanogaster
cgcatccgcatcc

SEQ ID NO: 611872 - DNA, 13 bp, D. melanogaster
cgcatcctcatcc

SEQ ID NO: 611873 - DNA, 13 bp, D. melanogaster
cgcatcgacaaca

SEQ ID NO: 611874 - DNA, 13 bp, D. melanogaster
cgcatcggatcgg

SEQ ID NO: 611875 - DNA, 13 bp, D. melanogaster
cgcatctagctgg

SEQ ID NO: 611876 - DNA, 14 bp, D. melanogaster
cgcatctgtatctg

SEQ ID NO: 611877 - DNA, 13 bp, D. melanogaster
cgcatgaatattt

SEQ ID NO: 611878 - DNA, 13 bp, D. melanogaster
cgcatgcaaaatg

SEQ ID NO: 611879 - DNA, 13 bp, D. melanogaster
cgcatgcaacaga

SEQ ID NO: 611880 - DNA, 13 bp, D. melanogaster
cgcatgcgcagcc

SEQ ID NO: 611881 - DNA, 13 bp, D. melanogaster
cgcatgtacagca

SEQ ID NO: 611882 - DNA, 14 bp, D. melanogaster
cgcatgtacagcat

SEQ ID NO: 611883 - DNA, 13 bp, D. melanogaster
cgcatgtatgtat

SEQ ID NO: 611884 - DNA, 13 bp, D. melanogaster
cgcatgtgtgtgt

SEQ ID NO: 611885 - DNA, 14 bp, D. melanogaster
cgcatgtgtgtgtg

SEQ ID NO: 611886 - DNA, 13 bp, D. melanogaster
cgcattaaattca

SEQ ID NO: 611887 - DNA, 13 bp, D. melanogaster
cgcattaatgcgc

SEQ ID NO: 611888 - DNA, 13 bp, D. melanogaster
cgcattaattaaa

SEQ ID NO: 611889 - DNA, 13 bp, D. melanogaster
cgcattcacacta

SEQ ID NO: 611890 - DNA, 13 bp, D. melanogaster
cgcattcaggatg

SEQ ID NO: 611891 - DNA, 13 bp, D. melanogaster
cgcattcgcattg

SEQ ID NO: 611892 - DNA, 13 bp, D. melanogaster
cgcattcgcgact

SEQ ID NO: 611893 - DNA, 13 bp, D. melanogaster
cgcattgaaattt

SEQ ID NO: 611894 - DNA, 14 bp, D. melanogaster
cgcattgaaatttc

SEQ ID NO: 611895 - DNA, 14 bp, D. melanogaster
cgcattgatttaat

SEQ ID NO: 611896 - DNA, 13 bp, D. melanogaster
cgcattgtttgtt

SEQ ID NO: 611897 - DNA, 13 bp, D. melanogaster
cgcatttaattga

SEQ ID NO: 611898 - DNA, 13 bp, D. melanogaster
cgcatttaattgc

SEQ ID NO: 611899 - DNA, 13 bp, D. melanogaster
cgcatttaatttg

SEQ ID NO: 611900 - DNA, 13 bp, D. melanogaster
cgcatttatttca

SEQ ID NO: 611901 - DNA, 13 bp, D. melanogaster
cgcatttcaaggt

SEQ ID NO: 611902 - DNA, 13 bp, D. melanogaster
cgcatttccaatt

SEQ ID NO: 611903 - DNA, 13 bp, D. melanogaster
cgcatttccgctt

SEQ ID NO: 611904 - DNA, 13 bp, D. melanogaster
cgcatttcgcttt

SEQ ID NO: 611905 - DNA, 13 bp, D. melanogaster
cgcatttcgtttt

SEQ ID NO: 611906 - DNA, 13 bp, D. melanogaster
cgcatttgaactt

SEQ ID NO: 611907 - DNA, 13 bp, D. melanogaster
cgcatttgcataa

SEQ ID NO: 611908 - DNA, 13 bp, D. melanogaster
cgcattttagagg

SEQ ID NO: 611909 - DNA, 13 bp, D. melanogaster
cgcattttattta

SEQ ID NO: 611910 - DNA, 13 bp, D. melanogaster
cgcattttccctt

SEQ ID NO: 611911 - DNA, 13 bp, D. melanogaster
cgcattttccgct

SEQ ID NO: 611912 - DNA, 13 bp, D. melanogaster
cgcattttgtgtt

SEQ ID NO: 611913 - DNA, 13 bp, D. melanogaster
cgcatttttatgg

SEQ ID NO: 611914 - DNA, 14 bp, D. melanogaster
cgcatttttgttat

SEQ ID NO: 611915 - DNA, 13 bp, D. melanogaster
cgccaaaaacttt

SEQ ID NO: 611916 - DNA, 13 bp, D. melanogaster
cgccaaaagccaa

SEQ ID NO: 611917 - DNA, 13 bp, D. melanogaster
cgccaaacttttt

SEQ ID NO: 611918 - DNA, 13 bp, D. melanogaster
cgccaaatgcaat

SEQ ID NO: 611919 - DNA, 13 bp, D. melanogaster
cgccaaattcaaa

SEQ ID NO: 611920 - DNA, 13 bp, D. melanogaster
cgccaaattgaat

SEQ ID NO: 611921 - DNA, 13 bp, D. melanogaster
cgccaacaaaatt

SEQ ID NO: 611922 - DNA, 13 bp, D. melanogaster
cgccaaccgaaca

SEQ ID NO: 611923 - DNA, 13 bp, D. melanogaster
cgccaagtttttt

SEQ ID NO: 611924 - DNA, 13 bp, D. melanogaster
cgccaatagcata

SEQ ID NO: 611925 - DNA, 14 bp, D. melanogaster
cgccaattatgcca

SEQ ID NO: 611926 - DNA, 13 bp, D. melanogaster
cgccaccattttg

SEQ ID NO: 611927 - DNA, 13 bp, D. melanogaster
cgccacccacttt

SEQ ID NO: 611928 - DNA, 13 bp, D. melanogaster
cgccaccctttcc

SEQ ID NO: 611929 - DNA, 14 bp, D. melanogaster
cgccaccctttccc

SEQ ID NO: 611930 - DNA, 13 bp, D. melanogaster
cgccaccgcccgt

SEQ ID NO: 611931 - DNA, 13 bp, D. melanogaster
cgccacctggcgg

SEQ ID NO: 611932 - DNA, 13 bp, D. melanogaster
cgccacgcacatc

SEQ ID NO: 611933 - DNA, 13 bp, D. melanogaster
cgccacgcccact

SEQ ID NO: 611934 - DNA, 13 bp, D. melanogaster
cgccacgcccctt

SEQ ID NO: 611935 - DNA, 13 bp, D. melanogaster
cgccacgtcgccc

SEQ ID NO: 611936 - DNA, 13 bp, D. melanogaster
cgccacgttgcac

SEQ ID NO: 611937 - DNA, 13 bp, D. melanogaster
cgccactcgcact

SEQ ID NO: 611938 - DNA, 13 bp, D. melanogaster
cgccactctgcag

SEQ ID NO: 611939 - DNA, 13 bp, D. melanogaster
cgccacttgtttt

SEQ ID NO: 611940 - DNA, 13 bp, D. melanogaster
cgccagaagcatc

SEQ ID NO: 611941 - DNA, 13 bp, D. melanogaster
cgccagaggggat

SEQ ID NO: 611942 - DNA, 13 bp, D. melanogaster
cgccagcaacagc

SEQ ID NO: 611943 - DNA, 14 bp, D. melanogaster
cgccagcaacagca

SEQ ID NO: 611944 - DNA, 14 bp, D. melanogaster
cgccagcagcaaca

SEQ ID NO: 611945 - DNA, 13 bp, D. melanogaster
cgccagcagcgga

SEQ ID NO: 611946 - DNA, 13 bp, D. melanogaster
cgccagccagcca

SEQ ID NO: 611947 - DNA, 13 bp, D. melanogaster
cgccagccgcgtg

SEQ ID NO: 611948 - DNA, 13 bp, D. melanogaster
cgccagctgtgca

SEQ ID NO: 611949 - DNA, 14 bp, D. melanogaster
cgccagctgtgcag

SEQ ID NO: 611950 - DNA, 13 bp, D. melanogaster
cgccaggagcggc

SEQ ID NO: 611951 - DNA, 13 bp, D. melanogaster
cgccaggtggcgc

SEQ ID NO: 611952 - DNA, 13 bp, D. melanogaster
cgccagttgccag

SEQ ID NO: 611953 - DNA, 13 bp, D. melanogaster
cgccatattgtac

SEQ ID NO: 611954 - DNA, 14 bp, D. melanogaster
cgccatcagcaaca

SEQ ID NO: 611955 - DNA, 13 bp, D. melanogaster
cgccatcatcgtc

SEQ ID NO: 611956 - DNA, 13 bp, D. melanogaster
cgccatctccatc

SEQ ID NO: 611957 - DNA, 13 bp, D. melanogaster
cgccatctctttt

SEQ ID NO: 611958 - DNA, 13 bp, D. melanogaster
cgccatctgttgg

SEQ ID NO: 611959 - DNA, 13 bp, D. melanogaster
cgccatttaattt

SEQ ID NO: 611960 - DNA, 14 bp, D. melanogaster
cgccatttgccatt

SEQ ID NO: 611961 - DNA, 13 bp, D. melanogaster
cgccattttgctg

SEQ ID NO: 611962 - DNA, 13 bp, D. melanogaster
cgcccaaaaatat

SEQ ID NO: 611963 - DNA, 13 bp, D. melanogaster
cgcccaacaagtt

SEQ ID NO: 611964 - DNA, 13 bp, D. melanogaster
cgcccacaaaatg

SEQ ID NO: 611965 - DNA, 13 bp, D. melanogaster
cgcccacaaaccg

SEQ ID NO: 611966 - DNA, 13 bp, D. melanogaster
cgcccacaagcca

SEQ ID NO: 611967 - DNA, 13 bp, D. melanogaster
cgcccacaatttt

SEQ ID NO: 611968 - DNA, 13 bp, D. melanogaster
cgcccacactttg

SEQ ID NO: 611969 - DNA, 13 bp, D. melanogaster
cgcccacattttc

SEQ ID NO: 611970 - DNA, 13 bp, D. melanogaster
cgcccaccaagga

SEQ ID NO: 611971 - DNA, 14 bp, D. melanogaster
cgcccaccaaggag

SEQ ID NO: 611972 - DNA, 14 bp, D. melanogaster
cgcccaccaccact

SEQ ID NO: 611973 - DNA, 13 bp, D. melanogaster
cgcccaccgactg

SEQ ID NO: 611974 - DNA, 14 bp, D. melanogaster
cgcccaccgcccat

SEQ ID NO: 611975 - DNA, 13 bp, D. melanogaster
cgcccactgccac

SEQ ID NO: 611976 - DNA, 13 bp, D. melanogaster
cgcccactgccca

SEQ ID NO: 611977 - DNA, 13 bp, D. melanogaster
cgcccactggcca

SEQ ID NO: 611978 - DNA, 13 bp, D. melanogaster
cgcccactttaac

SEQ ID NO: 611979 - DNA, 13 bp, D. melanogaster
cgcccacttttca

SEQ ID NO: 611980 - DNA, 13 bp, D. melanogaster
cgcccacttttcc

SEQ ID NO: 611981 - DNA, 13 bp, D. melanogaster
cgcccacttttgc

SEQ ID NO: 611982 - DNA, 13 bp, D. melanogaster
cgcccagctgaca

SEQ ID NO: 611983 - DNA, 13 bp, D. melanogaster
cgcccatcgccca

SEQ ID NO: 611984 - DNA, 13 bp, D. melanogaster
cgcccatctgaat

SEQ ID NO: 611985 - DNA, 13 bp, D. melanogaster
cgcccatgccgag

SEQ ID NO: 611986 - DNA, 14 bp, D. melanogaster
cgccccactccatc

SEQ ID NO: 611987 - DNA, 13 bp, D. melanogaster
cgccccctttttg

SEQ ID NO: 611988 - DNA, 13 bp, D. melanogaster
cgcccctcggtcg

SEQ ID NO: 611989 - DNA, 13 bp, D. melanogaster
cgcccgaagagat

SEQ ID NO: 611990 - DNA, 13 bp, D. melanogaster
cgcccggtgtgcg

SEQ ID NO: 611991 - DNA, 13 bp, D. melanogaster
cgccctaaagccg

SEQ ID NO: 611992 - DNA, 14 bp, D. melanogaster
cgccgacgtcgacg

SEQ ID NO: 611993 - DNA, 13 bp, D. melanogaster
cgccgatctttaa

SEQ ID NO: 611994 - DNA, 13 bp, D. melanogaster
cgccgcaaagtat

SEQ ID NO: 611995 - DNA, 13 bp, D. melanogaster
cgccgcaagatga

SEQ ID NO: 611996 - DNA, 13 bp, D. melanogaster
cgccgcaaggcaa

SEQ ID NO: 611997 - DNA, 13 bp, D. melanogaster
cgccgcacacaca

SEQ ID NO: 611998 - DNA, 13 bp, D. melanogaster
cgccgccgtcgac

SEQ ID NO: 611999 - DNA, 13 bp, D. melanogaster
cgccgcgtcttcg

SEQ ID NO: 612000 - DNA, 13 bp, D. melanogaster
cgccgctcaagat

SEQ ID NO: 612001 - DNA, 14 bp, D. melanogaster
cgccgctgccgacg

SEQ ID NO: 612002 - DNA, 14 bp, D. melanogaster
cgccgctgctgctg

SEQ ID NO: 612003 - DNA, 13 bp, D. melanogaster
cgccgctgctgtt

SEQ ID NO: 612004 - DNA, 13 bp, D. melanogaster
cgccggaaacgga

SEQ ID NO: 612005 - DNA, 13 bp, D. melanogaster
cgccggagagcag

SEQ ID NO: 612006 - DNA, 14 bp, D. melanogaster
cgccggagagcagc

SEQ ID NO: 612007 - DNA, 13 bp, D. melanogaster
cgccgtcgacgtc

SEQ ID NO: 612008 - DNA, 14 bp, D. melanogaster
cgccgtcgacgtcg

SEQ ID NO: 612009 - DNA, 13 bp, D. melanogaster
cgccgtcgtcgtc

SEQ ID NO: 612010 - DNA, 14 bp, D. melanogaster
cgccgtcgtcgtcg

SEQ ID NO: 612011 - DNA, 13 bp, D. melanogaster
cgccgtcttggcc

SEQ ID NO: 612012 - DNA, 14 bp, D. melanogaster
cgccgtcttggccg

SEQ ID NO: 612013 - DNA, 14 bp, D. melanogaster
cgccgttgttgttg

SEQ ID NO: 612014 - DNA, 13 bp, D. melanogaster
cgcctccatttcc

SEQ ID NO: 612015 - DNA, 13 bp, D. melanogaster
cgcctgaaagtat

SEQ ID NO: 612016 - DNA, 13 bp, D. melanogaster
cgcctgctgcaat

SEQ ID NO: 612017 - DNA, 13 bp, D. melanogaster
cgcctgctgcgcc

SEQ ID NO: 612018 - DNA, 13 bp, D. melanogaster
cgcctggtaattt

SEQ ID NO: 612019 - DNA, 13 bp, D. melanogaster
cgccttcaaagtg

SEQ ID NO: 612020 - DNA, 14 bp, D. melanogaster
cgccttcgcaagca

SEQ ID NO: 612021 - DNA, 13 bp, D. melanogaster
cgccttcgccttc

SEQ ID NO: 612022 - DNA, 13 bp, D. melanogaster
cgccttcttcaat

SEQ ID NO: 612023 - DNA, 13 bp, D. melanogaster
cgccttgcagcca

SEQ ID NO: 612024 - DNA, 13 bp, D. melanogaster
cgccttgcttggc

SEQ ID NO: 612025 - DNA, 14 bp, D. melanogaster
cgccttgcttggcc

SEQ ID NO: 612026 - DNA, 13 bp, D. melanogaster
cgcctttccacca

SEQ ID NO: 612027 - DNA, 13 bp, D. melanogaster
cgccttttggcca

SEQ ID NO: 612028 - DNA, 13 bp, D. melanogaster
cgcgaaagagacg

SEQ ID NO: 612029 - DNA, 13 bp, D. melanogaster
cgcgaaataccag

SEQ ID NO: 612030 - DNA, 13 bp, D. melanogaster
cgcgaaattcatt

SEQ ID NO: 612031 - DNA, 14 bp, D. melanogaster
cgcgaaattcattt

SEQ ID NO: 612032 - DNA, 14 bp, D. melanogaster
cgcgaacaagccac

SEQ ID NO: 612033 - DNA, 13 bp, D. melanogaster
cgcgaatgtttta

SEQ ID NO: 612034 - DNA, 14 bp, D. melanogaster
cgcgaattcttcag

SEQ ID NO: 612035 - DNA, 13 bp, D. melanogaster
cgcgaattcttta

SEQ ID NO: 612036 - DNA, 13 bp, D. melanogaster
cgcgacgcattcg

SEQ ID NO: 612037 - DNA, 13 bp, D. melanogaster
cgcgagagagaga

SEQ ID NO: 612038 - DNA, 13 bp, D. melanogaster
cgcgatgatgatg

SEQ ID NO: 612039 - DNA, 13 bp, D. melanogaster
cgcgatttggaaa

SEQ ID NO: 612040 - DNA, 14 bp, D. melanogaster
cgcgcacgcacaca

SEQ ID NO: 612041 - DNA, 13 bp, D. melanogaster
cgcgcatgcgcag

SEQ ID NO: 612042 - DNA, 14 bp, D. melanogaster
cgcgccgtgttcat

SEQ ID NO: 612043 - DNA, 13 bp, D. melanogaster
cgcgctcctgctc

SEQ ID NO: 612044 - DNA, 13 bp, D. melanogaster
cgcggacatcggg

SEQ ID NO: 612045 - DNA, 13 bp, D. melanogaster
cgcggccaagacg

SEQ ID NO: 612046 - DNA, 14 bp, D. melanogaster
cgcggcgtatacgc

SEQ ID NO: 612047 - DNA, 13 bp, D. melanogaster
cgcgtatctgtgt

SEQ ID NO: 612048 - DNA, 13 bp, D. melanogaster
cgcgttcgcattc

SEQ ID NO: 612049 - DNA, 14 bp, D. melanogaster
cgctaaaggaaaag

SEQ ID NO: 612050 - DNA, 13 bp, D. melanogaster
cgctaattgaaaa

SEQ ID NO: 612051 - DNA, 13 bp, D. melanogaster
cgctagaaaaaca

SEQ ID NO: 612052 - DNA, 13 bp, D. melanogaster
cgctagatggcgc

SEQ ID NO: 612053 - DNA, 13 bp, D. melanogaster
cgctcacacacac

SEQ ID NO: 612054 - DNA, 13 bp, D. melanogaster
cgctcaccatcat

SEQ ID NO: 612055 - DNA, 13 bp, D. melanogaster
cgctcacctacaa

SEQ ID NO: 612056 - DNA, 13 bp, D. melanogaster
cgctcactcactc

SEQ ID NO: 612057 - DNA, 13 bp, D. melanogaster
cgctcagtgcagc

SEQ ID NO: 612058 - DNA, 14 bp, D. melanogaster
cgctcataatccgt

SEQ ID NO: 612059 - DNA, 13 bp, D. melanogaster
cgctcattcattc

SEQ ID NO: 612060 - DNA, 13 bp, D. melanogaster
cgctcatttgttt

SEQ ID NO: 612061 - DNA, 14 bp, D. melanogaster
cgctccacggggaa

SEQ ID NO: 612062 - DNA, 13 bp, D. melanogaster
cgctcccgctgag

SEQ ID NO: 612063 - DNA, 13 bp, D. melanogaster
cgctcctctcgca

SEQ ID NO: 612064 - DNA, 13 bp, D. melanogaster
cgctcctgctctc

SEQ ID NO: 612065 - DNA, 13 bp, D. melanogaster
cgctcctgctgct

SEQ ID NO: 612066 - DNA, 14 bp, D. melanogaster
cgctcgaaaaaagg

SEQ ID NO: 612067 - DNA, 13 bp, D. melanogaster
cgctcgcactcac

SEQ ID NO: 612068 - DNA, 14 bp, D. melanogaster
cgctcgctcgctcg

SEQ ID NO: 612069 - DNA, 13 bp, D. melanogaster
cgctcgtcttgtt

SEQ ID NO: 612070 - DNA, 13 bp, D. melanogaster
cgctctaccaaac

SEQ ID NO: 612071 - DNA, 13 bp, D. melanogaster
cgctctatgcgat

SEQ ID NO: 612072 - DNA, 13 bp, D. melanogaster
cgctctcagcggg

SEQ ID NO: 612073 - DNA, 13 bp, D. melanogaster
cgctctcatcacg

SEQ ID NO: 612074 - DNA, 13 bp, D. melanogaster
cgctctcgctcgc

SEQ ID NO: 612075 - DNA, 14 bp, D. melanogaster
cgctctcgctcgct

SEQ ID NO: 612076 - DNA, 13 bp, D. melanogaster
cgctctcgctctc

SEQ ID NO: 612077 - DNA, 14 bp, D. melanogaster
cgctctcgctctct

SEQ ID NO: 612078 - DNA, 13 bp, D. melanogaster
cgctctctatctc

SEQ ID NO: 612079 - DNA, 13 bp, D. melanogaster
cgctctctgcaga

SEQ ID NO: 612080 - DNA, 13 bp, D. melanogaster
cgctctgaaacaa

SEQ ID NO: 612081 - DNA, 13 bp, D. melanogaster
cgctctgtttgtt

SEQ ID NO: 612082 - DNA, 13 bp, D. melanogaster
cgctcttctgggt

SEQ ID NO: 612083 - DNA, 13 bp, D. melanogaster
cgctgaccaactc

SEQ ID NO: 612084 - DNA, 15 bp, D. melanogaster
cgctgacgaagttga

SEQ ID NO: 612085 - DNA, 13 bp, D. melanogaster
cgctgagcaactt

SEQ ID NO: 612086 - DNA, 13 bp, D. melanogaster
cgctgaggaatat

SEQ ID NO: 612087 - DNA, 13 bp, D. melanogaster
cgctgatcaccac

SEQ ID NO: 612088 - DNA, 13 bp, D. melanogaster
cgctgatcaccat

SEQ ID NO: 612089 - DNA, 13 bp, D. melanogaster
cgctgatgatgat

SEQ ID NO: 612090 - DNA, 13 bp, D. melanogaster
cgctgcaacaaaa

SEQ ID NO: 612091 - DNA, 13 bp, D. melanogaster
cgctgcaatttgt

SEQ ID NO: 612092 - DNA, 13 bp, D. melanogaster
cgctgcacagtgg

SEQ ID NO: 612093 - DNA, 13 bp, D. melanogaster
cgctgcagaaaaa

SEQ ID NO: 612094 - DNA, 13 bp, D. melanogaster
cgctgcagcagcg

SEQ ID NO: 612095 - DNA, 13 bp, D. melanogaster
cgctgcagttgct

SEQ ID NO: 612096 - DNA, 13 bp, D. melanogaster
cgctgcagttttg

SEQ ID NO: 612097 - DNA, 13 bp, D. melanogaster
cgctgcatatatt

SEQ ID NO: 612098 - DNA, 14 bp, D. melanogaster
cgctgcatccatag

SEQ ID NO: 612099 - DNA, 13 bp, D. melanogaster
cgctgcattttcc

SEQ ID NO: 612100 - DNA, 13 bp, D. melanogaster
cgctgccaaattg

SEQ ID NO: 612101 - DNA, 13 bp, D. melanogaster
cgctgccactgcc

SEQ ID NO: 612102 - DNA, 13 bp, D. melanogaster
cgctgccatcaac

SEQ ID NO: 612103 - DNA, 13 bp, D. melanogaster
cgctgccattgtt

SEQ ID NO: 612104 - DNA, 13 bp, D. melanogaster
cgctgccgacgcc

SEQ ID NO: 612105 - DNA, 14 bp, D. melanogaster
cgctgccgacgtcg

SEQ ID NO: 612106 - DNA, 13 bp, D. melanogaster
cgctgccgccgct

SEQ ID NO: 612107 - DNA, 13 bp, D. melanogaster
cgctgccgctgcc

SEQ ID NO: 612108 - DNA, 14 bp, D. melanogaster
cgctgccgctgccg

SEQ ID NO: 612109 - DNA, 13 bp, D. melanogaster
cgctgccgctgct

SEQ ID NO: 612110 - DNA, 13 bp, D. melanogaster
cgctgccgctttt

SEQ ID NO: 612111 - DNA, 14 bp, D. melanogaster
cgctgccggcgtcg

SEQ ID NO: 612112 - DNA, 13 bp, D. melanogaster
cgctgcctttggc

SEQ ID NO: 612113 - DNA, 13 bp, D. melanogaster
cgctgcctttgtt

SEQ ID NO: 612114 - DNA, 13 bp, D. melanogaster
cgctgcgatgaac

SEQ ID NO: 612115 - DNA, 13 bp, D. melanogaster
cgctgcgcatgcg

SEQ ID NO: 612116 - DNA, 14 bp, D. melanogaster
cgctgcgcatgcgc

SEQ ID NO: 612117 - DNA, 13 bp, D. melanogaster
cgctgcgtctatg

SEQ ID NO: 612118 - DNA, 13 bp, D. melanogaster
cgctgcgtctttg

SEQ ID NO: 612119 - DNA, 13 bp, D. melanogaster
cgctgctcatttg

SEQ ID NO: 612120 - DNA, 13 bp, D. melanogaster
cgctgctcctggc

SEQ ID NO: 612121 - DNA, 13 bp, D. melanogaster
cgctgctctctct

SEQ ID NO: 612122 - DNA, 15 bp, D. melanogaster
cgctgctcttctgcc

SEQ ID NO: 612123 - DNA, 13 bp, D. melanogaster
cgctgctgccgcc

SEQ ID NO: 612124 - DNA, 13 bp, D. melanogaster
cgctgctgctcct

SEQ ID NO: 612125 - DNA, 13 bp, D. melanogaster
cgctgctgctgcc

SEQ ID NO: 612126 - DNA, 13 bp, D. melanogaster
cgctgctgctgct

SEQ ID NO: 612127 - DNA, 14 bp, D. melanogaster
cgctgctgctgctg

SEQ ID NO: 612128 - DNA, 15 bp, D. melanogaster
cgctgctgctgctgt

SEQ ID NO: 612129 - DNA, 13 bp, D. melanogaster
cgctgctgctgtg

SEQ ID NO: 612130 - DNA, 13 bp, D. melanogaster
cgctgctgctttt

SEQ ID NO: 612131 - DNA, 13 bp, D. melanogaster
cgctgctggcgta

SEQ ID NO: 612132 - DNA, 13 bp, D. melanogaster
cgctgctgttgtt

SEQ ID NO: 612133 - DNA, 13 bp, D. melanogaster
cgctgctgtttgc

SEQ ID NO: 612134 - DNA, 14 bp, D. melanogaster
cgctgcttctgctg

SEQ ID NO: 612135 - DNA, 13 bp, D. melanogaster
cgctgcttttgtt

SEQ ID NO: 612136 - DNA, 13 bp, D. melanogaster
cgctggcaaattg

SEQ ID NO: 612137 - DNA, 13 bp, D. melanogaster
cgctggcagcgca

SEQ ID NO: 612138 - DNA, 13 bp, D. melanogaster
cgctggcattgtt

SEQ ID NO: 612139 - DNA, 13 bp, D. melanogaster
cgctggcattttc

SEQ ID NO: 612140 - DNA, 13 bp, D. melanogaster
cgctggccaaaca

SEQ ID NO: 612141 - DNA, 14 bp, D. melanogaster
cgctggccagccga

SEQ ID NO: 612142 - DNA, 13 bp, D. melanogaster
cgctggccataaa

SEQ ID NO: 612143 - DNA, 13 bp, D. melanogaster
cgctggccatata

SEQ ID NO: 612144 - DNA, 14 bp, D. melanogaster
cgctggccatatat

SEQ ID NO: 612145 - DNA, 15 bp, D. melanogaster
cgctggccgctggcc

SEQ ID NO: 612146 - DNA, 13 bp, D. melanogaster
cgctggctttgat

SEQ ID NO: 612147 - DNA, 13 bp, D. melanogaster
cgctggctttgcc

SEQ ID NO: 612148 - DNA, 13 bp, D. melanogaster
cgctgggcgcgag

SEQ ID NO: 612149 - DNA, 13 bp, D. melanogaster
cgctggtttttgc

SEQ ID NO: 612150 - DNA, 13 bp, D. melanogaster
cgctgtatatata

SEQ ID NO: 612151 - DNA, 14 bp, D. melanogaster
cgctgtcgacgtcg

SEQ ID NO: 612152 - DNA, 14 bp, D. melanogaster
cgctgttgctgttg

SEQ ID NO: 612153 - DNA, 13 bp, D. melanogaster
cgctgttgttgtt

SEQ ID NO: 612154 - DNA, 14 bp, D. melanogaster
cgctgttgttgttg

SEQ ID NO: 612155 - DNA, 13 bp, D. melanogaster
cgcttaattgaaa

SEQ ID NO: 612156 - DNA, 13 bp, D. melanogaster
cgcttattaattt

SEQ ID NO: 612157 - DNA, 13 bp, D. melanogaster
cgcttcaatcaaa

SEQ ID NO: 612158 - DNA, 13 bp, D. melanogaster
cgcttccaggcaa

SEQ ID NO: 612159 - DNA, 14 bp, D. melanogaster
cgcttccgtttccg

SEQ ID NO: 612160 - DNA, 13 bp, D. melanogaster
cgcttccttctac

SEQ ID NO: 612161 - DNA, 14 bp, D. melanogaster
cgcttccttctacc

SEQ ID NO: 612162 - DNA, 13 bp, D. melanogaster
cgcttccttctgc

SEQ ID NO: 612163 - DNA, 14 bp, D. melanogaster
cgcttccttctgcc

SEQ ID NO: 612164 - DNA, 13 bp, D. melanogaster
cgcttcgattcga

SEQ ID NO: 612165 - DNA, 14 bp, D. melanogaster
cgcttcggcagcaa

SEQ ID NO: 612166 - DNA, 13 bp, D. melanogaster
cgcttcgtttcgt

SEQ ID NO: 612167 - DNA, 13 bp, D. melanogaster
cgcttctgccatt

SEQ ID NO: 612168 - DNA, 14 bp, D. melanogaster
cgcttggctgcaag

SEQ ID NO: 612169 - DNA, 13 bp, D. melanogaster
cgcttggctgcct

SEQ ID NO: 612170 - DNA, 13 bp, D. melanogaster
cgctttaaaaaca

SEQ ID NO: 612171 - DNA, 13 bp, D. melanogaster
cgctttaaaaatg

SEQ ID NO: 612172 - DNA, 13 bp, D. melanogaster
cgctttaattaaa

SEQ ID NO: 612173 - DNA, 13 bp, D. melanogaster
cgctttaatttta

SEQ ID NO: 612174 - DNA, 13 bp, D. melanogaster
cgctttagatggc

SEQ ID NO: 612175 - DNA, 13 bp, D. melanogaster
cgctttatttaat

SEQ ID NO: 612176 - DNA, 13 bp, D. melanogaster
cgctttcaacacc

SEQ ID NO: 612177 - DNA, 13 bp, D. melanogaster
cgctttcagtcca

SEQ ID NO: 612178 - DNA, 13 bp, D. melanogaster
cgctttccacttt

SEQ ID NO: 612179 - DNA, 13 bp, D. melanogaster
cgctttccatttt

SEQ ID NO: 612180 - DNA, 13 bp, D. melanogaster
cgctttcgatatc

SEQ ID NO: 612181 - DNA, 13 bp, D. melanogaster
cgctttgatttcg

SEQ ID NO: 612182 - DNA, 13 bp, D. melanogaster
cgctttgtgcttg

SEQ ID NO: 612183 - DNA, 14 bp, D. melanogaster
cgctttgtgcttgg

SEQ ID NO: 612184 - DNA, 13 bp, D. melanogaster
cgctttgttttac

SEQ ID NO: 612185 - DNA, 13 bp, D. melanogaster
cgctttgttttat

SEQ ID NO: 612186 - DNA, 13 bp, D. melanogaster
cgcttttatattt

SEQ ID NO: 612187 - DNA, 13 bp, D. melanogaster
cgcttttatttat

SEQ ID NO: 612188 - DNA, 13 bp, D. melanogaster
cgcttttcatttg

SEQ ID NO: 612189 - DNA, 13 bp, D. melanogaster
cgcttttccacct

SEQ ID NO: 612190 - DNA, 13 bp, D. melanogaster
cgcttttccactc

SEQ ID NO: 612191 - DNA, 13 bp, D. melanogaster
cgcttttccattt

SEQ ID NO: 612192 - DNA, 13 bp, D. melanogaster
cgcttttcccagc

SEQ ID NO: 612193 - DNA, 13 bp, D. melanogaster
cgcttttcccatt

SEQ ID NO: 612194 - DNA, 13 bp, D. melanogaster
cgcttttccccgc

SEQ ID NO: 612195 - DNA, 13 bp, D. melanogaster
cgcttttccgcct

SEQ ID NO: 612196 - DNA, 13 bp, D. melanogaster
cgcttttccgctt

SEQ ID NO: 612197 - DNA, 14 bp, D. melanogaster
cgcttttccgcttt

SEQ ID NO: 612198 - DNA, 13 bp, D. melanogaster
cgcttttcctgct

SEQ ID NO: 612199 - DNA, 13 bp, D. melanogaster
cgcttttcctggc

SEQ ID NO: 612200 - DNA, 13 bp, D. melanogaster
cgcttttccttcg

SEQ ID NO: 612201 - DNA, 13 bp, D. melanogaster
cgcttttcgaatt

SEQ ID NO: 612202 - DNA, 13 bp, D. melanogaster
cgcttttcgcttt

SEQ ID NO: 612203 - DNA, 13 bp, D. melanogaster
cgcttttcttaaa

SEQ ID NO: 612204 - DNA, 13 bp, D. melanogaster
cgcttttgctgtt

SEQ ID NO: 612205 - DNA, 13 bp, D. melanogaster
cgcttttggccac

SEQ ID NO: 612206 - DNA, 13 bp, D. melanogaster
cgctttttatatt

SEQ ID NO: 612207 - DNA, 13 bp, D. melanogaster
cgctttttcgctt

SEQ ID NO: 612208 - DNA, 13 bp, D. melanogaster
cgctttttgtcgt

SEQ ID NO: 612209 - DNA, 13 bp, D. melanogaster
cgctttttgtgga

SEQ ID NO: 612210 - DNA, 14 bp, D. melanogaster
cgctttttgtttgc

SEQ ID NO: 612211 - DNA, 13 bp, D. melanogaster
cggaaaaacggaa

SEQ ID NO: 612212 - DNA, 13 bp, D. melanogaster
cggaaaaatcgaa

SEQ ID NO: 612213 - DNA, 13 bp, D. melanogaster
cggaaaaatcgag

SEQ ID NO: 612214 - DNA, 13 bp, D. melanogaster
cggaaaaatggaa

SEQ ID NO: 612215 - DNA, 13 bp, D. melanogaster
cggaaaacggaaa

SEQ ID NO: 612216 - DNA, 13 bp, D. melanogaster
cggaaaactcaca

SEQ ID NO: 612217 - DNA, 13 bp, D. melanogaster
cggaaaactcatt

SEQ ID NO: 612218 - DNA, 13 bp, D. melanogaster
cggaaaactgaaa

SEQ ID NO: 612219 - DNA, 13 bp, D. melanogaster
cggaaaagccaag

SEQ ID NO: 612220 - DNA, 14 bp, D. melanogaster
cggaaaagcgggaa

SEQ ID NO: 612221 - DNA, 13 bp, D. melanogaster
cggaaaagctgga

SEQ ID NO: 612222 - DNA, 13 bp, D. melanogaster
cggaaaagtgcag

SEQ ID NO: 612223 - DNA, 13 bp, D. melanogaster
cggaaaagtggaa

SEQ ID NO: 612224 - DNA, 13 bp, D. melanogaster
cggaaaagtggag

SEQ ID NO: 612225 - DNA, 13 bp, D. melanogaster
cggaaaagtgggc

SEQ ID NO: 612226 - DNA, 13 bp, D. melanogaster
cggaaaataaata

SEQ ID NO: 612227 - DNA, 13 bp, D. melanogaster
cggaaaatagaca

SEQ ID NO: 612228 - DNA, 13 bp, D. melanogaster
cggaaaatcaatt

SEQ ID NO: 612229 - DNA, 14 bp, D. melanogaster
cggaaaatcgaaaa

SEQ ID NO: 612230 - DNA, 14 bp, D. melanogaster
cggaaaatcggaaa

SEQ ID NO: 612231 - DNA, 13 bp, D. melanogaster
cggaaaatgcaaa

SEQ ID NO: 612232 - DNA, 13 bp, D. melanogaster
cggaaaatgcaat

SEQ ID NO: 612233 - DNA, 13 bp, D. melanogaster
cggaaaatgcagg

SEQ ID NO: 612234 - DNA, 13 bp, D. melanogaster
cggaaaatgtgca

SEQ ID NO: 612235 - DNA, 13 bp, D. melanogaster
cggaaaatgtgga

SEQ ID NO: 612236 - DNA, 14 bp, D. melanogaster
cggaaaatgtggaa

SEQ ID NO: 612237 - DNA, 13 bp, D. melanogaster
cggaaaatgtggg

SEQ ID NO: 612238 - DNA, 13 bp, D. melanogaster
cggaaaatgttaa

SEQ ID NO: 612239 - DNA, 13 bp, D. melanogaster
cggaaaattaaaa

SEQ ID NO: 612240 - DNA, 13 bp, D. melanogaster
cggaaaattgctt

SEQ ID NO: 612241 - DNA, 13 bp, D. melanogaster
cggaaacagaaac

SEQ ID NO: 612242 - DNA, 13 bp, D. melanogaster
cggaaacggaaaa

SEQ ID NO: 612243 - DNA, 14 bp, D. melanogaster
cggaaacggaaaca

SEQ ID NO: 612244 - DNA, 14 bp, D. melanogaster
cggaaacggaaatc

SEQ ID NO: 612245 - DNA, 13 bp, D. melanogaster
cggaaacggaagc

SEQ ID NO: 612246 - DNA, 14 bp, D. melanogaster
cggaaacggaagcg

SEQ ID NO: 612247 - DNA, 13 bp, D. melanogaster
cggaaacggaagt

SEQ ID NO: 612248 - DNA, 14 bp, D. melanogaster
cggaaacggaagtg

SEQ ID NO: 612249 - DNA, 13 bp, D. melanogaster
cggaaactggcca

SEQ ID NO: 612250 - DNA, 13 bp, D. melanogaster
cggaaacttgaaa

SEQ ID NO: 612251 - DNA, 14 bp, D. melanogaster
cggaaagagagcaa

SEQ ID NO: 612252 - DNA, 13 bp, D. melanogaster
cggaaagcggaaa

SEQ ID NO: 612253 - DNA, 13 bp, D. melanogaster
cggaaagtggaaa

SEQ ID NO: 612254 - DNA, 13 bp, D. melanogaster
cggaaataataaa

SEQ ID NO: 612255 - DNA, 13 bp, D. melanogaster
cggaaatcgaaaa

SEQ ID NO: 612256 - DNA, 13 bp, D. melanogaster
cggaaatcgaagt

SEQ ID NO: 612257 - DNA, 13 bp, D. melanogaster
cggaaatgatcat

SEQ ID NO: 612258 - DNA, 13 bp, D. melanogaster
cggaaatggccag

SEQ ID NO: 612259 - DNA, 13 bp, D. melanogaster
cggaaattggtca

SEQ ID NO: 612260 - DNA, 13 bp, D. melanogaster
cggaaattgtttt

SEQ ID NO: 612261 - DNA, 13 bp, D. melanogaster
cggaaatttggat

SEQ ID NO: 612262 - DNA, 13 bp, D. melanogaster
cggaacaaatttt

SEQ ID NO: 612263 - DNA, 13 bp, D. melanogaster
cggaaccggaaac

SEQ ID NO: 612264 - DNA, 13 bp, D. melanogaster
cggaacgaaaaca

SEQ ID NO: 612265 - DNA, 15 bp, D. melanogaster
cggaacggaacggaa

SEQ ID NO: 612266 - DNA, 13 bp, D. melanogaster
cggaactttttct

SEQ ID NO: 612267 - DNA, 13 bp, D. melanogaster
cggaagcagccat

SEQ ID NO: 612268 - DNA, 13 bp, D. melanogaster
cggaagccaaact

SEQ ID NO: 612269 - DNA, 13 bp, D. melanogaster
cggaagcggaaat

SEQ ID NO: 612270 - DNA, 13 bp, D. melanogaster
cggaagcggaagt

SEQ ID NO: 612271 - DNA, 13 bp, D. melanogaster
cggaagtcccaaa

SEQ ID NO: 612272 - DNA, 13 bp, D. melanogaster
cggaatacaaaaa

SEQ ID NO: 612273 - DNA, 13 bp, D. melanogaster
cggaatacatttt

SEQ ID NO: 612274 - DNA, 14 bp, D. melanogaster
cggaatacggaata

SEQ ID NO: 612275 - DNA, 13 bp, D. melanogaster
cggaatcatttgt

SEQ ID NO: 612276 - DNA, 13 bp, D. melanogaster
cggaatcgaaatc

SEQ ID NO: 612277 - DNA, 14 bp, D. melanogaster
cggaatcgaaatcg

SEQ ID NO: 612278 - DNA, 13 bp, D. melanogaster
cggaatcgaatcg

SEQ ID NO: 612279 - DNA, 14 bp, D. melanogaster
cggaatcggaatca

SEQ ID NO: 612280 - DNA, 14 bp, D. melanogaster
cggaatcggaattg

SEQ ID NO: 612281 - DNA, 13 bp, D. melanogaster
cggaatcggattc

SEQ ID NO: 612282 - DNA, 13 bp, D. melanogaster
cggaatctgaatc

SEQ ID NO: 612283 - DNA, 13 bp, D. melanogaster
cggaatgagcagt

SEQ ID NO: 612284 - DNA, 13 bp, D. melanogaster
cggaatgtcagca

SEQ ID NO: 612285 - DNA, 14 bp, D. melanogaster
cggaattggaatcg

SEQ ID NO: 612286 - DNA, 13 bp, D. melanogaster
cggaattggaatt

SEQ ID NO: 612287 - DNA, 13 bp, D. melanogaster
cggaatttaaaat

SEQ ID NO: 612288 - DNA, 13 bp, D. melanogaster
cggaatttttctt

SEQ ID NO: 612289 - DNA, 14 bp, D. melanogaster
cggacaaagaaaac

SEQ ID NO: 612290 - DNA, 13 bp, D. melanogaster
cggacaaatggac

SEQ ID NO: 612291 - DNA, 14 bp, D. melanogaster
cggacaacctgacc

SEQ ID NO: 612292 - DNA, 13 bp, D. melanogaster
cggacaataatcc

SEQ ID NO: 612293 - DNA, 13 bp, D. melanogaster
cggacacaagcac

SEQ ID NO: 612294 - DNA, 13 bp, D. melanogaster
cggacacacacac

SEQ ID NO: 612295 - DNA, 14 bp, D. melanogaster
cggacacacacaca

SEQ ID NO: 612296 - DNA, 13 bp, D. melanogaster
cggacacataacg

SEQ ID NO: 612297 - DNA, 14 bp, D. melanogaster
cggacacggacacg

SEQ ID NO: 612298 - DNA, 13 bp, D. melanogaster
cggacagaaggac

SEQ ID NO: 612299 - DNA, 13 bp, D. melanogaster
cggacagacaaac

SEQ ID NO: 612300 - DNA, 13 bp, D. melanogaster
cggacagacagac

SEQ ID NO: 612301 - DNA, 13 bp, D. melanogaster
cggacagacgaac

SEQ ID NO: 612302 - DNA, 13 bp, D. melanogaster
cggacagacggac

SEQ ID NO: 612303 - DNA, 14 bp, D. melanogaster
cggacagacggacg

SEQ ID NO: 612304 - DNA, 13 bp, D. melanogaster
cggacagcggaca

SEQ ID NO: 612305 - DNA, 13 bp, D. melanogaster
cggacatgaccag

SEQ ID NO: 612306 - DNA, 13 bp, D. melanogaster
cggacattgccgg

SEQ ID NO: 612307 - DNA, 13 bp, D. melanogaster
cggacccggaccc

SEQ ID NO: 612308 - DNA, 13 bp, D. melanogaster
cggacgcctccga

SEQ ID NO: 612309 - DNA, 13 bp, D. melanogaster
cggacggacaaac

SEQ ID NO: 612310 - DNA, 13 bp, D. melanogaster
cggacggacatgg

SEQ ID NO: 612311 - DNA, 13 bp, D. melanogaster
cggacggacggac

SEQ ID NO: 612312 - DNA, 14 bp, D. melanogaster
cggacggacggaca

SEQ ID NO: 612313 - DNA, 13 bp, D. melanogaster
cggacggatctac

SEQ ID NO: 612314 - DNA, 14 bp, D. melanogaster
cggactaacgaaat

SEQ ID NO: 612315 - DNA, 13 bp, D. melanogaster
cggactacggact

SEQ ID NO: 612316 - DNA, 14 bp, D. melanogaster
cggactcggactcg

SEQ ID NO: 612317 - DNA, 13 bp, D. melanogaster
cggactcggattc

SEQ ID NO: 612318 - DNA, 13 bp, D. melanogaster
cggactggaaacc

SEQ ID NO: 612319 - DNA, 13 bp, D. melanogaster
cggacttaactgg

SEQ ID NO: 612320 - DNA, 14 bp, D. melanogaster
cggagaacggagaa

SEQ ID NO: 612321 - DNA, 13 bp, D. melanogaster
cggagaatatgga

SEQ ID NO: 612322 - DNA, 13 bp, D. melanogaster
cggagaatttctt

SEQ ID NO: 612323 - DNA, 14 bp, D. melanogaster
cggagatggagatg

SEQ ID NO: 612324 - DNA, 13 bp, D. melanogaster
cggagcaaacggt

SEQ ID NO: 612325 - DNA, 13 bp, D. melanogaster
cggagcagcagca

SEQ ID NO: 612326 - DNA, 14 bp, D. melanogaster
cggagcagcagcag

SEQ ID NO: 612327 - DNA, 13 bp, D. melanogaster
cggagcaggagca

SEQ ID NO: 612328 - DNA, 14 bp, D. melanogaster
cggagcaggagcag

SEQ ID NO: 612329 - DNA, 13 bp, D. melanogaster
cggagccggattt

SEQ ID NO: 612330 - DNA, 13 bp, D. melanogaster
cggagcgaaagag

SEQ ID NO: 612331 - DNA, 14 bp, D. melanogaster
cggagcggagcgga

SEQ ID NO: 612332 - DNA, 13 bp, D. melanogaster
cggagcggtactt

SEQ ID NO: 612333 - DNA, 13 bp, D. melanogaster
cggaggaaaagcg

SEQ ID NO: 612334 - DNA, 13 bp, D. melanogaster
cggaggagcagca

SEQ ID NO: 612335 - DNA, 13 bp, D. melanogaster
cggaggagcagga

SEQ ID NO: 612336 - DNA, 13 bp, D. melanogaster
cggaggaggagca

SEQ ID NO: 612337 - DNA, 13 bp, D. melanogaster
cggagggcgtggc

SEQ ID NO: 612338 - DNA, 13 bp, D. melanogaster
cggagtacctcaa

SEQ ID NO: 612339 - DNA, 13 bp, D. melanogaster
cggagttggagtt

SEQ ID NO: 612340 - DNA, 13 bp, D. melanogaster
cggagttgggagc

SEQ ID NO: 612341 - DNA, 13 bp, D. melanogaster
cggataacgcagc

SEQ ID NO: 612342 - DNA, 13 bp, D. melanogaster
cggataataatgg

SEQ ID NO: 612343 - DNA, 14 bp, D. melanogaster
cggatacagataca

SEQ ID NO: 612344 - DNA, 13 bp, D. melanogaster
cggatacagatgc

SEQ ID NO: 612345 - DNA, 13 bp, D. melanogaster
cggatacggatac

SEQ ID NO: 612346 - DNA, 13 bp, D. melanogaster
cggatacggatgc

SEQ ID NO: 612347 - DNA, 13 bp, D. melanogaster
cggatacggattc

SEQ ID NO: 612348 - DNA, 13 bp, D. melanogaster
cggatcagcaggc

SEQ ID NO: 612349 - DNA, 13 bp, D. melanogaster
cggatccggatcc

SEQ ID NO: 612350 - DNA, 13 bp, D. melanogaster
cggatcggatcga

SEQ ID NO: 612351 - DNA, 13 bp, D. melanogaster
cggatcggatcgc

SEQ ID NO: 612352 - DNA, 14 bp, D. melanogaster
cggatcggatcgga

SEQ ID NO: 612353 - DNA, 13 bp, D. melanogaster
cggatcggattgg

SEQ ID NO: 612354 - DNA, 13 bp, D. melanogaster
cggatcggtttgg

SEQ ID NO: 612355 - DNA, 13 bp, D. melanogaster
cggatgacaaaaa

SEQ ID NO: 612356 - DNA, 14 bp, D. melanogaster
cggatgatgatgat

SEQ ID NO: 612357 - DNA, 13 bp, D. melanogaster
cggatgcctcaga

SEQ ID NO: 612358 - DNA, 13 bp, D. melanogaster
cggatgcggatgg

SEQ ID NO: 612359 - DNA, 14 bp, D. melanogaster
cggatgcggatgtg

SEQ ID NO: 612360 - DNA, 13 bp, D. melanogaster
cggatgcggattc

SEQ ID NO: 612361 - DNA, 14 bp, D. melanogaster
cggatgtggatgcg

SEQ ID NO: 612362 - DNA, 14 bp, D. melanogaster
cggatgtggatgtg

SEQ ID NO: 612363 - DNA, 13 bp, D. melanogaster
cggatgtttatgt

SEQ ID NO: 612364 - DNA, 14 bp, D. melanogaster
cggattcggattca

SEQ ID NO: 612365 - DNA, 13 bp, D. melanogaster
cggattcggattg

SEQ ID NO: 612366 - DNA, 13 bp, D. melanogaster
cggattcggtttc

SEQ ID NO: 612367 - DNA, 13 bp, D. melanogaster
cggattctgattc

SEQ ID NO: 612368 - DNA, 14 bp, D. melanogaster
cggattggatcgga

SEQ ID NO: 612369 - DNA, 14 bp, D. melanogaster
cggattggattgga

SEQ ID NO: 612370 - DNA, 13 bp, D. melanogaster
cggattggggagt

SEQ ID NO: 612371 - DNA, 13 bp, D. melanogaster
cggattgtattga

SEQ ID NO: 612372 - DNA, 13 bp, D. melanogaster
cggatttaataaa

SEQ ID NO: 612373 - DNA, 13 bp, D. melanogaster
cggatttccccat

SEQ ID NO: 612374 - DNA, 13 bp, D. melanogaster
cggatttggattt

SEQ ID NO: 612375 - DNA, 14 bp, D. melanogaster
cggattttgatctt

SEQ ID NO: 612376 - DNA, 13 bp, D. melanogaster
cggattttgccaa

SEQ ID NO: 612377 - DNA, 13 bp, D. melanogaster
cggattttgtgaa

SEQ ID NO: 612378 - DNA, 13 bp, D. melanogaster
cggcaaaaagcaa

SEQ ID NO: 612379 - DNA, 13 bp, D. melanogaster
cggcaaaaataaa

SEQ ID NO: 612380 - DNA, 13 bp, D. melanogaster
cggcaaaacggtt

SEQ ID NO: 612381 - DNA, 13 bp, D. melanogaster
cggcaaaaggaaa

SEQ ID NO: 612382 - DNA, 13 bp, D. melanogaster
cggcaaacaaaca

SEQ ID NO: 612383 - DNA, 13 bp, D. melanogaster
cggcaaacaacaa

SEQ ID NO: 612384 - DNA, 13 bp, D. melanogaster
cggcaaacgaaaa

SEQ ID NO: 612385 - DNA, 14 bp, D. melanogaster
cggcaaacggcaaa

SEQ ID NO: 612386 - DNA, 13 bp, D. melanogaster
cggcaaaggcaac

SEQ ID NO: 612387 - DNA, 13 bp, D. melanogaster
cggcaaatgcaaa

SEQ ID NO: 612388 - DNA, 13 bp, D. melanogaster
cggcaaatgccaa

SEQ ID NO: 612389 - DNA, 13 bp, D. melanogaster
cggcaaatggaaa

SEQ ID NO: 612390 - DNA, 14 bp, D. melanogaster
cggcaaatggcaaa

SEQ ID NO: 612391 - DNA, 13 bp, D. melanogaster
cggcaaattgttt

SEQ ID NO: 612392 - DNA, 14 bp, D. melanogaster
cggcaacaacaaat

SEQ ID NO: 612393 - DNA, 14 bp, D. melanogaster
cggcaacaacaatg

SEQ ID NO: 612394 - DNA, 14 bp, D. melanogaster
cggcaacaacagca

SEQ ID NO: 612395 - DNA, 13 bp, D. melanogaster
cggcaacaataaa

SEQ ID NO: 612396 - DNA, 14 bp, D. melanogaster
cggcaacaataaca

SEQ ID NO: 612397 - DNA, 13 bp, D. melanogaster
cggcaacagaaaa

SEQ ID NO: 612398 - DNA, 13 bp, D. melanogaster
cggcaacagcagc

SEQ ID NO: 612399 - DNA, 15 bp, D. melanogaster
cggcaacagcagcaa

SEQ ID NO: 612400 - DNA, 13 bp, D. melanogaster
cggcaacatggat

SEQ ID NO: 612401 - DNA, 14 bp, D. melanogaster
cggcaacatgttgc

SEQ ID NO: 612402 - DNA, 13 bp, D. melanogaster
cggcaaccggcaa

SEQ ID NO: 612403 - DNA, 13 bp, D. melanogaster
cggcaacgacaac

SEQ ID NO: 612404 - DNA, 13 bp, D. melanogaster
cggcaacggcaac

SEQ ID NO: 612405 - DNA, 14 bp, D. melanogaster
cggcaacggcaaca

SEQ ID NO: 612406 - DNA, 13 bp, D. melanogaster
cggcaacggcagc

SEQ ID NO: 612407 - DNA, 14 bp, D. melanogaster
cggcaactggaaca

SEQ ID NO: 612408 - DNA, 13 bp, D. melanogaster
cggcaacttgaat

SEQ ID NO: 612409 - DNA, 13 bp, D. melanogaster
cggcaagccatcg

SEQ ID NO: 612410 - DNA, 13 bp, D. melanogaster
cggcaagtgcaaa

SEQ ID NO: 612411 - DNA, 13 bp, D. melanogaster
cggcaataaaaat

SEQ ID NO: 612412 - DNA, 14 bp, D. melanogaster
cggcaatctcgcgg

SEQ ID NO: 612413 - DNA, 13 bp, D. melanogaster
cggcaatgacagc

SEQ ID NO: 612414 - DNA, 13 bp, D. melanogaster
cggcaatggcaac

SEQ ID NO: 612415 - DNA, 13 bp, D. melanogaster
cggcaattgcaat

SEQ ID NO: 612416 - DNA, 13 bp, D. melanogaster
cggcactcacaca

SEQ ID NO: 612417 - DNA, 13 bp, D. melanogaster
cggcactccagct

SEQ ID NO: 612418 - DNA, 14 bp, D. melanogaster
cggcactcgctgcc

SEQ ID NO: 612419 - DNA, 13 bp, D. melanogaster
cggcagaagagca

SEQ ID NO: 612420 - DNA, 13 bp, D. melanogaster
cggcagaggcagc

SEQ ID NO: 612421 - DNA, 14 bp, D. melanogaster
cggcagaggcagcg

SEQ ID NO: 612422 - DNA, 13 bp, D. melanogaster
cggcagcaaaaaa

SEQ ID NO: 612423 - DNA, 13 bp, D. melanogaster
cggcagcaaaatg

SEQ ID NO: 612424 - DNA, 13 bp, D. melanogaster
cggcagcaacaag

SEQ ID NO: 612425 - DNA, 13 bp, D. melanogaster
cggcagcaacaat

SEQ ID NO: 612426 - DNA, 13 bp, D. melanogaster
cggcagcaacagt

SEQ ID NO: 612427 - DNA, 14 bp, D. melanogaster
cggcagcaacatca

SEQ ID NO: 612428 - DNA, 13 bp, D. melanogaster
cggcagcaacatg

SEQ ID NO: 612429 - DNA, 13 bp, D. melanogaster
cggcagcaacatt

SEQ ID NO: 612430 - DNA, 14 bp, D. melanogaster
cggcagcaattcgc

SEQ ID NO: 612431 - DNA, 13 bp, D. melanogaster
cggcagcagcaac

SEQ ID NO: 612432 - DNA, 15 bp, D. melanogaster
cggcagcagcagcaa

SEQ ID NO: 612433 - DNA, 13 bp, D. melanogaster
cggcagcagcggc

SEQ ID NO: 612434 - DNA, 13 bp, D. melanogaster
cggcagcagctgc

SEQ ID NO: 612435 - DNA, 13 bp, D. melanogaster
cggcagcaggagc

SEQ ID NO: 612436 - DNA, 13 bp, D. melanogaster
cggcagcagtctg

SEQ ID NO: 612437 - DNA, 14 bp, D. melanogaster
cggcagcgacgtcg

SEQ ID NO: 612438 - DNA, 13 bp, D. melanogaster
cggcagcgagtgc

SEQ ID NO: 612439 - DNA, 13 bp, D. melanogaster
cggcagcggaaaa

SEQ ID NO: 612440 - DNA, 13 bp, D. melanogaster
cggcagcggatgt

SEQ ID NO: 612441 - DNA, 13 bp, D. melanogaster
cggcagctgttgc

SEQ ID NO: 612442 - DNA, 13 bp, D. melanogaster
cggcaggaaaatg

SEQ ID NO: 612443 - DNA, 13 bp, D. melanogaster
cggcaggacctca

SEQ ID NO: 612444 - DNA, 13 bp, D. melanogaster
cggcagtgaaaac

SEQ ID NO: 612445 - DNA, 14 bp, D. melanogaster
cggcagtggcagtg

SEQ ID NO: 612446 - DNA, 13 bp, D. melanogaster
cggcataataaca

SEQ ID NO: 612447 - DNA, 13 bp, D. melanogaster
cggcatacacaag

SEQ ID NO: 612448 - DNA, 13 bp, D. melanogaster
cggcatcagcatc

SEQ ID NO: 612449 - DNA, 13 bp, D. melanogaster
cggcatcgccatt

SEQ ID NO: 612450 - DNA, 13 bp, D. melanogaster
cggcatcgtcatc

SEQ ID NO: 612451 - DNA, 13 bp, D. melanogaster
cggcatctgttgg

SEQ ID NO: 612452 - DNA, 13 bp, D. melanogaster
cggcatgggcgac

SEQ ID NO: 612453 - DNA, 13 bp, D. melanogaster
cggcatgttcatt

SEQ ID NO: 612454 - DNA, 13 bp, D. melanogaster
cggcattgcgttt

SEQ ID NO: 612455 - DNA, 14 bp, D. melanogaster
cggcattgcgttta

SEQ ID NO: 612456 - DNA, 13 bp, D. melanogaster
cggcattgctgcg

SEQ ID NO: 612457 - DNA, 13 bp, D. melanogaster
cggcatttggcat

SEQ ID NO: 612458 - DNA, 13 bp, D. melanogaster
cggccaaaagaaa

SEQ ID NO: 612459 - DNA, 13 bp, D. melanogaster
cggccaaaattgc

SEQ ID NO: 612460 - DNA, 14 bp, D. melanogaster
cggccaaaattgct

SEQ ID NO: 612461 - DNA, 13 bp, D. melanogaster
cggccaaatgctt

SEQ ID NO: 612462 - DNA, 13 bp, D. melanogaster
cggccaacaaaag

SEQ ID NO: 612463 - DNA, 14 bp, D. melanogaster
cggccaagacggcg

SEQ ID NO: 612464 - DNA, 13 bp, D. melanogaster
cggccaatgtggt

SEQ ID NO: 612465 - DNA, 14 bp, D. melanogaster
cggccacgcccact

SEQ ID NO: 612466 - DNA, 14 bp, D. melanogaster
cggccacgccccct

SEQ ID NO: 612467 - DNA, 14 bp, D. melanogaster
cggccacgcccctt

SEQ ID NO: 612468 - DNA, 13 bp, D. melanogaster
cggccacgcctcc

SEQ ID NO: 612469 - DNA, 13 bp, D. melanogaster
cggccagcaaaaa

SEQ ID NO: 612470 - DNA, 14 bp, D. melanogaster
cggccagcaacttt

SEQ ID NO: 612471 - DNA, 13 bp, D. melanogaster
cggccataaaaat

SEQ ID NO: 612472 - DNA, 13 bp, D. melanogaster
cggccatagcgaa

SEQ ID NO: 612473 - DNA, 13 bp, D. melanogaster
cggccatcaatca

SEQ ID NO: 612474 - DNA, 13 bp, D. melanogaster
cggccattaaaac

SEQ ID NO: 612475 - DNA, 13 bp, D. melanogaster
cggcccattcgca

SEQ ID NO: 612476 - DNA, 13 bp, D. melanogaster
cggccggacattg

SEQ ID NO: 612477 - DNA, 13 bp, D. melanogaster
cggccgttttctg

SEQ ID NO: 612478 - DNA, 13 bp, D. melanogaster
cggcctaatgttt

SEQ ID NO: 612479 - DNA, 14 bp, D. melanogaster
cggcctctgtttcc

SEQ ID NO: 612480 - DNA, 13 bp, D. melanogaster
cggcctgcaattc

SEQ ID NO: 612481 - DNA, 13 bp, D. melanogaster
cggcgaaacaaaa

SEQ ID NO: 612482 - DNA, 13 bp, D. melanogaster
cggcgaaactttt

SEQ ID NO: 612483 - DNA, 13 bp, D. melanogaster
cggcgaacaaaaa

SEQ ID NO: 612484 - DNA, 13 bp, D. melanogaster
cggcgaactgcat

SEQ ID NO: 612485 - DNA, 13 bp, D. melanogaster
cggcgaagaaagc

SEQ ID NO: 612486 - DNA, 13 bp, D. melanogaster
cggcgaatgcaaa

SEQ ID NO: 612487 - DNA, 13 bp, D. melanogaster
cggcgaatggaaa

SEQ ID NO: 612488 - DNA, 13 bp, D. melanogaster
cggcgacaacaac

SEQ ID NO: 612489 - DNA, 14 bp, D. melanogaster
cggcgacaacaaca

SEQ ID NO: 612490 - DNA, 13 bp, D. melanogaster
cggcgacagcgac

SEQ ID NO: 612491 - DNA, 13 bp, D. melanogaster
cggcgacggcgac

SEQ ID NO: 612492 - DNA, 13 bp, D. melanogaster
cggcgactgcgac

SEQ ID NO: 612493 - DNA, 13 bp, D. melanogaster
cggcgagcataat

SEQ ID NO: 612494 - DNA, 13 bp, D. melanogaster
cggcgatgatgat

SEQ ID NO: 612495 - DNA, 13 bp, D. melanogaster
cggcgatggcgat

SEQ ID NO: 612496 - DNA, 16 bp, D. melanogaster
cggcgattttaacaaa

SEQ ID NO: 612497 - DNA, 13 bp, D. melanogaster
cggcgcagcgcag

SEQ ID NO: 612498 - DNA, 13 bp, D. melanogaster
cggcgcagtcgca

SEQ ID NO: 612499 - DNA, 13 bp, D. melanogaster
cggcgcatgcgca

SEQ ID NO: 612500 - DNA, 13 bp, D. melanogaster
cggcggaaaagcg

SEQ ID NO: 612501 - DNA, 13 bp, D. melanogaster
cggcggcaacaaa

SEQ ID NO: 612502 - DNA, 14 bp, D. melanogaster
cggcggcaacaaca

SEQ ID NO: 612503 - DNA, 13 bp, D. melanogaster
cggcggcagcaac

SEQ ID NO: 612504 - DNA, 13 bp, D. melanogaster
cggcggcagcagc

SEQ ID NO: 612505 - DNA, 14 bp, D. melanogaster
cggcggcagcgacg

SEQ ID NO: 612506 - DNA, 14 bp, D. melanogaster
cggcggcgcagtcg

SEQ ID NO: 612507 - DNA, 13 bp, D. melanogaster
cggcggcggcaaa

SEQ ID NO: 612508 - DNA, 13 bp, D. melanogaster
cggcgggaacagc

SEQ ID NO: 612509 - DNA, 13 bp, D. melanogaster
cggcgtatgcgcg

SEQ ID NO: 612510 - DNA, 14 bp, D. melanogaster
cggctaaaagagcc

SEQ ID NO: 612511 - DNA, 13 bp, D. melanogaster
cggctattgatcc

SEQ ID NO: 612512 - DNA, 13 bp, D. melanogaster
cggctcatttgca

SEQ ID NO: 612513 - DNA, 13 bp, D. melanogaster
cggctcctccacg

SEQ ID NO: 612514 - DNA, 13 bp, D. melanogaster
cggctcgaaggac

SEQ ID NO: 612515 - DNA, 14 bp, D. melanogaster
cggctcgaaggacc

SEQ ID NO: 612516 - DNA, 13 bp, D. melanogaster
cggctgcaaaggc

SEQ ID NO: 612517 - DNA, 13 bp, D. melanogaster
cggctgcacccaa

SEQ ID NO: 612518 - DNA, 13 bp, D. melanogaster
cggctgcacccgc

SEQ ID NO: 612519 - DNA, 13 bp, D. melanogaster
cggctgcagagaa

SEQ ID NO: 612520 - DNA, 13 bp, D. melanogaster
cggctgccttcaa

SEQ ID NO: 612521 - DNA, 13 bp, D. melanogaster
cggctgcgccagt

SEQ ID NO: 612522 - DNA, 13 bp, D. melanogaster
cggctgcggatgt

SEQ ID NO: 612523 - DNA, 14 bp, D. melanogaster
cggctgctgagctg

SEQ ID NO: 612524 - DNA, 13 bp, D. melanogaster
cggctgctgcagt

SEQ ID NO: 612525 - DNA, 14 bp, D. melanogaster
cggctgctgctgct

SEQ ID NO: 612526 - DNA, 13 bp, D. melanogaster
cggctgctggctg

SEQ ID NO: 612527 - DNA, 13 bp, D. melanogaster
cggctggccagcg

SEQ ID NO: 612528 - DNA, 13 bp, D. melanogaster
cggctggctggct

SEQ ID NO: 612529 - DNA, 14 bp, D. melanogaster
cggctggctggctg

SEQ ID NO: 612530 - DNA, 13 bp, D. melanogaster
cggctgttgctgc

SEQ ID NO: 612531 - DNA, 14 bp, D. melanogaster
cggcttggagaagg

SEQ ID NO: 612532 - DNA, 13 bp, D. melanogaster
cggcttgggtgat

SEQ ID NO: 612533 - DNA, 13 bp, D. melanogaster
cggctttaatttt

SEQ ID NO: 612534 - DNA, 14 bp, D. melanogaster
cggctttagggcgt

SEQ ID NO: 612535 - DNA, 14 bp, D. melanogaster
cggctttctcgagc

SEQ ID NO: 612536 - DNA, 13 bp, D. melanogaster
cggctttggcttt

SEQ ID NO: 612537 - DNA, 13 bp, D. melanogaster
cggcttttgcctt

SEQ ID NO: 612538 - DNA, 13 bp, D. melanogaster
cggcttttgttgc

SEQ ID NO: 612539 - DNA, 13 bp, D. melanogaster
cggcttttgtttg

SEQ ID NO: 612540 - DNA, 13 bp, D. melanogaster
cgggaaaactttt

SEQ ID NO: 612541 - DNA, 13 bp, D. melanogaster
cgggaaaatcaat

SEQ ID NO: 612542 - DNA, 14 bp, D. melanogaster
cgggaaaatggaaa

SEQ ID NO: 612543 - DNA, 13 bp, D. melanogaster
cgggaaattaaca

SEQ ID NO: 612544 - DNA, 13 bp, D. melanogaster
cgggaacgggaac

SEQ ID NO: 612545 - DNA, 14 bp, D. melanogaster
cgggaactataaaa

SEQ ID NO: 612546 - DNA, 13 bp, D. melanogaster
cgggagagcagga

SEQ ID NO: 612547 - DNA, 13 bp, D. melanogaster
cgggagagcgaga

SEQ ID NO: 612548 - DNA, 14 bp, D. melanogaster
cgggagcgagcgga

SEQ ID NO: 612549 - DNA, 13 bp, D. melanogaster
cgggagtgagccg

SEQ ID NO: 612550 - DNA, 13 bp, D. melanogaster
cgggagtgagcgg

SEQ ID NO: 612551 - DNA, 13 bp, D. melanogaster
cgggagttttggg

SEQ ID NO: 612552 - DNA, 13 bp, D. melanogaster
cgggatcggaatc

SEQ ID NO: 612553 - DNA, 13 bp, D. melanogaster
cgggatcttttca

SEQ ID NO: 612554 - DNA, 13 bp, D. melanogaster
cgggattgggatt

SEQ ID NO: 612555 - DNA, 13 bp, D. melanogaster
cgggatttataat

SEQ ID NO: 612556 - DNA, 13 bp, D. melanogaster
cgggcacaccaag

SEQ ID NO: 612557 - DNA, 13 bp, D. melanogaster
cgggcacatctgc

SEQ ID NO: 612558 - DNA, 13 bp, D. melanogaster
cgggcagaaaaag

SEQ ID NO: 612559 - DNA, 14 bp, D. melanogaster
cgggccaaaaaaaa

SEQ ID NO: 612560 - DNA, 13 bp, D. melanogaster
cgggccaaaagga

SEQ ID NO: 612561 - DNA, 13 bp, D. melanogaster
cgggccaaacggc

SEQ ID NO: 612562 - DNA, 13 bp, D. melanogaster
cgggcctatctac

SEQ ID NO: 612563 - DNA, 13 bp, D. melanogaster
cgggcgccagtta

SEQ ID NO: 612564 - DNA, 14 bp, D. melanogaster
cgggctgcgttata

SEQ ID NO: 612565 - DNA, 13 bp, D. melanogaster
cgggctgctcacc

SEQ ID NO: 612566 - DNA, 13 bp, D. melanogaster
cgggctgctgctg

SEQ ID NO: 612567 - DNA, 13 bp, D. melanogaster
cggggaaatggga

SEQ ID NO: 612568 - DNA, 14 bp, D. melanogaster
cggggaagtcgact

SEQ ID NO: 612569 - DNA, 13 bp, D. melanogaster
cggggatcgggga

SEQ ID NO: 612570 - DNA, 13 bp, D. melanogaster
cggggcgtatggg

SEQ ID NO: 612571 - DNA, 13 bp, D. melanogaster
cggggcgtggcag

SEQ ID NO: 612572 - DNA, 13 bp, D. melanogaster
cgggggaaaatcg

SEQ ID NO: 612573 - DNA, 13 bp, D. melanogaster
cgggggatttttt

SEQ ID NO: 612574 - DNA, 14 bp, D. melanogaster
cggggggcgtggca

SEQ ID NO: 612575 - DNA, 13 bp, D. melanogaster
cgggtataaaaat

SEQ ID NO: 612576 - DNA, 14 bp, D. melanogaster
cgggtataaaaata

SEQ ID NO: 612577 - DNA, 13 bp, D. melanogaster
cgggtggcattct

SEQ ID NO: 612578 - DNA, 13 bp, D. melanogaster
cggtaaaagtcgg

SEQ ID NO: 612579 - DNA, 13 bp, D. melanogaster
cggtaattgctgt

SEQ ID NO: 612580 - DNA, 13 bp, D. melanogaster
cggtactaagcct

SEQ ID NO: 612581 - DNA, 14 bp, D. melanogaster
cggtataccaaaaa

SEQ ID NO: 612582 - DNA, 13 bp, D. melanogaster
cggtatccacatt

SEQ ID NO: 612583 - DNA, 13 bp, D. melanogaster
cggtattggaaag

SEQ ID NO: 612584 - DNA, 13 bp, D. melanogaster
cggtcaacagcta

SEQ ID NO: 612585 - DNA, 13 bp, D. melanogaster
cggtcacgcccac

SEQ ID NO: 612586 - DNA, 13 bp, D. melanogaster
cggtcagcaaacg

SEQ ID NO: 612587 - DNA, 13 bp, D. melanogaster
cggtcagtgctgc

SEQ ID NO: 612588 - DNA, 13 bp, D. melanogaster
cggtctacacgct

SEQ ID NO: 612589 - DNA, 13 bp, D. melanogaster
cggtgacatcaat

SEQ ID NO: 612590 - DNA, 13 bp, D. melanogaster
cggtgaccatgtt

SEQ ID NO: 612591 - DNA, 14 bp, D. melanogaster
cggtgagaagagag

SEQ ID NO: 612592 - DNA, 13 bp, D. melanogaster
cggtgcaaaagga

SEQ ID NO: 612593 - DNA, 13 bp, D. melanogaster
cggtgccaattcg

SEQ ID NO: 612594 - DNA, 13 bp, D. melanogaster
cggtgccccagtg

SEQ ID NO: 612595 - DNA, 13 bp, D. melanogaster
cggtgcgtatgcg

SEQ ID NO: 612596 - DNA, 13 bp, D. melanogaster
cggtgcgtgcgcg

SEQ ID NO: 612597 - DNA, 13 bp, D. melanogaster
cggtgcttcagct

SEQ ID NO: 612598 - DNA, 13 bp, D. melanogaster
cggtggaaaagcg

SEQ ID NO: 612599 - DNA, 13 bp, D. melanogaster
cggtggaaaatgg

SEQ ID NO: 612600 - DNA, 13 bp, D. melanogaster
cggtggaaatggt

SEQ ID NO: 612601 - DNA, 13 bp, D. melanogaster
cggtggaaattgc

SEQ ID NO: 612602 - DNA, 14 bp, D. melanogaster
cggtggcagtggca

SEQ ID NO: 612603 - DNA, 13 bp, D. melanogaster
cggtggcatggtg

SEQ ID NO: 612604 - DNA, 13 bp, D. melanogaster
cggtggcctgctc

SEQ ID NO: 612605 - DNA, 14 bp, D. melanogaster
cggtggctggagca

SEQ ID NO: 612606 - DNA, 14 bp, D. melanogaster
cggtgggcggggca

SEQ ID NO: 612607 - DNA, 13 bp, D. melanogaster
cggtgggtggaaa

SEQ ID NO: 612608 - DNA, 14 bp, D. melanogaster
cggtggttcagtgg

SEQ ID NO: 612609 - DNA, 13 bp, D. melanogaster
cggtgttccagtt

SEQ ID NO: 612610 - DNA, 13 bp, D. melanogaster
cggttaacaaaag

SEQ ID NO: 612611 - DNA, 13 bp, D. melanogaster
cggttaagcgcga

SEQ ID NO: 612612 - DNA, 13 bp, D. melanogaster
cggttaccaaaat

SEQ ID NO: 612613 - DNA, 13 bp, D. melanogaster
cggttagattttt

SEQ ID NO: 612614 - DNA, 13 bp, D. melanogaster
cggttataatttt

SEQ ID NO: 612615 - DNA, 13 bp, D. melanogaster
cggttatcaaaac

SEQ ID NO: 612616 - DNA, 13 bp, D. melanogaster
cggttcggttcag

SEQ ID NO: 612617 - DNA, 13 bp, D. melanogaster
cggttcggttcgg

SEQ ID NO: 612618 - DNA, 13 bp, D. melanogaster
cggttcggtttgg

SEQ ID NO: 612619 - DNA, 13 bp, D. melanogaster
cggttctattccg

SEQ ID NO: 612620 - DNA, 13 bp, D. melanogaster
cggttgcattttt

SEQ ID NO: 612621 - DNA, 13 bp, D. melanogaster
cggttgccaaaaa

SEQ ID NO: 612622 - DNA, 13 bp, D. melanogaster
cggttgccagttg

SEQ ID NO: 612623 - DNA, 13 bp, D. melanogaster
cggttggcagcgc

SEQ ID NO: 612624 - DNA, 13 bp, D. melanogaster
cggttgtaattgt

SEQ ID NO: 612625 - DNA, 13 bp, D. melanogaster
cggttgttattat

SEQ ID NO: 612626 - DNA, 13 bp, D. melanogaster
cggttgttgttgc

SEQ ID NO: 612627 - DNA, 13 bp, D. melanogaster
cggttgttttgag

SEQ ID NO: 612628 - DNA, 14 bp, D. melanogaster
cggtttcagtcggt

SEQ ID NO: 612629 - DNA, 13 bp, D. melanogaster
cggtttcggattc

SEQ ID NO: 612630 - DNA, 13 bp, D. melanogaster
cggtttcggtttc

SEQ ID NO: 612631 - DNA, 15 bp, D. melanogaster
cggtttctgctaccg

SEQ ID NO: 612632 - DNA, 14 bp, D. melanogaster
cggtttgtgggcgt

SEQ ID NO: 612633 - DNA, 13 bp, D. melanogaster
cggtttgtttgtc

SEQ ID NO: 612634 - DNA, 13 bp, D. melanogaster
cggttttgataac

SEQ ID NO: 612635 - DNA, 13 bp, D. melanogaster
cggttttgtcaac

SEQ ID NO: 612636 - DNA, 13 bp, D. melanogaster
cggtttttgtgcc

SEQ ID NO: 612637 - DNA, 13 bp, D. melanogaster
cgtaaaaaatata

SEQ ID NO: 612638 - DNA, 13 bp, D. melanogaster
cgtaaaaatagtg

SEQ ID NO: 612639 - DNA, 13 bp, D. melanogaster
cgtaaaaatgcaa

SEQ ID NO: 612640 - DNA, 13 bp, D. melanogaster
cgtaaaaatgttt

SEQ ID NO: 612641 - DNA, 13 bp, D. melanogaster
cgtaaaaattatt

SEQ ID NO: 612642 - DNA, 13 bp, D. melanogaster
cgtaaaacatttt

SEQ ID NO: 612643 - DNA, 13 bp, D. melanogaster
cgtaaaactaaaa

SEQ ID NO: 612644 - DNA, 13 bp, D. melanogaster
cgtaaaataaaat

SEQ ID NO: 612645 - DNA, 13 bp, D. melanogaster
cgtaaaatatata

SEQ ID NO: 612646 - DNA, 14 bp, D. melanogaster
cgtaaacaaaaaag

SEQ ID NO: 612647 - DNA, 13 bp, D. melanogaster
cgtaaactgcatt

SEQ ID NO: 612648 - DNA, 13 bp, D. melanogaster
cgtaataaaaatt

SEQ ID NO: 612649 - DNA, 13 bp, D. melanogaster
cgtaataaaattc

SEQ ID NO: 612650 - DNA, 14 bp, D. melanogaster
cgtaatattgttat

SEQ ID NO: 612651 - DNA, 13 bp, D. melanogaster
cgtaatattttaa

SEQ ID NO: 612652 - DNA, 13 bp, D. melanogaster
cgtaatcaaaacc

SEQ ID NO: 612653 - DNA, 13 bp, D. melanogaster
cgtaatcgtaatc

SEQ ID NO: 612654 - DNA, 13 bp, D. melanogaster
cgtaattaaaata

SEQ ID NO: 612655 - DNA, 13 bp, D. melanogaster
cgtaattcgtaat

SEQ ID NO: 612656 - DNA, 13 bp, D. melanogaster
cgtaattgtaatt

SEQ ID NO: 612657 - DNA, 14 bp, D. melanogaster
cgtaatttaataaa

SEQ ID NO: 612658 - DNA, 13 bp, D. melanogaster
cgtacatacatac

SEQ ID NO: 612659 - DNA, 14 bp, D. melanogaster
cgtacatacatacg

SEQ ID NO: 612660 - DNA, 14 bp, D. melanogaster
cgtacatacatata

SEQ ID NO: 612661 - DNA, 13 bp, D. melanogaster
cgtacgtacgtat

SEQ ID NO: 612662 - DNA, 13 bp, D. melanogaster
cgtactcatatat

SEQ ID NO: 612663 - DNA, 13 bp, D. melanogaster
cgtactcgtactc

SEQ ID NO: 612664 - DNA, 14 bp, D. melanogaster
cgtactcgtactcg

SEQ ID NO: 612665 - DNA, 13 bp, D. melanogaster
cgtactctttcaa

SEQ ID NO: 612666 - DNA, 13 bp, D. melanogaster
cgtagaaaagaac

SEQ ID NO: 612667 - DNA, 13 bp, D. melanogaster
cgtagaaaagagc

SEQ ID NO: 612668 - DNA, 14 bp, D. melanogaster
cgtagagtaaaagg

SEQ ID NO: 612669 - DNA, 14 bp, D. melanogaster
cgtagcatactttt

SEQ ID NO: 612670 - DNA, 13 bp, D. melanogaster
cgtaggccattta

SEQ ID NO: 612671 - DNA, 13 bp, D. melanogaster
cgtagtgacgaag

SEQ ID NO: 612672 - DNA, 13 bp, D. melanogaster
cgtagtgatgaag

SEQ ID NO: 612673 - DNA, 13 bp, D. melanogaster
cgtagtgttttca

SEQ ID NO: 612674 - DNA, 13 bp, D. melanogaster
cgtagtttttggt

SEQ ID NO: 612675 - DNA, 13 bp, D. melanogaster
cgtataaacgtcg

SEQ ID NO: 612676 - DNA, 13 bp, D. melanogaster
cgtataaataaat

SEQ ID NO: 612677 - DNA, 14 bp, D. melanogaster
cgtataaatataaa

SEQ ID NO: 612678 - DNA, 14 bp, D. melanogaster
cgtataagtttttc

SEQ ID NO: 612679 - DNA, 13 bp, D. melanogaster
cgtatacgcaacg

SEQ ID NO: 612680 - DNA, 14 bp, D. melanogaster
cgtatacgcaacgt

SEQ ID NO: 612681 - DNA, 14 bp, D. melanogaster
cgtatacgcaccgt

SEQ ID NO: 612682 - DNA, 13 bp, D. melanogaster
cgtatacgcactg

SEQ ID NO: 612683 - DNA, 13 bp, D. melanogaster
cgtatacgcccca

SEQ ID NO: 612684 - DNA, 13 bp, D. melanogaster
cgtatacgccccg

SEQ ID NO: 612685 - DNA, 13 bp, D. melanogaster
cgtatacgccctg

SEQ ID NO: 612686 - DNA, 14 bp, D. melanogaster
cgtatacgccgtgt

SEQ ID NO: 612687 - DNA, 13 bp, D. melanogaster
cgtatacgcgata

SEQ ID NO: 612688 - DNA, 14 bp, D. melanogaster
cgtatacgcgatat

SEQ ID NO: 612689 - DNA, 13 bp, D. melanogaster
cgtatacgtaata

SEQ ID NO: 612690 - DNA, 14 bp, D. melanogaster
cgtatacgtaataa

SEQ ID NO: 612691 - DNA, 14 bp, D. melanogaster
cgtatacgtaatat

SEQ ID NO: 612692 - DNA, 13 bp, D. melanogaster
cgtatacgtaatc

SEQ ID NO: 612693 - DNA, 14 bp, D. melanogaster
cgtatacgtaatgc

SEQ ID NO: 612694 - DNA, 13 bp, D. melanogaster
cgtatacgtatac

SEQ ID NO: 612695 - DNA, 13 bp, D. melanogaster
cgtatacttaata

SEQ ID NO: 612696 - DNA, 14 bp, D. melanogaster
cgtatacttaatat

SEQ ID NO: 612697 - DNA, 13 bp, D. melanogaster
cgtatacttaatt

SEQ ID NO: 612698 - DNA, 14 bp, D. melanogaster
cgtatacttaattt

SEQ ID NO: 612699 - DNA, 13 bp, D. melanogaster
cgtatatacatac

SEQ ID NO: 612700 - DNA, 14 bp, D. melanogaster
cgtatatacataca

SEQ ID NO: 612701 - DNA, 13 bp, D. melanogaster
cgtatatatttat

SEQ ID NO: 612702 - DNA, 14 bp, D. melanogaster
cgtatatgtacata

SEQ ID NO: 612703 - DNA, 13 bp, D. melanogaster
cgtatatgtgtgc

SEQ ID NO: 612704 - DNA, 14 bp, D. melanogaster
cgtatatgtgtgcg

SEQ ID NO: 612705 - DNA, 13 bp, D. melanogaster
cgtatatttaaaa

SEQ ID NO: 612706 - DNA, 13 bp, D. melanogaster
cgtatattttaaa

SEQ ID NO: 612707 - DNA, 13 bp, D. melanogaster
cgtatccgtatcc

SEQ ID NO: 612708 - DNA, 14 bp, D. melanogaster
cgtatccgtatctg

SEQ ID NO: 612709 - DNA, 14 bp, D. melanogaster
cgtatcgtatcgta

SEQ ID NO: 612710 - DNA, 13 bp, D. melanogaster
cgtatctgaatct

SEQ ID NO: 612711 - DNA, 13 bp, D. melanogaster
cgtatctgcatct

SEQ ID NO: 612712 - DNA, 13 bp, D. melanogaster
cgtatctgtatct

SEQ ID NO: 612713 - DNA, 14 bp, D. melanogaster
cgtatctgtatctg

SEQ ID NO: 612714 - DNA, 14 bp, D. melanogaster
cgtatctgtatctt

SEQ ID NO: 612715 - DNA, 13 bp, D. melanogaster
cgtatgaaaattg

SEQ ID NO: 612716 - DNA, 14 bp, D. melanogaster
cgtatgaaatatat

SEQ ID NO: 612717 - DNA, 14 bp, D. melanogaster
cgtatgaacgttga

SEQ ID NO: 612718 - DNA, 13 bp, D. melanogaster
cgtatgagcaaca

SEQ ID NO: 612719 - DNA, 14 bp, D. melanogaster
cgtatgagcaatgt

SEQ ID NO: 612720 - DNA, 13 bp, D. melanogaster
cgtatgagcgatg

SEQ ID NO: 612721 - DNA, 13 bp, D. melanogaster
cgtatgagtaatc

SEQ ID NO: 612722 - DNA, 13 bp, D. melanogaster
cgtatgcaaaacc

SEQ ID NO: 612723 - DNA, 16 bp, D. melanogaster
cgtatgcgtaatattt

SEQ ID NO: 612724 - DNA, 13 bp, D. melanogaster
cgtatgcgtaatc

SEQ ID NO: 612725 - DNA, 13 bp, D. melanogaster
cgtatgcgtaatg

SEQ ID NO: 612726 - DNA, 14 bp, D. melanogaster
cgtatgcgtaatgt

SEQ ID NO: 612727 - DNA, 14 bp, D. melanogaster
cgtatgcgtgatat

SEQ ID NO: 612728 - DNA, 13 bp, D. melanogaster
cgtatgctcatgc

SEQ ID NO: 612729 - DNA, 13 bp, D. melanogaster
cgtatgcttaatg

SEQ ID NO: 612730 - DNA, 14 bp, D. melanogaster
cgtatgtatgtgtg

SEQ ID NO: 612731 - DNA, 13 bp, D. melanogaster
cgtatgtgtaatg

SEQ ID NO: 612732 - DNA, 13 bp, D. melanogaster
cgtatgtgtgtgt

SEQ ID NO: 612733 - DNA, 14 bp, D. melanogaster
cgtatgtgtgtgtg

SEQ ID NO: 612734 - DNA, 13 bp, D. melanogaster
cgtatgtgttgtc

SEQ ID NO: 612735 - DNA, 13 bp, D. melanogaster
cgtattccgtatt

SEQ ID NO: 612736 - DNA, 13 bp, D. melanogaster
cgtattcttggca

SEQ ID NO: 612737 - DNA, 14 bp, D. melanogaster
cgtattcttggcaa

SEQ ID NO: 612738 - DNA, 13 bp, D. melanogaster
cgtattgatggcc

SEQ ID NO: 612739 - DNA, 13 bp, D. melanogaster
cgtatttattaag

SEQ ID NO: 612740 - DNA, 13 bp, D. melanogaster
cgtatttattatt

SEQ ID NO: 612741 - DNA, 13 bp, D. melanogaster
cgtatttcacttc

SEQ ID NO: 612742 - DNA, 13 bp, D. melanogaster
cgtatttcgtttt

SEQ ID NO: 612743 - DNA, 14 bp, D. melanogaster
cgtcaaatgaaatg

SEQ ID NO: 612744 - DNA, 13 bp, D. melanogaster
cgtcagcgcagca

SEQ ID NO: 612745 - DNA, 13 bp, D. melanogaster
cgtcataaattta

SEQ ID NO: 612746 - DNA, 13 bp, D. melanogaster
cgtcatcatcatc

SEQ ID NO: 612747 - DNA, 14 bp, D. melanogaster
cgtcatcatcatca

SEQ ID NO: 612748 - DNA, 13 bp, D. melanogaster
cgtcatcatcgtc

SEQ ID NO: 612749 - DNA, 14 bp, D. melanogaster
cgtcatcatcgtca

SEQ ID NO: 612750 - DNA, 14 bp, D. melanogaster
cgtcatcgcaaagt

SEQ ID NO: 612751 - DNA, 14 bp, D. melanogaster
cgtcatcgccatcg

SEQ ID NO: 612752 - DNA, 13 bp, D. melanogaster
cgtcatcggctgc

SEQ ID NO: 612753 - DNA, 13 bp, D. melanogaster
cgtcatcgtcatc

SEQ ID NO: 612754 - DNA, 14 bp, D. melanogaster
cgtcatcgtcatcg

SEQ ID NO: 612755 - DNA, 13 bp, D. melanogaster
cgtcatcttcatc

SEQ ID NO: 612756 - DNA, 13 bp, D. melanogaster
cgtcatttgcatt

SEQ ID NO: 612757 - DNA, 13 bp, D. melanogaster
cgtccaacgctgg

SEQ ID NO: 612758 - DNA, 14 bp, D. melanogaster
cgtccacatccacg

SEQ ID NO: 612759 - DNA, 13 bp, D. melanogaster
cgtccagaacagt

SEQ ID NO: 612760 - DNA, 13 bp, D. melanogaster
cgtccatcgtcca

SEQ ID NO: 612761 - DNA, 13 bp, D. melanogaster
cgtccgtataaac

SEQ ID NO: 612762 - DNA, 13 bp, D. melanogaster
cgtccgtctgtct

SEQ ID NO: 612763 - DNA, 13 bp, D. melanogaster
cgtcctgcatcct

SEQ ID NO: 612764 - DNA, 13 bp, D. melanogaster
cgtccttcgtcct

SEQ ID NO: 612765 - DNA, 13 bp, D. melanogaster
cgtccttttggcc

SEQ ID NO: 612766 - DNA, 13 bp, D. melanogaster
cgtcgaaggaccc

SEQ ID NO: 612767 - DNA, 13 bp, D. melanogaster
cgtcgacagcggc

SEQ ID NO: 612768 - DNA, 13 bp, D. melanogaster
cgtcgacgccggc

SEQ ID NO: 612769 - DNA, 13 bp, D. melanogaster
cgtcgacggcgac

SEQ ID NO: 612770 - DNA, 13 bp, D. melanogaster
cgtcgacgtcggc

SEQ ID NO: 612771 - DNA, 13 bp, D. melanogaster
cgtcgactgcgac

SEQ ID NO: 612772 - DNA, 13 bp, D. melanogaster
cgtcgactgcggc

SEQ ID NO: 612773 - DNA, 13 bp, D. melanogaster
cgtcgatgaataa

SEQ ID NO: 612774 - DNA, 13 bp, D. melanogaster
cgtcgcagtcgcc

SEQ ID NO: 612775 - DNA, 13 bp, D. melanogaster
cgtcgccatcgcc

SEQ ID NO: 612776 - DNA, 13 bp, D. melanogaster
cgtcgccatcgtc

SEQ ID NO: 612777 - DNA, 13 bp, D. melanogaster
cgtcggcagaggc

SEQ ID NO: 612778 - DNA, 13 bp, D. melanogaster
cgtcggcagcggc

SEQ ID NO: 612779 - DNA, 14 bp, D. melanogaster
cgtcggcagcggcg

SEQ ID NO: 612780 - DNA, 15 bp, D. melanogaster
cgtcggcagcggcgc

SEQ ID NO: 612781 - DNA, 14 bp, D. melanogaster
cgtcggcttgtgga

SEQ ID NO: 612782 - DNA, 14 bp, D. melanogaster
cgtcggggtcacca

SEQ ID NO: 612783 - DNA, 13 bp, D. melanogaster
cgtcgtcagcaaa

SEQ ID NO: 612784 - DNA, 14 bp, D. melanogaster
cgtcgtcgtcatcg

SEQ ID NO: 612785 - DNA, 13 bp, D. melanogaster
cgtcgtcgtcctc

SEQ ID NO: 612786 - DNA, 13 bp, D. melanogaster
cgtcgtcgtcgcc

SEQ ID NO: 612787 - DNA, 14 bp, D. melanogaster
cgtcgtcgtcgccg

SEQ ID NO: 612788 - DNA, 13 bp, D. melanogaster
cgtcgtcgtcggc

SEQ ID NO: 612789 - DNA, 13 bp, D. melanogaster
cgtcgtcgtcgtc

SEQ ID NO: 612790 - DNA, 14 bp, D. melanogaster
cgtcgtcgtcgtct

SEQ ID NO: 612791 - DNA, 13 bp, D. melanogaster
cgtcgtcgtcgtt

SEQ ID NO: 612792 - DNA, 14 bp, D. melanogaster
cgtcgtcgtcgttg

SEQ ID NO: 612793 - DNA, 13 bp, D. melanogaster
cgtcgtcgtctgc

SEQ ID NO: 612794 - DNA, 13 bp, D. melanogaster
cgtcgttgaatgt

SEQ ID NO: 612795 - DNA, 13 bp, D. melanogaster
cgtcgttgtcgtt

SEQ ID NO: 612796 - DNA, 13 bp, D. melanogaster
cgtcgttgttgtc

SEQ ID NO: 612797 - DNA, 13 bp, D. melanogaster
cgtcgttgttgtt

SEQ ID NO: 612798 - DNA, 13 bp, D. melanogaster
cgtctaaaaatac

SEQ ID NO: 612799 - DNA, 13 bp, D. melanogaster
cgtctaagttgta

SEQ ID NO: 612800 - DNA, 13 bp, D. melanogaster
cgtctacaagaaa

SEQ ID NO: 612801 - DNA, 13 bp, D. melanogaster
cgtctacaatgtt

SEQ ID NO: 612802 - DNA, 13 bp, D. melanogaster
cgtctacctgttc

SEQ ID NO: 612803 - DNA, 13 bp, D. melanogaster
cgtctatatcgtg

SEQ ID NO: 612804 - DNA, 13 bp, D. melanogaster
cgtctattggaca

SEQ ID NO: 612805 - DNA, 13 bp, D. melanogaster
cgtctcaatttct

SEQ ID NO: 612806 - DNA, 13 bp, D. melanogaster
cgtctccggcgaa

SEQ ID NO: 612807 - DNA, 14 bp, D. melanogaster
cgtctcgctcgcac

SEQ ID NO: 612808 - DNA, 14 bp, D. melanogaster
cgtctcgtctagct

SEQ ID NO: 612809 - DNA, 13 bp, D. melanogaster
cgtctcgtttcgt

SEQ ID NO: 612810 - DNA, 13 bp, D. melanogaster
cgtctctttctcg

SEQ ID NO: 612811 - DNA, 13 bp, D. melanogaster
cgtctctttctgc

SEQ ID NO: 612812 - DNA, 13 bp, D. melanogaster
cgtctctttctgg

SEQ ID NO: 612813 - DNA, 13 bp, D. melanogaster
cgtctgcaaactt

SEQ ID NO: 612814 - DNA, 13 bp, D. melanogaster
cgtctgcatggcg

SEQ ID NO: 612815 - DNA, 13 bp, D. melanogaster
cgtctgcgtttac

SEQ ID NO: 612816 - DNA, 13 bp, D. melanogaster
cgtctgctccaat

SEQ ID NO: 612817 - DNA, 13 bp, D. melanogaster
cgtctggtggctg

SEQ ID NO: 612818 - DNA, 14 bp, D. melanogaster
cgtctgtctgtccg

SEQ ID NO: 612819 - DNA, 14 bp, D. melanogaster
cgtctgtctgtctg

SEQ ID NO: 612820 - DNA, 13 bp, D. melanogaster
cgtctgtgtctgt

SEQ ID NO: 612821 - DNA, 13 bp, D. melanogaster
cgtcttatacata

SEQ ID NO: 612822 - DNA, 13 bp, D. melanogaster
cgtcttcatcatc

SEQ ID NO: 612823 - DNA, 14 bp, D. melanogaster
cgtcttcattggac

SEQ ID NO: 612824 - DNA, 13 bp, D. melanogaster
cgtcttcgtcttc

SEQ ID NO: 612825 - DNA, 13 bp, D. melanogaster
cgtcttggccgcg

SEQ ID NO: 612826 - DNA, 13 bp, D. melanogaster
cgtcttgtaaata

SEQ ID NO: 612827 - DNA, 13 bp, D. melanogaster
cgtcttttggcca

SEQ ID NO: 612828 - DNA, 14 bp, D. melanogaster
cgtctttttggctc

SEQ ID NO: 612829 - DNA, 13 bp, D. melanogaster
cgtgaaaactctt

SEQ ID NO: 612830 - DNA, 13 bp, D. melanogaster
cgtgaaaatgaaa

SEQ ID NO: 612831 - DNA, 13 bp, D. melanogaster
cgtgaatttgtct

SEQ ID NO: 612832 - DNA, 13 bp, D. melanogaster
cgtgaccggtttg

SEQ ID NO: 612833 - DNA, 14 bp, D. melanogaster
cgtgaccggtttgg

SEQ ID NO: 612834 - DNA, 13 bp, D. melanogaster
cgtgagcacagca

SEQ ID NO: 612835 - DNA, 14 bp, D. melanogaster
cgtgagcacagcag

SEQ ID NO: 612836 - DNA, 13 bp, D. melanogaster
cgtgaggaactgg

SEQ ID NO: 612837 - DNA, 13 bp, D. melanogaster
cgtgatgagagcg

SEQ ID NO: 612838 - DNA, 13 bp, D. melanogaster
cgtgatgatcagc

SEQ ID NO: 612839 - DNA, 14 bp, D. melanogaster
cgtgatgggctaaa

SEQ ID NO: 612840 - DNA, 13 bp, D. melanogaster
cgtgatttttgta

SEQ ID NO: 612841 - DNA, 13 bp, D. melanogaster
cgtgcagctctct

SEQ ID NO: 612842 - DNA, 15 bp, D. melanogaster
cgtgccaaaaaaaaa

SEQ ID NO: 612843 - DNA, 13 bp, D. melanogaster
cgtgccacccccg

SEQ ID NO: 612844 - DNA, 13 bp, D. melanogaster
cgtgccgctggga

SEQ ID NO: 612845 - DNA, 13 bp, D. melanogaster
cgtgcgtgtgcgt

SEQ ID NO: 612846 - DNA, 13 bp, D. melanogaster
cgtgcgtgtttgt

SEQ ID NO: 612847 - DNA, 13 bp, D. melanogaster
cgtgctcagcacg

SEQ ID NO: 612848 - DNA, 13 bp, D. melanogaster
cgtgctccgtgct

SEQ ID NO: 612849 - DNA, 13 bp, D. melanogaster
cgtgctgtgcgtg

SEQ ID NO: 612850 - DNA, 13 bp, D. melanogaster
cgtgcttgaggcc

SEQ ID NO: 612851 - DNA, 13 bp, D. melanogaster
cgtgcttgcattt

SEQ ID NO: 612852 - DNA, 13 bp, D. melanogaster
cgtggaacgccaa

SEQ ID NO: 612853 - DNA, 13 bp, D. melanogaster
cgtggaatgtgcg

SEQ ID NO: 612854 - DNA, 13 bp, D. melanogaster
cgtggacatggac

SEQ ID NO: 612855 - DNA, 13 bp, D. melanogaster
cgtggagcgaaga

SEQ ID NO: 612856 - DNA, 13 bp, D. melanogaster
cgtggaggagccg

SEQ ID NO: 612857 - DNA, 13 bp, D. melanogaster
cgtggcaaaaagt

SEQ ID NO: 612858 - DNA, 13 bp, D. melanogaster
cgtggccaacaag

SEQ ID NO: 612859 - DNA, 13 bp, D. melanogaster
cgtggcgaaaata

SEQ ID NO: 612860 - DNA, 13 bp, D. melanogaster
cgtggcgtatacg

SEQ ID NO: 612861 - DNA, 13 bp, D. melanogaster
cgtggcgtatgcg

SEQ ID NO: 612862 - DNA, 14 bp, D. melanogaster
cgtggcgtatgcgt

SEQ ID NO: 612863 - DNA, 13 bp, D. melanogaster
cgtggctgctgct

SEQ ID NO: 612864 - DNA, 13 bp, D. melanogaster
cgtggctgggctt

SEQ ID NO: 612865 - DNA, 13 bp, D. melanogaster
cgtgggcaaaaaa

SEQ ID NO: 612866 - DNA, 14 bp, D. melanogaster
cgtgggcgtggcat

SEQ ID NO: 612867 - DNA, 13 bp, D. melanogaster
cgtgggcgtggtc

SEQ ID NO: 612868 - DNA, 13 bp, D. melanogaster
cgtgggctatacg

SEQ ID NO: 612869 - DNA, 13 bp, D. melanogaster
cgtggtattgtcc

SEQ ID NO: 612870 - DNA, 13 bp, D. melanogaster
cgtggtcaccctg

SEQ ID NO: 612871 - DNA, 13 bp, D. melanogaster
cgtggtgatcagc

SEQ ID NO: 612872 - DNA, 13 bp, D. melanogaster
cgtggtgctggtg

SEQ ID NO: 612873 - DNA, 14 bp, D. melanogaster
cgtggtgctggtgt

SEQ ID NO: 612874 - DNA, 13 bp, D. melanogaster
cgtgtaaataaaa

SEQ ID NO: 612875 - DNA, 13 bp, D. melanogaster
cgtgtaattaaaa

SEQ ID NO: 612876 - DNA, 13 bp, D. melanogaster
cgtgtaatttggc

SEQ ID NO: 612877 - DNA, 13 bp, D. melanogaster
cgtgtatgtgtat

SEQ ID NO: 612878 - DNA, 13 bp, D. melanogaster
cgtgtctctttta

SEQ ID NO: 612879 - DNA, 14 bp, D. melanogaster
cgtgtctgtgtgtg

SEQ ID NO: 612880 - DNA, 13 bp, D. melanogaster
cgtgtgagtgtgt

SEQ ID NO: 612881 - DNA, 14 bp, D. melanogaster
cgtgtgagtgtgtg

SEQ ID NO: 612882 - DNA, 14 bp, D. melanogaster
cgtgtgcatgtgtg

SEQ ID NO: 612883 - DNA, 15 bp, D. melanogaster
cgtgtgcatgtgtgt

SEQ ID NO: 612884 - DNA, 13 bp, D. melanogaster
cgtgtgcattgca

SEQ ID NO: 612885 - DNA, 14 bp, D. melanogaster
cgtgtgccaaaaaa

SEQ ID NO: 612886 - DNA, 14 bp, D. melanogaster
cgtgtgcgtgtgcg

SEQ ID NO: 612887 - DNA, 13 bp, D. melanogaster
cgtgtgcgtgtgt

SEQ ID NO: 612888 - DNA, 13 bp, D. melanogaster
cgtgtgcttttcc

SEQ ID NO: 612889 - DNA, 14 bp, D. melanogaster
cgtgtgcttttccg

SEQ ID NO: 612890 - DNA, 13 bp, D. melanogaster
cgtgtgtatgtgt

SEQ ID NO: 612891 - DNA, 13 bp, D. melanogaster
cgtgtgtctgtgt

SEQ ID NO: 612892 - DNA, 14 bp, D. melanogaster
cgtgtgtgagtgag

SEQ ID NO: 612893 - DNA, 13 bp, D. melanogaster
cgtgtgtgagtgt

SEQ ID NO: 612894 - DNA, 14 bp, D. melanogaster
cgtgtgtgagtgtg

SEQ ID NO: 612895 - DNA, 13 bp, D. melanogaster
cgtgtgtgcatgt

SEQ ID NO: 612896 - DNA, 13 bp, D. melanogaster
cgtgtgtgcgaat

SEQ ID NO: 612897 - DNA, 13 bp, D. melanogaster
cgtgtgtgcgtga

SEQ ID NO: 612898 - DNA, 14 bp, D. melanogaster
cgtgtgtgcgtgcg

SEQ ID NO: 612899 - DNA, 14 bp, D. melanogaster
cgtgtgtgcttgtg

SEQ ID NO: 612900 - DNA, 13 bp, D. melanogaster
cgtgtgtgtatgt

SEQ ID NO: 612901 - DNA, 13 bp, D. melanogaster
cgtgtgtgtgagc

SEQ ID NO: 612902 - DNA, 13 bp, D. melanogaster
cgtgtgtgtgcat

SEQ ID NO: 612903 - DNA, 13 bp, D. melanogaster
cgtgtgtgtgcgc

SEQ ID NO: 612904 - DNA, 13 bp, D. melanogaster
cgtgtgtgtgtct

SEQ ID NO: 612905 - DNA, 15 bp, D. melanogaster
cgtgtgtgtgtgagc

SEQ ID NO: 612906 - DNA, 13 bp, D. melanogaster
cgtgtgtgtgtgc

SEQ ID NO: 612907 - DNA, 14 bp, D. melanogaster
cgtgtgtgtgtgta

SEQ ID NO: 612908 - DNA, 14 bp, D. melanogaster
cgtgtgtgtgtgtc

SEQ ID NO: 612909 - DNA, 13 bp, D. melanogaster
cgtgtttattttg

SEQ ID NO: 612910 - DNA, 13 bp, D. melanogaster
cgtgtttctgctt

SEQ ID NO: 612911 - DNA, 13 bp, D. melanogaster
cgtgttttaatta

SEQ ID NO: 612912 - DNA, 13 bp, D. melanogaster
cgtgttttccttg

SEQ ID NO: 612913 - DNA, 13 bp, D. melanogaster
cgttaaaaataaa

SEQ ID NO: 612914 - DNA, 13 bp, D. melanogaster
cgttaaaaataca

SEQ ID NO: 612915 - DNA, 13 bp, D. melanogaster
cgttaaaaatatt

SEQ ID NO: 612916 - DNA, 13 bp, D. melanogaster
cgttaaaagagga

SEQ ID NO: 612917 - DNA, 13 bp, D. melanogaster
cgttaaaatattc

SEQ ID NO: 612918 - DNA, 13 bp, D. melanogaster
cgttaaaatattt

SEQ ID NO: 612919 - DNA, 13 bp, D. melanogaster
cgttaaatatagt

SEQ ID NO: 612920 - DNA, 13 bp, D. melanogaster
cgttaacaattaa

SEQ ID NO: 612921 - DNA, 13 bp, D. melanogaster
cgttaatttgttt

SEQ ID NO: 612922 - DNA, 19 bp, D. melanogaster
cgttacgcatcttgttatt

SEQ ID NO: 612923 - DNA, 13 bp, D. melanogaster
cgttacgtatacg

SEQ ID NO: 612924 - DNA, 13 bp, D. melanogaster
cgttacgttacgt

SEQ ID NO: 612925 - DNA, 13 bp, D. melanogaster
cgttagcagtgct

SEQ ID NO: 612926 - DNA, 13 bp, D. melanogaster
cgttatcacggca

SEQ ID NO: 612927 - DNA, 13 bp, D. melanogaster
cgttatcgttatc

SEQ ID NO: 612928 - DNA, 13 bp, D. melanogaster
cgttattattatt

SEQ ID NO: 612929 - DNA, 13 bp, D. melanogaster
cgttcaacggcgg

SEQ ID NO: 612930 - DNA, 13 bp, D. melanogaster
cgttcagttgttg

SEQ ID NO: 612931 - DNA, 13 bp, D. melanogaster
cgttcatacgaac

SEQ ID NO: 612932 - DNA, 13 bp, D. melanogaster
cgttcatacggac

SEQ ID NO: 612933 - DNA, 13 bp, D. melanogaster
cgttcccatgtcc

SEQ ID NO: 612934 - DNA, 13 bp, D. melanogaster
cgttccgaatatg

SEQ ID NO: 612935 - DNA, 13 bp, D. melanogaster
cgttccgttccgt

SEQ ID NO: 612936 - DNA, 14 bp, D. melanogaster
cgttccgttccgtt

SEQ ID NO: 612937 - DNA, 14 bp, D. melanogaster
cgttccgtttcgtt

SEQ ID NO: 612938 - DNA, 14 bp, D. melanogaster
cgttcgtgtgtgtg

SEQ ID NO: 612939 - DNA, 13 bp, D. melanogaster
cgttcgttcgttg

SEQ ID NO: 612940 - DNA, 13 bp, D. melanogaster
cgttcgttcgttt

SEQ ID NO: 612941 - DNA, 13 bp, D. melanogaster
cgttctcagcgac

SEQ ID NO: 612942 - DNA, 13 bp, D. melanogaster
cgttctcgttctc

SEQ ID NO: 612943 - DNA, 13 bp, D. melanogaster
cgttctgctggat

SEQ ID NO: 612944 - DNA, 13 bp, D. melanogaster
cgttctgttctgt

SEQ ID NO: 612945 - DNA, 14 bp, D. melanogaster
cgttctgttctgtt

SEQ ID NO: 612946 - DNA, 13 bp, D. melanogaster
cgttcttgatgtt

SEQ ID NO: 612947 - DNA, 13 bp, D. melanogaster
cgttgaaaaagta

SEQ ID NO: 612948 - DNA, 13 bp, D. melanogaster
cgttgaaaactat

SEQ ID NO: 612949 - DNA, 13 bp, D. melanogaster
cgttgaaaagtat

SEQ ID NO: 612950 - DNA, 13 bp, D. melanogaster
cgttgaaaagttg

SEQ ID NO: 612951 - DNA, 13 bp, D. melanogaster
cgttgaacaacag

SEQ ID NO: 612952 - DNA, 13 bp, D. melanogaster
cgttgaacgttga

SEQ ID NO: 612953 - DNA, 13 bp, D. melanogaster
cgttgacagtttt

SEQ ID NO: 612954 - DNA, 13 bp, D. melanogaster
cgttgacattttc

SEQ ID NO: 612955 - DNA, 13 bp, D. melanogaster
cgttgagtgcgct

SEQ ID NO: 612956 - DNA, 13 bp, D. melanogaster
cgttgagtttgtt

SEQ ID NO: 612957 - DNA, 14 bp, D. melanogaster
cgttgagtttttgt

SEQ ID NO: 612958 - DNA, 13 bp, D. melanogaster
cgttgatcaaata

SEQ ID NO: 612959 - DNA, 13 bp, D. melanogaster
cgttgatcttaaa

SEQ ID NO: 612960 - DNA, 13 bp, D. melanogaster
cgttgatgatgat

SEQ ID NO: 612961 - DNA, 14 bp, D. melanogaster
cgttgatttcaagt

SEQ ID NO: 612962 - DNA, 13 bp, D. melanogaster
cgttgcaagagaa

SEQ ID NO: 612963 - DNA, 13 bp, D. melanogaster
cgttgcaattgca

SEQ ID NO: 612964 - DNA, 13 bp, D. melanogaster
cgttgcagctgca

SEQ ID NO: 612965 - DNA, 13 bp, D. melanogaster
cgttgccaccact

SEQ ID NO: 612966 - DNA, 13 bp, D. melanogaster
cgttgccattgcc

SEQ ID NO: 612967 - DNA, 13 bp, D. melanogaster
cgttgccgttgcc

SEQ ID NO: 612968 - DNA, 13 bp, D. melanogaster
cgttgcctacttt

SEQ ID NO: 612969 - DNA, 13 bp, D. melanogaster
cgttgcggatggc

SEQ ID NO: 612970 - DNA, 13 bp, D. melanogaster
cgttgcgtatacg

SEQ ID NO: 612971 - DNA, 14 bp, D. melanogaster
cgttgcgttgcgtt

SEQ ID NO: 612972 - DNA, 13 bp, D. melanogaster
cgttgcgtttgtg

SEQ ID NO: 612973 - DNA, 13 bp, D. melanogaster
cgttgctgttgtt

SEQ ID NO: 612974 - DNA, 13 bp, D. melanogaster
cgttggccaaatt

SEQ ID NO: 612975 - DNA, 13 bp, D. melanogaster
cgttggccaagtt

SEQ ID NO: 612976 - DNA, 13 bp, D. melanogaster
cgttggccatttc

SEQ ID NO: 612977 - DNA, 13 bp, D. melanogaster
cgttggccatttt

SEQ ID NO: 612978 - DNA, 13 bp, D. melanogaster
cgttggctttgtt

SEQ ID NO: 612979 - DNA, 13 bp, D. melanogaster
cgttgggcgccat

SEQ ID NO: 612980 - DNA, 13 bp, D. melanogaster
cgttggttcatac

SEQ ID NO: 612981 - DNA, 13 bp, D. melanogaster
cgttgtcgttgtg

SEQ ID NO: 612982 - DNA, 13 bp, D. melanogaster
cgttgttattatt

SEQ ID NO: 612983 - DNA, 14 bp, D. melanogaster
cgttgttattgttg

SEQ ID NO: 612984 - DNA, 13 bp, D. melanogaster
cgttgttgctgct

SEQ ID NO: 612985 - DNA, 14 bp, D. melanogaster
cgttgttgctgctg

SEQ ID NO: 612986 - DNA, 13 bp, D. melanogaster
cgttgttgctgtc

SEQ ID NO: 612987 - DNA, 13 bp, D. melanogaster
cgttgttgttgat

SEQ ID NO: 612988 - DNA, 13 bp, D. melanogaster
cgttgttgttgtc

SEQ ID NO: 612989 - DNA, 13 bp, D. melanogaster
cgtttaaaaataa

SEQ ID NO: 612990 - DNA, 14 bp, D. melanogaster
cgtttaaaaataaa

SEQ ID NO: 612991 - DNA, 13 bp, D. melanogaster
cgtttaaaaatgc

SEQ ID NO: 612992 - DNA, 13 bp, D. melanogaster
cgtttaattaaca

SEQ ID NO: 612993 - DNA, 14 bp, D. melanogaster
cgtttatacttttt

SEQ ID NO: 612994 - DNA, 13 bp, D. melanogaster
cgtttatgacatg

SEQ ID NO: 612995 - DNA, 13 bp, D. melanogaster
cgtttatggccaa

SEQ ID NO: 612996 - DNA, 14 bp, D. melanogaster
cgtttattgaagct

SEQ ID NO: 612997 - DNA, 13 bp, D. melanogaster
cgtttatttatgt

SEQ ID NO: 612998 - DNA, 13 bp, D. melanogaster
cgtttcaaaggct

SEQ ID NO: 612999 - DNA, 13 bp, D. melanogaster
cgtttcacggcat

SEQ ID NO: 613000 - DNA, 13 bp, D. melanogaster
cgtttcatttcat

SEQ ID NO: 613001 - DNA, 14 bp, D. melanogaster
cgtttcatttcgtt

SEQ ID NO: 613002 - DNA, 13 bp, D. melanogaster
cgtttccatttcc

SEQ ID NO: 613003 - DNA, 14 bp, D. melanogaster
cgtttccatttcca

SEQ ID NO: 613004 - DNA, 13 bp, D. melanogaster
cgtttccgaccat

SEQ ID NO: 613005 - DNA, 13 bp, D. melanogaster
cgtttccgctttc

SEQ ID NO: 613006 - DNA, 14 bp, D. melanogaster
cgtttccgtttccg

SEQ ID NO: 613007 - DNA, 13 bp, D. melanogaster
cgtttccgttttc

SEQ ID NO: 613008 - DNA, 13 bp, D. melanogaster
cgtttcgattcga

SEQ ID NO: 613009 - DNA, 13 bp, D. melanogaster
cgtttcggtttcg

SEQ ID NO: 613010 - DNA, 13 bp, D. melanogaster
cgtttcgttcgtt

SEQ ID NO: 613011 - DNA, 13 bp, D. melanogaster
cgtttcgtttcgc

SEQ ID NO: 613012 - DNA, 14 bp, D. melanogaster
cgtttcgtttcgct

SEQ ID NO: 613013 - DNA, 13 bp, D. melanogaster
cgtttcgtttcgg

SEQ ID NO: 613014 - DNA, 13 bp, D. melanogaster
cgtttcgtttggt

SEQ ID NO: 613015 - DNA, 13 bp, D. melanogaster
cgtttcgttttta

SEQ ID NO: 613016 - DNA, 13 bp, D. melanogaster
cgtttctgcattc

SEQ ID NO: 613017 - DNA, 14 bp, D. melanogaster
cgtttcttcgatca

SEQ ID NO: 613018 - DNA, 13 bp, D. melanogaster
cgtttgatggcga

SEQ ID NO: 613019 - DNA, 14 bp, D. melanogaster
cgtttgatggcgag

SEQ ID NO: 613020 - DNA, 13 bp, D. melanogaster
cgtttgcataaat

SEQ ID NO: 613021 - DNA, 13 bp, D. melanogaster
cgtttgcataatt

SEQ ID NO: 613022 - DNA, 13 bp, D. melanogaster
cgtttgcatggcc

SEQ ID NO: 613023 - DNA, 13 bp, D. melanogaster
cgtttgccaaaaa

SEQ ID NO: 613024 - DNA, 13 bp, D. melanogaster
cgtttgcccaccc

SEQ ID NO: 613025 - DNA, 13 bp, D. melanogaster
cgtttgcccatcc

SEQ ID NO: 613026 - DNA, 13 bp, D. melanogaster
cgtttgcccatct

SEQ ID NO: 613027 - DNA, 13 bp, D. melanogaster
cgtttgccgtttg

SEQ ID NO: 613028 - DNA, 13 bp, D. melanogaster
cgtttgcctgcaa

SEQ ID NO: 613029 - DNA, 13 bp, D. melanogaster
cgtttgcgttgtt

SEQ ID NO: 613030 - DNA, 13 bp, D. melanogaster
cgtttgcgtttgc

SEQ ID NO: 613031 - DNA, 13 bp, D. melanogaster
cgtttgctgaccg

SEQ ID NO: 613032 - DNA, 13 bp, D. melanogaster
cgtttgctgtttg

SEQ ID NO: 613033 - DNA, 13 bp, D. melanogaster
cgtttgctttctc

SEQ ID NO: 613034 - DNA, 13 bp, D. melanogaster
cgtttggcgctgc

SEQ ID NO: 613035 - DNA, 13 bp, D. melanogaster
cgtttgtaaatat

SEQ ID NO: 613036 - DNA, 13 bp, D. melanogaster
cgtttgtccattt

SEQ ID NO: 613037 - DNA, 13 bp, D. melanogaster
cgtttgtgaaaaa

SEQ ID NO: 613038 - DNA, 13 bp, D. melanogaster
cgtttgtgcggct

SEQ ID NO: 613039 - DNA, 13 bp, D. melanogaster
cgtttgtgtgtgc

SEQ ID NO: 613040 - DNA, 13 bp, D. melanogaster
cgtttgtttactt

SEQ ID NO: 613041 - DNA, 13 bp, D. melanogaster
cgtttgtttctat

SEQ ID NO: 613042 - DNA, 15 bp, D. melanogaster
cgtttgtttctatgt

SEQ ID NO: 613043 - DNA, 13 bp, D. melanogaster
cgtttgtttgctc

SEQ ID NO: 613044 - DNA, 13 bp, D. melanogaster
cgttttaaaatca

SEQ ID NO: 613045 - DNA, 13 bp, D. melanogaster
cgttttaaaattt

SEQ ID NO: 613046 - DNA, 13 bp, D. melanogaster
cgttttaaatgaa

SEQ ID NO: 613047 - DNA, 14 bp, D. melanogaster
cgttttaatttaat

SEQ ID NO: 613048 - DNA, 13 bp, D. melanogaster
cgttttacaatat

SEQ ID NO: 613049 - DNA, 13 bp, D. melanogaster
cgttttattaaaa

SEQ ID NO: 613050 - DNA, 13 bp, D. melanogaster
cgttttatttcta

SEQ ID NO: 613051 - DNA, 13 bp, D. melanogaster
cgttttatttgaa

SEQ ID NO: 613052 - DNA, 14 bp, D. melanogaster
cgttttatttgaat

SEQ ID NO: 613053 - DNA, 13 bp, D. melanogaster
cgttttcaataaa

SEQ ID NO: 613054 - DNA, 13 bp, D. melanogaster
cgttttcaatttg

SEQ ID NO: 613055 - DNA, 13 bp, D. melanogaster
cgttttcagtttc

SEQ ID NO: 613056 - DNA, 13 bp, D. melanogaster
cgttttcatttgc

SEQ ID NO: 613057 - DNA, 13 bp, D. melanogaster
cgttttccaaata

SEQ ID NO: 613058 - DNA, 13 bp, D. melanogaster
cgttttccattcc

SEQ ID NO: 613059 - DNA, 13 bp, D. melanogaster
cgttttccattta

SEQ ID NO: 613060 - DNA, 13 bp, D. melanogaster
cgttttccatttc

SEQ ID NO: 613061 - DNA, 13 bp, D. melanogaster
cgttttcccattt

SEQ ID NO: 613062 - DNA, 13 bp, D. melanogaster
cgttttccgattg

SEQ ID NO: 613063 - DNA, 13 bp, D. melanogaster
cgttttcctggaa

SEQ ID NO: 613064 - DNA, 13 bp, D. melanogaster
cgttttcgctttc

SEQ ID NO: 613065 - DNA, 13 bp, D. melanogaster
cgttttcggtttc

SEQ ID NO: 613066 - DNA, 14 bp, D. melanogaster
cgttttgagaaagg

SEQ ID NO: 613067 - DNA, 13 bp, D. melanogaster
cgttttgagtgta

SEQ ID NO: 613068 - DNA, 14 bp, D. melanogaster
cgttttgataaatt

SEQ ID NO: 613069 - DNA, 13 bp, D. melanogaster
cgttttgattttg

SEQ ID NO: 613070 - DNA, 13 bp, D. melanogaster
cgttttgcatatt

SEQ ID NO: 613071 - DNA, 13 bp, D. melanogaster
cgttttgccaagg

SEQ ID NO: 613072 - DNA, 13 bp, D. melanogaster
cgttttggccaaa

SEQ ID NO: 613073 - DNA, 13 bp, D. melanogaster
cgttttggccaag

SEQ ID NO: 613074 - DNA, 14 bp, D. melanogaster
cgttttggccaagt

SEQ ID NO: 613075 - DNA, 13 bp, D. melanogaster
cgttttggccatt

SEQ ID NO: 613076 - DNA, 13 bp, D. melanogaster
cgttttggctttg

SEQ ID NO: 613077 - DNA, 14 bp, D. melanogaster
cgttttgtatttct

SEQ ID NO: 613078 - DNA, 13 bp, D. melanogaster
cgttttgtttaat

SEQ ID NO: 613079 - DNA, 14 bp, D. melanogaster
cgtttttaaatttc

SEQ ID NO: 613080 - DNA, 13 bp, D. melanogaster
cgtttttatatat

SEQ ID NO: 613081 - DNA, 13 bp, D. melanogaster
cgtttttattgcc

SEQ ID NO: 613082 - DNA, 13 bp, D. melanogaster
cgtttttgctatc

SEQ ID NO: 613083 - DNA, 13 bp, D. melanogaster
ctaaaaaagcaca

SEQ ID NO: 613084 - DNA, 13 bp, D. melanogaster
ctaaaaaagctaa

SEQ ID NO: 613085 - DNA, 14 bp, D. melanogaster
ctaaaaacagaaat

SEQ ID NO: 613086 - DNA, 13 bp, D. melanogaster
ctaaaaacctaca

SEQ ID NO: 613087 - DNA, 13 bp, D. melanogaster
ctaaaaacttttg

SEQ ID NO: 613088 - DNA, 13 bp, D. melanogaster
ctaaaaagaaatg

SEQ ID NO: 613089 - DNA, 14 bp, D. melanogaster
ctaaaaagaagagg

SEQ ID NO: 613090 - DNA, 13 bp, D. melanogaster
ctaaaaagtatgc

SEQ ID NO: 613091 - DNA, 13 bp, D. melanogaster
ctaaaaagtttat

SEQ ID NO: 613092 - DNA, 13 bp, D. melanogaster
ctaaaaataaagc

SEQ ID NO: 613093 - DNA, 14 bp, D. melanogaster
ctaaaaataaaggg

SEQ ID NO: 613094 - DNA, 13 bp, D. melanogaster
ctaaaaatatgtt

SEQ ID NO: 613095 - DNA, 14 bp, D. melanogaster
ctaaaaatgatggc

SEQ ID NO: 613096 - DNA, 13 bp, D. melanogaster
ctaaaaatgattt

SEQ ID NO: 613097 - DNA, 13 bp, D. melanogaster
ctaaaaatgctca

SEQ ID NO: 613098 - DNA, 13 bp, D. melanogaster
ctaaaaatgcttt

SEQ ID NO: 613099 - DNA, 13 bp, D. melanogaster
ctaaaaatggaaa

SEQ ID NO: 613100 - DNA, 13 bp, D. melanogaster
ctaaaaatggtca

SEQ ID NO: 613101 - DNA, 14 bp, D. melanogaster
ctaaaaatggtcat

SEQ ID NO: 613102 - DNA, 13 bp, D. melanogaster
ctaaaaatgtaaa

SEQ ID NO: 613103 - DNA, 13 bp, D. melanogaster
ctaaaaatgtttt

SEQ ID NO: 613104 - DNA, 13 bp, D. melanogaster
ctaaaaattgtat

SEQ ID NO: 613105 - DNA, 13 bp, D. melanogaster
ctaaaacaatttg

SEQ ID NO: 613106 - DNA, 13 bp, D. melanogaster
ctaaaactgaaac

SEQ ID NO: 613107 - DNA, 13 bp, D. melanogaster
ctaaaactgccac

SEQ ID NO: 613108 - DNA, 13 bp, D. melanogaster
ctaaaactgtgga

SEQ ID NO: 613109 - DNA, 13 bp, D. melanogaster
ctaaaactttaat

SEQ ID NO: 613110 - DNA, 13 bp, D. melanogaster
ctaaaagcaggca

SEQ ID NO: 613111 - DNA, 14 bp, D. melanogaster
ctaaaagccaaagc

SEQ ID NO: 613112 - DNA, 13 bp, D. melanogaster
ctaaaagctttta

SEQ ID NO: 613113 - DNA, 13 bp, D. melanogaster
ctaaaaggatcaa

SEQ ID NO: 613114 - DNA, 13 bp, D. melanogaster
ctaaaagtatata

SEQ ID NO: 613115 - DNA, 14 bp, D. melanogaster
ctaaaagtatgcaa

SEQ ID NO: 613116 - DNA, 13 bp, D. melanogaster
ctaaaagttaaat

SEQ ID NO: 613117 - DNA, 13 bp, D. melanogaster
ctaaaatacagat

SEQ ID NO: 613118 - DNA, 13 bp, D. melanogaster
ctaaaatcaaatt

SEQ ID NO: 613119 - DNA, 13 bp, D. melanogaster
ctaaaatgaaata

SEQ ID NO: 613120 - DNA, 14 bp, D. melanogaster
ctaaaatgggaacc

SEQ ID NO: 613121 - DNA, 13 bp, D. melanogaster
ctaaaatgtaatt

SEQ ID NO: 613122 - DNA, 13 bp, D. melanogaster
ctaaaatgtataa

SEQ ID NO: 613123 - DNA, 13 bp, D. melanogaster
ctaaaatgttttt

SEQ ID NO: 613124 - DNA, 13 bp, D. melanogaster
ctaaaattggagt

SEQ ID NO: 613125 - DNA, 13 bp, D. melanogaster
ctaaaattgtaat

SEQ ID NO: 613126 - DNA, 13 bp, D. melanogaster
ctaaaattgttaa

SEQ ID NO: 613127 - DNA, 13 bp, D. melanogaster
ctaaaatttcaaa

SEQ ID NO: 613128 - DNA, 13 bp, D. melanogaster
ctaaaatttgtca

SEQ ID NO: 613129 - DNA, 13 bp, D. melanogaster
ctaaacaaaattt

SEQ ID NO: 613130 - DNA, 13 bp, D. melanogaster
ctaaacaaagcgc

SEQ ID NO: 613131 - DNA, 13 bp, D. melanogaster
ctaaacaaatcat

SEQ ID NO: 613132 - DNA, 14 bp, D. melanogaster
ctaaacaaatcatc

SEQ ID NO: 613133 - DNA, 13 bp, D. melanogaster
ctaaacaagaggg

SEQ ID NO: 613134 - DNA, 14 bp, D. melanogaster
ctaaacaattcaat

SEQ ID NO: 613135 - DNA, 14 bp, D. melanogaster
ctaaacaattttat

SEQ ID NO: 613136 - DNA, 13 bp, D. melanogaster
ctaaacacaatat

SEQ ID NO: 613137 - DNA, 13 bp, D. melanogaster
ctaaacacatatt

SEQ ID NO: 613138 - DNA, 13 bp, D. melanogaster
ctaaacagacaag

SEQ ID NO: 613139 - DNA, 13 bp, D. melanogaster
ctaaacatactca

SEQ ID NO: 613140 - DNA, 13 bp, D. melanogaster
ctaaaccaaaaga

SEQ ID NO: 613141 - DNA, 13 bp, D. melanogaster
ctaaacgacgaaa

SEQ ID NO: 613142 - DNA, 13 bp, D. melanogaster
ctaaacgtttcaa

SEQ ID NO: 613143 - DNA, 13 bp, D. melanogaster
ctaaactaaaatg

SEQ ID NO: 613144 - DNA, 14 bp, D. melanogaster
ctaaactaaaattt

SEQ ID NO: 613145 - DNA, 13 bp, D. melanogaster
ctaaactggagaa

SEQ ID NO: 613146 - DNA, 13 bp, D. melanogaster
ctaaactgttgtt

SEQ ID NO: 613147 - DNA, 14 bp, D. melanogaster
ctaaactgttgtta

SEQ ID NO: 613148 - DNA, 13 bp, D. melanogaster
ctaaacttttaaa

SEQ ID NO: 613149 - DNA, 13 bp, D. melanogaster
ctaaagaattcgc

SEQ ID NO: 613150 - DNA, 13 bp, D. melanogaster
ctaaagatttaaa

SEQ ID NO: 613151 - DNA, 13 bp, D. melanogaster
ctaaagccaaatt

SEQ ID NO: 613152 - DNA, 13 bp, D. melanogaster
ctaaagccgccaa

SEQ ID NO: 613153 - DNA, 13 bp, D. melanogaster
ctaaagcttaaca

SEQ ID NO: 613154 - DNA, 14 bp, D. melanogaster
ctaaaggaaaagct

SEQ ID NO: 613155 - DNA, 13 bp, D. melanogaster
ctaaaggaaaagg

SEQ ID NO: 613156 - DNA, 13 bp, D. melanogaster
ctaaagggcaagg

SEQ ID NO: 613157 - DNA, 13 bp, D. melanogaster
ctaaagtcgaaga

SEQ ID NO: 613158 - DNA, 13 bp, D. melanogaster
ctaaataaatgaa

SEQ ID NO: 613159 - DNA, 13 bp, D. melanogaster
ctaaataaattcc

SEQ ID NO: 613160 - DNA, 13 bp, D. melanogaster
ctaaataaattgt

SEQ ID NO: 613161 - DNA, 13 bp, D. melanogaster
ctaaataagagaa

SEQ ID NO: 613162 - DNA, 13 bp, D. melanogaster
ctaaatacaattt

SEQ ID NO: 613163 - DNA, 13 bp, D. melanogaster
ctaaatacatata

SEQ ID NO: 613164 - DNA, 14 bp, D. melanogaster
ctaaatacatatat

SEQ ID NO: 613165 - DNA, 13 bp, D. melanogaster
ctaaatacctaaa

SEQ ID NO: 613166 - DNA, 13 bp, D. melanogaster
ctaaatatacata

SEQ ID NO: 613167 - DNA, 14 bp, D. melanogaster
ctaaatatatatgt

SEQ ID NO: 613168 - DNA, 13 bp, D. melanogaster
ctaaatatatgta

SEQ ID NO: 613169 - DNA, 13 bp, D. melanogaster
ctaaatatctgtt

SEQ ID NO: 613170 - DNA, 13 bp, D. melanogaster
ctaaatatgcata

SEQ ID NO: 613171 - DNA, 13 bp, D. melanogaster
ctaaatatttcaa

SEQ ID NO: 613172 - DNA, 13 bp, D. melanogaster
ctaaatcaaaatt

SEQ ID NO: 613173 - DNA, 13 bp, D. melanogaster
ctaaatcaaacac

SEQ ID NO: 613174 - DNA, 13 bp, D. melanogaster
ctaaatcaagaat

SEQ ID NO: 613175 - DNA, 13 bp, D. melanogaster
ctaaatcaattta

SEQ ID NO: 613176 - DNA, 14 bp, D. melanogaster
ctaaatcaggagga

SEQ ID NO: 613177 - DNA, 13 bp, D. melanogaster
ctaaatctaaatc

SEQ ID NO: 613178 - DNA, 14 bp, D. melanogaster
ctaaatcttctaac

SEQ ID NO: 613179 - DNA, 13 bp, D. melanogaster
ctaaatgaaataa

SEQ ID NO: 613180 - DNA, 13 bp, D. melanogaster
ctaaatgaaattc

SEQ ID NO: 613181 - DNA, 13 bp, D. melanogaster
ctaaatgaattta

SEQ ID NO: 613182 - DNA, 13 bp, D. melanogaster
ctaaatggaaatt

SEQ ID NO: 613183 - DNA, 13 bp, D. melanogaster
ctaaatggttgaa

SEQ ID NO: 613184 - DNA, 13 bp, D. melanogaster
ctaaattaaaatc

SEQ ID NO: 613185 - DNA, 13 bp, D. melanogaster
ctaaattaaatgt

SEQ ID NO: 613186 - DNA, 13 bp, D. melanogaster
ctaaattagattt

SEQ ID NO: 613187 - DNA, 13 bp, D. melanogaster
ctaaattatttct

SEQ ID NO: 613188 - DNA, 13 bp, D. melanogaster
ctaaattcaattt

SEQ ID NO: 613189 - DNA, 13 bp, D. melanogaster
ctaaattccattt

SEQ ID NO: 613190 - DNA, 13 bp, D. melanogaster
ctaaattctaaat

SEQ ID NO: 613191 - DNA, 13 bp, D. melanogaster
ctaaattgaaatt

SEQ ID NO: 613192 - DNA, 13 bp, D. melanogaster
ctaaattgtttat

SEQ ID NO: 613193 - DNA, 13 bp, D. melanogaster
ctaaattgttttt

SEQ ID NO: 613194 - DNA, 13 bp, D. melanogaster
ctaaatttagaga

SEQ ID NO: 613195 - DNA, 13 bp, D. melanogaster
ctaaatttagttt

SEQ ID NO: 613196 - DNA, 13 bp, D. melanogaster
ctaaatttccaaa

SEQ ID NO: 613197 - DNA, 13 bp, D. melanogaster
ctaaatttgtaaa

SEQ ID NO: 613198 - DNA, 13 bp, D. melanogaster
ctaaatttgttta

SEQ ID NO: 613199 - DNA, 13 bp, D. melanogaster
ctaaattttgttt

SEQ ID NO: 613200 - DNA, 14 bp, D. melanogaster
ctaacaaaaattcg

SEQ ID NO: 613201 - DNA, 13 bp, D. melanogaster
ctaacaaaattat

SEQ ID NO: 613202 - DNA, 13 bp, D. melanogaster
ctaacaaattctt

SEQ ID NO: 613203 - DNA, 13 bp, D. melanogaster
ctaacaaattgaa

SEQ ID NO: 613204 - DNA, 13 bp, D. melanogaster
ctaacaaattgtt

SEQ ID NO: 613205 - DNA, 13 bp, D. melanogaster
ctaacaaccttga

SEQ ID NO: 613206 - DNA, 13 bp, D. melanogaster
ctaacaataagtg

SEQ ID NO: 613207 - DNA, 13 bp, D. melanogaster
ctaacaatttcat

SEQ ID NO: 613208 - DNA, 14 bp, D. melanogaster
ctaacaatttcatt

SEQ ID NO: 613209 - DNA, 13 bp, D. melanogaster
ctaacaatttttt

SEQ ID NO: 613210 - DNA, 13 bp, D. melanogaster
ctaacatctactg

SEQ ID NO: 613211 - DNA, 13 bp, D. melanogaster
ctaacattttaat

SEQ ID NO: 613212 - DNA, 13 bp, D. melanogaster
ctaacatttttat

SEQ ID NO: 613213 - DNA, 14 bp, D. melanogaster
ctaaccacggacgc

SEQ ID NO: 613214 - DNA, 13 bp, D. melanogaster
ctaaccatctatc

SEQ ID NO: 613215 - DNA, 13 bp, D. melanogaster
ctaacccagttcc

SEQ ID NO: 613216 - DNA, 13 bp, D. melanogaster
ctaacgaaattat

SEQ ID NO: 613217 - DNA, 13 bp, D. melanogaster
ctaacgcccacaa

SEQ ID NO: 613218 - DNA, 13 bp, D. melanogaster
ctaacgccctaaa

SEQ ID NO: 613219 - DNA, 14 bp, D. melanogaster
ctaacgccctaaaa

SEQ ID NO: 613220 - DNA, 13 bp, D. melanogaster
ctaactaaactaa

SEQ ID NO: 613221 - DNA, 13 bp, D. melanogaster
ctaactaaatata

SEQ ID NO: 613222 - DNA, 13 bp, D. melanogaster
ctaactaactaat

SEQ ID NO: 613223 - DNA, 14 bp, D. melanogaster
ctaactatccctat

SEQ ID NO: 613224 - DNA, 14 bp, D. melanogaster
ctaactctaactct

SEQ ID NO: 613225 - DNA, 13 bp, D. melanogaster
ctaactctaccca

SEQ ID NO: 613226 - DNA, 13 bp, D. melanogaster
ctaacttaattaa

SEQ ID NO: 613227 - DNA, 13 bp, D. melanogaster
ctaagaaagttaa

SEQ ID NO: 613228 - DNA, 14 bp, D. melanogaster
ctaagaaatacaaa

SEQ ID NO: 613229 - DNA, 13 bp, D. melanogaster
ctaagaaatgtct

SEQ ID NO: 613230 - DNA, 14 bp, D. melanogaster
ctaagaaatgtcta

SEQ ID NO: 613231 - DNA, 13 bp, D. melanogaster
ctaagaaattatt

SEQ ID NO: 613232 - DNA, 13 bp, D. melanogaster
ctaagaaggcagc

SEQ ID NO: 613233 - DNA, 14 bp, D. melanogaster
ctaagactagacta

SEQ ID NO: 613234 - DNA, 13 bp, D. melanogaster
ctaagatcaaaaa

SEQ ID NO: 613235 - DNA, 13 bp, D. melanogaster
ctaagcaaaaaag

SEQ ID NO: 613236 - DNA, 13 bp, D. melanogaster
ctaagcaaacaca

SEQ ID NO: 613237 - DNA, 13 bp, D. melanogaster
ctaagcaaataaa

SEQ ID NO: 613238 - DNA, 13 bp, D. melanogaster
ctaagcagcagga

SEQ ID NO: 613239 - DNA, 13 bp, D. melanogaster
ctaagccaaacaa

SEQ ID NO: 613240 - DNA, 13 bp, D. melanogaster
ctaagccaacaaa

SEQ ID NO: 613241 - DNA, 13 bp, D. melanogaster
ctaagcccaaaac

SEQ ID NO: 613242 - DNA, 13 bp, D. melanogaster
ctaagcccaaact

SEQ ID NO: 613243 - DNA, 13 bp, D. melanogaster
ctaagcgaaaaac

SEQ ID NO: 613244 - DNA, 13 bp, D. melanogaster
ctaagcgaattgt

SEQ ID NO: 613245 - DNA, 13 bp, D. melanogaster
ctaaggaatttga

SEQ ID NO: 613246 - DNA, 13 bp, D. melanogaster
ctaagtaaatagt

SEQ ID NO: 613247 - DNA, 14 bp, D. melanogaster
ctaagtcaaaacaa

SEQ ID NO: 613248 - DNA, 13 bp, D. melanogaster
ctaagtcagcatc

SEQ ID NO: 613249 - DNA, 13 bp, D. melanogaster
ctaataaaaatgt

SEQ ID NO: 613250 - DNA, 13 bp, D. melanogaster
ctaataaaacgaa

SEQ ID NO: 613251 - DNA, 13 bp, D. melanogaster
ctaataaaacttt

SEQ ID NO: 613252 - DNA, 13 bp, D. melanogaster
ctaataaacttga

SEQ ID NO: 613253 - DNA, 13 bp, D. melanogaster
ctaataactccaa

SEQ ID NO: 613254 - DNA, 13 bp, D. melanogaster
ctaataactttta

SEQ ID NO: 613255 - DNA, 13 bp, D. melanogaster
ctaatactaaata

SEQ ID NO: 613256 - DNA, 13 bp, D. melanogaster
ctaatactaatac

SEQ ID NO: 613257 - DNA, 13 bp, D. melanogaster
ctaatagaaacta

SEQ ID NO: 613258 - DNA, 13 bp, D. melanogaster
ctaatatatatac

SEQ ID NO: 613259 - DNA, 13 bp, D. melanogaster
ctaatattcaaat

SEQ ID NO: 613260 - DNA, 14 bp, D. melanogaster
ctaatattcaaata

SEQ ID NO: 613261 - DNA, 13 bp, D. melanogaster
ctaatattgttta

SEQ ID NO: 613262 - DNA, 13 bp, D. melanogaster
ctaatattttgcc

SEQ ID NO: 613263 - DNA, 14 bp, D. melanogaster
ctaatcaaatcaaa

SEQ ID NO: 613264 - DNA, 13 bp, D. melanogaster
ctaatcaaattaa

SEQ ID NO: 613265 - DNA, 13 bp, D. melanogaster
ctaatcaaattat

SEQ ID NO: 613266 - DNA, 13 bp, D. melanogaster
ctaatcaaatttg

SEQ ID NO: 613267 - DNA, 13 bp, D. melanogaster
ctaatcaagaata

SEQ ID NO: 613268 - DNA, 13 bp, D. melanogaster
ctaatcactgcct

SEQ ID NO: 613269 - DNA, 13 bp, D. melanogaster
ctaatccgagtat

SEQ ID NO: 613270 - DNA, 13 bp, D. melanogaster
ctaatcctctcca

SEQ ID NO: 613271 - DNA, 13 bp, D. melanogaster
ctaatctaatcta

SEQ ID NO: 613272 - DNA, 13 bp, D. melanogaster
ctaatctgcggga

SEQ ID NO: 613273 - DNA, 13 bp, D. melanogaster
ctaatcttaagaa

SEQ ID NO: 613274 - DNA, 13 bp, D. melanogaster
ctaatgaaaataa

SEQ ID NO: 613275 - DNA, 13 bp, D. melanogaster
ctaatgaattgaa

SEQ ID NO: 613276 - DNA, 14 bp, D. melanogaster
ctaatgatagtatt

SEQ ID NO: 613277 - DNA, 13 bp, D. melanogaster
ctaatgcaaattt

SEQ ID NO: 613278 - DNA, 13 bp, D. melanogaster
ctaatgcagcaat

SEQ ID NO: 613279 - DNA, 13 bp, D. melanogaster
ctaatgctaatgc

SEQ ID NO: 613280 - DNA, 13 bp, D. melanogaster
ctaatgctatact

SEQ ID NO: 613281 - DNA, 13 bp, D. melanogaster
ctaatggaattct

SEQ ID NO: 613282 - DNA, 13 bp, D. melanogaster
ctaatgtacatct

SEQ ID NO: 613283 - DNA, 13 bp, D. melanogaster
ctaatgttcctag

SEQ ID NO: 613284 - DNA, 13 bp, D. melanogaster
ctaattaaaagtg

SEQ ID NO: 613285 - DNA, 13 bp, D. melanogaster
ctaattaaaagtt

SEQ ID NO: 613286 - DNA, 13 bp, D. melanogaster
ctaattaaaatgt

SEQ ID NO: 613287 - DNA, 13 bp, D. melanogaster
ctaattaaatatg

SEQ ID NO: 613288 - DNA, 13 bp, D. melanogaster
ctaattaaattag

SEQ ID NO: 613289 - DNA, 13 bp, D. melanogaster
ctaattaacccaa

SEQ ID NO: 613290 - DNA, 13 bp, D. melanogaster
ctaattaactttt

SEQ ID NO: 613291 - DNA, 13 bp, D. melanogaster
ctaattaccaatg

SEQ ID NO: 613292 - DNA, 13 bp, D. melanogaster
ctaattactaatt

SEQ ID NO: 613293 - DNA, 13 bp, D. melanogaster
ctaattagatttc

SEQ ID NO: 613294 - DNA, 13 bp, D. melanogaster
ctaattagcaaac

SEQ ID NO: 613295 - DNA, 13 bp, D. melanogaster
ctaattataaacc

SEQ ID NO: 613296 - DNA, 13 bp, D. melanogaster
ctaattgaaaaat

SEQ ID NO: 613297 - DNA, 14 bp, D. melanogaster
ctaattgaaaaatt

SEQ ID NO: 613298 - DNA, 13 bp, D. melanogaster
ctaattgaaaagc

SEQ ID NO: 613299 - DNA, 13 bp, D. melanogaster
ctaattgaagaat

SEQ ID NO: 613300 - DNA, 13 bp, D. melanogaster
ctaattgaatatt

SEQ ID NO: 613301 - DNA, 13 bp, D. melanogaster
ctaattgaattaa

SEQ ID NO: 613302 - DNA, 14 bp, D. melanogaster
ctaattgaattaaa

SEQ ID NO: 613303 - DNA, 13 bp, D. melanogaster
ctaattgaatttg

SEQ ID NO: 613304 - DNA, 13 bp, D. melanogaster
ctaattgagttat

SEQ ID NO: 613305 - DNA, 13 bp, D. melanogaster
ctaattgatcaag

SEQ ID NO: 613306 - DNA, 13 bp, D. melanogaster
ctaattgattgat

SEQ ID NO: 613307 - DNA, 13 bp, D. melanogaster
ctaattgatttcc

SEQ ID NO: 613308 - DNA, 13 bp, D. melanogaster
ctaattgcaattt

SEQ ID NO: 613309 - DNA, 13 bp, D. melanogaster
ctaattgcatttg

SEQ ID NO: 613310 - DNA, 14 bp, D. melanogaster
ctaattgccaagaa

SEQ ID NO: 613311 - DNA, 13 bp, D. melanogaster
ctaattggattta

SEQ ID NO: 613312 - DNA, 13 bp, D. melanogaster
ctaattggatttc

SEQ ID NO: 613313 - DNA, 13 bp, D. melanogaster
ctaattggcagaa

SEQ ID NO: 613314 - DNA, 13 bp, D. melanogaster
ctaattggcagca

SEQ ID NO: 613315 - DNA, 14 bp, D. melanogaster
ctaattgtaattgc

SEQ ID NO: 613316 - DNA, 13 bp, D. melanogaster
ctaattgttattt

SEQ ID NO: 613317 - DNA, 13 bp, D. melanogaster
ctaattgttgttg

SEQ ID NO: 613318 - DNA, 13 bp, D. melanogaster
ctaattgttttta

SEQ ID NO: 613319 - DNA, 13 bp, D. melanogaster
ctaatttaaaagt

SEQ ID NO: 613320 - DNA, 13 bp, D. melanogaster
ctaatttaatttg

SEQ ID NO: 613321 - DNA, 14 bp, D. melanogaster
ctaatttatgcaaa

SEQ ID NO: 613322 - DNA, 13 bp, D. melanogaster
ctaatttatgtgc

SEQ ID NO: 613323 - DNA, 13 bp, D. melanogaster
ctaatttattgca

SEQ ID NO: 613324 - DNA, 13 bp, D. melanogaster
ctaatttatttac

SEQ ID NO: 613325 - DNA, 13 bp, D. melanogaster
ctaatttcaaatt

SEQ ID NO: 613326 - DNA, 13 bp, D. melanogaster
ctaatttccaaaa

SEQ ID NO: 613327 - DNA, 13 bp, D. melanogaster
ctaatttcgtcaa

SEQ ID NO: 613328 - DNA, 13 bp, D. melanogaster
ctaatttgatttt

SEQ ID NO: 613329 - DNA, 13 bp, D. melanogaster
ctaatttgcaaat

SEQ ID NO: 613330 - DNA, 13 bp, D. melanogaster
ctaatttgccatt

SEQ ID NO: 613331 - DNA, 13 bp, D. melanogaster
ctaatttgcttat

SEQ ID NO: 613332 - DNA, 13 bp, D. melanogaster
ctaatttgtatgc

SEQ ID NO: 613333 - DNA, 13 bp, D. melanogaster
ctaattttaatca

SEQ ID NO: 613334 - DNA, 14 bp, D. melanogaster
ctaattttgttgta

SEQ ID NO: 613335 - DNA, 13 bp, D. melanogaster
ctacaaaatattg

SEQ ID NO: 613336 - DNA, 13 bp, D. melanogaster
ctacaaaatgtgt

SEQ ID NO: 613337 - DNA, 14 bp, D. melanogaster
ctacaaacttctgg

SEQ ID NO: 613338 - DNA, 13 bp, D. melanogaster
ctacaaatttttc

SEQ ID NO: 613339 - DNA, 14 bp, D. melanogaster
ctacaaatttttct

SEQ ID NO: 613340 - DNA, 13 bp, D. melanogaster
ctacaacaatttg

SEQ ID NO: 613341 - DNA, 13 bp, D. melanogaster
ctacaacagcagc

SEQ ID NO: 613342 - DNA, 14 bp, D. melanogaster
ctacaacgctaaac

SEQ ID NO: 613343 - DNA, 13 bp, D. melanogaster
ctacaactacaaa

SEQ ID NO: 613344 - DNA, 14 bp, D. melanogaster
ctacaactacaact

SEQ ID NO: 613345 - DNA, 13 bp, D. melanogaster
ctacaactatctg

SEQ ID NO: 613346 - DNA, 13 bp, D. melanogaster
ctacaagcatttg

SEQ ID NO: 613347 - DNA, 14 bp, D. melanogaster
ctacaagcatttgt

SEQ ID NO: 613348 - DNA, 14 bp, D. melanogaster
ctacaagttgaagc

SEQ ID NO: 613349 - DNA, 13 bp, D. melanogaster
ctacaataacaac

SEQ ID NO: 613350 - DNA, 14 bp, D. melanogaster
ctacaatatttttg

SEQ ID NO: 613351 - DNA, 13 bp, D. melanogaster
ctacaatccaata

SEQ ID NO: 613352 - DNA, 13 bp, D. melanogaster
ctacaatctaaca

SEQ ID NO: 613353 - DNA, 13 bp, D. melanogaster
ctacaattttgtg

SEQ ID NO: 613354 - DNA, 14 bp, D. melanogaster
ctacacaaaagtaa

SEQ ID NO: 613355 - DNA, 13 bp, D. melanogaster
ctacacacacata

SEQ ID NO: 613356 - DNA, 13 bp, D. melanogaster
ctacacagagaaa

SEQ ID NO: 613357 - DNA, 14 bp, D. melanogaster
ctacacagagaaaa

SEQ ID NO: 613358 - DNA, 13 bp, D. melanogaster
ctacacaggaaaa

SEQ ID NO: 613359 - DNA, 13 bp, D. melanogaster
ctacaccaaaaag

SEQ ID NO: 613360 - DNA, 13 bp, D. melanogaster
ctacactctgctc

SEQ ID NO: 613361 - DNA, 13 bp, D. melanogaster
ctacactgaaaaa

SEQ ID NO: 613362 - DNA, 14 bp, D. melanogaster
ctacactgagaaaa

SEQ ID NO: 613363 - DNA, 13 bp, D. melanogaster
ctacacttgaaca

SEQ ID NO: 613364 - DNA, 14 bp, D. melanogaster
ctacacttgaacag

SEQ ID NO: 613365 - DNA, 13 bp, D. melanogaster
ctacactttcgat

SEQ ID NO: 613366 - DNA, 14 bp, D. melanogaster
ctacagaacaagaa

SEQ ID NO: 613367 - DNA, 13 bp, D. melanogaster
ctacagatccaaa

SEQ ID NO: 613368 - DNA, 14 bp, D. melanogaster
ctacagcaaagcat

SEQ ID NO: 613369 - DNA, 13 bp, D. melanogaster
ctacagctacagc

SEQ ID NO: 613370 - DNA, 13 bp, D. melanogaster
ctacaggatactg

SEQ ID NO: 613371 - DNA, 14 bp, D. melanogaster
ctacagtttcgtgt

SEQ ID NO: 613372 - DNA, 13 bp, D. melanogaster
ctacataaagaaa

SEQ ID NO: 613373 - DNA, 13 bp, D. melanogaster
ctacatacacata

SEQ ID NO: 613374 - DNA, 13 bp, D. melanogaster
ctacatacatata

SEQ ID NO: 613375 - DNA, 14 bp, D. melanogaster
ctacatacatatac

SEQ ID NO: 613376 - DNA, 13 bp, D. melanogaster
ctacatagaaaaa

SEQ ID NO: 613377 - DNA, 13 bp, D. melanogaster
ctacatatataca

SEQ ID NO: 613378 - DNA, 14 bp, D. melanogaster
ctacatatatacat

SEQ ID NO: 613379 - DNA, 13 bp, D. melanogaster
ctacatatatatt

SEQ ID NO: 613380 - DNA, 14 bp, D. melanogaster
ctacatatatgtat

SEQ ID NO: 613381 - DNA, 13 bp, D. melanogaster
ctacatatattta

SEQ ID NO: 613382 - DNA, 13 bp, D. melanogaster
ctacatccaaatc

SEQ ID NO: 613383 - DNA, 13 bp, D. melanogaster
ctacatccacatc

SEQ ID NO: 613384 - DNA, 13 bp, D. melanogaster
ctacatctacatc

SEQ ID NO: 613385 - DNA, 13 bp, D. melanogaster
ctacatgaaattc

SEQ ID NO: 613386 - DNA, 14 bp, D. melanogaster
ctacatgagtcagt

SEQ ID NO: 613387 - DNA, 13 bp, D. melanogaster
ctacattacaata

SEQ ID NO: 613388 - DNA, 13 bp, D. melanogaster
ctacattttaaaa

SEQ ID NO: 613389 - DNA, 13 bp, D. melanogaster
ctacattttcaat

SEQ ID NO: 613390 - DNA, 13 bp, D. melanogaster
ctacatttttgat

SEQ ID NO: 613391 - DNA, 13 bp, D. melanogaster
ctacatttttggt

SEQ ID NO: 613392 - DNA, 13 bp, D. melanogaster
ctaccaaaaatat

SEQ ID NO: 613393 - DNA, 13 bp, D. melanogaster
ctaccaactacca

SEQ ID NO: 613394 - DNA, 13 bp, D. melanogaster
ctaccagataccc

SEQ ID NO: 613395 - DNA, 15 bp, D. melanogaster
ctaccagcagcagaa

SEQ ID NO: 613396 - DNA, 13 bp, D. melanogaster
ctaccagctacca

SEQ ID NO: 613397 - DNA, 13 bp, D. melanogaster
ctacccagtaact

SEQ ID NO: 613398 - DNA, 13 bp, D. melanogaster
ctacccagttcca

SEQ ID NO: 613399 - DNA, 13 bp, D. melanogaster
ctaccgaaatcgg

SEQ ID NO: 613400 - DNA, 14 bp, D. melanogaster
ctaccgactgcgcc

SEQ ID NO: 613401 - DNA, 13 bp, D. melanogaster
ctacgaaaataaa

SEQ ID NO: 613402 - DNA, 13 bp, D. melanogaster
ctacgaaattggc

SEQ ID NO: 613403 - DNA, 13 bp, D. melanogaster
ctacgcataattc

SEQ ID NO: 613404 - DNA, 13 bp, D. melanogaster
ctacgcccatccc

SEQ ID NO: 613405 - DNA, 13 bp, D. melanogaster
ctacgtatatttt

SEQ ID NO: 613406 - DNA, 14 bp, D. melanogaster
ctactaaatgaaaa

SEQ ID NO: 613407 - DNA, 13 bp, D. melanogaster
ctactacaaattt

SEQ ID NO: 613408 - DNA, 13 bp, D. melanogaster
ctactacagcctt

SEQ ID NO: 613409 - DNA, 13 bp, D. melanogaster
ctactactacaac

SEQ ID NO: 613410 - DNA, 14 bp, D. melanogaster
ctactactactacc

SEQ ID NO: 613411 - DNA, 14 bp, D. melanogaster
ctactactactact

SEQ ID NO: 613412 - DNA, 13 bp, D. melanogaster
ctactactactgc

SEQ ID NO: 613413 - DNA, 13 bp, D. melanogaster
ctactactacttt

SEQ ID NO: 613414 - DNA, 13 bp, D. melanogaster
ctactactccaac

SEQ ID NO: 613415 - DNA, 13 bp, D. melanogaster
ctactatatatgt

SEQ ID NO: 613416 - DNA, 13 bp, D. melanogaster
ctactcaacatag

SEQ ID NO: 613417 - DNA, 13 bp, D. melanogaster
ctactccggttcc

SEQ ID NO: 613418 - DNA, 14 bp, D. melanogaster
ctactctcaatttg

SEQ ID NO: 613419 - DNA, 13 bp, D. melanogaster
ctactctcgttat

SEQ ID NO: 613420 - DNA, 13 bp, D. melanogaster
ctactgatcacat

SEQ ID NO: 613421 - DNA, 13 bp, D. melanogaster
ctactgcagcata

SEQ ID NO: 613422 - DNA, 13 bp, D. melanogaster
ctactgctactgc

SEQ ID NO: 613423 - DNA, 13 bp, D. melanogaster
ctactgctgctgc

SEQ ID NO: 613424 - DNA, 14 bp, D. melanogaster
ctactgctgctgct

SEQ ID NO: 613425 - DNA, 13 bp, D. melanogaster
ctactgctgctgg

SEQ ID NO: 613426 - DNA, 13 bp, D. melanogaster
ctactgctgctgt

SEQ ID NO: 613427 - DNA, 13 bp, D. melanogaster
ctactgggagcca

SEQ ID NO: 613428 - DNA, 13 bp, D. melanogaster
ctactgtgaattc

SEQ ID NO: 613429 - DNA, 13 bp, D. melanogaster
ctactgtgcaggc

SEQ ID NO: 613430 - DNA, 13 bp, D. melanogaster
ctacttaacgaaa

SEQ ID NO: 613431 - DNA, 13 bp, D. melanogaster
ctacttcacgttt

SEQ ID NO: 613432 - DNA, 13 bp, D. melanogaster
ctacttctacttt

SEQ ID NO: 613433 - DNA, 13 bp, D. melanogaster
ctacttgcaggcc

SEQ ID NO: 613434 - DNA, 13 bp, D. melanogaster
ctacttgctactt

SEQ ID NO: 613435 - DNA, 14 bp, D. melanogaster
ctacttggaaccga

SEQ ID NO: 613436 - DNA, 13 bp, D. melanogaster
ctactttaagcac

SEQ ID NO: 613437 - DNA, 13 bp, D. melanogaster
ctactttactgcg

SEQ ID NO: 613438 - DNA, 13 bp, D. melanogaster
ctactttagcata

SEQ ID NO: 613439 - DNA, 15 bp, D. melanogaster
ctactttagcataga

SEQ ID NO: 613440 - DNA, 13 bp, D. melanogaster
ctactttgttgcc

SEQ ID NO: 613441 - DNA, 13 bp, D. melanogaster
ctactttttcgag

SEQ ID NO: 613442 - DNA, 13 bp, D. melanogaster
ctagaaaaaacga

SEQ ID NO: 613443 - DNA, 13 bp, D. melanogaster
ctagaaaaactgc

SEQ ID NO: 613444 - DNA, 13 bp, D. melanogaster
ctagaaaaatatt

SEQ ID NO: 613445 - DNA, 13 bp, D. melanogaster
ctagaaaataaat

SEQ ID NO: 613446 - DNA, 13 bp, D. melanogaster
ctagaaactatat

SEQ ID NO: 613447 - DNA, 13 bp, D. melanogaster
ctagaaataaata

SEQ ID NO: 613448 - DNA, 13 bp, D. melanogaster
ctagaagcaagcg

SEQ ID NO: 613449 - DNA, 13 bp, D. melanogaster
ctagaatctgtat

SEQ ID NO: 613450 - DNA, 13 bp, D. melanogaster
ctagatacagata

SEQ ID NO: 613451 - DNA, 13 bp, D. melanogaster
ctagatgaaaatg

SEQ ID NO: 613452 - DNA, 14 bp, D. melanogaster
ctagatgatataat

SEQ ID NO: 613453 - DNA, 14 bp, D. melanogaster
ctagatttgttgaa

SEQ ID NO: 613454 - DNA, 13 bp, D. melanogaster
ctagcagtttctt

SEQ ID NO: 613455 - DNA, 13 bp, D. melanogaster
ctagccagccaca

SEQ ID NO: 613456 - DNA, 13 bp, D. melanogaster
ctagccatttcgg

SEQ ID NO: 613457 - DNA, 13 bp, D. melanogaster
ctagccgcttgct

SEQ ID NO: 613458 - DNA, 13 bp, D. melanogaster
ctagctgcaattt

SEQ ID NO: 613459 - DNA, 13 bp, D. melanogaster
ctagcttttatag

SEQ ID NO: 613460 - DNA, 14 bp, D. melanogaster
ctaggaatcaaaaa

SEQ ID NO: 613461 - DNA, 13 bp, D. melanogaster
ctaggtggcgcca

SEQ ID NO: 613462 - DNA, 13 bp, D. melanogaster
ctagtgccacatg

SEQ ID NO: 613463 - DNA, 13 bp, D. melanogaster
ctagtgcttggaa

SEQ ID NO: 613464 - DNA, 13 bp, D. melanogaster
ctagtggaaatgc

SEQ ID NO: 613465 - DNA, 13 bp, D. melanogaster
ctagttagcaaca

SEQ ID NO: 613466 - DNA, 13 bp, D. melanogaster
ctagttgcaattt

SEQ ID NO: 613467 - DNA, 14 bp, D. melanogaster
ctagttgctagttg

SEQ ID NO: 613468 - DNA, 13 bp, D. melanogaster
ctagtttaaaaaa

SEQ ID NO: 613469 - DNA, 13 bp, D. melanogaster
ctagtttttctgg

SEQ ID NO: 613470 - DNA, 13 bp, D. melanogaster
ctataaaaatgaa

SEQ ID NO: 613471 - DNA, 13 bp, D. melanogaster
ctataaaagatga

SEQ ID NO: 613472 - DNA, 13 bp, D. melanogaster
ctataaaagcaag

SEQ ID NO: 613473 - DNA, 13 bp, D. melanogaster
ctataaaatcatt

SEQ ID NO: 613474 - DNA, 13 bp, D. melanogaster
ctataaaatgtat

SEQ ID NO: 613475 - DNA, 13 bp, D. melanogaster
ctataaaattgca

SEQ ID NO: 613476 - DNA, 13 bp, D. melanogaster
ctataaaattgtt

SEQ ID NO: 613477 - DNA, 14 bp, D. melanogaster
ctataaaattgttt

SEQ ID NO: 613478 - DNA, 13 bp, D. melanogaster
ctataaataaaag

SEQ ID NO: 613479 - DNA, 13 bp, D. melanogaster
ctataaataaacc

SEQ ID NO: 613480 - DNA, 13 bp, D. melanogaster
ctataaatagaaa

SEQ ID NO: 613481 - DNA, 13 bp, D. melanogaster
ctataaatatgta

SEQ ID NO: 613482 - DNA, 13 bp, D. melanogaster
ctataaccacatc

SEQ ID NO: 613483 - DNA, 13 bp, D. melanogaster
ctataactataaa

SEQ ID NO: 613484 - DNA, 13 bp, D. melanogaster
ctataagtacaca

SEQ ID NO: 613485 - DNA, 14 bp, D. melanogaster
ctataatcaccgat

SEQ ID NO: 613486 - DNA, 13 bp, D. melanogaster
ctataatttctat

SEQ ID NO: 613487 - DNA, 13 bp, D. melanogaster
ctatacaaatatt

SEQ ID NO: 613488 - DNA, 13 bp, D. melanogaster
ctatacatacata

SEQ ID NO: 613489 - DNA, 13 bp, D. melanogaster
ctatacatataca

SEQ ID NO: 613490 - DNA, 13 bp, D. melanogaster
ctatacattttta

SEQ ID NO: 613491 - DNA, 13 bp, D. melanogaster
ctatactatacta

SEQ ID NO: 613492 - DNA, 14 bp, D. melanogaster
ctatactatactat

SEQ ID NO: 613493 - DNA, 13 bp, D. melanogaster
ctatactatatag

SEQ ID NO: 613494 - DNA, 13 bp, D. melanogaster
ctatacttcattt

SEQ ID NO: 613495 - DNA, 14 bp, D. melanogaster
ctatagaaattata

SEQ ID NO: 613496 - DNA, 13 bp, D. melanogaster
ctatagaatgcca

SEQ ID NO: 613497 - DNA, 13 bp, D. melanogaster
ctatagagacaag

SEQ ID NO: 613498 - DNA, 13 bp, D. melanogaster
ctatagaggcaga

SEQ ID NO: 613499 - DNA, 13 bp, D. melanogaster
ctatagctaaagg

SEQ ID NO: 613500 - DNA, 13 bp, D. melanogaster
ctatagtcaagtt

SEQ ID NO: 613501 - DNA, 13 bp, D. melanogaster
ctatataaactat

SEQ ID NO: 613502 - DNA, 13 bp, D. melanogaster
ctatataacagag

SEQ ID NO: 613503 - DNA, 13 bp, D. melanogaster
ctatataatgtat

SEQ ID NO: 613504 - DNA, 13 bp, D. melanogaster
ctatatacacaca

SEQ ID NO: 613505 - DNA, 13 bp, D. melanogaster
ctatatacacata

SEQ ID NO: 613506 - DNA, 14 bp, D. melanogaster
ctatatacacatat

SEQ ID NO: 613507 - DNA, 13 bp, D. melanogaster
ctatatacatata

SEQ ID NO: 613508 - DNA, 14 bp, D. melanogaster
ctatatacatatat

SEQ ID NO: 613509 - DNA, 13 bp, D. melanogaster
ctatatagtatag

SEQ ID NO: 613510 - DNA, 14 bp, D. melanogaster
ctatatatacacat

SEQ ID NO: 613511 - DNA, 13 bp, D. melanogaster
ctatatatacata

SEQ ID NO: 613512 - DNA, 14 bp, D. melanogaster
ctatatatacatat

SEQ ID NO: 613513 - DNA, 13 bp, D. melanogaster
ctatatatagtgt

SEQ ID NO: 613514 - DNA, 14 bp, D. melanogaster
ctatatatagtgta

SEQ ID NO: 613515 - DNA, 13 bp, D. melanogaster
ctatatatataca

SEQ ID NO: 613516 - DNA, 13 bp, D. melanogaster
ctatatatatcta

SEQ ID NO: 613517 - DNA, 13 bp, D. melanogaster
ctatatatggatg

SEQ ID NO: 613518 - DNA, 13 bp, D. melanogaster
ctatatatgtata

SEQ ID NO: 613519 - DNA, 14 bp, D. melanogaster
ctatatatttatgt

SEQ ID NO: 613520 - DNA, 13 bp, D. melanogaster
ctatatatttttg

SEQ ID NO: 613521 - DNA, 13 bp, D. melanogaster
ctatatcaataac

SEQ ID NO: 613522 - DNA, 13 bp, D. melanogaster
ctatatcataaat

SEQ ID NO: 613523 - DNA, 13 bp, D. melanogaster
ctatatcatcatt

SEQ ID NO: 613524 - DNA, 13 bp, D. melanogaster
ctatatctatatg

SEQ ID NO: 613525 - DNA, 13 bp, D. melanogaster
ctatatctattgc

SEQ ID NO: 613526 - DNA, 13 bp, D. melanogaster
ctatatgaaggtg

SEQ ID NO: 613527 - DNA, 13 bp, D. melanogaster
ctatatgatgatg

SEQ ID NO: 613528 - DNA, 13 bp, D. melanogaster
ctatatgccatat

SEQ ID NO: 613529 - DNA, 13 bp, D. melanogaster
ctatatgcggtat

SEQ ID NO: 613530 - DNA, 13 bp, D. melanogaster
ctatatgctatat

SEQ ID NO: 613531 - DNA, 14 bp, D. melanogaster
ctatatgctatata

SEQ ID NO: 613532 - DNA, 13 bp, D. melanogaster
ctatatgtatatc

SEQ ID NO: 613533 - DNA, 14 bp, D. melanogaster
ctatatgtatgtac

SEQ ID NO: 613534 - DNA, 13 bp, D. melanogaster
ctatatgtttgcg

SEQ ID NO: 613535 - DNA, 13 bp, D. melanogaster
ctatattaccatt

SEQ ID NO: 613536 - DNA, 13 bp, D. melanogaster
ctatattaggaat

SEQ ID NO: 613537 - DNA, 13 bp, D. melanogaster
ctatattatatag

SEQ ID NO: 613538 - DNA, 13 bp, D. melanogaster
ctatatttaacga

SEQ ID NO: 613539 - DNA, 13 bp, D. melanogaster
ctatatttacata

SEQ ID NO: 613540 - DNA, 13 bp, D. melanogaster
ctatatttatatc

SEQ ID NO: 613541 - DNA, 13 bp, D. melanogaster
ctatatttatgta

SEQ ID NO: 613542 - DNA, 13 bp, D. melanogaster
ctatatttggttg

SEQ ID NO: 613543 - DNA, 13 bp, D. melanogaster
ctatattttatac

SEQ ID NO: 613544 - DNA, 13 bp, D. melanogaster
ctatcaaaacttt

SEQ ID NO: 613545 - DNA, 13 bp, D. melanogaster
ctatcaaatattt

SEQ ID NO: 613546 - DNA, 13 bp, D. melanogaster
ctatcaatttcaa

SEQ ID NO: 613547 - DNA, 13 bp, D. melanogaster
ctatcaatttcac

SEQ ID NO: 613548 - DNA, 13 bp, D. melanogaster
ctatcagaaaaat

SEQ ID NO: 613549 - DNA, 13 bp, D. melanogaster
ctatcagatatcc

SEQ ID NO: 613550 - DNA, 13 bp, D. melanogaster
ctatcaggtaatc

SEQ ID NO: 613551 - DNA, 13 bp, D. melanogaster
ctatcatcatcat

SEQ ID NO: 613552 - DNA, 14 bp, D. melanogaster
ctatccacccgaaa

SEQ ID NO: 613553 - DNA, 13 bp, D. melanogaster
ctatccatccatc

SEQ ID NO: 613554 - DNA, 13 bp, D. melanogaster
ctatcccaaaact

SEQ ID NO: 613555 - DNA, 13 bp, D. melanogaster
ctatcccaaggtc

SEQ ID NO: 613556 - DNA, 13 bp, D. melanogaster
ctatcgaaaaaga

SEQ ID NO: 613557 - DNA, 13 bp, D. melanogaster
ctatcgatttgca

SEQ ID NO: 613558 - DNA, 14 bp, D. melanogaster
ctatcgatttgcaa

SEQ ID NO: 613559 - DNA, 13 bp, D. melanogaster
ctatcgcatggca

SEQ ID NO: 613560 - DNA, 14 bp, D. melanogaster
ctatcgcatggcag

SEQ ID NO: 613561 - DNA, 13 bp, D. melanogaster
ctatcgcttgttt

SEQ ID NO: 613562 - DNA, 14 bp, D. melanogaster
ctatctatatctat

SEQ ID NO: 613563 - DNA, 13 bp, D. melanogaster
ctatctatctata

SEQ ID NO: 613564 - DNA, 14 bp, D. melanogaster
ctatctatctatat

SEQ ID NO: 613565 - DNA, 13 bp, D. melanogaster
ctatctatctatc

SEQ ID NO: 613566 - DNA, 14 bp, D. melanogaster
ctatctatctatcc

SEQ ID NO: 613567 - DNA, 13 bp, D. melanogaster
ctatctatctatt

SEQ ID NO: 613568 - DNA, 14 bp, D. melanogaster
ctatctatctctct

SEQ ID NO: 613569 - DNA, 13 bp, D. melanogaster
ctatctattatgg

SEQ ID NO: 613570 - DNA, 13 bp, D. melanogaster
ctatctcaagacc

SEQ ID NO: 613571 - DNA, 14 bp, D. melanogaster
ctatctgaatggca

SEQ ID NO: 613572 - DNA, 13 bp, D. melanogaster
ctatctgcctgtc

SEQ ID NO: 613573 - DNA, 13 bp, D. melanogaster
ctatctgtatctg

SEQ ID NO: 613574 - DNA, 14 bp, D. melanogaster
ctatctgtatctgt

SEQ ID NO: 613575 - DNA, 13 bp, D. melanogaster
ctatctgtctgtc

SEQ ID NO: 613576 - DNA, 13 bp, D. melanogaster
ctatctgtgtgtg

SEQ ID NO: 613577 - DNA, 13 bp, D. melanogaster
ctatctgttttat

SEQ ID NO: 613578 - DNA, 14 bp, D. melanogaster
ctatcttgactatt

SEQ ID NO: 613579 - DNA, 13 bp, D. melanogaster
ctatgaaaaatat

SEQ ID NO: 613580 - DNA, 13 bp, D. melanogaster
ctatgaaaatgca

SEQ ID NO: 613581 - DNA, 13 bp, D. melanogaster
ctatgaacccaat

SEQ ID NO: 613582 - DNA, 13 bp, D. melanogaster
ctatgaatcattt

SEQ ID NO: 613583 - DNA, 13 bp, D. melanogaster
ctatgacttcttt

SEQ ID NO: 613584 - DNA, 13 bp, D. melanogaster
ctatgaggacttc

SEQ ID NO: 613585 - DNA, 13 bp, D. melanogaster
ctatgatgttttt

SEQ ID NO: 613586 - DNA, 14 bp, D. melanogaster
ctatgcaaaaaaaa

SEQ ID NO: 613587 - DNA, 13 bp, D. melanogaster
ctatgcaaattta

SEQ ID NO: 613588 - DNA, 13 bp, D. melanogaster
ctatgccatcatt

SEQ ID NO: 613589 - DNA, 13 bp, D. melanogaster
ctatgcgaaattt

SEQ ID NO: 613590 - DNA, 13 bp, D. melanogaster
ctatggaagaagc

SEQ ID NO: 613591 - DNA, 13 bp, D. melanogaster
ctatggcgtataa

SEQ ID NO: 613592 - DNA, 13 bp, D. melanogaster
ctatggtattttt

SEQ ID NO: 613593 - DNA, 13 bp, D. melanogaster
ctatgtaaatatt

SEQ ID NO: 613594 - DNA, 16 bp, D. melanogaster
ctatgtacatacatat

SEQ ID NO: 613595 - DNA, 15 bp, D. melanogaster
ctatgtacatatata

SEQ ID NO: 613596 - DNA, 14 bp, D. melanogaster
ctatgtacatatgt

SEQ ID NO: 613597 - DNA, 13 bp, D. melanogaster
ctatgtataatta

SEQ ID NO: 613598 - DNA, 13 bp, D. melanogaster
ctatgtatataca

SEQ ID NO: 613599 - DNA, 13 bp, D. melanogaster
ctatgtatatatg

SEQ ID NO: 613600 - DNA, 13 bp, D. melanogaster
ctatgtatatgta

SEQ ID NO: 613601 - DNA, 14 bp, D. melanogaster
ctatgtatatgtat

SEQ ID NO: 613602 - DNA, 13 bp, D. melanogaster
ctatgtattttat

SEQ ID NO: 613603 - DNA, 13 bp, D. melanogaster
ctatgtgaaggtg

SEQ ID NO: 613604 - DNA, 13 bp, D. melanogaster
ctatgtgtatata

SEQ ID NO: 613605 - DNA, 14 bp, D. melanogaster
ctatgtgtgtgtgt

SEQ ID NO: 613606 - DNA, 13 bp, D. melanogaster
ctatgtgtgtgtt

SEQ ID NO: 613607 - DNA, 13 bp, D. melanogaster
ctatgttataatt

SEQ ID NO: 613608 - DNA, 13 bp, D. melanogaster
ctattaaaacttt

SEQ ID NO: 613609 - DNA, 13 bp, D. melanogaster
ctattaaaatttc

SEQ ID NO: 613610 - DNA, 13 bp, D. melanogaster
ctattaaacaagg

SEQ ID NO: 613611 - DNA, 14 bp, D. melanogaster
ctattaaacaaggt

SEQ ID NO: 613612 - DNA, 13 bp, D. melanogaster
ctattaaagagaa

SEQ ID NO: 613613 - DNA, 13 bp, D. melanogaster
ctattaaaggagg

SEQ ID NO: 613614 - DNA, 13 bp, D. melanogaster
ctattaaagttaa

SEQ ID NO: 613615 - DNA, 13 bp, D. melanogaster
ctattaaattcta

SEQ ID NO: 613616 - DNA, 13 bp, D. melanogaster
ctattaactttaa

SEQ ID NO: 613617 - DNA, 13 bp, D. melanogaster
ctattaagcaatc

SEQ ID NO: 613618 - DNA, 14 bp, D. melanogaster
ctattaagcaatcg

SEQ ID NO: 613619 - DNA, 13 bp, D. melanogaster
ctattaagccatt

SEQ ID NO: 613620 - DNA, 13 bp, D. melanogaster
ctattaattatac

SEQ ID NO: 613621 - DNA, 13 bp, D. melanogaster
ctattactattac

SEQ ID NO: 613622 - DNA, 14 bp, D. melanogaster
ctattactattact

SEQ ID NO: 613623 - DNA, 14 bp, D. melanogaster
ctattataaaatgg

SEQ ID NO: 613624 - DNA, 14 bp, D. melanogaster
ctattatacattca

SEQ ID NO: 613625 - DNA, 13 bp, D. melanogaster
ctattatatggga

SEQ ID NO: 613626 - DNA, 13 bp, D. melanogaster
ctattatcagaca

SEQ ID NO: 613627 - DNA, 13 bp, D. melanogaster
ctattatcgataa

SEQ ID NO: 613628 - DNA, 13 bp, D. melanogaster
ctattattataga

SEQ ID NO: 613629 - DNA, 14 bp, D. melanogaster
ctattattattgtt

SEQ ID NO: 613630 - DNA, 13 bp, D. melanogaster
ctattatttgtat

SEQ ID NO: 613631 - DNA, 14 bp, D. melanogaster
ctattattttgacc

SEQ ID NO: 613632 - DNA, 13 bp, D. melanogaster
ctattcaaaagaa

SEQ ID NO: 613633 - DNA, 13 bp, D. melanogaster
ctattcatatgat

SEQ ID NO: 613634 - DNA, 13 bp, D. melanogaster
ctattcattctgc

SEQ ID NO: 613635 - DNA, 13 bp, D. melanogaster
ctattccatcatc

SEQ ID NO: 613636 - DNA, 13 bp, D. melanogaster
ctattcctattcc

SEQ ID NO: 613637 - DNA, 14 bp, D. melanogaster
ctattcctattcct

SEQ ID NO: 613638 - DNA, 13 bp, D. melanogaster
ctattcgaaaaat

SEQ ID NO: 613639 - DNA, 13 bp, D. melanogaster
ctattcgaagaag

SEQ ID NO: 613640 - DNA, 13 bp, D. melanogaster
ctattcgccaagt

SEQ ID NO: 613641 - DNA, 13 bp, D. melanogaster
ctattctacaaaa

SEQ ID NO: 613642 - DNA, 13 bp, D. melanogaster
ctattctattcta

SEQ ID NO: 613643 - DNA, 14 bp, D. melanogaster
ctattctattctat

SEQ ID NO: 613644 - DNA, 13 bp, D. melanogaster
ctattgatattta

SEQ ID NO: 613645 - DNA, 13 bp, D. melanogaster
ctattgattctga

SEQ ID NO: 613646 - DNA, 13 bp, D. melanogaster
ctattgcgaaatt

SEQ ID NO: 613647 - DNA, 13 bp, D. melanogaster
ctattgctattgc

SEQ ID NO: 613648 - DNA, 14 bp, D. melanogaster
ctattgctattgct

SEQ ID NO: 613649 - DNA, 13 bp, D. melanogaster
ctattggaattat

SEQ ID NO: 613650 - DNA, 14 bp, D. melanogaster
ctattggcatttcc

SEQ ID NO: 613651 - DNA, 13 bp, D. melanogaster
ctattggcgaaaa

SEQ ID NO: 613652 - DNA, 13 bp, D. melanogaster
ctattgtagtaag

SEQ ID NO: 613653 - DNA, 13 bp, D. melanogaster
ctattgtatattt

SEQ ID NO: 613654 - DNA, 13 bp, D. melanogaster
ctattgtattctt

SEQ ID NO: 613655 - DNA, 14 bp, D. melanogaster
ctattgtattctta

SEQ ID NO: 613656 - DNA, 13 bp, D. melanogaster
ctatttaaacaat

SEQ ID NO: 613657 - DNA, 13 bp, D. melanogaster
ctatttaacttca

SEQ ID NO: 613658 - DNA, 13 bp, D. melanogaster
ctatttaagctta

SEQ ID NO: 613659 - DNA, 13 bp, D. melanogaster
ctatttaagtttt

SEQ ID NO: 613660 - DNA, 13 bp, D. melanogaster
ctatttaatttgt

SEQ ID NO: 613661 - DNA, 14 bp, D. melanogaster
ctatttacaacatg

SEQ ID NO: 613662 - DNA, 13 bp, D. melanogaster
ctatttacaattt

SEQ ID NO: 613663 - DNA, 13 bp, D. melanogaster
ctatttacatata

SEQ ID NO: 613664 - DNA, 13 bp, D. melanogaster
ctatttagttgaa

SEQ ID NO: 613665 - DNA, 13 bp, D. melanogaster
ctatttataggta

SEQ ID NO: 613666 - DNA, 13 bp, D. melanogaster
ctatttatttaca

SEQ ID NO: 613667 - DNA, 13 bp, D. melanogaster
ctatttatttatg

SEQ ID NO: 613668 - DNA, 13 bp, D. melanogaster
ctatttatttgca

SEQ ID NO: 613669 - DNA, 13 bp, D. melanogaster
ctatttcaaaaat

SEQ ID NO: 613670 - DNA, 13 bp, D. melanogaster
ctatttcacaaga

SEQ ID NO: 613671 - DNA, 13 bp, D. melanogaster
ctatttcattgaa

SEQ ID NO: 613672 - DNA, 13 bp, D. melanogaster
ctatttccatttc

SEQ ID NO: 613673 - DNA, 13 bp, D. melanogaster
ctatttcttcgcc

SEQ ID NO: 613674 - DNA, 13 bp, D. melanogaster
ctatttgaaagag

SEQ ID NO: 613675 - DNA, 13 bp, D. melanogaster
ctatttgaagccg

SEQ ID NO: 613676 - DNA, 15 bp, D. melanogaster
ctatttgacataaaa

SEQ ID NO: 613677 - DNA, 13 bp, D. melanogaster
ctatttgccaaaa

SEQ ID NO: 613678 - DNA, 13 bp, D. melanogaster
ctatttgccattt

SEQ ID NO: 613679 - DNA, 13 bp, D. melanogaster
ctatttgcttatt

SEQ ID NO: 613680 - DNA, 13 bp, D. melanogaster
ctatttggaaaga

SEQ ID NO: 613681 - DNA, 13 bp, D. melanogaster
ctatttggaacac

SEQ ID NO: 613682 - DNA, 13 bp, D. melanogaster
ctatttggcattg

SEQ ID NO: 613683 - DNA, 13 bp, D. melanogaster
ctatttgtacttt

SEQ ID NO: 613684 - DNA, 13 bp, D. melanogaster
ctatttgtgcttt

SEQ ID NO: 613685 - DNA, 13 bp, D. melanogaster
ctatttgttgtgc

SEQ ID NO: 613686 - DNA, 13 bp, D. melanogaster
ctattttaaagtt

SEQ ID NO: 613687 - DNA, 13 bp, D. melanogaster
ctattttaagttt

SEQ ID NO: 613688 - DNA, 13 bp, D. melanogaster
ctattttatttcg

SEQ ID NO: 613689 - DNA, 13 bp, D. melanogaster
ctattttcaaata

SEQ ID NO: 613690 - DNA, 14 bp, D. melanogaster
ctattttcaaataa

SEQ ID NO: 613691 - DNA, 13 bp, D. melanogaster
ctattttccagct

SEQ ID NO: 613692 - DNA, 14 bp, D. melanogaster
ctattttcgaaaaa

SEQ ID NO: 613693 - DNA, 13 bp, D. melanogaster
ctattttctatga

SEQ ID NO: 613694 - DNA, 13 bp, D. melanogaster
ctattttgaatgg

SEQ ID NO: 613695 - DNA, 13 bp, D. melanogaster
ctattttgcataa

SEQ ID NO: 613696 - DNA, 13 bp, D. melanogaster
ctattttgttgga

SEQ ID NO: 613697 - DNA, 13 bp, D. melanogaster
ctatttttaaaca

SEQ ID NO: 613698 - DNA, 13 bp, D. melanogaster
ctatttttaaacc

SEQ ID NO: 613699 - DNA, 13 bp, D. melanogaster
ctatttttagcca

SEQ ID NO: 613700 - DNA, 13 bp, D. melanogaster
ctatttttataac

SEQ ID NO: 613701 - DNA, 13 bp, D. melanogaster
ctatttttatgaa

SEQ ID NO: 613702 - DNA, 14 bp, D. melanogaster
ctatttttatgaac

SEQ ID NO: 613703 - DNA, 13 bp, D. melanogaster
ctatttttggatt

SEQ ID NO: 613704 - DNA, 13 bp, D. melanogaster
ctattttttgtgc

SEQ ID NO: 613705 - DNA, 13 bp, D. melanogaster
ctcaaaaactgaa

SEQ ID NO: 613706 - DNA, 13 bp, D. melanogaster
ctcaaaaatacca

SEQ ID NO: 613707 - DNA, 13 bp, D. melanogaster
ctcaaaaatatgt

SEQ ID NO: 613708 - DNA, 13 bp, D. melanogaster
ctcaaaacccata

SEQ ID NO: 613709 - DNA, 13 bp, D. melanogaster
ctcaaaacgcaca

SEQ ID NO: 613710 - DNA, 13 bp, D. melanogaster
ctcaaaacggtca

SEQ ID NO: 613711 - DNA, 13 bp, D. melanogaster
ctcaaaactcaaa

SEQ ID NO: 613712 - DNA, 13 bp, D. melanogaster
ctcaaaactgaaa

SEQ ID NO: 613713 - DNA, 13 bp, D. melanogaster
ctcaaaagccaaa

SEQ ID NO: 613714 - DNA, 13 bp, D. melanogaster
ctcaaaagcgagc

SEQ ID NO: 613715 - DNA, 13 bp, D. melanogaster
ctcaaaagtatgc

SEQ ID NO: 613716 - DNA, 13 bp, D. melanogaster
ctcaaaatatatt

SEQ ID NO: 613717 - DNA, 13 bp, D. melanogaster
ctcaaaatattaa

SEQ ID NO: 613718 - DNA, 13 bp, D. melanogaster
ctcaaaatgacta

SEQ ID NO: 613719 - DNA, 13 bp, D. melanogaster
ctcaaaatgtaat

SEQ ID NO: 613720 - DNA, 13 bp, D. melanogaster
ctcaaacatatat

SEQ ID NO: 613721 - DNA, 13 bp, D. melanogaster
ctcaaacatttgt

SEQ ID NO: 613722 - DNA, 14 bp, D. melanogaster
ctcaaactactaca

SEQ ID NO: 613723 - DNA, 13 bp, D. melanogaster
ctcaaactcaaac

SEQ ID NO: 613724 - DNA, 13 bp, D. melanogaster
ctcaaactcggct

SEQ ID NO: 613725 - DNA, 13 bp, D. melanogaster
ctcaaagaagctg

SEQ ID NO: 613726 - DNA, 14 bp, D. melanogaster
ctcaaagccaacaa

SEQ ID NO: 613727 - DNA, 13 bp, D. melanogaster
ctcaaagttaaaa

SEQ ID NO: 613728 - DNA, 13 bp, D. melanogaster
ctcaaatacttca

SEQ ID NO: 613729 - DNA, 13 bp, D. melanogaster
ctcaaatatatat

SEQ ID NO: 613730 - DNA, 13 bp, D. melanogaster
ctcaaatgaaaaa

SEQ ID NO: 613731 - DNA, 13 bp, D. melanogaster
ctcaaattcaaat

SEQ ID NO: 613732 - DNA, 13 bp, D. melanogaster
ctcaaattgcaaa

SEQ ID NO: 613733 - DNA, 14 bp, D. melanogaster
ctcaaatttaatgt

SEQ ID NO: 613734 - DNA, 13 bp, D. melanogaster
ctcaaatttaatt

SEQ ID NO: 613735 - DNA, 13 bp, D. melanogaster
ctcaacaatggtt

SEQ ID NO: 613736 - DNA, 13 bp, D. melanogaster
ctcaacacctgct

SEQ ID NO: 613737 - DNA, 13 bp, D. melanogaster
ctcaacatatttt

SEQ ID NO: 613738 - DNA, 13 bp, D. melanogaster
ctcaacatcgaac

SEQ ID NO: 613739 - DNA, 13 bp, D. melanogaster
ctcaaccagcaat

SEQ ID NO: 613740 - DNA, 14 bp, D. melanogaster
ctcaacgacgccat

SEQ ID NO: 613741 - DNA, 13 bp, D. melanogaster
ctcaacgagaaga

SEQ ID NO: 613742 - DNA, 14 bp, D. melanogaster
ctcaacgagatatg

SEQ ID NO: 613743 - DNA, 13 bp, D. melanogaster
ctcaacgaggtat

SEQ ID NO: 613744 - DNA, 13 bp, D. melanogaster
ctcaactcatttg

SEQ ID NO: 613745 - DNA, 13 bp, D. melanogaster
ctcaactcttcgc

SEQ ID NO: 613746 - DNA, 14 bp, D. melanogaster
ctcaactcttcgcc

SEQ ID NO: 613747 - DNA, 13 bp, D. melanogaster
ctcaactgaactc

SEQ ID NO: 613748 - DNA, 13 bp, D. melanogaster
ctcaactgcaatg

SEQ ID NO: 613749 - DNA, 13 bp, D. melanogaster
ctcaacttcaact

SEQ ID NO: 613750 - DNA, 13 bp, D. melanogaster
ctcaacttttgtt

SEQ ID NO: 613751 - DNA, 13 bp, D. melanogaster
ctcaactttttgc

SEQ ID NO: 613752 - DNA, 13 bp, D. melanogaster
ctcaactttttgt

SEQ ID NO: 613753 - DNA, 13 bp, D. melanogaster
ctcaagaatctga

SEQ ID NO: 613754 - DNA, 13 bp, D. melanogaster
ctcaaggaacaac

SEQ ID NO: 613755 - DNA, 13 bp, D. melanogaster
ctcaagtgctttt

SEQ ID NO: 613756 - DNA, 13 bp, D. melanogaster
ctcaagtggaaaa

SEQ ID NO: 613757 - DNA, 13 bp, D. melanogaster
ctcaagtggcagg

SEQ ID NO: 613758 - DNA, 14 bp, D. melanogaster
ctcaataagctgcc

SEQ ID NO: 613759 - DNA, 13 bp, D. melanogaster
ctcaatagcaata

SEQ ID NO: 613760 - DNA, 13 bp, D. melanogaster
ctcaatattatcg

SEQ ID NO: 613761 - DNA, 13 bp, D. melanogaster
ctcaatattattt

SEQ ID NO: 613762 - DNA, 13 bp, D. melanogaster
ctcaatcccaatc

SEQ ID NO: 613763 - DNA, 13 bp, D. melanogaster
ctcaatctcaatc

SEQ ID NO: 613764 - DNA, 14 bp, D. melanogaster
ctcaatctcaatct

SEQ ID NO: 613765 - DNA, 13 bp, D. melanogaster
ctcaatctgaatc

SEQ ID NO: 613766 - DNA, 13 bp, D. melanogaster
ctcaatgtcgatg

SEQ ID NO: 613767 - DNA, 13 bp, D. melanogaster
ctcaattaaaatg

SEQ ID NO: 613768 - DNA, 13 bp, D. melanogaster
ctcaattaaatgt

SEQ ID NO: 613769 - DNA, 13 bp, D. melanogaster
ctcaattaaatta

SEQ ID NO: 613770 - DNA, 13 bp, D. melanogaster
ctcaattcgattc

SEQ ID NO: 613771 - DNA, 13 bp, D. melanogaster
ctcaatttaaagt

SEQ ID NO: 613772 - DNA, 13 bp, D. melanogaster
ctcaatttaagca

SEQ ID NO: 613773 - DNA, 13 bp, D. melanogaster
ctcaatttatatg

SEQ ID NO: 613774 - DNA, 13 bp, D. melanogaster
ctcaatttgcatt

SEQ ID NO: 613775 - DNA, 13 bp, D. melanogaster
ctcaatttgttaa

SEQ ID NO: 613776 - DNA, 13 bp, D. melanogaster
ctcaattttaaat

SEQ ID NO: 613777 - DNA, 13 bp, D. melanogaster
ctcaattttcagc

SEQ ID NO: 613778 - DNA, 13 bp, D. melanogaster
ctcaattttccat

SEQ ID NO: 613779 - DNA, 13 bp, D. melanogaster
ctcacaactcaca

SEQ ID NO: 613780 - DNA, 13 bp, D. melanogaster
ctcacacaagcac

SEQ ID NO: 613781 - DNA, 13 bp, D. melanogaster
ctcacacacacag

SEQ ID NO: 613782 - DNA, 14 bp, D. melanogaster
ctcacacacacaga

SEQ ID NO: 613783 - DNA, 13 bp, D. melanogaster
ctcacacacacat

SEQ ID NO: 613784 - DNA, 14 bp, D. melanogaster
ctcacacacacgcg

SEQ ID NO: 613785 - DNA, 13 bp, D. melanogaster
ctcacacacactc

SEQ ID NO: 613786 - DNA, 14 bp, D. melanogaster
ctcacacacactca

SEQ ID NO: 613787 - DNA, 13 bp, D. melanogaster
ctcacacacatgc

SEQ ID NO: 613788 - DNA, 14 bp, D. melanogaster
ctcacacacgcaca

SEQ ID NO: 613789 - DNA, 14 bp, D. melanogaster
ctcacacagacaca

SEQ ID NO: 613790 - DNA, 13 bp, D. melanogaster
ctcacacagatac

SEQ ID NO: 613791 - DNA, 13 bp, D. melanogaster
ctcacacaggcac

SEQ ID NO: 613792 - DNA, 14 bp, D. melanogaster
ctcacacatacaca

SEQ ID NO: 613793 - DNA, 13 bp, D. melanogaster
ctcacaccaacag

SEQ ID NO: 613794 - DNA, 13 bp, D. melanogaster
ctcacacgcacac

SEQ ID NO: 613795 - DNA, 14 bp, D. melanogaster
ctcacagcaaaaaa

SEQ ID NO: 613796 - DNA, 13 bp, D. melanogaster
ctcacagctcaca

SEQ ID NO: 613797 - DNA, 13 bp, D. melanogaster
ctcacatacacac

SEQ ID NO: 613798 - DNA, 13 bp, D. melanogaster
ctcaccatcatca

SEQ ID NO: 613799 - DNA, 13 bp, D. melanogaster
ctcacccacacag

SEQ ID NO: 613800 - DNA, 13 bp, D. melanogaster
ctcaccgaagtca

SEQ ID NO: 613801 - DNA, 13 bp, D. melanogaster
ctcaccgacaatc

SEQ ID NO: 613802 - DNA, 13 bp, D. melanogaster
ctcaccttcaact

SEQ ID NO: 613803 - DNA, 13 bp, D. melanogaster
ctcaccttgatat

SEQ ID NO: 613804 - DNA, 13 bp, D. melanogaster
ctcacgcacacag

SEQ ID NO: 613805 - DNA, 13 bp, D. melanogaster
ctcacgcacacat

SEQ ID NO: 613806 - DNA, 13 bp, D. melanogaster
ctcacgcacacca

SEQ ID NO: 613807 - DNA, 14 bp, D. melanogaster
ctcactcacacacg

SEQ ID NO: 613808 - DNA, 13 bp, D. melanogaster
ctcactcacactc

SEQ ID NO: 613809 - DNA, 13 bp, D. melanogaster
ctcactcacttac

SEQ ID NO: 613810 - DNA, 13 bp, D. melanogaster
ctcactcactttc

SEQ ID NO: 613811 - DNA, 13 bp, D. melanogaster
ctcactcgctctc

SEQ ID NO: 613812 - DNA, 13 bp, D. melanogaster
ctcactgaagaac

SEQ ID NO: 613813 - DNA, 13 bp, D. melanogaster
ctcacttggcgca

SEQ ID NO: 613814 - DNA, 13 bp, D. melanogaster
ctcagaaaaataa

SEQ ID NO: 613815 - DNA, 13 bp, D. melanogaster
ctcagaaaatcaa

SEQ ID NO: 613816 - DNA, 14 bp, D. melanogaster
ctcagaaaatcaaa

SEQ ID NO: 613817 - DNA, 13 bp, D. melanogaster
ctcagactcagac

SEQ ID NO: 613818 - DNA, 13 bp, D. melanogaster
ctcagagaaaaaa

SEQ ID NO: 613819 - DNA, 13 bp, D. melanogaster
ctcagagaaaccc

SEQ ID NO: 613820 - DNA, 13 bp, D. melanogaster
ctcagagattgga

SEQ ID NO: 613821 - DNA, 13 bp, D. melanogaster
ctcagatactcag

SEQ ID NO: 613822 - DNA, 13 bp, D. melanogaster
ctcagattaaaga

SEQ ID NO: 613823 - DNA, 13 bp, D. melanogaster
ctcagcaaaaaaa

SEQ ID NO: 613824 - DNA, 14 bp, D. melanogaster
ctcagcaaataatg

SEQ ID NO: 613825 - DNA, 13 bp, D. melanogaster
ctcagcaatatat

SEQ ID NO: 613826 - DNA, 13 bp, D. melanogaster
ctcagcagcagca

SEQ ID NO: 613827 - DNA, 13 bp, D. melanogaster
ctcagcccattgc

SEQ ID NO: 613828 - DNA, 13 bp, D. melanogaster
ctcagcgggagcg

SEQ ID NO: 613829 - DNA, 13 bp, D. melanogaster
ctcagctcaactc

SEQ ID NO: 613830 - DNA, 13 bp, D. melanogaster
ctcagctcagctc

SEQ ID NO: 613831 - DNA, 13 bp, D. melanogaster
ctcagctcggctc

SEQ ID NO: 613832 - DNA, 13 bp, D. melanogaster
ctcagctctcagc

SEQ ID NO: 613833 - DNA, 13 bp, D. melanogaster
ctcagctgctgct

SEQ ID NO: 613834 - DNA, 13 bp, D. melanogaster
ctcagcttaacca

SEQ ID NO: 613835 - DNA, 13 bp, D. melanogaster
ctcaggcaacgaa

SEQ ID NO: 613836 - DNA, 13 bp, D. melanogaster
ctcaggctatcaa

SEQ ID NO: 613837 - DNA, 13 bp, D. melanogaster
ctcagtaaaatta

SEQ ID NO: 613838 - DNA, 13 bp, D. melanogaster
ctcagtcagtcag

SEQ ID NO: 613839 - DNA, 13 bp, D. melanogaster
ctcagtctcagtc

SEQ ID NO: 613840 - DNA, 13 bp, D. melanogaster
ctcagtctcagtt

SEQ ID NO: 613841 - DNA, 13 bp, D. melanogaster
ctcagtgtgtgtg

SEQ ID NO: 613842 - DNA, 13 bp, D. melanogaster
ctcagttcagttc

SEQ ID NO: 613843 - DNA, 14 bp, D. melanogaster
ctcagtttacatcg

SEQ ID NO: 613844 - DNA, 13 bp, D. melanogaster
ctcagtttcagtt

SEQ ID NO: 613845 - DNA, 13 bp, D. melanogaster
ctcagtttctcag

SEQ ID NO: 613846 - DNA, 13 bp, D. melanogaster
ctcagttttcagt

SEQ ID NO: 613847 - DNA, 13 bp, D. melanogaster
ctcataaatagag

SEQ ID NO: 613848 - DNA, 13 bp, D. melanogaster
ctcataaatatat

SEQ ID NO: 613849 - DNA, 13 bp, D. melanogaster
ctcataatttatt

SEQ ID NO: 613850 - DNA, 13 bp, D. melanogaster
ctcatacgcaacg

SEQ ID NO: 613851 - DNA, 13 bp, D. melanogaster
ctcatacgcagcg

SEQ ID NO: 613852 - DNA, 13 bp, D. melanogaster
ctcatacgccccg

SEQ ID NO: 613853 - DNA, 14 bp, D. melanogaster
ctcatacgccccgt

SEQ ID NO: 613854 - DNA, 13 bp, D. melanogaster
ctcatacgccgtg

SEQ ID NO: 613855 - DNA, 13 bp, D. melanogaster
ctcatactgaaat

SEQ ID NO: 613856 - DNA, 13 bp, D. melanogaster
ctcatagttttat

SEQ ID NO: 613857 - DNA, 13 bp, D. melanogaster
ctcatatgtacat

SEQ ID NO: 613858 - DNA, 13 bp, D. melanogaster
ctcatatgtgatt

SEQ ID NO: 613859 - DNA, 13 bp, D. melanogaster
ctcatatttatat

SEQ ID NO: 613860 - DNA, 13 bp, D. melanogaster
ctcatatttttcc

SEQ ID NO: 613861 - DNA, 13 bp, D. melanogaster
ctcatcaactgaa

SEQ ID NO: 613862 - DNA, 13 bp, D. melanogaster
ctcatcaccacca

SEQ ID NO: 613863 - DNA, 14 bp, D. melanogaster
ctcatcatcatcag

SEQ ID NO: 613864 - DNA, 13 bp, D. melanogaster
ctcatcatcgcca

SEQ ID NO: 613865 - DNA, 14 bp, D. melanogaster
ctcatcatcgtcat

SEQ ID NO: 613866 - DNA, 13 bp, D. melanogaster
ctcatccacatcc

SEQ ID NO: 613867 - DNA, 14 bp, D. melanogaster
ctcatccacatcca

SEQ ID NO: 613868 - DNA, 13 bp, D. melanogaster
ctcatccgcatcc

SEQ ID NO: 613869 - DNA, 13 bp, D. melanogaster
ctcatccgcctct

SEQ ID NO: 613870 - DNA, 13 bp, D. melanogaster
ctcatcctcatcc

SEQ ID NO: 613871 - DNA, 13 bp, D. melanogaster
ctcatcctcattc

SEQ ID NO: 613872 - DNA, 13 bp, D. melanogaster
ctcatcctcgtcc

SEQ ID NO: 613873 - DNA, 14 bp, D. melanogaster
ctcatcctcgtcct

SEQ ID NO: 613874 - DNA, 13 bp, D. melanogaster
ctcatcgccttcg

SEQ ID NO: 613875 - DNA, 13 bp, D. melanogaster
ctcatctacttaa

SEQ ID NO: 613876 - DNA, 13 bp, D. melanogaster
ctcatctcatctc

SEQ ID NO: 613877 - DNA, 13 bp, D. melanogaster
ctcatctcatttg

SEQ ID NO: 613878 - DNA, 13 bp, D. melanogaster
ctcatctttggct

SEQ ID NO: 613879 - DNA, 13 bp, D. melanogaster
ctcatgcccatcc

SEQ ID NO: 613880 - DNA, 13 bp, D. melanogaster
ctcatgtctttgc

SEQ ID NO: 613881 - DNA, 13 bp, D. melanogaster
ctcattaaaataa

SEQ ID NO: 613882 - DNA, 13 bp, D. melanogaster
ctcattaaaattt

SEQ ID NO: 613883 - DNA, 13 bp, D. melanogaster
ctcattaaacatt

SEQ ID NO: 613884 - DNA, 13 bp, D. melanogaster
ctcattaagtgca

SEQ ID NO: 613885 - DNA, 14 bp, D. melanogaster
ctcattaatctttt

SEQ ID NO: 613886 - DNA, 13 bp, D. melanogaster
ctcattagcattt

SEQ ID NO: 613887 - DNA, 13 bp, D. melanogaster
ctcattattatta

SEQ ID NO: 613888 - DNA, 13 bp, D. melanogaster
ctcattcattcat

SEQ ID NO: 613889 - DNA, 13 bp, D. melanogaster
ctcattcccattc

SEQ ID NO: 613890 - DNA, 13 bp, D. melanogaster
ctcattccgaaca

SEQ ID NO: 613891 - DNA, 13 bp, D. melanogaster
ctcattcgcattc

SEQ ID NO: 613892 - DNA, 13 bp, D. melanogaster
ctcattctcatcc

SEQ ID NO: 613893 - DNA, 13 bp, D. melanogaster
ctcattctcattc

SEQ ID NO: 613894 - DNA, 13 bp, D. melanogaster
ctcattctcattt

SEQ ID NO: 613895 - DNA, 13 bp, D. melanogaster
ctcattgaaatgc

SEQ ID NO: 613896 - DNA, 13 bp, D. melanogaster
ctcattgttgctg

SEQ ID NO: 613897 - DNA, 14 bp, D. melanogaster
ctcattgttgttgt

SEQ ID NO: 613898 - DNA, 13 bp, D. melanogaster
ctcattgtttttc

SEQ ID NO: 613899 - DNA, 13 bp, D. melanogaster
ctcatttatatat

SEQ ID NO: 613900 - DNA, 13 bp, D. melanogaster
ctcatttatgttt

SEQ ID NO: 613901 - DNA, 13 bp, D. melanogaster
ctcatttatttgt

SEQ ID NO: 613902 - DNA, 13 bp, D. melanogaster
ctcatttcgattt

SEQ ID NO: 613903 - DNA, 14 bp, D. melanogaster
ctcatttgcagcac

SEQ ID NO: 613904 - DNA, 14 bp, D. melanogaster
ctcatttgcatgca

SEQ ID NO: 613905 - DNA, 13 bp, D. melanogaster
ctcatttggcatt

SEQ ID NO: 613906 - DNA, 13 bp, D. melanogaster
ctcatttggccaa

SEQ ID NO: 613907 - DNA, 13 bp, D. melanogaster
ctcatttggcttt

SEQ ID NO: 613908 - DNA, 13 bp, D. melanogaster
ctcatttggttca

SEQ ID NO: 613909 - DNA, 13 bp, D. melanogaster
ctcattttaaaat

SEQ ID NO: 613910 - DNA, 13 bp, D. melanogaster
ctcattttattcc

SEQ ID NO: 613911 - DNA, 13 bp, D. melanogaster
ctcattttcagtt

SEQ ID NO: 613912 - DNA, 13 bp, D. melanogaster
ctcattttccact

SEQ ID NO: 613913 - DNA, 13 bp, D. melanogaster
ctcattttgcatt

SEQ ID NO: 613914 - DNA, 14 bp, D. melanogaster
ctcattttgcattt

SEQ ID NO: 613915 - DNA, 13 bp, D. melanogaster
ctccaaaaacaag

SEQ ID NO: 613916 - DNA, 13 bp, D. melanogaster
ctccaaaagaaaa

SEQ ID NO: 613917 - DNA, 13 bp, D. melanogaster
ctccaacaagttc

SEQ ID NO: 613918 - DNA, 13 bp, D. melanogaster
ctccaacccagaa

SEQ ID NO: 613919 - DNA, 13 bp, D. melanogaster
ctccaactccaac

SEQ ID NO: 613920 - DNA, 13 bp, D. melanogaster
ctccaactgtctg

SEQ ID NO: 613921 - DNA, 13 bp, D. melanogaster
ctccaagaagaag

SEQ ID NO: 613922 - DNA, 13 bp, D. melanogaster
ctccaagaatgct

SEQ ID NO: 613923 - DNA, 13 bp, D. melanogaster
ctccaagaggtta

SEQ ID NO: 613924 - DNA, 13 bp, D. melanogaster
ctccaagctccaa

SEQ ID NO: 613925 - DNA, 14 bp, D. melanogaster
ctccaatccaatcc

SEQ ID NO: 613926 - DNA, 13 bp, D. melanogaster
ctccaatgacgat

SEQ ID NO: 613927 - DNA, 13 bp, D. melanogaster
ctccaatgctcca

SEQ ID NO: 613928 - DNA, 13 bp, D. melanogaster
ctccaattaaatt

SEQ ID NO: 613929 - DNA, 13 bp, D. melanogaster
ctccaattaagaa

SEQ ID NO: 613930 - DNA, 13 bp, D. melanogaster
ctccacaacgttc

SEQ ID NO: 613931 - DNA, 13 bp, D. melanogaster
ctccacagctcca

SEQ ID NO: 613932 - DNA, 13 bp, D. melanogaster
ctccacatccaca

SEQ ID NO: 613933 - DNA, 14 bp, D. melanogaster
ctccacatccacat

SEQ ID NO: 613934 - DNA, 13 bp, D. melanogaster
ctccaccaatttt

SEQ ID NO: 613935 - DNA, 13 bp, D. melanogaster
ctccacctatcca

SEQ ID NO: 613936 - DNA, 13 bp, D. melanogaster
ctccacgactcca

SEQ ID NO: 613937 - DNA, 13 bp, D. melanogaster
ctccacggacatt

SEQ ID NO: 613938 - DNA, 13 bp, D. melanogaster
ctccacggccaac

SEQ ID NO: 613939 - DNA, 13 bp, D. melanogaster
ctccacggggaat

SEQ ID NO: 613940 - DNA, 14 bp, D. melanogaster
ctccactccactca

SEQ ID NO: 613941 - DNA, 14 bp, D. melanogaster
ctccactccactcg

SEQ ID NO: 613942 - DNA, 13 bp, D. melanogaster
ctccactccgctc

SEQ ID NO: 613943 - DNA, 13 bp, D. melanogaster
ctccactgctcca

SEQ ID NO: 613944 - DNA, 13 bp, D. melanogaster
ctccactgctgcc

SEQ ID NO: 613945 - DNA, 13 bp, D. melanogaster
ctccacttcactc

SEQ ID NO: 613946 - DNA, 13 bp, D. melanogaster
ctccacttcactt

SEQ ID NO: 613947 - DNA, 13 bp, D. melanogaster
ctccacttccact

SEQ ID NO: 613948 - DNA, 13 bp, D. melanogaster
ctccacttccatt

SEQ ID NO: 613949 - DNA, 13 bp, D. melanogaster
ctccactttccac

SEQ ID NO: 613950 - DNA, 13 bp, D. melanogaster
ctccagaaactcc

SEQ ID NO: 613951 - DNA, 13 bp, D. melanogaster
ctccagaagtttg

SEQ ID NO: 613952 - DNA, 13 bp, D. melanogaster
ctccagactggtg

SEQ ID NO: 613953 - DNA, 13 bp, D. melanogaster
ctccagatgctgc

SEQ ID NO: 613954 - DNA, 13 bp, D. melanogaster
ctccagctccacc

SEQ ID NO: 613955 - DNA, 14 bp, D. melanogaster
ctccagctccagct

SEQ ID NO: 613956 - DNA, 13 bp, D. melanogaster
ctccagctccatc

SEQ ID NO: 613957 - DNA, 13 bp, D. melanogaster
ctccagctcctcc

SEQ ID NO: 613958 - DNA, 14 bp, D. melanogaster
ctccagctcctcct

SEQ ID NO: 613959 - DNA, 14 bp, D. melanogaster
ctccagctgcaatt

SEQ ID NO: 613960 - DNA, 13 bp, D. melanogaster
ctccagctgcagc

SEQ ID NO: 613961 - DNA, 13 bp, D. melanogaster
ctccagctgctcc

SEQ ID NO: 613962 - DNA, 13 bp, D. melanogaster
ctccagcttaatg

SEQ ID NO: 613963 - DNA, 14 bp, D. melanogaster
ctccagcttcagct

SEQ ID NO: 613964 - DNA, 13 bp, D. melanogaster
ctccagcttccca

SEQ ID NO: 613965 - DNA, 13 bp, D. melanogaster
ctccagcttcgat

SEQ ID NO: 613966 - DNA, 13 bp, D. melanogaster
ctccaggagcttt

SEQ ID NO: 613967 - DNA, 14 bp, D. melanogaster
ctccagtcggcaag

SEQ ID NO: 613968 - DNA, 13 bp, D. melanogaster
ctccagtgataat

SEQ ID NO: 613969 - DNA, 13 bp, D. melanogaster
ctccatatatata

SEQ ID NO: 613970 - DNA, 13 bp, D. melanogaster
ctccatcaccatc

SEQ ID NO: 613971 - DNA, 14 bp, D. melanogaster
ctccatcatcatca

SEQ ID NO: 613972 - DNA, 13 bp, D. melanogaster
ctccatcgccatc

SEQ ID NO: 613973 - DNA, 13 bp, D. melanogaster
ctccatctccatc

SEQ ID NO: 613974 - DNA, 14 bp, D. melanogaster
ctccatctccatct

SEQ ID NO: 613975 - DNA, 13 bp, D. melanogaster
ctccatctccatg

SEQ ID NO: 613976 - DNA, 13 bp, D. melanogaster
ctccatctccgtc

SEQ ID NO: 613977 - DNA, 13 bp, D. melanogaster
ctccatcttcatc

SEQ ID NO: 613978 - DNA, 13 bp, D. melanogaster
ctccattattatt

SEQ ID NO: 613979 - DNA, 13 bp, D. melanogaster
ctccattccattc

SEQ ID NO: 613980 - DNA, 13 bp, D. melanogaster
ctccattctccat

SEQ ID NO: 613981 - DNA, 14 bp, D. melanogaster
ctccattctccatt

SEQ ID NO: 613982 - DNA, 13 bp, D. melanogaster
ctccatttaaaca

SEQ ID NO: 613983 - DNA, 13 bp, D. melanogaster
ctccatttcattt

SEQ ID NO: 613984 - DNA, 13 bp, D. melanogaster
ctccatttcccac

SEQ ID NO: 613985 - DNA, 13 bp, D. melanogaster
ctccatttggcca

SEQ ID NO: 613986 - DNA, 13 bp, D. melanogaster
ctccattttgcag

SEQ ID NO: 613987 - DNA, 14 bp, D. melanogaster
ctccattttgcaga

SEQ ID NO: 613988 - DNA, 13 bp, D. melanogaster
ctccattttggcc

SEQ ID NO: 613989 - DNA, 14 bp, D. melanogaster
ctcccaaaataaat

SEQ ID NO: 613990 - DNA, 13 bp, D. melanogaster
ctcccagatgaca

SEQ ID NO: 613991 - DNA, 13 bp, D. melanogaster
ctcccatttccat

SEQ ID NO: 613992 - DNA, 13 bp, D. melanogaster
ctcccgggggaaa

SEQ ID NO: 613993 - DNA, 13 bp, D. melanogaster
ctccctcttttgg

SEQ ID NO: 613994 - DNA, 13 bp, D. melanogaster
ctccctggcctac

SEQ ID NO: 613995 - DNA, 13 bp, D. melanogaster
ctccctttcgcac

SEQ ID NO: 613996 - DNA, 14 bp, D. melanogaster
ctccgaaaactagt

SEQ ID NO: 613997 - DNA, 13 bp, D. melanogaster
ctccgaaagactc

SEQ ID NO: 613998 - DNA, 13 bp, D. melanogaster
ctccgaagtgagg

SEQ ID NO: 613999 - DNA, 13 bp, D. melanogaster
ctccgactccgac

SEQ ID NO: 614000 - DNA, 13 bp, D. melanogaster
ctccgattccgat

SEQ ID NO: 614001 - DNA, 13 bp, D. melanogaster
ctccgcctgctgc

SEQ ID NO: 614002 - DNA, 13 bp, D. melanogaster
ctccgctctgctc

SEQ ID NO: 614003 - DNA, 13 bp, D. melanogaster
ctccgctgccatc

SEQ ID NO: 614004 - DNA, 13 bp, D. melanogaster
ctccgctgctctc

SEQ ID NO: 614005 - DNA, 13 bp, D. melanogaster
ctccgcttcttcg

SEQ ID NO: 614006 - DNA, 13 bp, D. melanogaster
ctccggtggctgg

SEQ ID NO: 614007 - DNA, 13 bp, D. melanogaster
ctccggttccgtc

SEQ ID NO: 614008 - DNA, 13 bp, D. melanogaster
ctccgtgctccgt

SEQ ID NO: 614009 - DNA, 13 bp, D. melanogaster
ctccgtgtgtgtg

SEQ ID NO: 614010 - DNA, 14 bp, D. melanogaster
ctccgtgtgtgtgt

SEQ ID NO: 614011 - DNA, 13 bp, D. melanogaster
ctccgttttcgtc

SEQ ID NO: 614012 - DNA, 14 bp, D. melanogaster
ctcctcaatccaat

SEQ ID NO: 614013 - DNA, 13 bp, D. melanogaster
ctcctcatttgca

SEQ ID NO: 614014 - DNA, 13 bp, D. melanogaster
ctcctccaaaaaa

SEQ ID NO: 614015 - DNA, 14 bp, D. melanogaster
ctcctccaaaaaaa

SEQ ID NO: 614016 - DNA, 14 bp, D. melanogaster
ctcctccagctcct

SEQ ID NO: 614017 - DNA, 13 bp, D. melanogaster
ctcctccgcctta

SEQ ID NO: 614018 - DNA, 13 bp, D. melanogaster
ctcctcctcgatt

SEQ ID NO: 614019 - DNA, 14 bp, D. melanogaster
ctcctcctcgattc

SEQ ID NO: 614020 - DNA, 13 bp, D. melanogaster
ctcctcgtcctgc

SEQ ID NO: 614021 - DNA, 13 bp, D. melanogaster
ctcctctcgcagc

SEQ ID NO: 614022 - DNA, 14 bp, D. melanogaster
ctcctctcgcagcg

SEQ ID NO: 614023 - DNA, 13 bp, D. melanogaster
ctcctgaagctgg

SEQ ID NO: 614024 - DNA, 13 bp, D. melanogaster
ctcctgcactttg

SEQ ID NO: 614025 - DNA, 13 bp, D. melanogaster
ctcctgcagcaat

SEQ ID NO: 614026 - DNA, 13 bp, D. melanogaster
ctcctgccaccca

SEQ ID NO: 614027 - DNA, 13 bp, D. melanogaster
ctcctgccacgcc

SEQ ID NO: 614028 - DNA, 13 bp, D. melanogaster
ctcctgcctcctg

SEQ ID NO: 614029 - DNA, 13 bp, D. melanogaster
ctcctgcgaatgc

SEQ ID NO: 614030 - DNA, 13 bp, D. melanogaster
ctcctgctcctac

SEQ ID NO: 614031 - DNA, 14 bp, D. melanogaster
ctcctgctcctgct

SEQ ID NO: 614032 - DNA, 13 bp, D. melanogaster
ctcctgctcctgt

SEQ ID NO: 614033 - DNA, 13 bp, D. melanogaster
ctcctgctgatgc

SEQ ID NO: 614034 - DNA, 14 bp, D. melanogaster
ctcctgctgctgtt

SEQ ID NO: 614035 - DNA, 13 bp, D. melanogaster
ctcctgctgcttt

SEQ ID NO: 614036 - DNA, 13 bp, D. melanogaster
ctcctgctgttgc

SEQ ID NO: 614037 - DNA, 13 bp, D. melanogaster
ctcctggctcaac

SEQ ID NO: 614038 - DNA, 13 bp, D. melanogaster
ctcctggctcctg

SEQ ID NO: 614039 - DNA, 14 bp, D. melanogaster
ctcctggctcctgg

SEQ ID NO: 614040 - DNA, 13 bp, D. melanogaster
ctcctggctgggt

SEQ ID NO: 614041 - DNA, 13 bp, D. melanogaster
ctccttgaatgga

SEQ ID NO: 614042 - DNA, 14 bp, D. melanogaster
ctcctttcgaattt

SEQ ID NO: 614043 - DNA, 13 bp, D. melanogaster
ctcctttgaacat

SEQ ID NO: 614044 - DNA, 13 bp, D. melanogaster
ctcctttggctcc

SEQ ID NO: 614045 - DNA, 14 bp, D. melanogaster
ctcctttgtctgtg

SEQ ID NO: 614046 - DNA, 13 bp, D. melanogaster
ctccttttaaaaa

SEQ ID NO: 614047 - DNA, 13 bp, D. melanogaster
ctccttttggccc

SEQ ID NO: 614048 - DNA, 13 bp, D. melanogaster
ctcctttttggcc

SEQ ID NO: 614049 - DNA, 13 bp, D. melanogaster
ctcgaaaaaaaag

SEQ ID NO: 614050 - DNA, 13 bp, D. melanogaster
ctcgaaaaaaaat

SEQ ID NO: 614051 - DNA, 13 bp, D. melanogaster
ctcgaaaaatatt

SEQ ID NO: 614052 - DNA, 13 bp, D. melanogaster
ctcgaaacttttg

SEQ ID NO: 614053 - DNA, 13 bp, D. melanogaster
ctcgaaagcagct

SEQ ID NO: 614054 - DNA, 13 bp, D. melanogaster
ctcgaaatcaaga

SEQ ID NO: 614055 - DNA, 13 bp, D. melanogaster
ctcgaaatcattt

SEQ ID NO: 614056 - DNA, 13 bp, D. melanogaster
ctcgaaatggaaa

SEQ ID NO: 614057 - DNA, 13 bp, D. melanogaster
ctcgaaattggcc

SEQ ID NO: 614058 - DNA, 13 bp, D. melanogaster
ctcgaaattttaa

SEQ ID NO: 614059 - DNA, 13 bp, D. melanogaster
ctcgaagaaagca

SEQ ID NO: 614060 - DNA, 13 bp, D. melanogaster
ctcgaaggcaaaa

SEQ ID NO: 614061 - DNA, 13 bp, D. melanogaster
ctcgaatgccatt

SEQ ID NO: 614062 - DNA, 13 bp, D. melanogaster
ctcgaatttttgt

SEQ ID NO: 614063 - DNA, 13 bp, D. melanogaster
ctcgacaaaaaaa

SEQ ID NO: 614064 - DNA, 13 bp, D. melanogaster
ctcgacattaaaa

SEQ ID NO: 614065 - DNA, 13 bp, D. melanogaster
ctcgaccaagttg

SEQ ID NO: 614066 - DNA, 13 bp, D. melanogaster
ctcgactcgactg

SEQ ID NO: 614067 - DNA, 13 bp, D. melanogaster
ctcgactcgactt

SEQ ID NO: 614068 - DNA, 14 bp, D. melanogaster
ctcgactcgacttg

SEQ ID NO: 614069 - DNA, 13 bp, D. melanogaster
ctcgacttgacca

SEQ ID NO: 614070 - DNA, 14 bp, D. melanogaster
ctcgacttgaccat

SEQ ID NO: 614071 - DNA, 13 bp, D. melanogaster
ctcgacttggcca

SEQ ID NO: 614072 - DNA, 13 bp, D. melanogaster
ctcgagaacctca

SEQ ID NO: 614073 - DNA, 14 bp, D. melanogaster
ctcgagcaagaaaa

SEQ ID NO: 614074 - DNA, 13 bp, D. melanogaster
ctcgagctgctta

SEQ ID NO: 614075 - DNA, 13 bp, D. melanogaster
ctcgaggacagac

SEQ ID NO: 614076 - DNA, 14 bp, D. melanogaster
ctcgagtactttgc

SEQ ID NO: 614077 - DNA, 14 bp, D. melanogaster
ctcgagtgtgtgtg

SEQ ID NO: 614078 - DNA, 13 bp, D. melanogaster
ctcgatcattttc

SEQ ID NO: 614079 - DNA, 13 bp, D. melanogaster
ctcgatgttcaaa

SEQ ID NO: 614080 - DNA, 13 bp, D. melanogaster
ctcgattcgcgag

SEQ ID NO: 614081 - DNA, 13 bp, D. melanogaster
ctcgattctcgat

SEQ ID NO: 614082 - DNA, 13 bp, D. melanogaster
ctcgattgaccaa

SEQ ID NO: 614083 - DNA, 13 bp, D. melanogaster
ctcgattgcaatt

SEQ ID NO: 614084 - DNA, 13 bp, D. melanogaster
ctcgattttccca

SEQ ID NO: 614085 - DNA, 13 bp, D. melanogaster
ctcgattttccct

SEQ ID NO: 614086 - DNA, 14 bp, D. melanogaster
ctcgcaatctgcat

SEQ ID NO: 614087 - DNA, 13 bp, D. melanogaster
ctcgcacacaaat

SEQ ID NO: 614088 - DNA, 14 bp, D. melanogaster
ctcgcacacacaca

SEQ ID NO: 614089 - DNA, 13 bp, D. melanogaster
ctcgcacacacat

SEQ ID NO: 614090 - DNA, 14 bp, D. melanogaster
ctcgcacacacgca

SEQ ID NO: 614091 - DNA, 13 bp, D. melanogaster
ctcgcacactcgc

SEQ ID NO: 614092 - DNA, 13 bp, D. melanogaster
ctcgcactcacac

SEQ ID NO: 614093 - DNA, 14 bp, D. melanogaster
ctcgcactcacact

SEQ ID NO: 614094 - DNA, 13 bp, D. melanogaster
ctcgcactcgcac

SEQ ID NO: 614095 - DNA, 13 bp, D. melanogaster
ctcgcagcaggca

SEQ ID NO: 614096 - DNA, 13 bp, D. melanogaster
ctcgcaggatgcc

SEQ ID NO: 614097 - DNA, 13 bp, D. melanogaster
ctcgcagtgcacg

SEQ ID NO: 614098 - DNA, 13 bp, D. melanogaster
ctcgcagtgcagc

SEQ ID NO: 614099 - DNA, 13 bp, D. melanogaster
ctcgcagtgcatt

SEQ ID NO: 614100 - DNA, 14 bp, D. melanogaster
ctcgcattcgcatt

SEQ ID NO: 614101 - DNA, 13 bp, D. melanogaster
ctcgcattgttgt

SEQ ID NO: 614102 - DNA, 13 bp, D. melanogaster
ctcgcatttccat

SEQ ID NO: 614103 - DNA, 13 bp, D. melanogaster
ctcgccaaaaaaa

SEQ ID NO: 614104 - DNA, 13 bp, D. melanogaster
ctcgccaacgaag

SEQ ID NO: 614105 - DNA, 13 bp, D. melanogaster
ctcgccactctgc

SEQ ID NO: 614106 - DNA, 14 bp, D. melanogaster
ctcgccactctgca

SEQ ID NO: 614107 - DNA, 50 bp, D. melanogaster
ctcgccactctgcagagagcgcggcagtcagtcgctgttgaaccaagcta

SEQ ID NO: 614108 - DNA, 13 bp, D. melanogaster
ctcgccatcaaac

SEQ ID NO: 614109 - DNA, 14 bp, D. melanogaster
ctcgccatcaaacg

SEQ ID NO: 614110 - DNA, 15 bp, D. melanogaster
ctcgcccaccaagga

SEQ ID NO: 614111 - DNA, 13 bp, D. melanogaster
ctcgccgatttcc

SEQ ID NO: 614112 - DNA, 13 bp, D. melanogaster
ctcgccgcgaatg

SEQ ID NO: 614113 - DNA, 13 bp, D. melanogaster
ctcgcgctctctt

SEQ ID NO: 614114 - DNA, 13 bp, D. melanogaster
ctcgctcacacac

SEQ ID NO: 614115 - DNA, 13 bp, D. melanogaster
ctcgctcactcgc

SEQ ID NO: 614116 - DNA, 13 bp, D. melanogaster
ctcgctcgcacac

SEQ ID NO: 614117 - DNA, 14 bp, D. melanogaster
ctcgctcgcacaca

SEQ ID NO: 614118 - DNA, 13 bp, D. melanogaster
ctcgctcgcaccc

SEQ ID NO: 614119 - DNA, 13 bp, D. melanogaster
ctcgctcgctcgc

SEQ ID NO: 614120 - DNA, 14 bp, D. melanogaster
ctcgctcgctcgct

SEQ ID NO: 614121 - DNA, 14 bp, D. melanogaster
ctcgctcgctctct

SEQ ID NO: 614122 - DNA, 13 bp, D. melanogaster
ctcgctctcgctc

SEQ ID NO: 614123 - DNA, 13 bp, D. melanogaster
ctcgctctctttg

SEQ ID NO: 614124 - DNA, 13 bp, D. melanogaster
ctcgctctttcgc

SEQ ID NO: 614125 - DNA, 13 bp, D. melanogaster
ctcgctgaataat

SEQ ID NO: 614126 - DNA, 13 bp, D. melanogaster
ctcgctgcacttg

SEQ ID NO: 614127 - DNA, 13 bp, D. melanogaster
ctcgctgcagtcc

SEQ ID NO: 614128 - DNA, 13 bp, D. melanogaster
ctcgctgccgcat

SEQ ID NO: 614129 - DNA, 13 bp, D. melanogaster
ctcgctggctggc

SEQ ID NO: 614130 - DNA, 13 bp, D. melanogaster
ctcgctggctttt

SEQ ID NO: 614131 - DNA, 13 bp, D. melanogaster
ctcgcttttggcc

SEQ ID NO: 614132 - DNA, 13 bp, D. melanogaster
ctcggaaaaagag

SEQ ID NO: 614133 - DNA, 13 bp, D. melanogaster
ctcggaaaaatat

SEQ ID NO: 614134 - DNA, 13 bp, D. melanogaster
ctcggaatcggaa

SEQ ID NO: 614135 - DNA, 13 bp, D. melanogaster
ctcggatcggatc

SEQ ID NO: 614136 - DNA, 13 bp, D. melanogaster
ctcggattcggat

SEQ ID NO: 614137 - DNA, 14 bp, D. melanogaster
ctcggattcggatt

SEQ ID NO: 614138 - DNA, 13 bp, D. melanogaster
ctcggcactcggc

SEQ ID NO: 614139 - DNA, 13 bp, D. melanogaster
ctcggccagaagc

SEQ ID NO: 614140 - DNA, 13 bp, D. melanogaster
ctcgggaaaccaa

SEQ ID NO: 614141 - DNA, 13 bp, D. melanogaster
ctcgggcagcaga

SEQ ID NO: 614142 - DNA, 13 bp, D. melanogaster
ctcggtgctcttt

SEQ ID NO: 614143 - DNA, 13 bp, D. melanogaster
ctcggttttattt

SEQ ID NO: 614144 - DNA, 14 bp, D. melanogaster
ctcgtaaagtaaaa

SEQ ID NO: 614145 - DNA, 14 bp, D. melanogaster
ctcgtaataaaatt

SEQ ID NO: 614146 - DNA, 13 bp, D. melanogaster
ctcgtatgaaaat

SEQ ID NO: 614147 - DNA, 13 bp, D. melanogaster
ctcgtatttaaat

SEQ ID NO: 614148 - DNA, 13 bp, D. melanogaster
ctcgtcaaatgaa

SEQ ID NO: 614149 - DNA, 13 bp, D. melanogaster
ctcgtcatcatca

SEQ ID NO: 614150 - DNA, 13 bp, D. melanogaster
ctcgtcatttgtt

SEQ ID NO: 614151 - DNA, 13 bp, D. melanogaster
ctcgtcctcgtcc

SEQ ID NO: 614152 - DNA, 14 bp, D. melanogaster
ctcgtcctcgtcct

SEQ ID NO: 614153 - DNA, 13 bp, D. melanogaster
ctcgtcctgctgc

SEQ ID NO: 614154 - DNA, 13 bp, D. melanogaster
ctcgtccttcgtc

SEQ ID NO: 614155 - DNA, 14 bp, D. melanogaster
ctcgtctcgtctcg

SEQ ID NO: 614156 - DNA, 13 bp, D. melanogaster
ctcgtggatgtgg

SEQ ID NO: 614157 - DNA, 13 bp, D. melanogaster
ctcgtgttgttgt

SEQ ID NO: 614158 - DNA, 13 bp, D. melanogaster
ctcgtgttttcgg

SEQ ID NO: 614159 - DNA, 13 bp, D. melanogaster
ctcgttaagtggc

SEQ ID NO: 614160 - DNA, 13 bp, D. melanogaster
ctcgttattgcag

SEQ ID NO: 614161 - DNA, 13 bp, D. melanogaster
ctcgttctcgtcc

SEQ ID NO: 614162 - DNA, 13 bp, D. melanogaster
ctcgttgagctcg

SEQ ID NO: 614163 - DNA, 14 bp, D. melanogaster
ctcgttgagctcgt

SEQ ID NO: 614164 - DNA, 13 bp, D. melanogaster
ctcgttgagttcg

SEQ ID NO: 614165 - DNA, 13 bp, D. melanogaster
ctcgttgagtttg

SEQ ID NO: 614166 - DNA, 14 bp, D. melanogaster
ctcgttgagtttgt

SEQ ID NO: 614167 - DNA, 14 bp, D. melanogaster
ctcgttgttgttgc

SEQ ID NO: 614168 - DNA, 13 bp, D. melanogaster
ctcgttttccatt

SEQ ID NO: 614169 - DNA, 13 bp, D. melanogaster
ctcgttttgattt

SEQ ID NO: 614170 - DNA, 13 bp, D. melanogaster
ctcgtttttatgg

SEQ ID NO: 614171 - DNA, 13 bp, D. melanogaster
ctcgttttttcta

SEQ ID NO: 614172 - DNA, 13 bp, D. melanogaster
ctctaaaatatga

SEQ ID NO: 614173 - DNA, 15 bp, D. melanogaster
ctctaaaatgcgttg

SEQ ID NO: 614174 - DNA, 13 bp, D. melanogaster
ctctaaagagctt

SEQ ID NO: 614175 - DNA, 13 bp, D. melanogaster
ctctaaagtacat

SEQ ID NO: 614176 - DNA, 13 bp, D. melanogaster
ctctaaatatgag

SEQ ID NO: 614177 - DNA, 13 bp, D. melanogaster
ctctaaatatttt

SEQ ID NO: 614178 - DNA, 13 bp, D. melanogaster
ctctaacgcccaa

SEQ ID NO: 614179 - DNA, 13 bp, D. melanogaster
ctctaatatctat

SEQ ID NO: 614180 - DNA, 13 bp, D. melanogaster
ctctaattaaata

SEQ ID NO: 614181 - DNA, 13 bp, D. melanogaster
ctctacacataca

SEQ ID NO: 614182 - DNA, 14 bp, D. melanogaster
ctctaccagcagca

SEQ ID NO: 614183 - DNA, 13 bp, D. melanogaster
ctctactgaaact

SEQ ID NO: 614184 - DNA, 13 bp, D. melanogaster
ctctacttttgct

SEQ ID NO: 614185 - DNA, 13 bp, D. melanogaster
ctctagccgcagt

SEQ ID NO: 614186 - DNA, 13 bp, D. melanogaster
ctctatatataca

SEQ ID NO: 614187 - DNA, 13 bp, D. melanogaster
ctctatatatgta

SEQ ID NO: 614188 - DNA, 13 bp, D. melanogaster
ctctatattttgg

SEQ ID NO: 614189 - DNA, 13 bp, D. melanogaster
ctctatcgaaagc

SEQ ID NO: 614190 - DNA, 14 bp, D. melanogaster
ctctatctatctct

SEQ ID NO: 614191 - DNA, 13 bp, D. melanogaster
ctctatctcgctc

SEQ ID NO: 614192 - DNA, 13 bp, D. melanogaster
ctctatctctctg

SEQ ID NO: 614193 - DNA, 13 bp, D. melanogaster
ctctatgcaaatg

SEQ ID NO: 614194 - DNA, 13 bp, D. melanogaster
ctctatgtgtgtg

SEQ ID NO: 614195 - DNA, 13 bp, D. melanogaster
ctctattggcatt

SEQ ID NO: 614196 - DNA, 13 bp, D. melanogaster
ctctcaattcagc

SEQ ID NO: 614197 - DNA, 13 bp, D. melanogaster
ctctcactcgcac

SEQ ID NO: 614198 - DNA, 13 bp, D. melanogaster
ctctcactcgctc

SEQ ID NO: 614199 - DNA, 14 bp, D. melanogaster
ctctcactcgctct

SEQ ID NO: 614200 - DNA, 13 bp, D. melanogaster
ctctcactctcgc

SEQ ID NO: 614201 - DNA, 13 bp, D. melanogaster
ctctcagtgcagc

SEQ ID NO: 614202 - DNA, 13 bp, D. melanogaster
ctctccagctctc

SEQ ID NO: 614203 - DNA, 13 bp, D. melanogaster
ctctccataattt

SEQ ID NO: 614204 - DNA, 14 bp, D. melanogaster
ctctcccaccagca

SEQ ID NO: 614205 - DNA, 13 bp, D. melanogaster
ctctcccgaaata

SEQ ID NO: 614206 - DNA, 13 bp, D. melanogaster
ctctccctcgcac

SEQ ID NO: 614207 - DNA, 14 bp, D. melanogaster
ctctccgccgtgaa

SEQ ID NO: 614208 - DNA, 13 bp, D. melanogaster
ctctcctcctcga

SEQ ID NO: 614209 - DNA, 13 bp, D. melanogaster
ctctcgatttttt

SEQ ID NO: 614210 - DNA, 13 bp, D. melanogaster
ctctcgctcactc

SEQ ID NO: 614211 - DNA, 13 bp, D. melanogaster
ctctcgctcccac

SEQ ID NO: 614212 - DNA, 13 bp, D. melanogaster
ctctcgctcgcac

SEQ ID NO: 614213 - DNA, 13 bp, D. melanogaster
ctctcgctcgctc

SEQ ID NO: 614214 - DNA, 14 bp, D. melanogaster
ctctcgctcgctct

SEQ ID NO: 614215 - DNA, 13 bp, D. melanogaster
ctctcgctctcac

SEQ ID NO: 614216 - DNA, 13 bp, D. melanogaster
ctctcgctctcga

SEQ ID NO: 614217 - DNA, 13 bp, D. melanogaster
ctctcgctctctg

SEQ ID NO: 614218 - DNA, 13 bp, D. melanogaster
ctctcgctctggc

SEQ ID NO: 614219 - DNA, 13 bp, D. melanogaster
ctctctaacaaaa

SEQ ID NO: 614220 - DNA, 13 bp, D. melanogaster
ctctctatctatc

SEQ ID NO: 614221 - DNA, 13 bp, D. melanogaster
ctctctcgcactc

SEQ ID NO: 614222 - DNA, 14 bp, D. melanogaster
ctctctcgctctca

SEQ ID NO: 614223 - DNA, 13 bp, D. melanogaster
ctctctcgctctg

SEQ ID NO: 614224 - DNA, 13 bp, D. melanogaster
ctctctcgcttgc

SEQ ID NO: 614225 - DNA, 13 bp, D. melanogaster
ctctctcgttcgc

SEQ ID NO: 614226 - DNA, 13 bp, D. melanogaster
ctctctctatcgc

SEQ ID NO: 614227 - DNA, 13 bp, D. melanogaster
ctctctctatcta

SEQ ID NO: 614228 - DNA, 14 bp, D. melanogaster
ctctctctatctat

SEQ ID NO: 614229 - DNA, 14 bp, D. melanogaster
ctctctctcgcact

SEQ ID NO: 614230 - DNA, 14 bp, D. melanogaster
ctctctctctgtcg

SEQ ID NO: 614231 - DNA, 14 bp, D. melanogaster
ctctctctctgtgt

SEQ ID NO: 614232 - DNA, 13 bp, D. melanogaster
ctctctctcttgg

SEQ ID NO: 614233 - DNA, 14 bp, D. melanogaster
ctctctctgcctcg

SEQ ID NO: 614234 - DNA, 13 bp, D. melanogaster
ctctctgcctgct

SEQ ID NO: 614235 - DNA, 13 bp, D. melanogaster
ctctctgcgcttc

SEQ ID NO: 614236 - DNA, 13 bp, D. melanogaster
ctctctgtcgctc

SEQ ID NO: 614237 - DNA, 13 bp, D. melanogaster
ctctctgtcgtgt

SEQ ID NO: 614238 - DNA, 13 bp, D. melanogaster
ctctcttatacat

SEQ ID NO: 614239 - DNA, 14 bp, D. melanogaster
ctctcttctcaccg

SEQ ID NO: 614240 - DNA, 13 bp, D. melanogaster
ctctctttcgcac

SEQ ID NO: 614241 - DNA, 13 bp, D. melanogaster
ctctctttctggc

SEQ ID NO: 614242 - DNA, 13 bp, D. melanogaster
ctctcttttggcc

SEQ ID NO: 614243 - DNA, 13 bp, D. melanogaster
ctctgaactctga

SEQ ID NO: 614244 - DNA, 14 bp, D. melanogaster
ctctgaaggccaaa

SEQ ID NO: 614245 - DNA, 13 bp, D. melanogaster
ctctgaccctcct

SEQ ID NO: 614246 - DNA, 14 bp, D. melanogaster
ctctgaggagcttc

SEQ ID NO: 614247 - DNA, 13 bp, D. melanogaster
ctctgagttcctt

SEQ ID NO: 614248 - DNA, 13 bp, D. melanogaster
ctctgcatgtgtg

SEQ ID NO: 614249 - DNA, 13 bp, D. melanogaster
ctctgcatttaaa

SEQ ID NO: 614250 - DNA, 13 bp, D. melanogaster
ctctgcattttga

SEQ ID NO: 614251 - DNA, 13 bp, D. melanogaster
ctctgccaaacgt

SEQ ID NO: 614252 - DNA, 13 bp, D. melanogaster
ctctgccactgcc

SEQ ID NO: 614253 - DNA, 14 bp, D. melanogaster
ctctgccgcagcgc

SEQ ID NO: 614254 - DNA, 13 bp, D. melanogaster
ctctgccgctgcc

SEQ ID NO: 614255 - DNA, 14 bp, D. melanogaster
ctctgccggcgtcg

SEQ ID NO: 614256 - DNA, 13 bp, D. melanogaster
ctctgcgccagac

SEQ ID NO: 614257 - DNA, 13 bp, D. melanogaster
ctctgctcctctg

SEQ ID NO: 614258 - DNA, 13 bp, D. melanogaster
ctctgctctccaa

SEQ ID NO: 614259 - DNA, 13 bp, D. melanogaster
ctctgctctgttt

SEQ ID NO: 614260 - DNA, 13 bp, D. melanogaster
ctctgctgaactg

SEQ ID NO: 614261 - DNA, 13 bp, D. melanogaster
ctctgctgaattt

SEQ ID NO: 614262 - DNA, 13 bp, D. melanogaster
ctctgctgcccga

SEQ ID NO: 614263 - DNA, 13 bp, D. melanogaster
ctctgctgtttca

SEQ ID NO: 614264 - DNA, 13 bp, D. melanogaster
ctctgctgttttg

SEQ ID NO: 614265 - DNA, 13 bp, D. melanogaster
ctctgcttttggc

SEQ ID NO: 614266 - DNA, 13 bp, D. melanogaster
ctctgctttttgg

SEQ ID NO: 614267 - DNA, 13 bp, D. melanogaster
ctctggaatcttc

SEQ ID NO: 614268 - DNA, 13 bp, D. melanogaster
ctctggactctgg

SEQ ID NO: 614269 - DNA, 13 bp, D. melanogaster
ctctggcacctgg

SEQ ID NO: 614270 - DNA, 13 bp, D. melanogaster
ctctggccaaaaa

SEQ ID NO: 614271 - DNA, 13 bp, D. melanogaster
ctctgggcgctca

SEQ ID NO: 614272 - DNA, 13 bp, D. melanogaster
ctctggtctctgg

SEQ ID NO: 614273 - DNA, 13 bp, D. melanogaster
ctctggtctgttg

SEQ ID NO: 614274 - DNA, 13 bp, D. melanogaster
ctctgtaaattaa

SEQ ID NO: 614275 - DNA, 13 bp, D. melanogaster
ctctgtcccgctc

SEQ ID NO: 614276 - DNA, 14 bp, D. melanogaster
ctctgtctctgtct

SEQ ID NO: 614277 - DNA, 14 bp, D. melanogaster
ctctgtctgccttt

SEQ ID NO: 614278 - DNA, 13 bp, D. melanogaster
ctctgtgaccatt

SEQ ID NO: 614279 - DNA, 14 bp, D. melanogaster
ctctgtgaccattt

SEQ ID NO: 614280 - DNA, 13 bp, D. melanogaster
ctctgtgtctgtg

SEQ ID NO: 614281 - DNA, 13 bp, D. melanogaster
ctctgtgtgagtg

SEQ ID NO: 614282 - DNA, 13 bp, D. melanogaster
ctctgtgtgtgtg

SEQ ID NO: 614283 - DNA, 14 bp, D. melanogaster
ctctgtgtgtgtgt

SEQ ID NO: 614284 - DNA, 13 bp, D. melanogaster
ctctgttctgttc

SEQ ID NO: 614285 - DNA, 13 bp, D. melanogaster
ctctgttcttctg

SEQ ID NO: 614286 - DNA, 13 bp, D. melanogaster
ctctgttggccat

SEQ ID NO: 614287 - DNA, 13 bp, D. melanogaster
ctcttaaaaatat

SEQ ID NO: 614288 - DNA, 13 bp, D. melanogaster
ctcttaaaactaa

SEQ ID NO: 614289 - DNA, 14 bp, D. melanogaster
ctcttaaaactaaa

SEQ ID NO: 614290 - DNA, 14 bp, D. melanogaster
ctcttaaatattta

SEQ ID NO: 614291 - DNA, 13 bp, D. melanogaster
ctcttagatggct

SEQ ID NO: 614292 - DNA, 13 bp, D. melanogaster
ctcttatataatg

SEQ ID NO: 614293 - DNA, 13 bp, D. melanogaster
ctcttcaacttgg

SEQ ID NO: 614294 - DNA, 13 bp, D. melanogaster
ctcttcaatattt

SEQ ID NO: 614295 - DNA, 13 bp, D. melanogaster
ctcttcagttgat

SEQ ID NO: 614296 - DNA, 15 bp, D. melanogaster
ctcttcgaagatacc

SEQ ID NO: 614297 - DNA, 13 bp, D. melanogaster
ctcttcgcccacc

SEQ ID NO: 614298 - DNA, 13 bp, D. melanogaster
ctcttctacaatg

SEQ ID NO: 614299 - DNA, 13 bp, D. melanogaster
ctcttctggccaa

SEQ ID NO: 614300 - DNA, 13 bp, D. melanogaster
ctcttcttgcgat

SEQ ID NO: 614301 - DNA, 13 bp, D. melanogaster
ctcttgcttttgc

SEQ ID NO: 614302 - DNA, 13 bp, D. melanogaster
ctcttggagctaa

SEQ ID NO: 614303 - DNA, 13 bp, D. melanogaster
ctcttggccaact

SEQ ID NO: 614304 - DNA, 13 bp, D. melanogaster
ctcttggccaagt

SEQ ID NO: 614305 - DNA, 13 bp, D. melanogaster
ctcttgttttaat

SEQ ID NO: 614306 - DNA, 13 bp, D. melanogaster
ctcttgtttttac

SEQ ID NO: 614307 - DNA, 13 bp, D. melanogaster
ctctttaaaaaca

SEQ ID NO: 614308 - DNA, 13 bp, D. melanogaster
ctctttaatgcca

SEQ ID NO: 614309 - DNA, 13 bp, D. melanogaster
ctctttatatata

SEQ ID NO: 614310 - DNA, 13 bp, D. melanogaster
ctctttatgtggg

SEQ ID NO: 614311 - DNA, 13 bp, D. melanogaster
ctctttcaatttc

SEQ ID NO: 614312 - DNA, 13 bp, D. melanogaster
ctctttcataaag

SEQ ID NO: 614313 - DNA, 13 bp, D. melanogaster
ctctttccgctcg

SEQ ID NO: 614314 - DNA, 13 bp, D. melanogaster
ctctttcgcactc

SEQ ID NO: 614315 - DNA, 13 bp, D. melanogaster
ctctttcgccggc

SEQ ID NO: 614316 - DNA, 13 bp, D. melanogaster
ctctttcgctcgc

SEQ ID NO: 614317 - DNA, 13 bp, D. melanogaster
ctctttctgcggc

SEQ ID NO: 614318 - DNA, 13 bp, D. melanogaster
ctctttctggccc

SEQ ID NO: 614319 - DNA, 13 bp, D. melanogaster
ctctttgatttat

SEQ ID NO: 614320 - DNA, 13 bp, D. melanogaster
ctctttgccattt

SEQ ID NO: 614321 - DNA, 13 bp, D. melanogaster
ctctttggcattt

SEQ ID NO: 614322 - DNA, 13 bp, D. melanogaster
ctctttggctctc

SEQ ID NO: 614323 - DNA, 13 bp, D. melanogaster
ctctttggctttg

SEQ ID NO: 614324 - DNA, 13 bp, D. melanogaster
ctctttgttgggc

SEQ ID NO: 614325 - DNA, 13 bp, D. melanogaster
ctcttttaataga

SEQ ID NO: 614326 - DNA, 13 bp, D. melanogaster
ctcttttattgcc

SEQ ID NO: 614327 - DNA, 13 bp, D. melanogaster
ctcttttggcata

SEQ ID NO: 614328 - DNA, 13 bp, D. melanogaster
ctcttttgggcca

SEQ ID NO: 614329 - DNA, 13 bp, D. melanogaster
ctctttttaagtt

SEQ ID NO: 614330 - DNA, 13 bp, D. melanogaster
ctcttttttggca

SEQ ID NO: 614331 - DNA, 14 bp, D. melanogaster
ctgaaaaaatatat

SEQ ID NO: 614332 - DNA, 14 bp, D. melanogaster
ctgaaaaaattgaa

SEQ ID NO: 614333 - DNA, 13 bp, D. melanogaster
ctgaaaaaccaaa

SEQ ID NO: 614334 - DNA, 13 bp, D. melanogaster
ctgaaaaactgaa

SEQ ID NO: 614335 - DNA, 13 bp, D. melanogaster
ctgaaaaactgca

SEQ ID NO: 614336 - DNA, 14 bp, D. melanogaster
ctgaaaaataaaat

SEQ ID NO: 614337 - DNA, 13 bp, D. melanogaster
ctgaaaaataata

SEQ ID NO: 614338 - DNA, 13 bp, D. melanogaster
ctgaaaaattaaa

SEQ ID NO: 614339 - DNA, 13 bp, D. melanogaster
ctgaaaacaaaat

SEQ ID NO: 614340 - DNA, 14 bp, D. melanogaster
ctgaaaacaatcaa

SEQ ID NO: 614341 - DNA, 13 bp, D. melanogaster
ctgaaaacaattt

SEQ ID NO: 614342 - DNA, 13 bp, D. melanogaster
ctgaaaacacaca

SEQ ID NO: 614343 - DNA, 13 bp, D. melanogaster
ctgaaaacagaaa

SEQ ID NO: 614344 - DNA, 13 bp, D. melanogaster
ctgaaaacagtgc

SEQ ID NO: 614345 - DNA, 13 bp, D. melanogaster
ctgaaaaccgaaa

SEQ ID NO: 614346 - DNA, 13 bp, D. melanogaster
ctgaaaactaaaa

SEQ ID NO: 614347 - DNA, 13 bp, D. melanogaster
ctgaaaactgcaa

SEQ ID NO: 614348 - DNA, 13 bp, D. melanogaster
ctgaaaacttgaa

SEQ ID NO: 614349 - DNA, 13 bp, D. melanogaster
ctgaaaagaaaca

SEQ ID NO: 614350 - DNA, 13 bp, D. melanogaster
ctgaaaagcacat

SEQ ID NO: 614351 - DNA, 13 bp, D. melanogaster
ctgaaaaggaccg

SEQ ID NO: 614352 - DNA, 13 bp, D. melanogaster
ctgaaaagtatgc

SEQ ID NO: 614353 - DNA, 13 bp, D. melanogaster
ctgaaaagtgaaa

SEQ ID NO: 614354 - DNA, 13 bp, D. melanogaster
ctgaaaataataa

SEQ ID NO: 614355 - DNA, 13 bp, D. melanogaster
ctgaaaatacaaa

SEQ ID NO: 614356 - DNA, 13 bp, D. melanogaster
ctgaaaatagaaa

SEQ ID NO: 614357 - DNA, 14 bp, D. melanogaster
ctgaaaatatttaa

SEQ ID NO: 614358 - DNA, 13 bp, D. melanogaster
ctgaaaatcaaaa

SEQ ID NO: 614359 - DNA, 13 bp, D. melanogaster
ctgaaaatcaata

SEQ ID NO: 614360 - DNA, 13 bp, D. melanogaster
ctgaaaatgcaag

SEQ ID NO: 614361 - DNA, 13 bp, D. melanogaster
ctgaaaatgcatt

SEQ ID NO: 614362 - DNA, 13 bp, D. melanogaster
ctgaaaatggatg

SEQ ID NO: 614363 - DNA, 13 bp, D. melanogaster
ctgaaaattaaat

SEQ ID NO: 614364 - DNA, 13 bp, D. melanogaster
ctgaaaattgttt

SEQ ID NO: 614365 - DNA, 13 bp, D. melanogaster
ctgaaaatttaat

SEQ ID NO: 614366 - DNA, 13 bp, D. melanogaster
ctgaaaatttatt

SEQ ID NO: 614367 - DNA, 13 bp, D. melanogaster
ctgaaacaagaag

SEQ ID NO: 614368 - DNA, 14 bp, D. melanogaster
ctgaaactaaatat

SEQ ID NO: 614369 - DNA, 13 bp, D. melanogaster
ctgaaactgaaag

SEQ ID NO: 614370 - DNA, 13 bp, D. melanogaster
ctgaaactgaaat

SEQ ID NO: 614371 - DNA, 13 bp, D. melanogaster
ctgaaactgaact

SEQ ID NO: 614372 - DNA, 13 bp, D. melanogaster
ctgaaactgaagc

SEQ ID NO: 614373 - DNA, 13 bp, D. melanogaster
ctgaaacttaaaa

SEQ ID NO: 614374 - DNA, 13 bp, D. melanogaster
ctgaaagaaaacc

SEQ ID NO: 614375 - DNA, 13 bp, D. melanogaster
ctgaaagaaaagc

SEQ ID NO: 614376 - DNA, 13 bp, D. melanogaster
ctgaaagaaaatg

SEQ ID NO: 614377 - DNA, 13 bp, D. melanogaster
ctgaaagaaataa

SEQ ID NO: 614378 - DNA, 13 bp, D. melanogaster
ctgaaagatacaa

SEQ ID NO: 614379 - DNA, 13 bp, D. melanogaster
ctgaaagccaaaa

SEQ ID NO: 614380 - DNA, 13 bp, D. melanogaster
ctgaaagcgaaaa

SEQ ID NO: 614381 - DNA, 13 bp, D. melanogaster
ctgaaagctgaaa

SEQ ID NO: 614382 - DNA, 13 bp, D. melanogaster
ctgaaaggaaaat

SEQ ID NO: 614383 - DNA, 13 bp, D. melanogaster
ctgaaagtaaaat

SEQ ID NO: 614384 - DNA, 13 bp, D. melanogaster
ctgaaagtaggca

SEQ ID NO: 614385 - DNA, 13 bp, D. melanogaster
ctgaaagttcttc

SEQ ID NO: 614386 - DNA, 13 bp, D. melanogaster
ctgaaataaaatg

SEQ ID NO: 614387 - DNA, 13 bp, D. melanogaster
ctgaaataaatat

SEQ ID NO: 614388 - DNA, 13 bp, D. melanogaster
ctgaaataaatca

SEQ ID NO: 614389 - DNA, 13 bp, D. melanogaster
ctgaaataagtgg

SEQ ID NO: 614390 - DNA, 13 bp, D. melanogaster
ctgaaataataaa

SEQ ID NO: 614391 - DNA, 13 bp, D. melanogaster
ctgaaataattga

SEQ ID NO: 614392 - DNA, 13 bp, D. melanogaster
ctgaaatactggc

SEQ ID NO: 614393 - DNA, 13 bp, D. melanogaster
ctgaaatattgaa

SEQ ID NO: 614394 - DNA, 13 bp, D. melanogaster
ctgaaatatttat

SEQ ID NO: 614395 - DNA, 13 bp, D. melanogaster
ctgaaatcaaaac

SEQ ID NO: 614396 - DNA, 13 bp, D. melanogaster
ctgaaatcaaaag

SEQ ID NO: 614397 - DNA, 13 bp, D. melanogaster
ctgaaatcaaaat

SEQ ID NO: 614398 - DNA, 13 bp, D. melanogaster
ctgaaatcaatcg

SEQ ID NO: 614399 - DNA, 13 bp, D. melanogaster
ctgaaatccgaaa

SEQ ID NO: 614400 - DNA, 13 bp, D. melanogaster
ctgaaatccggac

SEQ ID NO: 614401 - DNA, 14 bp, D. melanogaster
ctgaaatctgaaat

SEQ ID NO: 614402 - DNA, 13 bp, D. melanogaster
ctgaaatctgtga

SEQ ID NO: 614403 - DNA, 13 bp, D. melanogaster
ctgaaatctttga

SEQ ID NO: 614404 - DNA, 14 bp, D. melanogaster
ctgaaatgaaatga

SEQ ID NO: 614405 - DNA, 13 bp, D. melanogaster
ctgaaatgctgaa

SEQ ID NO: 614406 - DNA, 14 bp, D. melanogaster
ctgaaattaaaatt

SEQ ID NO: 614407 - DNA, 13 bp, D. melanogaster
ctgaaattattta

SEQ ID NO: 614408 - DNA, 13 bp, D. melanogaster
ctgaaattgaatt

SEQ ID NO: 614409 - DNA, 13 bp, D. melanogaster
ctgaaattgtttt

SEQ ID NO: 614410 - DNA, 13 bp, D. melanogaster
ctgaaattttcat

SEQ ID NO: 614411 - DNA, 13 bp, D. melanogaster
ctgaacaaaaaat

SEQ ID NO: 614412 - DNA, 13 bp, D. melanogaster
ctgaacaatttgg

SEQ ID NO: 614413 - DNA, 15 bp, D. melanogaster
ctgaacaatttggat

SEQ ID NO: 614414 - DNA, 13 bp, D. melanogaster
ctgaaccgaactg

SEQ ID NO: 614415 - DNA, 13 bp, D. melanogaster
ctgaacctgaacc

SEQ ID NO: 614416 - DNA, 14 bp, D. melanogaster
ctgaacctgaacct

SEQ ID NO: 614417 - DNA, 14 bp, D. melanogaster
ctgaactaaacgaa

SEQ ID NO: 614418 - DNA, 13 bp, D. melanogaster
ctgaactacattg

SEQ ID NO: 614419 - DNA, 13 bp, D. melanogaster
ctgaactcaaaga

SEQ ID NO: 614420 - DNA, 13 bp, D. melanogaster
ctgaactcgaatc

SEQ ID NO: 614421 - DNA, 13 bp, D. melanogaster
ctgaactgaaact

SEQ ID NO: 614422 - DNA, 14 bp, D. melanogaster
ctgaactgagctga

SEQ ID NO: 614423 - DNA, 13 bp, D. melanogaster
ctgaactttttca

SEQ ID NO: 614424 - DNA, 13 bp, D. melanogaster
ctgaagaaatttt

SEQ ID NO: 614425 - DNA, 14 bp, D. melanogaster
ctgaagaacgacga

SEQ ID NO: 614426 - DNA, 13 bp, D. melanogaster
ctgaagaagaagc

SEQ ID NO: 614427 - DNA, 13 bp, D. melanogaster
ctgaagaattcgc

SEQ ID NO: 614428 - DNA, 14 bp, D. melanogaster
ctgaagaattcgcg

SEQ ID NO: 614429 - DNA, 15 bp, D. melanogaster
ctgaagacggcaact

SEQ ID NO: 614430 - DNA, 13 bp, D. melanogaster
ctgaagacgtcga

SEQ ID NO: 614431 - DNA, 13 bp, D. melanogaster
ctgaagatgattt

SEQ ID NO: 614432 - DNA, 13 bp, D. melanogaster
ctgaagcatcaaa

SEQ ID NO: 614433 - DNA, 14 bp, D. melanogaster
ctgaagctatgatg

SEQ ID NO: 614434 - DNA, 13 bp, D. melanogaster
ctgaagctatttc

SEQ ID NO: 614435 - DNA, 13 bp, D. melanogaster
ctgaagctgaaaa

SEQ ID NO: 614436 - DNA, 13 bp, D. melanogaster
ctgaagctgaagc

SEQ ID NO: 614437 - DNA, 14 bp, D. melanogaster
ctgaagctgaagct

SEQ ID NO: 614438 - DNA, 13 bp, D. melanogaster
ctgaagctggagt

SEQ ID NO: 614439 - DNA, 13 bp, D. melanogaster
ctgaaggccaaaa

SEQ ID NO: 614440 - DNA, 13 bp, D. melanogaster
ctgaaggctggca

SEQ ID NO: 614441 - DNA, 13 bp, D. melanogaster
ctgaagggcattg

SEQ ID NO: 614442 - DNA, 14 bp, D. melanogaster
ctgaagtaattaat

SEQ ID NO: 614443 - DNA, 13 bp, D. melanogaster
ctgaagttctcca

SEQ ID NO: 614444 - DNA, 13 bp, D. melanogaster
ctgaagtttttgg

SEQ ID NO: 614445 - DNA, 13 bp, D. melanogaster
ctgaataaaatat

SEQ ID NO: 614446 - DNA, 13 bp, D. melanogaster
ctgaatatatata

SEQ ID NO: 614447 - DNA, 13 bp, D. melanogaster
ctgaatatatttt

SEQ ID NO: 614448 - DNA, 13 bp, D. melanogaster
ctgaatatggaat

SEQ ID NO: 614449 - DNA, 13 bp, D. melanogaster
ctgaatattataa

SEQ ID NO: 614450 - DNA, 13 bp, D. melanogaster
ctgaatcaaaatt

SEQ ID NO: 614451 - DNA, 13 bp, D. melanogaster
ctgaatccgaatc

SEQ ID NO: 614452 - DNA, 13 bp, D. melanogaster
ctgaatccgattc

SEQ ID NO: 614453 - DNA, 13 bp, D. melanogaster
ctgaatcctgaat

SEQ ID NO: 614454 - DNA, 13 bp, D. melanogaster
ctgaatcggaatc

SEQ ID NO: 614455 - DNA, 13 bp, D. melanogaster
ctgaatctcaacc

SEQ ID NO: 614456 - DNA, 13 bp, D. melanogaster
ctgaatctcaatc

SEQ ID NO: 614457 - DNA, 13 bp, D. melanogaster
ctgaatctgaaaa

SEQ ID NO: 614458 - DNA, 13 bp, D. melanogaster
ctgaatctgagtc

SEQ ID NO: 614459 - DNA, 14 bp, D. melanogaster
ctgaatgaaagtaa

SEQ ID NO: 614460 - DNA, 13 bp, D. melanogaster
ctgaatgatgtca

SEQ ID NO: 614461 - DNA, 13 bp, D. melanogaster
ctgaatgcaaaaa

SEQ ID NO: 614462 - DNA, 13 bp, D. melanogaster
ctgaatgccaaat

SEQ ID NO: 614463 - DNA, 13 bp, D. melanogaster
ctgaatggcagga

SEQ ID NO: 614464 - DNA, 14 bp, D. melanogaster
ctgaatggcaggac

SEQ ID NO: 614465 - DNA, 13 bp, D. melanogaster
ctgaatggcctcc

SEQ ID NO: 614466 - DNA, 13 bp, D. melanogaster
ctgaatgtctgcc

SEQ ID NO: 614467 - DNA, 13 bp, D. melanogaster
ctgaatgttcttc

SEQ ID NO: 614468 - DNA, 14 bp, D. melanogaster
ctgaattatttaca

SEQ ID NO: 614469 - DNA, 13 bp, D. melanogaster
ctgaattgactgc

SEQ ID NO: 614470 - DNA, 13 bp, D. melanogaster
ctgaattgcattt

SEQ ID NO: 614471 - DNA, 13 bp, D. melanogaster
ctgaatttacttt

SEQ ID NO: 614472 - DNA, 13 bp, D. melanogaster
ctgaatttattaa

SEQ ID NO: 614473 - DNA, 13 bp, D. melanogaster
ctgaatttgcatt

SEQ ID NO: 614474 - DNA, 13 bp, D. melanogaster
ctgaattttacat

SEQ ID NO: 614475 - DNA, 14 bp, D. melanogaster
ctgaattttggcaa

SEQ ID NO: 614476 - DNA, 13 bp, D. melanogaster
ctgaatttttaat

SEQ ID NO: 614477 - DNA, 14 bp, D. melanogaster
ctgacaaatttcca

SEQ ID NO: 614478 - DNA, 13 bp, D. melanogaster
ctgacaaattttc

SEQ ID NO: 614479 - DNA, 13 bp, D. melanogaster
ctgacaacaacaa

SEQ ID NO: 614480 - DNA, 13 bp, D. melanogaster
ctgacaatttttt

SEQ ID NO: 614481 - DNA, 13 bp, D. melanogaster
ctgacaccagcag

SEQ ID NO: 614482 - DNA, 13 bp, D. melanogaster
ctgacacccaaca

SEQ ID NO: 614483 - DNA, 14 bp, D. melanogaster
ctgacagacagaca

SEQ ID NO: 614484 - DNA, 13 bp, D. melanogaster
ctgacagcgtctt

SEQ ID NO: 614485 - DNA, 13 bp, D. melanogaster
ctgacagctgcag

SEQ ID NO: 614486 - DNA, 13 bp, D. melanogaster
ctgacattgaaaa

SEQ ID NO: 614487 - DNA, 13 bp, D. melanogaster
ctgacattgaaga

SEQ ID NO: 614488 - DNA, 13 bp, D. melanogaster
ctgacattgattt

SEQ ID NO: 614489 - DNA, 13 bp, D. melanogaster
ctgacatttcaat

SEQ ID NO: 614490 - DNA, 13 bp, D. melanogaster
ctgaccacaaaat

SEQ ID NO: 614491 - DNA, 13 bp, D. melanogaster
ctgaccacgccca

SEQ ID NO: 614492 - DNA, 13 bp, D. melanogaster
ctgaccatatttc

SEQ ID NO: 614493 - DNA, 14 bp, D. melanogaster
ctgaccatgcactt

SEQ ID NO: 614494 - DNA, 14 bp, D. melanogaster
ctgaccattacaaa

SEQ ID NO: 614495 - DNA, 13 bp, D. melanogaster
ctgaccatttaca

SEQ ID NO: 614496 - DNA, 13 bp, D. melanogaster
ctgaccatttatt

SEQ ID NO: 614497 - DNA, 13 bp, D. melanogaster
ctgacgtggaatc

SEQ ID NO: 614498 - DNA, 13 bp, D. melanogaster
ctgactaactgac

SEQ ID NO: 614499 - DNA, 14 bp, D. melanogaster
ctgactaactgact

SEQ ID NO: 614500 - DNA, 13 bp, D. melanogaster
ctgactatcagat

SEQ ID NO: 614501 - DNA, 14 bp, D. melanogaster
ctgactattataat

SEQ ID NO: 614502 - DNA, 13 bp, D. melanogaster
ctgactattttta

SEQ ID NO: 614503 - DNA, 13 bp, D. melanogaster
ctgactcactgac

SEQ ID NO: 614504 - DNA, 13 bp, D. melanogaster
ctgactctgactc

SEQ ID NO: 614505 - DNA, 13 bp, D. melanogaster
ctgactgacagtc

SEQ ID NO: 614506 - DNA, 13 bp, D. melanogaster
ctgactgacattt

SEQ ID NO: 614507 - DNA, 13 bp, D. melanogaster
ctgactgacggac

SEQ ID NO: 614508 - DNA, 13 bp, D. melanogaster
ctgactgactaac

SEQ ID NO: 614509 - DNA, 13 bp, D. melanogaster
ctgactgactgac

SEQ ID NO: 614510 - DNA, 13 bp, D. melanogaster
ctgactgactgga

SEQ ID NO: 614511 - DNA, 13 bp, D. melanogaster
ctgactgactggc

SEQ ID NO: 614512 - DNA, 13 bp, D. melanogaster
ctgactggctggc

SEQ ID NO: 614513 - DNA, 13 bp, D. melanogaster
ctgactttgactt

SEQ ID NO: 614514 - DNA, 13 bp, D. melanogaster
ctgacttttattt

SEQ ID NO: 614515 - DNA, 13 bp, D. melanogaster
ctgagaaaaaagc

SEQ ID NO: 614516 - DNA, 13 bp, D. melanogaster
ctgagaaaaataa

SEQ ID NO: 614517 - DNA, 13 bp, D. melanogaster
ctgagaaaaatat

SEQ ID NO: 614518 - DNA, 13 bp, D. melanogaster
ctgagaaaaatgt

SEQ ID NO: 614519 - DNA, 13 bp, D. melanogaster
ctgagaactgaaa

SEQ ID NO: 614520 - DNA, 13 bp, D. melanogaster
ctgagaactttga

SEQ ID NO: 614521 - DNA, 13 bp, D. melanogaster
ctgagaaggaaat

SEQ ID NO: 614522 - DNA, 13 bp, D. melanogaster
ctgagaattttcc

SEQ ID NO: 614523 - DNA, 13 bp, D. melanogaster
ctgagagaaattt

SEQ ID NO: 614524 - DNA, 13 bp, D. melanogaster
ctgagagctgaga

SEQ ID NO: 614525 - DNA, 14 bp, D. melanogaster
ctgagagctgagag

SEQ ID NO: 614526 - DNA, 13 bp, D. melanogaster
ctgagatacagat

SEQ ID NO: 614527 - DNA, 13 bp, D. melanogaster
ctgagatcgagac

SEQ ID NO: 614528 - DNA, 13 bp, D. melanogaster
ctgagatgtacat

SEQ ID NO: 614529 - DNA, 14 bp, D. melanogaster
ctgagcaactacat

SEQ ID NO: 614530 - DNA, 14 bp, D. melanogaster
ctgagcaacttaat

SEQ ID NO: 614531 - DNA, 14 bp, D. melanogaster
ctgagcagtgccaa

SEQ ID NO: 614532 - DNA, 13 bp, D. melanogaster
ctgagcggagaac

SEQ ID NO: 614533 - DNA, 13 bp, D. melanogaster
ctgagctgagctg

SEQ ID NO: 614534 - DNA, 13 bp, D. melanogaster
ctgagctggatta

SEQ ID NO: 614535 - DNA, 14 bp, D. melanogaster
ctgagcttgcaatt

SEQ ID NO: 614536 - DNA, 13 bp, D. melanogaster
ctgaggcgctaaa

SEQ ID NO: 614537 - DNA, 13 bp, D. melanogaster
ctgaggctgaggc

SEQ ID NO: 614538 - DNA, 13 bp, D. melanogaster
ctgagggaaaaca

SEQ ID NO: 614539 - DNA, 13 bp, D. melanogaster
ctgaggtgtatgt

SEQ ID NO: 614540 - DNA, 13 bp, D. melanogaster
ctgagtacctaaa

SEQ ID NO: 614541 - DNA, 13 bp, D. melanogaster
ctgagtatatata

SEQ ID NO: 614542 - DNA, 13 bp, D. melanogaster
ctgagtgcatttt

SEQ ID NO: 614543 - DNA, 13 bp, D. melanogaster
ctgagttgagttg

SEQ ID NO: 614544 - DNA, 13 bp, D. melanogaster
ctgagttggccaa

SEQ ID NO: 614545 - DNA, 13 bp, D. melanogaster
ctgagtttttgtt

SEQ ID NO: 614546 - DNA, 13 bp, D. melanogaster
ctgataaaaagaa

SEQ ID NO: 614547 - DNA, 13 bp, D. melanogaster
ctgataaaagtgc

SEQ ID NO: 614548 - DNA, 13 bp, D. melanogaster
ctgataaagttga

SEQ ID NO: 614549 - DNA, 13 bp, D. melanogaster
ctgataaagtttt

SEQ ID NO: 614550 - DNA, 13 bp, D. melanogaster
ctgataaattatt

SEQ ID NO: 614551 - DNA, 13 bp, D. melanogaster
ctgataaattttc

SEQ ID NO: 614552 - DNA, 14 bp, D. melanogaster
ctgataaattttct

SEQ ID NO: 614553 - DNA, 13 bp, D. melanogaster
ctgataataataa

SEQ ID NO: 614554 - DNA, 13 bp, D. melanogaster
ctgataatgatga

SEQ ID NO: 614555 - DNA, 13 bp, D. melanogaster
ctgatagtcgagg

SEQ ID NO: 614556 - DNA, 14 bp, D. melanogaster
ctgatagtcgggaa

SEQ ID NO: 614557 - DNA, 13 bp, D. melanogaster
ctgatatatttgt

SEQ ID NO: 614558 - DNA, 13 bp, D. melanogaster
ctgatcaaaactc

SEQ ID NO: 614559 - DNA, 13 bp, D. melanogaster
ctgatcaaagaaa

SEQ ID NO: 614560 - DNA, 14 bp, D. melanogaster
ctgatcaacaagct

SEQ ID NO: 614561 - DNA, 13 bp, D. melanogaster
ctgatcagctgtc

SEQ ID NO: 614562 - DNA, 14 bp, D. melanogaster
ctgatcaggaatat

SEQ ID NO: 614563 - DNA, 13 bp, D. melanogaster
ctgatcatcatca

SEQ ID NO: 614564 - DNA, 13 bp, D. melanogaster
ctgatcctgctcc

SEQ ID NO: 614565 - DNA, 13 bp, D. melanogaster
ctgatcgaagaaa

SEQ ID NO: 614566 - DNA, 13 bp, D. melanogaster
ctgatcgacttcg

SEQ ID NO: 614567 - DNA, 13 bp, D. melanogaster
ctgatcgagataa

SEQ ID NO: 614568 - DNA, 13 bp, D. melanogaster
ctgatcgattttg

SEQ ID NO: 614569 - DNA, 13 bp, D. melanogaster
ctgatcgtcgtcc

SEQ ID NO: 614570 - DNA, 13 bp, D. melanogaster
ctgatcgtttatt

SEQ ID NO: 614571 - DNA, 13 bp, D. melanogaster
ctgatctatgatc

SEQ ID NO: 614572 - DNA, 13 bp, D. melanogaster
ctgatctcctttt

SEQ ID NO: 614573 - DNA, 14 bp, D. melanogaster
ctgatctgatctga

SEQ ID NO: 614574 - DNA, 13 bp, D. melanogaster
ctgatgacgatga

SEQ ID NO: 614575 - DNA, 13 bp, D. melanogaster
ctgatgagaatcg

SEQ ID NO: 614576 - DNA, 13 bp, D. melanogaster
ctgatgataaatc

SEQ ID NO: 614577 - DNA, 13 bp, D. melanogaster
ctgatgatgacga

SEQ ID NO: 614578 - DNA, 13 bp, D. melanogaster
ctgatgatgatgc

SEQ ID NO: 614579 - DNA, 13 bp, D. melanogaster
ctgatgcaagtgg

SEQ ID NO: 614580 - DNA, 14 bp, D. melanogaster
ctgatgctcatcag

SEQ ID NO: 614581 - DNA, 13 bp, D. melanogaster
ctgatgctgatga

SEQ ID NO: 614582 - DNA, 13 bp, D. melanogaster
ctgatgctgatgc

SEQ ID NO: 614583 - DNA, 13 bp, D. melanogaster
ctgatgctgatgg

SEQ ID NO: 614584 - DNA, 13 bp, D. melanogaster
ctgatgctgattc

SEQ ID NO: 614585 - DNA, 14 bp, D. melanogaster
ctgatgctgctgca

SEQ ID NO: 614586 - DNA, 13 bp, D. melanogaster
ctgatgctgttgc

SEQ ID NO: 614587 - DNA, 13 bp, D. melanogaster
ctgatggatggat

SEQ ID NO: 614588 - DNA, 13 bp, D. melanogaster
ctgatgtatggcc

SEQ ID NO: 614589 - DNA, 13 bp, D. melanogaster
ctgatgtccacca

SEQ ID NO: 614590 - DNA, 13 bp, D. melanogaster
ctgatgttacgcc

SEQ ID NO: 614591 - DNA, 13 bp, D. melanogaster
ctgattaaaaagt

SEQ ID NO: 614592 - DNA, 13 bp, D. melanogaster
ctgattagcggca

SEQ ID NO: 614593 - DNA, 13 bp, D. melanogaster
ctgattattatta

SEQ ID NO: 614594 - DNA, 13 bp, D. melanogaster
ctgattcaacttc

SEQ ID NO: 614595 - DNA, 13 bp, D. melanogaster
ctgattcagattc

SEQ ID NO: 614596 - DNA, 14 bp, D. melanogaster
ctgattccgattcc

SEQ ID NO: 614597 - DNA, 13 bp, D. melanogaster
ctgattctgaatc

SEQ ID NO: 614598 - DNA, 13 bp, D. melanogaster
ctgattctgattc

SEQ ID NO: 614599 - DNA, 13 bp, D. melanogaster
ctgattctgttca

SEQ ID NO: 614600 - DNA, 13 bp, D. melanogaster
ctgattgaaaatt

SEQ ID NO: 614601 - DNA, 13 bp, D. melanogaster
ctgattgattgat

SEQ ID NO: 614602 - DNA, 14 bp, D. melanogaster
ctgattgattgatt

SEQ ID NO: 614603 - DNA, 13 bp, D. melanogaster
ctgattgcattta

SEQ ID NO: 614604 - DNA, 13 bp, D. melanogaster
ctgattggaacgc

SEQ ID NO: 614605 - DNA, 13 bp, D. melanogaster
ctgatttaaaaat

SEQ ID NO: 614606 - DNA, 13 bp, D. melanogaster
ctgatttattatt

SEQ ID NO: 614607 - DNA, 14 bp, D. melanogaster
ctgatttatttatt

SEQ ID NO: 614608 - DNA, 13 bp, D. melanogaster
ctgatttcgattc

SEQ ID NO: 614609 - DNA, 13 bp, D. melanogaster
ctgatttggtttt

SEQ ID NO: 614610 - DNA, 13 bp, D. melanogaster
ctgattttcgcaa

SEQ ID NO: 614611 - DNA, 13 bp, D. melanogaster
ctgattttgattc

SEQ ID NO: 614612 - DNA, 13 bp, D. melanogaster
ctgattttgtaaa

SEQ ID NO: 614613 - DNA, 13 bp, D. melanogaster
ctgatttttaatt

SEQ ID NO: 614614 - DNA, 14 bp, D. melanogaster
ctgcaaaaaaaaat

SEQ ID NO: 614615 - DNA, 13 bp, D. melanogaster
ctgcaaaaaacag

SEQ ID NO: 614616 - DNA, 13 bp, D. melanogaster
ctgcaaaaacaaa

SEQ ID NO: 614617 - DNA, 13 bp, D. melanogaster
ctgcaaaaaccaa

SEQ ID NO: 614618 - DNA, 13 bp, D. melanogaster
ctgcaaaaactgg

SEQ ID NO: 614619 - DNA, 14 bp, D. melanogaster
ctgcaaaaactgga

SEQ ID NO: 614620 - DNA, 13 bp, D. melanogaster
ctgcaaaaacttg

SEQ ID NO: 614621 - DNA, 14 bp, D. melanogaster
ctgcaaaaatattt

SEQ ID NO: 614622 - DNA, 13 bp, D. melanogaster
ctgcaaaacaaaa

SEQ ID NO: 614623 - DNA, 13 bp, D. melanogaster
ctgcaaaacaaca

SEQ ID NO: 614624 - DNA, 13 bp, D. melanogaster
ctgcaaaactgca

SEQ ID NO: 614625 - DNA, 13 bp, D. melanogaster
ctgcaaaatcagc

SEQ ID NO: 614626 - DNA, 13 bp, D. melanogaster
ctgcaaaatcgac

SEQ ID NO: 614627 - DNA, 13 bp, D. melanogaster
ctgcaaaatgaaa

SEQ ID NO: 614628 - DNA, 13 bp, D. melanogaster
ctgcaaaatgaat

SEQ ID NO: 614629 - DNA, 13 bp, D. melanogaster
ctgcaaaatggag

SEQ ID NO: 614630 - DNA, 14 bp, D. melanogaster
ctgcaaaatggagt

SEQ ID NO: 614631 - DNA, 13 bp, D. melanogaster
ctgcaaaatggca

SEQ ID NO: 614632 - DNA, 13 bp, D. melanogaster
ctgcaaaatgtat

SEQ ID NO: 614633 - DNA, 13 bp, D. melanogaster
ctgcaaaattgtt

SEQ ID NO: 614634 - DNA, 13 bp, D. melanogaster
ctgcaaaatttat

SEQ ID NO: 614635 - DNA, 13 bp, D. melanogaster
ctgcaaacaattg

SEQ ID NO: 614636 - DNA, 13 bp, D. melanogaster
ctgcaaactgcag

SEQ ID NO: 614637 - DNA, 13 bp, D. melanogaster
ctgcaaactttct

SEQ ID NO: 614638 - DNA, 13 bp, D. melanogaster
ctgcaaagtatgc

SEQ ID NO: 614639 - DNA, 13 bp, D. melanogaster
ctgcaaagtgaag

SEQ ID NO: 614640 - DNA, 13 bp, D. melanogaster
ctgcaaagtttgc

SEQ ID NO: 614641 - DNA, 13 bp, D. melanogaster
ctgcaaataaatg

SEQ ID NO: 614642 - DNA, 13 bp, D. melanogaster
ctgcaaataatta

SEQ ID NO: 614643 - DNA, 13 bp, D. melanogaster
ctgcaaataccaa

SEQ ID NO: 614644 - DNA, 13 bp, D. melanogaster
ctgcaaatagaaa

SEQ ID NO: 614645 - DNA, 14 bp, D. melanogaster
ctgcaaatgaaaat

SEQ ID NO: 614646 - DNA, 14 bp, D. melanogaster
ctgcaaatgaaatt

SEQ ID NO: 614647 - DNA, 13 bp, D. melanogaster
ctgcaaatgagga

SEQ ID NO: 614648 - DNA, 14 bp, D. melanogaster
ctgcaaatgcaaaa

SEQ ID NO: 614649 - DNA, 13 bp, D. melanogaster
ctgcaaatgcaat

SEQ ID NO: 614650 - DNA, 13 bp, D. melanogaster
ctgcaaatggaaa

SEQ ID NO: 614651 - DNA, 13 bp, D. melanogaster
ctgcaaatggcaa

SEQ ID NO: 614652 - DNA, 13 bp, D. melanogaster
ctgcaaatgttgc

SEQ ID NO: 614653 - DNA, 13 bp, D. melanogaster
ctgcaaattaagt

SEQ ID NO: 614654 - DNA, 13 bp, D. melanogaster
ctgcaaattgcaa

SEQ ID NO: 614655 - DNA, 13 bp, D. melanogaster
ctgcaaattgcac

SEQ ID NO: 614656 - DNA, 13 bp, D. melanogaster
ctgcaacaaaatt

SEQ ID NO: 614657 - DNA, 13 bp, D. melanogaster
ctgcaacaaatgc

SEQ ID NO: 614658 - DNA, 13 bp, D. melanogaster
ctgcaacaaattg

SEQ ID NO: 614659 - DNA, 13 bp, D. melanogaster
ctgcaacaacaaa

SEQ ID NO: 614660 - DNA, 14 bp, D. melanogaster
ctgcaacaacaact

SEQ ID NO: 614661 - DNA, 13 bp, D. melanogaster
ctgcaacaatttc

SEQ ID NO: 614662 - DNA, 13 bp, D. melanogaster
ctgcaacaccagc

SEQ ID NO: 614663 - DNA, 14 bp, D. melanogaster
ctgcaacaccagca

SEQ ID NO: 614664 - DNA, 13 bp, D. melanogaster
ctgcaacacccaa

SEQ ID NO: 614665 - DNA, 13 bp, D. melanogaster
ctgcaacatcaca

SEQ ID NO: 614666 - DNA, 14 bp, D. melanogaster
ctgcaacctgcaac

SEQ ID NO: 614667 - DNA, 13 bp, D. melanogaster
ctgcaacgcaatt

SEQ ID NO: 614668 - DNA, 13 bp, D. melanogaster
ctgcaacgctgac

SEQ ID NO: 614669 - DNA, 13 bp, D. melanogaster
ctgcaactaaaca

SEQ ID NO: 614670 - DNA, 13 bp, D. melanogaster
ctgcaactgaaac

SEQ ID NO: 614671 - DNA, 14 bp, D. melanogaster
ctgcaactgcaacg

SEQ ID NO: 614672 - DNA, 13 bp, D. melanogaster
ctgcaactgcaag

SEQ ID NO: 614673 - DNA, 13 bp, D. melanogaster
ctgcaactgcaat

SEQ ID NO: 614674 - DNA, 14 bp, D. melanogaster
ctgcaactgcaatt

SEQ ID NO: 614675 - DNA, 13 bp, D. melanogaster
ctgcaactgcact

SEQ ID NO: 614676 - DNA, 13 bp, D. melanogaster
ctgcaactgcagc

SEQ ID NO: 614677 - DNA, 14 bp, D. melanogaster
ctgcaactgcagct

SEQ ID NO: 614678 - DNA, 13 bp, D. melanogaster
ctgcaactgcatt

SEQ ID NO: 614679 - DNA, 13 bp, D. melanogaster
ctgcaactgccaa

SEQ ID NO: 614680 - DNA, 13 bp, D. melanogaster
ctgcaactgccgc

SEQ ID NO: 614681 - DNA, 13 bp, D. melanogaster
ctgcaactgcgac

SEQ ID NO: 614682 - DNA, 13 bp, D. melanogaster
ctgcaactgcggc

SEQ ID NO: 614683 - DNA, 13 bp, D. melanogaster
ctgcaactgctgc

SEQ ID NO: 614684 - DNA, 14 bp, D. melanogaster
ctgcaactgctgca

SEQ ID NO: 614685 - DNA, 14 bp, D. melanogaster
ctgcaactggccat

SEQ ID NO: 614686 - DNA, 13 bp, D. melanogaster
ctgcaactgttgc

SEQ ID NO: 614687 - DNA, 14 bp, D. melanogaster
ctgcaacttgcaac

SEQ ID NO: 614688 - DNA, 13 bp, D. melanogaster
ctgcaactttaat

SEQ ID NO: 614689 - DNA, 13 bp, D. melanogaster
ctgcaagaaaatg

SEQ ID NO: 614690 - DNA, 13 bp, D. melanogaster
ctgcaagatggcc

SEQ ID NO: 614691 - DNA, 13 bp, D. melanogaster
ctgcaagctgcaa

SEQ ID NO: 614692 - DNA, 13 bp, D. melanogaster
ctgcaagggtata

SEQ ID NO: 614693 - DNA, 14 bp, D. melanogaster
ctgcaagggtatat

SEQ ID NO: 614694 - DNA, 13 bp, D. melanogaster
ctgcaagtgcaac

SEQ ID NO: 614695 - DNA, 14 bp, D. melanogaster
ctgcaagtgcaact

SEQ ID NO: 614696 - DNA, 14 bp, D. melanogaster
ctgcaagtgtgtgt

SEQ ID NO: 614697 - DNA, 13 bp, D. melanogaster
ctgcaataacgag

SEQ ID NO: 614698 - DNA, 14 bp, D. melanogaster
ctgcaatctgcaat

SEQ ID NO: 614699 - DNA, 13 bp, D. melanogaster
ctgcaatctgcag

SEQ ID NO: 614700 - DNA, 13 bp, D. melanogaster
ctgcaatcttcca

SEQ ID NO: 614701 - DNA, 13 bp, D. melanogaster
ctgcaatggaaat

SEQ ID NO: 614702 - DNA, 13 bp, D. melanogaster
ctgcaatggcaac

SEQ ID NO: 614703 - DNA, 13 bp, D. melanogaster
ctgcaatgtctgc

SEQ ID NO: 614704 - DNA, 13 bp, D. melanogaster
ctgcaattaatca

SEQ ID NO: 614705 - DNA, 13 bp, D. melanogaster
ctgcaattcattt

SEQ ID NO: 614706 - DNA, 13 bp, D. melanogaster
ctgcaattgcagc

SEQ ID NO: 614707 - DNA, 13 bp, D. melanogaster
ctgcaattgcagt

SEQ ID NO: 614708 - DNA, 13 bp, D. melanogaster
ctgcaattgctgc

SEQ ID NO: 614709 - DNA, 13 bp, D. melanogaster
ctgcaattgctgg

SEQ ID NO: 614710 - DNA, 14 bp, D. melanogaster
ctgcaattgctgga

SEQ ID NO: 614711 - DNA, 13 bp, D. melanogaster
ctgcaattgcttt

SEQ ID NO: 614712 - DNA, 13 bp, D. melanogaster
ctgcaattggaaa

SEQ ID NO: 614713 - DNA, 13 bp, D. melanogaster
ctgcaattgttgt

SEQ ID NO: 614714 - DNA, 13 bp, D. melanogaster
ctgcaatttaaat

SEQ ID NO: 614715 - DNA, 13 bp, D. melanogaster
ctgcaatttaatt

SEQ ID NO: 614716 - DNA, 13 bp, D. melanogaster
ctgcaatttgcat

SEQ ID NO: 614717 - DNA, 13 bp, D. melanogaster
ctgcaatttgttt

SEQ ID NO: 614718 - DNA, 13 bp, D. melanogaster
ctgcaattttgtg

SEQ ID NO: 614719 - DNA, 13 bp, D. melanogaster
ctgcaatttttgt

SEQ ID NO: 614720 - DNA, 13 bp, D. melanogaster
ctgcacaaacaca

SEQ ID NO: 614721 - DNA, 13 bp, D. melanogaster
ctgcacaaataaa

SEQ ID NO: 614722 - DNA, 13 bp, D. melanogaster
ctgcacacacaaa

SEQ ID NO: 614723 - DNA, 13 bp, D. melanogaster
ctgcacacacaca

SEQ ID NO: 614724 - DNA, 13 bp, D. melanogaster
ctgcacagctggc

SEQ ID NO: 614725 - DNA, 13 bp, D. melanogaster
ctgcacagtgcca

SEQ ID NO: 614726 - DNA, 13 bp, D. melanogaster
ctgcacagtgggc

SEQ ID NO: 614727 - DNA, 13 bp, D. melanogaster
ctgcacatttcca

SEQ ID NO: 614728 - DNA, 13 bp, D. melanogaster
ctgcaccaacacg

SEQ ID NO: 614729 - DNA, 13 bp, D. melanogaster
ctgcaccatattt

SEQ ID NO: 614730 - DNA, 13 bp, D. melanogaster
ctgcaccgagaaa

SEQ ID NO: 614731 - DNA, 13 bp, D. melanogaster
ctgcacctgtatc

SEQ ID NO: 614732 - DNA, 14 bp, D. melanogaster
ctgcacctgtatct

SEQ ID NO: 614733 - DNA, 13 bp, D. melanogaster
ctgcaccttcata

SEQ ID NO: 614734 - DNA, 13 bp, D. melanogaster
ctgcactcaaaaa

SEQ ID NO: 614735 - DNA, 13 bp, D. melanogaster
ctgcactcaattt

SEQ ID NO: 614736 - DNA, 13 bp, D. melanogaster
ctgcactcagaaa

SEQ ID NO: 614737 - DNA, 14 bp, D. melanogaster
ctgcactcgaaaaa

SEQ ID NO: 614738 - DNA, 13 bp, D. melanogaster
ctgcactgagaaa

SEQ ID NO: 614739 - DNA, 14 bp, D. melanogaster
ctgcactgcactgc

SEQ ID NO: 614740 - DNA, 13 bp, D. melanogaster
ctgcactgcagca

SEQ ID NO: 614741 - DNA, 13 bp, D. melanogaster
ctgcactgcatcc

SEQ ID NO: 614742 - DNA, 13 bp, D. melanogaster
ctgcactgccagc

SEQ ID NO: 614743 - DNA, 13 bp, D. melanogaster
ctgcactgcgaaa

SEQ ID NO: 614744 - DNA, 13 bp, D. melanogaster
ctgcactgcgaga

SEQ ID NO: 614745 - DNA, 13 bp, D. melanogaster
ctgcactggcctt

SEQ ID NO: 614746 - DNA, 13 bp, D. melanogaster
ctgcactgggaaa

SEQ ID NO: 614747 - DNA, 13 bp, D. melanogaster
ctgcacttaatga

SEQ ID NO: 614748 - DNA, 13 bp, D. melanogaster
ctgcacttccgct

SEQ ID NO: 614749 - DNA, 13 bp, D. melanogaster
ctgcacttcctgc

SEQ ID NO: 614750 - DNA, 13 bp, D. melanogaster
ctgcacttgacac

SEQ ID NO: 614751 - DNA, 13 bp, D. melanogaster
ctgcacttgcaaa

SEQ ID NO: 614752 - DNA, 13 bp, D. melanogaster
ctgcacttgcaac

SEQ ID NO: 614753 - DNA, 13 bp, D. melanogaster
ctgcacttgcatt

SEQ ID NO: 614754 - DNA, 13 bp, D. melanogaster
ctgcacttgctgc

SEQ ID NO: 614755 - DNA, 13 bp, D. melanogaster
ctgcactttattt

SEQ ID NO: 614756 - DNA, 13 bp, D. melanogaster
ctgcactttgaaa

SEQ ID NO: 614757 - DNA, 13 bp, D. melanogaster
ctgcacttttgca

SEQ ID NO: 614758 - DNA, 13 bp, D. melanogaster
ctgcactttttca

SEQ ID NO: 614759 - DNA, 14 bp, D. melanogaster
ctgcactttttttt

SEQ ID NO: 614760 - DNA, 13 bp, D. melanogaster
ctgcagaaaacgg

SEQ ID NO: 614761 - DNA, 13 bp, D. melanogaster
ctgcagaatcaga

SEQ ID NO: 614762 - DNA, 13 bp, D. melanogaster
ctgcagaatgtgg

SEQ ID NO: 614763 - DNA, 14 bp, D. melanogaster
ctgcagaatgtggc

SEQ ID NO: 614764 - DNA, 13 bp, D. melanogaster
ctgcagagccacc

SEQ ID NO: 614765 - DNA, 13 bp, D. melanogaster
ctgcagagccata

SEQ ID NO: 614766 - DNA, 14 bp, D. melanogaster
ctgcagagtcgatt

SEQ ID NO: 614767 - DNA, 13 bp, D. melanogaster
ctgcagatgcaga

SEQ ID NO: 614768 - DNA, 13 bp, D. melanogaster
ctgcagatggaaa

SEQ ID NO: 614769 - DNA, 13 bp, D. melanogaster
ctgcagcaacaaa

SEQ ID NO: 614770 - DNA, 13 bp, D. melanogaster
ctgcagcaactgc

SEQ ID NO: 614771 - DNA, 13 bp, D. melanogaster
ctgcagcagcaaa

SEQ ID NO: 614772 - DNA, 13 bp, D. melanogaster
ctgcagcagcagt

SEQ ID NO: 614773 - DNA, 13 bp, D. melanogaster
ctgcagcagcgac

SEQ ID NO: 614774 - DNA, 13 bp, D. melanogaster
ctgcagcagctgc

SEQ ID NO: 614775 - DNA, 13 bp, D. melanogaster
ctgcagcaggagc

SEQ ID NO: 614776 - DNA, 14 bp, D. melanogaster
ctgcagcaggagca

SEQ ID NO: 614777 - DNA, 13 bp, D. melanogaster
ctgcagcatatgc

SEQ ID NO: 614778 - DNA, 13 bp, D. melanogaster
ctgcagcccgcca

SEQ ID NO: 614779 - DNA, 13 bp, D. melanogaster
ctgcagcgaggga

SEQ ID NO: 614780 - DNA, 13 bp, D. melanogaster
ctgcagctgaaaa

SEQ ID NO: 614781 - DNA, 13 bp, D. melanogaster
ctgcagctgcaac

SEQ ID NO: 614782 - DNA, 14 bp, D. melanogaster
ctgcagctgcaaca

SEQ ID NO: 614783 - DNA, 13 bp, D. melanogaster
ctgcagctgcaat

SEQ ID NO: 614784 - DNA, 13 bp, D. melanogaster
ctgcagctgcgtg

SEQ ID NO: 614785 - DNA, 13 bp, D. melanogaster
ctgcagctgctgt

SEQ ID NO: 614786 - DNA, 13 bp, D. melanogaster
ctgcagctgtgtg

SEQ ID NO: 614787 - DNA, 13 bp, D. melanogaster
ctgcagctgttgc

SEQ ID NO: 614788 - DNA, 13 bp, D. melanogaster
ctgcagcttcagc

SEQ ID NO: 614789 - DNA, 13 bp, D. melanogaster
ctgcaggagctgc

SEQ ID NO: 614790 - DNA, 13 bp, D. melanogaster
ctgcaggcaatgc

SEQ ID NO: 614791 - DNA, 13 bp, D. melanogaster
ctgcaggtatacg

SEQ ID NO: 614792 - DNA, 13 bp, D. melanogaster
ctgcagtaaataa

SEQ ID NO: 614793 - DNA, 13 bp, D. melanogaster
ctgcagtcaaaag

SEQ ID NO: 614794 - DNA, 13 bp, D. melanogaster
ctgcagtcgctag

SEQ ID NO: 614795 - DNA, 13 bp, D. melanogaster
ctgcagttcctag

SEQ ID NO: 614796 - DNA, 13 bp, D. melanogaster
ctgcagttctctg

SEQ ID NO: 614797 - DNA, 14 bp, D. melanogaster
ctgcagttctctgg

SEQ ID NO: 614798 - DNA, 13 bp, D. melanogaster
ctgcagttctgca

SEQ ID NO: 614799 - DNA, 13 bp, D. melanogaster
ctgcagttctttg

SEQ ID NO: 614800 - DNA, 13 bp, D. melanogaster
ctgcagttgcaaa

SEQ ID NO: 614801 - DNA, 14 bp, D. melanogaster
ctgcagttgcaact

SEQ ID NO: 614802 - DNA, 14 bp, D. melanogaster
ctgcagttgcagct

SEQ ID NO: 614803 - DNA, 14 bp, D. melanogaster
ctgcagttgcagtt

SEQ ID NO: 614804 - DNA, 13 bp, D. melanogaster
ctgcagttgcatt

SEQ ID NO: 614805 - DNA, 13 bp, D. melanogaster
ctgcagttgccgc

SEQ ID NO: 614806 - DNA, 14 bp, D. melanogaster
ctgcagttgctgtt

SEQ ID NO: 614807 - DNA, 14 bp, D. melanogaster
ctgcagtttattat

SEQ ID NO: 614808 - DNA, 13 bp, D. melanogaster
ctgcagtttgttt

SEQ ID NO: 614809 - DNA, 13 bp, D. melanogaster
ctgcagttttccc

SEQ ID NO: 614810 - DNA, 13 bp, D. melanogaster
ctgcagtttttca

SEQ ID NO: 614811 - DNA, 13 bp, D. melanogaster
ctgcataaataaa

SEQ ID NO: 614812 - DNA, 13 bp, D. melanogaster
ctgcataaatatt

SEQ ID NO: 614813 - DNA, 13 bp, D. melanogaster
ctgcataaatttt

SEQ ID NO: 614814 - DNA, 13 bp, D. melanogaster
ctgcatacgaaat

SEQ ID NO: 614815 - DNA, 13 bp, D. melanogaster
ctgcatactcatt

SEQ ID NO: 614816 - DNA, 13 bp, D. melanogaster
ctgcatactttcg

SEQ ID NO: 614817 - DNA, 13 bp, D. melanogaster
ctgcatactttta

SEQ ID NO: 614818 - DNA, 13 bp, D. melanogaster
ctgcatatgcata

SEQ ID NO: 614819 - DNA, 14 bp, D. melanogaster
ctgcatatgttaaa

SEQ ID NO: 614820 - DNA, 13 bp, D. melanogaster
ctgcatatttaat

SEQ ID NO: 614821 - DNA, 13 bp, D. melanogaster
ctgcatcatcatc

SEQ ID NO: 614822 - DNA, 14 bp, D. melanogaster
ctgcatcctgcatc

SEQ ID NO: 614823 - DNA, 13 bp, D. melanogaster
ctgcatcggcaag

SEQ ID NO: 614824 - DNA, 13 bp, D. melanogaster
ctgcatctgcaac

SEQ ID NO: 614825 - DNA, 14 bp, D. melanogaster
ctgcatctgcagct

SEQ ID NO: 614826 - DNA, 13 bp, D. melanogaster
ctgcatctgcatc

SEQ ID NO: 614827 - DNA, 14 bp, D. melanogaster
ctgcatctgcatcc

SEQ ID NO: 614828 - DNA, 13 bp, D. melanogaster
ctgcatctgcatt

SEQ ID NO: 614829 - DNA, 13 bp, D. melanogaster
ctgcatctgtatc

SEQ ID NO: 614830 - DNA, 13 bp, D. melanogaster
ctgcatgcaaatt

SEQ ID NO: 614831 - DNA, 13 bp, D. melanogaster
ctgcatgcggcgc

SEQ ID NO: 614832 - DNA, 14 bp, D. melanogaster
ctgcatgcggcgca

SEQ ID NO: 614833 - DNA, 13 bp, D. melanogaster
ctgcatgctgcat

SEQ ID NO: 614834 - DNA, 13 bp, D. melanogaster
ctgcatgtgtatg

SEQ ID NO: 614835 - DNA, 13 bp, D. melanogaster
ctgcatgtgtgcg

SEQ ID NO: 614836 - DNA, 13 bp, D. melanogaster
ctgcatgtgtgtg

SEQ ID NO: 614837 - DNA, 13 bp, D. melanogaster
ctgcattaaaaaa

SEQ ID NO: 614838 - DNA, 13 bp, D. melanogaster
ctgcattcaaaat

SEQ ID NO: 614839 - DNA, 13 bp, D. melanogaster
ctgcattcccatt

SEQ ID NO: 614840 - DNA, 13 bp, D. melanogaster
ctgcattctgcat

SEQ ID NO: 614841 - DNA, 13 bp, D. melanogaster
ctgcattgaaagt

SEQ ID NO: 614842 - DNA, 13 bp, D. melanogaster
ctgcattgttgtt

SEQ ID NO: 614843 - DNA, 13 bp, D. melanogaster
ctgcatttaaaaa

SEQ ID NO: 614844 - DNA, 13 bp, D. melanogaster
ctgcatttaaatt

SEQ ID NO: 614845 - DNA, 13 bp, D. melanogaster
ctgcatttaagca

SEQ ID NO: 614846 - DNA, 13 bp, D. melanogaster
ctgcatttaagct

SEQ ID NO: 614847 - DNA, 13 bp, D. melanogaster
ctgcatttaataa

SEQ ID NO: 614848 - DNA, 13 bp, D. melanogaster
ctgcatttcgatt

SEQ ID NO: 614849 - DNA, 13 bp, D. melanogaster
ctgcatttgcatt

SEQ ID NO: 614850 - DNA, 14 bp, D. melanogaster
ctgcatttgcattt

SEQ ID NO: 614851 - DNA, 13 bp, D. melanogaster
ctgcatttgtatg

SEQ ID NO: 614852 - DNA, 13 bp, D. melanogaster
ctgcatttgtgca

SEQ ID NO: 614853 - DNA, 13 bp, D. melanogaster
ctgcatttgttta

SEQ ID NO: 614854 - DNA, 14 bp, D. melanogaster
ctgcattttgacac

SEQ ID NO: 614855 - DNA, 13 bp, D. melanogaster
ctgcattttggca

SEQ ID NO: 614856 - DNA, 13 bp, D. melanogaster
ctgcattttggcc

SEQ ID NO: 614857 - DNA, 13 bp, D. melanogaster
ctgcattttggtt

SEQ ID NO: 614858 - DNA, 13 bp, D. melanogaster
ctgcatttttcat

SEQ ID NO: 614859 - DNA, 13 bp, D. melanogaster
ctgccaaaaagtt

SEQ ID NO: 614860 - DNA, 13 bp, D. melanogaster
ctgccaaaatggt

SEQ ID NO: 614861 - DNA, 13 bp, D. melanogaster
ctgccaaatacta

SEQ ID NO: 614862 - DNA, 13 bp, D. melanogaster
ctgccaaatgcca

SEQ ID NO: 614863 - DNA, 13 bp, D. melanogaster
ctgccaaatggaa

SEQ ID NO: 614864 - DNA, 13 bp, D. melanogaster
ctgccaacaattc

SEQ ID NO: 614865 - DNA, 13 bp, D. melanogaster
ctgccaactgcaa

SEQ ID NO: 614866 - DNA, 13 bp, D. melanogaster
ctgccaactgcca

SEQ ID NO: 614867 - DNA, 13 bp, D. melanogaster
ctgccaactggca

SEQ ID NO: 614868 - DNA, 13 bp, D. melanogaster
ctgccaactttaa

SEQ ID NO: 614869 - DNA, 13 bp, D. melanogaster
ctgccaacttttc

SEQ ID NO: 614870 - DNA, 13 bp, D. melanogaster
ctgccaagagtat

SEQ ID NO: 614871 - DNA, 13 bp, D. melanogaster
ctgccaagatcag

SEQ ID NO: 614872 - DNA, 13 bp, D. melanogaster
ctgccaagtcgag

SEQ ID NO: 614873 - DNA, 13 bp, D. melanogaster
ctgccaagtgcca

SEQ ID NO: 614874 - DNA, 13 bp, D. melanogaster
ctgccaagtggaa

SEQ ID NO: 614875 - DNA, 13 bp, D. melanogaster
ctgccaagtggct

SEQ ID NO: 614876 - DNA, 13 bp, D. melanogaster
ctgccaatccctt

SEQ ID NO: 614877 - DNA, 13 bp, D. melanogaster
ctgccaattgcca

SEQ ID NO: 614878 - DNA, 13 bp, D. melanogaster
ctgccacaaaatg

SEQ ID NO: 614879 - DNA, 13 bp, D. melanogaster
ctgccacaaattg

SEQ ID NO: 614880 - DNA, 13 bp, D. melanogaster
ctgccacaacatc

SEQ ID NO: 614881 - DNA, 13 bp, D. melanogaster
ctgccacacacac

SEQ ID NO: 614882 - DNA, 13 bp, D. melanogaster
ctgccacacacca

SEQ ID NO: 614883 - DNA, 13 bp, D. melanogaster
ctgccacacccac

SEQ ID NO: 614884 - DNA, 13 bp, D. melanogaster
ctgccacccaaaa

SEQ ID NO: 614885 - DNA, 13 bp, D. melanogaster
ctgccacccacca

SEQ ID NO: 614886 - DNA, 13 bp, D. melanogaster
ctgccacccactt

SEQ ID NO: 614887 - DNA, 14 bp, D. melanogaster
ctgccacgcccaca

SEQ ID NO: 614888 - DNA, 14 bp, D. melanogaster
ctgccacgcccacc

SEQ ID NO: 614889 - DNA, 14 bp, D. melanogaster
ctgccacgcccact

SEQ ID NO: 614890 - DNA, 15 bp, D. melanogaster
ctgccacgcccactt

SEQ ID NO: 614891 - DNA, 14 bp, D. melanogaster
ctgccacgcccatt

SEQ ID NO: 614892 - DNA, 14 bp, D. melanogaster
ctgccacgccccca

SEQ ID NO: 614893 - DNA, 14 bp, D. melanogaster
ctgccacgccccct

SEQ ID NO: 614894 - DNA, 13 bp, D. melanogaster
ctgccacgcccct

SEQ ID NO: 614895 - DNA, 14 bp, D. melanogaster
ctgccacgcccctc

SEQ ID NO: 614896 - DNA, 14 bp, D. melanogaster
ctgccacgcccctt

SEQ ID NO: 614897 - DNA, 13 bp, D. melanogaster
ctgccacgccctc

SEQ ID NO: 614898 - DNA, 13 bp, D. melanogaster
ctgccacgccctt

SEQ ID NO: 614899 - DNA, 13 bp, D. melanogaster
ctgccacgcctcc

SEQ ID NO: 614900 - DNA, 13 bp, D. melanogaster
ctgccactcccac

SEQ ID NO: 614901 - DNA, 14 bp, D. melanogaster
ctgccactccccct

SEQ ID NO: 614902 - DNA, 13 bp, D. melanogaster
ctgccactgacag

SEQ ID NO: 614903 - DNA, 13 bp, D. melanogaster
ctgccactgcaac

SEQ ID NO: 614904 - DNA, 13 bp, D. melanogaster
ctgccactgccaa

SEQ ID NO: 614905 - DNA, 13 bp, D. melanogaster
ctgccactgccac

SEQ ID NO: 614906 - DNA, 14 bp, D. melanogaster
ctgccactgccaca

SEQ ID NO: 614907 - DNA, 13 bp, D. melanogaster
ctgccactgccgc

SEQ ID NO: 614908 - DNA, 14 bp, D. melanogaster
ctgccactgctgct

SEQ ID NO: 614909 - DNA, 13 bp, D. melanogaster
ctgccactggcac

SEQ ID NO: 614910 - DNA, 14 bp, D. melanogaster
ctgccacttccact

SEQ ID NO: 614911 - DNA, 13 bp, D. melanogaster
ctgccacttctgg

SEQ ID NO: 614912 - DNA, 13 bp, D. melanogaster
ctgccacttgcca

SEQ ID NO: 614913 - DNA, 13 bp, D. melanogaster
ctgccagacctga

SEQ ID NO: 614914 - DNA, 13 bp, D. melanogaster
ctgccagagaagg

SEQ ID NO: 614915 - DNA, 13 bp, D. melanogaster
ctgccagattttg

SEQ ID NO: 614916 - DNA, 13 bp, D. melanogaster
ctgccagcagcag

SEQ ID NO: 614917 - DNA, 13 bp, D. melanogaster
ctgccagccagat

SEQ ID NO: 614918 - DNA, 13 bp, D. melanogaster
ctgccagccagcc

SEQ ID NO: 614919 - DNA, 13 bp, D. melanogaster
ctgccagccattt

SEQ ID NO: 614920 - DNA, 13 bp, D. melanogaster
ctgccagcgaaaa

SEQ ID NO: 614921 - DNA, 13 bp, D. melanogaster
ctgccagctgaaa

SEQ ID NO: 614922 - DNA, 13 bp, D. melanogaster
ctgccagctgcca

SEQ ID NO: 614923 - DNA, 13 bp, D. melanogaster
ctgccagctgctg

SEQ ID NO: 614924 - DNA, 13 bp, D. melanogaster
ctgccaggagcag

SEQ ID NO: 614925 - DNA, 13 bp, D. melanogaster
ctgccagtggcat

SEQ ID NO: 614926 - DNA, 13 bp, D. melanogaster
ctgccagtgtgtg

SEQ ID NO: 614927 - DNA, 13 bp, D. melanogaster
ctgccagttggca

SEQ ID NO: 614928 - DNA, 13 bp, D. melanogaster
ctgccatacgtcg

SEQ ID NO: 614929 - DNA, 13 bp, D. melanogaster
ctgccatatttgc

SEQ ID NO: 614930 - DNA, 13 bp, D. melanogaster
ctgccatattttt

SEQ ID NO: 614931 - DNA, 13 bp, D. melanogaster
ctgccatccgctg

SEQ ID NO: 614932 - DNA, 13 bp, D. melanogaster
ctgccatcctgcc

SEQ ID NO: 614933 - DNA, 13 bp, D. melanogaster
ctgccatggttaa

SEQ ID NO: 614934 - DNA, 13 bp, D. melanogaster
ctgccattcagat

SEQ ID NO: 614935 - DNA, 13 bp, D. melanogaster
ctgccattgtctt

SEQ ID NO: 614936 - DNA, 13 bp, D. melanogaster
ctgccattgtgtt

SEQ ID NO: 614937 - DNA, 13 bp, D. melanogaster
ctgccattgttgc

SEQ ID NO: 614938 - DNA, 13 bp, D. melanogaster
ctgccattgtttt

SEQ ID NO: 614939 - DNA, 13 bp, D. melanogaster
ctgccatttcccc

SEQ ID NO: 614940 - DNA, 13 bp, D. melanogaster
ctgccatttgcca

SEQ ID NO: 614941 - DNA, 13 bp, D. melanogaster
ctgccattttcca

SEQ ID NO: 614942 - DNA, 13 bp, D. melanogaster
ctgccattttgtg

SEQ ID NO: 614943 - DNA, 13 bp, D. melanogaster
ctgcccaataagc

SEQ ID NO: 614944 - DNA, 13 bp, D. melanogaster
ctgcccaccgcgc

SEQ ID NO: 614945 - DNA, 13 bp, D. melanogaster
ctgcccactgccc

SEQ ID NO: 614946 - DNA, 13 bp, D. melanogaster
ctgccccaaaaaa

SEQ ID NO: 614947 - DNA, 13 bp, D. melanogaster
ctgccccaaaaac

SEQ ID NO: 614948 - DNA, 13 bp, D. melanogaster
ctgccccattcca

SEQ ID NO: 614949 - DNA, 13 bp, D. melanogaster
ctgccccccaaaa

SEQ ID NO: 614950 - DNA, 13 bp, D. melanogaster
ctgcccctgccac

SEQ ID NO: 614951 - DNA, 13 bp, D. melanogaster
ctgccgaaaataa

SEQ ID NO: 614952 - DNA, 13 bp, D. melanogaster
ctgccgcacaaaa

SEQ ID NO: 614953 - DNA, 13 bp, D. melanogaster
ctgccgcagcagc

SEQ ID NO: 614954 - DNA, 13 bp, D. melanogaster
ctgccgcccactt

SEQ ID NO: 614955 - DNA, 13 bp, D. melanogaster
ctgccgccgtcgc

SEQ ID NO: 614956 - DNA, 13 bp, D. melanogaster
ctgccgcctgcca

SEQ ID NO: 614957 - DNA, 13 bp, D. melanogaster
ctgccgctcctgg

SEQ ID NO: 614958 - DNA, 14 bp, D. melanogaster
ctgccgctcctggc

SEQ ID NO: 614959 - DNA, 13 bp, D. melanogaster
ctgccgctcttaa

SEQ ID NO: 614960 - DNA, 13 bp, D. melanogaster
ctgccgctgcaac

SEQ ID NO: 614961 - DNA, 13 bp, D. melanogaster
ctgccgctgcagc

SEQ ID NO: 614962 - DNA, 13 bp, D. melanogaster
ctgccgctgccac

SEQ ID NO: 614963 - DNA, 14 bp, D. melanogaster
ctgccgctgttgct

SEQ ID NO: 614964 - DNA, 13 bp, D. melanogaster
ctgccgcttttcc

SEQ ID NO: 614965 - DNA, 13 bp, D. melanogaster
ctgccggcgtcgc

SEQ ID NO: 614966 - DNA, 14 bp, D. melanogaster
ctgccggcgtcgct

SEQ ID NO: 614967 - DNA, 13 bp, D. melanogaster
ctgccggggggaa

SEQ ID NO: 614968 - DNA, 13 bp, D. melanogaster
ctgcctaagaatg

SEQ ID NO: 614969 - DNA, 13 bp, D. melanogaster
ctgcctccgagtg

SEQ ID NO: 614970 - DNA, 14 bp, D. melanogaster
ctgcctccgagtgc

SEQ ID NO: 614971 - DNA, 13 bp, D. melanogaster
ctgcctcgagtac

SEQ ID NO: 614972 - DNA, 13 bp, D. melanogaster
ctgcctcgtcatc

SEQ ID NO: 614973 - DNA, 13 bp, D. melanogaster
ctgcctctgccgc

SEQ ID NO: 614974 - DNA, 14 bp, D. melanogaster
ctgcctctgcctct

SEQ ID NO: 614975 - DNA, 14 bp, D. melanogaster
ctgcctctgctgct

SEQ ID NO: 614976 - DNA, 13 bp, D. melanogaster
ctgcctgccacac

SEQ ID NO: 614977 - DNA, 13 bp, D. melanogaster
ctgcctgccagcc

SEQ ID NO: 614978 - DNA, 13 bp, D. melanogaster
ctgcctgcctgca

SEQ ID NO: 614979 - DNA, 13 bp, D. melanogaster
ctgcctgcctgcc

SEQ ID NO: 614980 - DNA, 14 bp, D. melanogaster
ctgcctgcctgccg

SEQ ID NO: 614981 - DNA, 13 bp, D. melanogaster
ctgcctgcctgct

SEQ ID NO: 614982 - DNA, 13 bp, D. melanogaster
ctgcctgcctggc

SEQ ID NO: 614983 - DNA, 13 bp, D. melanogaster
ctgcctgcgtgca

SEQ ID NO: 614984 - DNA, 13 bp, D. melanogaster
ctgcctgctgcca

SEQ ID NO: 614985 - DNA, 13 bp, D. melanogaster
ctgcctgctgcct

SEQ ID NO: 614986 - DNA, 14 bp, D. melanogaster
ctgcctgctgcctt

SEQ ID NO: 614987 - DNA, 13 bp, D. melanogaster
ctgcctgctgctg

SEQ ID NO: 614988 - DNA, 13 bp, D. melanogaster
ctgcctggctggc

SEQ ID NO: 614989 - DNA, 13 bp, D. melanogaster
ctgcctggtgcgg

SEQ ID NO: 614990 - DNA, 13 bp, D. melanogaster
ctgcctgtccgtc

SEQ ID NO: 614991 - DNA, 13 bp, D. melanogaster
ctgcctgtctgtc

SEQ ID NO: 614992 - DNA, 13 bp, D. melanogaster
ctgcctgttctac

SEQ ID NO: 614993 - DNA, 13 bp, D. melanogaster
ctgccttcaactt

SEQ ID NO: 614994 - DNA, 13 bp, D. melanogaster
ctgccttctgcct

SEQ ID NO: 614995 - DNA, 13 bp, D. melanogaster
ctgccttggggga

SEQ ID NO: 614996 - DNA, 13 bp, D. melanogaster
ctgcctttgattt

SEQ ID NO: 614997 - DNA, 13 bp, D. melanogaster
ctgcctttgtgtg

SEQ ID NO: 614998 - DNA, 13 bp, D. melanogaster
ctgccttttaatt

SEQ ID NO: 614999 - DNA, 13 bp, D. melanogaster
ctgccttttggcc

SEQ ID NO: 615000 - DNA, 13 bp, D. melanogaster
ctgccttttggct

SEQ ID NO: 615001 - DNA, 13 bp, D. melanogaster
ctgccttttgttg

SEQ ID NO: 615002 - DNA, 13 bp, D. melanogaster
ctgcctttttggg

SEQ ID NO: 615003 - DNA, 13 bp, D. melanogaster
ctgcctttttgtg

SEQ ID NO: 615004 - DNA, 14 bp, D. melanogaster
ctgcgaaaacgttt

SEQ ID NO: 615005 - DNA, 13 bp, D. melanogaster
ctgcgaaaattgt

SEQ ID NO: 615006 - DNA, 13 bp, D. melanogaster
ctgcgaaatgaaa

SEQ ID NO: 615007 - DNA, 13 bp, D. melanogaster
ctgcgaacgcatc

SEQ ID NO: 615008 - DNA, 13 bp, D. melanogaster
ctgcgaactagga

SEQ ID NO: 615009 - DNA, 13 bp, D. melanogaster
ctgcgaaggaatc

SEQ ID NO: 615010 - DNA, 13 bp, D. melanogaster
ctgcgaatgcaaa

SEQ ID NO: 615011 - DNA, 13 bp, D. melanogaster
ctgcgaatgcgaa

SEQ ID NO: 615012 - DNA, 13 bp, D. melanogaster
ctgcgaatgcgga

SEQ ID NO: 615013 - DNA, 14 bp, D. melanogaster
ctgcgaattcaaaa

SEQ ID NO: 615014 - DNA, 13 bp, D. melanogaster
ctgcgacaaaaaa

SEQ ID NO: 615015 - DNA, 13 bp, D. melanogaster
ctgcgacgccgac

SEQ ID NO: 615016 - DNA, 13 bp, D. melanogaster
ctgcgactgcgac

SEQ ID NO: 615017 - DNA, 13 bp, D. melanogaster
ctgcgactgcgcc

SEQ ID NO: 615018 - DNA, 13 bp, D. melanogaster
ctgcgactgcggc

SEQ ID NO: 615019 - DNA, 13 bp, D. melanogaster
ctgcgactgctgc

SEQ ID NO: 615020 - DNA, 13 bp, D. melanogaster
ctgcgactgggac

SEQ ID NO: 615021 - DNA, 13 bp, D. melanogaster
ctgcgactgtgac

SEQ ID NO: 615022 - DNA, 13 bp, D. melanogaster
ctgcgagatttgt

SEQ ID NO: 615023 - DNA, 13 bp, D. melanogaster
ctgcgaggatacg

SEQ ID NO: 615024 - DNA, 13 bp, D. melanogaster
ctgcgcacacaca

SEQ ID NO: 615025 - DNA, 13 bp, D. melanogaster
ctgcgcagatggc

SEQ ID NO: 615026 - DNA, 13 bp, D. melanogaster
ctgcgcagctggg

SEQ ID NO: 615027 - DNA, 14 bp, D. melanogaster
ctgcgcagctggga

SEQ ID NO: 615028 - DNA, 13 bp, D. melanogaster
ctgcgcaggcgca

SEQ ID NO: 615029 - DNA, 13 bp, D. melanogaster
ctgcgcatgcgca

SEQ ID NO: 615030 - DNA, 13 bp, D. melanogaster
ctgcgcatgcgcg

SEQ ID NO: 615031 - DNA, 13 bp, D. melanogaster
ctgcgcatgcgtg

SEQ ID NO: 615032 - DNA, 13 bp, D. melanogaster
ctgcgcatgcttg

SEQ ID NO: 615033 - DNA, 13 bp, D. melanogaster
ctgcgccagttaa

SEQ ID NO: 615034 - DNA, 13 bp, D. melanogaster
ctgcgccatgtga

SEQ ID NO: 615035 - DNA, 14 bp, D. melanogaster
ctgcgccgccgtcg

SEQ ID NO: 615036 - DNA, 13 bp, D. melanogaster
ctgcgccgctgcc

SEQ ID NO: 615037 - DNA, 13 bp, D. melanogaster
ctgcgcctgcgca

SEQ ID NO: 615038 - DNA, 13 bp, D. melanogaster
ctgcgcctgctcg

SEQ ID NO: 615039 - DNA, 13 bp, D. melanogaster
ctgcgctgcaatc

SEQ ID NO: 615040 - DNA, 13 bp, D. melanogaster
ctgcgctgcatat

SEQ ID NO: 615041 - DNA, 13 bp, D. melanogaster
ctgcgctgccaaa

SEQ ID NO: 615042 - DNA, 13 bp, D. melanogaster
ctgcgctgccggg

SEQ ID NO: 615043 - DNA, 13 bp, D. melanogaster
ctgcgctgcctgc

SEQ ID NO: 615044 - DNA, 13 bp, D. melanogaster
ctgcgctgcgccg

SEQ ID NO: 615045 - DNA, 13 bp, D. melanogaster
ctgcgctgcgctg

SEQ ID NO: 615046 - DNA, 13 bp, D. melanogaster
ctgcgctgctgct

SEQ ID NO: 615047 - DNA, 13 bp, D. melanogaster
ctgcgctgctttt

SEQ ID NO: 615048 - DNA, 13 bp, D. melanogaster
ctgcgctttattt

SEQ ID NO: 615049 - DNA, 13 bp, D. melanogaster
ctgcggaaacaaa

SEQ ID NO: 615050 - DNA, 13 bp, D. melanogaster
ctgcggcagaggc

SEQ ID NO: 615051 - DNA, 13 bp, D. melanogaster
ctgcggcagcaac

SEQ ID NO: 615052 - DNA, 13 bp, D. melanogaster
ctgcggcggctgc

SEQ ID NO: 615053 - DNA, 13 bp, D. melanogaster
ctgcggctgcggc

SEQ ID NO: 615054 - DNA, 13 bp, D. melanogaster
ctgcggctgctgc

SEQ ID NO: 615055 - DNA, 13 bp, D. melanogaster
ctgcggctgtggc

SEQ ID NO: 615056 - DNA, 13 bp, D. melanogaster
ctgcggctgttgc

SEQ ID NO: 615057 - DNA, 13 bp, D. melanogaster
ctgcgggggcaat

SEQ ID NO: 615058 - DNA, 13 bp, D. melanogaster
ctgcgtcgacgtc

SEQ ID NO: 615059 - DNA, 13 bp, D. melanogaster
ctgcgtctgtgtg

SEQ ID NO: 615060 - DNA, 186 bp, D. melanogaster
ctgcgtgataacatccaaggtatcacgaagcctgctatccgccgtttggcccgtcgaggcggtgtgaagcgcatatctggactcatatacgaggaaacgcgtggcgttctgaaggttttcttggagaacgtaattcgtgatgccgtgacctacacggaacacgccaagaggaagacagttacagcc

SEQ ID NO: 615061 - DNA, 13 bp, D. melanogaster
ctgcgtgcataaa

SEQ ID NO: 615062 - DNA, 13 bp, D. melanogaster
ctgcgtgcgtgtg

SEQ ID NO: 615063 - DNA, 13 bp, D. melanogaster
ctgcgtgctctta

SEQ ID NO: 615064 - DNA, 13 bp, D. melanogaster
ctgcgtgtgcgtg

SEQ ID NO: 615065 - DNA, 13 bp, D. melanogaster
ctgcgtttactgg

SEQ ID NO: 615066 - DNA, 13 bp, D. melanogaster
ctgcgtttcataa

SEQ ID NO: 615067 - DNA, 13 bp, D. melanogaster
ctgcgtttgggat

SEQ ID NO: 615068 - DNA, 13 bp, D. melanogaster
ctgcgtttgtgtt

SEQ ID NO: 615069 - DNA, 13 bp, D. melanogaster
ctgcgttttatct

SEQ ID NO: 615070 - DNA, 13 bp, D. melanogaster
ctgcgttttgtgt

SEQ ID NO: 615071 - DNA, 13 bp, D. melanogaster
ctgctaaaaatgc

SEQ ID NO: 615072 - DNA, 13 bp, D. melanogaster
ctgctaaaatatt

SEQ ID NO: 615073 - DNA, 13 bp, D. melanogaster
ctgctaaagaaaa

SEQ ID NO: 615074 - DNA, 13 bp, D. melanogaster
ctgctaaagtttc

SEQ ID NO: 615075 - DNA, 13 bp, D. melanogaster
ctgctaataaaaa

SEQ ID NO: 615076 - DNA, 13 bp, D. melanogaster
ctgctaattgcca

SEQ ID NO: 615077 - DNA, 13 bp, D. melanogaster
ctgctacgcccac

SEQ ID NO: 615078 - DNA, 13 bp, D. melanogaster
ctgctactactac

SEQ ID NO: 615079 - DNA, 13 bp, D. melanogaster
ctgctactactgc

SEQ ID NO: 615080 - DNA, 13 bp, D. melanogaster
ctgctactcctgc

SEQ ID NO: 615081 - DNA, 13 bp, D. melanogaster
ctgctactgctac

SEQ ID NO: 615082 - DNA, 14 bp, D. melanogaster
ctgctactgctact

SEQ ID NO: 615083 - DNA, 13 bp, D. melanogaster
ctgctacttctgc

SEQ ID NO: 615084 - DNA, 13 bp, D. melanogaster
ctgctatcactgt

SEQ ID NO: 615085 - DNA, 13 bp, D. melanogaster
ctgctcaaatatt

SEQ ID NO: 615086 - DNA, 13 bp, D. melanogaster
ctgctcaatttgt

SEQ ID NO: 615087 - DNA, 13 bp, D. melanogaster
ctgctcacacaca

SEQ ID NO: 615088 - DNA, 14 bp, D. melanogaster
ctgctcacatgcaa

SEQ ID NO: 615089 - DNA, 13 bp, D. melanogaster
ctgctcactgctc

SEQ ID NO: 615090 - DNA, 13 bp, D. melanogaster
ctgctcattgttt

SEQ ID NO: 615091 - DNA, 13 bp, D. melanogaster
ctgctccacatcc

SEQ ID NO: 615092 - DNA, 14 bp, D. melanogaster
ctgctccacatttt

SEQ ID NO: 615093 - DNA, 13 bp, D. melanogaster
ctgctccactttt

SEQ ID NO: 615094 - DNA, 13 bp, D. melanogaster
ctgctccagctcc

SEQ ID NO: 615095 - DNA, 14 bp, D. melanogaster
ctgctccagctcca

SEQ ID NO: 615096 - DNA, 13 bp, D. melanogaster
ctgctccaggttc

SEQ ID NO: 615097 - DNA, 13 bp, D. melanogaster
ctgctccctgatc

SEQ ID NO: 615098 - DNA, 13 bp, D. melanogaster
ctgctccggctgc

SEQ ID NO: 615099 - DNA, 13 bp, D. melanogaster
ctgctcctactcc

SEQ ID NO: 615100 - DNA, 13 bp, D. melanogaster
ctgctcctccgct

SEQ ID NO: 615101 - DNA, 13 bp, D. melanogaster
ctgctcctcctgc

SEQ ID NO: 615102 - DNA, 14 bp, D. melanogaster
ctgctcctcctgct

SEQ ID NO: 615103 - DNA, 13 bp, D. melanogaster
ctgctcctctgct

SEQ ID NO: 615104 - DNA, 13 bp, D. melanogaster
ctgctcctgccac

SEQ ID NO: 615105 - DNA, 13 bp, D. melanogaster
ctgctcctgccgc

SEQ ID NO: 615106 - DNA, 13 bp, D. melanogaster
ctgctcctgctcc

SEQ ID NO: 615107 - DNA, 14 bp, D. melanogaster
ctgctcctgctccg

SEQ ID NO: 615108 - DNA, 14 bp, D. melanogaster
ctgctcctgctcct

SEQ ID NO: 615109 - DNA, 15 bp, D. melanogaster
ctgctcctgctcctc

SEQ ID NO: 615110 - DNA, 13 bp, D. melanogaster
ctgctcctgctgc

SEQ ID NO: 615111 - DNA, 14 bp, D. melanogaster
ctgctcctgctgct

SEQ ID NO: 615112 - DNA, 13 bp, D. melanogaster
ctgctcctgctgt

SEQ ID NO: 615113 - DNA, 14 bp, D. melanogaster
ctgctcctgcttct

SEQ ID NO: 615114 - DNA, 13 bp, D. melanogaster
ctgctcctggtcc

SEQ ID NO: 615115 - DNA, 13 bp, D. melanogaster
ctgctcctgttcc

SEQ ID NO: 615116 - DNA, 14 bp, D. melanogaster
ctgctcctgttcct

SEQ ID NO: 615117 - DNA, 13 bp, D. melanogaster
ctgctcctgtttc

SEQ ID NO: 615118 - DNA, 13 bp, D. melanogaster
ctgctcctgtttg

SEQ ID NO: 615119 - DNA, 13 bp, D. melanogaster
ctgctccttctac

SEQ ID NO: 615120 - DNA, 13 bp, D. melanogaster
ctgctccttgctg

SEQ ID NO: 615121 - DNA, 13 bp, D. melanogaster
ctgctccttttgt

SEQ ID NO: 615122 - DNA, 13 bp, D. melanogaster
ctgctcgatgttg

SEQ ID NO: 615123 - DNA, 13 bp, D. melanogaster
ctgctcgcaaagg

SEQ ID NO: 615124 - DNA, 13 bp, D. melanogaster
ctgctcggctctg

SEQ ID NO: 615125 - DNA, 13 bp, D. melanogaster
ctgctctccattt

SEQ ID NO: 615126 - DNA, 13 bp, D. melanogaster
ctgctctctcgct

SEQ ID NO: 615127 - DNA, 13 bp, D. melanogaster
ctgctctgctccg

SEQ ID NO: 615128 - DNA, 13 bp, D. melanogaster
ctgctctgctcct

SEQ ID NO: 615129 - DNA, 13 bp, D. melanogaster
ctgctctgctgct

SEQ ID NO: 615130 - DNA, 13 bp, D. melanogaster
ctgctctgctttt

SEQ ID NO: 615131 - DNA, 13 bp, D. melanogaster
ctgctctgtttga

SEQ ID NO: 615132 - DNA, 13 bp, D. melanogaster
ctgctcttcaatt

SEQ ID NO: 615133 - DNA, 13 bp, D. melanogaster
ctgctcttggcca

SEQ ID NO: 615134 - DNA, 13 bp, D. melanogaster
ctgctcttttggc

SEQ ID NO: 615135 - DNA, 13 bp, D. melanogaster
ctgctgaaggtga

SEQ ID NO: 615136 - DNA, 13 bp, D. melanogaster
ctgctgaattttc

SEQ ID NO: 615137 - DNA, 13 bp, D. melanogaster
ctgctgagaactc

SEQ ID NO: 615138 - DNA, 13 bp, D. melanogaster
ctgctgataaaaa

SEQ ID NO: 615139 - DNA, 13 bp, D. melanogaster
ctgctgataagaa

SEQ ID NO: 615140 - DNA, 13 bp, D. melanogaster
ctgctgatgcagt

SEQ ID NO: 615141 - DNA, 14 bp, D. melanogaster
ctgctgatgctgat

SEQ ID NO: 615142 - DNA, 13 bp, D. melanogaster
ctgctgatgtttt

SEQ ID NO: 615143 - DNA, 13 bp, D. melanogaster
ctgctgattctcc

SEQ ID NO: 615144 - DNA, 13 bp, D. melanogaster
ctgctgattggaa

SEQ ID NO: 615145 - DNA, 14 bp, D. melanogaster
ctgctgattggaac

SEQ ID NO: 615146 - DNA, 13 bp, D. melanogaster
ctgctgattttcc

SEQ ID NO: 615147 - DNA, 13 bp, D. melanogaster
ctgctgcaacagc

SEQ ID NO: 615148 - DNA, 14 bp, D. melanogaster
ctgctgcaactgca

SEQ ID NO: 615149 - DNA, 13 bp, D. melanogaster
ctgctgcaatgaa

SEQ ID NO: 615150 - DNA, 13 bp, D. melanogaster
ctgctgcacttgc

SEQ ID NO: 615151 - DNA, 13 bp, D. melanogaster
ctgctgcagcaac

SEQ ID NO: 615152 - DNA, 14 bp, D. melanogaster
ctgctgcagcaaca

SEQ ID NO: 615153 - DNA, 13 bp, D. melanogaster
ctgctgcagcagc

SEQ ID NO: 615154 - DNA, 14 bp, D. melanogaster
ctgctgcagcagca

SEQ ID NO: 615155 - DNA, 13 bp, D. melanogaster
ctgctgcagctgc

SEQ ID NO: 615156 - DNA, 13 bp, D. melanogaster
ctgctgcagcttc

SEQ ID NO: 615157 - DNA, 13 bp, D. melanogaster
ctgctgcaggacg

SEQ ID NO: 615158 - DNA, 14 bp, D. melanogaster
ctgctgcagttgca

SEQ ID NO: 615159 - DNA, 13 bp, D. melanogaster
ctgctgcagttgg

SEQ ID NO: 615160 - DNA, 13 bp, D. melanogaster
ctgctgcagttgt

SEQ ID NO: 615161 - DNA, 13 bp, D. melanogaster
ctgctgcagtttc

SEQ ID NO: 615162 - DNA, 13 bp, D. melanogaster
ctgctgcagtttt

SEQ ID NO: 615163 - DNA, 13 bp, D. melanogaster
ctgctgcatctgc

SEQ ID NO: 615164 - DNA, 13 bp, D. melanogaster
ctgctgcatgttg

SEQ ID NO: 615165 - DNA, 13 bp, D. melanogaster
ctgctgccaaaaa

SEQ ID NO: 615166 - DNA, 14 bp, D. melanogaster
ctgctgccactgct

SEQ ID NO: 615167 - DNA, 13 bp, D. melanogaster
ctgctgccacttc

SEQ ID NO: 615168 - DNA, 13 bp, D. melanogaster
ctgctgccattga

SEQ ID NO: 615169 - DNA, 13 bp, D. melanogaster
ctgctgccatttc

SEQ ID NO: 615170 - DNA, 13 bp, D. melanogaster
ctgctgcccgaga

SEQ ID NO: 615171 - DNA, 13 bp, D. melanogaster
ctgctgccgaggc

SEQ ID NO: 615172 - DNA, 13 bp, D. melanogaster
ctgctgccgctga

SEQ ID NO: 615173 - DNA, 14 bp, D. melanogaster
ctgctgccgctgcc

SEQ ID NO: 615174 - DNA, 14 bp, D. melanogaster
ctgctgccgctgtt

SEQ ID NO: 615175 - DNA, 13 bp, D. melanogaster
ctgctgccgttgc

SEQ ID NO: 615176 - DNA, 13 bp, D. melanogaster
ctgctgcctgcca

SEQ ID NO: 615177 - DNA, 14 bp, D. melanogaster
ctgctgcctgctgc

SEQ ID NO: 615178 - DNA, 13 bp, D. melanogaster
ctgctgcctgttg

SEQ ID NO: 615179 - DNA, 13 bp, D. melanogaster
ctgctgccttttg

SEQ ID NO: 615180 - DNA, 13 bp, D. melanogaster
ctgctgcgcaaga

SEQ ID NO: 615181 - DNA, 13 bp, D. melanogaster
ctgctgcgcaatg

SEQ ID NO: 615182 - DNA, 14 bp, D. melanogaster
ctgctgcgcagctg

SEQ ID NO: 615183 - DNA, 14 bp, D. melanogaster
ctgctgcgccgctg

SEQ ID NO: 615184 - DNA, 13 bp, D. melanogaster
ctgctgcgctgct

SEQ ID NO: 615185 - DNA, 13 bp, D. melanogaster
ctgctgctactgt

SEQ ID NO: 615186 - DNA, 13 bp, D. melanogaster
ctgctgctccagc

SEQ ID NO: 615187 - DNA, 14 bp, D. melanogaster
ctgctgctccagct

SEQ ID NO: 615188 - DNA, 13 bp, D. melanogaster
ctgctgctccgct

SEQ ID NO: 615189 - DNA, 13 bp, D. melanogaster
ctgctgctcctct

SEQ ID NO: 615190 - DNA, 13 bp, D. melanogaster
ctgctgctcctgc

SEQ ID NO: 615191 - DNA, 14 bp, D. melanogaster
ctgctgctcctgct

SEQ ID NO: 615192 - DNA, 13 bp, D. melanogaster
ctgctgctcctgg

SEQ ID NO: 615193 - DNA, 13 bp, D. melanogaster
ctgctgctccttt

SEQ ID NO: 615194 - DNA, 13 bp, D. melanogaster
ctgctgctcttgc

SEQ ID NO: 615195 - DNA, 13 bp, D. melanogaster
ctgctgctcttgt

SEQ ID NO: 615196 - DNA, 13 bp, D. melanogaster
ctgctgctctttt

SEQ ID NO: 615197 - DNA, 13 bp, D. melanogaster
ctgctgctgagaa

SEQ ID NO: 615198 - DNA, 13 bp, D. melanogaster
ctgctgctgatgc

SEQ ID NO: 615199 - DNA, 13 bp, D. melanogaster
ctgctgctgatgt

SEQ ID NO: 615200 - DNA, 13 bp, D. melanogaster
ctgctgctgcaag

SEQ ID NO: 615201 - DNA, 13 bp, D. melanogaster
ctgctgctgcact

SEQ ID NO: 615202 - DNA, 14 bp, D. melanogaster
ctgctgctgcactt

SEQ ID NO: 615203 - DNA, 13 bp, D. melanogaster
ctgctgctgcagc

SEQ ID NO: 615204 - DNA, 14 bp, D. melanogaster
ctgctgctgcagct

SEQ ID NO: 615205 - DNA, 14 bp, D. melanogaster
ctgctgctgcagtg

SEQ ID NO: 615206 - DNA, 13 bp, D. melanogaster
ctgctgctgccaa

SEQ ID NO: 615207 - DNA, 13 bp, D. melanogaster
ctgctgctgcccc

SEQ ID NO: 615208 - DNA, 13 bp, D. melanogaster
ctgctgctgccga

SEQ ID NO: 615209 - DNA, 14 bp, D. melanogaster
ctgctgctgccgcc

SEQ ID NO: 615210 - DNA, 13 bp, D. melanogaster
ctgctgctgccgt

SEQ ID NO: 615211 - DNA, 13 bp, D. melanogaster
ctgctgctgcgat

SEQ ID NO: 615212 - DNA, 13 bp, D. melanogaster
ctgctgctgcgct

SEQ ID NO: 615213 - DNA, 14 bp, D. melanogaster
ctgctgctgcgctg

SEQ ID NO: 615214 - DNA, 13 bp, D. melanogaster
ctgctgctgcgga

SEQ ID NO: 615215 - DNA, 13 bp, D. melanogaster
ctgctgctgcggc

SEQ ID NO: 615216 - DNA, 13 bp, D. melanogaster
ctgctgctgcgtt

SEQ ID NO: 615217 - DNA, 13 bp, D. melanogaster
ctgctgctgctaa

SEQ ID NO: 615218 - DNA, 13 bp, D. melanogaster
ctgctgctgctac

SEQ ID NO: 615219 - DNA, 14 bp, D. melanogaster
ctgctgctgctact

SEQ ID NO: 615220 - DNA, 14 bp, D. melanogaster
ctgctgctgctcct

SEQ ID NO: 615221 - DNA, 13 bp, D. melanogaster
ctgctgctgctcg

SEQ ID NO: 615222 - DNA, 14 bp, D. melanogaster
ctgctgctgctcgt

SEQ ID NO: 615223 - DNA, 14 bp, D. melanogaster
ctgctgctgctgac

SEQ ID NO: 615224 - DNA, 14 bp, D. melanogaster
ctgctgctgctgat

SEQ ID NO: 615225 - DNA, 14 bp, D. melanogaster
ctgctgctgctgca

SEQ ID NO: 615226 - DNA, 14 bp, D. melanogaster
ctgctgctgctgga

SEQ ID NO: 615227 - DNA, 14 bp, D. melanogaster
ctgctgctgctggc

SEQ ID NO: 615228 - DNA, 14 bp, D. melanogaster
ctgctgctgctggt

SEQ ID NO: 615229 - DNA, 14 bp, D. melanogaster
ctgctgctgctgtg

SEQ ID NO: 615230 - DNA, 13 bp, D. melanogaster
ctgctgctgctta

SEQ ID NO: 615231 - DNA, 13 bp, D. melanogaster
ctgctgctgcttt

SEQ ID NO: 615232 - DNA, 14 bp, D. melanogaster
ctgctgctgctttc

SEQ ID NO: 615233 - DNA, 14 bp, D. melanogaster
ctgctgctgctttt

SEQ ID NO: 615234 - DNA, 13 bp, D. melanogaster
ctgctgctggaaa

SEQ ID NO: 615235 - DNA, 13 bp, D. melanogaster
ctgctgctggcac

SEQ ID NO: 615236 - DNA, 13 bp, D. melanogaster
ctgctgctggcag

SEQ ID NO: 615237 - DNA, 13 bp, D. melanogaster
ctgctgctggcgg

SEQ ID NO: 615238 - DNA, 13 bp, D. melanogaster
ctgctgctggctt

SEQ ID NO: 615239 - DNA, 13 bp, D. melanogaster
ctgctgctggtgc

SEQ ID NO: 615240 - DNA, 13 bp, D. melanogaster
ctgctgctgtgtg

SEQ ID NO: 615241 - DNA, 14 bp, D. melanogaster
ctgctgctgtgttg

SEQ ID NO: 615242 - DNA, 14 bp, D. melanogaster
ctgctgctgttgat

SEQ ID NO: 615243 - DNA, 14 bp, D. melanogaster
ctgctgctgttgcc

SEQ ID NO: 615244 - DNA, 14 bp, D. melanogaster
ctgctgctgttggt

SEQ ID NO: 615245 - DNA, 13 bp, D. melanogaster
ctgctgctgttgt

SEQ ID NO: 615246 - DNA, 13 bp, D. melanogaster
ctgctgctgtttg

SEQ ID NO: 615247 - DNA, 13 bp, D. melanogaster
ctgctgctgtttt

SEQ ID NO: 615248 - DNA, 14 bp, D. melanogaster
ctgctgcttctgct

SEQ ID NO: 615249 - DNA, 13 bp, D. melanogaster
ctgctgcttctgt

SEQ ID NO: 615250 - DNA, 14 bp, D. melanogaster
ctgctgcttctgtt

SEQ ID NO: 615251 - DNA, 13 bp, D. melanogaster
ctgctgcttcttc

SEQ ID NO: 615252 - DNA, 13 bp, D. melanogaster
ctgctgctttgca

SEQ ID NO: 615253 - DNA, 13 bp, D. melanogaster
ctgctgctttgtt

SEQ ID NO: 615254 - DNA, 13 bp, D. melanogaster
ctgctgcttttgg

SEQ ID NO: 615255 - DNA, 14 bp, D. melanogaster
ctgctgcttttggc

SEQ ID NO: 615256 - DNA, 13 bp, D. melanogaster
ctgctgcttttta

SEQ ID NO: 615257 - DNA, 13 bp, D. melanogaster
ctgctgctttttc

SEQ ID NO: 615258 - DNA, 13 bp, D. melanogaster
ctgctggaaaact

SEQ ID NO: 615259 - DNA, 13 bp, D. melanogaster
ctgctggattatc

SEQ ID NO: 615260 - DNA, 13 bp, D. melanogaster
ctgctggcaaaaa

SEQ ID NO: 615261 - DNA, 14 bp, D. melanogaster
ctgctggccaaaaa

SEQ ID NO: 615262 - DNA, 13 bp, D. melanogaster
ctgctggccaaat

SEQ ID NO: 615263 - DNA, 13 bp, D. melanogaster
ctgctggccagga

SEQ ID NO: 615264 - DNA, 13 bp, D. melanogaster
ctgctggccagta

SEQ ID NO: 615265 - DNA, 14 bp, D. melanogaster
ctgctggccagtat

SEQ ID NO: 615266 - DNA, 13 bp, D. melanogaster
ctgctggccataa

SEQ ID NO: 615267 - DNA, 13 bp, D. melanogaster
ctgctggctgctc

SEQ ID NO: 615268 - DNA, 14 bp, D. melanogaster
ctgctggctgctgg

SEQ ID NO: 615269 - DNA, 13 bp, D. melanogaster
ctgctggtaattt

SEQ ID NO: 615270 - DNA, 13 bp, D. melanogaster
ctgctgtcgctgc

SEQ ID NO: 615271 - DNA, 13 bp, D. melanogaster
ctgctgtctgctg

SEQ ID NO: 615272 - DNA, 13 bp, D. melanogaster
ctgctgtgctgtg

SEQ ID NO: 615273 - DNA, 13 bp, D. melanogaster
ctgctgtggctgc

SEQ ID NO: 615274 - DNA, 13 bp, D. melanogaster
ctgctgttattgt

SEQ ID NO: 615275 - DNA, 13 bp, D. melanogaster
ctgctgttgatga

SEQ ID NO: 615276 - DNA, 14 bp, D. melanogaster
ctgctgttgccgct

SEQ ID NO: 615277 - DNA, 13 bp, D. melanogaster
ctgctgttgcggc

SEQ ID NO: 615278 - DNA, 13 bp, D. melanogaster
ctgctgttgctct

SEQ ID NO: 615279 - DNA, 14 bp, D. melanogaster
ctgctgttgctgat

SEQ ID NO: 615280 - DNA, 14 bp, D. melanogaster
ctgctgttgctgca

SEQ ID NO: 615281 - DNA, 14 bp, D. melanogaster
ctgctgttgctgcc

SEQ ID NO: 615282 - DNA, 13 bp, D. melanogaster
ctgctgttgctgg

SEQ ID NO: 615283 - DNA, 13 bp, D. melanogaster
ctgctgttgctgt

SEQ ID NO: 615284 - DNA, 14 bp, D. melanogaster
ctgctgttgctgtt

SEQ ID NO: 615285 - DNA, 13 bp, D. melanogaster
ctgctgttggcgt

SEQ ID NO: 615286 - DNA, 13 bp, D. melanogaster
ctgctgttgttgc

SEQ ID NO: 615287 - DNA, 14 bp, D. melanogaster
ctgctgttgttgta

SEQ ID NO: 615288 - DNA, 14 bp, D. melanogaster
ctgctgtttatcta

SEQ ID NO: 615289 - DNA, 13 bp, D. melanogaster
ctgctgtttctgc

SEQ ID NO: 615290 - DNA, 14 bp, D. melanogaster
ctgctgtttctgtt

SEQ ID NO: 615291 - DNA, 13 bp, D. melanogaster
ctgctgttttatt

SEQ ID NO: 615292 - DNA, 13 bp, D. melanogaster
ctgctgtttttgg

SEQ ID NO: 615293 - DNA, 13 bp, D. melanogaster
ctgcttaaaaatg

SEQ ID NO: 615294 - DNA, 13 bp, D. melanogaster
ctgcttaacgatc

SEQ ID NO: 615295 - DNA, 13 bp, D. melanogaster
ctgcttcaacacg

SEQ ID NO: 615296 - DNA, 13 bp, D. melanogaster
ctgcttcagcttc

SEQ ID NO: 615297 - DNA, 13 bp, D. melanogaster
ctgcttctctgct

SEQ ID NO: 615298 - DNA, 13 bp, D. melanogaster
ctgcttctgcctc

SEQ ID NO: 615299 - DNA, 14 bp, D. melanogaster
ctgcttctgctgct

SEQ ID NO: 615300 - DNA, 13 bp, D. melanogaster
ctgcttctgctgt

SEQ ID NO: 615301 - DNA, 14 bp, D. melanogaster
ctgcttctgcttct

SEQ ID NO: 615302 - DNA, 13 bp, D. melanogaster
ctgcttctgcttt

SEQ ID NO: 615303 - DNA, 13 bp, D. melanogaster
ctgcttctgtttg

SEQ ID NO: 615304 - DNA, 14 bp, D. melanogaster
ctgcttctgtttgg

SEQ ID NO: 615305 - DNA, 13 bp, D. melanogaster
ctgcttcttctgc

SEQ ID NO: 615306 - DNA, 13 bp, D. melanogaster
ctgcttcttcttg

SEQ ID NO: 615307 - DNA, 13 bp, D. melanogaster
ctgcttcttttgc

SEQ ID NO: 615308 - DNA, 13 bp, D. melanogaster
ctgcttggcacgc

SEQ ID NO: 615309 - DNA, 13 bp, D. melanogaster
ctgcttggctgct

SEQ ID NO: 615310 - DNA, 13 bp, D. melanogaster
ctgcttgtgctgc

SEQ ID NO: 615311 - DNA, 13 bp, D. melanogaster
ctgcttgtgtgtg

SEQ ID NO: 615312 - DNA, 13 bp, D. melanogaster
ctgctttaaaatg

SEQ ID NO: 615313 - DNA, 13 bp, D. melanogaster
ctgctttaaagca

SEQ ID NO: 615314 - DNA, 13 bp, D. melanogaster
ctgctttatggcc

SEQ ID NO: 615315 - DNA, 13 bp, D. melanogaster
ctgctttcccaac

SEQ ID NO: 615316 - DNA, 13 bp, D. melanogaster
ctgctttgctttg

SEQ ID NO: 615317 - DNA, 13 bp, D. melanogaster
ctgctttgtttgc

SEQ ID NO: 615318 - DNA, 13 bp, D. melanogaster
ctgcttttatatg

SEQ ID NO: 615319 - DNA, 13 bp, D. melanogaster
ctgcttttcagtt

SEQ ID NO: 615320 - DNA, 13 bp, D. melanogaster
ctgcttttccgcc

SEQ ID NO: 615321 - DNA, 13 bp, D. melanogaster
ctgcttttcctgc

SEQ ID NO: 615322 - DNA, 13 bp, D. melanogaster
ctgcttttcgctt

SEQ ID NO: 615323 - DNA, 13 bp, D. melanogaster
ctgcttttgaaca

SEQ ID NO: 615324 - DNA, 13 bp, D. melanogaster
ctgcttttggcca

SEQ ID NO: 615325 - DNA, 14 bp, D. melanogaster
ctgcttttggccaa

SEQ ID NO: 615326 - DNA, 14 bp, D. melanogaster
ctgcttttggccag

SEQ ID NO: 615327 - DNA, 14 bp, D. melanogaster
ctgcttttgttgct

SEQ ID NO: 615328 - DNA, 13 bp, D. melanogaster
ctgctttttgggg

SEQ ID NO: 615329 - DNA, 13 bp, D. melanogaster
ctgctttttgtgg

SEQ ID NO: 615330 - DNA, 13 bp, D. melanogaster
ctgcttttttaac

SEQ ID NO: 615331 - DNA, 13 bp, D. melanogaster
ctggaaaaaaagt

SEQ ID NO: 615332 - DNA, 13 bp, D. melanogaster
ctggaaaaaataa

SEQ ID NO: 615333 - DNA, 13 bp, D. melanogaster
ctggaaaaaatca

SEQ ID NO: 615334 - DNA, 13 bp, D. melanogaster
ctggaaaaactgt

SEQ ID NO: 615335 - DNA, 13 bp, D. melanogaster
ctggaaaaatatt

SEQ ID NO: 615336 - DNA, 13 bp, D. melanogaster
ctggaaaaattaa

SEQ ID NO: 615337 - DNA, 13 bp, D. melanogaster
ctggaaaaccatt

SEQ ID NO: 615338 - DNA, 13 bp, D. melanogaster
ctggaaaactgaa

SEQ ID NO: 615339 - DNA, 13 bp, D. melanogaster
ctggaaaagccag

SEQ ID NO: 615340 - DNA, 13 bp, D. melanogaster
ctggaaaagtggg

SEQ ID NO: 615341 - DNA, 13 bp, D. melanogaster
ctggaaaatcgaa

SEQ ID NO: 615342 - DNA, 14 bp, D. melanogaster
ctggaaaatcttaa

SEQ ID NO: 615343 - DNA, 13 bp, D. melanogaster
ctggaaaatgaat

SEQ ID NO: 615344 - DNA, 13 bp, D. melanogaster
ctggaaaatgcaa

SEQ ID NO: 615345 - DNA, 13 bp, D. melanogaster
ctggaaaatggaa

SEQ ID NO: 615346 - DNA, 14 bp, D. melanogaster
ctggaaaatggaaa

SEQ ID NO: 615347 - DNA, 13 bp, D. melanogaster
ctggaaaatggca

SEQ ID NO: 615348 - DNA, 13 bp, D. melanogaster
ctggaaaatggga

SEQ ID NO: 615349 - DNA, 13 bp, D. melanogaster
ctggaaaattgct

SEQ ID NO: 615350 - DNA, 13 bp, D. melanogaster
ctggaaaattgtg

SEQ ID NO: 615351 - DNA, 13 bp, D. melanogaster
ctggaaaatttgc

SEQ ID NO: 615352 - DNA, 13 bp, D. melanogaster
ctggaaaattttt

SEQ ID NO: 615353 - DNA, 13 bp, D. melanogaster
ctggaaaccgaac

SEQ ID NO: 615354 - DNA, 13 bp, D. melanogaster
ctggaaactattt

SEQ ID NO: 615355 - DNA, 13 bp, D. melanogaster
ctggaaactgaaa

SEQ ID NO: 615356 - DNA, 13 bp, D. melanogaster
ctggaaactggaa

SEQ ID NO: 615357 - DNA, 13 bp, D. melanogaster
ctggaaagagatt

SEQ ID NO: 615358 - DNA, 14 bp, D. melanogaster
ctggaaagctgcat

SEQ ID NO: 615359 - DNA, 13 bp, D. melanogaster
ctggaaatataaa

SEQ ID NO: 615360 - DNA, 13 bp, D. melanogaster
ctggaaatatatt

SEQ ID NO: 615361 - DNA, 13 bp, D. melanogaster
ctggaaatgaaat

SEQ ID NO: 615362 - DNA, 13 bp, D. melanogaster
ctggaaatgcaat

SEQ ID NO: 615363 - DNA, 13 bp, D. melanogaster
ctggaactgaaac

SEQ ID NO: 615364 - DNA, 14 bp, D. melanogaster
ctggaactgaaact

SEQ ID NO: 615365 - DNA, 13 bp, D. melanogaster
ctggaactggaac

SEQ ID NO: 615366 - DNA, 13 bp, D. melanogaster
ctggaacttttca

SEQ ID NO: 615367 - DNA, 13 bp, D. melanogaster
ctggaagaagtga

SEQ ID NO: 615368 - DNA, 13 bp, D. melanogaster
ctggaagattgcc

SEQ ID NO: 615369 - DNA, 13 bp, D. melanogaster
ctggaagcaggga

SEQ ID NO: 615370 - DNA, 13 bp, D. melanogaster
ctggaagtgcctt

SEQ ID NO: 615371 - DNA, 13 bp, D. melanogaster
ctggaagtggaag

SEQ ID NO: 615372 - DNA, 13 bp, D. melanogaster
ctggaatagatta

SEQ ID NO: 615373 - DNA, 13 bp, D. melanogaster
ctggaatagtttt

SEQ ID NO: 615374 - DNA, 13 bp, D. melanogaster
ctggaatcgtttg

SEQ ID NO: 615375 - DNA, 13 bp, D. melanogaster
ctggaatggaatg

SEQ ID NO: 615376 - DNA, 13 bp, D. melanogaster
ctggaattctttt

SEQ ID NO: 615377 - DNA, 13 bp, D. melanogaster
ctggaattgtcgt

SEQ ID NO: 615378 - DNA, 13 bp, D. melanogaster
ctggaattttaaa

SEQ ID NO: 615379 - DNA, 13 bp, D. melanogaster
ctggaatttttat

SEQ ID NO: 615380 - DNA, 13 bp, D. melanogaster
ctggacactctac

SEQ ID NO: 615381 - DNA, 13 bp, D. melanogaster
ctggacactggac

SEQ ID NO: 615382 - DNA, 13 bp, D. melanogaster
ctggacagacacc

SEQ ID NO: 615383 - DNA, 13 bp, D. melanogaster
ctggacaggcggc

SEQ ID NO: 615384 - DNA, 13 bp, D. melanogaster
ctggacgaattga

SEQ ID NO: 615385 - DNA, 13 bp, D. melanogaster
ctggacggatggc

SEQ ID NO: 615386 - DNA, 14 bp, D. melanogaster
ctggacgtgggcaa

SEQ ID NO: 615387 - DNA, 13 bp, D. melanogaster
ctggactggactg

SEQ ID NO: 615388 - DNA, 14 bp, D. melanogaster
ctggactggactgg

SEQ ID NO: 615389 - DNA, 13 bp, D. melanogaster
ctggactggctgg

SEQ ID NO: 615390 - DNA, 13 bp, D. melanogaster
ctggagaaaaaac

SEQ ID NO: 615391 - DNA, 13 bp, D. melanogaster
ctggagaacttca

SEQ ID NO: 615392 - DNA, 13 bp, D. melanogaster
ctggagaagatct

SEQ ID NO: 615393 - DNA, 14 bp, D. melanogaster
ctggagaagatctt

SEQ ID NO: 615394 - DNA, 13 bp, D. melanogaster
ctggagatcaagg

SEQ ID NO: 615395 - DNA, 14 bp, D. melanogaster
ctggagatcaaggc

SEQ ID NO: 615396 - DNA, 13 bp, D. melanogaster
ctggagcaatgcc

SEQ ID NO: 615397 - DNA, 13 bp, D. melanogaster
ctggagcactctt

SEQ ID NO: 615398 - DNA, 13 bp, D. melanogaster
ctggagcagtgca

SEQ ID NO: 615399 - DNA, 13 bp, D. melanogaster
ctggagcgccgtg

SEQ ID NO: 615400 - DNA, 13 bp, D. melanogaster
ctggagctctggt

SEQ ID NO: 615401 - DNA, 13 bp, D. melanogaster
ctggagctgattc

SEQ ID NO: 615402 - DNA, 14 bp, D. melanogaster
ctggagctggagca

SEQ ID NO: 615403 - DNA, 13 bp, D. melanogaster
ctggagcttgtct

SEQ ID NO: 615404 - DNA, 13 bp, D. melanogaster
ctggaggagcagc

SEQ ID NO: 615405 - DNA, 13 bp, D. melanogaster
ctggaggatgtac

SEQ ID NO: 615406 - DNA, 13 bp, D. melanogaster
ctggagttcaaag

SEQ ID NO: 615407 - DNA, 13 bp, D. melanogaster
ctggagttggagc

SEQ ID NO: 615408 - DNA, 13 bp, D. melanogaster
ctggagttggagt

SEQ ID NO: 615409 - DNA, 13 bp, D. melanogaster
ctggagttttttt

SEQ ID NO: 615410 - DNA, 13 bp, D. melanogaster
ctggatactggat

SEQ ID NO: 615411 - DNA, 13 bp, D. melanogaster
ctggatgacaaca

SEQ ID NO: 615412 - DNA, 13 bp, D. melanogaster
ctggatgatttgt

SEQ ID NO: 615413 - DNA, 14 bp, D. melanogaster
ctggatgctggatg

SEQ ID NO: 615414 - DNA, 13 bp, D. melanogaster
ctggatggctgga

SEQ ID NO: 615415 - DNA, 13 bp, D. melanogaster
ctggatgggatgg

SEQ ID NO: 615416 - DNA, 13 bp, D. melanogaster
ctggatggtccat

SEQ ID NO: 615417 - DNA, 13 bp, D. melanogaster
ctggatgtaaaaa

SEQ ID NO: 615418 - DNA, 14 bp, D. melanogaster
ctggatgtaatttt

SEQ ID NO: 615419 - DNA, 13 bp, D. melanogaster
ctggattccacca

SEQ ID NO: 615420 - DNA, 13 bp, D. melanogaster
ctggattctggat

SEQ ID NO: 615421 - DNA, 13 bp, D. melanogaster
ctggatttcttcc

SEQ ID NO: 615422 - DNA, 13 bp, D. melanogaster
ctggcaaaaaaaa

SEQ ID NO: 615423 - DNA, 13 bp, D. melanogaster
ctggcaaaaggca

SEQ ID NO: 615424 - DNA, 13 bp, D. melanogaster
ctggcaaaatgat

SEQ ID NO: 615425 - DNA, 13 bp, D. melanogaster
ctggcaaaatgtc

SEQ ID NO: 615426 - DNA, 13 bp, D. melanogaster
ctggcaaacaaac

SEQ ID NO: 615427 - DNA, 13 bp, D. melanogaster
ctggcaaacactt

SEQ ID NO: 615428 - DNA, 13 bp, D. melanogaster
ctggcaaagaaaa

SEQ ID NO: 615429 - DNA, 13 bp, D. melanogaster
ctggcaaagtggc

SEQ ID NO: 615430 - DNA, 13 bp, D. melanogaster
ctggcaaataccc

SEQ ID NO: 615431 - DNA, 13 bp, D. melanogaster
ctggcaaatattg

SEQ ID NO: 615432 - DNA, 13 bp, D. melanogaster
ctggcaaatgaaa

SEQ ID NO: 615433 - DNA, 13 bp, D. melanogaster
ctggcaaatgcaa

SEQ ID NO: 615434 - DNA, 14 bp, D. melanogaster
ctggcaaatggaaa

SEQ ID NO: 615435 - DNA, 13 bp, D. melanogaster
ctggcaaatgtca

SEQ ID NO: 615436 - DNA, 13 bp, D. melanogaster
ctggcaaattaat

SEQ ID NO: 615437 - DNA, 13 bp, D. melanogaster
ctggcaaattgca

SEQ ID NO: 615438 - DNA, 13 bp, D. melanogaster
ctggcaaatttat

SEQ ID NO: 615439 - DNA, 13 bp, D. melanogaster
ctggcaacagcaa

SEQ ID NO: 615440 - DNA, 13 bp, D. melanogaster
ctggcaacatttg

SEQ ID NO: 615441 - DNA, 13 bp, D. melanogaster
ctggcaacgccgc

SEQ ID NO: 615442 - DNA, 13 bp, D. melanogaster
ctggcaacgtttg

SEQ ID NO: 615443 - DNA, 13 bp, D. melanogaster
ctggcaactgcca

SEQ ID NO: 615444 - DNA, 13 bp, D. melanogaster
ctggcaactggca

SEQ ID NO: 615445 - DNA, 13 bp, D. melanogaster
ctggcaactggcg

SEQ ID NO: 615446 - DNA, 13 bp, D. melanogaster
ctggcaagaaaaa

SEQ ID NO: 615447 - DNA, 13 bp, D. melanogaster
ctggcaagctggc

SEQ ID NO: 615448 - DNA, 13 bp, D. melanogaster
ctggcaagtggat

SEQ ID NO: 615449 - DNA, 13 bp, D. melanogaster
ctggcaattggca

SEQ ID NO: 615450 - DNA, 13 bp, D. melanogaster
ctggcaatttgca

SEQ ID NO: 615451 - DNA, 13 bp, D. melanogaster
ctggcaatttgtt

SEQ ID NO: 615452 - DNA, 13 bp, D. melanogaster
ctggcaccctggg

SEQ ID NO: 615453 - DNA, 13 bp, D. melanogaster
ctggcagaaaaaa

SEQ ID NO: 615454 - DNA, 13 bp, D. melanogaster
ctggcagagattt

SEQ ID NO: 615455 - DNA, 13 bp, D. melanogaster
ctggcagcaaaaa

SEQ ID NO: 615456 - DNA, 13 bp, D. melanogaster
ctggcagcaacaa

SEQ ID NO: 615457 - DNA, 13 bp, D. melanogaster
ctggcagccaaaa

SEQ ID NO: 615458 - DNA, 13 bp, D. melanogaster
ctggcagccagca

SEQ ID NO: 615459 - DNA, 13 bp, D. melanogaster
ctggcagcgctgc

SEQ ID NO: 615460 - DNA, 13 bp, D. melanogaster
ctggcagcggaaa

SEQ ID NO: 615461 - DNA, 13 bp, D. melanogaster
ctggcagcggcaa

SEQ ID NO: 615462 - DNA, 13 bp, D. melanogaster
ctggcagcttatt

SEQ ID NO: 615463 - DNA, 13 bp, D. melanogaster
ctggcagtgcagc

SEQ ID NO: 615464 - DNA, 13 bp, D. melanogaster
ctggcataataag

SEQ ID NO: 615465 - DNA, 13 bp, D. melanogaster
ctggcatcaccaa

SEQ ID NO: 615466 - DNA, 13 bp, D. melanogaster
ctggcatcctggc

SEQ ID NO: 615467 - DNA, 14 bp, D. melanogaster
ctggcatcctggca

SEQ ID NO: 615468 - DNA, 13 bp, D. melanogaster
ctggcattcgcat

SEQ ID NO: 615469 - DNA, 13 bp, D. melanogaster
ctggcattctggc

SEQ ID NO: 615470 - DNA, 13 bp, D. melanogaster
ctggcattgtttt

SEQ ID NO: 615471 - DNA, 13 bp, D. melanogaster
ctggcatttattt

SEQ ID NO: 615472 - DNA, 13 bp, D. melanogaster
ctggcatttcaat

SEQ ID NO: 615473 - DNA, 13 bp, D. melanogaster
ctggcatttgaaa

SEQ ID NO: 615474 - DNA, 13 bp, D. melanogaster
ctggcatttgaat

SEQ ID NO: 615475 - DNA, 13 bp, D. melanogaster
ctggcatttgcat

SEQ ID NO: 615476 - DNA, 13 bp, D. melanogaster
ctggcatttggcc

SEQ ID NO: 615477 - DNA, 13 bp, D. melanogaster
ctggcatttgttt

SEQ ID NO: 615478 - DNA, 13 bp, D. melanogaster
ctggcattttctt

SEQ ID NO: 615479 - DNA, 13 bp, D. melanogaster
ctggccaaaaaaa

SEQ ID NO: 615480 - DNA, 13 bp, D. melanogaster
ctggccaaaaaag

SEQ ID NO: 615481 - DNA, 14 bp, D. melanogaster
ctggccaaaaaagt

SEQ ID NO: 615482 - DNA, 14 bp, D. melanogaster
ctggccaaaaacaa

SEQ ID NO: 615483 - DNA, 13 bp, D. melanogaster
ctggccaaaacaa

SEQ ID NO: 615484 - DNA, 14 bp, D. melanogaster
ctggccaaaaggaa

SEQ ID NO: 615485 - DNA, 13 bp, D. melanogaster
ctggccaaaaggg

SEQ ID NO: 615486 - DNA, 13 bp, D. melanogaster
ctggccaaaatag

SEQ ID NO: 615487 - DNA, 13 bp, D. melanogaster
ctggccaaaatga

SEQ ID NO: 615488 - DNA, 13 bp, D. melanogaster
ctggccaaacaac

SEQ ID NO: 615489 - DNA, 13 bp, D. melanogaster
ctggccaaaggaa

SEQ ID NO: 615490 - DNA, 13 bp, D. melanogaster
ctggccaaatgca

SEQ ID NO: 615491 - DNA, 13 bp, D. melanogaster
ctggccaaatggc

SEQ ID NO: 615492 - DNA, 13 bp, D. melanogaster
ctggccaaatgtg

SEQ ID NO: 615493 - DNA, 13 bp, D. melanogaster
ctggccaaattgt

SEQ ID NO: 615494 - DNA, 13 bp, D. melanogaster
ctggccaacaaat

SEQ ID NO: 615495 - DNA, 13 bp, D. melanogaster
ctggccaacattt

SEQ ID NO: 615496 - DNA, 13 bp, D. melanogaster
ctggccaacgcat

SEQ ID NO: 615497 - DNA, 15 bp, D. melanogaster
ctggccaacgctctg

SEQ ID NO: 615498 - DNA, 13 bp, D. melanogaster
ctggccaactgac

SEQ ID NO: 615499 - DNA, 13 bp, D. melanogaster
ctggccaactgcc

SEQ ID NO: 615500 - DNA, 13 bp, D. melanogaster
ctggccaactggc

SEQ ID NO: 615501 - DNA, 13 bp, D. melanogaster
ctggccaactggt

SEQ ID NO: 615502 - DNA, 13 bp, D. melanogaster
ctggccaaggcaa

SEQ ID NO: 615503 - DNA, 13 bp, D. melanogaster
ctggccaagtgaa

SEQ ID NO: 615504 - DNA, 13 bp, D. melanogaster
ctggccaagtgga

SEQ ID NO: 615505 - DNA, 13 bp, D. melanogaster
ctggccaagttaa

SEQ ID NO: 615506 - DNA, 13 bp, D. melanogaster
ctggccaagttga

SEQ ID NO: 615507 - DNA, 13 bp, D. melanogaster
ctggccacaaaag

SEQ ID NO: 615508 - DNA, 13 bp, D. melanogaster
ctggccacaaaat

SEQ ID NO: 615509 - DNA, 13 bp, D. melanogaster
ctggccacataaa

SEQ ID NO: 615510 - DNA, 14 bp, D. melanogaster
ctggccacgcccac

SEQ ID NO: 615511 - DNA, 14 bp, D. melanogaster
ctggccacgccccc

SEQ ID NO: 615512 - DNA, 13 bp, D. melanogaster
ctggccagaaaaa

SEQ ID NO: 615513 - DNA, 13 bp, D. melanogaster
ctggccagcaatt

SEQ ID NO: 615514 - DNA, 13 bp, D. melanogaster
ctggccagcagac

SEQ ID NO: 615515 - DNA, 13 bp, D. melanogaster
ctggccagcagca

SEQ ID NO: 615516 - DNA, 13 bp, D. melanogaster
ctggccagccgat

SEQ ID NO: 615517 - DNA, 13 bp, D. melanogaster
ctggccagcggca

SEQ ID NO: 615518 - DNA, 13 bp, D. melanogaster
ctggccataaaaa

SEQ ID NO: 615519 - DNA, 13 bp, D. melanogaster
ctggccatatatg

SEQ ID NO: 615520 - DNA, 13 bp, D. melanogaster
ctggccatggcca

SEQ ID NO: 615521 - DNA, 14 bp, D. melanogaster
ctggccatgtccgt

SEQ ID NO: 615522 - DNA, 13 bp, D. melanogaster
ctggccattaaaa

SEQ ID NO: 615523 - DNA, 14 bp, D. melanogaster
ctggccattatatg

SEQ ID NO: 615524 - DNA, 13 bp, D. melanogaster
ctggccatttccg

SEQ ID NO: 615525 - DNA, 13 bp, D. melanogaster
ctggccatttggc

SEQ ID NO: 615526 - DNA, 13 bp, D. melanogaster
ctggcccaaaaga

SEQ ID NO: 615527 - DNA, 15 bp, D. melanogaster
ctggccgctggccat

SEQ ID NO: 615528 - DNA, 13 bp, D. melanogaster
ctggccgttgcct

SEQ ID NO: 615529 - DNA, 13 bp, D. melanogaster
ctggcctggcctg

SEQ ID NO: 615530 - DNA, 13 bp, D. melanogaster
ctggccttattga

SEQ ID NO: 615531 - DNA, 14 bp, D. melanogaster
ctggcctttctctg

SEQ ID NO: 615532 - DNA, 14 bp, D. melanogaster
ctggcgagggtatg

SEQ ID NO: 615533 - DNA, 13 bp, D. melanogaster
ctggcgatgatga

SEQ ID NO: 615534 - DNA, 13 bp, D. melanogaster
ctggcgcagccgg

SEQ ID NO: 615535 - DNA, 13 bp, D. melanogaster
ctggcgccatctg

SEQ ID NO: 615536 - DNA, 13 bp, D. melanogaster
ctggcgcccactg

SEQ ID NO: 615537 - DNA, 13 bp, D. melanogaster
ctggcgctgcgaa

SEQ ID NO: 615538 - DNA, 14 bp, D. melanogaster
ctggcgctgcgaaa

SEQ ID NO: 615539 - DNA, 13 bp, D. melanogaster
ctggcgctgctgc

SEQ ID NO: 615540 - DNA, 13 bp, D. melanogaster
ctggcggggattg

SEQ ID NO: 615541 - DNA, 13 bp, D. melanogaster
ctggcgttggcat

SEQ ID NO: 615542 - DNA, 14 bp, D. melanogaster
ctggcgtttctgtt

SEQ ID NO: 615543 - DNA, 13 bp, D. melanogaster
ctggctaaaaata

SEQ ID NO: 615544 - DNA, 13 bp, D. melanogaster
ctggctaactggc

SEQ ID NO: 615545 - DNA, 13 bp, D. melanogaster
ctggctaattgaa

SEQ ID NO: 615546 - DNA, 13 bp, D. melanogaster
ctggctactggct

SEQ ID NO: 615547 - DNA, 14 bp, D. melanogaster
ctggctagctggct

SEQ ID NO: 615548 - DNA, 13 bp, D. melanogaster
ctggctcatcatc

SEQ ID NO: 615549 - DNA, 13 bp, D. melanogaster
ctggctgactggc

SEQ ID NO: 615550 - DNA, 13 bp, D. melanogaster
ctggctgactggt

SEQ ID NO: 615551 - DNA, 13 bp, D. melanogaster
ctggctgcacttt

SEQ ID NO: 615552 - DNA, 13 bp, D. melanogaster
ctggctgccactt

SEQ ID NO: 615553 - DNA, 13 bp, D. melanogaster
ctggctgccagtt

SEQ ID NO: 615554 - DNA, 13 bp, D. melanogaster
ctggctgccattt

SEQ ID NO: 615555 - DNA, 13 bp, D. melanogaster
ctggctgcctggc

SEQ ID NO: 615556 - DNA, 14 bp, D. melanogaster
ctggctgctggctg

SEQ ID NO: 615557 - DNA, 13 bp, D. melanogaster
ctggctggaaaag

SEQ ID NO: 615558 - DNA, 13 bp, D. melanogaster
ctggctggatggc

SEQ ID NO: 615559 - DNA, 13 bp, D. melanogaster
ctggctggcaaaa

SEQ ID NO: 615560 - DNA, 13 bp, D. melanogaster
ctggctggcagaa

SEQ ID NO: 615561 - DNA, 14 bp, D. melanogaster
ctggctggcagaag

SEQ ID NO: 615562 - DNA, 13 bp, D. melanogaster
ctggctggccaag

SEQ ID NO: 615563 - DNA, 13 bp, D. melanogaster
ctggctggctagc

SEQ ID NO: 615564 - DNA, 13 bp, D. melanogaster
ctggctggctgcc

SEQ ID NO: 615565 - DNA, 13 bp, D. melanogaster
ctggctggctgct

SEQ ID NO: 615566 - DNA, 14 bp, D. melanogaster
ctggctggctgctc

SEQ ID NO: 615567 - DNA, 14 bp, D. melanogaster
ctggctggctggca

SEQ ID NO: 615568 - DNA, 13 bp, D. melanogaster
ctggctggctggg

SEQ ID NO: 615569 - DNA, 13 bp, D. melanogaster
ctggctggctttt

SEQ ID NO: 615570 - DNA, 13 bp, D. melanogaster
ctggctgggattt

SEQ ID NO: 615571 - DNA, 13 bp, D. melanogaster
ctggctggttggc

SEQ ID NO: 615572 - DNA, 13 bp, D. melanogaster
ctggctgtgtgtg

SEQ ID NO: 615573 - DNA, 13 bp, D. melanogaster
ctggctgttaaca

SEQ ID NO: 615574 - DNA, 13 bp, D. melanogaster
ctggctgttttcc

SEQ ID NO: 615575 - DNA, 13 bp, D. melanogaster
ctggcttctggct

SEQ ID NO: 615576 - DNA, 13 bp, D. melanogaster
ctggcttcttcta

SEQ ID NO: 615577 - DNA, 13 bp, D. melanogaster
ctggctttcgtcg

SEQ ID NO: 615578 - DNA, 13 bp, D. melanogaster
ctggctttggaat

SEQ ID NO: 615579 - DNA, 13 bp, D. melanogaster
ctggctttgttcg

SEQ ID NO: 615580 - DNA, 13 bp, D. melanogaster
ctggcttttcaat

SEQ ID NO: 615581 - DNA, 13 bp, D. melanogaster
ctggcttttccac

SEQ ID NO: 615582 - DNA, 13 bp, D. melanogaster
ctgggaaaacttt

SEQ ID NO: 615583 - DNA, 13 bp, D. melanogaster
ctgggaaaatcga

SEQ ID NO: 615584 - DNA, 13 bp, D. melanogaster
ctgggaaaatcgc

SEQ ID NO: 615585 - DNA, 13 bp, D. melanogaster
ctgggaaaatggt

SEQ ID NO: 615586 - DNA, 13 bp, D. melanogaster
ctgggaaactggg

SEQ ID NO: 615587 - DNA, 14 bp, D. melanogaster
ctgggaaactggga

SEQ ID NO: 615588 - DNA, 13 bp, D. melanogaster
ctgggaacgggtg

SEQ ID NO: 615589 - DNA, 13 bp, D. melanogaster
ctgggaactctgg

SEQ ID NO: 615590 - DNA, 14 bp, D. melanogaster
ctgggaactctggt

SEQ ID NO: 615591 - DNA, 13 bp, D. melanogaster
ctgggaactggaa

SEQ ID NO: 615592 - DNA, 13 bp, D. melanogaster
ctgggaagtggaa

SEQ ID NO: 615593 - DNA, 13 bp, D. melanogaster
ctgggaatgccac

SEQ ID NO: 615594 - DNA, 13 bp, D. melanogaster
ctgggagaaaaac

SEQ ID NO: 615595 - DNA, 13 bp, D. melanogaster
ctgggagaaaagt

SEQ ID NO: 615596 - DNA, 13 bp, D. melanogaster
ctgggaggaagtt

SEQ ID NO: 615597 - DNA, 17 bp, D. melanogaster
ctgggagttggtggcca

SEQ ID NO: 615598 - DNA, 13 bp, D. melanogaster
ctgggatatcaat

SEQ ID NO: 615599 - DNA, 13 bp, D. melanogaster
ctgggatctggga

SEQ ID NO: 615600 - DNA, 13 bp, D. melanogaster
ctgggatgagctg

SEQ ID NO: 615601 - DNA, 13 bp, D. melanogaster
ctgggatgggatg

SEQ ID NO: 615602 - DNA, 13 bp, D. melanogaster
ctgggattatatt

SEQ ID NO: 615603 - DNA, 13 bp, D. melanogaster
ctgggcaaaaaaa

SEQ ID NO: 615604 - DNA, 13 bp, D. melanogaster
ctgggcaaatgtt

SEQ ID NO: 615605 - DNA, 13 bp, D. melanogaster
ctgggcaactggg

SEQ ID NO: 615606 - DNA, 13 bp, D. melanogaster
ctgggcagcaaaa

SEQ ID NO: 615607 - DNA, 13 bp, D. melanogaster
ctgggcatcccat

SEQ ID NO: 615608 - DNA, 13 bp, D. melanogaster
ctgggccaacaaa

SEQ ID NO: 615609 - DNA, 14 bp, D. melanogaster
ctgggctgggctgg

SEQ ID NO: 615610 - DNA, 13 bp, D. melanogaster
ctggggaaatgga

SEQ ID NO: 615611 - DNA, 13 bp, D. melanogaster
ctgggtaaatgcc

SEQ ID NO: 615612 - DNA, 13 bp, D. melanogaster
ctgggtactgggt

SEQ ID NO: 615613 - DNA, 13 bp, D. melanogaster
ctggtaatttgat

SEQ ID NO: 615614 - DNA, 13 bp, D. melanogaster
ctggtatctggta

SEQ ID NO: 615615 - DNA, 13 bp, D. melanogaster
ctggtatttatgt

SEQ ID NO: 615616 - DNA, 13 bp, D. melanogaster
ctggtcatgtccg

SEQ ID NO: 615617 - DNA, 14 bp, D. melanogaster
ctggtcatgtccgt

SEQ ID NO: 615618 - DNA, 13 bp, D. melanogaster
ctggtcctggtcc

SEQ ID NO: 615619 - DNA, 13 bp, D. melanogaster
ctggtcgtcctgt

SEQ ID NO: 615620 - DNA, 13 bp, D. melanogaster
ctggtctactgag

SEQ ID NO: 615621 - DNA, 13 bp, D. melanogaster
ctggtctggcctg

SEQ ID NO: 615622 - DNA, 13 bp, D. melanogaster
ctggtgaattgta

SEQ ID NO: 615623 - DNA, 13 bp, D. melanogaster
ctggtgatggtgt

SEQ ID NO: 615624 - DNA, 14 bp, D. melanogaster
ctggtgatggtgtg

SEQ ID NO: 615625 - DNA, 13 bp, D. melanogaster
ctggtgctggtgc

SEQ ID NO: 615626 - DNA, 13 bp, D. melanogaster
ctggtggctggtg

SEQ ID NO: 615627 - DNA, 14 bp, D. melanogaster
ctggtggctggtgt

SEQ ID NO: 615628 - DNA, 14 bp, D. melanogaster
ctggtgggcgtggc

SEQ ID NO: 615629 - DNA, 13 bp, D. melanogaster
ctggtggtgatga

SEQ ID NO: 615630 - DNA, 14 bp, D. melanogaster
ctggtggtgatgag

SEQ ID NO: 615631 - DNA, 14 bp, D. melanogaster
ctggtggttatagt

SEQ ID NO: 615632 - DNA, 13 bp, D. melanogaster
ctggtgtcctggg

SEQ ID NO: 615633 - DNA, 13 bp, D. melanogaster
ctggtgtgcgtgc

SEQ ID NO: 615634 - DNA, 13 bp, D. melanogaster
ctggttcaggttc

SEQ ID NO: 615635 - DNA, 13 bp, D. melanogaster
ctggttcgagttc

SEQ ID NO: 615636 - DNA, 13 bp, D. melanogaster
ctggttctccgct

SEQ ID NO: 615637 - DNA, 13 bp, D. melanogaster
ctggttctggttt

SEQ ID NO: 615638 - DNA, 13 bp, D. melanogaster
ctggttgcaatta

SEQ ID NO: 615639 - DNA, 13 bp, D. melanogaster
ctggttgcctact

SEQ ID NO: 615640 - DNA, 13 bp, D. melanogaster
ctggttgctgctg

SEQ ID NO: 615641 - DNA, 13 bp, D. melanogaster
ctggtttatttat

SEQ ID NO: 615642 - DNA, 13 bp, D. melanogaster
ctggtttcgaagt

SEQ ID NO: 615643 - DNA, 13 bp, D. melanogaster
ctggtttcggttt

SEQ ID NO: 615644 - DNA, 13 bp, D. melanogaster
ctggtttgaagta

SEQ ID NO: 615645 - DNA, 13 bp, D. melanogaster
ctggtttggcgtg

SEQ ID NO: 615646 - DNA, 13 bp, D. melanogaster
ctggtttgtggtc

SEQ ID NO: 615647 - DNA, 13 bp, D. melanogaster
ctggttttaatca

SEQ ID NO: 615648 - DNA, 13 bp, D. melanogaster
ctggtttttggct

SEQ ID NO: 615649 - DNA, 13 bp, D. melanogaster
ctggtttttgggc

SEQ ID NO: 615650 - DNA, 14 bp, D. melanogaster
ctgtaaaaaataaa

SEQ ID NO: 615651 - DNA, 13 bp, D. melanogaster
ctgtaaaaagaaa

SEQ ID NO: 615652 - DNA, 13 bp, D. melanogaster
ctgtaaaaataat

SEQ ID NO: 615653 - DNA, 13 bp, D. melanogaster
ctgtaaaaatatt

SEQ ID NO: 615654 - DNA, 13 bp, D. melanogaster
ctgtaaaaatgtt

SEQ ID NO: 615655 - DNA, 14 bp, D. melanogaster
ctgtaaaaatgttt

SEQ ID NO: 615656 - DNA, 13 bp, D. melanogaster
ctgtaaaaattgt

SEQ ID NO: 615657 - DNA, 13 bp, D. melanogaster
ctgtaaaacaaaa

SEQ ID NO: 615658 - DNA, 13 bp, D. melanogaster
ctgtaaaatagaa

SEQ ID NO: 615659 - DNA, 13 bp, D. melanogaster
ctgtaaaatcaga

SEQ ID NO: 615660 - DNA, 14 bp, D. melanogaster
ctgtaaaatcagag

SEQ ID NO: 615661 - DNA, 13 bp, D. melanogaster
ctgtaaacatatt

SEQ ID NO: 615662 - DNA, 13 bp, D. melanogaster
ctgtaaagaaaat

SEQ ID NO: 615663 - DNA, 13 bp, D. melanogaster
ctgtaaatatttg

SEQ ID NO: 615664 - DNA, 13 bp, D. melanogaster
ctgtaaatatttt

SEQ ID NO: 615665 - DNA, 13 bp, D. melanogaster
ctgtaaatgaaaa

SEQ ID NO: 615666 - DNA, 13 bp, D. melanogaster
ctgtaaattatat

SEQ ID NO: 615667 - DNA, 13 bp, D. melanogaster
ctgtaacaatcaa

SEQ ID NO: 615668 - DNA, 13 bp, D. melanogaster
ctgtaactgtaac

SEQ ID NO: 615669 - DNA, 14 bp, D. melanogaster
ctgtaactgtaact

SEQ ID NO: 615670 - DNA, 13 bp, D. melanogaster
ctgtaactgttgt

SEQ ID NO: 615671 - DNA, 13 bp, D. melanogaster
ctgtaacttgtta

SEQ ID NO: 615672 - DNA, 13 bp, D. melanogaster
ctgtaattagtgt

SEQ ID NO: 615673 - DNA, 14 bp, D. melanogaster
ctgtaattattaca

SEQ ID NO: 615674 - DNA, 13 bp, D. melanogaster
ctgtaattgtttt

SEQ ID NO: 615675 - DNA, 13 bp, D. melanogaster
ctgtaatttaatt

SEQ ID NO: 615676 - DNA, 13 bp, D. melanogaster
ctgtacaaatggt

SEQ ID NO: 615677 - DNA, 13 bp, D. melanogaster
ctgtacaaattaa

SEQ ID NO: 615678 - DNA, 13 bp, D. melanogaster
ctgtactgtactg

SEQ ID NO: 615679 - DNA, 13 bp, D. melanogaster
ctgtagaagaacc

SEQ ID NO: 615680 - DNA, 13 bp, D. melanogaster
ctgtagaggctaa

SEQ ID NO: 615681 - DNA, 13 bp, D. melanogaster
ctgtagcatactt

SEQ ID NO: 615682 - DNA, 13 bp, D. melanogaster
ctgtagctgctgt

SEQ ID NO: 615683 - DNA, 13 bp, D. melanogaster
ctgtagctgtagc

SEQ ID NO: 615684 - DNA, 14 bp, D. melanogaster
ctgtagctgtagct

SEQ ID NO: 615685 - DNA, 13 bp, D. melanogaster
ctgtagtcgagtt

SEQ ID NO: 615686 - DNA, 14 bp, D. melanogaster
ctgtagttgttgtt

SEQ ID NO: 615687 - DNA, 13 bp, D. melanogaster
ctgtagttttatt

SEQ ID NO: 615688 - DNA, 13 bp, D. melanogaster
ctgtataaacaaa

SEQ ID NO: 615689 - DNA, 13 bp, D. melanogaster
ctgtataattttt

SEQ ID NO: 615690 - DNA, 13 bp, D. melanogaster
ctgtatattttta

SEQ ID NO: 615691 - DNA, 13 bp, D. melanogaster
ctgtatctattaa

SEQ ID NO: 615692 - DNA, 14 bp, D. melanogaster
ctgtatctgaatct

SEQ ID NO: 615693 - DNA, 13 bp, D. melanogaster
ctgtatctgagta

SEQ ID NO: 615694 - DNA, 14 bp, D. melanogaster
ctgtatctgagtat

SEQ ID NO: 615695 - DNA, 14 bp, D. melanogaster
ctgtatctgcagct

SEQ ID NO: 615696 - DNA, 13 bp, D. melanogaster
ctgtatctgtacc

SEQ ID NO: 615697 - DNA, 15 bp, D. melanogaster
ctgtatctgtatctc

SEQ ID NO: 615698 - DNA, 13 bp, D. melanogaster
ctgtatctgtatg

SEQ ID NO: 615699 - DNA, 14 bp, D. melanogaster
ctgtatctgtatgt

SEQ ID NO: 615700 - DNA, 14 bp, D. melanogaster
ctgtatctgtattt

SEQ ID NO: 615701 - DNA, 13 bp, D. melanogaster
ctgtatctgtgcc

SEQ ID NO: 615702 - DNA, 13 bp, D. melanogaster
ctgtatctgtgtg

SEQ ID NO: 615703 - DNA, 14 bp, D. melanogaster
ctgtatctgtgtgt

SEQ ID NO: 615704 - DNA, 13 bp, D. melanogaster
ctgtatctgtttc

SEQ ID NO: 615705 - DNA, 13 bp, D. melanogaster
ctgtatcttttgc

SEQ ID NO: 615706 - DNA, 14 bp, D. melanogaster
ctgtatgcaaaact

SEQ ID NO: 615707 - DNA, 13 bp, D. melanogaster
ctgtatgccatct

SEQ ID NO: 615708 - DNA, 14 bp, D. melanogaster
ctgtattgttgcca

SEQ ID NO: 615709 - DNA, 13 bp, D. melanogaster
ctgtatttatatt

SEQ ID NO: 615710 - DNA, 13 bp, D. melanogaster
ctgtatttattaa

SEQ ID NO: 615711 - DNA, 13 bp, D. melanogaster
ctgtatttatttg

SEQ ID NO: 615712 - DNA, 14 bp, D. melanogaster
ctgtcaaaaaaaaa

SEQ ID NO: 615713 - DNA, 13 bp, D. melanogaster
ctgtcaaagtttt

SEQ ID NO: 615714 - DNA, 13 bp, D. melanogaster
ctgtcaagtgcag

SEQ ID NO: 615715 - DNA, 13 bp, D. melanogaster
ctgtcaatgatgg

SEQ ID NO: 615716 - DNA, 13 bp, D. melanogaster
ctgtcacgcccac

SEQ ID NO: 615717 - DNA, 13 bp, D. melanogaster
ctgtcagtcagtc

SEQ ID NO: 615718 - DNA, 13 bp, D. melanogaster
ctgtcatatttag

SEQ ID NO: 615719 - DNA, 13 bp, D. melanogaster
ctgtccaactgtc

SEQ ID NO: 615720 - DNA, 14 bp, D. melanogaster
ctgtccatatgaac

SEQ ID NO: 615721 - DNA, 14 bp, D. melanogaster
ctgtcccaagcact

SEQ ID NO: 615722 - DNA, 13 bp, D. melanogaster
ctgtccgatggtc

SEQ ID NO: 615723 - DNA, 13 bp, D. melanogaster
ctgtccgcctgtc

SEQ ID NO: 615724 - DNA, 13 bp, D. melanogaster
ctgtccgctgtcc

SEQ ID NO: 615725 - DNA, 14 bp, D. melanogaster
ctgtccgtccgttt

SEQ ID NO: 615726 - DNA, 13 bp, D. melanogaster
ctgtccgttcgtc

SEQ ID NO: 615727 - DNA, 13 bp, D. melanogaster
ctgtccgtttgtc

SEQ ID NO: 615728 - DNA, 13 bp, D. melanogaster
ctgtcctccgctc

SEQ ID NO: 615729 - DNA, 13 bp, D. melanogaster
ctgtcctttctca

SEQ ID NO: 615730 - DNA, 13 bp, D. melanogaster
ctgtcgacggcgg

SEQ ID NO: 615731 - DNA, 14 bp, D. melanogaster
ctgtcgctgctgct

SEQ ID NO: 615732 - DNA, 13 bp, D. melanogaster
ctgtcgctggtgg

SEQ ID NO: 615733 - DNA, 13 bp, D. melanogaster
ctgtcggagccaa

SEQ ID NO: 615734 - DNA, 13 bp, D. melanogaster
ctgtcggtataca

SEQ ID NO: 615735 - DNA, 13 bp, D. melanogaster
ctgtcgtcctgtc

SEQ ID NO: 615736 - DNA, 13 bp, D. melanogaster
ctgtcgtcgtcgt

SEQ ID NO: 615737 - DNA, 13 bp, D. melanogaster
ctgtctaggaaca

SEQ ID NO: 615738 - DNA, 13 bp, D. melanogaster
ctgtctatcctgt

SEQ ID NO: 615739 - DNA, 13 bp, D. melanogaster
ctgtctcgctcgc

SEQ ID NO: 615740 - DNA, 13 bp, D. melanogaster
ctgtctcgctctc

SEQ ID NO: 615741 - DNA, 13 bp, D. melanogaster
ctgtctctgtcgc

SEQ ID NO: 615742 - DNA, 13 bp, D. melanogaster
ctgtctctttcgc

SEQ ID NO: 615743 - DNA, 13 bp, D. melanogaster
ctgtctctttctg

SEQ ID NO: 615744 - DNA, 13 bp, D. melanogaster
ctgtctgcctgcc

SEQ ID NO: 615745 - DNA, 13 bp, D. melanogaster
ctgtctggcattt

SEQ ID NO: 615746 - DNA, 13 bp, D. melanogaster
ctgtctggcgatt

SEQ ID NO: 615747 - DNA, 13 bp, D. melanogaster
ctgtctggctggc

SEQ ID NO: 615748 - DNA, 13 bp, D. melanogaster
ctgtctggctgtc

SEQ ID NO: 615749 - DNA, 13 bp, D. melanogaster
ctgtctggtggtg

SEQ ID NO: 615750 - DNA, 13 bp, D. melanogaster
ctgtctgtccgtc

SEQ ID NO: 615751 - DNA, 13 bp, D. melanogaster
ctgtctgtctatc

SEQ ID NO: 615752 - DNA, 13 bp, D. melanogaster
ctgtctgtctgac

SEQ ID NO: 615753 - DNA, 13 bp, D. melanogaster
ctgtctgtctgcc

SEQ ID NO: 615754 - DNA, 13 bp, D. melanogaster
ctgtctgtctgtc

SEQ ID NO: 615755 - DNA, 13 bp, D. melanogaster
ctgtctgtctgtg

SEQ ID NO: 615756 - DNA, 13 bp, D. melanogaster
ctgtctgtgtgtg

SEQ ID NO: 615757 - DNA, 13 bp, D. melanogaster
ctgtcttatatta

SEQ ID NO: 615758 - DNA, 13 bp, D. melanogaster
ctgtgaaaaatct

SEQ ID NO: 615759 - DNA, 13 bp, D. melanogaster
ctgtgaaaaatgt

SEQ ID NO: 615760 - DNA, 13 bp, D. melanogaster
ctgtgaaaataaa

SEQ ID NO: 615761 - DNA, 13 bp, D. melanogaster
ctgtgaaacgggg

SEQ ID NO: 615762 - DNA, 13 bp, D. melanogaster
ctgtgaaatttct

SEQ ID NO: 615763 - DNA, 13 bp, D. melanogaster
ctgtgaagaaatg

SEQ ID NO: 615764 - DNA, 13 bp, D. melanogaster
ctgtgacaacatg

SEQ ID NO: 615765 - DNA, 14 bp, D. melanogaster
ctgtgactgtgact

SEQ ID NO: 615766 - DNA, 13 bp, D. melanogaster
ctgtgagtgtgtg

SEQ ID NO: 615767 - DNA, 14 bp, D. melanogaster
ctgtgagtgtgtgt

SEQ ID NO: 615768 - DNA, 13 bp, D. melanogaster
ctgtgatattttg

SEQ ID NO: 615769 - DNA, 13 bp, D. melanogaster
ctgtgatcaattt

SEQ ID NO: 615770 - DNA, 14 bp, D. melanogaster
ctgtgatttttggt

SEQ ID NO: 615771 - DNA, 13 bp, D. melanogaster
ctgtgcaaatttg

SEQ ID NO: 615772 - DNA, 13 bp, D. melanogaster
ctgtgcaacaaag

SEQ ID NO: 615773 - DNA, 13 bp, D. melanogaster
ctgtgcacacaca

SEQ ID NO: 615774 - DNA, 13 bp, D. melanogaster
ctgtgcaggctga

SEQ ID NO: 615775 - DNA, 13 bp, D. melanogaster
ctgtgcatatttt

SEQ ID NO: 615776 - DNA, 14 bp, D. melanogaster
ctgtgcatgtgtgt

SEQ ID NO: 615777 - DNA, 13 bp, D. melanogaster
ctgtgccaacgag

SEQ ID NO: 615778 - DNA, 13 bp, D. melanogaster
ctgtgcgccaagt

SEQ ID NO: 615779 - DNA, 13 bp, D. melanogaster
ctgtgctcacgaa

SEQ ID NO: 615780 - DNA, 13 bp, D. melanogaster
ctgtgctgctgct

SEQ ID NO: 615781 - DNA, 14 bp, D. melanogaster
ctgtgctgctgctg

SEQ ID NO: 615782 - DNA, 13 bp, D. melanogaster
ctgtgctgtgtgt

SEQ ID NO: 615783 - DNA, 13 bp, D. melanogaster
ctgtggaaaatgt

SEQ ID NO: 615784 - DNA, 13 bp, D. melanogaster
ctgtggaaatgga

SEQ ID NO: 615785 - DNA, 13 bp, D. melanogaster
ctgtggatgtgga

SEQ ID NO: 615786 - DNA, 13 bp, D. melanogaster
ctgtggcaaaagt

SEQ ID NO: 615787 - DNA, 13 bp, D. melanogaster
ctgtggcagatac

SEQ ID NO: 615788 - DNA, 14 bp, D. melanogaster
ctgtggcagatacc

SEQ ID NO: 615789 - DNA, 13 bp, D. melanogaster
ctgtggcagcaac

SEQ ID NO: 615790 - DNA, 14 bp, D. melanogaster
ctgtggcagcaaca

SEQ ID NO: 615791 - DNA, 13 bp, D. melanogaster
ctgtggcagcagc

SEQ ID NO: 615792 - DNA, 13 bp, D. melanogaster
ctgtggcattttt

SEQ ID NO: 615793 - DNA, 13 bp, D. melanogaster
ctgtggcgctcca

SEQ ID NO: 615794 - DNA, 13 bp, D. melanogaster
ctgtggttatgca

SEQ ID NO: 615795 - DNA, 13 bp, D. melanogaster
ctgtggttctcca

SEQ ID NO: 615796 - DNA, 14 bp, D. melanogaster
ctgtgtaaatattt

SEQ ID NO: 615797 - DNA, 13 bp, D. melanogaster
ctgtgtaaatgtg

SEQ ID NO: 615798 - DNA, 13 bp, D. melanogaster
ctgtgtatgtttt

SEQ ID NO: 615799 - DNA, 13 bp, D. melanogaster
ctgtgtccaaaaa

SEQ ID NO: 615800 - DNA, 13 bp, D. melanogaster
ctgtgtcctccac

SEQ ID NO: 615801 - DNA, 13 bp, D. melanogaster
ctgtgtctgtgtg

SEQ ID NO: 615802 - DNA, 13 bp, D. melanogaster
ctgtgtgagtgag

SEQ ID NO: 615803 - DNA, 13 bp, D. melanogaster
ctgtgtgagtgtg

SEQ ID NO: 615804 - DNA, 13 bp, D. melanogaster
ctgtgtgcagcaa

SEQ ID NO: 615805 - DNA, 13 bp, D. melanogaster
ctgtgtgcgtgcg

SEQ ID NO: 615806 - DNA, 13 bp, D. melanogaster
ctgtgtgcgtgtt

SEQ ID NO: 615807 - DNA, 14 bp, D. melanogaster
ctgtgtgcgtgttt

SEQ ID NO: 615808 - DNA, 13 bp, D. melanogaster
ctgtgtgctctgt

SEQ ID NO: 615809 - DNA, 13 bp, D. melanogaster
ctgtgtgcttgtg

SEQ ID NO: 615810 - DNA, 13 bp, D. melanogaster
ctgtgtgggtgag

SEQ ID NO: 615811 - DNA, 13 bp, D. melanogaster
ctgtgtgtatgtg

SEQ ID NO: 615812 - DNA, 14 bp, D. melanogaster
ctgtgtgtatgtgt

SEQ ID NO: 615813 - DNA, 13 bp, D. melanogaster
ctgtgtgtatttg

SEQ ID NO: 615814 - DNA, 13 bp, D. melanogaster
ctgtgtgtctgtg

SEQ ID NO: 615815 - DNA, 13 bp, D. melanogaster
ctgtgtgtgagtg

SEQ ID NO: 615816 - DNA, 13 bp, D. melanogaster
ctgtgtgtgcatg

SEQ ID NO: 615817 - DNA, 13 bp, D. melanogaster
ctgtgtgtgcgag

SEQ ID NO: 615818 - DNA, 14 bp, D. melanogaster
ctgtgtgtgcgagt

SEQ ID NO: 615819 - DNA, 13 bp, D. melanogaster
ctgtgtgtgtata

SEQ ID NO: 615820 - DNA, 13 bp, D. melanogaster
ctgtgtgtgtatg

SEQ ID NO: 615821 - DNA, 14 bp, D. melanogaster
ctgtgtgtgtatgt

SEQ ID NO: 615822 - DNA, 13 bp, D. melanogaster
ctgtgtgtgtgaa

SEQ ID NO: 615823 - DNA, 13 bp, D. melanogaster
ctgtgtgtgtgag

SEQ ID NO: 615824 - DNA, 13 bp, D. melanogaster
ctgtgttctgtgt

SEQ ID NO: 615825 - DNA, 13 bp, D. melanogaster
ctgtgttttgatt

SEQ ID NO: 615826 - DNA, 13 bp, D. melanogaster
ctgttaaaataaa

SEQ ID NO: 615827 - DNA, 13 bp, D. melanogaster
ctgttaaaataat

SEQ ID NO: 615828 - DNA, 13 bp, D. melanogaster
ctgttaaatgaat

SEQ ID NO: 615829 - DNA, 13 bp, D. melanogaster
ctgttaaatttaa

SEQ ID NO: 615830 - DNA, 13 bp, D. melanogaster
ctgttaaccgaaa

SEQ ID NO: 615831 - DNA, 13 bp, D. melanogaster
ctgttaagacagc

SEQ ID NO: 615832 - DNA, 13 bp, D. melanogaster
ctgttaatccaag

SEQ ID NO: 615833 - DNA, 13 bp, D. melanogaster
ctgttacaatatt

SEQ ID NO: 615834 - DNA, 13 bp, D. melanogaster
ctgttacatattt

SEQ ID NO: 615835 - DNA, 13 bp, D. melanogaster
ctgttacattttt

SEQ ID NO: 615836 - DNA, 13 bp, D. melanogaster
ctgttattattat

SEQ ID NO: 615837 - DNA, 13 bp, D. melanogaster
ctgttattgtttg

SEQ ID NO: 615838 - DNA, 13 bp, D. melanogaster
ctgttcaatcagg

SEQ ID NO: 615839 - DNA, 13 bp, D. melanogaster
ctgttcaatggtt

SEQ ID NO: 615840 - DNA, 14 bp, D. melanogaster
ctgttcacacatga

SEQ ID NO: 615841 - DNA, 13 bp, D. melanogaster
ctgttcattatgc

SEQ ID NO: 615842 - DNA, 13 bp, D. melanogaster
ctgttcccagttg

SEQ ID NO: 615843 - DNA, 13 bp, D. melanogaster
ctgttcccgccgc

SEQ ID NO: 615844 - DNA, 13 bp, D. melanogaster
ctgttccctttgc

SEQ ID NO: 615845 - DNA, 13 bp, D. melanogaster
ctgttcctgttcc

SEQ ID NO: 615846 - DNA, 14 bp, D. melanogaster
ctgttcctgttcct

SEQ ID NO: 615847 - DNA, 13 bp, D. melanogaster
ctgttcgatggtt

SEQ ID NO: 615848 - DNA, 13 bp, D. melanogaster
ctgttcgcctggt

SEQ ID NO: 615849 - DNA, 13 bp, D. melanogaster
ctgttcgggtttc

SEQ ID NO: 615850 - DNA, 13 bp, D. melanogaster
ctgttctaaaata

SEQ ID NO: 615851 - DNA, 14 bp, D. melanogaster
ctgttctacatttt

SEQ ID NO: 615852 - DNA, 13 bp, D. melanogaster
ctgttctacggcc

SEQ ID NO: 615853 - DNA, 14 bp, D. melanogaster
ctgttctgttctgt

SEQ ID NO: 615854 - DNA, 13 bp, D. melanogaster
ctgttcttggatt

SEQ ID NO: 615855 - DNA, 14 bp, D. melanogaster
ctgttgaaatattt

SEQ ID NO: 615856 - DNA, 13 bp, D. melanogaster
ctgttgagcagca

SEQ ID NO: 615857 - DNA, 13 bp, D. melanogaster
ctgttgatatttt

SEQ ID NO: 615858 - DNA, 13 bp, D. melanogaster
ctgttgatgctgc

SEQ ID NO: 615859 - DNA, 13 bp, D. melanogaster
ctgttgattgata

SEQ ID NO: 615860 - DNA, 13 bp, D. melanogaster
ctgttgatttgtt

SEQ ID NO: 615861 - DNA, 13 bp, D. melanogaster
ctgttgattttcc

SEQ ID NO: 615862 - DNA, 13 bp, D. melanogaster
ctgttgattttgc

SEQ ID NO: 615863 - DNA, 14 bp, D. melanogaster
ctgttgcaagttgc

SEQ ID NO: 615864 - DNA, 13 bp, D. melanogaster
ctgttgcactttt

SEQ ID NO: 615865 - DNA, 14 bp, D. melanogaster
ctgttgcagttgca

SEQ ID NO: 615866 - DNA, 14 bp, D. melanogaster
ctgttgcagttgct

SEQ ID NO: 615867 - DNA, 13 bp, D. melanogaster
ctgttgccccaaa

SEQ ID NO: 615868 - DNA, 14 bp, D. melanogaster
ctgttgccgctgct

SEQ ID NO: 615869 - DNA, 15 bp, D. melanogaster
ctgttgccgctgctg

SEQ ID NO: 615870 - DNA, 13 bp, D. melanogaster
ctgttgccgcttg

SEQ ID NO: 615871 - DNA, 13 bp, D. melanogaster
ctgttgccggtgc

SEQ ID NO: 615872 - DNA, 13 bp, D. melanogaster
ctgttgcggctta

SEQ ID NO: 615873 - DNA, 14 bp, D. melanogaster
ctgttgctattgct

SEQ ID NO: 615874 - DNA, 13 bp, D. melanogaster
ctgttgctcctgt

SEQ ID NO: 615875 - DNA, 13 bp, D. melanogaster
ctgttgctgattt

SEQ ID NO: 615876 - DNA, 13 bp, D. melanogaster
ctgttgctgctac

SEQ ID NO: 615877 - DNA, 15 bp, D. melanogaster
ctgttgctgctgctg

SEQ ID NO: 615878 - DNA, 13 bp, D. melanogaster
ctgttgctgctgt

SEQ ID NO: 615879 - DNA, 13 bp, D. melanogaster
ctgttgctgcttc

SEQ ID NO: 615880 - DNA, 13 bp, D. melanogaster
ctgttgctggtgc

SEQ ID NO: 615881 - DNA, 13 bp, D. melanogaster
ctgttgctgtcgc

SEQ ID NO: 615882 - DNA, 13 bp, D. melanogaster
ctgttgctgtggc

SEQ ID NO: 615883 - DNA, 14 bp, D. melanogaster
ctgttgctgttgca

SEQ ID NO: 615884 - DNA, 14 bp, D. melanogaster
ctgttgctgttgcc

SEQ ID NO: 615885 - DNA, 13 bp, D. melanogaster
ctgttgctgttgg

SEQ ID NO: 615886 - DNA, 14 bp, D. melanogaster
ctgttgcttctgtt

SEQ ID NO: 615887 - DNA, 13 bp, D. melanogaster
ctgttgcttttgc

SEQ ID NO: 615888 - DNA, 13 bp, D. melanogaster
ctgttgcttttgg

SEQ ID NO: 615889 - DNA, 13 bp, D. melanogaster
ctgttggattggg

SEQ ID NO: 615890 - DNA, 14 bp, D. melanogaster
ctgttggccaaaaa

SEQ ID NO: 615891 - DNA, 13 bp, D. melanogaster
ctgttggccaaca

SEQ ID NO: 615892 - DNA, 13 bp, D. melanogaster
ctgttggccagtt

SEQ ID NO: 615893 - DNA, 13 bp, D. melanogaster
ctgttggccatat

SEQ ID NO: 615894 - DNA, 13 bp, D. melanogaster
ctgttggccatgt

SEQ ID NO: 615895 - DNA, 13 bp, D. melanogaster
ctgttggccattt

SEQ ID NO: 615896 - DNA, 13 bp, D. melanogaster
ctgttgtactttt

SEQ ID NO: 615897 - DNA, 13 bp, D. melanogaster
ctgttgtcgctgt

SEQ ID NO: 615898 - DNA, 14 bp, D. melanogaster
ctgttgtcgctgtt

SEQ ID NO: 615899 - DNA, 13 bp, D. melanogaster
ctgttgttatgca

SEQ ID NO: 615900 - DNA, 13 bp, D. melanogaster
ctgttgttattgt

SEQ ID NO: 615901 - DNA, 14 bp, D. melanogaster
ctgttgttattgtt

SEQ ID NO: 615902 - DNA, 13 bp, D. melanogaster
ctgttgttgctcc

SEQ ID NO: 615903 - DNA, 13 bp, D. melanogaster
ctgttgttgctgc

SEQ ID NO: 615904 - DNA, 14 bp, D. melanogaster
ctgttgttgctgct

SEQ ID NO: 615905 - DNA, 13 bp, D. melanogaster
ctgttgttgctgg

SEQ ID NO: 615906 - DNA, 13 bp, D. melanogaster
ctgttgttggctt

SEQ ID NO: 615907 - DNA, 14 bp, D. melanogaster
ctgttgttgttgca

SEQ ID NO: 615908 - DNA, 13 bp, D. melanogaster
ctgtttaatttgt

SEQ ID NO: 615909 - DNA, 13 bp, D. melanogaster
ctgtttaccttat

SEQ ID NO: 615910 - DNA, 13 bp, D. melanogaster
ctgtttactgttt

SEQ ID NO: 615911 - DNA, 13 bp, D. melanogaster
ctgtttactttgc

SEQ ID NO: 615912 - DNA, 13 bp, D. melanogaster
ctgtttagaaatt

SEQ ID NO: 615913 - DNA, 13 bp, D. melanogaster
ctgtttagctttt

SEQ ID NO: 615914 - DNA, 13 bp, D. melanogaster
ctgtttcaacttc

SEQ ID NO: 615915 - DNA, 13 bp, D. melanogaster
ctgtttcagtttc

SEQ ID NO: 615916 - DNA, 13 bp, D. melanogaster
ctgtttccatttc

SEQ ID NO: 615917 - DNA, 13 bp, D. melanogaster
ctgtttcggatcc

SEQ ID NO: 615918 - DNA, 14 bp, D. melanogaster
ctgtttcggatcct

SEQ ID NO: 615919 - DNA, 13 bp, D. melanogaster
ctgtttctgctcc

SEQ ID NO: 615920 - DNA, 13 bp, D. melanogaster
ctgtttctgtgtg

SEQ ID NO: 615921 - DNA, 13 bp, D. melanogaster
ctgtttctgttcc

SEQ ID NO: 615922 - DNA, 14 bp, D. melanogaster
ctgtttcttttcta

SEQ ID NO: 615923 - DNA, 13 bp, D. melanogaster
ctgtttgagtttt

SEQ ID NO: 615924 - DNA, 13 bp, D. melanogaster
ctgtttgcagcat

SEQ ID NO: 615925 - DNA, 13 bp, D. melanogaster
ctgtttgcattta

SEQ ID NO: 615926 - DNA, 13 bp, D. melanogaster
ctgtttgccagcc

SEQ ID NO: 615927 - DNA, 13 bp, D. melanogaster
ctgtttgccattt

SEQ ID NO: 615928 - DNA, 13 bp, D. melanogaster
ctgtttgccgttt

SEQ ID NO: 615929 - DNA, 13 bp, D. melanogaster
ctgtttgcctttc

SEQ ID NO: 615930 - DNA, 13 bp, D. melanogaster
ctgtttgcctttg

SEQ ID NO: 615931 - DNA, 13 bp, D. melanogaster
ctgtttgcgtttg

SEQ ID NO: 615932 - DNA, 13 bp, D. melanogaster
ctgtttgctggcc

SEQ ID NO: 615933 - DNA, 13 bp, D. melanogaster
ctgtttgctgttg

SEQ ID NO: 615934 - DNA, 13 bp, D. melanogaster
ctgtttggagtcc

SEQ ID NO: 615935 - DNA, 13 bp, D. melanogaster
ctgtttggccaaa

SEQ ID NO: 615936 - DNA, 13 bp, D. melanogaster
ctgtttggctgtt

SEQ ID NO: 615937 - DNA, 13 bp, D. melanogaster
ctgtttggtgtat

SEQ ID NO: 615938 - DNA, 14 bp, D. melanogaster
ctgtttggtttcca

SEQ ID NO: 615939 - DNA, 13 bp, D. melanogaster
ctgtttgtaaatt

SEQ ID NO: 615940 - DNA, 13 bp, D. melanogaster
ctgttttaatatt

SEQ ID NO: 615941 - DNA, 13 bp, D. melanogaster
ctgttttacattt

SEQ ID NO: 615942 - DNA, 13 bp, D. melanogaster
ctgttttcaagaa

SEQ ID NO: 615943 - DNA, 13 bp, D. melanogaster
ctgttttcacagt

SEQ ID NO: 615944 - DNA, 13 bp, D. melanogaster
ctgttttcgcaag

SEQ ID NO: 615945 - DNA, 15 bp, D. melanogaster
ctgttttgagcagct

SEQ ID NO: 615946 - DNA, 13 bp, D. melanogaster
ctgttttgcattt

SEQ ID NO: 615947 - DNA, 13 bp, D. melanogaster
ctgttttgcgtta

SEQ ID NO: 615948 - DNA, 13 bp, D. melanogaster
ctgttttggtaat

SEQ ID NO: 615949 - DNA, 13 bp, D. melanogaster
ctgttttgtgcac

SEQ ID NO: 615950 - DNA, 13 bp, D. melanogaster
ctgttttgtgcag

SEQ ID NO: 615951 - DNA, 14 bp, D. melanogaster
ctgtttttaggtaa

SEQ ID NO: 615952 - DNA, 13 bp, D. melanogaster
ctgtttttgcgct

SEQ ID NO: 615953 - DNA, 13 bp, D. melanogaster
ctgtttttggcca

SEQ ID NO: 615954 - DNA, 13 bp, D. melanogaster
ctgttttttccca

SEQ ID NO: 615955 - DNA, 13 bp, D. melanogaster
ctgtttttttaaa

SEQ ID NO: 615956 - DNA, 13 bp, D. melanogaster
cttaaaaaaagga

SEQ ID NO: 615957 - DNA, 13 bp, D. melanogaster
cttaaaaaactta

SEQ ID NO: 615958 - DNA, 14 bp, D. melanogaster
cttaaaaaagaaat

SEQ ID NO: 615959 - DNA, 13 bp, D. melanogaster
cttaaaaaatgaa

SEQ ID NO: 615960 - DNA, 13 bp, D. melanogaster
cttaaaaaatgta

SEQ ID NO: 615961 - DNA, 13 bp, D. melanogaster
cttaaaaagcaaa

SEQ ID NO: 615962 - DNA, 13 bp, D. melanogaster
cttaaaaagcatt

SEQ ID NO: 615963 - DNA, 14 bp, D. melanogaster
cttaaaaatctaac

SEQ ID NO: 615964 - DNA, 13 bp, D. melanogaster
cttaaaaatgtaa

SEQ ID NO: 615965 - DNA, 13 bp, D. melanogaster
cttaaaaatgtat

SEQ ID NO: 615966 - DNA, 13 bp, D. melanogaster
cttaaaaattgtt

SEQ ID NO: 615967 - DNA, 13 bp, D. melanogaster
cttaaaaatttga

SEQ ID NO: 615968 - DNA, 14 bp, D. melanogaster
cttaaaacattttt

SEQ ID NO: 615969 - DNA, 13 bp, D. melanogaster
cttaaaaccattg

SEQ ID NO: 615970 - DNA, 13 bp, D. melanogaster
cttaaaactaatt

SEQ ID NO: 615971 - DNA, 13 bp, D. melanogaster
cttaaaagaattt

SEQ ID NO: 615972 - DNA, 13 bp, D. melanogaster
cttaaaagatttt

SEQ ID NO: 615973 - DNA, 13 bp, D. melanogaster
cttaaaagtagga

SEQ ID NO: 615974 - DNA, 13 bp, D. melanogaster
cttaaaagttgaa

SEQ ID NO: 615975 - DNA, 13 bp, D. melanogaster
cttaaaatacatt

SEQ ID NO: 615976 - DNA, 13 bp, D. melanogaster
cttaaaatatcat

SEQ ID NO: 615977 - DNA, 13 bp, D. melanogaster
cttaaaatcgttg

SEQ ID NO: 615978 - DNA, 13 bp, D. melanogaster
cttaaaatgaaaa

SEQ ID NO: 615979 - DNA, 13 bp, D. melanogaster
cttaaaatgcaat

SEQ ID NO: 615980 - DNA, 13 bp, D. melanogaster
cttaaaatggaaa

SEQ ID NO: 615981 - DNA, 13 bp, D. melanogaster
cttaaaatgttta

SEQ ID NO: 615982 - DNA, 13 bp, D. melanogaster
cttaaaattcaat

SEQ ID NO: 615983 - DNA, 13 bp, D. melanogaster
cttaaaattgaat

SEQ ID NO: 615984 - DNA, 13 bp, D. melanogaster
cttaaaattgtat

SEQ ID NO: 615985 - DNA, 13 bp, D. melanogaster
cttaaaattgttt

SEQ ID NO: 615986 - DNA, 13 bp, D. melanogaster
cttaaacaaacac

SEQ ID NO: 615987 - DNA, 13 bp, D. melanogaster
cttaaacaaccaa

SEQ ID NO: 615988 - DNA, 13 bp, D. melanogaster
cttaaacatctaa

SEQ ID NO: 615989 - DNA, 13 bp, D. melanogaster
cttaaacatttaa

SEQ ID NO: 615990 - DNA, 13 bp, D. melanogaster
cttaaacttttct

SEQ ID NO: 615991 - DNA, 13 bp, D. melanogaster
cttaaagaaaatt

SEQ ID NO: 615992 - DNA, 13 bp, D. melanogaster
cttaaagaatatg

SEQ ID NO: 615993 - DNA, 13 bp, D. melanogaster
cttaaagagaagc

SEQ ID NO: 615994 - DNA, 13 bp, D. melanogaster
cttaaagatgagc

SEQ ID NO: 615995 - DNA, 13 bp, D. melanogaster
cttaaagcataaa

SEQ ID NO: 615996 - DNA, 13 bp, D. melanogaster
cttaaagcctaaa

SEQ ID NO: 615997 - DNA, 14 bp, D. melanogaster
cttaaagcgaatta

SEQ ID NO: 615998 - DNA, 13 bp, D. melanogaster
cttaaaggagctg

SEQ ID NO: 615999 - DNA, 13 bp, D. melanogaster
cttaaagttaaat

SEQ ID NO: 616000 - DNA, 13 bp, D. melanogaster
cttaaagtttttt

SEQ ID NO: 616001 - DNA, 13 bp, D. melanogaster
cttaaataacttt

SEQ ID NO: 616002 - DNA, 13 bp, D. melanogaster
cttaaatacatag

SEQ ID NO: 616003 - DNA, 13 bp, D. melanogaster
cttaaatacattt

SEQ ID NO: 616004 - DNA, 13 bp, D. melanogaster
cttaaatagttaa

SEQ ID NO: 616005 - DNA, 13 bp, D. melanogaster
cttaaatatatac

SEQ ID NO: 616006 - DNA, 13 bp, D. melanogaster
cttaaatattgat

SEQ ID NO: 616007 - DNA, 13 bp, D. melanogaster
cttaaatatttag

SEQ ID NO: 616008 - DNA, 13 bp, D. melanogaster
cttaaatcatatg

SEQ ID NO: 616009 - DNA, 13 bp, D. melanogaster
cttaaatccaatt

SEQ ID NO: 616010 - DNA, 13 bp, D. melanogaster
cttaaatctttaa

SEQ ID NO: 616011 - DNA, 13 bp, D. melanogaster
cttaaatgcaatt

SEQ ID NO: 616012 - DNA, 14 bp, D. melanogaster
cttaaatgcagaaa

SEQ ID NO: 616013 - DNA, 13 bp, D. melanogaster
cttaaatgccttt

SEQ ID NO: 616014 - DNA, 13 bp, D. melanogaster
cttaaatgttatt

SEQ ID NO: 616015 - DNA, 13 bp, D. melanogaster
cttaaatgttttt

SEQ ID NO: 616016 - DNA, 13 bp, D. melanogaster
cttaaattatact

SEQ ID NO: 616017 - DNA, 14 bp, D. melanogaster
cttaaattatactt

SEQ ID NO: 616018 - DNA, 13 bp, D. melanogaster
cttaaattatgca

SEQ ID NO: 616019 - DNA, 13 bp, D. melanogaster
cttaaattattca

SEQ ID NO: 616020 - DNA, 13 bp, D. melanogaster
cttaaattatttc

SEQ ID NO: 616021 - DNA, 13 bp, D. melanogaster
cttaaattcaagg

SEQ ID NO: 616022 - DNA, 13 bp, D. melanogaster
cttaaattcattt

SEQ ID NO: 616023 - DNA, 13 bp, D. melanogaster
cttaaattgaaaa

SEQ ID NO: 616024 - DNA, 13 bp, D. melanogaster
cttaaattggttt

SEQ ID NO: 616025 - DNA, 13 bp, D. melanogaster
cttaaatttaact

SEQ ID NO: 616026 - DNA, 14 bp, D. melanogaster
cttaaatttatatg

SEQ ID NO: 616027 - DNA, 13 bp, D. melanogaster
cttaaatttcaat

SEQ ID NO: 616028 - DNA, 13 bp, D. melanogaster
cttaaatttcatt

SEQ ID NO: 616029 - DNA, 13 bp, D. melanogaster
cttaaatttgcat

SEQ ID NO: 616030 - DNA, 13 bp, D. melanogaster
cttaacaaataat

SEQ ID NO: 616031 - DNA, 13 bp, D. melanogaster
cttaacaagtttt

SEQ ID NO: 616032 - DNA, 13 bp, D. melanogaster
cttaacagtgcca

SEQ ID NO: 616033 - DNA, 13 bp, D. melanogaster
cttaacataaatt

SEQ ID NO: 616034 - DNA, 13 bp, D. melanogaster
cttaacataattt

SEQ ID NO: 616035 - DNA, 13 bp, D. melanogaster
cttaacattattt

SEQ ID NO: 616036 - DNA, 13 bp, D. melanogaster
cttaacattttta

SEQ ID NO: 616037 - DNA, 13 bp, D. melanogaster
cttaaccactcgt

SEQ ID NO: 616038 - DNA, 13 bp, D. melanogaster
cttaacccattga

SEQ ID NO: 616039 - DNA, 13 bp, D. melanogaster
cttaaccctttgc

SEQ ID NO: 616040 - DNA, 13 bp, D. melanogaster
cttaacccttttg

SEQ ID NO: 616041 - DNA, 13 bp, D. melanogaster
cttaacgcaaaac

SEQ ID NO: 616042 - DNA, 13 bp, D. melanogaster
cttaactaaatta

SEQ ID NO: 616043 - DNA, 13 bp, D. melanogaster
cttaacttttgtt

SEQ ID NO: 616044 - DNA, 14 bp, D. melanogaster
cttaacttttgttt

SEQ ID NO: 616045 - DNA, 13 bp, D. melanogaster
cttaagaatccaa

SEQ ID NO: 616046 - DNA, 13 bp, D. melanogaster
cttaagactaaaa

SEQ ID NO: 616047 - DNA, 13 bp, D. melanogaster
cttaagactaaca

SEQ ID NO: 616048 - DNA, 13 bp, D. melanogaster
cttaagatattct

SEQ ID NO: 616049 - DNA, 13 bp, D. melanogaster
cttaagcaaaaaa

SEQ ID NO: 616050 - DNA, 13 bp, D. melanogaster
cttaagcatttaa

SEQ ID NO: 616051 - DNA, 13 bp, D. melanogaster
cttaagcttaagc

SEQ ID NO: 616052 - DNA, 14 bp, D. melanogaster
cttaagcttaagct

SEQ ID NO: 616053 - DNA, 13 bp, D. melanogaster
cttaagggccccc

SEQ ID NO: 616054 - DNA, 13 bp, D. melanogaster
cttaagtaaccaa

SEQ ID NO: 616055 - DNA, 13 bp, D. melanogaster
cttaagtcagtcg

SEQ ID NO: 616056 - DNA, 13 bp, D. melanogaster
cttaagtgaaatg

SEQ ID NO: 616057 - DNA, 13 bp, D. melanogaster
cttaagtgctgtc

SEQ ID NO: 616058 - DNA, 13 bp, D. melanogaster
cttaagtggcagc

SEQ ID NO: 616059 - DNA, 13 bp, D. melanogaster
cttaagttaagtt

SEQ ID NO: 616060 - DNA, 13 bp, D. melanogaster
cttaagttccaca

SEQ ID NO: 616061 - DNA, 13 bp, D. melanogaster
cttaagttccgtg

SEQ ID NO: 616062 - DNA, 13 bp, D. melanogaster
cttaagttgaatc

SEQ ID NO: 616063 - DNA, 13 bp, D. melanogaster
cttaagtttatta

SEQ ID NO: 616064 - DNA, 13 bp, D. melanogaster
cttaagtttttca

SEQ ID NO: 616065 - DNA, 14 bp, D. melanogaster
cttaagtttttcat

SEQ ID NO: 616066 - DNA, 13 bp, D. melanogaster
cttaagtttttta

SEQ ID NO: 616067 - DNA, 13 bp, D. melanogaster
cttaataaatctt

SEQ ID NO: 616068 - DNA, 13 bp, D. melanogaster
cttaataaatgta

SEQ ID NO: 616069 - DNA, 13 bp, D. melanogaster
cttaataaattca

SEQ ID NO: 616070 - DNA, 13 bp, D. melanogaster
cttaataactttt

SEQ ID NO: 616071 - DNA, 13 bp, D. melanogaster
cttaataagatcc

SEQ ID NO: 616072 - DNA, 13 bp, D. melanogaster
cttaatagtcata

SEQ ID NO: 616073 - DNA, 13 bp, D. melanogaster
cttaatataacaa

SEQ ID NO: 616074 - DNA, 13 bp, D. melanogaster
cttaatatatgta

SEQ ID NO: 616075 - DNA, 14 bp, D. melanogaster
cttaatatattcgt

SEQ ID NO: 616076 - DNA, 13 bp, D. melanogaster
cttaatatctatt

SEQ ID NO: 616077 - DNA, 13 bp, D. melanogaster
cttaatattcata

SEQ ID NO: 616078 - DNA, 13 bp, D. melanogaster
cttaatattgcat

SEQ ID NO: 616079 - DNA, 13 bp, D. melanogaster
cttaatatttttg

SEQ ID NO: 616080 - DNA, 14 bp, D. melanogaster
cttaatatttttgt

SEQ ID NO: 616081 - DNA, 13 bp, D. melanogaster
cttaatcttaatc

SEQ ID NO: 616082 - DNA, 13 bp, D. melanogaster
cttaatgaaaata

SEQ ID NO: 616083 - DNA, 13 bp, D. melanogaster
cttaatgaaataa

SEQ ID NO: 616084 - DNA, 13 bp, D. melanogaster
cttaatgaaatcc

SEQ ID NO: 616085 - DNA, 13 bp, D. melanogaster
cttaatgtttgtt

SEQ ID NO: 616086 - DNA, 13 bp, D. melanogaster
cttaattaaagcc

SEQ ID NO: 616087 - DNA, 13 bp, D. melanogaster
cttaattaattag

SEQ ID NO: 616088 - DNA, 13 bp, D. melanogaster
cttaattacaatt

SEQ ID NO: 616089 - DNA, 13 bp, D. melanogaster
cttaattaccatt

SEQ ID NO: 616090 - DNA, 14 bp, D. melanogaster
cttaattaccattg

SEQ ID NO: 616091 - DNA, 13 bp, D. melanogaster
cttaattatttac

SEQ ID NO: 616092 - DNA, 13 bp, D. melanogaster
cttaattgaaaaa

SEQ ID NO: 616093 - DNA, 13 bp, D. melanogaster
cttaattgaaaac

SEQ ID NO: 616094 - DNA, 14 bp, D. melanogaster
cttaattgagtata

SEQ ID NO: 616095 - DNA, 13 bp, D. melanogaster
cttaattgtattt

SEQ ID NO: 616096 - DNA, 13 bp, D. melanogaster
cttaattgtttta

SEQ ID NO: 616097 - DNA, 13 bp, D. melanogaster
cttaatttataca

SEQ ID NO: 616098 - DNA, 13 bp, D. melanogaster
cttaatttattgt

SEQ ID NO: 616099 - DNA, 13 bp, D. melanogaster
cttaatttgaatt

SEQ ID NO: 616100 - DNA, 13 bp, D. melanogaster
cttaatttgtaaa

SEQ ID NO: 616101 - DNA, 13 bp, D. melanogaster
cttaatttgtttg

SEQ ID NO: 616102 - DNA, 14 bp, D. melanogaster
cttaattttgcgaa

SEQ ID NO: 616103 - DNA, 13 bp, D. melanogaster
cttaatttttgct

SEQ ID NO: 616104 - DNA, 13 bp, D. melanogaster
cttaatttttgta

SEQ ID NO: 616105 - DNA, 13 bp, D. melanogaster
cttacaaaaagac

SEQ ID NO: 616106 - DNA, 13 bp, D. melanogaster
cttacaaaagagt

SEQ ID NO: 616107 - DNA, 13 bp, D. melanogaster
cttacaaaattaa

SEQ ID NO: 616108 - DNA, 13 bp, D. melanogaster
cttacaaataaag

SEQ ID NO: 616109 - DNA, 13 bp, D. melanogaster
cttacaacttttt

SEQ ID NO: 616110 - DNA, 13 bp, D. melanogaster
cttacaatccgat

SEQ ID NO: 616111 - DNA, 13 bp, D. melanogaster
cttacaattcccc

SEQ ID NO: 616112 - DNA, 13 bp, D. melanogaster
cttacaattttgg

SEQ ID NO: 616113 - DNA, 13 bp, D. melanogaster
cttacacacacac

SEQ ID NO: 616114 - DNA, 14 bp, D. melanogaster
cttacacacacaca

SEQ ID NO: 616115 - DNA, 13 bp, D. melanogaster
cttacacattttt

SEQ ID NO: 616116 - DNA, 13 bp, D. melanogaster
cttacactcacac

SEQ ID NO: 616117 - DNA, 13 bp, D. melanogaster
cttacagctatat

SEQ ID NO: 616118 - DNA, 14 bp, D. melanogaster
cttacaggcgaaga

SEQ ID NO: 616119 - DNA, 13 bp, D. melanogaster
cttacatacacac

SEQ ID NO: 616120 - DNA, 14 bp, D. melanogaster
cttacatacatata

SEQ ID NO: 616121 - DNA, 14 bp, D. melanogaster
cttacatatatata

SEQ ID NO: 616122 - DNA, 14 bp, D. melanogaster
cttacatatatgta

SEQ ID NO: 616123 - DNA, 13 bp, D. melanogaster
cttacatatattt

SEQ ID NO: 616124 - DNA, 14 bp, D. melanogaster
cttacatatgtaca

SEQ ID NO: 616125 - DNA, 13 bp, D. melanogaster
cttacatctatat

SEQ ID NO: 616126 - DNA, 13 bp, D. melanogaster
cttaccaaaaatg

SEQ ID NO: 616127 - DNA, 13 bp, D. melanogaster
cttaccacaaaaa

SEQ ID NO: 616128 - DNA, 13 bp, D. melanogaster
cttaccattttcc

SEQ ID NO: 616129 - DNA, 13 bp, D. melanogaster
cttacccagactc

SEQ ID NO: 616130 - DNA, 13 bp, D. melanogaster
cttaccctttggc

SEQ ID NO: 616131 - DNA, 13 bp, D. melanogaster
cttaccttacctt

SEQ ID NO: 616132 - DNA, 13 bp, D. melanogaster
cttacgaagaaat

SEQ ID NO: 616133 - DNA, 13 bp, D. melanogaster
cttacgcagagaa

SEQ ID NO: 616134 - DNA, 13 bp, D. melanogaster
cttacgtgggcta

SEQ ID NO: 616135 - DNA, 13 bp, D. melanogaster
cttactatatata

SEQ ID NO: 616136 - DNA, 13 bp, D. melanogaster
cttactattgtag

SEQ ID NO: 616137 - DNA, 13 bp, D. melanogaster
cttacttacattt

SEQ ID NO: 616138 - DNA, 13 bp, D. melanogaster
cttacttatcatt

SEQ ID NO: 616139 - DNA, 13 bp, D. melanogaster
cttagaaatgaaa

SEQ ID NO: 616140 - DNA, 13 bp, D. melanogaster
cttagataacaaa

SEQ ID NO: 616141 - DNA, 13 bp, D. melanogaster
cttagatatatat

SEQ ID NO: 616142 - DNA, 13 bp, D. melanogaster
cttagcatttata

SEQ ID NO: 616143 - DNA, 13 bp, D. melanogaster
cttagctgttttt

SEQ ID NO: 616144 - DNA, 13 bp, D. melanogaster
cttagcttatttt

SEQ ID NO: 616145 - DNA, 13 bp, D. melanogaster
cttagctttgggc

SEQ ID NO: 616146 - DNA, 13 bp, D. melanogaster
cttaggaactata

SEQ ID NO: 616147 - DNA, 13 bp, D. melanogaster
cttagtgaattaa

SEQ ID NO: 616148 - DNA, 13 bp, D. melanogaster
cttagttttaatt

SEQ ID NO: 616149 - DNA, 13 bp, D. melanogaster
cttagttttagtt

SEQ ID NO: 616150 - DNA, 13 bp, D. melanogaster
cttagtttttaag

SEQ ID NO: 616151 - DNA, 14 bp, D. melanogaster
cttataaaaaatgc

SEQ ID NO: 616152 - DNA, 14 bp, D. melanogaster
cttataaacatttt

SEQ ID NO: 616153 - DNA, 13 bp, D. melanogaster
cttataaataaag

SEQ ID NO: 616154 - DNA, 13 bp, D. melanogaster
cttataaatcaaa

SEQ ID NO: 616155 - DNA, 13 bp, D. melanogaster
cttataaatgttt

SEQ ID NO: 616156 - DNA, 14 bp, D. melanogaster
cttataacaccgga

SEQ ID NO: 616157 - DNA, 13 bp, D. melanogaster
cttataactaaat

SEQ ID NO: 616158 - DNA, 13 bp, D. melanogaster
cttataatatatg

SEQ ID NO: 616159 - DNA, 13 bp, D. melanogaster
cttataatttgtt

SEQ ID NO: 616160 - DNA, 13 bp, D. melanogaster
cttatacaaatat

SEQ ID NO: 616161 - DNA, 13 bp, D. melanogaster
cttatacacgaaa

SEQ ID NO: 616162 - DNA, 13 bp, D. melanogaster
cttatacataagt

SEQ ID NO: 616163 - DNA, 13 bp, D. melanogaster
cttatacatacat

SEQ ID NO: 616164 - DNA, 14 bp, D. melanogaster
cttatacatacata

SEQ ID NO: 616165 - DNA, 14 bp, D. melanogaster
cttatacatatata

SEQ ID NO: 616166 - DNA, 13 bp, D. melanogaster
cttatacttatac

SEQ ID NO: 616167 - DNA, 13 bp, D. melanogaster
cttatactttgtg

SEQ ID NO: 616168 - DNA, 13 bp, D. melanogaster
cttatactttttg

SEQ ID NO: 616169 - DNA, 13 bp, D. melanogaster
cttatatacaaga

SEQ ID NO: 616170 - DNA, 14 bp, D. melanogaster
cttatatacatata

SEQ ID NO: 616171 - DNA, 13 bp, D. melanogaster
cttatatacttat

SEQ ID NO: 616172 - DNA, 13 bp, D. melanogaster
cttatatatatac

SEQ ID NO: 616173 - DNA, 14 bp, D. melanogaster
cttatatatataca

SEQ ID NO: 616174 - DNA, 14 bp, D. melanogaster
cttatatatgtatg

SEQ ID NO: 616175 - DNA, 13 bp, D. melanogaster
cttatatgtacat

SEQ ID NO: 616176 - DNA, 13 bp, D. melanogaster
cttatatgtatat

SEQ ID NO: 616177 - DNA, 14 bp, D. melanogaster
cttatatgtatata

SEQ ID NO: 616178 - DNA, 13 bp, D. melanogaster
cttatcaaaaaat

SEQ ID NO: 616179 - DNA, 13 bp, D. melanogaster
cttatcaatgttt

SEQ ID NO: 616180 - DNA, 13 bp, D. melanogaster
cttatcacttaac

SEQ ID NO: 616181 - DNA, 14 bp, D. melanogaster
cttatcacttaaca

SEQ ID NO: 616182 - DNA, 13 bp, D. melanogaster
cttatcagcaaaa

SEQ ID NO: 616183 - DNA, 13 bp, D. melanogaster
cttatcagcgatt

SEQ ID NO: 616184 - DNA, 13 bp, D. melanogaster
cttatcagttggc

SEQ ID NO: 616185 - DNA, 13 bp, D. melanogaster
cttatcataaatt

SEQ ID NO: 616186 - DNA, 13 bp, D. melanogaster
cttatcgaaaatg

SEQ ID NO: 616187 - DNA, 13 bp, D. melanogaster
cttatcggaacta

SEQ ID NO: 616188 - DNA, 13 bp, D. melanogaster
cttatctggaatg

SEQ ID NO: 616189 - DNA, 13 bp, D. melanogaster
cttatcttaaatc

SEQ ID NO: 616190 - DNA, 13 bp, D. melanogaster
cttatcttatcgc

SEQ ID NO: 616191 - DNA, 13 bp, D. melanogaster
cttatgcaaattt

SEQ ID NO: 616192 - DNA, 14 bp, D. melanogaster
cttatgcacaccgc

SEQ ID NO: 616193 - DNA, 13 bp, D. melanogaster
cttatgctgatat

SEQ ID NO: 616194 - DNA, 13 bp, D. melanogaster
cttatggatatgc

SEQ ID NO: 616195 - DNA, 13 bp, D. melanogaster
cttatggctgcac

SEQ ID NO: 616196 - DNA, 13 bp, D. melanogaster
cttatgtacgcag

SEQ ID NO: 616197 - DNA, 13 bp, D. melanogaster
cttatgtatatct

SEQ ID NO: 616198 - DNA, 13 bp, D. melanogaster
cttattagctttt

SEQ ID NO: 616199 - DNA, 13 bp, D. melanogaster
cttattatttgta

SEQ ID NO: 616200 - DNA, 13 bp, D. melanogaster
cttattcaattta

SEQ ID NO: 616201 - DNA, 14 bp, D. melanogaster
cttattctagttaa

SEQ ID NO: 616202 - DNA, 13 bp, D. melanogaster
cttattgaaattt

SEQ ID NO: 616203 - DNA, 13 bp, D. melanogaster
cttattgatttta

SEQ ID NO: 616204 - DNA, 13 bp, D. melanogaster
cttattggattct

SEQ ID NO: 616205 - DNA, 13 bp, D. melanogaster
cttattgtcccct

SEQ ID NO: 616206 - DNA, 13 bp, D. melanogaster
cttattgttattg

SEQ ID NO: 616207 - DNA, 13 bp, D. melanogaster
cttattgtttacg

SEQ ID NO: 616208 - DNA, 13 bp, D. melanogaster
cttattgttttga

SEQ ID NO: 616209 - DNA, 14 bp, D. melanogaster
cttatttaatcaac

SEQ ID NO: 616210 - DNA, 13 bp, D. melanogaster
cttatttacccgc

SEQ ID NO: 616211 - DNA, 14 bp, D. melanogaster
cttatttacgccag

SEQ ID NO: 616212 - DNA, 13 bp, D. melanogaster
cttatttatacat

SEQ ID NO: 616213 - DNA, 13 bp, D. melanogaster
cttatttcacagt

SEQ ID NO: 616214 - DNA, 13 bp, D. melanogaster
cttatttgcatac

SEQ ID NO: 616215 - DNA, 13 bp, D. melanogaster
cttatttgtaatt

SEQ ID NO: 616216 - DNA, 13 bp, D. melanogaster
cttattttaagtt

SEQ ID NO: 616217 - DNA, 14 bp, D. melanogaster
cttattttaagttt

SEQ ID NO: 616218 - DNA, 13 bp, D. melanogaster
cttattttatgaa

SEQ ID NO: 616219 - DNA, 13 bp, D. melanogaster
cttattttgacgg

SEQ ID NO: 616220 - DNA, 13 bp, D. melanogaster
cttatttttcaca

SEQ ID NO: 616221 - DNA, 13 bp, D. melanogaster
cttatttttgcat

SEQ ID NO: 616222 - DNA, 13 bp, D. melanogaster
cttcaaaaagtga

SEQ ID NO: 616223 - DNA, 13 bp, D. melanogaster
cttcaaaaatata

SEQ ID NO: 616224 - DNA, 13 bp, D. melanogaster
cttcaaaagaaat

SEQ ID NO: 616225 - DNA, 13 bp, D. melanogaster
cttcaaaaggtat

SEQ ID NO: 616226 - DNA, 13 bp, D. melanogaster
cttcaaacagatg

SEQ ID NO: 616227 - DNA, 13 bp, D. melanogaster
cttcaaaccgaat

SEQ ID NO: 616228 - DNA, 13 bp, D. melanogaster
cttcaaacgtctg

SEQ ID NO: 616229 - DNA, 13 bp, D. melanogaster
cttcaaagtgcag

SEQ ID NO: 616230 - DNA, 13 bp, D. melanogaster
cttcaaatcgaaa

SEQ ID NO: 616231 - DNA, 13 bp, D. melanogaster
cttcaaatttatt

SEQ ID NO: 616232 - DNA, 14 bp, D. melanogaster
cttcaaatttattc

SEQ ID NO: 616233 - DNA, 14 bp, D. melanogaster
cttcaacagcacac

SEQ ID NO: 616234 - DNA, 13 bp, D. melanogaster
cttcaacgggagc

SEQ ID NO: 616235 - DNA, 13 bp, D. melanogaster
cttcaactccaac

SEQ ID NO: 616236 - DNA, 13 bp, D. melanogaster
cttcaactctttt

SEQ ID NO: 616237 - DNA, 13 bp, D. melanogaster
cttcaacttcaac

SEQ ID NO: 616238 - DNA, 14 bp, D. melanogaster
cttcaacttcaact

SEQ ID NO: 616239 - DNA, 13 bp, D. melanogaster
cttcaacttcctc

SEQ ID NO: 616240 - DNA, 14 bp, D. melanogaster
cttcaagaaagtca

SEQ ID NO: 616241 - DNA, 14 bp, D. melanogaster
cttcaagaagtttt

SEQ ID NO: 616242 - DNA, 14 bp, D. melanogaster
cttcaagttattta

SEQ ID NO: 616243 - DNA, 13 bp, D. melanogaster
cttcaataaattt

SEQ ID NO: 616244 - DNA, 13 bp, D. melanogaster
cttcaatacaaca

SEQ ID NO: 616245 - DNA, 13 bp, D. melanogaster
cttcaatatatat

SEQ ID NO: 616246 - DNA, 13 bp, D. melanogaster
cttcaatcaaaaa

SEQ ID NO: 616247 - DNA, 13 bp, D. melanogaster
cttcaatgtcaga

SEQ ID NO: 616248 - DNA, 13 bp, D. melanogaster
cttcaattaataa

SEQ ID NO: 616249 - DNA, 13 bp, D. melanogaster
cttcaattattca

SEQ ID NO: 616250 - DNA, 13 bp, D. melanogaster
cttcaattcaaat

SEQ ID NO: 616251 - DNA, 13 bp, D. melanogaster
cttcaattgattt

SEQ ID NO: 616252 - DNA, 13 bp, D. melanogaster
cttcaatttcaat

SEQ ID NO: 616253 - DNA, 13 bp, D. melanogaster
cttcaatttgaat

SEQ ID NO: 616254 - DNA, 13 bp, D. melanogaster
cttcaatttggcc

SEQ ID NO: 616255 - DNA, 13 bp, D. melanogaster
cttcaattttcaa

SEQ ID NO: 616256 - DNA, 13 bp, D. melanogaster
cttcacacctccg

SEQ ID NO: 616257 - DNA, 13 bp, D. melanogaster
cttcaccttagaa

SEQ ID NO: 616258 - DNA, 13 bp, D. melanogaster
cttcactaacttc

SEQ ID NO: 616259 - DNA, 13 bp, D. melanogaster
cttcactgtactt

SEQ ID NO: 616260 - DNA, 13 bp, D. melanogaster
cttcacttcactt

SEQ ID NO: 616261 - DNA, 13 bp, D. melanogaster
cttcacttttgtt

SEQ ID NO: 616262 - DNA, 13 bp, D. melanogaster
cttcagcaaaaac

SEQ ID NO: 616263 - DNA, 13 bp, D. melanogaster
cttcagctccaac

SEQ ID NO: 616264 - DNA, 14 bp, D. melanogaster
cttcagctccagct

SEQ ID NO: 616265 - DNA, 13 bp, D. melanogaster
cttcagctgtctt

SEQ ID NO: 616266 - DNA, 14 bp, D. melanogaster
cttcagctgtctta

SEQ ID NO: 616267 - DNA, 14 bp, D. melanogaster
cttcagcttcagct

SEQ ID NO: 616268 - DNA, 13 bp, D. melanogaster
cttcagcttctgc

SEQ ID NO: 616269 - DNA, 13 bp, D. melanogaster
cttcagcttcttt

SEQ ID NO: 616270 - DNA, 13 bp, D. melanogaster
cttcagtcattca

SEQ ID NO: 616271 - DNA, 13 bp, D. melanogaster
cttcagtttcagc

SEQ ID NO: 616272 - DNA, 14 bp, D. melanogaster
cttcataacttaaa

SEQ ID NO: 616273 - DNA, 13 bp, D. melanogaster
cttcataagtcaa

SEQ ID NO: 616274 - DNA, 14 bp, D. melanogaster
cttcataattttct

SEQ ID NO: 616275 - DNA, 13 bp, D. melanogaster
cttcatacataca

SEQ ID NO: 616276 - DNA, 13 bp, D. melanogaster
cttcatatatata

SEQ ID NO: 616277 - DNA, 13 bp, D. melanogaster
cttcatccagttc

SEQ ID NO: 616278 - DNA, 13 bp, D. melanogaster
cttcatctccatc

SEQ ID NO: 616279 - DNA, 14 bp, D. melanogaster
cttcatcttcatct

SEQ ID NO: 616280 - DNA, 13 bp, D. melanogaster
cttcatgaatttc

SEQ ID NO: 616281 - DNA, 13 bp, D. melanogaster
cttcattatcatt

SEQ ID NO: 616282 - DNA, 13 bp, D. melanogaster
cttcattgttgat

SEQ ID NO: 616283 - DNA, 13 bp, D. melanogaster
cttcatttccatt

SEQ ID NO: 616284 - DNA, 13 bp, D. melanogaster
cttcatttcgctt

SEQ ID NO: 616285 - DNA, 13 bp, D. melanogaster
cttcatttctgct

SEQ ID NO: 616286 - DNA, 13 bp, D. melanogaster
cttcatttgattt

SEQ ID NO: 616287 - DNA, 13 bp, D. melanogaster
cttcatttgcagc

SEQ ID NO: 616288 - DNA, 13 bp, D. melanogaster
cttcatttgcata

SEQ ID NO: 616289 - DNA, 13 bp, D. melanogaster
cttcatttgccat

SEQ ID NO: 616290 - DNA, 13 bp, D. melanogaster
cttcatttgttat

SEQ ID NO: 616291 - DNA, 13 bp, D. melanogaster
cttcattttccat

SEQ ID NO: 616292 - DNA, 13 bp, D. melanogaster
cttcattttggcc

SEQ ID NO: 616293 - DNA, 13 bp, D. melanogaster
cttccaaaaataa

SEQ ID NO: 616294 - DNA, 13 bp, D. melanogaster
cttccaattggaa

SEQ ID NO: 616295 - DNA, 13 bp, D. melanogaster
cttccacaacttc

SEQ ID NO: 616296 - DNA, 13 bp, D. melanogaster
cttccacaggaac

SEQ ID NO: 616297 - DNA, 13 bp, D. melanogaster
cttccactgccac

SEQ ID NO: 616298 - DNA, 13 bp, D. melanogaster
cttccacttccac

SEQ ID NO: 616299 - DNA, 14 bp, D. melanogaster
cttccacttccact

SEQ ID NO: 616300 - DNA, 13 bp, D. melanogaster
cttccacttgact

SEQ ID NO: 616301 - DNA, 13 bp, D. melanogaster
cttccactttcca

SEQ ID NO: 616302 - DNA, 13 bp, D. melanogaster
cttccagatcccc

SEQ ID NO: 616303 - DNA, 13 bp, D. melanogaster
cttccagcgtttt

SEQ ID NO: 616304 - DNA, 13 bp, D. melanogaster
cttccagctcttt

SEQ ID NO: 616305 - DNA, 13 bp, D. melanogaster
cttccagtcagac

SEQ ID NO: 616306 - DNA, 13 bp, D. melanogaster
cttccatagaatt

SEQ ID NO: 616307 - DNA, 13 bp, D. melanogaster
cttccatttctat

SEQ ID NO: 616308 - DNA, 13 bp, D. melanogaster
cttcccaagaaga

SEQ ID NO: 616309 - DNA, 13 bp, D. melanogaster
cttccccagtggc

SEQ ID NO: 616310 - DNA, 13 bp, D. melanogaster
cttcccttttggc

SEQ ID NO: 616311 - DNA, 13 bp, D. melanogaster
cttccgaattcca

SEQ ID NO: 616312 - DNA, 14 bp, D. melanogaster
cttccgatttcggt

SEQ ID NO: 616313 - DNA, 13 bp, D. melanogaster
cttccgctggctt

SEQ ID NO: 616314 - DNA, 13 bp, D. melanogaster
cttccgcttccgc

SEQ ID NO: 616315 - DNA, 13 bp, D. melanogaster
cttccggagcaaa

SEQ ID NO: 616316 - DNA, 14 bp, D. melanogaster
cttccgtttccggc

SEQ ID NO: 616317 - DNA, 13 bp, D. melanogaster
cttccgtttgcca

SEQ ID NO: 616318 - DNA, 13 bp, D. melanogaster
cttcctaaaaaaa

SEQ ID NO: 616319 - DNA, 13 bp, D. melanogaster
cttcctctttaat

SEQ ID NO: 616320 - DNA, 13 bp, D. melanogaster
cttcctgctgttt

SEQ ID NO: 616321 - DNA, 13 bp, D. melanogaster
cttcctggtgtcc

SEQ ID NO: 616322 - DNA, 13 bp, D. melanogaster
cttcctgtttgcc

SEQ ID NO: 616323 - DNA, 13 bp, D. melanogaster
cttccttttggcc

SEQ ID NO: 616324 - DNA, 13 bp, D. melanogaster
cttcgaaacgaaa

SEQ ID NO: 616325 - DNA, 13 bp, D. melanogaster
cttcgaacgcctg

SEQ ID NO: 616326 - DNA, 13 bp, D. melanogaster
cttcgacatagta

SEQ ID NO: 616327 - DNA, 14 bp, D. melanogaster
cttcgacttcgact

SEQ ID NO: 616328 - DNA, 13 bp, D. melanogaster
cttcgacttggac

SEQ ID NO: 616329 - DNA, 13 bp, D. melanogaster
cttcgactttgcc

SEQ ID NO: 616330 - DNA, 13 bp, D. melanogaster
cttcgactttggc

SEQ ID NO: 616331 - DNA, 13 bp, D. melanogaster
cttcgaggtgcag

SEQ ID NO: 616332 - DNA, 13 bp, D. melanogaster
cttcgagtggaaa

SEQ ID NO: 616333 - DNA, 13 bp, D. melanogaster
cttcgagtgggtg

SEQ ID NO: 616334 - DNA, 13 bp, D. melanogaster
cttcgatcagaat

SEQ ID NO: 616335 - DNA, 13 bp, D. melanogaster
cttcgatgctcat

SEQ ID NO: 616336 - DNA, 13 bp, D. melanogaster
cttcgattcgatt

SEQ ID NO: 616337 - DNA, 13 bp, D. melanogaster
cttcgattgcgca

SEQ ID NO: 616338 - DNA, 13 bp, D. melanogaster
cttcgatttagtg

SEQ ID NO: 616339 - DNA, 13 bp, D. melanogaster
cttcgatttcaat

SEQ ID NO: 616340 - DNA, 13 bp, D. melanogaster
cttcgatttccat

SEQ ID NO: 616341 - DNA, 13 bp, D. melanogaster
cttcgatttcgtg

SEQ ID NO: 616342 - DNA, 13 bp, D. melanogaster
cttcgatttgttt

SEQ ID NO: 616343 - DNA, 13 bp, D. melanogaster
cttcgcagaatgc

SEQ ID NO: 616344 - DNA, 13 bp, D. melanogaster
cttcgcccgccgt

SEQ ID NO: 616345 - DNA, 13 bp, D. melanogaster
cttcgccttcgcc

SEQ ID NO: 616346 - DNA, 14 bp, D. melanogaster
cttcgccttcgcct

SEQ ID NO: 616347 - DNA, 13 bp, D. melanogaster
cttcgcctttgcc

SEQ ID NO: 616348 - DNA, 13 bp, D. melanogaster
cttcgcgctatct

SEQ ID NO: 616349 - DNA, 13 bp, D. melanogaster
cttcgctagcttc

SEQ ID NO: 616350 - DNA, 14 bp, D. melanogaster
cttcgctctctcgc

SEQ ID NO: 616351 - DNA, 13 bp, D. melanogaster
cttcgcttcgctt

SEQ ID NO: 616352 - DNA, 13 bp, D. melanogaster
cttcgctttgtac

SEQ ID NO: 616353 - DNA, 14 bp, D. melanogaster
cttcgctttgtaca

SEQ ID NO: 616354 - DNA, 13 bp, D. melanogaster
cttcgcttttccg

SEQ ID NO: 616355 - DNA, 13 bp, D. melanogaster
cttcgcttttggc

SEQ ID NO: 616356 - DNA, 13 bp, D. melanogaster
cttcggagtggca

SEQ ID NO: 616357 - DNA, 13 bp, D. melanogaster
cttcggatccttt

SEQ ID NO: 616358 - DNA, 13 bp, D. melanogaster
cttcggcactcca

SEQ ID NO: 616359 - DNA, 14 bp, D. melanogaster
cttcggcggtgacc

SEQ ID NO: 616360 - DNA, 14 bp, D. melanogaster
cttcggctcacaag

SEQ ID NO: 616361 - DNA, 13 bp, D. melanogaster
cttcggctgctgc

SEQ ID NO: 616362 - DNA, 13 bp, D. melanogaster
cttcggttacctc

SEQ ID NO: 616363 - DNA, 13 bp, D. melanogaster
cttcggtttaaat

SEQ ID NO: 616364 - DNA, 13 bp, D. melanogaster
cttcggtttcggt

SEQ ID NO: 616365 - DNA, 13 bp, D. melanogaster
cttcggtttttgg

SEQ ID NO: 616366 - DNA, 13 bp, D. melanogaster
cttcgtatacgtt

SEQ ID NO: 616367 - DNA, 13 bp, D. melanogaster
cttcgtcactatg

SEQ ID NO: 616368 - DNA, 13 bp, D. melanogaster
cttcgtcatcgtc

SEQ ID NO: 616369 - DNA, 13 bp, D. melanogaster
cttcgtcattttt

SEQ ID NO: 616370 - DNA, 13 bp, D. melanogaster
cttcgtccatttc

SEQ ID NO: 616371 - DNA, 13 bp, D. melanogaster
cttcgtcctgccg

SEQ ID NO: 616372 - DNA, 13 bp, D. melanogaster
cttcgtcctgcga

SEQ ID NO: 616373 - DNA, 13 bp, D. melanogaster
cttcgtcctgcgg

SEQ ID NO: 616374 - DNA, 13 bp, D. melanogaster
cttcgtctgcgtt

SEQ ID NO: 616375 - DNA, 14 bp, D. melanogaster
cttcgtctgcgttt

SEQ ID NO: 616376 - DNA, 13 bp, D. melanogaster
cttcgtcttcgtc

SEQ ID NO: 616377 - DNA, 14 bp, D. melanogaster
cttcgtcttcgtct

SEQ ID NO: 616378 - DNA, 13 bp, D. melanogaster
cttcgttcatttt

SEQ ID NO: 616379 - DNA, 13 bp, D. melanogaster
cttcgttggcgag

SEQ ID NO: 616380 - DNA, 13 bp, D. melanogaster
cttcgtttacctg

SEQ ID NO: 616381 - DNA, 13 bp, D. melanogaster
cttctacaatggg

SEQ ID NO: 616382 - DNA, 14 bp, D. melanogaster
cttctacacttgaa

SEQ ID NO: 616383 - DNA, 13 bp, D. melanogaster
cttctactgctgc

SEQ ID NO: 616384 - DNA, 13 bp, D. melanogaster
cttctagctttta

SEQ ID NO: 616385 - DNA, 13 bp, D. melanogaster
cttctatatattc

SEQ ID NO: 616386 - DNA, 13 bp, D. melanogaster
cttctatatgttt

SEQ ID NO: 616387 - DNA, 13 bp, D. melanogaster
cttctattaataa

SEQ ID NO: 616388 - DNA, 13 bp, D. melanogaster
cttctattataat

SEQ ID NO: 616389 - DNA, 13 bp, D. melanogaster
cttctcaccgagg

SEQ ID NO: 616390 - DNA, 13 bp, D. melanogaster
cttctcagcccac

SEQ ID NO: 616391 - DNA, 13 bp, D. melanogaster
cttctcagttttc

SEQ ID NO: 616392 - DNA, 13 bp, D. melanogaster
cttctccagctgc

SEQ ID NO: 616393 - DNA, 13 bp, D. melanogaster
cttctcctatata

SEQ ID NO: 616394 - DNA, 13 bp, D. melanogaster
cttctcctgctgc

SEQ ID NO: 616395 - DNA, 13 bp, D. melanogaster
cttctcggtcttc

SEQ ID NO: 616396 - DNA, 13 bp, D. melanogaster
cttctctggcaga

SEQ ID NO: 616397 - DNA, 14 bp, D. melanogaster
cttctgaaataatt

SEQ ID NO: 616398 - DNA, 13 bp, D. melanogaster
cttctgagtgctg

SEQ ID NO: 616399 - DNA, 16 bp, D. melanogaster
cttctgatgtagttaa

SEQ ID NO: 616400 - DNA, 14 bp, D. melanogaster
cttctgccagccag

SEQ ID NO: 616401 - DNA, 13 bp, D. melanogaster
cttctgccatttt

SEQ ID NO: 616402 - DNA, 14 bp, D. melanogaster
cttctgccgctgtc

SEQ ID NO: 616403 - DNA, 13 bp, D. melanogaster
cttctgcctctgc

SEQ ID NO: 616404 - DNA, 13 bp, D. melanogaster
cttctgccttctg

SEQ ID NO: 616405 - DNA, 13 bp, D. melanogaster
cttctgcgctgcg

SEQ ID NO: 616406 - DNA, 14 bp, D. melanogaster
cttctgcgctgcgc

SEQ ID NO: 616407 - DNA, 14 bp, D. melanogaster
cttctgctcctgct

SEQ ID NO: 616408 - DNA, 13 bp, D. melanogaster
cttctgctcctgt

SEQ ID NO: 616409 - DNA, 13 bp, D. melanogaster
cttctgctgcagc

SEQ ID NO: 616410 - DNA, 13 bp, D. melanogaster
cttctgctgctcc

SEQ ID NO: 616411 - DNA, 13 bp, D. melanogaster
cttctgctgctga

SEQ ID NO: 616412 - DNA, 13 bp, D. melanogaster
cttctgctgctgc

SEQ ID NO: 616413 - DNA, 14 bp, D. melanogaster
cttctgctgctgcc

SEQ ID NO: 616414 - DNA, 13 bp, D. melanogaster
cttctgctgctgg

SEQ ID NO: 616415 - DNA, 14 bp, D. melanogaster
cttctgctgctgtt

SEQ ID NO: 616416 - DNA, 13 bp, D. melanogaster
cttctgctgcttc

SEQ ID NO: 616417 - DNA, 13 bp, D. melanogaster
cttctgctggcca

SEQ ID NO: 616418 - DNA, 13 bp, D. melanogaster
cttctggccaaaa

SEQ ID NO: 616419 - DNA, 13 bp, D. melanogaster
cttctggccaagt

SEQ ID NO: 616420 - DNA, 13 bp, D. melanogaster
cttctggccattt

SEQ ID NO: 616421 - DNA, 13 bp, D. melanogaster
cttctggccgagg

SEQ ID NO: 616422 - DNA, 14 bp, D. melanogaster
cttctggcttttcc

SEQ ID NO: 616423 - DNA, 13 bp, D. melanogaster
cttctgtaattat

SEQ ID NO: 616424 - DNA, 14 bp, D. melanogaster
cttctgttgctgct

SEQ ID NO: 616425 - DNA, 13 bp, D. melanogaster
cttctgttgctgt

SEQ ID NO: 616426 - DNA, 13 bp, D. melanogaster
cttcttcaagcca

SEQ ID NO: 616427 - DNA, 13 bp, D. melanogaster
cttcttcaatcaa

SEQ ID NO: 616428 - DNA, 13 bp, D. melanogaster
cttcttcatcatc

SEQ ID NO: 616429 - DNA, 14 bp, D. melanogaster
cttcttcatcatca

SEQ ID NO: 616430 - DNA, 13 bp, D. melanogaster
cttcttcattaag

SEQ ID NO: 616431 - DNA, 13 bp, D. melanogaster
cttcttccagtcc

SEQ ID NO: 616432 - DNA, 13 bp, D. melanogaster
cttcttccttata

SEQ ID NO: 616433 - DNA, 13 bp, D. melanogaster
cttcttcgtctac

SEQ ID NO: 616434 - DNA, 13 bp, D. melanogaster
cttcttctaccaa

SEQ ID NO: 616435 - DNA, 13 bp, D. melanogaster
cttcttcttcaag

SEQ ID NO: 616436 - DNA, 13 bp, D. melanogaster
cttcttctttaag

SEQ ID NO: 616437 - DNA, 14 bp, D. melanogaster
cttcttgaagcaca

SEQ ID NO: 616438 - DNA, 13 bp, D. melanogaster
cttcttgctggcg

SEQ ID NO: 616439 - DNA, 13 bp, D. melanogaster
cttcttggaattt

SEQ ID NO: 616440 - DNA, 14 bp, D. melanogaster
cttcttggaatttg

SEQ ID NO: 616441 - DNA, 13 bp, D. melanogaster
cttcttggccaaa

SEQ ID NO: 616442 - DNA, 13 bp, D. melanogaster
cttcttggccaac

SEQ ID NO: 616443 - DNA, 13 bp, D. melanogaster
cttcttggccatt

SEQ ID NO: 616444 - DNA, 13 bp, D. melanogaster
cttcttggctgcc

SEQ ID NO: 616445 - DNA, 13 bp, D. melanogaster
cttcttgggcaac

SEQ ID NO: 616446 - DNA, 13 bp, D. melanogaster
cttcttggtttaa

SEQ ID NO: 616447 - DNA, 13 bp, D. melanogaster
cttcttgtatctt

SEQ ID NO: 616448 - DNA, 13 bp, D. melanogaster
cttctttaaacaa

SEQ ID NO: 616449 - DNA, 13 bp, D. melanogaster
cttctttaagtag

SEQ ID NO: 616450 - DNA, 13 bp, D. melanogaster
cttctttaagttg

SEQ ID NO: 616451 - DNA, 13 bp, D. melanogaster
cttctttcataaa

SEQ ID NO: 616452 - DNA, 13 bp, D. melanogaster
cttctttgagctg

SEQ ID NO: 616453 - DNA, 13 bp, D. melanogaster
cttcttttgctgc

SEQ ID NO: 616454 - DNA, 13 bp, D. melanogaster
cttctttttggaa

SEQ ID NO: 616455 - DNA, 13 bp, D. melanogaster
cttgaaaaataaa

SEQ ID NO: 616456 - DNA, 14 bp, D. melanogaster
cttgaaaaatattt

SEQ ID NO: 616457 - DNA, 13 bp, D. melanogaster
cttgaaaaatgca

SEQ ID NO: 616458 - DNA, 13 bp, D. melanogaster
cttgaaaacaaaa

SEQ ID NO: 616459 - DNA, 13 bp, D. melanogaster
cttgaaaacattt

SEQ ID NO: 616460 - DNA, 14 bp, D. melanogaster
cttgaaaacatttt

SEQ ID NO: 616461 - DNA, 13 bp, D. melanogaster
cttgaaaacgttg

SEQ ID NO: 616462 - DNA, 14 bp, D. melanogaster
cttgaaaacgttga

SEQ ID NO: 616463 - DNA, 13 bp, D. melanogaster
cttgaaaactatt

SEQ ID NO: 616464 - DNA, 13 bp, D. melanogaster
cttgaaaagcttt

SEQ ID NO: 616465 - DNA, 14 bp, D. melanogaster
cttgaaaaggccaa

SEQ ID NO: 616466 - DNA, 13 bp, D. melanogaster
cttgaaaattgaa

SEQ ID NO: 616467 - DNA, 13 bp, D. melanogaster
cttgaaaattgag

SEQ ID NO: 616468 - DNA, 13 bp, D. melanogaster
cttgaaaattgta

SEQ ID NO: 616469 - DNA, 13 bp, D. melanogaster
cttgaaagcgaaa

SEQ ID NO: 616470 - DNA, 13 bp, D. melanogaster
cttgaaataaaaa

SEQ ID NO: 616471 - DNA, 13 bp, D. melanogaster
cttgaaatgcaaa

SEQ ID NO: 616472 - DNA, 13 bp, D. melanogaster
cttgaaattctag

SEQ ID NO: 616473 - DNA, 13 bp, D. melanogaster
cttgaaattgcat

SEQ ID NO: 616474 - DNA, 13 bp, D. melanogaster
cttgaaatttaaa

SEQ ID NO: 616475 - DNA, 13 bp, D. melanogaster
cttgaacaaaaat

SEQ ID NO: 616476 - DNA, 13 bp, D. melanogaster
cttgaactttgac

SEQ ID NO: 616477 - DNA, 13 bp, D. melanogaster
cttgaagaaaaca

SEQ ID NO: 616478 - DNA, 13 bp, D. melanogaster
cttgaagaaaact

SEQ ID NO: 616479 - DNA, 13 bp, D. melanogaster
cttgaagaacgtt

SEQ ID NO: 616480 - DNA, 13 bp, D. melanogaster
cttgaagaagaac

SEQ ID NO: 616481 - DNA, 13 bp, D. melanogaster
cttgaagaagaag

SEQ ID NO: 616482 - DNA, 14 bp, D. melanogaster
cttgaagttcaaaa

SEQ ID NO: 616483 - DNA, 13 bp, D. melanogaster
cttgaatatatat

SEQ ID NO: 616484 - DNA, 13 bp, D. melanogaster
cttgaatattatt

SEQ ID NO: 616485 - DNA, 13 bp, D. melanogaster
cttgaatggcata

SEQ ID NO: 616486 - DNA, 14 bp, D. melanogaster
cttgaatggtggtc

SEQ ID NO: 616487 - DNA, 13 bp, D. melanogaster
cttgaattttgat

SEQ ID NO: 616488 - DNA, 13 bp, D. melanogaster
cttgaccattcaa

SEQ ID NO: 616489 - DNA, 13 bp, D. melanogaster
cttgactattatt

SEQ ID NO: 616490 - DNA, 13 bp, D. melanogaster
cttgactggcagt

SEQ ID NO: 616491 - DNA, 13 bp, D. melanogaster
cttgacttgactg

SEQ ID NO: 616492 - DNA, 13 bp, D. melanogaster
cttgacttggctt

SEQ ID NO: 616493 - DNA, 13 bp, D. melanogaster
cttgactttggct

SEQ ID NO: 616494 - DNA, 13 bp, D. melanogaster
cttgagactttat

SEQ ID NO: 616495 - DNA, 13 bp, D. melanogaster
cttgagcagatat

SEQ ID NO: 616496 - DNA, 13 bp, D. melanogaster
cttgagcgacaat

SEQ ID NO: 616497 - DNA, 13 bp, D. melanogaster
cttgagcgaggca

SEQ ID NO: 616498 - DNA, 13 bp, D. melanogaster
cttgagcttgagc

SEQ ID NO: 616499 - DNA, 13 bp, D. melanogaster
cttgaggaactcc

SEQ ID NO: 616500 - DNA, 13 bp, D. melanogaster
cttgagtatattc

SEQ ID NO: 616501 - DNA, 13 bp, D. melanogaster
cttgagtgtgtgt

SEQ ID NO: 616502 - DNA, 14 bp, D. melanogaster
cttgagtgtgtgtg

SEQ ID NO: 616503 - DNA, 13 bp, D. melanogaster
cttgagttttgtt

SEQ ID NO: 616504 - DNA, 15 bp, D. melanogaster
cttgataaactaatt

SEQ ID NO: 616505 - DNA, 13 bp, D. melanogaster
cttgatatatata

SEQ ID NO: 616506 - DNA, 13 bp, D. melanogaster
cttgatgaatggc

SEQ ID NO: 616507 - DNA, 13 bp, D. melanogaster
cttgattaattaa

SEQ ID NO: 616508 - DNA, 13 bp, D. melanogaster
cttgattgcattt

SEQ ID NO: 616509 - DNA, 13 bp, D. melanogaster
cttgatttagatc

SEQ ID NO: 616510 - DNA, 13 bp, D. melanogaster
cttgatttcattt

SEQ ID NO: 616511 - DNA, 13 bp, D. melanogaster
cttgattttaagt

SEQ ID NO: 616512 - DNA, 13 bp, D. melanogaster
cttgattttcaat

SEQ ID NO: 616513 - DNA, 13 bp, D. melanogaster
cttgcaaaaatta

SEQ ID NO: 616514 - DNA, 13 bp, D. melanogaster
cttgcaaaataaa

SEQ ID NO: 616515 - DNA, 13 bp, D. melanogaster
cttgcaacatgtt

SEQ ID NO: 616516 - DNA, 13 bp, D. melanogaster
cttgcaactcttg

SEQ ID NO: 616517 - DNA, 13 bp, D. melanogaster
cttgcaactggca

SEQ ID NO: 616518 - DNA, 13 bp, D. melanogaster
cttgcaataattt

SEQ ID NO: 616519 - DNA, 13 bp, D. melanogaster
cttgcaattaatt

SEQ ID NO: 616520 - DNA, 13 bp, D. melanogaster
cttgcaatttaaa

SEQ ID NO: 616521 - DNA, 13 bp, D. melanogaster
cttgcaatttatt

SEQ ID NO: 616522 - DNA, 13 bp, D. melanogaster
cttgcacttgcaa

SEQ ID NO: 616523 - DNA, 14 bp, D. melanogaster
cttgcagcagcaac

SEQ ID NO: 616524 - DNA, 13 bp, D. melanogaster
cttgcagctccta

SEQ ID NO: 616525 - DNA, 13 bp, D. melanogaster
cttgcagctgctg

SEQ ID NO: 616526 - DNA, 13 bp, D. melanogaster
cttgcagttgcag

SEQ ID NO: 616527 - DNA, 13 bp, D. melanogaster
cttgcataattta

SEQ ID NO: 616528 - DNA, 14 bp, D. melanogaster
cttgcatgataagt

SEQ ID NO: 616529 - DNA, 13 bp, D. melanogaster
cttgccaaaaaaa

SEQ ID NO: 616530 - DNA, 14 bp, D. melanogaster
cttgccaaaaaaaa

SEQ ID NO: 616531 - DNA, 13 bp, D. melanogaster
cttgccaaagttt

SEQ ID NO: 616532 - DNA, 13 bp, D. melanogaster
cttgccaaatcaa

SEQ ID NO: 616533 - DNA, 13 bp, D. melanogaster
cttgccaatttat

SEQ ID NO: 616534 - DNA, 13 bp, D. melanogaster
cttgccacaaaaa

SEQ ID NO: 616535 - DNA, 13 bp, D. melanogaster
cttgccacacaca

SEQ ID NO: 616536 - DNA, 13 bp, D. melanogaster
cttgccacgccca

SEQ ID NO: 616537 - DNA, 14 bp, D. melanogaster
cttgccacgccccc

SEQ ID NO: 616538 - DNA, 13 bp, D. melanogaster
cttgccacttgag

SEQ ID NO: 616539 - DNA, 13 bp, D. melanogaster
cttgccacttgcc

SEQ ID NO: 616540 - DNA, 13 bp, D. melanogaster
cttgccacttggc

SEQ ID NO: 616541 - DNA, 13 bp, D. melanogaster
cttgccatatatg

SEQ ID NO: 616542 - DNA, 13 bp, D. melanogaster
cttgcccaatacc

SEQ ID NO: 616543 - DNA, 14 bp, D. melanogaster
cttgcctttcactc

SEQ ID NO: 616544 - DNA, 14 bp, D. melanogaster
cttgcgcaaacaca

SEQ ID NO: 616545 - DNA, 13 bp, D. melanogaster
cttgcgtcagctg

SEQ ID NO: 616546 - DNA, 15 bp, D. melanogaster
cttgcgtgaaattcg

SEQ ID NO: 616547 - DNA, 13 bp, D. melanogaster
cttgcgtgtgtgt

SEQ ID NO: 616548 - DNA, 14 bp, D. melanogaster
cttgcgtgtgtgtg

SEQ ID NO: 616549 - DNA, 13 bp, D. melanogaster
cttgctataattt

SEQ ID NO: 616550 - DNA, 13 bp, D. melanogaster
cttgctcgaagaa

SEQ ID NO: 616551 - DNA, 13 bp, D. melanogaster
cttgctgcacaaa

SEQ ID NO: 616552 - DNA, 13 bp, D. melanogaster
cttgctggctggc

SEQ ID NO: 616553 - DNA, 13 bp, D. melanogaster
cttgcttaaccac

SEQ ID NO: 616554 - DNA, 14 bp, D. melanogaster
cttgcttaaccact

SEQ ID NO: 616555 - DNA, 13 bp, D. melanogaster
cttgcttggccac

SEQ ID NO: 616556 - DNA, 13 bp, D. melanogaster
cttgcttgtgtga

SEQ ID NO: 616557 - DNA, 13 bp, D. melanogaster
cttggaaaaaatc

SEQ ID NO: 616558 - DNA, 13 bp, D. melanogaster
cttggaaaacccc

SEQ ID NO: 616559 - DNA, 14 bp, D. melanogaster
cttggaaaacccca

SEQ ID NO: 616560 - DNA, 13 bp, D. melanogaster
cttggaaatcggc

SEQ ID NO: 616561 - DNA, 13 bp, D. melanogaster
cttggaaatgggt

SEQ ID NO: 616562 - DNA, 13 bp, D. melanogaster
cttggaactggca

SEQ ID NO: 616563 - DNA, 13 bp, D. melanogaster
cttggaattggaa

SEQ ID NO: 616564 - DNA, 13 bp, D. melanogaster
cttggacattccc

SEQ ID NO: 616565 - DNA, 13 bp, D. melanogaster
cttggagcttgga

SEQ ID NO: 616566 - DNA, 13 bp, D. melanogaster
cttggagttatta

SEQ ID NO: 616567 - DNA, 13 bp, D. melanogaster
cttggataacttg

SEQ ID NO: 616568 - DNA, 13 bp, D. melanogaster
cttggattataat

SEQ ID NO: 616569 - DNA, 13 bp, D. melanogaster
cttggatttcatt

SEQ ID NO: 616570 - DNA, 14 bp, D. melanogaster
cttggatttggatt

SEQ ID NO: 616571 - DNA, 13 bp, D. melanogaster
cttggcaacaaaa

SEQ ID NO: 616572 - DNA, 13 bp, D. melanogaster
cttggcaatcaaa

SEQ ID NO: 616573 - DNA, 13 bp, D. melanogaster
cttggcagaggcc

SEQ ID NO: 616574 - DNA, 13 bp, D. melanogaster
cttggcagatccc

SEQ ID NO: 616575 - DNA, 13 bp, D. melanogaster
cttggcagtggac

SEQ ID NO: 616576 - DNA, 13 bp, D. melanogaster
cttggcataaatt

SEQ ID NO: 616577 - DNA, 14 bp, D. melanogaster
cttggccaaaaagg

SEQ ID NO: 616578 - DNA, 13 bp, D. melanogaster
cttggccaaaaat

SEQ ID NO: 616579 - DNA, 13 bp, D. melanogaster
cttggccaaaacc

SEQ ID NO: 616580 - DNA, 13 bp, D. melanogaster
cttggccaaaacg

SEQ ID NO: 616581 - DNA, 13 bp, D. melanogaster
cttggccaaaatg

SEQ ID NO: 616582 - DNA, 13 bp, D. melanogaster
cttggccaaatcg

SEQ ID NO: 616583 - DNA, 13 bp, D. melanogaster
cttggccaacagc

SEQ ID NO: 616584 - DNA, 13 bp, D. melanogaster
cttggccaacttt

SEQ ID NO: 616585 - DNA, 13 bp, D. melanogaster
cttggccaagaaa

SEQ ID NO: 616586 - DNA, 13 bp, D. melanogaster
cttggccaagagc

SEQ ID NO: 616587 - DNA, 13 bp, D. melanogaster
cttggccaaggtc

SEQ ID NO: 616588 - DNA, 13 bp, D. melanogaster
cttggccaagtgg

SEQ ID NO: 616589 - DNA, 13 bp, D. melanogaster
cttggccaagttc

SEQ ID NO: 616590 - DNA, 13 bp, D. melanogaster
cttggccacgttt

SEQ ID NO: 616591 - DNA, 13 bp, D. melanogaster
cttggccacttga

SEQ ID NO: 616592 - DNA, 13 bp, D. melanogaster
cttggccacttgg

SEQ ID NO: 616593 - DNA, 13 bp, D. melanogaster
cttggccacttgt

SEQ ID NO: 616594 - DNA, 13 bp, D. melanogaster
cttggccactttt

SEQ ID NO: 616595 - DNA, 13 bp, D. melanogaster
cttggccagccag

SEQ ID NO: 616596 - DNA, 13 bp, D. melanogaster
cttggccagtttg

SEQ ID NO: 616597 - DNA, 13 bp, D. melanogaster
cttggccattggc

SEQ ID NO: 616598 - DNA, 13 bp, D. melanogaster
cttggccatttaa

SEQ ID NO: 616599 - DNA, 13 bp, D. melanogaster
cttggccatttca

SEQ ID NO: 616600 - DNA, 13 bp, D. melanogaster
cttggcccaaccc

SEQ ID NO: 616601 - DNA, 13 bp, D. melanogaster
cttggcccggcca

SEQ ID NO: 616602 - DNA, 13 bp, D. melanogaster
cttggcctggccc

SEQ ID NO: 616603 - DNA, 13 bp, D. melanogaster
cttggcgaaaaaa

SEQ ID NO: 616604 - DNA, 13 bp, D. melanogaster
cttggcgcaacat

SEQ ID NO: 616605 - DNA, 13 bp, D. melanogaster
cttggctaattta

SEQ ID NO: 616606 - DNA, 13 bp, D. melanogaster
cttggctataatt

SEQ ID NO: 616607 - DNA, 13 bp, D. melanogaster
cttggctgaaaat

SEQ ID NO: 616608 - DNA, 13 bp, D. melanogaster
cttggctgattct

SEQ ID NO: 616609 - DNA, 13 bp, D. melanogaster
cttggctgccttt

SEQ ID NO: 616610 - DNA, 13 bp, D. melanogaster
cttggctgctgct

SEQ ID NO: 616611 - DNA, 13 bp, D. melanogaster
cttggctgctttt

SEQ ID NO: 616612 - DNA, 14 bp, D. melanogaster
cttggctggctggc

SEQ ID NO: 616613 - DNA, 13 bp, D. melanogaster
cttggctgtcaca

SEQ ID NO: 616614 - DNA, 13 bp, D. melanogaster
cttggcttaaagc

SEQ ID NO: 616615 - DNA, 13 bp, D. melanogaster
cttggcttgcatt

SEQ ID NO: 616616 - DNA, 13 bp, D. melanogaster
cttggcttgttga

SEQ ID NO: 616617 - DNA, 13 bp, D. melanogaster
cttggctttctct

SEQ ID NO: 616618 - DNA, 13 bp, D. melanogaster
cttggctttggct

SEQ ID NO: 616619 - DNA, 14 bp, D. melanogaster
cttggctttggctt

SEQ ID NO: 616620 - DNA, 13 bp, D. melanogaster
cttggctttggtt

SEQ ID NO: 616621 - DNA, 13 bp, D. melanogaster
cttggcttttccg

SEQ ID NO: 616622 - DNA, 13 bp, D. melanogaster
cttggcttttcct

SEQ ID NO: 616623 - DNA, 13 bp, D. melanogaster
cttggcttttgtg

SEQ ID NO: 616624 - DNA, 13 bp, D. melanogaster
cttgggattcgaa

SEQ ID NO: 616625 - DNA, 15 bp, D. melanogaster
cttgggcaacagaac

SEQ ID NO: 616626 - DNA, 13 bp, D. melanogaster
cttgggcattcct

SEQ ID NO: 616627 - DNA, 13 bp, D. melanogaster
cttgggccaactg

SEQ ID NO: 616628 - DNA, 13 bp, D. melanogaster
cttggggcacctg

SEQ ID NO: 616629 - DNA, 13 bp, D. melanogaster
cttgggtaccaag

SEQ ID NO: 616630 - DNA, 14 bp, D. melanogaster
cttgggtaccaaga

SEQ ID NO: 616631 - DNA, 13 bp, D. melanogaster
cttgggttaattt

SEQ ID NO: 616632 - DNA, 13 bp, D. melanogaster
cttgggttcagtt

SEQ ID NO: 616633 - DNA, 13 bp, D. melanogaster
cttggtacccaag

SEQ ID NO: 616634 - DNA, 13 bp, D. melanogaster
cttggtcagcaat

SEQ ID NO: 616635 - DNA, 13 bp, D. melanogaster
cttggtcctgaac

SEQ ID NO: 616636 - DNA, 13 bp, D. melanogaster
cttggtccttggt

SEQ ID NO: 616637 - DNA, 14 bp, D. melanogaster
cttggtccttggtc

SEQ ID NO: 616638 - DNA, 13 bp, D. melanogaster
cttggtcgatttt

SEQ ID NO: 616639 - DNA, 13 bp, D. melanogaster
cttggtgaaaaat

SEQ ID NO: 616640 - DNA, 13 bp, D. melanogaster
cttggtgatgttc

SEQ ID NO: 616641 - DNA, 13 bp, D. melanogaster
cttggtgctatat

SEQ ID NO: 616642 - DNA, 13 bp, D. melanogaster
cttggtgggcgag

SEQ ID NO: 616643 - DNA, 13 bp, D. melanogaster
cttggttataatt

SEQ ID NO: 616644 - DNA, 13 bp, D. melanogaster
cttggtttgggat

SEQ ID NO: 616645 - DNA, 13 bp, D. melanogaster
cttggtttttata

SEQ ID NO: 616646 - DNA, 13 bp, D. melanogaster
cttgtaaactttt

SEQ ID NO: 616647 - DNA, 13 bp, D. melanogaster
cttgtaaataaac

SEQ ID NO: 616648 - DNA, 13 bp, D. melanogaster
cttgtaaataatt

SEQ ID NO: 616649 - DNA, 14 bp, D. melanogaster
cttgtaaatacttt

SEQ ID NO: 616650 - DNA, 14 bp, D. melanogaster
cttgtaaatattga

SEQ ID NO: 616651 - DNA, 13 bp, D. melanogaster
cttgtaaatattt

SEQ ID NO: 616652 - DNA, 13 bp, D. melanogaster
cttgtaaatgtag

SEQ ID NO: 616653 - DNA, 13 bp, D. melanogaster
cttgtaaatttaa

SEQ ID NO: 616654 - DNA, 13 bp, D. melanogaster
cttgtaaatttat

SEQ ID NO: 616655 - DNA, 13 bp, D. melanogaster
cttgtaaatttct

SEQ ID NO: 616656 - DNA, 13 bp, D. melanogaster
cttgtaaatttgt

SEQ ID NO: 616657 - DNA, 13 bp, D. melanogaster
cttgtaattttgc

SEQ ID NO: 616658 - DNA, 13 bp, D. melanogaster
cttgtacttgtac

SEQ ID NO: 616659 - DNA, 13 bp, D. melanogaster
cttgtagcccaac

SEQ ID NO: 616660 - DNA, 13 bp, D. melanogaster
cttgtatataaaa

SEQ ID NO: 616661 - DNA, 13 bp, D. melanogaster
cttgtatatatgt

SEQ ID NO: 616662 - DNA, 13 bp, D. melanogaster
cttgtatatattt

SEQ ID NO: 616663 - DNA, 13 bp, D. melanogaster
cttgtatatgtat

SEQ ID NO: 616664 - DNA, 14 bp, D. melanogaster
cttgtatcatattt

SEQ ID NO: 616665 - DNA, 13 bp, D. melanogaster
cttgtatcgttgt

SEQ ID NO: 616666 - DNA, 13 bp, D. melanogaster
cttgtattgtatt

SEQ ID NO: 616667 - DNA, 13 bp, D. melanogaster
cttgtatttggtc

SEQ ID NO: 616668 - DNA, 13 bp, D. melanogaster
cttgtcaaaggag

SEQ ID NO: 616669 - DNA, 14 bp, D. melanogaster
cttgtctcgcataa

SEQ ID NO: 616670 - DNA, 13 bp, D. melanogaster
cttgtctgtttag

SEQ ID NO: 616671 - DNA, 13 bp, D. melanogaster
cttgtgaaaatca

SEQ ID NO: 616672 - DNA, 13 bp, D. melanogaster
cttgtgaaatttt

SEQ ID NO: 616673 - DNA, 13 bp, D. melanogaster
cttgtgagtgtgt

SEQ ID NO: 616674 - DNA, 13 bp, D. melanogaster
cttgtgataattt

SEQ ID NO: 616675 - DNA, 13 bp, D. melanogaster
cttgtgcaacatc

SEQ ID NO: 616676 - DNA, 14 bp, D. melanogaster
cttgtgcaacatca

SEQ ID NO: 616677 - DNA, 13 bp, D. melanogaster
cttgtgcattttt

SEQ ID NO: 616678 - DNA, 13 bp, D. melanogaster
cttgtgccacttt

SEQ ID NO: 616679 - DNA, 13 bp, D. melanogaster
cttgtgctgctgc

SEQ ID NO: 616680 - DNA, 13 bp, D. melanogaster
cttgtggctgaaa

SEQ ID NO: 616681 - DNA, 14 bp, D. melanogaster
cttgtgggcgtggc

SEQ ID NO: 616682 - DNA, 13 bp, D. melanogaster
cttgtgtaaaact

SEQ ID NO: 616683 - DNA, 13 bp, D. melanogaster
cttgtgtaatttg

SEQ ID NO: 616684 - DNA, 13 bp, D. melanogaster
cttgtgtctttgg

SEQ ID NO: 616685 - DNA, 13 bp, D. melanogaster
cttgtgtgcgtgt

SEQ ID NO: 616686 - DNA, 14 bp, D. melanogaster
cttgtgtgcgtgtg

SEQ ID NO: 616687 - DNA, 13 bp, D. melanogaster
cttgtgtgcgttt

SEQ ID NO: 616688 - DNA, 13 bp, D. melanogaster
cttgtgtgtgtga

SEQ ID NO: 616689 - DNA, 14 bp, D. melanogaster
cttgttatgcagtt

SEQ ID NO: 616690 - DNA, 13 bp, D. melanogaster
cttgttattgttg

SEQ ID NO: 616691 - DNA, 13 bp, D. melanogaster
cttgttccgttgt

SEQ ID NO: 616692 - DNA, 13 bp, D. melanogaster
cttgttcgctttc

SEQ ID NO: 616693 - DNA, 13 bp, D. melanogaster
cttgttctatctg

SEQ ID NO: 616694 - DNA, 13 bp, D. melanogaster
cttgttctcatat

SEQ ID NO: 616695 - DNA, 13 bp, D. melanogaster
cttgttgaacagc

SEQ ID NO: 616696 - DNA, 14 bp, D. melanogaster
cttgttgaattcgt

SEQ ID NO: 616697 - DNA, 13 bp, D. melanogaster
cttgttgacattt

SEQ ID NO: 616698 - DNA, 14 bp, D. melanogaster
cttgttgacatttt

SEQ ID NO: 616699 - DNA, 13 bp, D. melanogaster
cttgttgcagttg

SEQ ID NO: 616700 - DNA, 13 bp, D. melanogaster
cttgttggccacg

SEQ ID NO: 616701 - DNA, 14 bp, D. melanogaster
cttgttggccacgg

SEQ ID NO: 616702 - DNA, 13 bp, D. melanogaster
cttgttgtcttcc

SEQ ID NO: 616703 - DNA, 13 bp, D. melanogaster
cttgttgttattg

SEQ ID NO: 616704 - DNA, 13 bp, D. melanogaster
cttgttgttggcc

SEQ ID NO: 616705 - DNA, 13 bp, D. melanogaster
cttgttgttgtcg

SEQ ID NO: 616706 - DNA, 13 bp, D. melanogaster
cttgtttaaaaaa

SEQ ID NO: 616707 - DNA, 13 bp, D. melanogaster
cttgtttaaaaat

SEQ ID NO: 616708 - DNA, 13 bp, D. melanogaster
cttgtttaaatta

SEQ ID NO: 616709 - DNA, 13 bp, D. melanogaster
cttgtttaagatt

SEQ ID NO: 616710 - DNA, 13 bp, D. melanogaster
cttgtttagattt

SEQ ID NO: 616711 - DNA, 13 bp, D. melanogaster
cttgtttgccagc

SEQ ID NO: 616712 - DNA, 13 bp, D. melanogaster
cttgttttatata

SEQ ID NO: 616713 - DNA, 13 bp, D. melanogaster
cttgtttttgaat

SEQ ID NO: 616714 - DNA, 13 bp, D. melanogaster
cttgttttttaaa

SEQ ID NO: 616715 - DNA, 13 bp, D. melanogaster
ctttaaaaaacct

SEQ ID NO: 616716 - DNA, 14 bp, D. melanogaster
ctttaaaaaacctt

SEQ ID NO: 616717 - DNA, 13 bp, D. melanogaster
ctttaaaaacaat

SEQ ID NO: 616718 - DNA, 14 bp, D. melanogaster
ctttaaaaatcaca

SEQ ID NO: 616719 - DNA, 13 bp, D. melanogaster
ctttaaaaatgca

SEQ ID NO: 616720 - DNA, 13 bp, D. melanogaster
ctttaaaaatgta

SEQ ID NO: 616721 - DNA, 13 bp, D. melanogaster
ctttaaaacgttt

SEQ ID NO: 616722 - DNA, 13 bp, D. melanogaster
ctttaaaactaat

SEQ ID NO: 616723 - DNA, 13 bp, D. melanogaster
ctttaaaacttta

SEQ ID NO: 616724 - DNA, 13 bp, D. melanogaster
ctttaaaagaaaa

SEQ ID NO: 616725 - DNA, 13 bp, D. melanogaster
ctttaaaagaatt

SEQ ID NO: 616726 - DNA, 13 bp, D. melanogaster
ctttaaaagcttt

SEQ ID NO: 616727 - DNA, 13 bp, D. melanogaster
ctttaaaagtaga

SEQ ID NO: 616728 - DNA, 13 bp, D. melanogaster
ctttaaaagtatt

SEQ ID NO: 616729 - DNA, 13 bp, D. melanogaster
ctttaaaagttgt

SEQ ID NO: 616730 - DNA, 13 bp, D. melanogaster
ctttaaaatatga

SEQ ID NO: 616731 - DNA, 13 bp, D. melanogaster
ctttaaaatatgt

SEQ ID NO: 616732 - DNA, 13 bp, D. melanogaster
ctttaaaatcaac

SEQ ID NO: 616733 - DNA, 13 bp, D. melanogaster
ctttaaaatgaat

SEQ ID NO: 616734 - DNA, 13 bp, D. melanogaster
ctttaaaatggaa

SEQ ID NO: 616735 - DNA, 13 bp, D. melanogaster
ctttaaaatgttt

SEQ ID NO: 616736 - DNA, 13 bp, D. melanogaster
ctttaaaattgat

SEQ ID NO: 616737 - DNA, 14 bp, D. melanogaster
ctttaaaattgatt

SEQ ID NO: 616738 - DNA, 13 bp, D. melanogaster
ctttaaacaaata

SEQ ID NO: 616739 - DNA, 13 bp, D. melanogaster
ctttaaacaaatt

SEQ ID NO: 616740 - DNA, 13 bp, D. melanogaster
ctttaaacaactg

SEQ ID NO: 616741 - DNA, 14 bp, D. melanogaster
ctttaaacattttg

SEQ ID NO: 616742 - DNA, 13 bp, D. melanogaster
ctttaaagaaata

SEQ ID NO: 616743 - DNA, 13 bp, D. melanogaster
ctttaaagcagtg

SEQ ID NO: 616744 - DNA, 13 bp, D. melanogaster
ctttaaagctaaa

SEQ ID NO: 616745 - DNA, 14 bp, D. melanogaster
ctttaaaggatgtt

SEQ ID NO: 616746 - DNA, 13 bp, D. melanogaster
ctttaaagtcaaa

SEQ ID NO: 616747 - DNA, 13 bp, D. melanogaster
ctttaaatacttt

SEQ ID NO: 616748 - DNA, 13 bp, D. melanogaster
ctttaaatagaaa

SEQ ID NO: 616749 - DNA, 14 bp, D. melanogaster
ctttaaatatattc

SEQ ID NO: 616750 - DNA, 13 bp, D. melanogaster
ctttaaatatgtt

SEQ ID NO: 616751 - DNA, 13 bp, D. melanogaster
ctttaaatattct

SEQ ID NO: 616752 - DNA, 13 bp, D. melanogaster
ctttaaatcaatt

SEQ ID NO: 616753 - DNA, 13 bp, D. melanogaster
ctttaaatgaatt

SEQ ID NO: 616754 - DNA, 13 bp, D. melanogaster
ctttaaatgctta

SEQ ID NO: 616755 - DNA, 13 bp, D. melanogaster
ctttaaatgtaat

SEQ ID NO: 616756 - DNA, 13 bp, D. melanogaster
ctttaaatgtata

SEQ ID NO: 616757 - DNA, 13 bp, D. melanogaster
ctttaaatgtttt

SEQ ID NO: 616758 - DNA, 14 bp, D. melanogaster
ctttaaatgttttt

SEQ ID NO: 616759 - DNA, 13 bp, D. melanogaster
ctttaaattagcc

SEQ ID NO: 616760 - DNA, 13 bp, D. melanogaster
ctttaaattcatt

SEQ ID NO: 616761 - DNA, 13 bp, D. melanogaster
ctttaaattgaaa

SEQ ID NO: 616762 - DNA, 13 bp, D. melanogaster
ctttaaattgaat

SEQ ID NO: 616763 - DNA, 13 bp, D. melanogaster
ctttaaattgcca

SEQ ID NO: 616764 - DNA, 13 bp, D. melanogaster
ctttaaatttgaa

SEQ ID NO: 616765 - DNA, 13 bp, D. melanogaster
ctttaacaaaaat

SEQ ID NO: 616766 - DNA, 13 bp, D. melanogaster
ctttaacaaataa

SEQ ID NO: 616767 - DNA, 13 bp, D. melanogaster
ctttaactacgtt

SEQ ID NO: 616768 - DNA, 13 bp, D. melanogaster
ctttaacttttaa

SEQ ID NO: 616769 - DNA, 13 bp, D. melanogaster
ctttaagaaatat

SEQ ID NO: 616770 - DNA, 13 bp, D. melanogaster
ctttaagaacttc

SEQ ID NO: 616771 - DNA, 14 bp, D. melanogaster
ctttaagcacatct

SEQ ID NO: 616772 - DNA, 14 bp, D. melanogaster
ctttaagcacgttt

SEQ ID NO: 616773 - DNA, 13 bp, D. melanogaster
ctttaagccgctt

SEQ ID NO: 616774 - DNA, 13 bp, D. melanogaster
ctttaagctgccg

SEQ ID NO: 616775 - DNA, 13 bp, D. melanogaster
ctttaagcttaaa

SEQ ID NO: 616776 - DNA, 13 bp, D. melanogaster
ctttaagcttttt

SEQ ID NO: 616777 - DNA, 13 bp, D. melanogaster
ctttaagggaagg

SEQ ID NO: 616778 - DNA, 13 bp, D. melanogaster
ctttaagtaattt

SEQ ID NO: 616779 - DNA, 13 bp, D. melanogaster
ctttaagtatttt

SEQ ID NO: 616780 - DNA, 13 bp, D. melanogaster
ctttaagtgattt

SEQ ID NO: 616781 - DNA, 13 bp, D. melanogaster
ctttaagtgcatt

SEQ ID NO: 616782 - DNA, 13 bp, D. melanogaster
ctttaagttattt

SEQ ID NO: 616783 - DNA, 13 bp, D. melanogaster
ctttaagttctcc

SEQ ID NO: 616784 - DNA, 13 bp, D. melanogaster
ctttaagtttaag

SEQ ID NO: 616785 - DNA, 13 bp, D. melanogaster
ctttaagttttta

SEQ ID NO: 616786 - DNA, 14 bp, D. melanogaster
ctttaagtttttaa

SEQ ID NO: 616787 - DNA, 13 bp, D. melanogaster
ctttaataaaact

SEQ ID NO: 616788 - DNA, 13 bp, D. melanogaster
ctttaataacaat

SEQ ID NO: 616789 - DNA, 13 bp, D. melanogaster
ctttaataacttt

SEQ ID NO: 616790 - DNA, 14 bp, D. melanogaster
ctttaataccctga

SEQ ID NO: 616791 - DNA, 13 bp, D. melanogaster
ctttaataggaaa

SEQ ID NO: 616792 - DNA, 13 bp, D. melanogaster
ctttaatagttcc

SEQ ID NO: 616793 - DNA, 13 bp, D. melanogaster
ctttaatatctat

SEQ ID NO: 616794 - DNA, 13 bp, D. melanogaster
ctttaatcaaaat

SEQ ID NO: 616795 - DNA, 13 bp, D. melanogaster
ctttaatctatct

SEQ ID NO: 616796 - DNA, 13 bp, D. melanogaster
ctttaatgccttt

SEQ ID NO: 616797 - DNA, 13 bp, D. melanogaster
ctttaatggattt

SEQ ID NO: 616798 - DNA, 13 bp, D. melanogaster
ctttaatgtcttc

SEQ ID NO: 616799 - DNA, 13 bp, D. melanogaster
ctttaattaagtt

SEQ ID NO: 616800 - DNA, 13 bp, D. melanogaster
ctttaattaattg

SEQ ID NO: 616801 - DNA, 13 bp, D. melanogaster
ctttaattagttt

SEQ ID NO: 616802 - DNA, 13 bp, D. melanogaster
ctttaattcaaag

SEQ ID NO: 616803 - DNA, 13 bp, D. melanogaster
ctttaattcacaa

SEQ ID NO: 616804 - DNA, 13 bp, D. melanogaster
ctttaattgaaaa

SEQ ID NO: 616805 - DNA, 13 bp, D. melanogaster
ctttaattgcaat

SEQ ID NO: 616806 - DNA, 14 bp, D. melanogaster
ctttaattgcattt

SEQ ID NO: 616807 - DNA, 13 bp, D. melanogaster
ctttaattggtcc

SEQ ID NO: 616808 - DNA, 13 bp, D. melanogaster
ctttaatttcaac

SEQ ID NO: 616809 - DNA, 13 bp, D. melanogaster
ctttaatttcaat

SEQ ID NO: 616810 - DNA, 13 bp, D. melanogaster
ctttaatttgctt

SEQ ID NO: 616811 - DNA, 13 bp, D. melanogaster
ctttaatttgtat

SEQ ID NO: 616812 - DNA, 13 bp, D. melanogaster
ctttaatttgtta

SEQ ID NO: 616813 - DNA, 13 bp, D. melanogaster
ctttaatttgttg

SEQ ID NO: 616814 - DNA, 13 bp, D. melanogaster
ctttaattttaag

SEQ ID NO: 616815 - DNA, 13 bp, D. melanogaster
ctttacaaaaggc

SEQ ID NO: 616816 - DNA, 13 bp, D. melanogaster
ctttacactttaa

SEQ ID NO: 616817 - DNA, 13 bp, D. melanogaster
ctttacactttgt

SEQ ID NO: 616818 - DNA, 13 bp, D. melanogaster
ctttacatacaaa

SEQ ID NO: 616819 - DNA, 13 bp, D. melanogaster
ctttacggaaatg

SEQ ID NO: 616820 - DNA, 13 bp, D. melanogaster
ctttacggacatc

SEQ ID NO: 616821 - DNA, 13 bp, D. melanogaster
ctttagaaaaaaa

SEQ ID NO: 616822 - DNA, 13 bp, D. melanogaster
ctttagaagattt

SEQ ID NO: 616823 - DNA, 13 bp, D. melanogaster
ctttagaagtttg

SEQ ID NO: 616824 - DNA, 13 bp, D. melanogaster
ctttagaattttg

SEQ ID NO: 616825 - DNA, 13 bp, D. melanogaster
ctttagataatta

SEQ ID NO: 616826 - DNA, 13 bp, D. melanogaster
ctttagatgataa

SEQ ID NO: 616827 - DNA, 13 bp, D. melanogaster
ctttagcattcga

SEQ ID NO: 616828 - DNA, 13 bp, D. melanogaster
ctttagccactcg

SEQ ID NO: 616829 - DNA, 14 bp, D. melanogaster
ctttagcttcagct

SEQ ID NO: 616830 - DNA, 13 bp, D. melanogaster
ctttagcttctgc

SEQ ID NO: 616831 - DNA, 14 bp, D. melanogaster
ctttagcttctgct

SEQ ID NO: 616832 - DNA, 13 bp, D. melanogaster
ctttagctttagc

SEQ ID NO: 616833 - DNA, 13 bp, D. melanogaster
ctttaggaaacaa

SEQ ID NO: 616834 - DNA, 13 bp, D. melanogaster
ctttagtatctgt

SEQ ID NO: 616835 - DNA, 13 bp, D. melanogaster
ctttagtattaaa

SEQ ID NO: 616836 - DNA, 13 bp, D. melanogaster
ctttagtgcctgg

SEQ ID NO: 616837 - DNA, 13 bp, D. melanogaster
ctttagtgttagt

SEQ ID NO: 616838 - DNA, 13 bp, D. melanogaster
ctttagttttagt

SEQ ID NO: 616839 - DNA, 13 bp, D. melanogaster
ctttagtttttgc

SEQ ID NO: 616840 - DNA, 13 bp, D. melanogaster
ctttataaacttt

SEQ ID NO: 616841 - DNA, 13 bp, D. melanogaster
ctttataaatcga

SEQ ID NO: 616842 - DNA, 13 bp, D. melanogaster
ctttataaatgaa

SEQ ID NO: 616843 - DNA, 13 bp, D. melanogaster
ctttatatatgta

SEQ ID NO: 616844 - DNA, 14 bp, D. melanogaster
ctttatgaaagaag

SEQ ID NO: 616845 - DNA, 13 bp, D. melanogaster
ctttatgaatgta

SEQ ID NO: 616846 - DNA, 13 bp, D. melanogaster
ctttatggcattt

SEQ ID NO: 616847 - DNA, 13 bp, D. melanogaster
ctttatggccaaa

SEQ ID NO: 616848 - DNA, 13 bp, D. melanogaster
ctttatgtactat

SEQ ID NO: 616849 - DNA, 13 bp, D. melanogaster
ctttatgtgaaaa

SEQ ID NO: 616850 - DNA, 13 bp, D. melanogaster
ctttatgttcttc

SEQ ID NO: 616851 - DNA, 13 bp, D. melanogaster
ctttatgtttctg

SEQ ID NO: 616852 - DNA, 13 bp, D. melanogaster
ctttattaaatcc

SEQ ID NO: 616853 - DNA, 13 bp, D. melanogaster
ctttattaacata

SEQ ID NO: 616854 - DNA, 13 bp, D. melanogaster
ctttattagccga

SEQ ID NO: 616855 - DNA, 13 bp, D. melanogaster
ctttattatgtaa

SEQ ID NO: 616856 - DNA, 13 bp, D. melanogaster
ctttattcaactt

SEQ ID NO: 616857 - DNA, 13 bp, D. melanogaster
ctttattctttgg

SEQ ID NO: 616858 - DNA, 13 bp, D. melanogaster
ctttattgaaaat

SEQ ID NO: 616859 - DNA, 13 bp, D. melanogaster
ctttattgatgtc

SEQ ID NO: 616860 - DNA, 13 bp, D. melanogaster
ctttattggaaat

SEQ ID NO: 616861 - DNA, 13 bp, D. melanogaster
ctttattgtaaaa

SEQ ID NO: 616862 - DNA, 13 bp, D. melanogaster
ctttatttaaaca

SEQ ID NO: 616863 - DNA, 13 bp, D. melanogaster
ctttatttacaat

SEQ ID NO: 616864 - DNA, 13 bp, D. melanogaster
ctttatttagact

SEQ ID NO: 616865 - DNA, 13 bp, D. melanogaster
ctttatttataga

SEQ ID NO: 616866 - DNA, 13 bp, D. melanogaster
ctttatttgtaag

SEQ ID NO: 616867 - DNA, 13 bp, D. melanogaster
ctttattttaaga

SEQ ID NO: 616868 - DNA, 14 bp, D. melanogaster
ctttattttaagat

SEQ ID NO: 616869 - DNA, 13 bp, D. melanogaster
ctttattttcaag

SEQ ID NO: 616870 - DNA, 14 bp, D. melanogaster
ctttattttcggta

SEQ ID NO: 616871 - DNA, 13 bp, D. melanogaster
ctttcaaaataaa

SEQ ID NO: 616872 - DNA, 13 bp, D. melanogaster
ctttcaaaataat

SEQ ID NO: 616873 - DNA, 13 bp, D. melanogaster
ctttcaaaatgca

SEQ ID NO: 616874 - DNA, 13 bp, D. melanogaster
ctttcaaaggctt

SEQ ID NO: 616875 - DNA, 13 bp, D. melanogaster
ctttcaaagtgtt

SEQ ID NO: 616876 - DNA, 13 bp, D. melanogaster
ctttcaaataaaa

SEQ ID NO: 616877 - DNA, 13 bp, D. melanogaster
ctttcaaataaat

SEQ ID NO: 616878 - DNA, 13 bp, D. melanogaster
ctttcaaataatt

SEQ ID NO: 616879 - DNA, 13 bp, D. melanogaster
ctttcaacgaatc

SEQ ID NO: 616880 - DNA, 13 bp, D. melanogaster
ctttcaactttca

SEQ ID NO: 616881 - DNA, 13 bp, D. melanogaster
ctttcaaggcaac

SEQ ID NO: 616882 - DNA, 13 bp, D. melanogaster
ctttcaataatat

SEQ ID NO: 616883 - DNA, 13 bp, D. melanogaster
ctttcaatattat

SEQ ID NO: 616884 - DNA, 13 bp, D. melanogaster
ctttcaatcattt

SEQ ID NO: 616885 - DNA, 13 bp, D. melanogaster
ctttcaattaaat

SEQ ID NO: 616886 - DNA, 13 bp, D. melanogaster
ctttcaattacat

SEQ ID NO: 616887 - DNA, 13 bp, D. melanogaster
ctttcaattcaaa

SEQ ID NO: 616888 - DNA, 13 bp, D. melanogaster
ctttcaatttcaa

SEQ ID NO: 616889 - DNA, 14 bp, D. melanogaster
ctttcaatttcaat

SEQ ID NO: 616890 - DNA, 13 bp, D. melanogaster
ctttcacttggca

SEQ ID NO: 616891 - DNA, 14 bp, D. melanogaster
ctttcacttttaaa

SEQ ID NO: 616892 - DNA, 13 bp, D. melanogaster
ctttcagagaacc

SEQ ID NO: 616893 - DNA, 13 bp, D. melanogaster
ctttcagatactt

SEQ ID NO: 616894 - DNA, 13 bp, D. melanogaster
ctttcagtgcacc

SEQ ID NO: 616895 - DNA, 13 bp, D. melanogaster
ctttcagtgcagc

SEQ ID NO: 616896 - DNA, 13 bp, D. melanogaster
ctttcagttgttt

SEQ ID NO: 616897 - DNA, 13 bp, D. melanogaster
ctttcataaaatt

SEQ ID NO: 616898 - DNA, 13 bp, D. melanogaster
ctttcatcttttg

SEQ ID NO: 616899 - DNA, 13 bp, D. melanogaster
ctttcattcaatt

SEQ ID NO: 616900 - DNA, 13 bp, D. melanogaster
ctttcattcattc

SEQ ID NO: 616901 - DNA, 13 bp, D. melanogaster
ctttcatttaaaa

SEQ ID NO: 616902 - DNA, 13 bp, D. melanogaster
ctttcatttccat

SEQ ID NO: 616903 - DNA, 13 bp, D. melanogaster
ctttcatttcgat

SEQ ID NO: 616904 - DNA, 13 bp, D. melanogaster
ctttcatttcgtt

SEQ ID NO: 616905 - DNA, 13 bp, D. melanogaster
ctttcatttgaaa

SEQ ID NO: 616906 - DNA, 13 bp, D. melanogaster
ctttcatttgcat

SEQ ID NO: 616907 - DNA, 14 bp, D. melanogaster
ctttcatttgcatt

SEQ ID NO: 616908 - DNA, 13 bp, D. melanogaster
ctttcatttggca

SEQ ID NO: 616909 - DNA, 13 bp, D. melanogaster
ctttcatttggtt

SEQ ID NO: 616910 - DNA, 13 bp, D. melanogaster
ctttcattttcaa

SEQ ID NO: 616911 - DNA, 13 bp, D. melanogaster
ctttccaatctct

SEQ ID NO: 616912 - DNA, 13 bp, D. melanogaster
ctttccaattcca

SEQ ID NO: 616913 - DNA, 13 bp, D. melanogaster
ctttccacatttt

SEQ ID NO: 616914 - DNA, 13 bp, D. melanogaster
ctttccaccgccc

SEQ ID NO: 616915 - DNA, 13 bp, D. melanogaster
ctttccaggcatt

SEQ ID NO: 616916 - DNA, 13 bp, D. melanogaster
ctttccatgtccc

SEQ ID NO: 616917 - DNA, 13 bp, D. melanogaster
ctttccattgacc

SEQ ID NO: 616918 - DNA, 13 bp, D. melanogaster
ctttccatttaat

SEQ ID NO: 616919 - DNA, 13 bp, D. melanogaster
ctttccatttgcc

SEQ ID NO: 616920 - DNA, 14 bp, D. melanogaster
ctttccatttttaa

SEQ ID NO: 616921 - DNA, 14 bp, D. melanogaster
ctttcccaaaaaaa

SEQ ID NO: 616922 - DNA, 13 bp, D. melanogaster
ctttcccaaaaat

SEQ ID NO: 616923 - DNA, 13 bp, D. melanogaster
ctttcccagctgc

SEQ ID NO: 616924 - DNA, 13 bp, D. melanogaster
ctttcccagtttt

SEQ ID NO: 616925 - DNA, 13 bp, D. melanogaster
ctttccccaaaaa

SEQ ID NO: 616926 - DNA, 13 bp, D. melanogaster
ctttcccgacttt

SEQ ID NO: 616927 - DNA, 13 bp, D. melanogaster
ctttcccgatttt

SEQ ID NO: 616928 - DNA, 13 bp, D. melanogaster
ctttccgaaagct

SEQ ID NO: 616929 - DNA, 13 bp, D. melanogaster
ctttccgcccact

SEQ ID NO: 616930 - DNA, 13 bp, D. melanogaster
ctttcctaaaggc

SEQ ID NO: 616931 - DNA, 13 bp, D. melanogaster
ctttccttggatt

SEQ ID NO: 616932 - DNA, 13 bp, D. melanogaster
ctttcgaaaaaaa

SEQ ID NO: 616933 - DNA, 14 bp, D. melanogaster
ctttcgaaaaaaaa

SEQ ID NO: 616934 - DNA, 13 bp, D. melanogaster
ctttcgaatatat

SEQ ID NO: 616935 - DNA, 13 bp, D. melanogaster
ctttcgaatttat

SEQ ID NO: 616936 - DNA, 13 bp, D. melanogaster
ctttcgatatcta

SEQ ID NO: 616937 - DNA, 13 bp, D. melanogaster
ctttcgattggca

SEQ ID NO: 616938 - DNA, 13 bp, D. melanogaster
ctttcgccggaga

SEQ ID NO: 616939 - DNA, 13 bp, D. melanogaster
ctttcgctttatt

SEQ ID NO: 616940 - DNA, 14 bp, D. melanogaster
ctttcgctttattt

SEQ ID NO: 616941 - DNA, 13 bp, D. melanogaster
ctttcgctttcag

SEQ ID NO: 616942 - DNA, 13 bp, D. melanogaster
ctttcgctttgca

SEQ ID NO: 616943 - DNA, 13 bp, D. melanogaster
ctttcgcttttgc

SEQ ID NO: 616944 - DNA, 13 bp, D. melanogaster
ctttcggattctg

SEQ ID NO: 616945 - DNA, 13 bp, D. melanogaster
ctttcggctttcg

SEQ ID NO: 616946 - DNA, 13 bp, D. melanogaster
ctttcgtcctcgc

SEQ ID NO: 616947 - DNA, 13 bp, D. melanogaster
ctttcgtttcatt

SEQ ID NO: 616948 - DNA, 13 bp, D. melanogaster
ctttcgttttaat

SEQ ID NO: 616949 - DNA, 13 bp, D. melanogaster
ctttcgttttgat

SEQ ID NO: 616950 - DNA, 13 bp, D. melanogaster
ctttctaacttag

SEQ ID NO: 616951 - DNA, 13 bp, D. melanogaster
ctttctaatttcc

SEQ ID NO: 616952 - DNA, 13 bp, D. melanogaster
ctttctcttggcc

SEQ ID NO: 616953 - DNA, 13 bp, D. melanogaster
ctttctgcaattt

SEQ ID NO: 616954 - DNA, 13 bp, D. melanogaster
ctttctgcacttt

SEQ ID NO: 616955 - DNA, 13 bp, D. melanogaster
ctttctgctgctt

SEQ ID NO: 616956 - DNA, 13 bp, D. melanogaster
ctttctggcattc

SEQ ID NO: 616957 - DNA, 13 bp, D. melanogaster
ctttctggcattg

SEQ ID NO: 616958 - DNA, 13 bp, D. melanogaster
ctttctggccaaa

SEQ ID NO: 616959 - DNA, 13 bp, D. melanogaster
ctttctggccaac

SEQ ID NO: 616960 - DNA, 13 bp, D. melanogaster
ctttctggctttc

SEQ ID NO: 616961 - DNA, 13 bp, D. melanogaster
ctttctgtagtgg

SEQ ID NO: 616962 - DNA, 13 bp, D. melanogaster
ctttctgtttgcc

SEQ ID NO: 616963 - DNA, 13 bp, D. melanogaster
ctttcttaataaa

SEQ ID NO: 616964 - DNA, 13 bp, D. melanogaster
ctttcttctcaac

SEQ ID NO: 616965 - DNA, 13 bp, D. melanogaster
ctttctttatgaa

SEQ ID NO: 616966 - DNA, 13 bp, D. melanogaster
ctttctttccagc

SEQ ID NO: 616967 - DNA, 13 bp, D. melanogaster
ctttctttgctgg

SEQ ID NO: 616968 - DNA, 13 bp, D. melanogaster
ctttgaaaaatat

SEQ ID NO: 616969 - DNA, 13 bp, D. melanogaster
ctttgaaaaatgt

SEQ ID NO: 616970 - DNA, 14 bp, D. melanogaster
ctttgaaaaatgtt

SEQ ID NO: 616971 - DNA, 13 bp, D. melanogaster
ctttgaaaacgca

SEQ ID NO: 616972 - DNA, 14 bp, D. melanogaster
ctttgaaaacttta

SEQ ID NO: 616973 - DNA, 13 bp, D. melanogaster
ctttgaaaataat

SEQ ID NO: 616974 - DNA, 13 bp, D. melanogaster
ctttgaaagacat

SEQ ID NO: 616975 - DNA, 13 bp, D. melanogaster
ctttgaaatatcc

SEQ ID NO: 616976 - DNA, 13 bp, D. melanogaster
ctttgaaatcttg

SEQ ID NO: 616977 - DNA, 13 bp, D. melanogaster
ctttgaaatgcga

SEQ ID NO: 616978 - DNA, 13 bp, D. melanogaster
ctttgaaattata

SEQ ID NO: 616979 - DNA, 13 bp, D. melanogaster
ctttgaaattatt

SEQ ID NO: 616980 - DNA, 13 bp, D. melanogaster
ctttgaaattcaa

SEQ ID NO: 616981 - DNA, 13 bp, D. melanogaster
ctttgaactttaa

SEQ ID NO: 616982 - DNA, 14 bp, D. melanogaster
ctttgaactttttt

SEQ ID NO: 616983 - DNA, 13 bp, D. melanogaster
ctttgaagagcaa

SEQ ID NO: 616984 - DNA, 14 bp, D. melanogaster
ctttgaagagcaat

SEQ ID NO: 616985 - DNA, 13 bp, D. melanogaster
ctttgaataattg

SEQ ID NO: 616986 - DNA, 13 bp, D. melanogaster
ctttgaatatata

SEQ ID NO: 616987 - DNA, 13 bp, D. melanogaster
ctttgaatgccat

SEQ ID NO: 616988 - DNA, 13 bp, D. melanogaster
ctttgaattcggc

SEQ ID NO: 616989 - DNA, 13 bp, D. melanogaster
ctttgaatttcaa

SEQ ID NO: 616990 - DNA, 13 bp, D. melanogaster
ctttgaatttctg

SEQ ID NO: 616991 - DNA, 14 bp, D. melanogaster
ctttgaatttctgg

SEQ ID NO: 616992 - DNA, 14 bp, D. melanogaster
ctttgaatttgact

SEQ ID NO: 616993 - DNA, 13 bp, D. melanogaster
ctttgacaagggt

SEQ ID NO: 616994 - DNA, 14 bp, D. melanogaster
ctttgacaagggtc

SEQ ID NO: 616995 - DNA, 13 bp, D. melanogaster
ctttgacactttg

SEQ ID NO: 616996 - DNA, 13 bp, D. melanogaster
ctttgacagcggc

SEQ ID NO: 616997 - DNA, 13 bp, D. melanogaster
ctttgacattact

SEQ ID NO: 616998 - DNA, 13 bp, D. melanogaster
ctttgaccttttt

SEQ ID NO: 616999 - DNA, 13 bp, D. melanogaster
ctttgacttggcc

SEQ ID NO: 617000 - DNA, 14 bp, D. melanogaster
ctttgactttgact

SEQ ID NO: 617001 - DNA, 13 bp, D. melanogaster
ctttgactttgcc

SEQ ID NO: 617002 - DNA, 13 bp, D. melanogaster
ctttgactttggc

SEQ ID NO: 617003 - DNA, 13 bp, D. melanogaster
ctttgagaataga

SEQ ID NO: 617004 - DNA, 13 bp, D. melanogaster
ctttgagctttac

SEQ ID NO: 617005 - DNA, 13 bp, D. melanogaster
ctttgagtcccac

SEQ ID NO: 617006 - DNA, 13 bp, D. melanogaster
ctttgagttcagt

SEQ ID NO: 617007 - DNA, 13 bp, D. melanogaster
ctttgagttttcc

SEQ ID NO: 617008 - DNA, 13 bp, D. melanogaster
ctttgataacttt

SEQ ID NO: 617009 - DNA, 13 bp, D. melanogaster
ctttgatatacca

SEQ ID NO: 617010 - DNA, 13 bp, D. melanogaster
ctttgatatgact

SEQ ID NO: 617011 - DNA, 13 bp, D. melanogaster
ctttgatgacatc

SEQ ID NO: 617012 - DNA, 13 bp, D. melanogaster
ctttgattcaatt

SEQ ID NO: 617013 - DNA, 13 bp, D. melanogaster
ctttgattgattg

SEQ ID NO: 617014 - DNA, 13 bp, D. melanogaster
ctttgattgcatt

SEQ ID NO: 617015 - DNA, 13 bp, D. melanogaster
ctttgattgcctg

SEQ ID NO: 617016 - DNA, 13 bp, D. melanogaster
ctttgatttaaat

SEQ ID NO: 617017 - DNA, 13 bp, D. melanogaster
ctttgatttatgg

SEQ ID NO: 617018 - DNA, 13 bp, D. melanogaster
ctttgatttcaaa

SEQ ID NO: 617019 - DNA, 13 bp, D. melanogaster
ctttgattttcca

SEQ ID NO: 617020 - DNA, 14 bp, D. melanogaster
ctttgattttccag

SEQ ID NO: 617021 - DNA, 13 bp, D. melanogaster
ctttgattttgca

SEQ ID NO: 617022 - DNA, 13 bp, D. melanogaster
ctttgcaaaagtt

SEQ ID NO: 617023 - DNA, 13 bp, D. melanogaster
ctttgcaactttt

SEQ ID NO: 617024 - DNA, 13 bp, D. melanogaster
ctttgcaagagct

SEQ ID NO: 617025 - DNA, 14 bp, D. melanogaster
ctttgcacaatgcc

SEQ ID NO: 617026 - DNA, 13 bp, D. melanogaster
ctttgcacatttc

SEQ ID NO: 617027 - DNA, 13 bp, D. melanogaster
ctttgcagccgaa

SEQ ID NO: 617028 - DNA, 13 bp, D. melanogaster
ctttgcataataa

SEQ ID NO: 617029 - DNA, 14 bp, D. melanogaster
ctttgcatattctc

SEQ ID NO: 617030 - DNA, 13 bp, D. melanogaster
ctttgcatgtgtg

SEQ ID NO: 617031 - DNA, 13 bp, D. melanogaster
ctttgcattataa

SEQ ID NO: 617032 - DNA, 13 bp, D. melanogaster
ctttgcatttatt

SEQ ID NO: 617033 - DNA, 13 bp, D. melanogaster
ctttgcatttgcc

SEQ ID NO: 617034 - DNA, 14 bp, D. melanogaster
ctttgccaaaaaaa

SEQ ID NO: 617035 - DNA, 13 bp, D. melanogaster
ctttgccaaaatg

SEQ ID NO: 617036 - DNA, 13 bp, D. melanogaster
ctttgccaacttt

SEQ ID NO: 617037 - DNA, 13 bp, D. melanogaster
ctttgccaccttt

SEQ ID NO: 617038 - DNA, 13 bp, D. melanogaster
ctttgccactttg

SEQ ID NO: 617039 - DNA, 13 bp, D. melanogaster
ctttgccactttt

SEQ ID NO: 617040 - DNA, 13 bp, D. melanogaster
ctttgccagcagc

SEQ ID NO: 617041 - DNA, 13 bp, D. melanogaster
ctttgccagctgc

SEQ ID NO: 617042 - DNA, 13 bp, D. melanogaster
ctttgccagcttt

SEQ ID NO: 617043 - DNA, 13 bp, D. melanogaster
ctttgccatattt

SEQ ID NO: 617044 - DNA, 13 bp, D. melanogaster
ctttgcccacttt

SEQ ID NO: 617045 - DNA, 13 bp, D. melanogaster
ctttgcctctgct

SEQ ID NO: 617046 - DNA, 13 bp, D. melanogaster
ctttgcctctttg

SEQ ID NO: 617047 - DNA, 14 bp, D. melanogaster
ctttgccttcggat

SEQ ID NO: 617048 - DNA, 13 bp, D. melanogaster
ctttgcctttgat

SEQ ID NO: 617049 - DNA, 14 bp, D. melanogaster
ctttgcgtttattt

SEQ ID NO: 617050 - DNA, 13 bp, D. melanogaster
ctttgctaccttc

SEQ ID NO: 617051 - DNA, 13 bp, D. melanogaster
ctttgctctggaa

SEQ ID NO: 617052 - DNA, 14 bp, D. melanogaster
ctttgctctttgat

SEQ ID NO: 617053 - DNA, 13 bp, D. melanogaster
ctttgctgaaatt

SEQ ID NO: 617054 - DNA, 13 bp, D. melanogaster
ctttgctgatttt

SEQ ID NO: 617055 - DNA, 13 bp, D. melanogaster
ctttgctgcattt

SEQ ID NO: 617056 - DNA, 13 bp, D. melanogaster
ctttgctggaggt

SEQ ID NO: 617057 - DNA, 13 bp, D. melanogaster
ctttgctggcaaa

SEQ ID NO: 617058 - DNA, 13 bp, D. melanogaster
ctttgcttatatt

SEQ ID NO: 617059 - DNA, 13 bp, D. melanogaster
ctttgctttcatt

SEQ ID NO: 617060 - DNA, 13 bp, D. melanogaster
ctttgctttgcat

SEQ ID NO: 617061 - DNA, 14 bp, D. melanogaster
ctttgctttggctt

SEQ ID NO: 617062 - DNA, 13 bp, D. melanogaster
ctttggaaaaatt

SEQ ID NO: 617063 - DNA, 13 bp, D. melanogaster
ctttggaaaataa

SEQ ID NO: 617064 - DNA, 13 bp, D. melanogaster
ctttggaaaatat

SEQ ID NO: 617065 - DNA, 13 bp, D. melanogaster
ctttggaacaatt

SEQ ID NO: 617066 - DNA, 13 bp, D. melanogaster
ctttggaagaact

SEQ ID NO: 617067 - DNA, 13 bp, D. melanogaster
ctttggaatcatt

SEQ ID NO: 617068 - DNA, 13 bp, D. melanogaster
ctttggatgtttt

SEQ ID NO: 617069 - DNA, 13 bp, D. melanogaster
ctttggatttgat

SEQ ID NO: 617070 - DNA, 13 bp, D. melanogaster
ctttggcaaacaa

SEQ ID NO: 617071 - DNA, 13 bp, D. melanogaster
ctttggcaaataa

SEQ ID NO: 617072 - DNA, 13 bp, D. melanogaster
ctttggcaaatat

SEQ ID NO: 617073 - DNA, 13 bp, D. melanogaster
ctttggcaacatt

SEQ ID NO: 617074 - DNA, 13 bp, D. melanogaster
ctttggcaacttt

SEQ ID NO: 617075 - DNA, 13 bp, D. melanogaster
ctttggcactttg

SEQ ID NO: 617076 - DNA, 14 bp, D. melanogaster
ctttggcagaatgt

SEQ ID NO: 617077 - DNA, 13 bp, D. melanogaster
ctttggcagccgc

SEQ ID NO: 617078 - DNA, 13 bp, D. melanogaster
ctttggcattaaa

SEQ ID NO: 617079 - DNA, 13 bp, D. melanogaster
ctttggcatttcc

SEQ ID NO: 617080 - DNA, 13 bp, D. melanogaster
ctttggccaaatg

SEQ ID NO: 617081 - DNA, 13 bp, D. melanogaster
ctttggccacgcc

SEQ ID NO: 617082 - DNA, 13 bp, D. melanogaster
ctttggcgatgcg

SEQ ID NO: 617083 - DNA, 13 bp, D. melanogaster
ctttggctaatta

SEQ ID NO: 617084 - DNA, 13 bp, D. melanogaster
ctttggctaattt

SEQ ID NO: 617085 - DNA, 13 bp, D. melanogaster
ctttggctcgtcc

SEQ ID NO: 617086 - DNA, 13 bp, D. melanogaster
ctttggctctggc

SEQ ID NO: 617087 - DNA, 13 bp, D. melanogaster
ctttggctgcatt

SEQ ID NO: 617088 - DNA, 13 bp, D. melanogaster
ctttggctgttgc

SEQ ID NO: 617089 - DNA, 13 bp, D. melanogaster
ctttggcttccat

SEQ ID NO: 617090 - DNA, 13 bp, D. melanogaster
ctttggcttcgct

SEQ ID NO: 617091 - DNA, 13 bp, D. melanogaster
ctttggcttggct

SEQ ID NO: 617092 - DNA, 13 bp, D. melanogaster
ctttggctttgct

SEQ ID NO: 617093 - DNA, 13 bp, D. melanogaster
ctttggctttggg

SEQ ID NO: 617094 - DNA, 13 bp, D. melanogaster
ctttgggaaaaac

SEQ ID NO: 617095 - DNA, 13 bp, D. melanogaster
ctttgggcattat

SEQ ID NO: 617096 - DNA, 14 bp, D. melanogaster
ctttgggcattatg

SEQ ID NO: 617097 - DNA, 13 bp, D. melanogaster
ctttgggccaact

SEQ ID NO: 617098 - DNA, 13 bp, D. melanogaster
ctttgggccaaga

SEQ ID NO: 617099 - DNA, 13 bp, D. melanogaster
ctttgggccataa

SEQ ID NO: 617100 - DNA, 13 bp, D. melanogaster
ctttgggcttttc

SEQ ID NO: 617101 - DNA, 13 bp, D. melanogaster
ctttggtacgacc

SEQ ID NO: 617102 - DNA, 13 bp, D. melanogaster
ctttggtgctttg

SEQ ID NO: 617103 - DNA, 13 bp, D. melanogaster
ctttggtggccat

SEQ ID NO: 617104 - DNA, 13 bp, D. melanogaster
ctttggtgggaat

SEQ ID NO: 617105 - DNA, 13 bp, D. melanogaster
ctttggtttagtt

SEQ ID NO: 617106 - DNA, 13 bp, D. melanogaster
ctttggtttcatt

SEQ ID NO: 617107 - DNA, 13 bp, D. melanogaster
ctttgtaaatttt

SEQ ID NO: 617108 - DNA, 13 bp, D. melanogaster
ctttgtaattaaa

SEQ ID NO: 617109 - DNA, 13 bp, D. melanogaster
ctttgtaattatt

SEQ ID NO: 617110 - DNA, 13 bp, D. melanogaster
ctttgtaatttaa

SEQ ID NO: 617111 - DNA, 13 bp, D. melanogaster
ctttgtaatttat

SEQ ID NO: 617112 - DNA, 14 bp, D. melanogaster
ctttgtagatcaat

SEQ ID NO: 617113 - DNA, 13 bp, D. melanogaster
ctttgtatataaa

SEQ ID NO: 617114 - DNA, 13 bp, D. melanogaster
ctttgtatctgcg

SEQ ID NO: 617115 - DNA, 13 bp, D. melanogaster
ctttgtatctttc

SEQ ID NO: 617116 - DNA, 13 bp, D. melanogaster
ctttgtatctttg

SEQ ID NO: 617117 - DNA, 13 bp, D. melanogaster
ctttgtattccaa

SEQ ID NO: 617118 - DNA, 13 bp, D. melanogaster
ctttgtatttaat

SEQ ID NO: 617119 - DNA, 13 bp, D. melanogaster
ctttgtatttgct

SEQ ID NO: 617120 - DNA, 13 bp, D. melanogaster
ctttgtctgtctg

SEQ ID NO: 617121 - DNA, 13 bp, D. melanogaster
ctttgtcttggcc

SEQ ID NO: 617122 - DNA, 13 bp, D. melanogaster
ctttgtctttgcc

SEQ ID NO: 617123 - DNA, 13 bp, D. melanogaster
ctttgtctttggc

SEQ ID NO: 617124 - DNA, 13 bp, D. melanogaster
ctttgtgcataag

SEQ ID NO: 617125 - DNA, 13 bp, D. melanogaster
ctttgtgccagca

SEQ ID NO: 617126 - DNA, 13 bp, D. melanogaster
ctttgtgccattt

SEQ ID NO: 617127 - DNA, 13 bp, D. melanogaster
ctttgtgcctttg

SEQ ID NO: 617128 - DNA, 13 bp, D. melanogaster
ctttgtgcttgga

SEQ ID NO: 617129 - DNA, 13 bp, D. melanogaster
ctttgtggccatt

SEQ ID NO: 617130 - DNA, 13 bp, D. melanogaster
ctttgtgtccttc

SEQ ID NO: 617131 - DNA, 13 bp, D. melanogaster
ctttgtgtgcgtg

SEQ ID NO: 617132 - DNA, 13 bp, D. melanogaster
ctttgtgtgcttc

SEQ ID NO: 617133 - DNA, 13 bp, D. melanogaster
ctttgtgtgtgcg

SEQ ID NO: 617134 - DNA, 14 bp, D. melanogaster
ctttgtgtttaact

SEQ ID NO: 617135 - DNA, 13 bp, D. melanogaster
ctttgtgtttgcc

SEQ ID NO: 617136 - DNA, 13 bp, D. melanogaster
ctttgttaaatat

SEQ ID NO: 617137 - DNA, 13 bp, D. melanogaster
ctttgttaattaa

SEQ ID NO: 617138 - DNA, 13 bp, D. melanogaster
ctttgttcaccta

SEQ ID NO: 617139 - DNA, 13 bp, D. melanogaster
ctttgttgcaatt

SEQ ID NO: 617140 - DNA, 13 bp, D. melanogaster
ctttgttgcacag

SEQ ID NO: 617141 - DNA, 14 bp, D. melanogaster
ctttgttgctgctg

SEQ ID NO: 617142 - DNA, 13 bp, D. melanogaster
ctttgttgttggc

SEQ ID NO: 617143 - DNA, 13 bp, D. melanogaster
ctttgtttaaact

SEQ ID NO: 617144 - DNA, 13 bp, D. melanogaster
ctttgtttaattg

SEQ ID NO: 617145 - DNA, 13 bp, D. melanogaster
ctttgtttacatt

SEQ ID NO: 617146 - DNA, 13 bp, D. melanogaster
ctttgtttacctt

SEQ ID NO: 617147 - DNA, 13 bp, D. melanogaster
ctttgtttacgtt

SEQ ID NO: 617148 - DNA, 13 bp, D. melanogaster
ctttgtttgactt

SEQ ID NO: 617149 - DNA, 13 bp, D. melanogaster
ctttgtttgcaat

SEQ ID NO: 617150 - DNA, 13 bp, D. melanogaster
ctttgtttggcca

SEQ ID NO: 617151 - DNA, 14 bp, D. melanogaster
ctttgtttgtttac

SEQ ID NO: 617152 - DNA, 13 bp, D. melanogaster
ctttgttttcaat

SEQ ID NO: 617153 - DNA, 13 bp, D. melanogaster
ctttgttttccat

SEQ ID NO: 617154 - DNA, 13 bp, D. melanogaster
ctttgttttcggc

SEQ ID NO: 617155 - DNA, 13 bp, D. melanogaster
ctttgttttgaaa

SEQ ID NO: 617156 - DNA, 13 bp, D. melanogaster
ctttgttttgact

SEQ ID NO: 617157 - DNA, 13 bp, D. melanogaster
ctttgttttggcc

SEQ ID NO: 617158 - DNA, 14 bp, D. melanogaster
ctttgtttttgacc

SEQ ID NO: 617159 - DNA, 13 bp, D. melanogaster
cttttaaaaaatg

SEQ ID NO: 617160 - DNA, 14 bp, D. melanogaster
cttttaaaaaattg

SEQ ID NO: 617161 - DNA, 13 bp, D. melanogaster
cttttaaaaacaa

SEQ ID NO: 617162 - DNA, 13 bp, D. melanogaster
cttttaaaaatca

SEQ ID NO: 617163 - DNA, 13 bp, D. melanogaster
cttttaaaacatt

SEQ ID NO: 617164 - DNA, 14 bp, D. melanogaster
cttttaaaactaaa

SEQ ID NO: 617165 - DNA, 13 bp, D. melanogaster
cttttaaaagtaa

SEQ ID NO: 617166 - DNA, 13 bp, D. melanogaster
cttttaaaataca

SEQ ID NO: 617167 - DNA, 13 bp, D. melanogaster
cttttaaaatctt

SEQ ID NO: 617168 - DNA, 13 bp, D. melanogaster
cttttaaaattga

SEQ ID NO: 617169 - DNA, 13 bp, D. melanogaster
cttttaaactaaa

SEQ ID NO: 617170 - DNA, 13 bp, D. melanogaster
cttttaaagttaa

SEQ ID NO: 617171 - DNA, 13 bp, D. melanogaster
cttttaaagtttt

SEQ ID NO: 617172 - DNA, 13 bp, D. melanogaster
cttttaaataagc

SEQ ID NO: 617173 - DNA, 13 bp, D. melanogaster
cttttaaatatac

SEQ ID NO: 617174 - DNA, 13 bp, D. melanogaster
cttttaaatcgaa

SEQ ID NO: 617175 - DNA, 13 bp, D. melanogaster
cttttaaatgaaa

SEQ ID NO: 617176 - DNA, 13 bp, D. melanogaster
cttttaaatgatt

SEQ ID NO: 617177 - DNA, 13 bp, D. melanogaster
cttttaaatgcaa

SEQ ID NO: 617178 - DNA, 13 bp, D. melanogaster
cttttaaatggaa

SEQ ID NO: 617179 - DNA, 13 bp, D. melanogaster
cttttaaatttgt

SEQ ID NO: 617180 - DNA, 13 bp, D. melanogaster
cttttaactgttt

SEQ ID NO: 617181 - DNA, 13 bp, D. melanogaster
cttttaacttaaa

SEQ ID NO: 617182 - DNA, 13 bp, D. melanogaster
cttttaagccttt

SEQ ID NO: 617183 - DNA, 14 bp, D. melanogaster
cttttaagttaaaa

SEQ ID NO: 617184 - DNA, 14 bp, D. melanogaster
cttttaatagattt

SEQ ID NO: 617185 - DNA, 13 bp, D. melanogaster
cttttaatgattt

SEQ ID NO: 617186 - DNA, 13 bp, D. melanogaster
cttttaatggcaa

SEQ ID NO: 617187 - DNA, 13 bp, D. melanogaster
cttttaatggcat

SEQ ID NO: 617188 - DNA, 13 bp, D. melanogaster
cttttaatgttaa

SEQ ID NO: 617189 - DNA, 14 bp, D. melanogaster
cttttaatgttaat

SEQ ID NO: 617190 - DNA, 13 bp, D. melanogaster
cttttaattcaat

SEQ ID NO: 617191 - DNA, 13 bp, D. melanogaster
cttttaattgaaa

SEQ ID NO: 617192 - DNA, 13 bp, D. melanogaster
cttttaattgatt

SEQ ID NO: 617193 - DNA, 13 bp, D. melanogaster
cttttaattgttc

SEQ ID NO: 617194 - DNA, 13 bp, D. melanogaster
cttttaatttcaa

SEQ ID NO: 617195 - DNA, 13 bp, D. melanogaster
cttttaatttgat

SEQ ID NO: 617196 - DNA, 14 bp, D. melanogaster
cttttaatttttgc

SEQ ID NO: 617197 - DNA, 13 bp, D. melanogaster
cttttacattttg

SEQ ID NO: 617198 - DNA, 13 bp, D. melanogaster
cttttaccaaatg

SEQ ID NO: 617199 - DNA, 13 bp, D. melanogaster
cttttactttaaa

SEQ ID NO: 617200 - DNA, 13 bp, D. melanogaster
cttttactttacg

SEQ ID NO: 617201 - DNA, 13 bp, D. melanogaster
cttttactttgca

SEQ ID NO: 617202 - DNA, 14 bp, D. melanogaster
cttttactttgcaa

SEQ ID NO: 617203 - DNA, 13 bp, D. melanogaster
cttttactttggc

SEQ ID NO: 617204 - DNA, 13 bp, D. melanogaster
cttttacttttcg

SEQ ID NO: 617205 - DNA, 13 bp, D. melanogaster
cttttagaaaata

SEQ ID NO: 617206 - DNA, 13 bp, D. melanogaster
cttttagatttta

SEQ ID NO: 617207 - DNA, 13 bp, D. melanogaster
cttttagattttc

SEQ ID NO: 617208 - DNA, 13 bp, D. melanogaster
cttttagcacgtg

SEQ ID NO: 617209 - DNA, 13 bp, D. melanogaster
cttttagctcttt

SEQ ID NO: 617210 - DNA, 14 bp, D. melanogaster
cttttagctctttg

SEQ ID NO: 617211 - DNA, 13 bp, D. melanogaster
cttttagcttgta

SEQ ID NO: 617212 - DNA, 13 bp, D. melanogaster
cttttagcttttg

SEQ ID NO: 617213 - DNA, 13 bp, D. melanogaster
cttttataatgga

SEQ ID NO: 617214 - DNA, 13 bp, D. melanogaster
cttttatacaaaa

SEQ ID NO: 617215 - DNA, 14 bp, D. melanogaster
cttttatatgttaa

SEQ ID NO: 617216 - DNA, 13 bp, D. melanogaster
cttttatctaact

SEQ ID NO: 617217 - DNA, 13 bp, D. melanogaster
cttttatgaatga

SEQ ID NO: 617218 - DNA, 13 bp, D. melanogaster
cttttatgaattt

SEQ ID NO: 617219 - DNA, 13 bp, D. melanogaster
cttttatggccgc

SEQ ID NO: 617220 - DNA, 13 bp, D. melanogaster
cttttatggcctt

SEQ ID NO: 617221 - DNA, 13 bp, D. melanogaster
cttttatggttat

SEQ ID NO: 617222 - DNA, 13 bp, D. melanogaster
cttttattgaatt

SEQ ID NO: 617223 - DNA, 14 bp, D. melanogaster
cttttattgaatta

SEQ ID NO: 617224 - DNA, 13 bp, D. melanogaster
cttttatttggca

SEQ ID NO: 617225 - DNA, 13 bp, D. melanogaster
cttttcaaaaaca

SEQ ID NO: 617226 - DNA, 13 bp, D. melanogaster
cttttcaaaagtg

SEQ ID NO: 617227 - DNA, 13 bp, D. melanogaster
cttttcaaaatca

SEQ ID NO: 617228 - DNA, 13 bp, D. melanogaster
cttttcaaaatta

SEQ ID NO: 617229 - DNA, 13 bp, D. melanogaster
cttttcaaacatt

SEQ ID NO: 617230 - DNA, 13 bp, D. melanogaster
cttttcaaataaa

SEQ ID NO: 617231 - DNA, 13 bp, D. melanogaster
cttttcaaatata

SEQ ID NO: 617232 - DNA, 13 bp, D. melanogaster
cttttcaacaaat

SEQ ID NO: 617233 - DNA, 13 bp, D. melanogaster
cttttcaacactt

SEQ ID NO: 617234 - DNA, 13 bp, D. melanogaster
cttttcaagctgc

SEQ ID NO: 617235 - DNA, 13 bp, D. melanogaster
cttttcaagtttt

SEQ ID NO: 617236 - DNA, 13 bp, D. melanogaster
cttttcaatgcaa

SEQ ID NO: 617237 - DNA, 14 bp, D. melanogaster
cttttcaattaaat

SEQ ID NO: 617238 - DNA, 13 bp, D. melanogaster
cttttcaatttca

SEQ ID NO: 617239 - DNA, 13 bp, D. melanogaster
cttttcacaattt

SEQ ID NO: 617240 - DNA, 13 bp, D. melanogaster
cttttcacactct

SEQ ID NO: 617241 - DNA, 13 bp, D. melanogaster
cttttcacacttt

SEQ ID NO: 617242 - DNA, 13 bp, D. melanogaster
cttttcacgcttt

SEQ ID NO: 617243 - DNA, 13 bp, D. melanogaster
cttttcactgttt

SEQ ID NO: 617244 - DNA, 13 bp, D. melanogaster
cttttcagctttt

SEQ ID NO: 617245 - DNA, 13 bp, D. melanogaster
cttttcatttggc

SEQ ID NO: 617246 - DNA, 14 bp, D. melanogaster
cttttcattttcaa

SEQ ID NO: 617247 - DNA, 13 bp, D. melanogaster
cttttccaaattc

SEQ ID NO: 617248 - DNA, 13 bp, D. melanogaster
cttttccaacccc

SEQ ID NO: 617249 - DNA, 13 bp, D. melanogaster
cttttccaactgc

SEQ ID NO: 617250 - DNA, 13 bp, D. melanogaster
cttttccaataaa

SEQ ID NO: 617251 - DNA, 13 bp, D. melanogaster
cttttccacaatt

SEQ ID NO: 617252 - DNA, 13 bp, D. melanogaster
cttttccacttaa

SEQ ID NO: 617253 - DNA, 13 bp, D. melanogaster
cttttccactttg

SEQ ID NO: 617254 - DNA, 13 bp, D. melanogaster
cttttccattcca

SEQ ID NO: 617255 - DNA, 13 bp, D. melanogaster
cttttccattcgc

SEQ ID NO: 617256 - DNA, 13 bp, D. melanogaster
cttttccattgtc

SEQ ID NO: 617257 - DNA, 14 bp, D. melanogaster
cttttccatttcca

SEQ ID NO: 617258 - DNA, 13 bp, D. melanogaster
cttttcccagtcc

SEQ ID NO: 617259 - DNA, 13 bp, D. melanogaster
cttttccgaccat

SEQ ID NO: 617260 - DNA, 14 bp, D. melanogaster
cttttccgcatttc

SEQ ID NO: 617261 - DNA, 13 bp, D. melanogaster
cttttccgctgcc

SEQ ID NO: 617262 - DNA, 13 bp, D. melanogaster
cttttccggctgc

SEQ ID NO: 617263 - DNA, 13 bp, D. melanogaster
cttttcctataaa

SEQ ID NO: 617264 - DNA, 13 bp, D. melanogaster
cttttcctgcgca

SEQ ID NO: 617265 - DNA, 13 bp, D. melanogaster
cttttcctgctgc

SEQ ID NO: 617266 - DNA, 13 bp, D. melanogaster
cttttcctttagt

SEQ ID NO: 617267 - DNA, 14 bp, D. melanogaster
cttttcctttagtg

SEQ ID NO: 617268 - DNA, 13 bp, D. melanogaster
cttttcgaaaaaa

SEQ ID NO: 617269 - DNA, 13 bp, D. melanogaster
cttttcgatagta

SEQ ID NO: 617270 - DNA, 13 bp, D. melanogaster
cttttcgcatggg

SEQ ID NO: 617271 - DNA, 13 bp, D. melanogaster
cttttcgccattt

SEQ ID NO: 617272 - DNA, 13 bp, D. melanogaster
cttttcgccgcct

SEQ ID NO: 617273 - DNA, 14 bp, D. melanogaster
cttttcgctcagtg

SEQ ID NO: 617274 - DNA, 13 bp, D. melanogaster
cttttcgctttgc

SEQ ID NO: 617275 - DNA, 13 bp, D. melanogaster
cttttcggccagc

SEQ ID NO: 617276 - DNA, 13 bp, D. melanogaster
cttttcggccatt

SEQ ID NO: 617277 - DNA, 13 bp, D. melanogaster
cttttcgtcctgc

SEQ ID NO: 617278 - DNA, 13 bp, D. melanogaster
cttttcgtttggc

SEQ ID NO: 617279 - DNA, 13 bp, D. melanogaster
cttttctaaaaat

SEQ ID NO: 617280 - DNA, 13 bp, D. melanogaster
cttttctaaatat

SEQ ID NO: 617281 - DNA, 13 bp, D. melanogaster
cttttctacgcat

SEQ ID NO: 617282 - DNA, 13 bp, D. melanogaster
cttttctcacagt

SEQ ID NO: 617283 - DNA, 13 bp, D. melanogaster
cttttctgccagt

SEQ ID NO: 617284 - DNA, 13 bp, D. melanogaster
cttttctggccaa

SEQ ID NO: 617285 - DNA, 14 bp, D. melanogaster
cttttcttaaaaaa

SEQ ID NO: 617286 - DNA, 13 bp, D. melanogaster
cttttgaaaaata

SEQ ID NO: 617287 - DNA, 14 bp, D. melanogaster
cttttgaaaaataa

SEQ ID NO: 617288 - DNA, 13 bp, D. melanogaster
cttttgaaaactt

SEQ ID NO: 617289 - DNA, 13 bp, D. melanogaster
cttttgaaaagtt

SEQ ID NO: 617290 - DNA, 13 bp, D. melanogaster
cttttgaaaatat

SEQ ID NO: 617291 - DNA, 14 bp, D. melanogaster
cttttgaaaatata

SEQ ID NO: 617292 - DNA, 14 bp, D. melanogaster
cttttgaaacattt

SEQ ID NO: 617293 - DNA, 14 bp, D. melanogaster
cttttgaaatatat

SEQ ID NO: 617294 - DNA, 13 bp, D. melanogaster
cttttgaataata

SEQ ID NO: 617295 - DNA, 13 bp, D. melanogaster
cttttgaatattt

SEQ ID NO: 617296 - DNA, 13 bp, D. melanogaster
cttttgacaattt

SEQ ID NO: 617297 - DNA, 14 bp, D. melanogaster
cttttgagatattc

SEQ ID NO: 617298 - DNA, 13 bp, D. melanogaster
cttttgataaact

SEQ ID NO: 617299 - DNA, 13 bp, D. melanogaster
cttttgatacctt

SEQ ID NO: 617300 - DNA, 13 bp, D. melanogaster
cttttgattgaca

SEQ ID NO: 617301 - DNA, 13 bp, D. melanogaster
cttttgattgcca

SEQ ID NO: 617302 - DNA, 13 bp, D. melanogaster
cttttgatttatg

SEQ ID NO: 617303 - DNA, 14 bp, D. melanogaster
cttttgatttatgc

SEQ ID NO: 617304 - DNA, 13 bp, D. melanogaster
cttttgatttgat

SEQ ID NO: 617305 - DNA, 13 bp, D. melanogaster
cttttgcaaaagt

SEQ ID NO: 617306 - DNA, 13 bp, D. melanogaster
cttttgcaaaatt

SEQ ID NO: 617307 - DNA, 14 bp, D. melanogaster
cttttgcaataaac

SEQ ID NO: 617308 - DNA, 13 bp, D. melanogaster
cttttgcaattag

SEQ ID NO: 617309 - DNA, 13 bp, D. melanogaster
cttttgcactttt

SEQ ID NO: 617310 - DNA, 13 bp, D. melanogaster
cttttgcataagt

SEQ ID NO: 617311 - DNA, 13 bp, D. melanogaster
cttttgcatattt

SEQ ID NO: 617312 - DNA, 13 bp, D. melanogaster
cttttgccaactt

SEQ ID NO: 617313 - DNA, 13 bp, D. melanogaster
cttttgccagcaa

SEQ ID NO: 617314 - DNA, 13 bp, D. melanogaster
cttttgccagcca

SEQ ID NO: 617315 - DNA, 13 bp, D. melanogaster
cttttgccgcatt

SEQ ID NO: 617316 - DNA, 13 bp, D. melanogaster
cttttgcctttcg

SEQ ID NO: 617317 - DNA, 14 bp, D. melanogaster
cttttgcctttgcc

SEQ ID NO: 617318 - DNA, 14 bp, D. melanogaster
cttttgcgactgtt

SEQ ID NO: 617319 - DNA, 13 bp, D. melanogaster
cttttgcgcattt

SEQ ID NO: 617320 - DNA, 14 bp, D. melanogaster
cttttgcgctcggc

SEQ ID NO: 617321 - DNA, 13 bp, D. melanogaster
cttttgctaattt

SEQ ID NO: 617322 - DNA, 13 bp, D. melanogaster
cttttgctcattt

SEQ ID NO: 617323 - DNA, 13 bp, D. melanogaster
cttttgctgaaat

SEQ ID NO: 617324 - DNA, 13 bp, D. melanogaster
cttttgctgcact

SEQ ID NO: 617325 - DNA, 13 bp, D. melanogaster
cttttgctgccca

SEQ ID NO: 617326 - DNA, 13 bp, D. melanogaster
cttttgctgctgc

SEQ ID NO: 617327 - DNA, 14 bp, D. melanogaster
cttttgctgctgct

SEQ ID NO: 617328 - DNA, 13 bp, D. melanogaster
cttttgctgcttc

SEQ ID NO: 617329 - DNA, 13 bp, D. melanogaster
cttttgctggcca

SEQ ID NO: 617330 - DNA, 13 bp, D. melanogaster
cttttgctgtgct

SEQ ID NO: 617331 - DNA, 13 bp, D. melanogaster
cttttgcttctgc

SEQ ID NO: 617332 - DNA, 13 bp, D. melanogaster
cttttgcttttac

SEQ ID NO: 617333 - DNA, 13 bp, D. melanogaster
cttttggaaaata

SEQ ID NO: 617334 - DNA, 13 bp, D. melanogaster
cttttggaaatat

SEQ ID NO: 617335 - DNA, 13 bp, D. melanogaster
cttttggaatttt

SEQ ID NO: 617336 - DNA, 13 bp, D. melanogaster
cttttggatattt

SEQ ID NO: 617337 - DNA, 13 bp, D. melanogaster
cttttggcaaaaa

SEQ ID NO: 617338 - DNA, 13 bp, D. melanogaster
cttttggcacttg

SEQ ID NO: 617339 - DNA, 13 bp, D. melanogaster
cttttggcagcca

SEQ ID NO: 617340 - DNA, 13 bp, D. melanogaster
cttttggcatttt

SEQ ID NO: 617341 - DNA, 14 bp, D. melanogaster
cttttggccaaaaa

SEQ ID NO: 617342 - DNA, 13 bp, D. melanogaster
cttttggccaaat

SEQ ID NO: 617343 - DNA, 14 bp, D. melanogaster
cttttggccaacaa

SEQ ID NO: 617344 - DNA, 14 bp, D. melanogaster
cttttggccaactt

SEQ ID NO: 617345 - DNA, 14 bp, D. melanogaster
cttttggccaagaa

SEQ ID NO: 617346 - DNA, 14 bp, D. melanogaster
cttttggccaagtc

SEQ ID NO: 617347 - DNA, 13 bp, D. melanogaster
cttttggccaatt

SEQ ID NO: 617348 - DNA, 13 bp, D. melanogaster
cttttggccacat

SEQ ID NO: 617349 - DNA, 13 bp, D. melanogaster
cttttggccagca

SEQ ID NO: 617350 - DNA, 13 bp, D. melanogaster
cttttggccagcg

SEQ ID NO: 617351 - DNA, 13 bp, D. melanogaster
cttttggccagga

SEQ ID NO: 617352 - DNA, 13 bp, D. melanogaster
cttttggccattt

SEQ ID NO: 617353 - DNA, 14 bp, D. melanogaster
cttttggccatttc

SEQ ID NO: 617354 - DNA, 14 bp, D. melanogaster
cttttggccatttt

SEQ ID NO: 617355 - DNA, 13 bp, D. melanogaster
cttttggcccaca

SEQ ID NO: 617356 - DNA, 13 bp, D. melanogaster
cttttggcccatt

SEQ ID NO: 617357 - DNA, 13 bp, D. melanogaster
cttttggcccggc

SEQ ID NO: 617358 - DNA, 13 bp, D. melanogaster
cttttggccgcct

SEQ ID NO: 617359 - DNA, 13 bp, D. melanogaster
cttttggcctttg

SEQ ID NO: 617360 - DNA, 13 bp, D. melanogaster
cttttggctgcca

SEQ ID NO: 617361 - DNA, 13 bp, D. melanogaster
cttttggctggtt

SEQ ID NO: 617362 - DNA, 13 bp, D. melanogaster
cttttggcttctg

SEQ ID NO: 617363 - DNA, 13 bp, D. melanogaster
cttttggctttaa

SEQ ID NO: 617364 - DNA, 14 bp, D. melanogaster
cttttggctttggc

SEQ ID NO: 617365 - DNA, 13 bp, D. melanogaster
cttttgggcattt

SEQ ID NO: 617366 - DNA, 13 bp, D. melanogaster
cttttgggccact

SEQ ID NO: 617367 - DNA, 13 bp, D. melanogaster
cttttggttttca

SEQ ID NO: 617368 - DNA, 13 bp, D. melanogaster
cttttgtaaaata

SEQ ID NO: 617369 - DNA, 14 bp, D. melanogaster
cttttgtaaatgaa

SEQ ID NO: 617370 - DNA, 13 bp, D. melanogaster
cttttgtaatgaa

SEQ ID NO: 617371 - DNA, 13 bp, D. melanogaster
cttttgtacattt

SEQ ID NO: 617372 - DNA, 13 bp, D. melanogaster
cttttgtacctca

SEQ ID NO: 617373 - DNA, 13 bp, D. melanogaster
cttttgtagaata

SEQ ID NO: 617374 - DNA, 13 bp, D. melanogaster
cttttgtcggaat

SEQ ID NO: 617375 - DNA, 13 bp, D. melanogaster
cttttgtctgact

SEQ ID NO: 617376 - DNA, 14 bp, D. melanogaster
cttttgtgaaactg

SEQ ID NO: 617377 - DNA, 13 bp, D. melanogaster
cttttgtgaagac

SEQ ID NO: 617378 - DNA, 13 bp, D. melanogaster
cttttgtgcaaaa

SEQ ID NO: 617379 - DNA, 13 bp, D. melanogaster
cttttgtgccaaa

SEQ ID NO: 617380 - DNA, 13 bp, D. melanogaster
cttttgtgccact

SEQ ID NO: 617381 - DNA, 14 bp, D. melanogaster
cttttgtggcattt

SEQ ID NO: 617382 - DNA, 13 bp, D. melanogaster
cttttgtgtggaa

SEQ ID NO: 617383 - DNA, 13 bp, D. melanogaster
cttttgtgtggct

SEQ ID NO: 617384 - DNA, 13 bp, D. melanogaster
cttttgttaagtt

SEQ ID NO: 617385 - DNA, 13 bp, D. melanogaster
cttttgttattaa

SEQ ID NO: 617386 - DNA, 13 bp, D. melanogaster
cttttgttattcg

SEQ ID NO: 617387 - DNA, 13 bp, D. melanogaster
cttttgttgcact

SEQ ID NO: 617388 - DNA, 13 bp, D. melanogaster
cttttgttgcatc

SEQ ID NO: 617389 - DNA, 13 bp, D. melanogaster
cttttgttgcccg

SEQ ID NO: 617390 - DNA, 13 bp, D. melanogaster
cttttgttgctgc

SEQ ID NO: 617391 - DNA, 13 bp, D. melanogaster
cttttgttggcca

SEQ ID NO: 617392 - DNA, 13 bp, D. melanogaster
cttttgtttaatg

SEQ ID NO: 617393 - DNA, 13 bp, D. melanogaster
cttttgtttacat

SEQ ID NO: 617394 - DNA, 13 bp, D. melanogaster
cttttgtttatgc

SEQ ID NO: 617395 - DNA, 13 bp, D. melanogaster
cttttgtttcgcc

SEQ ID NO: 617396 - DNA, 13 bp, D. melanogaster
cttttgtttgcgc

SEQ ID NO: 617397 - DNA, 13 bp, D. melanogaster
cttttgtttggcc

SEQ ID NO: 617398 - DNA, 13 bp, D. melanogaster
cttttgtttgggc

SEQ ID NO: 617399 - DNA, 13 bp, D. melanogaster
cttttgttttgca

SEQ ID NO: 617400 - DNA, 13 bp, D. melanogaster
ctttttaaaaaca

SEQ ID NO: 617401 - DNA, 13 bp, D. melanogaster
ctttttaaaaatc

SEQ ID NO: 617402 - DNA, 13 bp, D. melanogaster
ctttttaaaacaa

SEQ ID NO: 617403 - DNA, 14 bp, D. melanogaster
ctttttaaagaaaa

SEQ ID NO: 617404 - DNA, 13 bp, D. melanogaster
ctttttaaatact

SEQ ID NO: 617405 - DNA, 13 bp, D. melanogaster
ctttttaaatttg

SEQ ID NO: 617406 - DNA, 14 bp, D. melanogaster
ctttttaacgaatc

SEQ ID NO: 617407 - DNA, 13 bp, D. melanogaster
ctttttaagtatt

SEQ ID NO: 617408 - DNA, 13 bp, D. melanogaster
ctttttaatgtcg

SEQ ID NO: 617409 - DNA, 14 bp, D. melanogaster
ctttttaattagtt

SEQ ID NO: 617410 - DNA, 13 bp, D. melanogaster
ctttttacaataa

SEQ ID NO: 617411 - DNA, 13 bp, D. melanogaster
ctttttataaaac

SEQ ID NO: 617412 - DNA, 14 bp, D. melanogaster
ctttttataaaacc

SEQ ID NO: 617413 - DNA, 13 bp, D. melanogaster
ctttttataaatg

SEQ ID NO: 617414 - DNA, 14 bp, D. melanogaster
ctttttatacccgt

SEQ ID NO: 617415 - DNA, 13 bp, D. melanogaster
ctttttatatgat

SEQ ID NO: 617416 - DNA, 13 bp, D. melanogaster
ctttttatggatt

SEQ ID NO: 617417 - DNA, 13 bp, D. melanogaster
ctttttattgaaa

SEQ ID NO: 617418 - DNA, 14 bp, D. melanogaster
ctttttattttcgc

SEQ ID NO: 617419 - DNA, 14 bp, D. melanogaster
ctttttcaacgaat

SEQ ID NO: 617420 - DNA, 13 bp, D. melanogaster
ctttttcacaatt

SEQ ID NO: 617421 - DNA, 14 bp, D. melanogaster
ctttttcagctttt

SEQ ID NO: 617422 - DNA, 13 bp, D. melanogaster
ctttttccgctgc

SEQ ID NO: 617423 - DNA, 13 bp, D. melanogaster
ctttttcctgctg

SEQ ID NO: 617424 - DNA, 13 bp, D. melanogaster
ctttttcgacttt

SEQ ID NO: 617425 - DNA, 13 bp, D. melanogaster
ctttttcgagtgt

SEQ ID NO: 617426 - DNA, 13 bp, D. melanogaster
ctttttctggcca

SEQ ID NO: 617427 - DNA, 13 bp, D. melanogaster
ctttttcttggcc

SEQ ID NO: 617428 - DNA, 13 bp, D. melanogaster
ctttttgaaaaat

SEQ ID NO: 617429 - DNA, 14 bp, D. melanogaster
ctttttgaaaatgt

SEQ ID NO: 617430 - DNA, 13 bp, D. melanogaster
ctttttgaaataa

SEQ ID NO: 617431 - DNA, 13 bp, D. melanogaster
ctttttgaaattt

SEQ ID NO: 617432 - DNA, 13 bp, D. melanogaster
ctttttgaaggat

SEQ ID NO: 617433 - DNA, 13 bp, D. melanogaster
ctttttgaatgat

SEQ ID NO: 617434 - DNA, 13 bp, D. melanogaster
ctttttgacattc

SEQ ID NO: 617435 - DNA, 13 bp, D. melanogaster
ctttttgattaaa

SEQ ID NO: 617436 - DNA, 13 bp, D. melanogaster
ctttttgcaaaca

SEQ ID NO: 617437 - DNA, 13 bp, D. melanogaster
ctttttgcacttt

SEQ ID NO: 617438 - DNA, 13 bp, D. melanogaster
ctttttgcagctc

SEQ ID NO: 617439 - DNA, 13 bp, D. melanogaster
ctttttgcatatt

SEQ ID NO: 617440 - DNA, 13 bp, D. melanogaster
ctttttgccaccc

SEQ ID NO: 617441 - DNA, 14 bp, D. melanogaster
ctttttgccacgcc

SEQ ID NO: 617442 - DNA, 13 bp, D. melanogaster
ctttttgccagcc

SEQ ID NO: 617443 - DNA, 13 bp, D. melanogaster
ctttttgccattt

SEQ ID NO: 617444 - DNA, 13 bp, D. melanogaster
ctttttgcccact

SEQ ID NO: 617445 - DNA, 13 bp, D. melanogaster
ctttttgccgtca

SEQ ID NO: 617446 - DNA, 13 bp, D. melanogaster
ctttttgcggctt

SEQ ID NO: 617447 - DNA, 14 bp, D. melanogaster
ctttttggaaaatt

SEQ ID NO: 617448 - DNA, 13 bp, D. melanogaster
ctttttggcagca

SEQ ID NO: 617449 - DNA, 13 bp, D. melanogaster
ctttttggcagct

SEQ ID NO: 617450 - DNA, 13 bp, D. melanogaster
ctttttggcatta

SEQ ID NO: 617451 - DNA, 13 bp, D. melanogaster
ctttttggccaac

SEQ ID NO: 617452 - DNA, 13 bp, D. melanogaster
ctttttggccaag

SEQ ID NO: 617453 - DNA, 13 bp, D. melanogaster
ctttttggccacg

SEQ ID NO: 617454 - DNA, 14 bp, D. melanogaster
ctttttggccagct

SEQ ID NO: 617455 - DNA, 13 bp, D. melanogaster
ctttttggccagg

SEQ ID NO: 617456 - DNA, 13 bp, D. melanogaster
ctttttggcccgg

SEQ ID NO: 617457 - DNA, 13 bp, D. melanogaster
ctttttggctaaa

SEQ ID NO: 617458 - DNA, 13 bp, D. melanogaster
ctttttggctcaa

SEQ ID NO: 617459 - DNA, 13 bp, D. melanogaster
ctttttggcttaa

SEQ ID NO: 617460 - DNA, 13 bp, D. melanogaster
ctttttggggcaa

SEQ ID NO: 617461 - DNA, 13 bp, D. melanogaster
ctttttggggctt

SEQ ID NO: 617462 - DNA, 13 bp, D. melanogaster
ctttttgggggca

SEQ ID NO: 617463 - DNA, 13 bp, D. melanogaster
ctttttgtaaaaa

SEQ ID NO: 617464 - DNA, 13 bp, D. melanogaster
ctttttgtaagcg

SEQ ID NO: 617465 - DNA, 13 bp, D. melanogaster
ctttttgtaattg

SEQ ID NO: 617466 - DNA, 14 bp, D. melanogaster
ctttttgtacattt

SEQ ID NO: 617467 - DNA, 13 bp, D. melanogaster
ctttttgtccact

SEQ ID NO: 617468 - DNA, 13 bp, D. melanogaster
ctttttgtggccc

SEQ ID NO: 617469 - DNA, 13 bp, D. melanogaster
ctttttgttggcc

SEQ ID NO: 617470 - DNA, 13 bp, D. melanogaster
cttttttaaaatg

SEQ ID NO: 617471 - DNA, 13 bp, D. melanogaster
cttttttaagtgg

SEQ ID NO: 617472 - DNA, 13 bp, D. melanogaster
cttttttaccact

SEQ ID NO: 617473 - DNA, 13 bp, D. melanogaster
cttttttatatgc

SEQ ID NO: 617474 - DNA, 13 bp, D. melanogaster
cttttttatgggc

SEQ ID NO: 617475 - DNA, 13 bp, D. melanogaster
cttttttcagctt

SEQ ID NO: 617476 - DNA, 13 bp, D. melanogaster
cttttttccacac

SEQ ID NO: 617477 - DNA, 13 bp, D. melanogaster
cttttttccagtg

SEQ ID NO: 617478 - DNA, 13 bp, D. melanogaster
cttttttcttgca

SEQ ID NO: 617479 - DNA, 13 bp, D. melanogaster
cttttttgacatt

SEQ ID NO: 617480 - DNA, 13 bp, D. melanogaster
cttttttgcactt

SEQ ID NO: 617481 - DNA, 13 bp, D. melanogaster
cttttttgctggc

SEQ ID NO: 617482 - DNA, 14 bp, D. melanogaster
cttttttggccaag

SEQ ID NO: 617483 - DNA, 13 bp, D. melanogaster
cttttttggccag

SEQ ID NO: 617484 - DNA, 13 bp, D. melanogaster
ctttttttcagtg

SEQ ID NO: 617485 - DNA, 13 bp, D. melanogaster
ctttttttcgcat

SEQ ID NO: 617486 - DNA, 13 bp, D. melanogaster
ctttttttgtgga

SEQ ID NO: 617487 - DNA, 13 bp, D. melanogaster
cttttttttagca

SEQ ID NO: 617488 - DNA, 14 bp, D. melanogaster
ctttttttttgcaa

SEQ ID NO: 617489 - DNA, 13 bp, D. melanogaster
gaaaaaaaacttt

SEQ ID NO: 617490 - DNA, 13 bp, D. melanogaster
gaaaaaaacatcg

SEQ ID NO: 617491 - DNA, 13 bp, D. melanogaster
gaaaaaaaggctt

SEQ ID NO: 617492 - DNA, 13 bp, D. melanogaster
gaaaaaaatctat

SEQ ID NO: 617493 - DNA, 13 bp, D. melanogaster
gaaaaaaatgcga

SEQ ID NO: 617494 - DNA, 13 bp, D. melanogaster
gaaaaaacaccgg

SEQ ID NO: 617495 - DNA, 13 bp, D. melanogaster
gaaaaaacgaggt

SEQ ID NO: 617496 - DNA, 13 bp, D. melanogaster
gaaaaaacggtag

SEQ ID NO: 617497 - DNA, 13 bp, D. melanogaster
gaaaaaacggtgg

SEQ ID NO: 617498 - DNA, 13 bp, D. melanogaster
gaaaaaactgaag

SEQ ID NO: 617499 - DNA, 13 bp, D. melanogaster
gaaaaaactgcaa

SEQ ID NO: 617500 - DNA, 13 bp, D. melanogaster
gaaaaaacttggc

SEQ ID NO: 617501 - DNA, 13 bp, D. melanogaster
gaaaaaactttta

SEQ ID NO: 617502 - DNA, 13 bp, D. melanogaster
gaaaaaacttttc

SEQ ID NO: 617503 - DNA, 13 bp, D. melanogaster
gaaaaaagacatt

SEQ ID NO: 617504 - DNA, 14 bp, D. melanogaster
gaaaaaagcgaaat

SEQ ID NO: 617505 - DNA, 13 bp, D. melanogaster
gaaaaaagcgatc

SEQ ID NO: 617506 - DNA, 13 bp, D. melanogaster
gaaaaaagggttg

SEQ ID NO: 617507 - DNA, 13 bp, D. melanogaster
gaaaaaagtgctg

SEQ ID NO: 617508 - DNA, 13 bp, D. melanogaster
gaaaaaagtgggc

SEQ ID NO: 617509 - DNA, 14 bp, D. melanogaster
gaaaaaagttctta

SEQ ID NO: 617510 - DNA, 13 bp, D. melanogaster
gaaaaaagtttcg

SEQ ID NO: 617511 - DNA, 13 bp, D. melanogaster
gaaaaaagttttt

SEQ ID NO: 617512 - DNA, 13 bp, D. melanogaster
gaaaaaatatcga

SEQ ID NO: 617513 - DNA, 13 bp, D. melanogaster
gaaaaaatattct

SEQ ID NO: 617514 - DNA, 13 bp, D. melanogaster
gaaaaaatattgt

SEQ ID NO: 617515 - DNA, 13 bp, D. melanogaster
gaaaaaatcatat

SEQ ID NO: 617516 - DNA, 13 bp, D. melanogaster
gaaaaaatccatt

SEQ ID NO: 617517 - DNA, 13 bp, D. melanogaster
gaaaaaatcgatt

SEQ ID NO: 617518 - DNA, 14 bp, D. melanogaster
gaaaaaatcggaaa

SEQ ID NO: 617519 - DNA, 13 bp, D. melanogaster
gaaaaaatcttta

SEQ ID NO: 617520 - DNA, 14 bp, D. melanogaster
gaaaaaatgcaaat

SEQ ID NO: 617521 - DNA, 13 bp, D. melanogaster
gaaaaaatgcaag

SEQ ID NO: 617522 - DNA, 13 bp, D. melanogaster
gaaaaaatgcata

SEQ ID NO: 617523 - DNA, 13 bp, D. melanogaster
gaaaaaatggcaa

SEQ ID NO: 617524 - DNA, 13 bp, D. melanogaster
gaaaaaatggcca

SEQ ID NO: 617525 - DNA, 14 bp, D. melanogaster
gaaaaaatgggatt

SEQ ID NO: 617526 - DNA, 13 bp, D. melanogaster
gaaaaaattcaag

SEQ ID NO: 617527 - DNA, 13 bp, D. melanogaster
gaaaaaattcgaa

SEQ ID NO: 617528 - DNA, 13 bp, D. melanogaster
gaaaaaattgtat

SEQ ID NO: 617529 - DNA, 14 bp, D. melanogaster
gaaaaaattgtgga

SEQ ID NO: 617530 - DNA, 13 bp, D. melanogaster
gaaaaaattttac

SEQ ID NO: 617531 - DNA, 13 bp, D. melanogaster
gaaaaacaaactc

SEQ ID NO: 617532 - DNA, 13 bp, D. melanogaster
gaaaaacaaactg

SEQ ID NO: 617533 - DNA, 13 bp, D. melanogaster
gaaaaacaaagtg

SEQ ID NO: 617534 - DNA, 13 bp, D. melanogaster
gaaaaacaacatt

SEQ ID NO: 617535 - DNA, 13 bp, D. melanogaster
gaaaaacaactga

SEQ ID NO: 617536 - DNA, 13 bp, D. melanogaster
gaaaaacaagatt

SEQ ID NO: 617537 - DNA, 13 bp, D. melanogaster
gaaaaacaatatt

SEQ ID NO: 617538 - DNA, 13 bp, D. melanogaster
gaaaaacaattgt

SEQ ID NO: 617539 - DNA, 14 bp, D. melanogaster
gaaaaacaattgtt

SEQ ID NO: 617540 - DNA, 13 bp, D. melanogaster
gaaaaacaattta

SEQ ID NO: 617541 - DNA, 13 bp, D. melanogaster
gaaaaacaatttt

SEQ ID NO: 617542 - DNA, 13 bp, D. melanogaster
gaaaaacacaatt

SEQ ID NO: 617543 - DNA, 13 bp, D. melanogaster
gaaaaacaccgac

SEQ ID NO: 617544 - DNA, 13 bp, D. melanogaster
gaaaaacagcagc

SEQ ID NO: 617545 - DNA, 13 bp, D. melanogaster
gaaaaacaggtga

SEQ ID NO: 617546 - DNA, 13 bp, D. melanogaster
gaaaaacagtttt

SEQ ID NO: 617547 - DNA, 13 bp, D. melanogaster
gaaaaacataact

SEQ ID NO: 617548 - DNA, 13 bp, D. melanogaster
gaaaaacatatgc

SEQ ID NO: 617549 - DNA, 14 bp, D. melanogaster
gaaaaacatatgct

SEQ ID NO: 617550 - DNA, 13 bp, D. melanogaster
gaaaaacatcgat

SEQ ID NO: 617551 - DNA, 13 bp, D. melanogaster
gaaaaacatggaa

SEQ ID NO: 617552 - DNA, 13 bp, D. melanogaster
gaaaaacattaag

SEQ ID NO: 617553 - DNA, 13 bp, D. melanogaster
gaaaaacattgaa

SEQ ID NO: 617554 - DNA, 13 bp, D. melanogaster
gaaaaacatttgc

SEQ ID NO: 617555 - DNA, 13 bp, D. melanogaster
gaaaaacatttgt

SEQ ID NO: 617556 - DNA, 13 bp, D. melanogaster
gaaaaaccagaat

SEQ ID NO: 617557 - DNA, 13 bp, D. melanogaster
gaaaaaccagttt

SEQ ID NO: 617558 - DNA, 13 bp, D. melanogaster
gaaaaaccccttt

SEQ ID NO: 617559 - DNA, 13 bp, D. melanogaster
gaaaaacgaagtg

SEQ ID NO: 617560 - DNA, 13 bp, D. melanogaster
gaaaaacgtggaa

SEQ ID NO: 617561 - DNA, 13 bp, D. melanogaster
gaaaaactaaact

SEQ ID NO: 617562 - DNA, 13 bp, D. melanogaster
gaaaaactaggcc

SEQ ID NO: 617563 - DNA, 13 bp, D. melanogaster
gaaaaactattta

SEQ ID NO: 617564 - DNA, 13 bp, D. melanogaster
gaaaaactatttg

SEQ ID NO: 617565 - DNA, 13 bp, D. melanogaster
gaaaaactcgaaa

SEQ ID NO: 617566 - DNA, 13 bp, D. melanogaster
gaaaaactgacaa

SEQ ID NO: 617567 - DNA, 13 bp, D. melanogaster
gaaaaactgcaag

SEQ ID NO: 617568 - DNA, 13 bp, D. melanogaster
gaaaaactgcaga

SEQ ID NO: 617569 - DNA, 13 bp, D. melanogaster
gaaaaactggaaa

SEQ ID NO: 617570 - DNA, 14 bp, D. melanogaster
gaaaaactggaaaa

SEQ ID NO: 617571 - DNA, 13 bp, D. melanogaster
gaaaaactgggaa

SEQ ID NO: 617572 - DNA, 13 bp, D. melanogaster
gaaaaactgtttt

SEQ ID NO: 617573 - DNA, 13 bp, D. melanogaster
gaaaaacttaaat

SEQ ID NO: 617574 - DNA, 13 bp, D. melanogaster
gaaaaacttaagg

SEQ ID NO: 617575 - DNA, 14 bp, D. melanogaster
gaaaaacttatacg

SEQ ID NO: 617576 - DNA, 13 bp, D. melanogaster
gaaaaacttcaaa

SEQ ID NO: 617577 - DNA, 13 bp, D. melanogaster
gaaaaacttcacc

SEQ ID NO: 617578 - DNA, 14 bp, D. melanogaster
gaaaaacttcacca

SEQ ID NO: 617579 - DNA, 13 bp, D. melanogaster
gaaaaacttgaaa

SEQ ID NO: 617580 - DNA, 13 bp, D. melanogaster
gaaaaacttgcaa

SEQ ID NO: 617581 - DNA, 13 bp, D. melanogaster
gaaaaactttata

SEQ ID NO: 617582 - DNA, 13 bp, D. melanogaster
gaaaaactttatc

SEQ ID NO: 617583 - DNA, 13 bp, D. melanogaster
gaaaaacttttac

SEQ ID NO: 617584 - DNA, 13 bp, D. melanogaster
gaaaaacttttcc

SEQ ID NO: 617585 - DNA, 14 bp, D. melanogaster
gaaaaacttttcca

SEQ ID NO: 617586 - DNA, 13 bp, D. melanogaster
gaaaaacttttcg

SEQ ID NO: 617587 - DNA, 13 bp, D. melanogaster
gaaaaacttttgc

SEQ ID NO: 617588 - DNA, 13 bp, D. melanogaster
gaaaaagaaactt

SEQ ID NO: 617589 - DNA, 13 bp, D. melanogaster
gaaaaagaagcta

SEQ ID NO: 617590 - DNA, 13 bp, D. melanogaster
gaaaaagattttt

SEQ ID NO: 617591 - DNA, 13 bp, D. melanogaster
gaaaaagcaatta

SEQ ID NO: 617592 - DNA, 13 bp, D. melanogaster
gaaaaagcagcca

SEQ ID NO: 617593 - DNA, 13 bp, D. melanogaster
gaaaaagcatttt

SEQ ID NO: 617594 - DNA, 13 bp, D. melanogaster
gaaaaagctgaaa

SEQ ID NO: 617595 - DNA, 13 bp, D. melanogaster
gaaaaagctggaa

SEQ ID NO: 617596 - DNA, 14 bp, D. melanogaster
gaaaaaggaaattc

SEQ ID NO: 617597 - DNA, 13 bp, D. melanogaster
gaaaaaggcattt

SEQ ID NO: 617598 - DNA, 14 bp, D. melanogaster
gaaaaagtacaaca

SEQ ID NO: 617599 - DNA, 13 bp, D. melanogaster
gaaaaagtacatt

SEQ ID NO: 617600 - DNA, 13 bp, D. melanogaster
gaaaaagtattta

SEQ ID NO: 617601 - DNA, 13 bp, D. melanogaster
gaaaaagtgctta

SEQ ID NO: 617602 - DNA, 13 bp, D. melanogaster
gaaaaagtggcaa

SEQ ID NO: 617603 - DNA, 13 bp, D. melanogaster
gaaaaagtgggtg

SEQ ID NO: 617604 - DNA, 13 bp, D. melanogaster
gaaaaagttaagc

SEQ ID NO: 617605 - DNA, 13 bp, D. melanogaster
gaaaaagttaatt

SEQ ID NO: 617606 - DNA, 13 bp, D. melanogaster
gaaaaagttgtaa

SEQ ID NO: 617607 - DNA, 13 bp, D. melanogaster
gaaaaagtttcgc

SEQ ID NO: 617608 - DNA, 13 bp, D. melanogaster
gaaaaagtttggc

SEQ ID NO: 617609 - DNA, 14 bp, D. melanogaster
gaaaaagtttttaa

SEQ ID NO: 617610 - DNA, 13 bp, D. melanogaster
gaaaaagtttttt

SEQ ID NO: 617611 - DNA, 13 bp, D. melanogaster
gaaaaataacatt

SEQ ID NO: 617612 - DNA, 14 bp, D. melanogaster
gaaaaataacgtaa

SEQ ID NO: 617613 - DNA, 13 bp, D. melanogaster
gaaaaataacttt

SEQ ID NO: 617614 - DNA, 13 bp, D. melanogaster
gaaaaataagcgt

SEQ ID NO: 617615 - DNA, 14 bp, D. melanogaster
gaaaaataagcgtc

SEQ ID NO: 617616 - DNA, 13 bp, D. melanogaster
gaaaaataattca

SEQ ID NO: 617617 - DNA, 13 bp, D. melanogaster
gaaaaatacaatt

SEQ ID NO: 617618 - DNA, 13 bp, D. melanogaster
gaaaaatacatta

SEQ ID NO: 617619 - DNA, 13 bp, D. melanogaster
gaaaaatactttt

SEQ ID NO: 617620 - DNA, 13 bp, D. melanogaster
gaaaaatagtttg

SEQ ID NO: 617621 - DNA, 13 bp, D. melanogaster
gaaaaatatatct

SEQ ID NO: 617622 - DNA, 13 bp, D. melanogaster
gaaaaatatcata

SEQ ID NO: 617623 - DNA, 13 bp, D. melanogaster
gaaaaatatgcaa

SEQ ID NO: 617624 - DNA, 13 bp, D. melanogaster
gaaaaatattgtt

SEQ ID NO: 617625 - DNA, 13 bp, D. melanogaster
gaaaaatatttac

SEQ ID NO: 617626 - DNA, 13 bp, D. melanogaster
gaaaaatatttga

SEQ ID NO: 617627 - DNA, 13 bp, D. melanogaster
gaaaaatattttc

SEQ ID NO: 617628 - DNA, 13 bp, D. melanogaster
gaaaaatcaactg

SEQ ID NO: 617629 - DNA, 13 bp, D. melanogaster
gaaaaatcaatgc

SEQ ID NO: 617630 - DNA, 13 bp, D. melanogaster
gaaaaatcaatta

SEQ ID NO: 617631 - DNA, 13 bp, D. melanogaster
gaaaaatcatata

SEQ ID NO: 617632 - DNA, 13 bp, D. melanogaster
gaaaaatccaagt

SEQ ID NO: 617633 - DNA, 13 bp, D. melanogaster
gaaaaatccatta

SEQ ID NO: 617634 - DNA, 13 bp, D. melanogaster
gaaaaatcccaga

SEQ ID NO: 617635 - DNA, 13 bp, D. melanogaster
gaaaaatcgaatt

SEQ ID NO: 617636 - DNA, 13 bp, D. melanogaster
gaaaaatcgagca

SEQ ID NO: 617637 - DNA, 13 bp, D. melanogaster
gaaaaatcgatta

SEQ ID NO: 617638 - DNA, 13 bp, D. melanogaster
gaaaaatcgcaaa

SEQ ID NO: 617639 - DNA, 13 bp, D. melanogaster
gaaaaatcgcatt

SEQ ID NO: 617640 - DNA, 13 bp, D. melanogaster
gaaaaatcgtaaa

SEQ ID NO: 617641 - DNA, 13 bp, D. melanogaster
gaaaaatcgtttt

SEQ ID NO: 617642 - DNA, 14 bp, D. melanogaster
gaaaaatctaattt

SEQ ID NO: 617643 - DNA, 13 bp, D. melanogaster
gaaaaatctgagt

SEQ ID NO: 617644 - DNA, 13 bp, D. melanogaster
gaaaaatctttga

SEQ ID NO: 617645 - DNA, 13 bp, D. melanogaster
gaaaaatgaaact

SEQ ID NO: 617646 - DNA, 13 bp, D. melanogaster
gaaaaatgaagtt

SEQ ID NO: 617647 - DNA, 13 bp, D. melanogaster
gaaaaatgcaaac

SEQ ID NO: 617648 - DNA, 14 bp, D. melanogaster
gaaaaatgcaccca

SEQ ID NO: 617649 - DNA, 13 bp, D. melanogaster
gaaaaatgcaccg

SEQ ID NO: 617650 - DNA, 13 bp, D. melanogaster
gaaaaatgcataa

SEQ ID NO: 617651 - DNA, 13 bp, D. melanogaster
gaaaaatgcattt

SEQ ID NO: 617652 - DNA, 14 bp, D. melanogaster
gaaaaatgcatttc

SEQ ID NO: 617653 - DNA, 13 bp, D. melanogaster
gaaaaatgccaaa

SEQ ID NO: 617654 - DNA, 13 bp, D. melanogaster
gaaaaatgcccca

SEQ ID NO: 617655 - DNA, 13 bp, D. melanogaster
gaaaaatgccgag

SEQ ID NO: 617656 - DNA, 13 bp, D. melanogaster
gaaaaatgcgaaa

SEQ ID NO: 617657 - DNA, 13 bp, D. melanogaster
gaaaaatgcgcaa

SEQ ID NO: 617658 - DNA, 13 bp, D. melanogaster
gaaaaatgctcaa

SEQ ID NO: 617659 - DNA, 14 bp, D. melanogaster
gaaaaatgctcaat

SEQ ID NO: 617660 - DNA, 13 bp, D. melanogaster
gaaaaatgctgaa

SEQ ID NO: 617661 - DNA, 13 bp, D. melanogaster
gaaaaatgcttaa

SEQ ID NO: 617662 - DNA, 14 bp, D. melanogaster
gaaaaatggaaatt

SEQ ID NO: 617663 - DNA, 13 bp, D. melanogaster
gaaaaatggacaa

SEQ ID NO: 617664 - DNA, 14 bp, D. melanogaster
gaaaaatggcaaaa

SEQ ID NO: 617665 - DNA, 14 bp, D. melanogaster
gaaaaatgggttaa

SEQ ID NO: 617666 - DNA, 13 bp, D. melanogaster
gaaaaatggtgaa

SEQ ID NO: 617667 - DNA, 13 bp, D. melanogaster
gaaaaatgtactt

SEQ ID NO: 617668 - DNA, 13 bp, D. melanogaster
gaaaaatgtagat

SEQ ID NO: 617669 - DNA, 13 bp, D. melanogaster
gaaaaatgtcctt

SEQ ID NO: 617670 - DNA, 13 bp, D. melanogaster
gaaaaatgtcttt

SEQ ID NO: 617671 - DNA, 13 bp, D. melanogaster
gaaaaatgtgcgg

SEQ ID NO: 617672 - DNA, 13 bp, D. melanogaster
gaaaaatgtggaa

SEQ ID NO: 617673 - DNA, 14 bp, D. melanogaster
gaaaaatgtgtaaa

SEQ ID NO: 617674 - DNA, 13 bp, D. melanogaster
gaaaaatgttcat

SEQ ID NO: 617675 - DNA, 14 bp, D. melanogaster
gaaaaatgttcatt

SEQ ID NO: 617676 - DNA, 13 bp, D. melanogaster
gaaaaatgttgca

SEQ ID NO: 617677 - DNA, 13 bp, D. melanogaster
gaaaaatgtttcc

SEQ ID NO: 617678 - DNA, 14 bp, D. melanogaster
gaaaaatgtttgtt

SEQ ID NO: 617679 - DNA, 13 bp, D. melanogaster
gaaaaatgttttg

SEQ ID NO: 617680 - DNA, 14 bp, D. melanogaster
gaaaaatgttttga

SEQ ID NO: 617681 - DNA, 13 bp, D. melanogaster
gaaaaattacaga

SEQ ID NO: 617682 - DNA, 13 bp, D. melanogaster
gaaaaattacata

SEQ ID NO: 617683 - DNA, 13 bp, D. melanogaster
gaaaaattactaa

SEQ ID NO: 617684 - DNA, 13 bp, D. melanogaster
gaaaaattatgat

SEQ ID NO: 617685 - DNA, 14 bp, D. melanogaster
gaaaaattcaaata

SEQ ID NO: 617686 - DNA, 13 bp, D. melanogaster
gaaaaattcacaa

SEQ ID NO: 617687 - DNA, 13 bp, D. melanogaster
gaaaaattcatga

SEQ ID NO: 617688 - DNA, 13 bp, D. melanogaster
gaaaaattccaaa

SEQ ID NO: 617689 - DNA, 13 bp, D. melanogaster
gaaaaattccatt

SEQ ID NO: 617690 - DNA, 13 bp, D. melanogaster
gaaaaattcccaa

SEQ ID NO: 617691 - DNA, 13 bp, D. melanogaster
gaaaaattccgaa

SEQ ID NO: 617692 - DNA, 14 bp, D. melanogaster
gaaaaattcgttga

SEQ ID NO: 617693 - DNA, 13 bp, D. melanogaster
gaaaaattgacaa

SEQ ID NO: 617694 - DNA, 13 bp, D. melanogaster
gaaaaattgccaa

SEQ ID NO: 617695 - DNA, 14 bp, D. melanogaster
gaaaaattgccaaa

SEQ ID NO: 617696 - DNA, 14 bp, D. melanogaster
gaaaaattggcaaa

SEQ ID NO: 617697 - DNA, 13 bp, D. melanogaster
gaaaaattgtaat

SEQ ID NO: 617698 - DNA, 13 bp, D. melanogaster
gaaaaattgtata

SEQ ID NO: 617699 - DNA, 13 bp, D. melanogaster
gaaaaattgtatg

SEQ ID NO: 617700 - DNA, 13 bp, D. melanogaster
gaaaaattgtcaa

SEQ ID NO: 617701 - DNA, 13 bp, D. melanogaster
gaaaaattgttaa

SEQ ID NO: 617702 - DNA, 13 bp, D. melanogaster
gaaaaattgttga

SEQ ID NO: 617703 - DNA, 13 bp, D. melanogaster
gaaaaattgttgt

SEQ ID NO: 617704 - DNA, 13 bp, D. melanogaster
gaaaaatttattg

SEQ ID NO: 617705 - DNA, 14 bp, D. melanogaster
gaaaaatttattgt

SEQ ID NO: 617706 - DNA, 13 bp, D. melanogaster
gaaaaatttgcaa

SEQ ID NO: 617707 - DNA, 13 bp, D. melanogaster
gaaaaatttgcat

SEQ ID NO: 617708 - DNA, 14 bp, D. melanogaster
gaaaaatttgcttt

SEQ ID NO: 617709 - DNA, 14 bp, D. melanogaster
gaaaaatttgtagt

SEQ ID NO: 617710 - DNA, 13 bp, D. melanogaster
gaaaaattttcca

SEQ ID NO: 617711 - DNA, 13 bp, D. melanogaster
gaaaacaaaactt

SEQ ID NO: 617712 - DNA, 13 bp, D. melanogaster
gaaaacaaaagct

SEQ ID NO: 617713 - DNA, 13 bp, D. melanogaster
gaaaacaaaagtg

SEQ ID NO: 617714 - DNA, 13 bp, D. melanogaster
gaaaacaaaatcc

SEQ ID NO: 617715 - DNA, 13 bp, D. melanogaster
gaaaacaaaatgt

SEQ ID NO: 617716 - DNA, 13 bp, D. melanogaster
gaaaacaaagcct

SEQ ID NO: 617717 - DNA, 14 bp, D. melanogaster
gaaaacaaagcctc

SEQ ID NO: 617718 - DNA, 13 bp, D. melanogaster
gaaaacaaagttc

SEQ ID NO: 617719 - DNA, 14 bp, D. melanogaster
gaaaacaaatatat

SEQ ID NO: 617720 - DNA, 14 bp, D. melanogaster
gaaaacaaatattt

SEQ ID NO: 617721 - DNA, 13 bp, D. melanogaster
gaaaacaaatgtt

SEQ ID NO: 617722 - DNA, 13 bp, D. melanogaster
gaaaacaaattca

SEQ ID NO: 617723 - DNA, 13 bp, D. melanogaster
gaaaacaaattgc

SEQ ID NO: 617724 - DNA, 13 bp, D. melanogaster
gaaaacaaattgt

SEQ ID NO: 617725 - DNA, 13 bp, D. melanogaster
gaaaacaaattta

SEQ ID NO: 617726 - DNA, 13 bp, D. melanogaster
gaaaacaaatttt

SEQ ID NO: 617727 - DNA, 13 bp, D. melanogaster
gaaaacaacttaa

SEQ ID NO: 617728 - DNA, 13 bp, D. melanogaster
gaaaacaagcaat

SEQ ID NO: 617729 - DNA, 14 bp, D. melanogaster
gaaaacaagcctcc

SEQ ID NO: 617730 - DNA, 13 bp, D. melanogaster
gaaaacaagctag

SEQ ID NO: 617731 - DNA, 14 bp, D. melanogaster
gaaaacaaggagta

SEQ ID NO: 617732 - DNA, 13 bp, D. melanogaster
gaaaacaagttaa

SEQ ID NO: 617733 - DNA, 13 bp, D. melanogaster
gaaaacaagtttt

SEQ ID NO: 617734 - DNA, 14 bp, D. melanogaster
gaaaacaataaatt

SEQ ID NO: 617735 - DNA, 13 bp, D. melanogaster
gaaaacaatgaat

SEQ ID NO: 617736 - DNA, 13 bp, D. melanogaster
gaaaacaatgcaa

SEQ ID NO: 617737 - DNA, 13 bp, D. melanogaster
gaaaacaatgcca

SEQ ID NO: 617738 - DNA, 13 bp, D. melanogaster
gaaaacaatgtaa

SEQ ID NO: 617739 - DNA, 13 bp, D. melanogaster
gaaaacaattaac

SEQ ID NO: 617740 - DNA, 14 bp, D. melanogaster
gaaaacaattattt

SEQ ID NO: 617741 - DNA, 13 bp, D. melanogaster
gaaaacaattgaa

SEQ ID NO: 617742 - DNA, 13 bp, D. melanogaster
gaaaacaattgca

SEQ ID NO: 617743 - DNA, 13 bp, D. melanogaster
gaaaacaattgga

SEQ ID NO: 617744 - DNA, 13 bp, D. melanogaster
gaaaacaatttaa

SEQ ID NO: 617745 - DNA, 13 bp, D. melanogaster
gaaaacacattaa

SEQ ID NO: 617746 - DNA, 13 bp, D. melanogaster
gaaaacacatttt

SEQ ID NO: 617747 - DNA, 13 bp, D. melanogaster
gaaaacagccaga

SEQ ID NO: 617748 - DNA, 13 bp, D. melanogaster
gaaaacaggagac

SEQ ID NO: 617749 - DNA, 13 bp, D. melanogaster
gaaaacaggcagg

SEQ ID NO: 617750 - DNA, 13 bp, D. melanogaster
gaaaacagggaat

SEQ ID NO: 617751 - DNA, 13 bp, D. melanogaster
gaaaacagtgaaa

SEQ ID NO: 617752 - DNA, 13 bp, D. melanogaster
gaaaacagttaaa

SEQ ID NO: 617753 - DNA, 13 bp, D. melanogaster
gaaaacagttcct

SEQ ID NO: 617754 - DNA, 13 bp, D. melanogaster
gaaaacagttttt

SEQ ID NO: 617755 - DNA, 13 bp, D. melanogaster
gaaaacatacaca

SEQ ID NO: 617756 - DNA, 14 bp, D. melanogaster
gaaaacatacacag

SEQ ID NO: 617757 - DNA, 13 bp, D. melanogaster
gaaaacatatgta

SEQ ID NO: 617758 - DNA, 13 bp, D. melanogaster
gaaaacatcaaca

SEQ ID NO: 617759 - DNA, 13 bp, D. melanogaster
gaaaacatccaaa

SEQ ID NO: 617760 - DNA, 14 bp, D. melanogaster
gaaaacatgaaaat

SEQ ID NO: 617761 - DNA, 14 bp, D. melanogaster
gaaaacatggaaaa

SEQ ID NO: 617762 - DNA, 13 bp, D. melanogaster
gaaaacattaatt

SEQ ID NO: 617763 - DNA, 13 bp, D. melanogaster
gaaaacattattt

SEQ ID NO: 617764 - DNA, 14 bp, D. melanogaster
gaaaacatttaaaa

SEQ ID NO: 617765 - DNA, 13 bp, D. melanogaster
gaaaacatttaag

SEQ ID NO: 617766 - DNA, 13 bp, D. melanogaster
gaaaacatttatt

SEQ ID NO: 617767 - DNA, 13 bp, D. melanogaster
gaaaacatttcga

SEQ ID NO: 617768 - DNA, 13 bp, D. melanogaster
gaaaacatttgaa

SEQ ID NO: 617769 - DNA, 13 bp, D. melanogaster
gaaaacatttgca

SEQ ID NO: 617770 - DNA, 13 bp, D. melanogaster
gaaaacattttca

SEQ ID NO: 617771 - DNA, 13 bp, D. melanogaster
gaaaacattttcc

SEQ ID NO: 617772 - DNA, 13 bp, D. melanogaster
gaaaacattttgc

SEQ ID NO: 617773 - DNA, 13 bp, D. melanogaster
gaaaacattttgt

SEQ ID NO: 617774 - DNA, 13 bp, D. melanogaster
gaaaaccaaaagt

SEQ ID NO: 617775 - DNA, 13 bp, D. melanogaster
gaaaaccaaacat

SEQ ID NO: 617776 - DNA, 13 bp, D. melanogaster
gaaaaccaaatga

SEQ ID NO: 617777 - DNA, 14 bp, D. melanogaster
gaaaaccaaatgaa

SEQ ID NO: 617778 - DNA, 13 bp, D. melanogaster
gaaaaccaagcca

SEQ ID NO: 617779 - DNA, 14 bp, D. melanogaster
gaaaaccaagtaca

SEQ ID NO: 617780 - DNA, 13 bp, D. melanogaster
gaaaaccagcaga

SEQ ID NO: 617781 - DNA, 13 bp, D. melanogaster
gaaaaccagtttg

SEQ ID NO: 617782 - DNA, 13 bp, D. melanogaster
gaaaaccatttaa

SEQ ID NO: 617783 - DNA, 13 bp, D. melanogaster
gaaaaccatttga

SEQ ID NO: 617784 - DNA, 13 bp, D. melanogaster
gaaaaccattttt

SEQ ID NO: 617785 - DNA, 13 bp, D. melanogaster
gaaaacccataaa

SEQ ID NO: 617786 - DNA, 13 bp, D. melanogaster
gaaaacccattaa

SEQ ID NO: 617787 - DNA, 14 bp, D. melanogaster
gaaaacccattaaa

SEQ ID NO: 617788 - DNA, 13 bp, D. melanogaster
gaaaacccttttg

SEQ ID NO: 617789 - DNA, 13 bp, D. melanogaster
gaaaacctgacat

SEQ ID NO: 617790 - DNA, 14 bp, D. melanogaster
gaaaaccttcagaa

SEQ ID NO: 617791 - DNA, 13 bp, D. melanogaster
gaaaaccttttaa

SEQ ID NO: 617792 - DNA, 13 bp, D. melanogaster
gaaaacgaaaatc

SEQ ID NO: 617793 - DNA, 13 bp, D. melanogaster
gaaaacgaaaatg

SEQ ID NO: 617794 - DNA, 13 bp, D. melanogaster
gaaaacgaaaatt

SEQ ID NO: 617795 - DNA, 13 bp, D. melanogaster
gaaaacgaaactc

SEQ ID NO: 617796 - DNA, 14 bp, D. melanogaster
gaaaacgaaatgaa

SEQ ID NO: 617797 - DNA, 13 bp, D. melanogaster
gaaaacgaaattc

SEQ ID NO: 617798 - DNA, 13 bp, D. melanogaster
gaaaacgaaattg

SEQ ID NO: 617799 - DNA, 13 bp, D. melanogaster
gaaaacgaaccga

SEQ ID NO: 617800 - DNA, 13 bp, D. melanogaster
gaaaacgaatatt

SEQ ID NO: 617801 - DNA, 13 bp, D. melanogaster
gaaaacgaatgaa

SEQ ID NO: 617802 - DNA, 13 bp, D. melanogaster
gaaaacgaatgca

SEQ ID NO: 617803 - DNA, 13 bp, D. melanogaster
gaaaacgagaatg

SEQ ID NO: 617804 - DNA, 13 bp, D. melanogaster
gaaaacgagccaa

SEQ ID NO: 617805 - DNA, 13 bp, D. melanogaster
gaaaacgatgaaa

SEQ ID NO: 617806 - DNA, 13 bp, D. melanogaster
gaaaacgattttc

SEQ ID NO: 617807 - DNA, 13 bp, D. melanogaster
gaaaacgcatcga

SEQ ID NO: 617808 - DNA, 13 bp, D. melanogaster
gaaaacgcatttc

SEQ ID NO: 617809 - DNA, 13 bp, D. melanogaster
gaaaacgctttaa

SEQ ID NO: 617810 - DNA, 13 bp, D. melanogaster
gaaaacgcttttc

SEQ ID NO: 617811 - DNA, 13 bp, D. melanogaster
gaaaacggaaaat

SEQ ID NO: 617812 - DNA, 13 bp, D. melanogaster
gaaaacggaaacg

SEQ ID NO: 617813 - DNA, 13 bp, D. melanogaster
gaaaacggaaatg

SEQ ID NO: 617814 - DNA, 13 bp, D. melanogaster
gaaaacggaggac

SEQ ID NO: 617815 - DNA, 14 bp, D. melanogaster
gaaaacggaggact

SEQ ID NO: 617816 - DNA, 13 bp, D. melanogaster
gaaaacggcgaaa

SEQ ID NO: 617817 - DNA, 13 bp, D. melanogaster
gaaaacgtaaaat

SEQ ID NO: 617818 - DNA, 13 bp, D. melanogaster
gaaaacgtaaaca

SEQ ID NO: 617819 - DNA, 14 bp, D. melanogaster
gaaaacgtaaacaa

SEQ ID NO: 617820 - DNA, 13 bp, D. melanogaster
gaaaacgtgaaaa

SEQ ID NO: 617821 - DNA, 13 bp, D. melanogaster
gaaaacgttgaaa

SEQ ID NO: 617822 - DNA, 13 bp, D. melanogaster
gaaaacgtttgct

SEQ ID NO: 617823 - DNA, 13 bp, D. melanogaster
gaaaacgttttcg

SEQ ID NO: 617824 - DNA, 13 bp, D. melanogaster
gaaaacgttttta

SEQ ID NO: 617825 - DNA, 13 bp, D. melanogaster
gaaaacgtttttt

SEQ ID NO: 617826 - DNA, 13 bp, D. melanogaster
gaaaactaaaatg

SEQ ID NO: 617827 - DNA, 13 bp, D. melanogaster
gaaaactaaatta

SEQ ID NO: 617828 - DNA, 13 bp, D. melanogaster
gaaaactaaattt

SEQ ID NO: 617829 - DNA, 13 bp, D. melanogaster
gaaaactaatatt

SEQ ID NO: 617830 - DNA, 13 bp, D. melanogaster
gaaaactactaaa

SEQ ID NO: 617831 - DNA, 13 bp, D. melanogaster
gaaaactagaaac

SEQ ID NO: 617832 - DNA, 13 bp, D. melanogaster
gaaaactatataa

SEQ ID NO: 617833 - DNA, 13 bp, D. melanogaster
gaaaactattaaa

SEQ ID NO: 617834 - DNA, 13 bp, D. melanogaster
gaaaactattcaa

SEQ ID NO: 617835 - DNA, 13 bp, D. melanogaster
gaaaactatttaa

SEQ ID NO: 617836 - DNA, 13 bp, D. melanogaster
gaaaactatttct

SEQ ID NO: 617837 - DNA, 13 bp, D. melanogaster
gaaaactattttg

SEQ ID NO: 617838 - DNA, 14 bp, D. melanogaster
gaaaactatttttg

SEQ ID NO: 617839 - DNA, 13 bp, D. melanogaster
gaaaactcaaaat

SEQ ID NO: 617840 - DNA, 13 bp, D. melanogaster
gaaaactcactca

SEQ ID NO: 617841 - DNA, 13 bp, D. melanogaster
gaaaactccatta

SEQ ID NO: 617842 - DNA, 13 bp, D. melanogaster
gaaaactcgtttt

SEQ ID NO: 617843 - DNA, 13 bp, D. melanogaster
gaaaactctgcag

SEQ ID NO: 617844 - DNA, 13 bp, D. melanogaster
gaaaactcttcaa

SEQ ID NO: 617845 - DNA, 13 bp, D. melanogaster
gaaaactgaaaac

SEQ ID NO: 617846 - DNA, 14 bp, D. melanogaster
gaaaactgaaaacc

SEQ ID NO: 617847 - DNA, 14 bp, D. melanogaster
gaaaactgaaaacg

SEQ ID NO: 617848 - DNA, 13 bp, D. melanogaster
gaaaactgaaaag

SEQ ID NO: 617849 - DNA, 14 bp, D. melanogaster
gaaaactgaaactg

SEQ ID NO: 617850 - DNA, 13 bp, D. melanogaster
gaaaactgaaagc

SEQ ID NO: 617851 - DNA, 13 bp, D. melanogaster
gaaaactgaaatg

SEQ ID NO: 617852 - DNA, 13 bp, D. melanogaster
gaaaactgaatgc

SEQ ID NO: 617853 - DNA, 13 bp, D. melanogaster
gaaaactgaattt

SEQ ID NO: 617854 - DNA, 13 bp, D. melanogaster
gaaaactgaggaa

SEQ ID NO: 617855 - DNA, 13 bp, D. melanogaster
gaaaactgatttt

SEQ ID NO: 617856 - DNA, 13 bp, D. melanogaster
gaaaactgcaaac

SEQ ID NO: 617857 - DNA, 13 bp, D. melanogaster
gaaaactgctgca

SEQ ID NO: 617858 - DNA, 13 bp, D. melanogaster
gaaaactggaaaa

SEQ ID NO: 617859 - DNA, 13 bp, D. melanogaster
gaaaactggcaac

SEQ ID NO: 617860 - DNA, 13 bp, D. melanogaster
gaaaactggcgaa

SEQ ID NO: 617861 - DNA, 13 bp, D. melanogaster
gaaaactgtttgc

SEQ ID NO: 617862 - DNA, 13 bp, D. melanogaster
gaaaacttaaaca

SEQ ID NO: 617863 - DNA, 14 bp, D. melanogaster
gaaaacttcttgaa

SEQ ID NO: 617864 - DNA, 13 bp, D. melanogaster
gaaaacttgaaaa

SEQ ID NO: 617865 - DNA, 13 bp, D. melanogaster
gaaaacttgccag

SEQ ID NO: 617866 - DNA, 13 bp, D. melanogaster
gaaaacttgttta

SEQ ID NO: 617867 - DNA, 13 bp, D. melanogaster
gaaaacttgtttt

SEQ ID NO: 617868 - DNA, 13 bp, D. melanogaster
gaaaactttaaaa

SEQ ID NO: 617869 - DNA, 13 bp, D. melanogaster
gaaaactttaaat

SEQ ID NO: 617870 - DNA, 13 bp, D. melanogaster
gaaaactttaagc

SEQ ID NO: 617871 - DNA, 13 bp, D. melanogaster
gaaaactttcgcc

SEQ ID NO: 617872 - DNA, 13 bp, D. melanogaster
gaaaactttgaaa

SEQ ID NO: 617873 - DNA, 13 bp, D. melanogaster
gaaaactttgact

SEQ ID NO: 617874 - DNA, 13 bp, D. melanogaster
gaaaactttgttt

SEQ ID NO: 617875 - DNA, 13 bp, D. melanogaster
gaaaacttttaac

SEQ ID NO: 617876 - DNA, 13 bp, D. melanogaster
gaaaacttttaat

SEQ ID NO: 617877 - DNA, 13 bp, D. melanogaster
gaaaacttttaga

SEQ ID NO: 617878 - DNA, 14 bp, D. melanogaster
gaaaacttttagaa

SEQ ID NO: 617879 - DNA, 13 bp, D. melanogaster
gaaaacttttcat

SEQ ID NO: 617880 - DNA, 13 bp, D. melanogaster
gaaaacttttcca

SEQ ID NO: 617881 - DNA, 13 bp, D. melanogaster
gaaaacttttctc

SEQ ID NO: 617882 - DNA, 13 bp, D. melanogaster
gaaaacttttctg

SEQ ID NO: 617883 - DNA, 13 bp, D. melanogaster
gaaaacttttgcc

SEQ ID NO: 617884 - DNA, 13 bp, D. melanogaster
gaaaacttttgtc

SEQ ID NO: 617885 - DNA, 13 bp, D. melanogaster
gaaaacttttgtt

SEQ ID NO: 617886 - DNA, 13 bp, D. melanogaster
gaaaactttttat

SEQ ID NO: 617887 - DNA, 13 bp, D. melanogaster
gaaaactttttgc

SEQ ID NO: 617888 - DNA, 13 bp, D. melanogaster
gaaaagaaaatgc

SEQ ID NO: 617889 - DNA, 14 bp, D. melanogaster
gaaaagaaaattgc

SEQ ID NO: 617890 - DNA, 13 bp, D. melanogaster
gaaaagaaaccat

SEQ ID NO: 617891 - DNA, 14 bp, D. melanogaster
gaaaagaaaccatt

SEQ ID NO: 617892 - DNA, 13 bp, D. melanogaster
gaaaagaaatact

SEQ ID NO: 617893 - DNA, 13 bp, D. melanogaster
gaaaagaaatcat

SEQ ID NO: 617894 - DNA, 13 bp, D. melanogaster
gaaaagaaattgc

SEQ ID NO: 617895 - DNA, 13 bp, D. melanogaster
gaaaagaaatttg

SEQ ID NO: 617896 - DNA, 14 bp, D. melanogaster
gaaaagaaatttgt

SEQ ID NO: 617897 - DNA, 13 bp, D. melanogaster
gaaaagaacaatt

SEQ ID NO: 617898 - DNA, 14 bp, D. melanogaster
gaaaagaacaattg

SEQ ID NO: 617899 - DNA, 14 bp, D. melanogaster
gaaaagaatatgct

SEQ ID NO: 617900 - DNA, 13 bp, D. melanogaster
gaaaagaatgcaa

SEQ ID NO: 617901 - DNA, 13 bp, D. melanogaster
gaaaagaattatt

SEQ ID NO: 617902 - DNA, 13 bp, D. melanogaster
gaaaagaatttta

SEQ ID NO: 617903 - DNA, 13 bp, D. melanogaster
gaaaagaccatta

SEQ ID NO: 617904 - DNA, 13 bp, D. melanogaster
gaaaagacttaca

SEQ ID NO: 617905 - DNA, 13 bp, D. melanogaster
gaaaagagatggc

SEQ ID NO: 617906 - DNA, 13 bp, D. melanogaster
gaaaagagcagca

SEQ ID NO: 617907 - DNA, 22 bp, D. melanogaster
gaaaagagctgttcgctgtagc

SEQ ID NO: 617908 - DNA, 13 bp, D. melanogaster
gaaaagatacatt

SEQ ID NO: 617909 - DNA, 13 bp, D. melanogaster
gaaaagatgcccg

SEQ ID NO: 617910 - DNA, 13 bp, D. melanogaster
gaaaagatgtacc

SEQ ID NO: 617911 - DNA, 13 bp, D. melanogaster
gaaaagatgtcca

SEQ ID NO: 617912 - DNA, 14 bp, D. melanogaster
gaaaagatgtccaa

SEQ ID NO: 617913 - DNA, 13 bp, D. melanogaster
gaaaagattaaca

SEQ ID NO: 617914 - DNA, 13 bp, D. melanogaster
gaaaagattcgca

SEQ ID NO: 617915 - DNA, 13 bp, D. melanogaster
gaaaagatttaat

SEQ ID NO: 617916 - DNA, 13 bp, D. melanogaster
gaaaagcaaaagt

SEQ ID NO: 617917 - DNA, 13 bp, D. melanogaster
gaaaagcaaacat

SEQ ID NO: 617918 - DNA, 13 bp, D. melanogaster
gaaaagcaaatat

SEQ ID NO: 617919 - DNA, 13 bp, D. melanogaster
gaaaagcaaatgc

SEQ ID NO: 617920 - DNA, 13 bp, D. melanogaster
gaaaagcaacagc

SEQ ID NO: 617921 - DNA, 13 bp, D. melanogaster
gaaaagcaattgc

SEQ ID NO: 617922 - DNA, 13 bp, D. melanogaster
gaaaagcaatttc

SEQ ID NO: 617923 - DNA, 13 bp, D. melanogaster
gaaaagcagaagc

SEQ ID NO: 617924 - DNA, 13 bp, D. melanogaster
gaaaagcagcagc

SEQ ID NO: 617925 - DNA, 14 bp, D. melanogaster
gaaaagcagcagca

SEQ ID NO: 617926 - DNA, 13 bp, D. melanogaster
gaaaagcagcagg

SEQ ID NO: 617927 - DNA, 13 bp, D. melanogaster
gaaaagcagcgaa

SEQ ID NO: 617928 - DNA, 13 bp, D. melanogaster
gaaaagcattaaa

SEQ ID NO: 617929 - DNA, 13 bp, D. melanogaster
gaaaagcattcaa

SEQ ID NO: 617930 - DNA, 13 bp, D. melanogaster
gaaaagcattgtt

SEQ ID NO: 617931 - DNA, 13 bp, D. melanogaster
gaaaagcatttaa

SEQ ID NO: 617932 - DNA, 13 bp, D. melanogaster
gaaaagcatttta

SEQ ID NO: 617933 - DNA, 13 bp, D. melanogaster
gaaaagccaaagt

SEQ ID NO: 617934 - DNA, 13 bp, D. melanogaster
gaaaagccaagag

SEQ ID NO: 617935 - DNA, 13 bp, D. melanogaster
gaaaagccaagcg

SEQ ID NO: 617936 - DNA, 13 bp, D. melanogaster
gaaaagccaagga

SEQ ID NO: 617937 - DNA, 13 bp, D. melanogaster
gaaaagccaccca

SEQ ID NO: 617938 - DNA, 13 bp, D. melanogaster
gaaaagccagcaa

SEQ ID NO: 617939 - DNA, 13 bp, D. melanogaster
gaaaagccagcga

SEQ ID NO: 617940 - DNA, 13 bp, D. melanogaster
gaaaagccataaa

SEQ ID NO: 617941 - DNA, 13 bp, D. melanogaster
gaaaagccatttg

SEQ ID NO: 617942 - DNA, 13 bp, D. melanogaster
gaaaagcccaaag

SEQ ID NO: 617943 - DNA, 13 bp, D. melanogaster
gaaaagccggcaa

SEQ ID NO: 617944 - DNA, 13 bp, D. melanogaster
gaaaagcgaaaat

SEQ ID NO: 617945 - DNA, 13 bp, D. melanogaster
gaaaagcgaaacg

SEQ ID NO: 617946 - DNA, 13 bp, D. melanogaster
gaaaagcgaaact

SEQ ID NO: 617947 - DNA, 13 bp, D. melanogaster
gaaaagcgaacga

SEQ ID NO: 617948 - DNA, 14 bp, D. melanogaster
gaaaagcgaggcca

SEQ ID NO: 617949 - DNA, 13 bp, D. melanogaster
gaaaagcgagtgg

SEQ ID NO: 617950 - DNA, 13 bp, D. melanogaster
gaaaagcgatgga

SEQ ID NO: 617951 - DNA, 13 bp, D. melanogaster
gaaaagcgatttt

SEQ ID NO: 617952 - DNA, 13 bp, D. melanogaster
gaaaagcgccaaa

SEQ ID NO: 617953 - DNA, 13 bp, D. melanogaster
gaaaagcgcgaaa

SEQ ID NO: 617954 - DNA, 13 bp, D. melanogaster
gaaaagcggaagc

SEQ ID NO: 617955 - DNA, 13 bp, D. melanogaster
gaaaagcggatgg

SEQ ID NO: 617956 - DNA, 13 bp, D. melanogaster
gaaaagcggcaaa

SEQ ID NO: 617957 - DNA, 13 bp, D. melanogaster
gaaaagcgggcgg

SEQ ID NO: 617958 - DNA, 13 bp, D. melanogaster
gaaaagcgtgaaa

SEQ ID NO: 617959 - DNA, 14 bp, D. melanogaster
gaaaagcgtgaaaa

SEQ ID NO: 617960 - DNA, 14 bp, D. melanogaster
gaaaagcgtggaaa

SEQ ID NO: 617961 - DNA, 13 bp, D. melanogaster
gaaaagcgttttc

SEQ ID NO: 617962 - DNA, 13 bp, D. melanogaster
gaaaagctaagaa

SEQ ID NO: 617963 - DNA, 13 bp, D. melanogaster
gaaaagctacaaa

SEQ ID NO: 617964 - DNA, 13 bp, D. melanogaster
gaaaagctgaaaa

SEQ ID NO: 617965 - DNA, 14 bp, D. melanogaster
gaaaagctgaaaag

SEQ ID NO: 617966 - DNA, 14 bp, D. melanogaster
gaaaagctgaaaat

SEQ ID NO: 617967 - DNA, 13 bp, D. melanogaster
gaaaagctgaaag

SEQ ID NO: 617968 - DNA, 13 bp, D. melanogaster
gaaaagctgaaga

SEQ ID NO: 617969 - DNA, 13 bp, D. melanogaster
gaaaagctgacca

SEQ ID NO: 617970 - DNA, 13 bp, D. melanogaster
gaaaagctgcaga

SEQ ID NO: 617971 - DNA, 14 bp, D. melanogaster
gaaaagctggaaaa

SEQ ID NO: 617972 - DNA, 14 bp, D. melanogaster
gaaaagctggcaaa

SEQ ID NO: 617973 - DNA, 13 bp, D. melanogaster
gaaaagctgggaa

SEQ ID NO: 617974 - DNA, 14 bp, D. melanogaster
gaaaagctgggaaa

SEQ ID NO: 617975 - DNA, 13 bp, D. melanogaster
gaaaagcttcaaa

SEQ ID NO: 617976 - DNA, 13 bp, D. melanogaster
gaaaagcttgaaa

SEQ ID NO: 617977 - DNA, 13 bp, D. melanogaster
gaaaagctttttg

SEQ ID NO: 617978 - DNA, 14 bp, D. melanogaster
gaaaaggaaaaact

SEQ ID NO: 617979 - DNA, 13 bp, D. melanogaster
gaaaaggaaaact

SEQ ID NO: 617980 - DNA, 14 bp, D. melanogaster
gaaaaggaaaactt

SEQ ID NO: 617981 - DNA, 13 bp, D. melanogaster
gaaaaggaaaatc

SEQ ID NO: 617982 - DNA, 13 bp, D. melanogaster
gaaaaggaaactg

SEQ ID NO: 617983 - DNA, 14 bp, D. melanogaster
gaaaaggaaatgct

SEQ ID NO: 617984 - DNA, 13 bp, D. melanogaster
gaaaaggaccgat

SEQ ID NO: 617985 - DNA, 13 bp, D. melanogaster
gaaaaggacttgt

SEQ ID NO: 617986 - DNA, 13 bp, D. melanogaster
gaaaaggagcgca

SEQ ID NO: 617987 - DNA, 13 bp, D. melanogaster
gaaaaggatatat

SEQ ID NO: 617988 - DNA, 13 bp, D. melanogaster
gaaaaggcaacat

SEQ ID NO: 617989 - DNA, 13 bp, D. melanogaster
gaaaaggccaaac

SEQ ID NO: 617990 - DNA, 13 bp, D. melanogaster
gaaaaggcttaaa

SEQ ID NO: 617991 - DNA, 13 bp, D. melanogaster
gaaaagggaaact

SEQ ID NO: 617992 - DNA, 13 bp, D. melanogaster
gaaaagggaatgc

SEQ ID NO: 617993 - DNA, 13 bp, D. melanogaster
gaaaagggatttt

SEQ ID NO: 617994 - DNA, 13 bp, D. melanogaster
gaaaagggcaata

SEQ ID NO: 617995 - DNA, 13 bp, D. melanogaster
gaaaaggggcgtg

SEQ ID NO: 617996 - DNA, 13 bp, D. melanogaster
gaaaagggttttt

SEQ ID NO: 617997 - DNA, 13 bp, D. melanogaster
gaaaaggtaaaca

SEQ ID NO: 617998 - DNA, 14 bp, D. melanogaster
gaaaagtaaaagtt

SEQ ID NO: 617999 - DNA, 13 bp, D. melanogaster
gaaaagtaattat

SEQ ID NO: 618000 - DNA, 13 bp, D. melanogaster
gaaaagtatatat

SEQ ID NO: 618001 - DNA, 13 bp, D. melanogaster
gaaaagtatattt

SEQ ID NO: 618002 - DNA, 13 bp, D. melanogaster
gaaaagtatctta

SEQ ID NO: 618003 - DNA, 13 bp, D. melanogaster
gaaaagtatgcaa

SEQ ID NO: 618004 - DNA, 13 bp, D. melanogaster
gaaaagtattatt

SEQ ID NO: 618005 - DNA, 13 bp, D. melanogaster
gaaaagtattttg

SEQ ID NO: 618006 - DNA, 13 bp, D. melanogaster
gaaaagtcaacag

SEQ ID NO: 618007 - DNA, 13 bp, D. melanogaster
gaaaagtcacaaa

SEQ ID NO: 618008 - DNA, 13 bp, D. melanogaster
gaaaagtcatttt

SEQ ID NO: 618009 - DNA, 13 bp, D. melanogaster
gaaaagtcggaaa

SEQ ID NO: 618010 - DNA, 14 bp, D. melanogaster
gaaaagtcggaaaa

SEQ ID NO: 618011 - DNA, 13 bp, D. melanogaster
gaaaagtgaaaac

SEQ ID NO: 618012 - DNA, 14 bp, D. melanogaster
gaaaagtgaaaatt

SEQ ID NO: 618013 - DNA, 13 bp, D. melanogaster
gaaaagtgaaacc

SEQ ID NO: 618014 - DNA, 13 bp, D. melanogaster
gaaaagtgaacaa

SEQ ID NO: 618015 - DNA, 14 bp, D. melanogaster
gaaaagtgaatatt

SEQ ID NO: 618016 - DNA, 13 bp, D. melanogaster
gaaaagtgaatga

SEQ ID NO: 618017 - DNA, 13 bp, D. melanogaster
gaaaagtgaattt

SEQ ID NO: 618018 - DNA, 13 bp, D. melanogaster
gaaaagtgatttt

SEQ ID NO: 618019 - DNA, 13 bp, D. melanogaster
gaaaagtgcaaaa

SEQ ID NO: 618020 - DNA, 14 bp, D. melanogaster
gaaaagtgcaaaaa

SEQ ID NO: 618021 - DNA, 13 bp, D. melanogaster
gaaaagtgcaata

SEQ ID NO: 618022 - DNA, 13 bp, D. melanogaster
gaaaagtgcactt

SEQ ID NO: 618023 - DNA, 13 bp, D. melanogaster
gaaaagtgcagaa

SEQ ID NO: 618024 - DNA, 13 bp, D. melanogaster
gaaaagtgcagag

SEQ ID NO: 618025 - DNA, 13 bp, D. melanogaster
gaaaagtgcattg

SEQ ID NO: 618026 - DNA, 13 bp, D. melanogaster
gaaaagtgcccaa

SEQ ID NO: 618027 - DNA, 13 bp, D. melanogaster
gaaaagtgcgaaa

SEQ ID NO: 618028 - DNA, 13 bp, D. melanogaster
gaaaagtgcttaa

SEQ ID NO: 618029 - DNA, 13 bp, D. melanogaster
gaaaagtggaaat

SEQ ID NO: 618030 - DNA, 13 bp, D. melanogaster
gaaaagtggcaaa

SEQ ID NO: 618031 - DNA, 13 bp, D. melanogaster
gaaaagtggcagg

SEQ ID NO: 618032 - DNA, 13 bp, D. melanogaster
gaaaagtggccaa

SEQ ID NO: 618033 - DNA, 13 bp, D. melanogaster
gaaaagtgggcgg

SEQ ID NO: 618034 - DNA, 13 bp, D. melanogaster
gaaaagtgggcgt

SEQ ID NO: 618035 - DNA, 13 bp, D. melanogaster
gaaaagtgggtgg

SEQ ID NO: 618036 - DNA, 13 bp, D. melanogaster
gaaaagtgtgaaa

SEQ ID NO: 618037 - DNA, 13 bp, D. melanogaster
gaaaagtgtggaa

SEQ ID NO: 618038 - DNA, 14 bp, D. melanogaster
gaaaagtgtggaaa

SEQ ID NO: 618039 - DNA, 13 bp, D. melanogaster
gaaaagtgtgtaa

SEQ ID NO: 618040 - DNA, 13 bp, D. melanogaster
gaaaagtgtgtca

SEQ ID NO: 618041 - DNA, 13 bp, D. melanogaster
gaaaagtgttttt

SEQ ID NO: 618042 - DNA, 13 bp, D. melanogaster
gaaaagttaattt

SEQ ID NO: 618043 - DNA, 13 bp, D. melanogaster
gaaaagttacttt

SEQ ID NO: 618044 - DNA, 13 bp, D. melanogaster
gaaaagttcaaaa

SEQ ID NO: 618045 - DNA, 13 bp, D. melanogaster
gaaaagttcaatg

SEQ ID NO: 618046 - DNA, 13 bp, D. melanogaster
gaaaagttcttaa

SEQ ID NO: 618047 - DNA, 13 bp, D. melanogaster
gaaaagttgaaac

SEQ ID NO: 618048 - DNA, 13 bp, D. melanogaster
gaaaagttgcagc

SEQ ID NO: 618049 - DNA, 13 bp, D. melanogaster
gaaaagttgctgc

SEQ ID NO: 618050 - DNA, 13 bp, D. melanogaster
gaaaagtttactt

SEQ ID NO: 618051 - DNA, 13 bp, D. melanogaster
gaaaagtttcaaa

SEQ ID NO: 618052 - DNA, 13 bp, D. melanogaster
gaaaagtttcaat

SEQ ID NO: 618053 - DNA, 13 bp, D. melanogaster
gaaaagtttcagt

SEQ ID NO: 618054 - DNA, 13 bp, D. melanogaster
gaaaagtttccaa

SEQ ID NO: 618055 - DNA, 13 bp, D. melanogaster
gaaaagtttccca

SEQ ID NO: 618056 - DNA, 13 bp, D. melanogaster
gaaaagtttctgg

SEQ ID NO: 618057 - DNA, 14 bp, D. melanogaster
gaaaagtttgcaaa

SEQ ID NO: 618058 - DNA, 13 bp, D. melanogaster
gaaaagtttgcca

SEQ ID NO: 618059 - DNA, 13 bp, D. melanogaster
gaaaagtttgctg

SEQ ID NO: 618060 - DNA, 13 bp, D. melanogaster
gaaaagtttggca

SEQ ID NO: 618061 - DNA, 14 bp, D. melanogaster
gaaaagtttggcaa

SEQ ID NO: 618062 - DNA, 13 bp, D. melanogaster
gaaaagtttgtaa

SEQ ID NO: 618063 - DNA, 13 bp, D. melanogaster
gaaaagttttcca

SEQ ID NO: 618064 - DNA, 13 bp, D. melanogaster
gaaaagttttcgg

SEQ ID NO: 618065 - DNA, 13 bp, D. melanogaster
gaaaagttttgaa

SEQ ID NO: 618066 - DNA, 13 bp, D. melanogaster
gaaaagttttgcg

SEQ ID NO: 618067 - DNA, 13 bp, D. melanogaster
gaaaagttttggc

SEQ ID NO: 618068 - DNA, 13 bp, D. melanogaster
gaaaagtttttct

SEQ ID NO: 618069 - DNA, 13 bp, D. melanogaster
gaaaagtttttgg

SEQ ID NO: 618070 - DNA, 13 bp, D. melanogaster
gaaaagtttttgt

SEQ ID NO: 618071 - DNA, 14 bp, D. melanogaster
gaaaagtttttgtg

SEQ ID NO: 618072 - DNA, 13 bp, D. melanogaster
gaaaagttttttt

SEQ ID NO: 618073 - DNA, 13 bp, D. melanogaster
gaaaataaaacgc

SEQ ID NO: 618074 - DNA, 13 bp, D. melanogaster
gaaaataaaactg

SEQ ID NO: 618075 - DNA, 13 bp, D. melanogaster
gaaaataaaagcg

SEQ ID NO: 618076 - DNA, 13 bp, D. melanogaster
gaaaataaacttg

SEQ ID NO: 618077 - DNA, 13 bp, D. melanogaster
gaaaataaagcga

SEQ ID NO: 618078 - DNA, 13 bp, D. melanogaster
gaaaataaagtcc

SEQ ID NO: 618079 - DNA, 13 bp, D. melanogaster
gaaaataaagttt

SEQ ID NO: 618080 - DNA, 14 bp, D. melanogaster
gaaaataaatacat

SEQ ID NO: 618081 - DNA, 13 bp, D. melanogaster
gaaaataaatcta

SEQ ID NO: 618082 - DNA, 13 bp, D. melanogaster
gaaaataaatgca

SEQ ID NO: 618083 - DNA, 13 bp, D. melanogaster
gaaaataaatgtt

SEQ ID NO: 618084 - DNA, 13 bp, D. melanogaster
gaaaataacattt

SEQ ID NO: 618085 - DNA, 13 bp, D. melanogaster
gaaaataaccaca

SEQ ID NO: 618086 - DNA, 13 bp, D. melanogaster
gaaaataacttca

SEQ ID NO: 618087 - DNA, 13 bp, D. melanogaster
gaaaataacttta

SEQ ID NO: 618088 - DNA, 13 bp, D. melanogaster
gaaaataagtttt

SEQ ID NO: 618089 - DNA, 13 bp, D. melanogaster
gaaaataatacat

SEQ ID NO: 618090 - DNA, 13 bp, D. melanogaster
gaaaataatattg

SEQ ID NO: 618091 - DNA, 13 bp, D. melanogaster
gaaaataatcatt

SEQ ID NO: 618092 - DNA, 14 bp, D. melanogaster
gaaaataatgcaaa

SEQ ID NO: 618093 - DNA, 13 bp, D. melanogaster
gaaaataatgtta

SEQ ID NO: 618094 - DNA, 13 bp, D. melanogaster
gaaaataattcat

SEQ ID NO: 618095 - DNA, 13 bp, D. melanogaster
gaaaatacaattt

SEQ ID NO: 618096 - DNA, 14 bp, D. melanogaster
gaaaatacagattc

SEQ ID NO: 618097 - DNA, 13 bp, D. melanogaster
gaaaatacatatt

SEQ ID NO: 618098 - DNA, 14 bp, D. melanogaster
gaaaatacatattt

SEQ ID NO: 618099 - DNA, 13 bp, D. melanogaster
gaaaataccgaaa

SEQ ID NO: 618100 - DNA, 14 bp, D. melanogaster
gaaaatacgaaaat

SEQ ID NO: 618101 - DNA, 13 bp, D. melanogaster
gaaaatacgaata

SEQ ID NO: 618102 - DNA, 13 bp, D. melanogaster
gaaaatacggaaa

SEQ ID NO: 618103 - DNA, 13 bp, D. melanogaster
gaaaatacgtttt

SEQ ID NO: 618104 - DNA, 13 bp, D. melanogaster
gaaaatactattt

SEQ ID NO: 618105 - DNA, 13 bp, D. melanogaster
gaaaatactcaga

SEQ ID NO: 618106 - DNA, 13 bp, D. melanogaster
gaaaatactgaaa

SEQ ID NO: 618107 - DNA, 14 bp, D. melanogaster
gaaaatactgaaaa

SEQ ID NO: 618108 - DNA, 13 bp, D. melanogaster
gaaaatacttatc

SEQ ID NO: 618109 - DNA, 13 bp, D. melanogaster
gaaaatacttgaa

SEQ ID NO: 618110 - DNA, 13 bp, D. melanogaster
gaaaatacttttc

SEQ ID NO: 618111 - DNA, 13 bp, D. melanogaster
gaaaatagcaaca

SEQ ID NO: 618112 - DNA, 13 bp, D. melanogaster
gaaaatagcacaa

SEQ ID NO: 618113 - DNA, 13 bp, D. melanogaster
gaaaatagcgaaa

SEQ ID NO: 618114 - DNA, 13 bp, D. melanogaster
gaaaatagctaaa

SEQ ID NO: 618115 - DNA, 13 bp, D. melanogaster
gaaaataggcaaa

SEQ ID NO: 618116 - DNA, 13 bp, D. melanogaster
gaaaatagttgaa

SEQ ID NO: 618117 - DNA, 13 bp, D. melanogaster
gaaaatataacga

SEQ ID NO: 618118 - DNA, 13 bp, D. melanogaster
gaaaatatacaat

SEQ ID NO: 618119 - DNA, 13 bp, D. melanogaster
gaaaatatagtat

SEQ ID NO: 618120 - DNA, 13 bp, D. melanogaster
gaaaatatataac

SEQ ID NO: 618121 - DNA, 13 bp, D. melanogaster
gaaaatatataca

SEQ ID NO: 618122 - DNA, 13 bp, D. melanogaster
gaaaatatatgca

SEQ ID NO: 618123 - DNA, 13 bp, D. melanogaster
gaaaatatattga

SEQ ID NO: 618124 - DNA, 14 bp, D. melanogaster
gaaaatatcaaatt

SEQ ID NO: 618125 - DNA, 13 bp, D. melanogaster
gaaaatatcctta

SEQ ID NO: 618126 - DNA, 13 bp, D. melanogaster
gaaaatatcgata

SEQ ID NO: 618127 - DNA, 13 bp, D. melanogaster
gaaaatatctaaa

SEQ ID NO: 618128 - DNA, 13 bp, D. melanogaster
gaaaatatctcaa

SEQ ID NO: 618129 - DNA, 13 bp, D. melanogaster
gaaaatatcttga

SEQ ID NO: 618130 - DNA, 13 bp, D. melanogaster
gaaaatatgagca

SEQ ID NO: 618131 - DNA, 13 bp, D. melanogaster
gaaaatatgcaaa

SEQ ID NO: 618132 - DNA, 14 bp, D. melanogaster
gaaaatatgcaaat

SEQ ID NO: 618133 - DNA, 13 bp, D. melanogaster
gaaaatatgcagc

SEQ ID NO: 618134 - DNA, 13 bp, D. melanogaster
gaaaatatgcttt

SEQ ID NO: 618135 - DNA, 13 bp, D. melanogaster
gaaaatatggaat

SEQ ID NO: 618136 - DNA, 13 bp, D. melanogaster
gaaaatatgttga

SEQ ID NO: 618137 - DNA, 13 bp, D. melanogaster
gaaaatatgtttt

SEQ ID NO: 618138 - DNA, 13 bp, D. melanogaster
gaaaatattcaaa

SEQ ID NO: 618139 - DNA, 14 bp, D. melanogaster
gaaaatattcaagg

SEQ ID NO: 618140 - DNA, 13 bp, D. melanogaster
gaaaatattccat

SEQ ID NO: 618141 - DNA, 13 bp, D. melanogaster
gaaaatattgcat

SEQ ID NO: 618142 - DNA, 13 bp, D. melanogaster
gaaaatattgtag

SEQ ID NO: 618143 - DNA, 13 bp, D. melanogaster
gaaaatattgtta

SEQ ID NO: 618144 - DNA, 13 bp, D. melanogaster
gaaaatattgttt

SEQ ID NO: 618145 - DNA, 14 bp, D. melanogaster
gaaaatattgtttt

SEQ ID NO: 618146 - DNA, 13 bp, D. melanogaster
gaaaatatttaag

SEQ ID NO: 618147 - DNA, 13 bp, D. melanogaster
gaaaatatttagc

SEQ ID NO: 618148 - DNA, 14 bp, D. melanogaster
gaaaatatttatga

SEQ ID NO: 618149 - DNA, 13 bp, D. melanogaster
gaaaatatttgaa

SEQ ID NO: 618150 - DNA, 13 bp, D. melanogaster
gaaaatatttgca

SEQ ID NO: 618151 - DNA, 13 bp, D. melanogaster
gaaaatatttgta

SEQ ID NO: 618152 - DNA, 14 bp, D. melanogaster
gaaaatattttcca

SEQ ID NO: 618153 - DNA, 13 bp, D. melanogaster
gaaaatattttga

SEQ ID NO: 618154 - DNA, 13 bp, D. melanogaster
gaaaatatttttg

SEQ ID NO: 618155 - DNA, 14 bp, D. melanogaster
gaaaatcaaaaatt

SEQ ID NO: 618156 - DNA, 13 bp, D. melanogaster
gaaaatcaaaacc

SEQ ID NO: 618157 - DNA, 13 bp, D. melanogaster
gaaaatcaaaagg

SEQ ID NO: 618158 - DNA, 13 bp, D. melanogaster
gaaaatcaaaagt

SEQ ID NO: 618159 - DNA, 13 bp, D. melanogaster
gaaaatcaaacga

SEQ ID NO: 618160 - DNA, 13 bp, D. melanogaster
gaaaatcaaagcc

SEQ ID NO: 618161 - DNA, 14 bp, D. melanogaster
gaaaatcaaatcaa

SEQ ID NO: 618162 - DNA, 13 bp, D. melanogaster
gaaaatcaaatga

SEQ ID NO: 618163 - DNA, 14 bp, D. melanogaster
gaaaatcaaatgaa

SEQ ID NO: 618164 - DNA, 13 bp, D. melanogaster
gaaaatcaaatta

SEQ ID NO: 618165 - DNA, 13 bp, D. melanogaster
gaaaatcaaattt

SEQ ID NO: 618166 - DNA, 13 bp, D. melanogaster
gaaaatcaacaac

SEQ ID NO: 618167 - DNA, 13 bp, D. melanogaster
gaaaatcaagtga

SEQ ID NO: 618168 - DNA, 13 bp, D. melanogaster
gaaaatcaagttt

SEQ ID NO: 618169 - DNA, 13 bp, D. melanogaster
gaaaatcaataga

SEQ ID NO: 618170 - DNA, 13 bp, D. melanogaster
gaaaatcaatatg

SEQ ID NO: 618171 - DNA, 13 bp, D. melanogaster
gaaaatcaatatt

SEQ ID NO: 618172 - DNA, 13 bp, D. melanogaster
gaaaatcaatcaa

SEQ ID NO: 618173 - DNA, 13 bp, D. melanogaster
gaaaatcaatgga

SEQ ID NO: 618174 - DNA, 13 bp, D. melanogaster
gaaaatcaatttc

SEQ ID NO: 618175 - DNA, 13 bp, D. melanogaster
gaaaatcaatttt

SEQ ID NO: 618176 - DNA, 13 bp, D. melanogaster
gaaaatcacataa

SEQ ID NO: 618177 - DNA, 13 bp, D. melanogaster
gaaaatcacattt

SEQ ID NO: 618178 - DNA, 13 bp, D. melanogaster
gaaaatcacttga

SEQ ID NO: 618179 - DNA, 13 bp, D. melanogaster
gaaaatcagcaaa

SEQ ID NO: 618180 - DNA, 13 bp, D. melanogaster
gaaaatcagcagc

SEQ ID NO: 618181 - DNA, 13 bp, D. melanogaster
gaaaatcaggaaa

SEQ ID NO: 618182 - DNA, 13 bp, D. melanogaster
gaaaatcaggata

SEQ ID NO: 618183 - DNA, 13 bp, D. melanogaster
gaaaatcatatat

SEQ ID NO: 618184 - DNA, 13 bp, D. melanogaster
gaaaatcatcttc

SEQ ID NO: 618185 - DNA, 13 bp, D. melanogaster
gaaaatcatttga

SEQ ID NO: 618186 - DNA, 13 bp, D. melanogaster
gaaaatcatttgc

SEQ ID NO: 618187 - DNA, 13 bp, D. melanogaster
gaaaatccaaaag

SEQ ID NO: 618188 - DNA, 13 bp, D. melanogaster
gaaaatccaaaat

SEQ ID NO: 618189 - DNA, 13 bp, D. melanogaster
gaaaatccaaatg

SEQ ID NO: 618190 - DNA, 13 bp, D. melanogaster
gaaaatccaatac

SEQ ID NO: 618191 - DNA, 14 bp, D. melanogaster
gaaaatccaatact

SEQ ID NO: 618192 - DNA, 13 bp, D. melanogaster
gaaaatccaattt

SEQ ID NO: 618193 - DNA, 13 bp, D. melanogaster
gaaaatccattta

SEQ ID NO: 618194 - DNA, 13 bp, D. melanogaster
gaaaatccgaaaa

SEQ ID NO: 618195 - DNA, 13 bp, D. melanogaster
gaaaatccgattg

SEQ ID NO: 618196 - DNA, 13 bp, D. melanogaster
gaaaatcctttga

SEQ ID NO: 618197 - DNA, 13 bp, D. melanogaster
gaaaatccttttg

SEQ ID NO: 618198 - DNA, 13 bp, D. melanogaster
gaaaatccttttt

SEQ ID NO: 618199 - DNA, 13 bp, D. melanogaster
gaaaatcgaaaac

SEQ ID NO: 618200 - DNA, 13 bp, D. melanogaster
gaaaatcgaaaga

SEQ ID NO: 618201 - DNA, 13 bp, D. melanogaster
gaaaatcgaaagt

SEQ ID NO: 618202 - DNA, 13 bp, D. melanogaster
gaaaatcgaaata

SEQ ID NO: 618203 - DNA, 13 bp, D. melanogaster
gaaaatcgaaatc

SEQ ID NO: 618204 - DNA, 13 bp, D. melanogaster
gaaaatcgaaatt

SEQ ID NO: 618205 - DNA, 13 bp, D. melanogaster
gaaaatcgaacaa

SEQ ID NO: 618206 - DNA, 14 bp, D. melanogaster
gaaaatcgaacaaa

SEQ ID NO: 618207 - DNA, 13 bp, D. melanogaster
gaaaatcgaagaa

SEQ ID NO: 618208 - DNA, 13 bp, D. melanogaster
gaaaatcgaagca

SEQ ID NO: 618209 - DNA, 13 bp, D. melanogaster
gaaaatcgaatgg

SEQ ID NO: 618210 - DNA, 13 bp, D. melanogaster
gaaaatcgaattt

SEQ ID NO: 618211 - DNA, 13 bp, D. melanogaster
gaaaatcgagaat

SEQ ID NO: 618212 - DNA, 13 bp, D. melanogaster
gaaaatcgaggaa

SEQ ID NO: 618213 - DNA, 13 bp, D. melanogaster
gaaaatcgataaa

SEQ ID NO: 618214 - DNA, 13 bp, D. melanogaster
gaaaatcgataga

SEQ ID NO: 618215 - DNA, 13 bp, D. melanogaster
gaaaatcgatggc

SEQ ID NO: 618216 - DNA, 13 bp, D. melanogaster
gaaaatcgcacaa

SEQ ID NO: 618217 - DNA, 13 bp, D. melanogaster
gaaaatcgcattt

SEQ ID NO: 618218 - DNA, 13 bp, D. melanogaster
gaaaatcgcctgg

SEQ ID NO: 618219 - DNA, 13 bp, D. melanogaster
gaaaatcgctgaa

SEQ ID NO: 618220 - DNA, 13 bp, D. melanogaster
gaaaatcgctttt

SEQ ID NO: 618221 - DNA, 14 bp, D. melanogaster
gaaaatcggaaaac

SEQ ID NO: 618222 - DNA, 13 bp, D. melanogaster
gaaaatcggagaa

SEQ ID NO: 618223 - DNA, 13 bp, D. melanogaster
gaaaatcggcaaa

SEQ ID NO: 618224 - DNA, 13 bp, D. melanogaster
gaaaatcgggaaa

SEQ ID NO: 618225 - DNA, 14 bp, D. melanogaster
gaaaatcggggaaa

SEQ ID NO: 618226 - DNA, 13 bp, D. melanogaster
gaaaatcgtaaat

SEQ ID NO: 618227 - DNA, 13 bp, D. melanogaster
gaaaatcgtcttc

SEQ ID NO: 618228 - DNA, 13 bp, D. melanogaster
gaaaatcgtgaaa

SEQ ID NO: 618229 - DNA, 13 bp, D. melanogaster
gaaaatcgtgtgg

SEQ ID NO: 618230 - DNA, 13 bp, D. melanogaster
gaaaatcgttgaa

SEQ ID NO: 618231 - DNA, 13 bp, D. melanogaster
gaaaatcgttttg

SEQ ID NO: 618232 - DNA, 13 bp, D. melanogaster
gaaaatctattaa

SEQ ID NO: 618233 - DNA, 13 bp, D. melanogaster
gaaaatctatttt

SEQ ID NO: 618234 - DNA, 13 bp, D. melanogaster
gaaaatctcattt

SEQ ID NO: 618235 - DNA, 13 bp, D. melanogaster
gaaaatctgaaat

SEQ ID NO: 618236 - DNA, 14 bp, D. melanogaster
gaaaatctggaaaa

SEQ ID NO: 618237 - DNA, 13 bp, D. melanogaster
gaaaatctgtaaa

SEQ ID NO: 618238 - DNA, 13 bp, D. melanogaster
gaaaatcttacat

SEQ ID NO: 618239 - DNA, 13 bp, D. melanogaster
gaaaatctttaaa

SEQ ID NO: 618240 - DNA, 13 bp, D. melanogaster
gaaaatctttaga

SEQ ID NO: 618241 - DNA, 13 bp, D. melanogaster
gaaaatcttttcc

SEQ ID NO: 618242 - DNA, 13 bp, D. melanogaster
gaaaatcttttgg

SEQ ID NO: 618243 - DNA, 13 bp, D. melanogaster
gaaaatgaaaacg

SEQ ID NO: 618244 - DNA, 14 bp, D. melanogaster
gaaaatgaaaacga

SEQ ID NO: 618245 - DNA, 14 bp, D. melanogaster
gaaaatgaaaagtt

SEQ ID NO: 618246 - DNA, 13 bp, D. melanogaster
gaaaatgaaacag

SEQ ID NO: 618247 - DNA, 13 bp, D. melanogaster
gaaaatgaaactg

SEQ ID NO: 618248 - DNA, 13 bp, D. melanogaster
gaaaatgaaagtg

SEQ ID NO: 618249 - DNA, 13 bp, D. melanogaster
gaaaatgaaatca

SEQ ID NO: 618250 - DNA, 13 bp, D. melanogaster
gaaaatgaaatgg

SEQ ID NO: 618251 - DNA, 13 bp, D. melanogaster
gaaaatgaaattt

SEQ ID NO: 618252 - DNA, 13 bp, D. melanogaster
gaaaatgaagaca

SEQ ID NO: 618253 - DNA, 13 bp, D. melanogaster
gaaaatgaagctg

SEQ ID NO: 618254 - DNA, 13 bp, D. melanogaster
gaaaatgaagtga

SEQ ID NO: 618255 - DNA, 13 bp, D. melanogaster
gaaaatgaatatg

SEQ ID NO: 618256 - DNA, 13 bp, D. melanogaster
gaaaatgaatgtg

SEQ ID NO: 618257 - DNA, 14 bp, D. melanogaster
gaaaatgaatgtgt

SEQ ID NO: 618258 - DNA, 14 bp, D. melanogaster
gaaaatgacaaaat

SEQ ID NO: 618259 - DNA, 13 bp, D. melanogaster
gaaaatgacaaca

SEQ ID NO: 618260 - DNA, 13 bp, D. melanogaster
gaaaatgatcgag

SEQ ID NO: 618261 - DNA, 13 bp, D. melanogaster
gaaaatgattgaa

SEQ ID NO: 618262 - DNA, 13 bp, D. melanogaster
gaaaatgatttcc

SEQ ID NO: 618263 - DNA, 13 bp, D. melanogaster
gaaaatgatttgc

SEQ ID NO: 618264 - DNA, 14 bp, D. melanogaster
gaaaatgatttgca

SEQ ID NO: 618265 - DNA, 14 bp, D. melanogaster
gaaaatgcaaaatg

SEQ ID NO: 618266 - DNA, 13 bp, D. melanogaster
gaaaatgcaaatg

SEQ ID NO: 618267 - DNA, 14 bp, D. melanogaster
gaaaatgcaaatga

SEQ ID NO: 618268 - DNA, 14 bp, D. melanogaster
gaaaatgcaaatgc

SEQ ID NO: 618269 - DNA, 13 bp, D. melanogaster
gaaaatgcaaatt

SEQ ID NO: 618270 - DNA, 13 bp, D. melanogaster
gaaaatgcaataa

SEQ ID NO: 618271 - DNA, 13 bp, D. melanogaster
gaaaatgcaatcg

SEQ ID NO: 618272 - DNA, 13 bp, D. melanogaster
gaaaatgcaattt

SEQ ID NO: 618273 - DNA, 14 bp, D. melanogaster
gaaaatgcataaaa

SEQ ID NO: 618274 - DNA, 13 bp, D. melanogaster
gaaaatgcatatt

SEQ ID NO: 618275 - DNA, 13 bp, D. melanogaster
gaaaatgcattaa

SEQ ID NO: 618276 - DNA, 13 bp, D. melanogaster
gaaaatgcattca

SEQ ID NO: 618277 - DNA, 13 bp, D. melanogaster
gaaaatgcattgc

SEQ ID NO: 618278 - DNA, 13 bp, D. melanogaster
gaaaatgccaaaa

SEQ ID NO: 618279 - DNA, 13 bp, D. melanogaster
gaaaatgccaaag

SEQ ID NO: 618280 - DNA, 13 bp, D. melanogaster
gaaaatgccacaa

SEQ ID NO: 618281 - DNA, 13 bp, D. melanogaster
gaaaatgccagca

SEQ ID NO: 618282 - DNA, 13 bp, D. melanogaster
gaaaatgcgaaaa

SEQ ID NO: 618283 - DNA, 14 bp, D. melanogaster
gaaaatgcgaaaaa

SEQ ID NO: 618284 - DNA, 14 bp, D. melanogaster
gaaaatgcgaaaat

SEQ ID NO: 618285 - DNA, 13 bp, D. melanogaster
gaaaatgcgaaat

SEQ ID NO: 618286 - DNA, 13 bp, D. melanogaster
gaaaatgcgagga

SEQ ID NO: 618287 - DNA, 13 bp, D. melanogaster
gaaaatgcgcaaa

SEQ ID NO: 618288 - DNA, 14 bp, D. melanogaster
gaaaatgcggaaaa

SEQ ID NO: 618289 - DNA, 13 bp, D. melanogaster
gaaaatgcgggga

SEQ ID NO: 618290 - DNA, 13 bp, D. melanogaster
gaaaatgcttaaa

SEQ ID NO: 618291 - DNA, 13 bp, D. melanogaster
gaaaatgctttca

SEQ ID NO: 618292 - DNA, 13 bp, D. melanogaster
gaaaatgctttcc

SEQ ID NO: 618293 - DNA, 13 bp, D. melanogaster
gaaaatgctttct

SEQ ID NO: 618294 - DNA, 13 bp, D. melanogaster
gaaaatggaaaac

SEQ ID NO: 618295 - DNA, 14 bp, D. melanogaster
gaaaatggaaaacc

SEQ ID NO: 618296 - DNA, 14 bp, D. melanogaster
gaaaatggaaaacg

SEQ ID NO: 618297 - DNA, 13 bp, D. melanogaster
gaaaatggaaacg

SEQ ID NO: 618298 - DNA, 13 bp, D. melanogaster
gaaaatggaaatg

SEQ ID NO: 618299 - DNA, 13 bp, D. melanogaster
gaaaatggaaatt

SEQ ID NO: 618300 - DNA, 13 bp, D. melanogaster
gaaaatggaatat

SEQ ID NO: 618301 - DNA, 13 bp, D. melanogaster
gaaaatggaatgg

SEQ ID NO: 618302 - DNA, 13 bp, D. melanogaster
gaaaatggagcaa

SEQ ID NO: 618303 - DNA, 13 bp, D. melanogaster
gaaaatggatgga

SEQ ID NO: 618304 - DNA, 13 bp, D. melanogaster
gaaaatggcaaaa

SEQ ID NO: 618305 - DNA, 13 bp, D. melanogaster
gaaaatggcaaag

SEQ ID NO: 618306 - DNA, 14 bp, D. melanogaster
gaaaatggcaaatg

SEQ ID NO: 618307 - DNA, 13 bp, D. melanogaster
gaaaatggcaagc

SEQ ID NO: 618308 - DNA, 13 bp, D. melanogaster
gaaaatggcagcc

SEQ ID NO: 618309 - DNA, 13 bp, D. melanogaster
gaaaatggcattg

SEQ ID NO: 618310 - DNA, 14 bp, D. melanogaster
gaaaatggccaaaa

SEQ ID NO: 618311 - DNA, 13 bp, D. melanogaster
gaaaatggccaag

SEQ ID NO: 618312 - DNA, 13 bp, D. melanogaster
gaaaatggctgaa

SEQ ID NO: 618313 - DNA, 13 bp, D. melanogaster
gaaaatggctggg

SEQ ID NO: 618314 - DNA, 14 bp, D. melanogaster
gaaaatgggaaaac

SEQ ID NO: 618315 - DNA, 13 bp, D. melanogaster
gaaaatgggaaca

SEQ ID NO: 618316 - DNA, 14 bp, D. melanogaster
gaaaatgggaattt

SEQ ID NO: 618317 - DNA, 13 bp, D. melanogaster
gaaaatgggcaag

SEQ ID NO: 618318 - DNA, 13 bp, D. melanogaster
gaaaatggggggt

SEQ ID NO: 618319 - DNA, 13 bp, D. melanogaster
gaaaatggggtgg

SEQ ID NO: 618320 - DNA, 13 bp, D. melanogaster
gaaaatgggttgg

SEQ ID NO: 618321 - DNA, 13 bp, D. melanogaster
gaaaatggtaatg

SEQ ID NO: 618322 - DNA, 13 bp, D. melanogaster
gaaaatggtgaaa

SEQ ID NO: 618323 - DNA, 13 bp, D. melanogaster
gaaaatggttggg

SEQ ID NO: 618324 - DNA, 13 bp, D. melanogaster
gaaaatggttttt

SEQ ID NO: 618325 - DNA, 14 bp, D. melanogaster
gaaaatggttttta

SEQ ID NO: 618326 - DNA, 13 bp, D. melanogaster
gaaaatgtaaaac

SEQ ID NO: 618327 - DNA, 13 bp, D. melanogaster
gaaaatgtaaatg

SEQ ID NO: 618328 - DNA, 13 bp, D. melanogaster
gaaaatgtacaaa

SEQ ID NO: 618329 - DNA, 14 bp, D. melanogaster
gaaaatgtacaaaa

SEQ ID NO: 618330 - DNA, 13 bp, D. melanogaster
gaaaatgtacttc

SEQ ID NO: 618331 - DNA, 14 bp, D. melanogaster
gaaaatgtatttat

SEQ ID NO: 618332 - DNA, 13 bp, D. melanogaster
gaaaatgtcaaag

SEQ ID NO: 618333 - DNA, 13 bp, D. melanogaster
gaaaatgtcaagt

SEQ ID NO: 618334 - DNA, 13 bp, D. melanogaster
gaaaatgtcgaaa

SEQ ID NO: 618335 - DNA, 14 bp, D. melanogaster
gaaaatgtgaaaat

SEQ ID NO: 618336 - DNA, 14 bp, D. melanogaster
gaaaatgtgaaaca

SEQ ID NO: 618337 - DNA, 13 bp, D. melanogaster
gaaaatgtgaaag

SEQ ID NO: 618338 - DNA, 13 bp, D. melanogaster
gaaaatgtgaatg

SEQ ID NO: 618339 - DNA, 13 bp, D. melanogaster
gaaaatgtgcaaa

SEQ ID NO: 618340 - DNA, 13 bp, D. melanogaster
gaaaatgtgccaa

SEQ ID NO: 618341 - DNA, 14 bp, D. melanogaster
gaaaatgtggaaat

SEQ ID NO: 618342 - DNA, 13 bp, D. melanogaster
gaaaatgtggaat

SEQ ID NO: 618343 - DNA, 14 bp, D. melanogaster
gaaaatgtgggaaa

SEQ ID NO: 618344 - DNA, 13 bp, D. melanogaster
gaaaatgtgggcg

SEQ ID NO: 618345 - DNA, 13 bp, D. melanogaster
gaaaatgtgggtg

SEQ ID NO: 618346 - DNA, 13 bp, D. melanogaster
gaaaatgtgtaaa

SEQ ID NO: 618347 - DNA, 13 bp, D. melanogaster
gaaaatgtgtcaa

SEQ ID NO: 618348 - DNA, 14 bp, D. melanogaster
gaaaatgtgtgaaa

SEQ ID NO: 618349 - DNA, 13 bp, D. melanogaster
gaaaatgtgttgt

SEQ ID NO: 618350 - DNA, 13 bp, D. melanogaster
gaaaatgtgtttt

SEQ ID NO: 618351 - DNA, 14 bp, D. melanogaster
gaaaatgtgttttt

SEQ ID NO: 618352 - DNA, 13 bp, D. melanogaster
gaaaatgttattt

SEQ ID NO: 618353 - DNA, 13 bp, D. melanogaster
gaaaatgttccaa

SEQ ID NO: 618354 - DNA, 13 bp, D. melanogaster
gaaaatgttcttt

SEQ ID NO: 618355 - DNA, 14 bp, D. melanogaster
gaaaatgttgaaaa

SEQ ID NO: 618356 - DNA, 13 bp, D. melanogaster
gaaaatgttgcag

SEQ ID NO: 618357 - DNA, 14 bp, D. melanogaster
gaaaatgttggaaa

SEQ ID NO: 618358 - DNA, 13 bp, D. melanogaster
gaaaatgttgtaa

SEQ ID NO: 618359 - DNA, 13 bp, D. melanogaster
gaaaatgtttaca

SEQ ID NO: 618360 - DNA, 13 bp, D. melanogaster
gaaaatgtttata

SEQ ID NO: 618361 - DNA, 14 bp, D. melanogaster
gaaaatgtttcaaa

SEQ ID NO: 618362 - DNA, 13 bp, D. melanogaster
gaaaatgtttgag

SEQ ID NO: 618363 - DNA, 13 bp, D. melanogaster
gaaaatgtttgct

SEQ ID NO: 618364 - DNA, 13 bp, D. melanogaster
gaaaatgtttgtt

SEQ ID NO: 618365 - DNA, 13 bp, D. melanogaster
gaaaatgtttttt

SEQ ID NO: 618366 - DNA, 13 bp, D. melanogaster
gaaaattaaaatc

SEQ ID NO: 618367 - DNA, 14 bp, D. melanogaster
gaaaattaaaatct

SEQ ID NO: 618368 - DNA, 13 bp, D. melanogaster
gaaaattaaatca

SEQ ID NO: 618369 - DNA, 13 bp, D. melanogaster
gaaaattaactaa

SEQ ID NO: 618370 - DNA, 13 bp, D. melanogaster
gaaaattaagtga

SEQ ID NO: 618371 - DNA, 13 bp, D. melanogaster
gaaaattaagttt

SEQ ID NO: 618372 - DNA, 13 bp, D. melanogaster
gaaaattaattag

SEQ ID NO: 618373 - DNA, 13 bp, D. melanogaster
gaaaattaattgc

SEQ ID NO: 618374 - DNA, 13 bp, D. melanogaster
gaaaattacaatt

SEQ ID NO: 618375 - DNA, 13 bp, D. melanogaster
gaaaattacattt

SEQ ID NO: 618376 - DNA, 14 bp, D. melanogaster
gaaaattacatttt

SEQ ID NO: 618377 - DNA, 13 bp, D. melanogaster
gaaaattacttta

SEQ ID NO: 618378 - DNA, 13 bp, D. melanogaster
gaaaattatacaa

SEQ ID NO: 618379 - DNA, 13 bp, D. melanogaster
gaaaattatattg

SEQ ID NO: 618380 - DNA, 13 bp, D. melanogaster
gaaaattatgaag

SEQ ID NO: 618381 - DNA, 13 bp, D. melanogaster
gaaaattattatg

SEQ ID NO: 618382 - DNA, 13 bp, D. melanogaster
gaaaattattcaa

SEQ ID NO: 618383 - DNA, 14 bp, D. melanogaster
gaaaattatttaga

SEQ ID NO: 618384 - DNA, 13 bp, D. melanogaster
gaaaattcaaatt

SEQ ID NO: 618385 - DNA, 14 bp, D. melanogaster
gaaaattcaaattg

SEQ ID NO: 618386 - DNA, 13 bp, D. melanogaster
gaaaattcaactt

SEQ ID NO: 618387 - DNA, 13 bp, D. melanogaster
gaaaattcaagaa

SEQ ID NO: 618388 - DNA, 13 bp, D. melanogaster
gaaaattcaataa

SEQ ID NO: 618389 - DNA, 13 bp, D. melanogaster
gaaaattcaatta

SEQ ID NO: 618390 - DNA, 13 bp, D. melanogaster
gaaaattcataaa

SEQ ID NO: 618391 - DNA, 13 bp, D. melanogaster
gaaaattccaaaa

SEQ ID NO: 618392 - DNA, 13 bp, D. melanogaster
gaaaattccaaga

SEQ ID NO: 618393 - DNA, 14 bp, D. melanogaster
gaaaattccattaa

SEQ ID NO: 618394 - DNA, 13 bp, D. melanogaster
gaaaattcccaaa

SEQ ID NO: 618395 - DNA, 13 bp, D. melanogaster
gaaaattcccatt

SEQ ID NO: 618396 - DNA, 13 bp, D. melanogaster
gaaaattcccttt

SEQ ID NO: 618397 - DNA, 13 bp, D. melanogaster
gaaaattccgttt

SEQ ID NO: 618398 - DNA, 14 bp, D. melanogaster
gaaaattccgtttg

SEQ ID NO: 618399 - DNA, 13 bp, D. melanogaster
gaaaattcgaaac

SEQ ID NO: 618400 - DNA, 13 bp, D. melanogaster
gaaaattcgaatc

SEQ ID NO: 618401 - DNA, 13 bp, D. melanogaster
gaaaattcgattt

SEQ ID NO: 618402 - DNA, 13 bp, D. melanogaster
gaaaattcgctaa

SEQ ID NO: 618403 - DNA, 14 bp, D. melanogaster
gaaaattcggaaaa

SEQ ID NO: 618404 - DNA, 13 bp, D. melanogaster
gaaaattctaaaa

SEQ ID NO: 618405 - DNA, 13 bp, D. melanogaster
gaaaattctgaaa

SEQ ID NO: 618406 - DNA, 13 bp, D. melanogaster
gaaaattctggaa

SEQ ID NO: 618407 - DNA, 13 bp, D. melanogaster
gaaaattctgttt

SEQ ID NO: 618408 - DNA, 13 bp, D. melanogaster
gaaaattcttcaa

SEQ ID NO: 618409 - DNA, 13 bp, D. melanogaster
gaaaattcttgtt

SEQ ID NO: 618410 - DNA, 14 bp, D. melanogaster
gaaaattgaaaact

SEQ ID NO: 618411 - DNA, 13 bp, D. melanogaster
gaaaattgaaatt

SEQ ID NO: 618412 - DNA, 13 bp, D. melanogaster
gaaaattgaacaa

SEQ ID NO: 618413 - DNA, 13 bp, D. melanogaster
gaaaattgaatat

SEQ ID NO: 618414 - DNA, 13 bp, D. melanogaster
gaaaattgaattg

SEQ ID NO: 618415 - DNA, 13 bp, D. melanogaster
gaaaattgaattt

SEQ ID NO: 618416 - DNA, 13 bp, D. melanogaster
gaaaattgaccca

SEQ ID NO: 618417 - DNA, 13 bp, D. melanogaster
gaaaattgagcaa

SEQ ID NO: 618418 - DNA, 13 bp, D. melanogaster
gaaaattgattta

SEQ ID NO: 618419 - DNA, 13 bp, D. melanogaster
gaaaattgatttt

SEQ ID NO: 618420 - DNA, 13 bp, D. melanogaster
gaaaattgcaaaa

SEQ ID NO: 618421 - DNA, 13 bp, D. melanogaster
gaaaattgcaaat

SEQ ID NO: 618422 - DNA, 13 bp, D. melanogaster
gaaaattgcaaca

SEQ ID NO: 618423 - DNA, 14 bp, D. melanogaster
gaaaattgcaattt

SEQ ID NO: 618424 - DNA, 13 bp, D. melanogaster
gaaaattgcactt

SEQ ID NO: 618425 - DNA, 13 bp, D. melanogaster
gaaaattgcagaa

SEQ ID NO: 618426 - DNA, 13 bp, D. melanogaster
gaaaattgcataa

SEQ ID NO: 618427 - DNA, 13 bp, D. melanogaster
gaaaattgcatat

SEQ ID NO: 618428 - DNA, 13 bp, D. melanogaster
gaaaattgcattg

SEQ ID NO: 618429 - DNA, 14 bp, D. melanogaster
gaaaattgcattta

SEQ ID NO: 618430 - DNA, 13 bp, D. melanogaster
gaaaattgccaaa

SEQ ID NO: 618431 - DNA, 13 bp, D. melanogaster
gaaaattgccagc

SEQ ID NO: 618432 - DNA, 13 bp, D. melanogaster
gaaaattgccttt

SEQ ID NO: 618433 - DNA, 13 bp, D. melanogaster
gaaaattgcgaaa

SEQ ID NO: 618434 - DNA, 13 bp, D. melanogaster
gaaaattgcgggg

SEQ ID NO: 618435 - DNA, 13 bp, D. melanogaster
gaaaattgctcaa

SEQ ID NO: 618436 - DNA, 13 bp, D. melanogaster
gaaaattgctggg

SEQ ID NO: 618437 - DNA, 13 bp, D. melanogaster
gaaaattgctttt

SEQ ID NO: 618438 - DNA, 14 bp, D. melanogaster
gaaaattggaaaat

SEQ ID NO: 618439 - DNA, 13 bp, D. melanogaster
gaaaattggccaa

SEQ ID NO: 618440 - DNA, 13 bp, D. melanogaster
gaaaattggtttt

SEQ ID NO: 618441 - DNA, 13 bp, D. melanogaster
gaaaattgtaaat

SEQ ID NO: 618442 - DNA, 13 bp, D. melanogaster
gaaaattgtaatg

SEQ ID NO: 618443 - DNA, 13 bp, D. melanogaster
gaaaattgtatat

SEQ ID NO: 618444 - DNA, 13 bp, D. melanogaster
gaaaattgtcaaa

SEQ ID NO: 618445 - DNA, 13 bp, D. melanogaster
gaaaattgtcaac

SEQ ID NO: 618446 - DNA, 13 bp, D. melanogaster
gaaaattgtgaaa

SEQ ID NO: 618447 - DNA, 14 bp, D. melanogaster
gaaaattgtgaaaa

SEQ ID NO: 618448 - DNA, 13 bp, D. melanogaster
gaaaattgtgaat

SEQ ID NO: 618449 - DNA, 13 bp, D. melanogaster
gaaaattgtgcaa

SEQ ID NO: 618450 - DNA, 14 bp, D. melanogaster
gaaaattgtgcaaa

SEQ ID NO: 618451 - DNA, 13 bp, D. melanogaster
gaaaattgtggca

SEQ ID NO: 618452 - DNA, 13 bp, D. melanogaster
gaaaattgttatt

SEQ ID NO: 618453 - DNA, 13 bp, D. melanogaster
gaaaattgttgaa

SEQ ID NO: 618454 - DNA, 13 bp, D. melanogaster
gaaaattgtttat

SEQ ID NO: 618455 - DNA, 14 bp, D. melanogaster
gaaaattgtttatt

SEQ ID NO: 618456 - DNA, 13 bp, D. melanogaster
gaaaattgttttg

SEQ ID NO: 618457 - DNA, 13 bp, D. melanogaster
gaaaattgttttt

SEQ ID NO: 618458 - DNA, 14 bp, D. melanogaster
gaaaattgtttttc

SEQ ID NO: 618459 - DNA, 13 bp, D. melanogaster
gaaaatttaaatc

SEQ ID NO: 618460 - DNA, 13 bp, D. melanogaster
gaaaatttaagtt

SEQ ID NO: 618461 - DNA, 14 bp, D. melanogaster
gaaaatttaatttg

SEQ ID NO: 618462 - DNA, 14 bp, D. melanogaster
gaaaatttacattt

SEQ ID NO: 618463 - DNA, 13 bp, D. melanogaster
gaaaatttaccca

SEQ ID NO: 618464 - DNA, 13 bp, D. melanogaster
gaaaatttatcag

SEQ ID NO: 618465 - DNA, 13 bp, D. melanogaster
gaaaatttatcga

SEQ ID NO: 618466 - DNA, 13 bp, D. melanogaster
gaaaatttatgaa

SEQ ID NO: 618467 - DNA, 13 bp, D. melanogaster
gaaaatttatgca

SEQ ID NO: 618468 - DNA, 13 bp, D. melanogaster
gaaaatttcacaa

SEQ ID NO: 618469 - DNA, 13 bp, D. melanogaster
gaaaatttcactt

SEQ ID NO: 618470 - DNA, 13 bp, D. melanogaster
gaaaatttcataa

SEQ ID NO: 618471 - DNA, 13 bp, D. melanogaster
gaaaatttcatta

SEQ ID NO: 618472 - DNA, 13 bp, D. melanogaster
gaaaatttccaca

SEQ ID NO: 618473 - DNA, 13 bp, D. melanogaster
gaaaatttgaaat

SEQ ID NO: 618474 - DNA, 14 bp, D. melanogaster
gaaaatttgaaatt

SEQ ID NO: 618475 - DNA, 13 bp, D. melanogaster
gaaaatttgaata

SEQ ID NO: 618476 - DNA, 14 bp, D. melanogaster
gaaaatttgacatt

SEQ ID NO: 618477 - DNA, 13 bp, D. melanogaster
gaaaatttgagca

SEQ ID NO: 618478 - DNA, 13 bp, D. melanogaster
gaaaatttggaaa

SEQ ID NO: 618479 - DNA, 13 bp, D. melanogaster
gaaaatttgtcaa

SEQ ID NO: 618480 - DNA, 13 bp, D. melanogaster
gaaaatttgtgga

SEQ ID NO: 618481 - DNA, 13 bp, D. melanogaster
gaaaatttgttaa

SEQ ID NO: 618482 - DNA, 13 bp, D. melanogaster
gaaaatttgttga

SEQ ID NO: 618483 - DNA, 13 bp, D. melanogaster
gaaaattttacaa

SEQ ID NO: 618484 - DNA, 14 bp, D. melanogaster
gaaaattttagttt

SEQ ID NO: 618485 - DNA, 13 bp, D. melanogaster
gaaaattttcaat

SEQ ID NO: 618486 - DNA, 13 bp, D. melanogaster
gaaaattttcatt

SEQ ID NO: 618487 - DNA, 13 bp, D. melanogaster
gaaaattttccaa

SEQ ID NO: 618488 - DNA, 13 bp, D. melanogaster
gaaaattttcgaa

SEQ ID NO: 618489 - DNA, 13 bp, D. melanogaster
gaaaattttgttt

SEQ ID NO: 618490 - DNA, 13 bp, D. melanogaster
gaaaatttttcct

SEQ ID NO: 618491 - DNA, 13 bp, D. melanogaster
gaaacaaaaactg

SEQ ID NO: 618492 - DNA, 14 bp, D. melanogaster
gaaacaaaaactga

SEQ ID NO: 618493 - DNA, 14 bp, D. melanogaster
gaaacaaaaatatt

SEQ ID NO: 618494 - DNA, 13 bp, D. melanogaster
gaaacaaaagtca

SEQ ID NO: 618495 - DNA, 13 bp, D. melanogaster
gaaacaaaatatt

SEQ ID NO: 618496 - DNA, 14 bp, D. melanogaster
gaaacaaaatgata

SEQ ID NO: 618497 - DNA, 13 bp, D. melanogaster
gaaacaaaatggc

SEQ ID NO: 618498 - DNA, 13 bp, D. melanogaster
gaaacaaaattta

SEQ ID NO: 618499 - DNA, 13 bp, D. melanogaster
gaaacaaacttgc

SEQ ID NO: 618500 - DNA, 13 bp, D. melanogaster
gaaacaaatattt

SEQ ID NO: 618501 - DNA, 13 bp, D. melanogaster
gaaacaaatcgaa

SEQ ID NO: 618502 - DNA, 13 bp, D. melanogaster
gaaacaaatgaat

SEQ ID NO: 618503 - DNA, 14 bp, D. melanogaster
gaaacaaattaaat

SEQ ID NO: 618504 - DNA, 13 bp, D. melanogaster
gaaacaaattcaa

SEQ ID NO: 618505 - DNA, 13 bp, D. melanogaster
gaaacaaatttaa

SEQ ID NO: 618506 - DNA, 13 bp, D. melanogaster
gaaacaaatttgc

SEQ ID NO: 618507 - DNA, 13 bp, D. melanogaster
gaaacaacaaatt

SEQ ID NO: 618508 - DNA, 14 bp, D. melanogaster
gaaacaacaaattc

SEQ ID NO: 618509 - DNA, 14 bp, D. melanogaster
gaaacaacaacaat

SEQ ID NO: 618510 - DNA, 13 bp, D. melanogaster
gaaacaagagtta

SEQ ID NO: 618511 - DNA, 13 bp, D. melanogaster
gaaacaataaatc

SEQ ID NO: 618512 - DNA, 14 bp, D. melanogaster
gaaacaataaatcg

SEQ ID NO: 618513 - DNA, 13 bp, D. melanogaster
gaaacaatataat

SEQ ID NO: 618514 - DNA, 13 bp, D. melanogaster
gaaacaatattta

SEQ ID NO: 618515 - DNA, 13 bp, D. melanogaster
gaaacaatatttc

SEQ ID NO: 618516 - DNA, 13 bp, D. melanogaster
gaaacaatcaata

SEQ ID NO: 618517 - DNA, 13 bp, D. melanogaster
gaaacaatcctct

SEQ ID NO: 618518 - DNA, 13 bp, D. melanogaster
gaaacaatgccaa

SEQ ID NO: 618519 - DNA, 13 bp, D. melanogaster
gaaacaatggcaa

SEQ ID NO: 618520 - DNA, 13 bp, D. melanogaster
gaaacaattgaaa

SEQ ID NO: 618521 - DNA, 13 bp, D. melanogaster
gaaacaattgcaa

SEQ ID NO: 618522 - DNA, 14 bp, D. melanogaster
gaaacaattgtttt

SEQ ID NO: 618523 - DNA, 13 bp, D. melanogaster
gaaacaatttcga

SEQ ID NO: 618524 - DNA, 13 bp, D. melanogaster
gaaacacactcac

SEQ ID NO: 618525 - DNA, 13 bp, D. melanogaster
gaaacaccaaaat

SEQ ID NO: 618526 - DNA, 14 bp, D. melanogaster
gaaacacccatgtg

SEQ ID NO: 618527 - DNA, 16 bp, D. melanogaster
gaaacacgtctccacc

SEQ ID NO: 618528 - DNA, 13 bp, D. melanogaster
gaaacactgaaaa

SEQ ID NO: 618529 - DNA, 13 bp, D. melanogaster
gaaacagaaacat

SEQ ID NO: 618530 - DNA, 13 bp, D. melanogaster
gaaacagaaatta

SEQ ID NO: 618531 - DNA, 13 bp, D. melanogaster
gaaacagcaacag

SEQ ID NO: 618532 - DNA, 14 bp, D. melanogaster
gaaacagcagaaca

SEQ ID NO: 618533 - DNA, 14 bp, D. melanogaster
gaaacagcagagca

SEQ ID NO: 618534 - DNA, 13 bp, D. melanogaster
gaaacagcagcag

SEQ ID NO: 618535 - DNA, 13 bp, D. melanogaster
gaaacagctgttt

SEQ ID NO: 618536 - DNA, 13 bp, D. melanogaster
gaaacagttaaaa

SEQ ID NO: 618537 - DNA, 13 bp, D. melanogaster
gaaacagttgctt

SEQ ID NO: 618538 - DNA, 13 bp, D. melanogaster
gaaacagttttat

SEQ ID NO: 618539 - DNA, 13 bp, D. melanogaster
gaaacatacattt

SEQ ID NO: 618540 - DNA, 13 bp, D. melanogaster
gaaacatagaaac

SEQ ID NO: 618541 - DNA, 13 bp, D. melanogaster
gaaacatatatat

SEQ ID NO: 618542 - DNA, 14 bp, D. melanogaster
gaaacatattctca

SEQ ID NO: 618543 - DNA, 13 bp, D. melanogaster
gaaacatatttac

SEQ ID NO: 618544 - DNA, 13 bp, D. melanogaster
gaaacatgaaaca

SEQ ID NO: 618545 - DNA, 13 bp, D. melanogaster
gaaacattaaaca

SEQ ID NO: 618546 - DNA, 13 bp, D. melanogaster
gaaacattgcatg

SEQ ID NO: 618547 - DNA, 13 bp, D. melanogaster
gaaacatttaatt

SEQ ID NO: 618548 - DNA, 13 bp, D. melanogaster
gaaacatttcaaa

SEQ ID NO: 618549 - DNA, 13 bp, D. melanogaster
gaaacattttcat

SEQ ID NO: 618550 - DNA, 13 bp, D. melanogaster
gaaacattttgat

SEQ ID NO: 618551 - DNA, 13 bp, D. melanogaster
gaaacatttttaa

SEQ ID NO: 618552 - DNA, 14 bp, D. melanogaster
gaaacatttttgaa

SEQ ID NO: 618553 - DNA, 13 bp, D. melanogaster
gaaaccaaaactg

SEQ ID NO: 618554 - DNA, 13 bp, D. melanogaster
gaaaccaaaatgt

SEQ ID NO: 618555 - DNA, 13 bp, D. melanogaster
gaaaccaaaatta

SEQ ID NO: 618556 - DNA, 13 bp, D. melanogaster
gaaaccaaaattt

SEQ ID NO: 618557 - DNA, 13 bp, D. melanogaster
gaaaccaaaccga

SEQ ID NO: 618558 - DNA, 13 bp, D. melanogaster
gaaaccaaatatt

SEQ ID NO: 618559 - DNA, 14 bp, D. melanogaster
gaaaccaaatcaaa

SEQ ID NO: 618560 - DNA, 14 bp, D. melanogaster
gaaaccaaatgaaa

SEQ ID NO: 618561 - DNA, 15 bp, D. melanogaster
gaaaccaacattact

SEQ ID NO: 618562 - DNA, 13 bp, D. melanogaster
gaaaccaactgaa

SEQ ID NO: 618563 - DNA, 13 bp, D. melanogaster
gaaaccaatatgg

SEQ ID NO: 618564 - DNA, 13 bp, D. melanogaster
gaaaccaatctgg

SEQ ID NO: 618565 - DNA, 13 bp, D. melanogaster
gaaaccactgatt

SEQ ID NO: 618566 - DNA, 13 bp, D. melanogaster
gaaaccatttgta

SEQ ID NO: 618567 - DNA, 13 bp, D. melanogaster
gaaacccactttt

SEQ ID NO: 618568 - DNA, 13 bp, D. melanogaster
gaaaccccgaaaa

SEQ ID NO: 618569 - DNA, 13 bp, D. melanogaster
gaaacccgaacag

SEQ ID NO: 618570 - DNA, 14 bp, D. melanogaster
gaaacccgaacaga

SEQ ID NO: 618571 - DNA, 13 bp, D. melanogaster
gaaacccgtttgc

SEQ ID NO: 618572 - DNA, 13 bp, D. melanogaster
gaaaccgaaaaat

SEQ ID NO: 618573 - DNA, 14 bp, D. melanogaster
gaaaccgaaaaatc

SEQ ID NO: 618574 - DNA, 13 bp, D. melanogaster
gaaaccgaaacag

SEQ ID NO: 618575 - DNA, 14 bp, D. melanogaster
gaaaccgaaacaga

SEQ ID NO: 618576 - DNA, 13 bp, D. melanogaster
gaaaccgaaacca

SEQ ID NO: 618577 - DNA, 13 bp, D. melanogaster
gaaaccgaaaccc

SEQ ID NO: 618578 - DNA, 13 bp, D. melanogaster
gaaaccgaaactc

SEQ ID NO: 618579 - DNA, 13 bp, D. melanogaster
gaaaccgaaactt

SEQ ID NO: 618580 - DNA, 13 bp, D. melanogaster
gaaaccgaaattg

SEQ ID NO: 618581 - DNA, 13 bp, D. melanogaster
gaaaccgaaccaa

SEQ ID NO: 618582 - DNA, 13 bp, D. melanogaster
gaaaccgaacttc

SEQ ID NO: 618583 - DNA, 13 bp, D. melanogaster
gaaaccgaatccg

SEQ ID NO: 618584 - DNA, 13 bp, D. melanogaster
gaaaccgaatcga

SEQ ID NO: 618585 - DNA, 13 bp, D. melanogaster
gaaaccgcaaaat

SEQ ID NO: 618586 - DNA, 13 bp, D. melanogaster
gaaaccgcatcga

SEQ ID NO: 618587 - DNA, 13 bp, D. melanogaster
gaaacctaaaaat

SEQ ID NO: 618588 - DNA, 13 bp, D. melanogaster
gaaacctaaacca

SEQ ID NO: 618589 - DNA, 13 bp, D. melanogaster
gaaaccttcttct

SEQ ID NO: 618590 - DNA, 13 bp, D. melanogaster
gaaacgaaaatat

SEQ ID NO: 618591 - DNA, 13 bp, D. melanogaster
gaaacgaaaccga

SEQ ID NO: 618592 - DNA, 13 bp, D. melanogaster
gaaacgaaacgag

SEQ ID NO: 618593 - DNA, 13 bp, D. melanogaster
gaaacgaaacgga

SEQ ID NO: 618594 - DNA, 13 bp, D. melanogaster
gaaacgaaagact

SEQ ID NO: 618595 - DNA, 13 bp, D. melanogaster
gaaacgaaagcga

SEQ ID NO: 618596 - DNA, 14 bp, D. melanogaster
gaaacgaaatcaaa

SEQ ID NO: 618597 - DNA, 13 bp, D. melanogaster
gaaacgaaatcga

SEQ ID NO: 618598 - DNA, 13 bp, D. melanogaster
gaaacgaaatgaa

SEQ ID NO: 618599 - DNA, 14 bp, D. melanogaster
gaaacgaaatgaaa

SEQ ID NO: 618600 - DNA, 14 bp, D. melanogaster
gaaacgaaatgaat

SEQ ID NO: 618601 - DNA, 13 bp, D. melanogaster
gaaacgaaatgga

SEQ ID NO: 618602 - DNA, 14 bp, D. melanogaster
gaaacgaaattaaa

SEQ ID NO: 618603 - DNA, 13 bp, D. melanogaster
gaaacgaaattga

SEQ ID NO: 618604 - DNA, 13 bp, D. melanogaster
gaaacgaactgaa

SEQ ID NO: 618605 - DNA, 13 bp, D. melanogaster
gaaacgaagcgaa

SEQ ID NO: 618606 - DNA, 13 bp, D. melanogaster
gaaacgaatcgaa

SEQ ID NO: 618607 - DNA, 13 bp, D. melanogaster
gaaacgaattcaa

SEQ ID NO: 618608 - DNA, 13 bp, D. melanogaster
gaaacgaattgaa

SEQ ID NO: 618609 - DNA, 13 bp, D. melanogaster
gaaacgagttggc

SEQ ID NO: 618610 - DNA, 13 bp, D. melanogaster
gaaacgatgtggc

SEQ ID NO: 618611 - DNA, 14 bp, D. melanogaster
gaaacgattctgcc

SEQ ID NO: 618612 - DNA, 13 bp, D. melanogaster
gaaacgcaataaa

SEQ ID NO: 618613 - DNA, 13 bp, D. melanogaster
gaaacgcaatcaa

SEQ ID NO: 618614 - DNA, 13 bp, D. melanogaster
gaaacgcacacac

SEQ ID NO: 618615 - DNA, 14 bp, D. melanogaster
gaaacgcacacaca

SEQ ID NO: 618616 - DNA, 13 bp, D. melanogaster
gaaacgcactgta

SEQ ID NO: 618617 - DNA, 13 bp, D. melanogaster
gaaacgcactgtc

SEQ ID NO: 618618 - DNA, 13 bp, D. melanogaster
gaaacgcactgtt

SEQ ID NO: 618619 - DNA, 13 bp, D. melanogaster
gaaacgcattaat

SEQ ID NO: 618620 - DNA, 13 bp, D. melanogaster
gaaacgcttcctt

SEQ ID NO: 618621 - DNA, 14 bp, D. melanogaster
gaaacgcttccttt

SEQ ID NO: 618622 - DNA, 13 bp, D. melanogaster
gaaacgctttctt

SEQ ID NO: 618623 - DNA, 13 bp, D. melanogaster
gaaacggaaaagt

SEQ ID NO: 618624 - DNA, 13 bp, D. melanogaster
gaaacggaaacgc

SEQ ID NO: 618625 - DNA, 13 bp, D. melanogaster
gaaacggaaacgt

SEQ ID NO: 618626 - DNA, 13 bp, D. melanogaster
gaaacggaaactg

SEQ ID NO: 618627 - DNA, 13 bp, D. melanogaster
gaaacggaaatcg

SEQ ID NO: 618628 - DNA, 14 bp, D. melanogaster
gaaacggaaatgaa

SEQ ID NO: 618629 - DNA, 13 bp, D. melanogaster
gaaacggaaatta

SEQ ID NO: 618630 - DNA, 13 bp, D. melanogaster
gaaacggaaattg

SEQ ID NO: 618631 - DNA, 14 bp, D. melanogaster
gaaacggaacggaa

SEQ ID NO: 618632 - DNA, 13 bp, D. melanogaster
gaaacggaagcca

SEQ ID NO: 618633 - DNA, 13 bp, D. melanogaster
gaaacggaagtga

SEQ ID NO: 618634 - DNA, 13 bp, D. melanogaster
gaaacggaagttg

SEQ ID NO: 618635 - DNA, 13 bp, D. melanogaster
gaaacggttcaaa

SEQ ID NO: 618636 - DNA, 14 bp, D. melanogaster
gaaacgtgttcaaa

SEQ ID NO: 618637 - DNA, 13 bp, D. melanogaster
gaaactaaaaact

SEQ ID NO: 618638 - DNA, 13 bp, D. melanogaster
gaaactaaaaagt

SEQ ID NO: 618639 - DNA, 13 bp, D. melanogaster
gaaactaaaacta

SEQ ID NO: 618640 - DNA, 13 bp, D. melanogaster
gaaactaaaagat

SEQ ID NO: 618641 - DNA, 13 bp, D. melanogaster
gaaactaaaatat

SEQ ID NO: 618642 - DNA, 13 bp, D. melanogaster
gaaactaaaatgt

SEQ ID NO: 618643 - DNA, 13 bp, D. melanogaster
gaaactaaatcta

SEQ ID NO: 618644 - DNA, 13 bp, D. melanogaster
gaaactaatattt

SEQ ID NO: 618645 - DNA, 13 bp, D. melanogaster
gaaactaattaat

SEQ ID NO: 618646 - DNA, 13 bp, D. melanogaster
gaaactacacctg

SEQ ID NO: 618647 - DNA, 13 bp, D. melanogaster
gaaactagaaact

SEQ ID NO: 618648 - DNA, 13 bp, D. melanogaster
gaaactatatacc

SEQ ID NO: 618649 - DNA, 13 bp, D. melanogaster
gaaactatatcca

SEQ ID NO: 618650 - DNA, 13 bp, D. melanogaster
gaaactatccacc

SEQ ID NO: 618651 - DNA, 13 bp, D. melanogaster
gaaactatgaaaa

SEQ ID NO: 618652 - DNA, 13 bp, D. melanogaster
gaaactatggctt

SEQ ID NO: 618653 - DNA, 13 bp, D. melanogaster
gaaactattgaag

SEQ ID NO: 618654 - DNA, 13 bp, D. melanogaster
gaaactatttaat

SEQ ID NO: 618655 - DNA, 13 bp, D. melanogaster
gaaactcaaaaga

SEQ ID NO: 618656 - DNA, 13 bp, D. melanogaster
gaaactcaaacat

SEQ ID NO: 618657 - DNA, 13 bp, D. melanogaster
gaaactcaaactc

SEQ ID NO: 618658 - DNA, 14 bp, D. melanogaster
gaaactcttctcct

SEQ ID NO: 618659 - DNA, 13 bp, D. melanogaster
gaaactcttgaaa

SEQ ID NO: 618660 - DNA, 13 bp, D. melanogaster
gaaactctttaca

SEQ ID NO: 618661 - DNA, 13 bp, D. melanogaster
gaaactgaaaacg

SEQ ID NO: 618662 - DNA, 13 bp, D. melanogaster
gaaactgaaaact

SEQ ID NO: 618663 - DNA, 14 bp, D. melanogaster
gaaactgaaaactg

SEQ ID NO: 618664 - DNA, 13 bp, D. melanogaster
gaaactgaaaagt

SEQ ID NO: 618665 - DNA, 13 bp, D. melanogaster
gaaactgaaaata

SEQ ID NO: 618666 - DNA, 14 bp, D. melanogaster
gaaactgaaaatga

SEQ ID NO: 618667 - DNA, 14 bp, D. melanogaster
gaaactgaaactgg

SEQ ID NO: 618668 - DNA, 13 bp, D. melanogaster
gaaactgaaattg

SEQ ID NO: 618669 - DNA, 13 bp, D. melanogaster
gaaactgaatctg

SEQ ID NO: 618670 - DNA, 13 bp, D. melanogaster
gaaactgagaaaa

SEQ ID NO: 618671 - DNA, 13 bp, D. melanogaster
gaaactgagaaac

SEQ ID NO: 618672 - DNA, 13 bp, D. melanogaster
gaaactgataaag

SEQ ID NO: 618673 - DNA, 13 bp, D. melanogaster
gaaactgcatttt

SEQ ID NO: 618674 - DNA, 13 bp, D. melanogaster
gaaactgctagca

SEQ ID NO: 618675 - DNA, 13 bp, D. melanogaster
gaaactgctggtg

SEQ ID NO: 618676 - DNA, 13 bp, D. melanogaster
gaaactggccaac

SEQ ID NO: 618677 - DNA, 13 bp, D. melanogaster
gaaactgggtcaa

SEQ ID NO: 618678 - DNA, 13 bp, D. melanogaster
gaaactgtcaaaa

SEQ ID NO: 618679 - DNA, 13 bp, D. melanogaster
gaaactgtcaaat

SEQ ID NO: 618680 - DNA, 13 bp, D. melanogaster
gaaactgtgaaaa

SEQ ID NO: 618681 - DNA, 13 bp, D. melanogaster
gaaactgttctgg

SEQ ID NO: 618682 - DNA, 13 bp, D. melanogaster
gaaactgttgttg

SEQ ID NO: 618683 - DNA, 13 bp, D. melanogaster
gaaactgtttgtt

SEQ ID NO: 618684 - DNA, 13 bp, D. melanogaster
gaaacttaaaaac

SEQ ID NO: 618685 - DNA, 13 bp, D. melanogaster
gaaacttaattga

SEQ ID NO: 618686 - DNA, 13 bp, D. melanogaster
gaaacttatcagc

SEQ ID NO: 618687 - DNA, 13 bp, D. melanogaster
gaaacttgtttca

SEQ ID NO: 618688 - DNA, 13 bp, D. melanogaster
gaaacttgtttgt

SEQ ID NO: 618689 - DNA, 13 bp, D. melanogaster
gaaactttaaaac

SEQ ID NO: 618690 - DNA, 13 bp, D. melanogaster
gaaactttaaaga

SEQ ID NO: 618691 - DNA, 13 bp, D. melanogaster
gaaactttattaa

SEQ ID NO: 618692 - DNA, 13 bp, D. melanogaster
gaaactttcactt

SEQ ID NO: 618693 - DNA, 13 bp, D. melanogaster
gaaactttgaaat

SEQ ID NO: 618694 - DNA, 13 bp, D. melanogaster
gaaactttggaaa

SEQ ID NO: 618695 - DNA, 13 bp, D. melanogaster
gaaactttggtgg

SEQ ID NO: 618696 - DNA, 13 bp, D. melanogaster
gaaacttttaatt

SEQ ID NO: 618697 - DNA, 13 bp, D. melanogaster
gaaacttttactt

SEQ ID NO: 618698 - DNA, 13 bp, D. melanogaster
gaaacttttcaaa

SEQ ID NO: 618699 - DNA, 13 bp, D. melanogaster
gaaacttttcaat

SEQ ID NO: 618700 - DNA, 13 bp, D. melanogaster
gaaacttttccaa

SEQ ID NO: 618701 - DNA, 13 bp, D. melanogaster
gaaacttttccag

SEQ ID NO: 618702 - DNA, 13 bp, D. melanogaster
gaaacttttgcaa

SEQ ID NO: 618703 - DNA, 13 bp, D. melanogaster
gaaacttttgccc

SEQ ID NO: 618704 - DNA, 13 bp, D. melanogaster
gaaacttttgtgg

SEQ ID NO: 618705 - DNA, 13 bp, D. melanogaster
gaaacttttttgg

SEQ ID NO: 618706 - DNA, 13 bp, D. melanogaster
gaaagaaaaactg

SEQ ID NO: 618707 - DNA, 13 bp, D. melanogaster
gaaagaaaacctc

SEQ ID NO: 618708 - DNA, 13 bp, D. melanogaster
gaaagaaaagttt

SEQ ID NO: 618709 - DNA, 13 bp, D. melanogaster
gaaagaaaattca

SEQ ID NO: 618710 - DNA, 13 bp, D. melanogaster
gaaagaaatcgaa

SEQ ID NO: 618711 - DNA, 13 bp, D. melanogaster
gaaagaaattcat

SEQ ID NO: 618712 - DNA, 13 bp, D. melanogaster
gaaagaacacata

SEQ ID NO: 618713 - DNA, 13 bp, D. melanogaster
gaaagaacatttc

SEQ ID NO: 618714 - DNA, 13 bp, D. melanogaster
gaaagaagcgttt

SEQ ID NO: 618715 - DNA, 13 bp, D. melanogaster
gaaagaagtaaca

SEQ ID NO: 618716 - DNA, 15 bp, D. melanogaster
gaaagaagtcataga

SEQ ID NO: 618717 - DNA, 13 bp, D. melanogaster
gaaagaagttagc

SEQ ID NO: 618718 - DNA, 13 bp, D. melanogaster
gaaagacaaaatt

SEQ ID NO: 618719 - DNA, 13 bp, D. melanogaster
gaaagagacagac

SEQ ID NO: 618720 - DNA, 13 bp, D. melanogaster
gaaagagacagca

SEQ ID NO: 618721 - DNA, 13 bp, D. melanogaster
gaaagagacagcc

SEQ ID NO: 618722 - DNA, 13 bp, D. melanogaster
gaaagagacggac

SEQ ID NO: 618723 - DNA, 13 bp, D. melanogaster
gaaagagacggca

SEQ ID NO: 618724 - DNA, 14 bp, D. melanogaster
gaaagagacggcag

SEQ ID NO: 618725 - DNA, 13 bp, D. melanogaster
gaaagagacgggc

SEQ ID NO: 618726 - DNA, 14 bp, D. melanogaster
gaaagagacggggc

SEQ ID NO: 618727 - DNA, 13 bp, D. melanogaster
gaaagagagcaat

SEQ ID NO: 618728 - DNA, 13 bp, D. melanogaster
gaaagagagcgca

SEQ ID NO: 618729 - DNA, 13 bp, D. melanogaster
gaaagagagcgcc

SEQ ID NO: 618730 - DNA, 13 bp, D. melanogaster
gaaagagagggct

SEQ ID NO: 618731 - DNA, 14 bp, D. melanogaster
gaaagagagtaatt

SEQ ID NO: 618732 - DNA, 14 bp, D. melanogaster
gaaagatacagata

SEQ ID NO: 618733 - DNA, 13 bp, D. melanogaster
gaaagatatttaa

SEQ ID NO: 618734 - DNA, 13 bp, D. melanogaster
gaaagatatttat

SEQ ID NO: 618735 - DNA, 13 bp, D. melanogaster
gaaagatttacat

SEQ ID NO: 618736 - DNA, 13 bp, D. melanogaster
gaaagatttctgg

SEQ ID NO: 618737 - DNA, 13 bp, D. melanogaster
gaaagcaaaagcg

SEQ ID NO: 618738 - DNA, 13 bp, D. melanogaster
gaaagcaaaagtg

SEQ ID NO: 618739 - DNA, 13 bp, D. melanogaster
gaaagcaaaagtt

SEQ ID NO: 618740 - DNA, 13 bp, D. melanogaster
gaaagcaaaatat

SEQ ID NO: 618741 - DNA, 13 bp, D. melanogaster
gaaagcaaaatca

SEQ ID NO: 618742 - DNA, 13 bp, D. melanogaster
gaaagcaaaatgc

SEQ ID NO: 618743 - DNA, 14 bp, D. melanogaster
gaaagcaaacaaat

SEQ ID NO: 618744 - DNA, 13 bp, D. melanogaster
gaaagcaaagagc

SEQ ID NO: 618745 - DNA, 13 bp, D. melanogaster
gaaagcaaataat

SEQ ID NO: 618746 - DNA, 13 bp, D. melanogaster
gaaagcaacagca

SEQ ID NO: 618747 - DNA, 13 bp, D. melanogaster
gaaagcaataaga

SEQ ID NO: 618748 - DNA, 13 bp, D. melanogaster
gaaagcaatcaaa

SEQ ID NO: 618749 - DNA, 13 bp, D. melanogaster
gaaagcaatttca

SEQ ID NO: 618750 - DNA, 13 bp, D. melanogaster
gaaagcacacaca

SEQ ID NO: 618751 - DNA, 13 bp, D. melanogaster
gaaagcagaaagc

SEQ ID NO: 618752 - DNA, 13 bp, D. melanogaster
gaaagcagacgag

SEQ ID NO: 618753 - DNA, 14 bp, D. melanogaster
gaaagcagacgagg

SEQ ID NO: 618754 - DNA, 13 bp, D. melanogaster
gaaagcagagcaa

SEQ ID NO: 618755 - DNA, 13 bp, D. melanogaster
gaaagcagcaaca

SEQ ID NO: 618756 - DNA, 14 bp, D. melanogaster
gaaagcagcagcag

SEQ ID NO: 618757 - DNA, 13 bp, D. melanogaster
gaaagcagcgaaa

SEQ ID NO: 618758 - DNA, 14 bp, D. melanogaster
gaaagcatgttctg

SEQ ID NO: 618759 - DNA, 13 bp, D. melanogaster
gaaagcatttaaa

SEQ ID NO: 618760 - DNA, 13 bp, D. melanogaster
gaaagccaaaagt

SEQ ID NO: 618761 - DNA, 14 bp, D. melanogaster
gaaagccaaagcca

SEQ ID NO: 618762 - DNA, 13 bp, D. melanogaster
gaaagccaaatac

SEQ ID NO: 618763 - DNA, 13 bp, D. melanogaster
gaaagccaaatga

SEQ ID NO: 618764 - DNA, 13 bp, D. melanogaster
gaaagccaaccaa

SEQ ID NO: 618765 - DNA, 13 bp, D. melanogaster
gaaagccaagcca

SEQ ID NO: 618766 - DNA, 13 bp, D. melanogaster
gaaagccagccag

SEQ ID NO: 618767 - DNA, 14 bp, D. melanogaster
gaaagccagttaag

SEQ ID NO: 618768 - DNA, 13 bp, D. melanogaster
gaaagccataaaa

SEQ ID NO: 618769 - DNA, 13 bp, D. melanogaster
gaaagccatgtta

SEQ ID NO: 618770 - DNA, 13 bp, D. melanogaster
gaaagccattaaa

SEQ ID NO: 618771 - DNA, 13 bp, D. melanogaster
gaaagccccaaaa

SEQ ID NO: 618772 - DNA, 13 bp, D. melanogaster
gaaagccgaaaac

SEQ ID NO: 618773 - DNA, 13 bp, D. melanogaster
gaaagccgggcta

SEQ ID NO: 618774 - DNA, 13 bp, D. melanogaster
gaaagcgaaaaat

SEQ ID NO: 618775 - DNA, 13 bp, D. melanogaster
gaaagcgaaaact

SEQ ID NO: 618776 - DNA, 13 bp, D. melanogaster
gaaagcgaaaagc

SEQ ID NO: 618777 - DNA, 13 bp, D. melanogaster
gaaagcgaaacga

SEQ ID NO: 618778 - DNA, 13 bp, D. melanogaster
gaaagcgaaagca

SEQ ID NO: 618779 - DNA, 13 bp, D. melanogaster
gaaagcgaaagtt

SEQ ID NO: 618780 - DNA, 13 bp, D. melanogaster
gaaagcgaaataa

SEQ ID NO: 618781 - DNA, 13 bp, D. melanogaster
gaaagcgaaattg

SEQ ID NO: 618782 - DNA, 13 bp, D. melanogaster
gaaagcgagatga

SEQ ID NO: 618783 - DNA, 13 bp, D. melanogaster
gaaagcgatatcg

SEQ ID NO: 618784 - DNA, 13 bp, D. melanogaster
gaaagcggaaacg

SEQ ID NO: 618785 - DNA, 13 bp, D. melanogaster
gaaagcggaaagc

SEQ ID NO: 618786 - DNA, 13 bp, D. melanogaster
gaaagcggcgaaa

SEQ ID NO: 618787 - DNA, 13 bp, D. melanogaster
gaaagcgtggaaa

SEQ ID NO: 618788 - DNA, 13 bp, D. melanogaster
gaaagcgttgcaa

SEQ ID NO: 618789 - DNA, 14 bp, D. melanogaster
gaaagcgtttccga

SEQ ID NO: 618790 - DNA, 13 bp, D. melanogaster
gaaagctaaatga

SEQ ID NO: 618791 - DNA, 13 bp, D. melanogaster
gaaagctaatcaa

SEQ ID NO: 618792 - DNA, 13 bp, D. melanogaster
gaaagctcctgga

SEQ ID NO: 618793 - DNA, 13 bp, D. melanogaster
gaaagctctaaag

SEQ ID NO: 618794 - DNA, 13 bp, D. melanogaster
gaaagctgaaagc

SEQ ID NO: 618795 - DNA, 13 bp, D. melanogaster
gaaagctgcaaaa

SEQ ID NO: 618796 - DNA, 14 bp, D. melanogaster
gaaagctgcatagc

SEQ ID NO: 618797 - DNA, 13 bp, D. melanogaster
gaaagctgctaga

SEQ ID NO: 618798 - DNA, 13 bp, D. melanogaster
gaaagctggaaaa

SEQ ID NO: 618799 - DNA, 14 bp, D. melanogaster
gaaagctggaaaag

SEQ ID NO: 618800 - DNA, 13 bp, D. melanogaster
gaaagctggaatc

SEQ ID NO: 618801 - DNA, 14 bp, D. melanogaster
gaaagctgttttta

SEQ ID NO: 618802 - DNA, 13 bp, D. melanogaster
gaaagctttcaaa

SEQ ID NO: 618803 - DNA, 13 bp, D. melanogaster
gaaaggaaaatca

SEQ ID NO: 618804 - DNA, 13 bp, D. melanogaster
gaaaggaaaccga

SEQ ID NO: 618805 - DNA, 13 bp, D. melanogaster
gaaaggaaatcaa

SEQ ID NO: 618806 - DNA, 13 bp, D. melanogaster
gaaaggaaatcga

SEQ ID NO: 618807 - DNA, 13 bp, D. melanogaster
gaaaggcaaacat

SEQ ID NO: 618808 - DNA, 13 bp, D. melanogaster
gaaaggcaacaac

SEQ ID NO: 618809 - DNA, 13 bp, D. melanogaster
gaaaggcaagaac

SEQ ID NO: 618810 - DNA, 13 bp, D. melanogaster
gaaaggcagcagc

SEQ ID NO: 618811 - DNA, 14 bp, D. melanogaster
gaaaggcagccaag

SEQ ID NO: 618812 - DNA, 13 bp, D. melanogaster
gaaaggcttaatg

SEQ ID NO: 618813 - DNA, 13 bp, D. melanogaster
gaaaggggcgtgg

SEQ ID NO: 618814 - DNA, 13 bp, D. melanogaster
gaaaggtgaaagc

SEQ ID NO: 618815 - DNA, 13 bp, D. melanogaster
gaaagtaaccaag

SEQ ID NO: 618816 - DNA, 13 bp, D. melanogaster
gaaagtacatata

SEQ ID NO: 618817 - DNA, 13 bp, D. melanogaster
gaaagtagaaagt

SEQ ID NO: 618818 - DNA, 14 bp, D. melanogaster
gaaagtagccaaca

SEQ ID NO: 618819 - DNA, 13 bp, D. melanogaster
gaaagtagctatt

SEQ ID NO: 618820 - DNA, 13 bp, D. melanogaster
gaaagtatataat

SEQ ID NO: 618821 - DNA, 13 bp, D. melanogaster
gaaagtatatata

SEQ ID NO: 618822 - DNA, 13 bp, D. melanogaster
gaaagtattggat

SEQ ID NO: 618823 - DNA, 13 bp, D. melanogaster
gaaagtatttcaa

SEQ ID NO: 618824 - DNA, 13 bp, D. melanogaster
gaaagtattttaa

SEQ ID NO: 618825 - DNA, 13 bp, D. melanogaster
gaaagtcaaaaac

SEQ ID NO: 618826 - DNA, 13 bp, D. melanogaster
gaaagtcagaaag

SEQ ID NO: 618827 - DNA, 13 bp, D. melanogaster
gaaagtcataaaa

SEQ ID NO: 618828 - DNA, 13 bp, D. melanogaster
gaaagtcatcaaa

SEQ ID NO: 618829 - DNA, 14 bp, D. melanogaster
gaaagtccatcaaa

SEQ ID NO: 618830 - DNA, 13 bp, D. melanogaster
gaaagtcggaaaa

SEQ ID NO: 618831 - DNA, 13 bp, D. melanogaster
gaaagtgaaaaca

SEQ ID NO: 618832 - DNA, 14 bp, D. melanogaster
gaaagtgaaaagtg

SEQ ID NO: 618833 - DNA, 14 bp, D. melanogaster
gaaagtgaaaagtt

SEQ ID NO: 618834 - DNA, 13 bp, D. melanogaster
gaaagtgaaaatc

SEQ ID NO: 618835 - DNA, 13 bp, D. melanogaster
gaaagtgaaactt

SEQ ID NO: 618836 - DNA, 13 bp, D. melanogaster
gaaagtgaaaggc

SEQ ID NO: 618837 - DNA, 13 bp, D. melanogaster
gaaagtgaaagta

SEQ ID NO: 618838 - DNA, 13 bp, D. melanogaster
gaaagtgaaagtg

SEQ ID NO: 618839 - DNA, 14 bp, D. melanogaster
gaaagtgaaagtga

SEQ ID NO: 618840 - DNA, 13 bp, D. melanogaster
gaaagtgaaagtt

SEQ ID NO: 618841 - DNA, 13 bp, D. melanogaster
gaaagtgaagtga

SEQ ID NO: 618842 - DNA, 13 bp, D. melanogaster
gaaagtgaatttg

SEQ ID NO: 618843 - DNA, 13 bp, D. melanogaster
gaaagtgcaaaaa

SEQ ID NO: 618844 - DNA, 13 bp, D. melanogaster
gaaagtgcatttc

SEQ ID NO: 618845 - DNA, 13 bp, D. melanogaster
gaaagtgccaaaa

SEQ ID NO: 618846 - DNA, 13 bp, D. melanogaster
gaaagtgctcaaa

SEQ ID NO: 618847 - DNA, 13 bp, D. melanogaster
gaaagtggaaagc

SEQ ID NO: 618848 - DNA, 13 bp, D. melanogaster
gaaagtggaagtg

SEQ ID NO: 618849 - DNA, 13 bp, D. melanogaster
gaaagtggcagga

SEQ ID NO: 618850 - DNA, 13 bp, D. melanogaster
gaaagtggctcat

SEQ ID NO: 618851 - DNA, 13 bp, D. melanogaster
gaaagtgggaaat

SEQ ID NO: 618852 - DNA, 13 bp, D. melanogaster
gaaagtgggaatc

SEQ ID NO: 618853 - DNA, 13 bp, D. melanogaster
gaaagtgggcggt

SEQ ID NO: 618854 - DNA, 13 bp, D. melanogaster
gaaagtgtataaa

SEQ ID NO: 618855 - DNA, 13 bp, D. melanogaster
gaaagtgtggaaa

SEQ ID NO: 618856 - DNA, 13 bp, D. melanogaster
gaaagtgttgaaa

SEQ ID NO: 618857 - DNA, 13 bp, D. melanogaster
gaaagtgttgcat

SEQ ID NO: 618858 - DNA, 13 bp, D. melanogaster
gaaagtgtttaaa

SEQ ID NO: 618859 - DNA, 13 bp, D. melanogaster
gaaagtgttttcc

SEQ ID NO: 618860 - DNA, 13 bp, D. melanogaster
gaaagtgttttct

SEQ ID NO: 618861 - DNA, 13 bp, D. melanogaster
gaaagttcaatta

SEQ ID NO: 618862 - DNA, 13 bp, D. melanogaster
gaaagttcttctt

SEQ ID NO: 618863 - DNA, 13 bp, D. melanogaster
gaaagttgaaaat

SEQ ID NO: 618864 - DNA, 13 bp, D. melanogaster
gaaagttggcaaa

SEQ ID NO: 618865 - DNA, 13 bp, D. melanogaster
gaaagtttaaata

SEQ ID NO: 618866 - DNA, 13 bp, D. melanogaster
gaaagtttcaaaa

SEQ ID NO: 618867 - DNA, 13 bp, D. melanogaster
gaaagtttgcgaa

SEQ ID NO: 618868 - DNA, 13 bp, D. melanogaster
gaaagttttcaat

SEQ ID NO: 618869 - DNA, 13 bp, D. melanogaster
gaaagttttcact

SEQ ID NO: 618870 - DNA, 13 bp, D. melanogaster
gaaagttttgcaa

SEQ ID NO: 618871 - DNA, 13 bp, D. melanogaster
gaaagttttggcc

SEQ ID NO: 618872 - DNA, 13 bp, D. melanogaster
gaaagtttttaaa

SEQ ID NO: 618873 - DNA, 14 bp, D. melanogaster
gaaagtttttaaaa

SEQ ID NO: 618874 - DNA, 13 bp, D. melanogaster
gaaagtttttatc

SEQ ID NO: 618875 - DNA, 13 bp, D. melanogaster
gaaagtttttcaa

SEQ ID NO: 618876 - DNA, 13 bp, D. melanogaster
gaaagtttttccc

SEQ ID NO: 618877 - DNA, 13 bp, D. melanogaster
gaaataaaaatgc

SEQ ID NO: 618878 - DNA, 13 bp, D. melanogaster
gaaataaaacatt

SEQ ID NO: 618879 - DNA, 14 bp, D. melanogaster
gaaataaaacattt

SEQ ID NO: 618880 - DNA, 13 bp, D. melanogaster
gaaataaaaccat

SEQ ID NO: 618881 - DNA, 14 bp, D. melanogaster
gaaataaaactgtc

SEQ ID NO: 618882 - DNA, 13 bp, D. melanogaster
gaaataaaagcca

SEQ ID NO: 618883 - DNA, 13 bp, D. melanogaster
gaaataaaagcga

SEQ ID NO: 618884 - DNA, 14 bp, D. melanogaster
gaaataaaatgcaa

SEQ ID NO: 618885 - DNA, 14 bp, D. melanogaster
gaaataaaattgca

SEQ ID NO: 618886 - DNA, 13 bp, D. melanogaster
gaaataaaattgt

SEQ ID NO: 618887 - DNA, 14 bp, D. melanogaster
gaaataaacatttt

SEQ ID NO: 618888 - DNA, 13 bp, D. melanogaster
gaaataaacgcaa

SEQ ID NO: 618889 - DNA, 14 bp, D. melanogaster
gaaataaacttttt

SEQ ID NO: 618890 - DNA, 13 bp, D. melanogaster
gaaataaagttat

SEQ ID NO: 618891 - DNA, 13 bp, D. melanogaster
gaaataaatattg

SEQ ID NO: 618892 - DNA, 14 bp, D. melanogaster
gaaataaatgcaaa

SEQ ID NO: 618893 - DNA, 13 bp, D. melanogaster
gaaataaattaca

SEQ ID NO: 618894 - DNA, 13 bp, D. melanogaster
gaaataaattact

SEQ ID NO: 618895 - DNA, 13 bp, D. melanogaster
gaaataaattcaa

SEQ ID NO: 618896 - DNA, 14 bp, D. melanogaster
gaaataaattcttt

SEQ ID NO: 618897 - DNA, 13 bp, D. melanogaster
gaaataaatttca

SEQ ID NO: 618898 - DNA, 13 bp, D. melanogaster
gaaataaatttga

SEQ ID NO: 618899 - DNA, 13 bp, D. melanogaster
gaaataacgaaat

SEQ ID NO: 618900 - DNA, 14 bp, D. melanogaster
gaaataacttaaaa

SEQ ID NO: 618901 - DNA, 13 bp, D. melanogaster
gaaataacttaat

SEQ ID NO: 618902 - DNA, 13 bp, D. melanogaster
gaaataactttat

SEQ ID NO: 618903 - DNA, 13 bp, D. melanogaster
gaaataagaactg

SEQ ID NO: 618904 - DNA, 13 bp, D. melanogaster
gaaataagcaaat

SEQ ID NO: 618905 - DNA, 13 bp, D. melanogaster
gaaataagccaaa

SEQ ID NO: 618906 - DNA, 13 bp, D. melanogaster
gaaataataatca

SEQ ID NO: 618907 - DNA, 13 bp, D. melanogaster
gaaataatatcaa

SEQ ID NO: 618908 - DNA, 13 bp, D. melanogaster
gaaataatcaatg

SEQ ID NO: 618909 - DNA, 13 bp, D. melanogaster
gaaataatcataa

SEQ ID NO: 618910 - DNA, 13 bp, D. melanogaster
gaaataatgagat

SEQ ID NO: 618911 - DNA, 13 bp, D. melanogaster
gaaataatggaag

SEQ ID NO: 618912 - DNA, 14 bp, D. melanogaster
gaaataatggaagt

SEQ ID NO: 618913 - DNA, 13 bp, D. melanogaster
gaaataattaggt

SEQ ID NO: 618914 - DNA, 13 bp, D. melanogaster
gaaataattcaat

SEQ ID NO: 618915 - DNA, 13 bp, D. melanogaster
gaaataattgtgc

SEQ ID NO: 618916 - DNA, 13 bp, D. melanogaster
gaaataatttaag

SEQ ID NO: 618917 - DNA, 13 bp, D. melanogaster
gaaataatttcga

SEQ ID NO: 618918 - DNA, 13 bp, D. melanogaster
gaaataattttgc

SEQ ID NO: 618919 - DNA, 13 bp, D. melanogaster
gaaatacaaatgt

SEQ ID NO: 618920 - DNA, 13 bp, D. melanogaster
gaaatacaagccc

SEQ ID NO: 618921 - DNA, 13 bp, D. melanogaster
gaaatacaattgc

SEQ ID NO: 618922 - DNA, 14 bp, D. melanogaster
gaaatacaattgta

SEQ ID NO: 618923 - DNA, 13 bp, D. melanogaster
gaaatacacaatg

SEQ ID NO: 618924 - DNA, 13 bp, D. melanogaster
gaaatacacattc

SEQ ID NO: 618925 - DNA, 13 bp, D. melanogaster
gaaatacactttt

SEQ ID NO: 618926 - DNA, 14 bp, D. melanogaster
gaaatacatacata

SEQ ID NO: 618927 - DNA, 13 bp, D. melanogaster
gaaatacatattt

SEQ ID NO: 618928 - DNA, 13 bp, D. melanogaster
gaaatacatgaag

SEQ ID NO: 618929 - DNA, 13 bp, D. melanogaster
gaaatacattgaa

SEQ ID NO: 618930 - DNA, 13 bp, D. melanogaster
gaaataccattta

SEQ ID NO: 618931 - DNA, 13 bp, D. melanogaster
gaaatactcaaaa

SEQ ID NO: 618932 - DNA, 13 bp, D. melanogaster
gaaatactttgaa

SEQ ID NO: 618933 - DNA, 13 bp, D. melanogaster
gaaatacttttat

SEQ ID NO: 618934 - DNA, 13 bp, D. melanogaster
gaaatacttttgg

SEQ ID NO: 618935 - DNA, 13 bp, D. melanogaster
gaaatacttttta

SEQ ID NO: 618936 - DNA, 13 bp, D. melanogaster
gaaatagaaattt

SEQ ID NO: 618937 - DNA, 13 bp, D. melanogaster
gaaatagacagca

SEQ ID NO: 618938 - DNA, 13 bp, D. melanogaster
gaaatagatttcc

SEQ ID NO: 618939 - DNA, 13 bp, D. melanogaster
gaaatagatttga

SEQ ID NO: 618940 - DNA, 13 bp, D. melanogaster
gaaatagattttc

SEQ ID NO: 618941 - DNA, 13 bp, D. melanogaster
gaaatagcaacaa

SEQ ID NO: 618942 - DNA, 13 bp, D. melanogaster
gaaatagcatata

SEQ ID NO: 618943 - DNA, 16 bp, D. melanogaster
gaaatagccaaatcta

SEQ ID NO: 618944 - DNA, 13 bp, D. melanogaster
gaaatagtcaaat

SEQ ID NO: 618945 - DNA, 13 bp, D. melanogaster
gaaatagtgcagg

SEQ ID NO: 618946 - DNA, 13 bp, D. melanogaster
gaaatataaaagc

SEQ ID NO: 618947 - DNA, 13 bp, D. melanogaster
gaaatatacaaat

SEQ ID NO: 618948 - DNA, 13 bp, D. melanogaster
gaaatatacaatt

SEQ ID NO: 618949 - DNA, 13 bp, D. melanogaster
gaaatatacacat

SEQ ID NO: 618950 - DNA, 13 bp, D. melanogaster
gaaatatacatat

SEQ ID NO: 618951 - DNA, 14 bp, D. melanogaster
gaaatatacatata

SEQ ID NO: 618952 - DNA, 13 bp, D. melanogaster
gaaatatacattt

SEQ ID NO: 618953 - DNA, 13 bp, D. melanogaster
gaaatatatatca

SEQ ID NO: 618954 - DNA, 13 bp, D. melanogaster
gaaatatatatgt

SEQ ID NO: 618955 - DNA, 13 bp, D. melanogaster
gaaatatatcaaa

SEQ ID NO: 618956 - DNA, 13 bp, D. melanogaster
gaaatatatgcat

SEQ ID NO: 618957 - DNA, 13 bp, D. melanogaster
gaaatatatgtac

SEQ ID NO: 618958 - DNA, 14 bp, D. melanogaster
gaaatatatgtata

SEQ ID NO: 618959 - DNA, 13 bp, D. melanogaster
gaaatatattcaa

SEQ ID NO: 618960 - DNA, 13 bp, D. melanogaster
gaaatatattgca

SEQ ID NO: 618961 - DNA, 13 bp, D. melanogaster
gaaatatattgta

SEQ ID NO: 618962 - DNA, 13 bp, D. melanogaster
gaaatatgaaagt

SEQ ID NO: 618963 - DNA, 13 bp, D. melanogaster
gaaatatgaaatt

SEQ ID NO: 618964 - DNA, 13 bp, D. melanogaster
gaaatatgagcaa

SEQ ID NO: 618965 - DNA, 13 bp, D. melanogaster
gaaatatgatgga

SEQ ID NO: 618966 - DNA, 13 bp, D. melanogaster
gaaatatgcaatt

SEQ ID NO: 618967 - DNA, 13 bp, D. melanogaster
gaaatatgcatat

SEQ ID NO: 618968 - DNA, 14 bp, D. melanogaster
gaaatatggaaaat

SEQ ID NO: 618969 - DNA, 13 bp, D. melanogaster
gaaatatggtcag

SEQ ID NO: 618970 - DNA, 14 bp, D. melanogaster
gaaatatgtatatg

SEQ ID NO: 618971 - DNA, 13 bp, D. melanogaster
gaaatatgtatgt

SEQ ID NO: 618972 - DNA, 13 bp, D. melanogaster
gaaatatgtgaaa

SEQ ID NO: 618973 - DNA, 13 bp, D. melanogaster
gaaatatgtttgt

SEQ ID NO: 618974 - DNA, 13 bp, D. melanogaster
gaaatatgttttt

SEQ ID NO: 618975 - DNA, 13 bp, D. melanogaster
gaaatattaaatc

SEQ ID NO: 618976 - DNA, 13 bp, D. melanogaster
gaaatattaatga

SEQ ID NO: 618977 - DNA, 13 bp, D. melanogaster
gaaatattacgca

SEQ ID NO: 618978 - DNA, 13 bp, D. melanogaster
gaaatattagtaa

SEQ ID NO: 618979 - DNA, 13 bp, D. melanogaster
gaaatattcaaat

SEQ ID NO: 618980 - DNA, 14 bp, D. melanogaster
gaaatattcaaatt

SEQ ID NO: 618981 - DNA, 13 bp, D. melanogaster
gaaatattcaatt

SEQ ID NO: 618982 - DNA, 13 bp, D. melanogaster
gaaatattcatgg

SEQ ID NO: 618983 - DNA, 13 bp, D. melanogaster
gaaatattcattt

SEQ ID NO: 618984 - DNA, 13 bp, D. melanogaster
gaaatattccaaa

SEQ ID NO: 618985 - DNA, 13 bp, D. melanogaster
gaaatattccacc

SEQ ID NO: 618986 - DNA, 13 bp, D. melanogaster
gaaatattctttt

SEQ ID NO: 618987 - DNA, 13 bp, D. melanogaster
gaaatattgaaat

SEQ ID NO: 618988 - DNA, 13 bp, D. melanogaster
gaaatattgtaaa

SEQ ID NO: 618989 - DNA, 13 bp, D. melanogaster
gaaatattgtaat

SEQ ID NO: 618990 - DNA, 13 bp, D. melanogaster
gaaatattgttaa

SEQ ID NO: 618991 - DNA, 13 bp, D. melanogaster
gaaatatttaaac

SEQ ID NO: 618992 - DNA, 13 bp, D. melanogaster
gaaatatttaaga

SEQ ID NO: 618993 - DNA, 13 bp, D. melanogaster
gaaatatttatac

SEQ ID NO: 618994 - DNA, 13 bp, D. melanogaster
gaaatatttccac

SEQ ID NO: 618995 - DNA, 13 bp, D. melanogaster
gaaatatttccca

SEQ ID NO: 618996 - DNA, 13 bp, D. melanogaster
gaaatatttcgaa

SEQ ID NO: 618997 - DNA, 13 bp, D. melanogaster
gaaatatttgcag

SEQ ID NO: 618998 - DNA, 13 bp, D. melanogaster
gaaatatttgctt

SEQ ID NO: 618999 - DNA, 13 bp, D. melanogaster
gaaatatttggca

SEQ ID NO: 619000 - DNA, 13 bp, D. melanogaster
gaaatattttatg

SEQ ID NO: 619001 - DNA, 13 bp, D. melanogaster
gaaatattttcat

SEQ ID NO: 619002 - DNA, 13 bp, D. melanogaster
gaaatattttctt

SEQ ID NO: 619003 - DNA, 13 bp, D. melanogaster
gaaatattttgct

SEQ ID NO: 619004 - DNA, 13 bp, D. melanogaster
gaaatattttgta

SEQ ID NO: 619005 - DNA, 13 bp, D. melanogaster
gaaatatttttcg

SEQ ID NO: 619006 - DNA, 13 bp, D. melanogaster
gaaatatttttga

SEQ ID NO: 619007 - DNA, 13 bp, D. melanogaster
gaaatattttttg

SEQ ID NO: 619008 - DNA, 13 bp, D. melanogaster
gaaatcaaaaatt

SEQ ID NO: 619009 - DNA, 13 bp, D. melanogaster
gaaatcaaaacat

SEQ ID NO: 619010 - DNA, 13 bp, D. melanogaster
gaaatcaaaacta

SEQ ID NO: 619011 - DNA, 13 bp, D. melanogaster
gaaatcaaaagat

SEQ ID NO: 619012 - DNA, 13 bp, D. melanogaster
gaaatcaaaatca

SEQ ID NO: 619013 - DNA, 14 bp, D. melanogaster
gaaatcaaaatcaa

SEQ ID NO: 619014 - DNA, 13 bp, D. melanogaster
gaaatcaaaatgc

SEQ ID NO: 619015 - DNA, 13 bp, D. melanogaster
gaaatcaaacatc

SEQ ID NO: 619016 - DNA, 13 bp, D. melanogaster
gaaatcaaactaa

SEQ ID NO: 619017 - DNA, 13 bp, D. melanogaster
gaaatcaaacttc

SEQ ID NO: 619018 - DNA, 13 bp, D. melanogaster
gaaatcaaagcaa

SEQ ID NO: 619019 - DNA, 13 bp, D. melanogaster
gaaatcaaaggaa

SEQ ID NO: 619020 - DNA, 13 bp, D. melanogaster
gaaatcaaagtca

SEQ ID NO: 619021 - DNA, 14 bp, D. melanogaster
gaaatcaaatgaaa

SEQ ID NO: 619022 - DNA, 13 bp, D. melanogaster
gaaatcaaatgca

SEQ ID NO: 619023 - DNA, 13 bp, D. melanogaster
gaaatcaaattaa

SEQ ID NO: 619024 - DNA, 13 bp, D. melanogaster
gaaatcaaattgt

SEQ ID NO: 619025 - DNA, 13 bp, D. melanogaster
gaaatcaacttaa

SEQ ID NO: 619026 - DNA, 13 bp, D. melanogaster
gaaatcaactttc

SEQ ID NO: 619027 - DNA, 13 bp, D. melanogaster
gaaatcaagacaa

SEQ ID NO: 619028 - DNA, 13 bp, D. melanogaster
gaaatcaaggcaa

SEQ ID NO: 619029 - DNA, 14 bp, D. melanogaster
gaaatcaataaata

SEQ ID NO: 619030 - DNA, 13 bp, D. melanogaster
gaaatcaatagaa

SEQ ID NO: 619031 - DNA, 13 bp, D. melanogaster
gaaatcaatattt

SEQ ID NO: 619032 - DNA, 13 bp, D. melanogaster
gaaatcaatcaaa

SEQ ID NO: 619033 - DNA, 14 bp, D. melanogaster
gaaatcaatcaaaa

SEQ ID NO: 619034 - DNA, 13 bp, D. melanogaster
gaaatcaatgaaa

SEQ ID NO: 619035 - DNA, 13 bp, D. melanogaster
gaaatcaatgcca

SEQ ID NO: 619036 - DNA, 13 bp, D. melanogaster
gaaatcaattcaa

SEQ ID NO: 619037 - DNA, 13 bp, D. melanogaster
gaaatcaattctg

SEQ ID NO: 619038 - DNA, 13 bp, D. melanogaster
gaaatcaattgaa

SEQ ID NO: 619039 - DNA, 13 bp, D. melanogaster
gaaatcaatttaa

SEQ ID NO: 619040 - DNA, 13 bp, D. melanogaster
gaaatcaatttgc

SEQ ID NO: 619041 - DNA, 13 bp, D. melanogaster
gaaatcaatttgg

SEQ ID NO: 619042 - DNA, 14 bp, D. melanogaster
gaaatcaattttga

SEQ ID NO: 619043 - DNA, 13 bp, D. melanogaster
gaaatcaattttt

SEQ ID NO: 619044 - DNA, 13 bp, D. melanogaster
gaaatcacagaag

SEQ ID NO: 619045 - DNA, 13 bp, D. melanogaster
gaaatcactgcct

SEQ ID NO: 619046 - DNA, 13 bp, D. melanogaster
gaaatcagaaata

SEQ ID NO: 619047 - DNA, 13 bp, D. melanogaster
gaaatcagaaatc

SEQ ID NO: 619048 - DNA, 14 bp, D. melanogaster
gaaatcagaaatca

SEQ ID NO: 619049 - DNA, 13 bp, D. melanogaster
gaaatcagaaatt

SEQ ID NO: 619050 - DNA, 13 bp, D. melanogaster
gaaatcagaatat

SEQ ID NO: 619051 - DNA, 14 bp, D. melanogaster
gaaatcagagagtt

SEQ ID NO: 619052 - DNA, 13 bp, D. melanogaster
gaaatcagcaaaa

SEQ ID NO: 619053 - DNA, 13 bp, D. melanogaster
gaaatcagcttaa

SEQ ID NO: 619054 - DNA, 13 bp, D. melanogaster
gaaatcagtaatg

SEQ ID NO: 619055 - DNA, 14 bp, D. melanogaster
gaaatcagtttttt

SEQ ID NO: 619056 - DNA, 13 bp, D. melanogaster
gaaatcataaatt

SEQ ID NO: 619057 - DNA, 13 bp, D. melanogaster
gaaatcataataa

SEQ ID NO: 619058 - DNA, 13 bp, D. melanogaster
gaaatcatacttc

SEQ ID NO: 619059 - DNA, 13 bp, D. melanogaster
gaaatcatagaaa

SEQ ID NO: 619060 - DNA, 13 bp, D. melanogaster
gaaatcatatata

SEQ ID NO: 619061 - DNA, 13 bp, D. melanogaster
gaaatcatcatca

SEQ ID NO: 619062 - DNA, 13 bp, D. melanogaster
gaaatcattaaaa

SEQ ID NO: 619063 - DNA, 14 bp, D. melanogaster
gaaatcattaaaaa

SEQ ID NO: 619064 - DNA, 13 bp, D. melanogaster
gaaatcattaaat

SEQ ID NO: 619065 - DNA, 13 bp, D. melanogaster
gaaatcatttata

SEQ ID NO: 619066 - DNA, 14 bp, D. melanogaster
gaaatcatttcatt

SEQ ID NO: 619067 - DNA, 13 bp, D. melanogaster
gaaatcattttga

SEQ ID NO: 619068 - DNA, 13 bp, D. melanogaster
gaaatccaaaaat

SEQ ID NO: 619069 - DNA, 13 bp, D. melanogaster
gaaatccaaaatc

SEQ ID NO: 619070 - DNA, 13 bp, D. melanogaster
gaaatccaaaatg

SEQ ID NO: 619071 - DNA, 13 bp, D. melanogaster
gaaatccaaattg

SEQ ID NO: 619072 - DNA, 13 bp, D. melanogaster
gaaatccaacaaa

SEQ ID NO: 619073 - DNA, 13 bp, D. melanogaster
gaaatccaagcca

SEQ ID NO: 619074 - DNA, 13 bp, D. melanogaster
gaaatccagcaga

SEQ ID NO: 619075 - DNA, 13 bp, D. melanogaster
gaaatccatttaa

SEQ ID NO: 619076 - DNA, 13 bp, D. melanogaster
gaaatcccataaa

SEQ ID NO: 619077 - DNA, 13 bp, D. melanogaster
gaaatccccaaaa

SEQ ID NO: 619078 - DNA, 14 bp, D. melanogaster
gaaatccctttgcc

SEQ ID NO: 619079 - DNA, 13 bp, D. melanogaster
gaaatccgaaaac

SEQ ID NO: 619080 - DNA, 13 bp, D. melanogaster
gaaatccgaaatc

SEQ ID NO: 619081 - DNA, 13 bp, D. melanogaster
gaaatccttaaaa

SEQ ID NO: 619082 - DNA, 13 bp, D. melanogaster
gaaatcctttaaa

SEQ ID NO: 619083 - DNA, 13 bp, D. melanogaster
gaaatcgaaaaat

SEQ ID NO: 619084 - DNA, 13 bp, D. melanogaster
gaaatcgaaaaga

SEQ ID NO: 619085 - DNA, 13 bp, D. melanogaster
gaaatcgaaaagg

SEQ ID NO: 619086 - DNA, 13 bp, D. melanogaster
gaaatcgaaaatt

SEQ ID NO: 619087 - DNA, 13 bp, D. melanogaster
gaaatcgaaacaa

SEQ ID NO: 619088 - DNA, 13 bp, D. melanogaster
gaaatcgaaacca

SEQ ID NO: 619089 - DNA, 13 bp, D. melanogaster
gaaatcgaaactg

SEQ ID NO: 619090 - DNA, 13 bp, D. melanogaster
gaaatcgaaagtg

SEQ ID NO: 619091 - DNA, 13 bp, D. melanogaster
gaaatcgaaatca

SEQ ID NO: 619092 - DNA, 13 bp, D. melanogaster
gaaatcgaaatcc

SEQ ID NO: 619093 - DNA, 13 bp, D. melanogaster
gaaatcgaaatga

SEQ ID NO: 619094 - DNA, 13 bp, D. melanogaster
gaaatcgaaatgg

SEQ ID NO: 619095 - DNA, 14 bp, D. melanogaster
gaaatcgaaatgga

SEQ ID NO: 619096 - DNA, 13 bp, D. melanogaster
gaaatcgaaatta

SEQ ID NO: 619097 - DNA, 13 bp, D. melanogaster
gaaatcgaaattg

SEQ ID NO: 619098 - DNA, 14 bp, D. melanogaster
gaaatcgaaattga

SEQ ID NO: 619099 - DNA, 13 bp, D. melanogaster
gaaatcgaagaaa

SEQ ID NO: 619100 - DNA, 13 bp, D. melanogaster
gaaatcgaagtag

SEQ ID NO: 619101 - DNA, 13 bp, D. melanogaster
gaaatcgaagtta

SEQ ID NO: 619102 - DNA, 14 bp, D. melanogaster
gaaatcgaatcgaa

SEQ ID NO: 619103 - DNA, 13 bp, D. melanogaster
gaaatcgaattga

SEQ ID NO: 619104 - DNA, 13 bp, D. melanogaster
gaaatcgaatttg

SEQ ID NO: 619105 - DNA, 13 bp, D. melanogaster
gaaatcgaggaaa

SEQ ID NO: 619106 - DNA, 13 bp, D. melanogaster
gaaatcgatagaa

SEQ ID NO: 619107 - DNA, 13 bp, D. melanogaster
gaaatcgatttag

SEQ ID NO: 619108 - DNA, 13 bp, D. melanogaster
gaaatcgcaaata

SEQ ID NO: 619109 - DNA, 13 bp, D. melanogaster
gaaatcgcataaa

SEQ ID NO: 619110 - DNA, 13 bp, D. melanogaster
gaaatcgccagac

SEQ ID NO: 619111 - DNA, 13 bp, D. melanogaster
gaaatcggaagac

SEQ ID NO: 619112 - DNA, 13 bp, D. melanogaster
gaaatcggaatca

SEQ ID NO: 619113 - DNA, 13 bp, D. melanogaster
gaaatcggaatcg

SEQ ID NO: 619114 - DNA, 13 bp, D. melanogaster
gaaatcgttttta

SEQ ID NO: 619115 - DNA, 13 bp, D. melanogaster
gaaatcgtttttc

SEQ ID NO: 619116 - DNA, 13 bp, D. melanogaster
gaaatctaattag

SEQ ID NO: 619117 - DNA, 13 bp, D. melanogaster
gaaatctataaat

SEQ ID NO: 619118 - DNA, 13 bp, D. melanogaster
gaaatctatatat

SEQ ID NO: 619119 - DNA, 13 bp, D. melanogaster
gaaatctgcataa

SEQ ID NO: 619120 - DNA, 13 bp, D. melanogaster
gaaatctggccaa

SEQ ID NO: 619121 - DNA, 13 bp, D. melanogaster
gaaatctgtgaaa

SEQ ID NO: 619122 - DNA, 13 bp, D. melanogaster
gaaatcttcattt

SEQ ID NO: 619123 - DNA, 13 bp, D. melanogaster
gaaatctttattt

SEQ ID NO: 619124 - DNA, 13 bp, D. melanogaster
gaaatctttcttc

SEQ ID NO: 619125 - DNA, 13 bp, D. melanogaster
gaaatcttttaaa

SEQ ID NO: 619126 - DNA, 13 bp, D. melanogaster
gaaatctttttgt

SEQ ID NO: 619127 - DNA, 13 bp, D. melanogaster
gaaatgaaaaact

SEQ ID NO: 619128 - DNA, 14 bp, D. melanogaster
gaaatgaaaaagca

SEQ ID NO: 619129 - DNA, 13 bp, D. melanogaster
gaaatgaaaacga

SEQ ID NO: 619130 - DNA, 14 bp, D. melanogaster
gaaatgaaaacgaa

SEQ ID NO: 619131 - DNA, 13 bp, D. melanogaster
gaaatgaaaacgc

SEQ ID NO: 619132 - DNA, 13 bp, D. melanogaster
gaaatgaaaactt

SEQ ID NO: 619133 - DNA, 13 bp, D. melanogaster
gaaatgaaaattc

SEQ ID NO: 619134 - DNA, 14 bp, D. melanogaster
gaaatgaaaattca

SEQ ID NO: 619135 - DNA, 13 bp, D. melanogaster
gaaatgaaaattt

SEQ ID NO: 619136 - DNA, 14 bp, D. melanogaster
gaaatgaaacgaaa

SEQ ID NO: 619137 - DNA, 13 bp, D. melanogaster
gaaatgaaacgga

SEQ ID NO: 619138 - DNA, 13 bp, D. melanogaster
gaaatgaaacgtt

SEQ ID NO: 619139 - DNA, 13 bp, D. melanogaster
gaaatgaaactca

SEQ ID NO: 619140 - DNA, 13 bp, D. melanogaster
gaaatgaaagcaa

SEQ ID NO: 619141 - DNA, 13 bp, D. melanogaster
gaaatgaaagcca

SEQ ID NO: 619142 - DNA, 13 bp, D. melanogaster
gaaatgaaagcga

SEQ ID NO: 619143 - DNA, 13 bp, D. melanogaster
gaaatgaaagtgc

SEQ ID NO: 619144 - DNA, 14 bp, D. melanogaster
gaaatgaaataaac

SEQ ID NO: 619145 - DNA, 13 bp, D. melanogaster
gaaatgaaataca

SEQ ID NO: 619146 - DNA, 14 bp, D. melanogaster
gaaatgaaatattt

SEQ ID NO: 619147 - DNA, 14 bp, D. melanogaster
gaaatgaaatcaaa

SEQ ID NO: 619148 - DNA, 13 bp, D. melanogaster
gaaatgaaatgtt

SEQ ID NO: 619149 - DNA, 13 bp, D. melanogaster
gaaatgaaattac

SEQ ID NO: 619150 - DNA, 13 bp, D. melanogaster
gaaatgaaattcc

SEQ ID NO: 619151 - DNA, 13 bp, D. melanogaster
gaaatgaaattta

SEQ ID NO: 619152 - DNA, 13 bp, D. melanogaster
gaaatgaagggta

SEQ ID NO: 619153 - DNA, 13 bp, D. melanogaster
gaaatgaatatta

SEQ ID NO: 619154 - DNA, 14 bp, D. melanogaster
gaaatgaatcccga

SEQ ID NO: 619155 - DNA, 13 bp, D. melanogaster
gaaatgaatgaat

SEQ ID NO: 619156 - DNA, 13 bp, D. melanogaster
gaaatgaattaat

SEQ ID NO: 619157 - DNA, 13 bp, D. melanogaster
gaaatgaattgaa

SEQ ID NO: 619158 - DNA, 13 bp, D. melanogaster
gaaatgaatttgc

SEQ ID NO: 619159 - DNA, 14 bp, D. melanogaster
gaaatgacccagtt

SEQ ID NO: 619160 - DNA, 13 bp, D. melanogaster
gaaatgagcaaat

SEQ ID NO: 619161 - DNA, 13 bp, D. melanogaster
gaaatgagcattt

SEQ ID NO: 619162 - DNA, 13 bp, D. melanogaster
gaaatgatgatga

SEQ ID NO: 619163 - DNA, 13 bp, D. melanogaster
gaaatgatttaaa

SEQ ID NO: 619164 - DNA, 13 bp, D. melanogaster
gaaatgatttatt

SEQ ID NO: 619165 - DNA, 13 bp, D. melanogaster
gaaatgatttcac

SEQ ID NO: 619166 - DNA, 13 bp, D. melanogaster
gaaatgatttcga

SEQ ID NO: 619167 - DNA, 13 bp, D. melanogaster
gaaatgatttgtt

SEQ ID NO: 619168 - DNA, 14 bp, D. melanogaster
gaaatgatttgttt

SEQ ID NO: 619169 - DNA, 13 bp, D. melanogaster
gaaatgcaaaaac

SEQ ID NO: 619170 - DNA, 14 bp, D. melanogaster
gaaatgcaaaaaca

SEQ ID NO: 619171 - DNA, 13 bp, D. melanogaster
gaaatgcaaaaca

SEQ ID NO: 619172 - DNA, 13 bp, D. melanogaster
gaaatgcaaaata

SEQ ID NO: 619173 - DNA, 13 bp, D. melanogaster
gaaatgcaaacaa

SEQ ID NO: 619174 - DNA, 13 bp, D. melanogaster
gaaatgcaaacac

SEQ ID NO: 619175 - DNA, 13 bp, D. melanogaster
gaaatgcaaacat

SEQ ID NO: 619176 - DNA, 14 bp, D. melanogaster
gaaatgcaaataaa

SEQ ID NO: 619177 - DNA, 14 bp, D. melanogaster
gaaatgcaaatgaa

SEQ ID NO: 619178 - DNA, 13 bp, D. melanogaster
gaaatgcaaatta

SEQ ID NO: 619179 - DNA, 13 bp, D. melanogaster
gaaatgcaagaaa

SEQ ID NO: 619180 - DNA, 13 bp, D. melanogaster
gaaatgcaataaa

SEQ ID NO: 619181 - DNA, 13 bp, D. melanogaster
gaaatgcaatgaa

SEQ ID NO: 619182 - DNA, 14 bp, D. melanogaster
gaaatgcaattgaa

SEQ ID NO: 619183 - DNA, 13 bp, D. melanogaster
gaaatgcaattgc

SEQ ID NO: 619184 - DNA, 13 bp, D. melanogaster
gaaatgcaatttt

SEQ ID NO: 619185 - DNA, 13 bp, D. melanogaster
gaaatgcacaaaa

SEQ ID NO: 619186 - DNA, 13 bp, D. melanogaster
gaaatgcacacaa

SEQ ID NO: 619187 - DNA, 13 bp, D. melanogaster
gaaatgcagaaaa

SEQ ID NO: 619188 - DNA, 13 bp, D. melanogaster
gaaatgcagaaat

SEQ ID NO: 619189 - DNA, 13 bp, D. melanogaster
gaaatgcagccaa

SEQ ID NO: 619190 - DNA, 13 bp, D. melanogaster
gaaatgcagctgc

SEQ ID NO: 619191 - DNA, 13 bp, D. melanogaster
gaaatgcataaaa

SEQ ID NO: 619192 - DNA, 13 bp, D. melanogaster
gaaatgcatgaga

SEQ ID NO: 619193 - DNA, 13 bp, D. melanogaster
gaaatgcatgcaa

SEQ ID NO: 619194 - DNA, 13 bp, D. melanogaster
gaaatgcattcaa

SEQ ID NO: 619195 - DNA, 13 bp, D. melanogaster
gaaatgcattcga

SEQ ID NO: 619196 - DNA, 13 bp, D. melanogaster
gaaatgcatttaa

SEQ ID NO: 619197 - DNA, 13 bp, D. melanogaster
gaaatgcatttct

SEQ ID NO: 619198 - DNA, 13 bp, D. melanogaster
gaaatgcatttgc

SEQ ID NO: 619199 - DNA, 13 bp, D. melanogaster
gaaatgcatttta

SEQ ID NO: 619200 - DNA, 13 bp, D. melanogaster
gaaatgcattttt

SEQ ID NO: 619201 - DNA, 13 bp, D. melanogaster
gaaatgccaaaaa

SEQ ID NO: 619202 - DNA, 14 bp, D. melanogaster
gaaatgccaaaaaa

SEQ ID NO: 619203 - DNA, 13 bp, D. melanogaster
gaaatgccaaaag

SEQ ID NO: 619204 - DNA, 13 bp, D. melanogaster
gaaatgccaaaca

SEQ ID NO: 619205 - DNA, 13 bp, D. melanogaster
gaaatgccaatgc

SEQ ID NO: 619206 - DNA, 13 bp, D. melanogaster
gaaatgccataaa

SEQ ID NO: 619207 - DNA, 13 bp, D. melanogaster
gaaatgccattaa

SEQ ID NO: 619208 - DNA, 13 bp, D. melanogaster
gaaatgccggaaa

SEQ ID NO: 619209 - DNA, 13 bp, D. melanogaster
gaaatgcctgctc

SEQ ID NO: 619210 - DNA, 13 bp, D. melanogaster
gaaatgcgaaatg

SEQ ID NO: 619211 - DNA, 14 bp, D. melanogaster
gaaatgcgaaatgc

SEQ ID NO: 619212 - DNA, 13 bp, D. melanogaster
gaaatgcgaacaa

SEQ ID NO: 619213 - DNA, 13 bp, D. melanogaster
gaaatgcgaacgc

SEQ ID NO: 619214 - DNA, 13 bp, D. melanogaster
gaaatgcgaatga

SEQ ID NO: 619215 - DNA, 13 bp, D. melanogaster
gaaatgcgatcga

SEQ ID NO: 619216 - DNA, 13 bp, D. melanogaster
gaaatgcgcaaaa

SEQ ID NO: 619217 - DNA, 13 bp, D. melanogaster
gaaatgcggaaaa

SEQ ID NO: 619218 - DNA, 13 bp, D. melanogaster
gaaatgcggaaat

SEQ ID NO: 619219 - DNA, 13 bp, D. melanogaster
gaaatgcgttttc

SEQ ID NO: 619220 - DNA, 13 bp, D. melanogaster
gaaatgctaatga

SEQ ID NO: 619221 - DNA, 13 bp, D. melanogaster
gaaatgctcgaaa

SEQ ID NO: 619222 - DNA, 13 bp, D. melanogaster
gaaatgctgaaat

SEQ ID NO: 619223 - DNA, 13 bp, D. melanogaster
gaaatgctggaaa

SEQ ID NO: 619224 - DNA, 13 bp, D. melanogaster
gaaatgctggcaa

SEQ ID NO: 619225 - DNA, 13 bp, D. melanogaster
gaaatgctggcca

SEQ ID NO: 619226 - DNA, 14 bp, D. melanogaster
gaaatgctggccat

SEQ ID NO: 619227 - DNA, 14 bp, D. melanogaster
gaaatgcttaaaaa

SEQ ID NO: 619228 - DNA, 13 bp, D. melanogaster
gaaatgcttgcga

SEQ ID NO: 619229 - DNA, 13 bp, D. melanogaster
gaaatgcttttaa

SEQ ID NO: 619230 - DNA, 13 bp, D. melanogaster
gaaatgcttttgt

SEQ ID NO: 619231 - DNA, 14 bp, D. melanogaster
gaaatggaaaactt

SEQ ID NO: 619232 - DNA, 14 bp, D. melanogaster
gaaatggaaaagtg

SEQ ID NO: 619233 - DNA, 13 bp, D. melanogaster
gaaatggaaacaa

SEQ ID NO: 619234 - DNA, 13 bp, D. melanogaster
gaaatggaaaccg

SEQ ID NO: 619235 - DNA, 13 bp, D. melanogaster
gaaatggaaacga

SEQ ID NO: 619236 - DNA, 13 bp, D. melanogaster
gaaatggaaacgg

SEQ ID NO: 619237 - DNA, 13 bp, D. melanogaster
gaaatggaaacta

SEQ ID NO: 619238 - DNA, 13 bp, D. melanogaster
gaaatggaaactg

SEQ ID NO: 619239 - DNA, 13 bp, D. melanogaster
gaaatggaaagca

SEQ ID NO: 619240 - DNA, 13 bp, D. melanogaster
gaaatggaaatat

SEQ ID NO: 619241 - DNA, 13 bp, D. melanogaster
gaaatggaaatga

SEQ ID NO: 619242 - DNA, 14 bp, D. melanogaster
gaaatggaaatggg

SEQ ID NO: 619243 - DNA, 14 bp, D. melanogaster
gaaatggaaattaa

SEQ ID NO: 619244 - DNA, 14 bp, D. melanogaster
gaaatggaaattga

SEQ ID NO: 619245 - DNA, 13 bp, D. melanogaster
gaaatggaaattt

SEQ ID NO: 619246 - DNA, 13 bp, D. melanogaster
gaaatggaagtgg

SEQ ID NO: 619247 - DNA, 14 bp, D. melanogaster
gaaatggaagtgga

SEQ ID NO: 619248 - DNA, 13 bp, D. melanogaster
gaaatggaatcga

SEQ ID NO: 619249 - DNA, 13 bp, D. melanogaster
gaaatggaatgaa

SEQ ID NO: 619250 - DNA, 13 bp, D. melanogaster
gaaatggaatgca

SEQ ID NO: 619251 - DNA, 13 bp, D. melanogaster
gaaatggaatgga

SEQ ID NO: 619252 - DNA, 14 bp, D. melanogaster
gaaatggaatggaa

SEQ ID NO: 619253 - DNA, 13 bp, D. melanogaster
gaaatggaatggg

SEQ ID NO: 619254 - DNA, 13 bp, D. melanogaster
gaaatggaatttg

SEQ ID NO: 619255 - DNA, 13 bp, D. melanogaster
gaaatggagatta

SEQ ID NO: 619256 - DNA, 14 bp, D. melanogaster
gaaatggatttcca

SEQ ID NO: 619257 - DNA, 13 bp, D. melanogaster
gaaatggcaaaaa

SEQ ID NO: 619258 - DNA, 14 bp, D. melanogaster
gaaatggcaaaaaa

SEQ ID NO: 619259 - DNA, 13 bp, D. melanogaster
gaaatggcaaaat

SEQ ID NO: 619260 - DNA, 13 bp, D. melanogaster
gaaatggcaaaca

SEQ ID NO: 619261 - DNA, 13 bp, D. melanogaster
gaaatggcaaaga

SEQ ID NO: 619262 - DNA, 13 bp, D. melanogaster
gaaatggcaaatg

SEQ ID NO: 619263 - DNA, 14 bp, D. melanogaster
gaaatggcaaatgg

SEQ ID NO: 619264 - DNA, 13 bp, D. melanogaster
gaaatggcaaatt

SEQ ID NO: 619265 - DNA, 13 bp, D. melanogaster
gaaatggcaacta

SEQ ID NO: 619266 - DNA, 13 bp, D. melanogaster
gaaatggcaattg

SEQ ID NO: 619267 - DNA, 13 bp, D. melanogaster
gaaatggcagaaa

SEQ ID NO: 619268 - DNA, 13 bp, D. melanogaster
gaaatggcataaa

SEQ ID NO: 619269 - DNA, 13 bp, D. melanogaster
gaaatggccaaaa

SEQ ID NO: 619270 - DNA, 14 bp, D. melanogaster
gaaatggccaaaaa

SEQ ID NO: 619271 - DNA, 14 bp, D. melanogaster
gaaatggccaaaag

SEQ ID NO: 619272 - DNA, 14 bp, D. melanogaster
gaaatggccaaaat

SEQ ID NO: 619273 - DNA, 13 bp, D. melanogaster
gaaatggccaaat

SEQ ID NO: 619274 - DNA, 13 bp, D. melanogaster
gaaatggccattt

SEQ ID NO: 619275 - DNA, 13 bp, D. melanogaster
gaaatggctttaa

SEQ ID NO: 619276 - DNA, 13 bp, D. melanogaster
gaaatgggaaaac

SEQ ID NO: 619277 - DNA, 13 bp, D. melanogaster
gaaatgggaaaca

SEQ ID NO: 619278 - DNA, 13 bp, D. melanogaster
gaaatgggaaact

SEQ ID NO: 619279 - DNA, 14 bp, D. melanogaster
gaaatgggaaatgg

SEQ ID NO: 619280 - DNA, 13 bp, D. melanogaster
gaaatgggaatgc

SEQ ID NO: 619281 - DNA, 13 bp, D. melanogaster
gaaatgggaggca

SEQ ID NO: 619282 - DNA, 13 bp, D. melanogaster
gaaatgggagtgg

SEQ ID NO: 619283 - DNA, 13 bp, D. melanogaster
gaaatgggcgaaa

SEQ ID NO: 619284 - DNA, 13 bp, D. melanogaster
gaaatgggtgaaa

SEQ ID NO: 619285 - DNA, 13 bp, D. melanogaster
gaaatgggtggaa

SEQ ID NO: 619286 - DNA, 13 bp, D. melanogaster
gaaatggtgaaaa

SEQ ID NO: 619287 - DNA, 13 bp, D. melanogaster
gaaatggtgaaat

SEQ ID NO: 619288 - DNA, 13 bp, D. melanogaster
gaaatggtggaaa

SEQ ID NO: 619289 - DNA, 13 bp, D. melanogaster
gaaatggttaaaa

SEQ ID NO: 619290 - DNA, 13 bp, D. melanogaster
gaaatggttacac

SEQ ID NO: 619291 - DNA, 14 bp, D. melanogaster
gaaatggttacacc

SEQ ID NO: 619292 - DNA, 13 bp, D. melanogaster
gaaatggtttaaa

SEQ ID NO: 619293 - DNA, 13 bp, D. melanogaster
gaaatggttttgg

SEQ ID NO: 619294 - DNA, 13 bp, D. melanogaster
gaaatgtaaatct

SEQ ID NO: 619295 - DNA, 13 bp, D. melanogaster
gaaatgtaatgaa

SEQ ID NO: 619296 - DNA, 13 bp, D. melanogaster
gaaatgtaattta

SEQ ID NO: 619297 - DNA, 13 bp, D. melanogaster
gaaatgtacaaaa

SEQ ID NO: 619298 - DNA, 14 bp, D. melanogaster
gaaatgtacaaaaa

SEQ ID NO: 619299 - DNA, 13 bp, D. melanogaster
gaaatgtacatat

SEQ ID NO: 619300 - DNA, 13 bp, D. melanogaster
gaaatgtacggaa

SEQ ID NO: 619301 - DNA, 13 bp, D. melanogaster
gaaatgtactttt

SEQ ID NO: 619302 - DNA, 13 bp, D. melanogaster
gaaatgtataaat

SEQ ID NO: 619303 - DNA, 13 bp, D. melanogaster
gaaatgtatatgt

SEQ ID NO: 619304 - DNA, 13 bp, D. melanogaster
gaaatgtatgtaa

SEQ ID NO: 619305 - DNA, 13 bp, D. melanogaster
gaaatgtatgtat

SEQ ID NO: 619306 - DNA, 13 bp, D. melanogaster
gaaatgtatttaa

SEQ ID NO: 619307 - DNA, 14 bp, D. melanogaster
gaaatgtatttaaa

SEQ ID NO: 619308 - DNA, 13 bp, D. melanogaster
gaaatgtatttgc

SEQ ID NO: 619309 - DNA, 13 bp, D. melanogaster
gaaatgtcaataa

SEQ ID NO: 619310 - DNA, 13 bp, D. melanogaster
gaaatgtcgacgg

SEQ ID NO: 619311 - DNA, 13 bp, D. melanogaster
gaaatgtctacca

SEQ ID NO: 619312 - DNA, 13 bp, D. melanogaster
gaaatgtgaaaca

SEQ ID NO: 619313 - DNA, 13 bp, D. melanogaster
gaaatgtgaaata

SEQ ID NO: 619314 - DNA, 14 bp, D. melanogaster
gaaatgtgaaatgt

SEQ ID NO: 619315 - DNA, 13 bp, D. melanogaster
gaaatgtgaattt

SEQ ID NO: 619316 - DNA, 13 bp, D. melanogaster
gaaatgtgcaaat

SEQ ID NO: 619317 - DNA, 13 bp, D. melanogaster
gaaatgtgccaaa

SEQ ID NO: 619318 - DNA, 13 bp, D. melanogaster
gaaatgtggaaaa

SEQ ID NO: 619319 - DNA, 13 bp, D. melanogaster
gaaatgtggagca

SEQ ID NO: 619320 - DNA, 13 bp, D. melanogaster
gaaatgtggccaa

SEQ ID NO: 619321 - DNA, 13 bp, D. melanogaster
gaaatgtgtcaaa

SEQ ID NO: 619322 - DNA, 13 bp, D. melanogaster
gaaatgtgtgcca

SEQ ID NO: 619323 - DNA, 13 bp, D. melanogaster
gaaatgttaatga

SEQ ID NO: 619324 - DNA, 13 bp, D. melanogaster
gaaatgttaattg

SEQ ID NO: 619325 - DNA, 13 bp, D. melanogaster
gaaatgttagttt

SEQ ID NO: 619326 - DNA, 13 bp, D. melanogaster
gaaatgttattaa

SEQ ID NO: 619327 - DNA, 13 bp, D. melanogaster
gaaatgttcgaaa

SEQ ID NO: 619328 - DNA, 13 bp, D. melanogaster
gaaatgttgaaat

SEQ ID NO: 619329 - DNA, 13 bp, D. melanogaster
gaaatgttgcaat

SEQ ID NO: 619330 - DNA, 13 bp, D. melanogaster
gaaatgttgccaa

SEQ ID NO: 619331 - DNA, 13 bp, D. melanogaster
gaaatgttggaaa

SEQ ID NO: 619332 - DNA, 13 bp, D. melanogaster
gaaatgttggcaa

SEQ ID NO: 619333 - DNA, 13 bp, D. melanogaster
gaaatgtttaaat

SEQ ID NO: 619334 - DNA, 13 bp, D. melanogaster
gaaatgtttaatt

SEQ ID NO: 619335 - DNA, 13 bp, D. melanogaster
gaaatgtttacaa

SEQ ID NO: 619336 - DNA, 13 bp, D. melanogaster
gaaatgtttatgg

SEQ ID NO: 619337 - DNA, 13 bp, D. melanogaster
gaaatgtttattt

SEQ ID NO: 619338 - DNA, 13 bp, D. melanogaster
gaaatgtttcaat

SEQ ID NO: 619339 - DNA, 13 bp, D. melanogaster
gaaatgtttgaaa

SEQ ID NO: 619340 - DNA, 13 bp, D. melanogaster
gaaatgtttgcaa

SEQ ID NO: 619341 - DNA, 14 bp, D. melanogaster
gaaatgtttgccat

SEQ ID NO: 619342 - DNA, 13 bp, D. melanogaster
gaaatgtttgccg

SEQ ID NO: 619343 - DNA, 13 bp, D. melanogaster
gaaatgtttggaa

SEQ ID NO: 619344 - DNA, 13 bp, D. melanogaster
gaaatgtttgtgc

SEQ ID NO: 619345 - DNA, 13 bp, D. melanogaster
gaaatgttttata

SEQ ID NO: 619346 - DNA, 13 bp, D. melanogaster
gaaatgttttcca

SEQ ID NO: 619347 - DNA, 13 bp, D. melanogaster
gaaatgttttccg

SEQ ID NO: 619348 - DNA, 13 bp, D. melanogaster
gaaatgttttgct

SEQ ID NO: 619349 - DNA, 14 bp, D. melanogaster
gaaatgtttttaaa

SEQ ID NO: 619350 - DNA, 13 bp, D. melanogaster
gaaattaaaattg

SEQ ID NO: 619351 - DNA, 14 bp, D. melanogaster
gaaattaaatcaaa

SEQ ID NO: 619352 - DNA, 13 bp, D. melanogaster
gaaattaaattga

SEQ ID NO: 619353 - DNA, 13 bp, D. melanogaster
gaaattaacaaat

SEQ ID NO: 619354 - DNA, 14 bp, D. melanogaster
gaaattaacatttt

SEQ ID NO: 619355 - DNA, 13 bp, D. melanogaster
gaaattaactaaa

SEQ ID NO: 619356 - DNA, 13 bp, D. melanogaster
gaaattaactgcc

SEQ ID NO: 619357 - DNA, 13 bp, D. melanogaster
gaaattaactttt

SEQ ID NO: 619358 - DNA, 13 bp, D. melanogaster
gaaattaagctac

SEQ ID NO: 619359 - DNA, 14 bp, D. melanogaster
gaaattaagctacg

SEQ ID NO: 619360 - DNA, 14 bp, D. melanogaster
gaaattaaggagct

SEQ ID NO: 619361 - DNA, 13 bp, D. melanogaster
gaaattaattatg

SEQ ID NO: 619362 - DNA, 13 bp, D. melanogaster
gaaattaattggt

SEQ ID NO: 619363 - DNA, 13 bp, D. melanogaster
gaaattaatttca

SEQ ID NO: 619364 - DNA, 14 bp, D. melanogaster
gaaattaatttcaa

SEQ ID NO: 619365 - DNA, 13 bp, D. melanogaster
gaaattaatttcc

SEQ ID NO: 619366 - DNA, 13 bp, D. melanogaster
gaaattacaattc

SEQ ID NO: 619367 - DNA, 13 bp, D. melanogaster
gaaattacagtag

SEQ ID NO: 619368 - DNA, 13 bp, D. melanogaster
gaaattacattga

SEQ ID NO: 619369 - DNA, 14 bp, D. melanogaster
gaaattacattttt

SEQ ID NO: 619370 - DNA, 13 bp, D. melanogaster
gaaattaccaaaa

SEQ ID NO: 619371 - DNA, 14 bp, D. melanogaster
gaaattaccaaaac

SEQ ID NO: 619372 - DNA, 13 bp, D. melanogaster
gaaattagaaagt

SEQ ID NO: 619373 - DNA, 14 bp, D. melanogaster
gaaattagcataaa

SEQ ID NO: 619374 - DNA, 13 bp, D. melanogaster
gaaattagcattt

SEQ ID NO: 619375 - DNA, 13 bp, D. melanogaster
gaaattagttgta

SEQ ID NO: 619376 - DNA, 13 bp, D. melanogaster
gaaattagtttaa

SEQ ID NO: 619377 - DNA, 13 bp, D. melanogaster
gaaattagtttat

SEQ ID NO: 619378 - DNA, 13 bp, D. melanogaster
gaaattagttttc

SEQ ID NO: 619379 - DNA, 14 bp, D. melanogaster
gaaattagttttta

SEQ ID NO: 619380 - DNA, 13 bp, D. melanogaster
gaaattatacatt

SEQ ID NO: 619381 - DNA, 13 bp, D. melanogaster
gaaattatagcaa

SEQ ID NO: 619382 - DNA, 14 bp, D. melanogaster
gaaattatcaaaaa

SEQ ID NO: 619383 - DNA, 13 bp, D. melanogaster
gaaattatcaatt

SEQ ID NO: 619384 - DNA, 13 bp, D. melanogaster
gaaattatgcaaa

SEQ ID NO: 619385 - DNA, 13 bp, D. melanogaster
gaaattattgcaa

SEQ ID NO: 619386 - DNA, 13 bp, D. melanogaster
gaaattattgtaa

SEQ ID NO: 619387 - DNA, 13 bp, D. melanogaster
gaaattattgtat

SEQ ID NO: 619388 - DNA, 13 bp, D. melanogaster
gaaattattgttt

SEQ ID NO: 619389 - DNA, 14 bp, D. melanogaster
gaaattatttagtt

SEQ ID NO: 619390 - DNA, 13 bp, D. melanogaster
gaaattatttcat

SEQ ID NO: 619391 - DNA, 13 bp, D. melanogaster
gaaattatttgat

SEQ ID NO: 619392 - DNA, 13 bp, D. melanogaster
gaaattatttgtt

SEQ ID NO: 619393 - DNA, 13 bp, D. melanogaster
gaaattattttca

SEQ ID NO: 619394 - DNA, 13 bp, D. melanogaster
gaaattattttgg

SEQ ID NO: 619395 - DNA, 13 bp, D. melanogaster
gaaattcaaaaac

SEQ ID NO: 619396 - DNA, 13 bp, D. melanogaster
gaaattcaaaaat

SEQ ID NO: 619397 - DNA, 14 bp, D. melanogaster
gaaattcaaaattt

SEQ ID NO: 619398 - DNA, 13 bp, D. melanogaster
gaaattcaaacaa

SEQ ID NO: 619399 - DNA, 13 bp, D. melanogaster
gaaattcaaactg

SEQ ID NO: 619400 - DNA, 13 bp, D. melanogaster
gaaattcaaagaa

SEQ ID NO: 619401 - DNA, 13 bp, D. melanogaster
gaaattcaaagta

SEQ ID NO: 619402 - DNA, 13 bp, D. melanogaster
gaaattcaaataa

SEQ ID NO: 619403 - DNA, 14 bp, D. melanogaster
gaaattcaaatgaa

SEQ ID NO: 619404 - DNA, 13 bp, D. melanogaster
gaaattcaaatgc

SEQ ID NO: 619405 - DNA, 14 bp, D. melanogaster
gaaattcaaattca

SEQ ID NO: 619406 - DNA, 13 bp, D. melanogaster
gaaattcaaattt

SEQ ID NO: 619407 - DNA, 14 bp, D. melanogaster
gaaattcaaatttt

SEQ ID NO: 619408 - DNA, 13 bp, D. melanogaster
gaaattcaataaa

SEQ ID NO: 619409 - DNA, 13 bp, D. melanogaster
gaaattcaatgaa

SEQ ID NO: 619410 - DNA, 13 bp, D. melanogaster
gaaattcaattgc

SEQ ID NO: 619411 - DNA, 13 bp, D. melanogaster
gaaattcaattgt

SEQ ID NO: 619412 - DNA, 13 bp, D. melanogaster
gaaattcaatttc

SEQ ID NO: 619413 - DNA, 13 bp, D. melanogaster
gaaattcaatttg

SEQ ID NO: 619414 - DNA, 14 bp, D. melanogaster
gaaattcaatttgt

SEQ ID NO: 619415 - DNA, 13 bp, D. melanogaster
gaaattcatattt

SEQ ID NO: 619416 - DNA, 13 bp, D. melanogaster
gaaattcattcaa

SEQ ID NO: 619417 - DNA, 13 bp, D. melanogaster
gaaattcattgaa

SEQ ID NO: 619418 - DNA, 14 bp, D. melanogaster
gaaattcatttaat

SEQ ID NO: 619419 - DNA, 13 bp, D. melanogaster
gaaattcattttt

SEQ ID NO: 619420 - DNA, 13 bp, D. melanogaster
gaaattccaaatt

SEQ ID NO: 619421 - DNA, 13 bp, D. melanogaster
gaaattccaacca

SEQ ID NO: 619422 - DNA, 13 bp, D. melanogaster
gaaattccaagaa

SEQ ID NO: 619423 - DNA, 13 bp, D. melanogaster
gaaattccattga

SEQ ID NO: 619424 - DNA, 13 bp, D. melanogaster
gaaattccatttg

SEQ ID NO: 619425 - DNA, 13 bp, D. melanogaster
gaaattccatttt

SEQ ID NO: 619426 - DNA, 13 bp, D. melanogaster
gaaattcctaata

SEQ ID NO: 619427 - DNA, 13 bp, D. melanogaster
gaaattccttaaa

SEQ ID NO: 619428 - DNA, 13 bp, D. melanogaster
gaaattcgaaaaa

SEQ ID NO: 619429 - DNA, 13 bp, D. melanogaster
gaaattcgaaatt

SEQ ID NO: 619430 - DNA, 13 bp, D. melanogaster
gaaattcgatttg

SEQ ID NO: 619431 - DNA, 13 bp, D. melanogaster
gaaattcgcataa

SEQ ID NO: 619432 - DNA, 16 bp, D. melanogaster
gaaattcgtcgctacc

SEQ ID NO: 619433 - DNA, 13 bp, D. melanogaster
gaaattcgttttc

SEQ ID NO: 619434 - DNA, 13 bp, D. melanogaster
gaaattcgttttt

SEQ ID NO: 619435 - DNA, 13 bp, D. melanogaster
gaaattctaaaat

SEQ ID NO: 619436 - DNA, 13 bp, D. melanogaster
gaaattctaattt

SEQ ID NO: 619437 - DNA, 13 bp, D. melanogaster
gaaattctataaa

SEQ ID NO: 619438 - DNA, 13 bp, D. melanogaster
gaaattctatttt

SEQ ID NO: 619439 - DNA, 13 bp, D. melanogaster
gaaattctccaaa

SEQ ID NO: 619440 - DNA, 13 bp, D. melanogaster
gaaattctggtgt

SEQ ID NO: 619441 - DNA, 13 bp, D. melanogaster
gaaattcttaaat

SEQ ID NO: 619442 - DNA, 13 bp, D. melanogaster
gaaattctttaaa

SEQ ID NO: 619443 - DNA, 13 bp, D. melanogaster
gaaattctttgtt

SEQ ID NO: 619444 - DNA, 13 bp, D. melanogaster
gaaattctttttt

SEQ ID NO: 619445 - DNA, 13 bp, D. melanogaster
gaaattgaaaatg

SEQ ID NO: 619446 - DNA, 14 bp, D. melanogaster
gaaattgaaaattg

SEQ ID NO: 619447 - DNA, 14 bp, D. melanogaster
gaaattgaaaattt

SEQ ID NO: 619448 - DNA, 13 bp, D. melanogaster
gaaattgaaagca

SEQ ID NO: 619449 - DNA, 13 bp, D. melanogaster
gaaattgaaatat

SEQ ID NO: 619450 - DNA, 13 bp, D. melanogaster
gaaattgaaatca

SEQ ID NO: 619451 - DNA, 14 bp, D. melanogaster
gaaattgaaatcga

SEQ ID NO: 619452 - DNA, 13 bp, D. melanogaster
gaaattgaaatct

SEQ ID NO: 619453 - DNA, 14 bp, D. melanogaster
gaaattgaaatgaa

SEQ ID NO: 619454 - DNA, 13 bp, D. melanogaster
gaaattgaaatgg

SEQ ID NO: 619455 - DNA, 13 bp, D. melanogaster
gaaattgaaatgt

SEQ ID NO: 619456 - DNA, 13 bp, D. melanogaster
gaaattgaaatta

SEQ ID NO: 619457 - DNA, 14 bp, D. melanogaster
gaaattgaaattga

SEQ ID NO: 619458 - DNA, 14 bp, D. melanogaster
gaaattgaaattgc

SEQ ID NO: 619459 - DNA, 13 bp, D. melanogaster
gaaattgaaattt

SEQ ID NO: 619460 - DNA, 14 bp, D. melanogaster
gaaattgaaatttt

SEQ ID NO: 619461 - DNA, 13 bp, D. melanogaster
gaaattgaattgt

SEQ ID NO: 619462 - DNA, 13 bp, D. melanogaster
gaaattgaattta

SEQ ID NO: 619463 - DNA, 13 bp, D. melanogaster
gaaattgactttg

SEQ ID NO: 619464 - DNA, 13 bp, D. melanogaster
gaaattgatgaaa

SEQ ID NO: 619465 - DNA, 13 bp, D. melanogaster
gaaattgattaat

SEQ ID NO: 619466 - DNA, 13 bp, D. melanogaster
gaaattgattctt

SEQ ID NO: 619467 - DNA, 13 bp, D. melanogaster
gaaattgatttgt

SEQ ID NO: 619468 - DNA, 13 bp, D. melanogaster
gaaattgattttt

SEQ ID NO: 619469 - DNA, 14 bp, D. melanogaster
gaaattgatttttc

SEQ ID NO: 619470 - DNA, 13 bp, D. melanogaster
gaaattgcaaaat

SEQ ID NO: 619471 - DNA, 13 bp, D. melanogaster
gaaattgcaactg

SEQ ID NO: 619472 - DNA, 13 bp, D. melanogaster
gaaattgcaattg

SEQ ID NO: 619473 - DNA, 13 bp, D. melanogaster
gaaattgcaattt

SEQ ID NO: 619474 - DNA, 13 bp, D. melanogaster
gaaattgcataaa

SEQ ID NO: 619475 - DNA, 13 bp, D. melanogaster
gaaattgcattgt

SEQ ID NO: 619476 - DNA, 13 bp, D. melanogaster
gaaattgcatttg

SEQ ID NO: 619477 - DNA, 14 bp, D. melanogaster
gaaattgcattttc

SEQ ID NO: 619478 - DNA, 13 bp, D. melanogaster
gaaattgccaaaa

SEQ ID NO: 619479 - DNA, 14 bp, D. melanogaster
gaaattgccaaaat

SEQ ID NO: 619480 - DNA, 13 bp, D. melanogaster
gaaattgccaaca

SEQ ID NO: 619481 - DNA, 13 bp, D. melanogaster
gaaattgccaagc

SEQ ID NO: 619482 - DNA, 13 bp, D. melanogaster
gaaattgcctttt

SEQ ID NO: 619483 - DNA, 13 bp, D. melanogaster
gaaattgcgaaaa

SEQ ID NO: 619484 - DNA, 13 bp, D. melanogaster
gaaattgctaaca

SEQ ID NO: 619485 - DNA, 13 bp, D. melanogaster
gaaattgctggca

SEQ ID NO: 619486 - DNA, 13 bp, D. melanogaster
gaaattgcttaat

SEQ ID NO: 619487 - DNA, 13 bp, D. melanogaster
gaaattgctttgc

SEQ ID NO: 619488 - DNA, 13 bp, D. melanogaster
gaaattgcttttc

SEQ ID NO: 619489 - DNA, 13 bp, D. melanogaster
gaaattgcttttg

SEQ ID NO: 619490 - DNA, 13 bp, D. melanogaster
gaaattggaaaac

SEQ ID NO: 619491 - DNA, 13 bp, D. melanogaster
gaaattggaaaat

SEQ ID NO: 619492 - DNA, 13 bp, D. melanogaster
gaaattggaaatt

SEQ ID NO: 619493 - DNA, 13 bp, D. melanogaster
gaaattggaattg

SEQ ID NO: 619494 - DNA, 14 bp, D. melanogaster
gaaattggaattga

SEQ ID NO: 619495 - DNA, 13 bp, D. melanogaster
gaaattggaattt

SEQ ID NO: 619496 - DNA, 13 bp, D. melanogaster
gaaattggcaaaa

SEQ ID NO: 619497 - DNA, 13 bp, D. melanogaster
gaaattggcaatt

SEQ ID NO: 619498 - DNA, 14 bp, D. melanogaster
gaaattggccaaaa

SEQ ID NO: 619499 - DNA, 14 bp, D. melanogaster
gaaattggccaaca

SEQ ID NO: 619500 - DNA, 13 bp, D. melanogaster
gaaattgggaatt

SEQ ID NO: 619501 - DNA, 13 bp, D. melanogaster
gaaattggggaaa

SEQ ID NO: 619502 - DNA, 13 bp, D. melanogaster
gaaattgggttaa

SEQ ID NO: 619503 - DNA, 13 bp, D. melanogaster
gaaattggtaaaa

SEQ ID NO: 619504 - DNA, 13 bp, D. melanogaster
gaaattggttttt

SEQ ID NO: 619505 - DNA, 13 bp, D. melanogaster
gaaattgtaaata

SEQ ID NO: 619506 - DNA, 13 bp, D. melanogaster
gaaattgtaaatt

SEQ ID NO: 619507 - DNA, 13 bp, D. melanogaster
gaaattgtaataa

SEQ ID NO: 619508 - DNA, 14 bp, D. melanogaster
gaaattgtaatatt

SEQ ID NO: 619509 - DNA, 13 bp, D. melanogaster
gaaattgtacaaa

SEQ ID NO: 619510 - DNA, 13 bp, D. melanogaster
gaaattgtagaag

SEQ ID NO: 619511 - DNA, 13 bp, D. melanogaster
gaaattgtatatt

SEQ ID NO: 619512 - DNA, 13 bp, D. melanogaster
gaaattgtattaa

SEQ ID NO: 619513 - DNA, 13 bp, D. melanogaster
gaaattgtattag

SEQ ID NO: 619514 - DNA, 13 bp, D. melanogaster
gaaattgtatttt

SEQ ID NO: 619515 - DNA, 13 bp, D. melanogaster
gaaattgtcaaaa

SEQ ID NO: 619516 - DNA, 13 bp, D. melanogaster
gaaattgtcaaat

SEQ ID NO: 619517 - DNA, 13 bp, D. melanogaster
gaaattgtgattt

SEQ ID NO: 619518 - DNA, 13 bp, D. melanogaster
gaaattgtgtaaa

SEQ ID NO: 619519 - DNA, 13 bp, D. melanogaster
gaaattgtgtcaa

SEQ ID NO: 619520 - DNA, 14 bp, D. melanogaster
gaaattgttaaatt

SEQ ID NO: 619521 - DNA, 13 bp, D. melanogaster
gaaattgttaata

SEQ ID NO: 619522 - DNA, 13 bp, D. melanogaster
gaaattgttacaa

SEQ ID NO: 619523 - DNA, 14 bp, D. melanogaster
gaaattgttgcaaa

SEQ ID NO: 619524 - DNA, 13 bp, D. melanogaster
gaaattgttgcag

SEQ ID NO: 619525 - DNA, 13 bp, D. melanogaster
gaaattgttgcca

SEQ ID NO: 619526 - DNA, 13 bp, D. melanogaster
gaaattgttgttg

SEQ ID NO: 619527 - DNA, 13 bp, D. melanogaster
gaaattgtttcaa

SEQ ID NO: 619528 - DNA, 13 bp, D. melanogaster
gaaattgttttca

SEQ ID NO: 619529 - DNA, 13 bp, D. melanogaster
gaaattgttttta

SEQ ID NO: 619530 - DNA, 13 bp, D. melanogaster
gaaatttaaaaac

SEQ ID NO: 619531 - DNA, 13 bp, D. melanogaster
gaaatttaaatgt

SEQ ID NO: 619532 - DNA, 13 bp, D. melanogaster
gaaatttaacaaa

SEQ ID NO: 619533 - DNA, 13 bp, D. melanogaster
gaaatttaagtaa

SEQ ID NO: 619534 - DNA, 13 bp, D. melanogaster
gaaatttaagttt

SEQ ID NO: 619535 - DNA, 13 bp, D. melanogaster
gaaatttaataca

SEQ ID NO: 619536 - DNA, 13 bp, D. melanogaster
gaaatttaatgaa

SEQ ID NO: 619537 - DNA, 13 bp, D. melanogaster
gaaatttaattac

SEQ ID NO: 619538 - DNA, 13 bp, D. melanogaster
gaaatttaattag

SEQ ID NO: 619539 - DNA, 14 bp, D. melanogaster
gaaatttaatttgc

SEQ ID NO: 619540 - DNA, 13 bp, D. melanogaster
gaaatttacaaaa

SEQ ID NO: 619541 - DNA, 13 bp, D. melanogaster
gaaatttacatat

SEQ ID NO: 619542 - DNA, 13 bp, D. melanogaster
gaaatttactttt

SEQ ID NO: 619543 - DNA, 14 bp, D. melanogaster
gaaatttatgcgca

SEQ ID NO: 619544 - DNA, 13 bp, D. melanogaster
gaaatttatgctt

SEQ ID NO: 619545 - DNA, 13 bp, D. melanogaster
gaaatttattgaa

SEQ ID NO: 619546 - DNA, 13 bp, D. melanogaster
gaaatttattgca

SEQ ID NO: 619547 - DNA, 13 bp, D. melanogaster
gaaatttattgta

SEQ ID NO: 619548 - DNA, 13 bp, D. melanogaster
gaaatttatttgt

SEQ ID NO: 619549 - DNA, 14 bp, D. melanogaster
gaaatttcactttt

SEQ ID NO: 619550 - DNA, 13 bp, D. melanogaster
gaaatttcattat

SEQ ID NO: 619551 - DNA, 13 bp, D. melanogaster
gaaatttcattgc

SEQ ID NO: 619552 - DNA, 13 bp, D. melanogaster
gaaatttccattt

SEQ ID NO: 619553 - DNA, 13 bp, D. melanogaster
gaaatttccccaa

SEQ ID NO: 619554 - DNA, 13 bp, D. melanogaster
gaaatttcgaaaa

SEQ ID NO: 619555 - DNA, 14 bp, D. melanogaster
gaaatttcgtgttt

SEQ ID NO: 619556 - DNA, 13 bp, D. melanogaster
gaaatttgaaaag

SEQ ID NO: 619557 - DNA, 13 bp, D. melanogaster
gaaatttgaaaat

SEQ ID NO: 619558 - DNA, 14 bp, D. melanogaster
gaaatttgaaaatt

SEQ ID NO: 619559 - DNA, 13 bp, D. melanogaster
gaaatttgaaagc

SEQ ID NO: 619560 - DNA, 13 bp, D. melanogaster
gaaatttgaataa

SEQ ID NO: 619561 - DNA, 13 bp, D. melanogaster
gaaatttgatatt

SEQ ID NO: 619562 - DNA, 13 bp, D. melanogaster
gaaatttgcacaa

SEQ ID NO: 619563 - DNA, 13 bp, D. melanogaster
gaaatttgcatat

SEQ ID NO: 619564 - DNA, 13 bp, D. melanogaster
gaaatttgcatgc

SEQ ID NO: 619565 - DNA, 13 bp, D. melanogaster
gaaatttggaaat

SEQ ID NO: 619566 - DNA, 13 bp, D. melanogaster
gaaatttgggtta

SEQ ID NO: 619567 - DNA, 13 bp, D. melanogaster
gaaatttgtcgca

SEQ ID NO: 619568 - DNA, 14 bp, D. melanogaster
gaaatttgtgaaat

SEQ ID NO: 619569 - DNA, 13 bp, D. melanogaster
gaaatttgtgtgt

SEQ ID NO: 619570 - DNA, 13 bp, D. melanogaster
gaaatttgttcaa

SEQ ID NO: 619571 - DNA, 13 bp, D. melanogaster
gaaatttgttcat

SEQ ID NO: 619572 - DNA, 13 bp, D. melanogaster
gaaatttgttgac

SEQ ID NO: 619573 - DNA, 13 bp, D. melanogaster
gaaatttgtttaa

SEQ ID NO: 619574 - DNA, 14 bp, D. melanogaster
gaaatttgttttaa

SEQ ID NO: 619575 - DNA, 13 bp, D. melanogaster
gaaattttaatga

SEQ ID NO: 619576 - DNA, 13 bp, D. melanogaster
gaaattttacaaa

SEQ ID NO: 619577 - DNA, 13 bp, D. melanogaster
gaaattttattac

SEQ ID NO: 619578 - DNA, 13 bp, D. melanogaster
gaaattttcaaaa

SEQ ID NO: 619579 - DNA, 13 bp, D. melanogaster
gaaattttcaaat

SEQ ID NO: 619580 - DNA, 13 bp, D. melanogaster
gaaattttcattt

SEQ ID NO: 619581 - DNA, 13 bp, D. melanogaster
gaaattttcccaa

SEQ ID NO: 619582 - DNA, 13 bp, D. melanogaster
gaaattttcgtta

SEQ ID NO: 619583 - DNA, 13 bp, D. melanogaster
gaaattttctttt

SEQ ID NO: 619584 - DNA, 13 bp, D. melanogaster
gaaattttgaaaa

SEQ ID NO: 619585 - DNA, 13 bp, D. melanogaster
gaaattttgaatt

SEQ ID NO: 619586 - DNA, 13 bp, D. melanogaster
gaaattttgctga

SEQ ID NO: 619587 - DNA, 13 bp, D. melanogaster
gaaattttggaaa

SEQ ID NO: 619588 - DNA, 14 bp, D. melanogaster
gaaatttttaaaag

SEQ ID NO: 619589 - DNA, 13 bp, D. melanogaster
gaaatttttcaaa

SEQ ID NO: 619590 - DNA, 13 bp, D. melanogaster
gaaatttttgaat

SEQ ID NO: 619591 - DNA, 13 bp, D. melanogaster
gaaattttttcaa

SEQ ID NO: 619592 - DNA, 13 bp, D. melanogaster
gaacaaaaatgta

SEQ ID NO: 619593 - DNA, 14 bp, D. melanogaster
gaacaaaaattcga

SEQ ID NO: 619594 - DNA, 13 bp, D. melanogaster
gaacaaaagatta

SEQ ID NO: 619595 - DNA, 13 bp, D. melanogaster
gaacaaaatatat

SEQ ID NO: 619596 - DNA, 13 bp, D. melanogaster
gaacaaaatgttt

SEQ ID NO: 619597 - DNA, 13 bp, D. melanogaster
gaacaaaattcat

SEQ ID NO: 619598 - DNA, 13 bp, D. melanogaster
gaacaaacaattt

SEQ ID NO: 619599 - DNA, 13 bp, D. melanogaster
gaacaaactgaag

SEQ ID NO: 619600 - DNA, 14 bp, D. melanogaster
gaacaaagtacaaa

SEQ ID NO: 619601 - DNA, 13 bp, D. melanogaster
gaacaaatgatga

SEQ ID NO: 619602 - DNA, 13 bp, D. melanogaster
gaacaaattataa

SEQ ID NO: 619603 - DNA, 13 bp, D. melanogaster
gaacaaattattt

SEQ ID NO: 619604 - DNA, 13 bp, D. melanogaster
gaacaaattgaaa

SEQ ID NO: 619605 - DNA, 13 bp, D. melanogaster
gaacaaatttaaa

SEQ ID NO: 619606 - DNA, 13 bp, D. melanogaster
gaacaaattttgt

SEQ ID NO: 619607 - DNA, 13 bp, D. melanogaster
gaacaacaaatgc

SEQ ID NO: 619608 - DNA, 13 bp, D. melanogaster
gaacaacaaattt

SEQ ID NO: 619609 - DNA, 13 bp, D. melanogaster
gaacaacaacagc

SEQ ID NO: 619610 - DNA, 13 bp, D. melanogaster
gaacaacaacagt

SEQ ID NO: 619611 - DNA, 14 bp, D. melanogaster
gaacaacaataaca

SEQ ID NO: 619612 - DNA, 13 bp, D. melanogaster
gaacaacaataat

SEQ ID NO: 619613 - DNA, 13 bp, D. melanogaster
gaacaacaatagt

SEQ ID NO: 619614 - DNA, 14 bp, D. melanogaster
gaacaactacaaca

SEQ ID NO: 619615 - DNA, 13 bp, D. melanogaster
gaacaagaaaatg

SEQ ID NO: 619616 - DNA, 13 bp, D. melanogaster
gaacaagacgagc

SEQ ID NO: 619617 - DNA, 13 bp, D. melanogaster
gaacaagcattta

SEQ ID NO: 619618 - DNA, 13 bp, D. melanogaster
gaacaagtctgca

SEQ ID NO: 619619 - DNA, 13 bp, D. melanogaster
gaacaataataat

SEQ ID NO: 619620 - DNA, 13 bp, D. melanogaster
gaacaatgaatca

SEQ ID NO: 619621 - DNA, 13 bp, D. melanogaster
gaacaatgcctcc

SEQ ID NO: 619622 - DNA, 13 bp, D. melanogaster
gaacaattccatc

SEQ ID NO: 619623 - DNA, 13 bp, D. melanogaster
gaacaattggatt

SEQ ID NO: 619624 - DNA, 13 bp, D. melanogaster
gaacaattttaaa

SEQ ID NO: 619625 - DNA, 14 bp, D. melanogaster
gaacaattttaatt

SEQ ID NO: 619626 - DNA, 13 bp, D. melanogaster
gaacaattttgaa

SEQ ID NO: 619627 - DNA, 13 bp, D. melanogaster
gaacacaaatatt

SEQ ID NO: 619628 - DNA, 13 bp, D. melanogaster
gaacacaagtccg

SEQ ID NO: 619629 - DNA, 13 bp, D. melanogaster
gaacacacacata

SEQ ID NO: 619630 - DNA, 13 bp, D. melanogaster
gaacacagaaata

SEQ ID NO: 619631 - DNA, 13 bp, D. melanogaster
gaacacataataa

SEQ ID NO: 619632 - DNA, 15 bp, D. melanogaster
gaacaccctgctcct

SEQ ID NO: 619633 - DNA, 13 bp, D. melanogaster
gaacaccgcatcc

SEQ ID NO: 619634 - DNA, 13 bp, D. melanogaster
gaacacttgacga

SEQ ID NO: 619635 - DNA, 13 bp, D. melanogaster
gaacagaatgggg

SEQ ID NO: 619636 - DNA, 13 bp, D. melanogaster
gaacagagcagaa

SEQ ID NO: 619637 - DNA, 13 bp, D. melanogaster
gaacagatattta

SEQ ID NO: 619638 - DNA, 13 bp, D. melanogaster
gaacagcagcaac

SEQ ID NO: 619639 - DNA, 14 bp, D. melanogaster
gaacagcagcaaca

SEQ ID NO: 619640 - DNA, 14 bp, D. melanogaster
gaacagccgtttgg

SEQ ID NO: 619641 - DNA, 13 bp, D. melanogaster
gaacagctgagtg

SEQ ID NO: 619642 - DNA, 13 bp, D. melanogaster
gaacagctgctgc

SEQ ID NO: 619643 - DNA, 13 bp, D. melanogaster
gaacagctgttgc

SEQ ID NO: 619644 - DNA, 13 bp, D. melanogaster
gaacagctgtttg

SEQ ID NO: 619645 - DNA, 13 bp, D. melanogaster
gaacaggagctga

SEQ ID NO: 619646 - DNA, 14 bp, D. melanogaster
gaacaggagctgaa

SEQ ID NO: 619647 - DNA, 13 bp, D. melanogaster
gaacagggaaact

SEQ ID NO: 619648 - DNA, 13 bp, D. melanogaster
gaacagttggaaa

SEQ ID NO: 619649 - DNA, 13 bp, D. melanogaster
gaacagttgtatt

SEQ ID NO: 619650 - DNA, 13 bp, D. melanogaster
gaacagttttaaa

SEQ ID NO: 619651 - DNA, 13 bp, D. melanogaster
gaacataaaacat

SEQ ID NO: 619652 - DNA, 13 bp, D. melanogaster
gaacataaacatt

SEQ ID NO: 619653 - DNA, 14 bp, D. melanogaster
gaacataaacattc

SEQ ID NO: 619654 - DNA, 14 bp, D. melanogaster
gaacataaatataa

SEQ ID NO: 619655 - DNA, 13 bp, D. melanogaster
gaacataaatcaa

SEQ ID NO: 619656 - DNA, 13 bp, D. melanogaster
gaacataataaca

SEQ ID NO: 619657 - DNA, 13 bp, D. melanogaster
gaacatacatata

SEQ ID NO: 619658 - DNA, 14 bp, D. melanogaster
gaacatatatcaaa

SEQ ID NO: 619659 - DNA, 13 bp, D. melanogaster
gaacatcgagaat

SEQ ID NO: 619660 - DNA, 13 bp, D. melanogaster
gaacatctgccat

SEQ ID NO: 619661 - DNA, 13 bp, D. melanogaster
gaacatggaaaat

SEQ ID NO: 619662 - DNA, 13 bp, D. melanogaster
gaacatgtaccaa

SEQ ID NO: 619663 - DNA, 13 bp, D. melanogaster
gaacatgtgctaa

SEQ ID NO: 619664 - DNA, 13 bp, D. melanogaster
gaacatgtttgtg

SEQ ID NO: 619665 - DNA, 13 bp, D. melanogaster
gaacatttaaatt

SEQ ID NO: 619666 - DNA, 13 bp, D. melanogaster
gaacatttattat

SEQ ID NO: 619667 - DNA, 13 bp, D. melanogaster
gaacattttaaat

SEQ ID NO: 619668 - DNA, 13 bp, D. melanogaster
gaacattttccat

SEQ ID NO: 619669 - DNA, 13 bp, D. melanogaster
gaacattttgaaa

SEQ ID NO: 619670 - DNA, 13 bp, D. melanogaster
gaacatttttcaa

SEQ ID NO: 619671 - DNA, 13 bp, D. melanogaster
gaaccaaaacaat

SEQ ID NO: 619672 - DNA, 13 bp, D. melanogaster
gaaccaaaccgaa

SEQ ID NO: 619673 - DNA, 13 bp, D. melanogaster
gaaccaaatcgaa

SEQ ID NO: 619674 - DNA, 13 bp, D. melanogaster
gaaccaaatgaga

SEQ ID NO: 619675 - DNA, 13 bp, D. melanogaster
gaaccaacagacc

SEQ ID NO: 619676 - DNA, 13 bp, D. melanogaster
gaaccaagcgctt

SEQ ID NO: 619677 - DNA, 13 bp, D. melanogaster
gaaccacaagatg

SEQ ID NO: 619678 - DNA, 13 bp, D. melanogaster
gaaccaccgaacc

SEQ ID NO: 619679 - DNA, 13 bp, D. melanogaster
gaaccaccgtgcc

SEQ ID NO: 619680 - DNA, 13 bp, D. melanogaster
gaaccactgaacc

SEQ ID NO: 619681 - DNA, 13 bp, D. melanogaster
gaaccagttaaaa

SEQ ID NO: 619682 - DNA, 13 bp, D. melanogaster
gaaccatacagtc

SEQ ID NO: 619683 - DNA, 13 bp, D. melanogaster
gaaccatcaatgt

SEQ ID NO: 619684 - DNA, 13 bp, D. melanogaster
gaaccatcgaaca

SEQ ID NO: 619685 - DNA, 13 bp, D. melanogaster
gaaccatttttcg

SEQ ID NO: 619686 - DNA, 14 bp, D. melanogaster
gaacccaagaaaat

SEQ ID NO: 619687 - DNA, 14 bp, D. melanogaster
gaacccaagagcga

SEQ ID NO: 619688 - DNA, 14 bp, D. melanogaster
gaacccagtcaaaa

SEQ ID NO: 619689 - DNA, 13 bp, D. melanogaster
gaaccccagctct

SEQ ID NO: 619690 - DNA, 13 bp, D. melanogaster
gaaccgaaaccga

SEQ ID NO: 619691 - DNA, 13 bp, D. melanogaster
gaaccgaaacgaa

SEQ ID NO: 619692 - DNA, 13 bp, D. melanogaster
gaaccgaacccaa

SEQ ID NO: 619693 - DNA, 14 bp, D. melanogaster
gaaccgaaccgaaa

SEQ ID NO: 619694 - DNA, 14 bp, D. melanogaster
gaaccgaactgaac

SEQ ID NO: 619695 - DNA, 14 bp, D. melanogaster
gaaccgattaccat

SEQ ID NO: 619696 - DNA, 13 bp, D. melanogaster
gaaccggaaacgg

SEQ ID NO: 619697 - DNA, 14 bp, D. melanogaster
gaaccggaaacgga

SEQ ID NO: 619698 - DNA, 13 bp, D. melanogaster
gaacctgaacctg

SEQ ID NO: 619699 - DNA, 13 bp, D. melanogaster
gaacctggagcag

SEQ ID NO: 619700 - DNA, 13 bp, D. melanogaster
gaaccttatcatt

SEQ ID NO: 619701 - DNA, 13 bp, D. melanogaster
gaacgaaaactga

SEQ ID NO: 619702 - DNA, 13 bp, D. melanogaster
gaacgaaacggaa

SEQ ID NO: 619703 - DNA, 13 bp, D. melanogaster
gaacgaaagcgag

SEQ ID NO: 619704 - DNA, 13 bp, D. melanogaster
gaacgaaatgaaa

SEQ ID NO: 619705 - DNA, 13 bp, D. melanogaster
gaacgaagtcaca

SEQ ID NO: 619706 - DNA, 13 bp, D. melanogaster
gaacgaatgaatg

SEQ ID NO: 619707 - DNA, 13 bp, D. melanogaster
gaacgaattaaaa

SEQ ID NO: 619708 - DNA, 13 bp, D. melanogaster
gaacgacgacgac

SEQ ID NO: 619709 - DNA, 13 bp, D. melanogaster
gaacgactgcgag

SEQ ID NO: 619710 - DNA, 13 bp, D. melanogaster
gaacgagaacgag

SEQ ID NO: 619711 - DNA, 14 bp, D. melanogaster
gaacgatcgcaagg

SEQ ID NO: 619712 - DNA, 13 bp, D. melanogaster
gaacgatctcaag

SEQ ID NO: 619713 - DNA, 13 bp, D. melanogaster
gaacgatttttta

SEQ ID NO: 619714 - DNA, 13 bp, D. melanogaster
gaacgcaaacagt

SEQ ID NO: 619715 - DNA, 13 bp, D. melanogaster
gaacgcacacaca

SEQ ID NO: 619716 - DNA, 13 bp, D. melanogaster
gaacgccaaataa

SEQ ID NO: 619717 - DNA, 13 bp, D. melanogaster
gaacgcgatcgtg

SEQ ID NO: 619718 - DNA, 13 bp, D. melanogaster
gaacgctgccttg

SEQ ID NO: 619719 - DNA, 13 bp, D. melanogaster
gaacggaaacgga

SEQ ID NO: 619720 - DNA, 13 bp, D. melanogaster
gaacggaacgaaa

SEQ ID NO: 619721 - DNA, 13 bp, D. melanogaster
gaacggaacggaa

SEQ ID NO: 619722 - DNA, 14 bp, D. melanogaster
gaacggaacggaaa

SEQ ID NO: 619723 - DNA, 14 bp, D. melanogaster
gaacggaacggaac

SEQ ID NO: 619724 - DNA, 13 bp, D. melanogaster
gaacggaatataa

SEQ ID NO: 619725 - DNA, 13 bp, D. melanogaster
gaacggcaaacaa

SEQ ID NO: 619726 - DNA, 13 bp, D. melanogaster
gaacggctgcaga

SEQ ID NO: 619727 - DNA, 13 bp, D. melanogaster
gaacggctgcgct

SEQ ID NO: 619728 - DNA, 13 bp, D. melanogaster
gaacgtaattcgt

SEQ ID NO: 619729 - DNA, 13 bp, D. melanogaster
gaacgtcagctaa

SEQ ID NO: 619730 - DNA, 13 bp, D. melanogaster
gaacgtcgagatc

SEQ ID NO: 619731 - DNA, 14 bp, D. melanogaster
gaacgtcttcattg

SEQ ID NO: 619732 - DNA, 13 bp, D. melanogaster
gaacgtgtgtgtg

SEQ ID NO: 619733 - DNA, 14 bp, D. melanogaster
gaacgttgagatct

SEQ ID NO: 619734 - DNA, 14 bp, D. melanogaster
gaacgtttcaattt

SEQ ID NO: 619735 - DNA, 13 bp, D. melanogaster
gaactaactaagt

SEQ ID NO: 619736 - DNA, 13 bp, D. melanogaster
gaactaagtgaaa

SEQ ID NO: 619737 - DNA, 13 bp, D. melanogaster
gaactaatatttt

SEQ ID NO: 619738 - DNA, 14 bp, D. melanogaster
gaactaatgcagtt

SEQ ID NO: 619739 - DNA, 13 bp, D. melanogaster
gaactaattaaat

SEQ ID NO: 619740 - DNA, 13 bp, D. melanogaster
gaactacagaaaa

SEQ ID NO: 619741 - DNA, 13 bp, D. melanogaster
gaactagaggaat

SEQ ID NO: 619742 - DNA, 13 bp, D. melanogaster
gaactataaaata

SEQ ID NO: 619743 - DNA, 13 bp, D. melanogaster
gaactataactat

SEQ ID NO: 619744 - DNA, 13 bp, D. melanogaster
gaactattaaagc

SEQ ID NO: 619745 - DNA, 14 bp, D. melanogaster
gaactattaaagct

SEQ ID NO: 619746 - DNA, 13 bp, D. melanogaster
gaactatttaagc

SEQ ID NO: 619747 - DNA, 14 bp, D. melanogaster
gaactatttaagct

SEQ ID NO: 619748 - DNA, 13 bp, D. melanogaster
gaactatttttaa

SEQ ID NO: 619749 - DNA, 13 bp, D. melanogaster
gaactcaaagagt

SEQ ID NO: 619750 - DNA, 13 bp, D. melanogaster
gaactcacacaca

SEQ ID NO: 619751 - DNA, 13 bp, D. melanogaster
gaactcacatttg

SEQ ID NO: 619752 - DNA, 13 bp, D. melanogaster
gaactcagtagca

SEQ ID NO: 619753 - DNA, 15 bp, D. melanogaster
gaactccagctgcaa

SEQ ID NO: 619754 - DNA, 13 bp, D. melanogaster
gaactcgattttt

SEQ ID NO: 619755 - DNA, 13 bp, D. melanogaster
gaactcgtacttt

SEQ ID NO: 619756 - DNA, 13 bp, D. melanogaster
gaactctcaaaat

SEQ ID NO: 619757 - DNA, 14 bp, D. melanogaster
gaactgaaaccgaa

SEQ ID NO: 619758 - DNA, 14 bp, D. melanogaster
gaactgaaactgaa

SEQ ID NO: 619759 - DNA, 13 bp, D. melanogaster
gaactgaaatcaa

SEQ ID NO: 619760 - DNA, 13 bp, D. melanogaster
gaactgaaatcga

SEQ ID NO: 619761 - DNA, 13 bp, D. melanogaster
gaactgaacagaa

SEQ ID NO: 619762 - DNA, 13 bp, D. melanogaster
gaactgaactaaa

SEQ ID NO: 619763 - DNA, 14 bp, D. melanogaster
gaactgaactgaag

SEQ ID NO: 619764 - DNA, 13 bp, D. melanogaster
gaactgaactgag

SEQ ID NO: 619765 - DNA, 13 bp, D. melanogaster
gaactgaactgca

SEQ ID NO: 619766 - DNA, 13 bp, D. melanogaster
gaactgaactgta

SEQ ID NO: 619767 - DNA, 14 bp, D. melanogaster
gaactgaactgtat

SEQ ID NO: 619768 - DNA, 13 bp, D. melanogaster
gaactgaagaaat

SEQ ID NO: 619769 - DNA, 14 bp, D. melanogaster
gaactgaagaaatt

SEQ ID NO: 619770 - DNA, 13 bp, D. melanogaster
gaactgaattgaa

SEQ ID NO: 619771 - DNA, 13 bp, D. melanogaster
gaactgagaactg

SEQ ID NO: 619772 - DNA, 14 bp, D. melanogaster
gaactgagaactga

SEQ ID NO: 619773 - DNA, 13 bp, D. melanogaster
gaactgataattt

SEQ ID NO: 619774 - DNA, 13 bp, D. melanogaster
gaactgcaaaaac

SEQ ID NO: 619775 - DNA, 13 bp, D. melanogaster
gaactgcagaatg

SEQ ID NO: 619776 - DNA, 15 bp, D. melanogaster
gaactgcagctgtgg

SEQ ID NO: 619777 - DNA, 14 bp, D. melanogaster
gaactgcatctgca

SEQ ID NO: 619778 - DNA, 13 bp, D. melanogaster
gaactgcattcca

SEQ ID NO: 619779 - DNA, 14 bp, D. melanogaster
gaactgcatttgaa

SEQ ID NO: 619780 - DNA, 13 bp, D. melanogaster
gaactgcgaactg

SEQ ID NO: 619781 - DNA, 13 bp, D. melanogaster
gaactgctgcagg

SEQ ID NO: 619782 - DNA, 13 bp, D. melanogaster
gaactggaaaatg

SEQ ID NO: 619783 - DNA, 14 bp, D. melanogaster
gaactggaactgga

SEQ ID NO: 619784 - DNA, 13 bp, D. melanogaster
gaactggatgaag

SEQ ID NO: 619785 - DNA, 14 bp, D. melanogaster
gaactggcaaatac

SEQ ID NO: 619786 - DNA, 13 bp, D. melanogaster
gaactgggaactg

SEQ ID NO: 619787 - DNA, 13 bp, D. melanogaster
gaactgggagctg

SEQ ID NO: 619788 - DNA, 13 bp, D. melanogaster
gaactgggtcatg

SEQ ID NO: 619789 - DNA, 13 bp, D. melanogaster
gaactgggttagg

SEQ ID NO: 619790 - DNA, 13 bp, D. melanogaster
gaactgtattctt

SEQ ID NO: 619791 - DNA, 13 bp, D. melanogaster
gaactgtgtgacc

SEQ ID NO: 619792 - DNA, 13 bp, D. melanogaster
gaactgtgtgagc

SEQ ID NO: 619793 - DNA, 13 bp, D. melanogaster
gaactgtttgaat

SEQ ID NO: 619794 - DNA, 13 bp, D. melanogaster
gaacttaaaaact

SEQ ID NO: 619795 - DNA, 13 bp, D. melanogaster
gaacttaaaaaga

SEQ ID NO: 619796 - DNA, 13 bp, D. melanogaster
gaacttaaaataa

SEQ ID NO: 619797 - DNA, 13 bp, D. melanogaster
gaacttaaggaaa

SEQ ID NO: 619798 - DNA, 14 bp, D. melanogaster
gaacttaaggaaaa

SEQ ID NO: 619799 - DNA, 13 bp, D. melanogaster
gaacttaatctac

SEQ ID NO: 619800 - DNA, 13 bp, D. melanogaster
gaacttaattaaa

SEQ ID NO: 619801 - DNA, 13 bp, D. melanogaster
gaacttatatatt

SEQ ID NO: 619802 - DNA, 14 bp, D. melanogaster
gaacttattgaaca

SEQ ID NO: 619803 - DNA, 13 bp, D. melanogaster
gaacttcaaaaat

SEQ ID NO: 619804 - DNA, 13 bp, D. melanogaster
gaacttcattaat

SEQ ID NO: 619805 - DNA, 13 bp, D. melanogaster
gaacttctgtcat

SEQ ID NO: 619806 - DNA, 14 bp, D. melanogaster
gaacttgaagaaaa

SEQ ID NO: 619807 - DNA, 13 bp, D. melanogaster
gaacttgactata

SEQ ID NO: 619808 - DNA, 13 bp, D. melanogaster
gaacttggacgga

SEQ ID NO: 619809 - DNA, 13 bp, D. melanogaster
gaacttggcattt

SEQ ID NO: 619810 - DNA, 14 bp, D. melanogaster
gaacttggcatttg

SEQ ID NO: 619811 - DNA, 13 bp, D. melanogaster
gaacttggccaaa

SEQ ID NO: 619812 - DNA, 13 bp, D. melanogaster
gaacttgggaatt

SEQ ID NO: 619813 - DNA, 13 bp, D. melanogaster
gaacttgtttttc

SEQ ID NO: 619814 - DNA, 14 bp, D. melanogaster
gaacttgtttttca

SEQ ID NO: 619815 - DNA, 13 bp, D. melanogaster
gaactttaaaaaa

SEQ ID NO: 619816 - DNA, 13 bp, D. melanogaster
gaactttaaataa

SEQ ID NO: 619817 - DNA, 13 bp, D. melanogaster
gaactttaacttt

SEQ ID NO: 619818 - DNA, 13 bp, D. melanogaster
gaactttaattgc

SEQ ID NO: 619819 - DNA, 13 bp, D. melanogaster
gaactttataaaa

SEQ ID NO: 619820 - DNA, 13 bp, D. melanogaster
gaactttattcaa

SEQ ID NO: 619821 - DNA, 13 bp, D. melanogaster
gaactttcaacga

SEQ ID NO: 619822 - DNA, 13 bp, D. melanogaster
gaactttcacttt

SEQ ID NO: 619823 - DNA, 13 bp, D. melanogaster
gaactttgaactt

SEQ ID NO: 619824 - DNA, 13 bp, D. melanogaster
gaactttggccaa

SEQ ID NO: 619825 - DNA, 13 bp, D. melanogaster
gaacttttaatga

SEQ ID NO: 619826 - DNA, 13 bp, D. melanogaster
gaacttttctgag

SEQ ID NO: 619827 - DNA, 13 bp, D. melanogaster
gaacttttgcatt

SEQ ID NO: 619828 - DNA, 13 bp, D. melanogaster
gaacttttggcca

SEQ ID NO: 619829 - DNA, 13 bp, D. melanogaster
gaactttttaata

SEQ ID NO: 619830 - DNA, 13 bp, D. melanogaster
gaagaaaaatcta

SEQ ID NO: 619831 - DNA, 13 bp, D. melanogaster
gaagaaaaattgc

SEQ ID NO: 619832 - DNA, 13 bp, D. melanogaster
gaagaaaactcaa

SEQ ID NO: 619833 - DNA, 13 bp, D. melanogaster
gaagaaaatagca

SEQ ID NO: 619834 - DNA, 14 bp, D. melanogaster
gaagaaaatcatca

SEQ ID NO: 619835 - DNA, 13 bp, D. melanogaster
gaagaaacctaaa

SEQ ID NO: 619836 - DNA, 13 bp, D. melanogaster
gaagaaatacaag

SEQ ID NO: 619837 - DNA, 13 bp, D. melanogaster
gaagaaatacaat

SEQ ID NO: 619838 - DNA, 13 bp, D. melanogaster
gaagaaattgaat

SEQ ID NO: 619839 - DNA, 13 bp, D. melanogaster
gaagaacattcag

SEQ ID NO: 619840 - DNA, 13 bp, D. melanogaster
gaagaacgacgat

SEQ ID NO: 619841 - DNA, 13 bp, D. melanogaster
gaagaacgttgtg

SEQ ID NO: 619842 - DNA, 13 bp, D. melanogaster
gaagaactttaaa

SEQ ID NO: 619843 - DNA, 13 bp, D. melanogaster
gaagaagaacttt

SEQ ID NO: 619844 - DNA, 14 bp, D. melanogaster
gaagaagaagcagc

SEQ ID NO: 619845 - DNA, 13 bp, D. melanogaster
gaagaagagatca

SEQ ID NO: 619846 - DNA, 14 bp, D. melanogaster
gaagaagattggtt

SEQ ID NO: 619847 - DNA, 14 bp, D. melanogaster
gaagaagcagaagc

SEQ ID NO: 619848 - DNA, 14 bp, D. melanogaster
gaagaagcagcagc

SEQ ID NO: 619849 - DNA, 13 bp, D. melanogaster
gaagaagcagctg

SEQ ID NO: 619850 - DNA, 14 bp, D. melanogaster
gaagaagccatcaa

SEQ ID NO: 619851 - DNA, 14 bp, D. melanogaster
gaagaagctgatgt

SEQ ID NO: 619852 - DNA, 13 bp, D. melanogaster
gaagaagggcatc

SEQ ID NO: 619853 - DNA, 13 bp, D. melanogaster
gaagaaggtggca

SEQ ID NO: 619854 - DNA, 13 bp, D. melanogaster
gaagaagtcgaat

SEQ ID NO: 619855 - DNA, 13 bp, D. melanogaster
gaagaagtcgtcg

SEQ ID NO: 619856 - DNA, 13 bp, D. melanogaster
gaagaatatatat

SEQ ID NO: 619857 - DNA, 13 bp, D. melanogaster
gaagaatcaattt

SEQ ID NO: 619858 - DNA, 13 bp, D. melanogaster
gaagaattcaatt

SEQ ID NO: 619859 - DNA, 13 bp, D. melanogaster
gaagaattcgcgt

SEQ ID NO: 619860 - DNA, 13 bp, D. melanogaster
gaagaattttcag

SEQ ID NO: 619861 - DNA, 13 bp, D. melanogaster
gaagacagaagac

SEQ ID NO: 619862 - DNA, 13 bp, D. melanogaster
gaagaccgaagac

SEQ ID NO: 619863 - DNA, 13 bp, D. melanogaster
gaagaccggcagc

SEQ ID NO: 619864 - DNA, 13 bp, D. melanogaster
gaagacgaagacg

SEQ ID NO: 619865 - DNA, 14 bp, D. melanogaster
gaagacgacgacga

SEQ ID NO: 619866 - DNA, 13 bp, D. melanogaster
gaagacgattttc

SEQ ID NO: 619867 - DNA, 14 bp, D. melanogaster
gaagacgcggcgct

SEQ ID NO: 619868 - DNA, 13 bp, D. melanogaster
gaagacggcaact

SEQ ID NO: 619869 - DNA, 13 bp, D. melanogaster
gaagacgtcgatg

SEQ ID NO: 619870 - DNA, 14 bp, D. melanogaster
gaagacgtttttat

SEQ ID NO: 619871 - DNA, 13 bp, D. melanogaster
gaagactgcaata

SEQ ID NO: 619872 - DNA, 13 bp, D. melanogaster
gaagactttatat

SEQ ID NO: 619873 - DNA, 13 bp, D. melanogaster
gaagactttgatc

SEQ ID NO: 619874 - DNA, 13 bp, D. melanogaster
gaagagaccaacc

SEQ ID NO: 619875 - DNA, 13 bp, D. melanogaster
gaagagcaatgta

SEQ ID NO: 619876 - DNA, 13 bp, D. melanogaster
gaagagccgaaaa

SEQ ID NO: 619877 - DNA, 15 bp, D. melanogaster
gaagaggacgacgat

SEQ ID NO: 619878 - DNA, 13 bp, D. melanogaster
gaagaggataata

SEQ ID NO: 619879 - DNA, 13 bp, D. melanogaster
gaagaggatctcc

SEQ ID NO: 619880 - DNA, 13 bp, D. melanogaster
gaagaggcaaggc

SEQ ID NO: 619881 - DNA, 13 bp, D. melanogaster
gaagagggttcgt

SEQ ID NO: 619882 - DNA, 13 bp, D. melanogaster
gaagagtatgact

SEQ ID NO: 619883 - DNA, 14 bp, D. melanogaster
gaagagttcgaaaa

SEQ ID NO: 619884 - DNA, 13 bp, D. melanogaster
gaagataaccaat

SEQ ID NO: 619885 - DNA, 14 bp, D. melanogaster
gaagatacagatac

SEQ ID NO: 619886 - DNA, 13 bp, D. melanogaster
gaagatatgatgt

SEQ ID NO: 619887 - DNA, 13 bp, D. melanogaster
gaagatattttat

SEQ ID NO: 619888 - DNA, 13 bp, D. melanogaster
gaagatcaaaatc

SEQ ID NO: 619889 - DNA, 13 bp, D. melanogaster
gaagatcaaatgc

SEQ ID NO: 619890 - DNA, 14 bp, D. melanogaster
gaagatcataatga

SEQ ID NO: 619891 - DNA, 13 bp, D. melanogaster
gaagatctttaat

SEQ ID NO: 619892 - DNA, 13 bp, D. melanogaster
gaagatgaaactg

SEQ ID NO: 619893 - DNA, 13 bp, D. melanogaster
gaagatgataatg

SEQ ID NO: 619894 - DNA, 14 bp, D. melanogaster
gaagatgataatga

SEQ ID NO: 619895 - DNA, 14 bp, D. melanogaster
gaagatgatgaaga

SEQ ID NO: 619896 - DNA, 13 bp, D. melanogaster
gaagatggagatg

SEQ ID NO: 619897 - DNA, 14 bp, D. melanogaster
gaagatggcccaaa

SEQ ID NO: 619898 - DNA, 13 bp, D. melanogaster
gaagatgtgctca

SEQ ID NO: 619899 - DNA, 13 bp, D. melanogaster
gaagatgtggatg

SEQ ID NO: 619900 - DNA, 13 bp, D. melanogaster
gaagattaccaag

SEQ ID NO: 619901 - DNA, 13 bp, D. melanogaster
gaagattattaaa

SEQ ID NO: 619902 - DNA, 13 bp, D. melanogaster
gaagattattatt

SEQ ID NO: 619903 - DNA, 13 bp, D. melanogaster
gaagattgcaaaa

SEQ ID NO: 619904 - DNA, 13 bp, D. melanogaster
gaagatttccaat

SEQ ID NO: 619905 - DNA, 13 bp, D. melanogaster
gaagatttggaaa

SEQ ID NO: 619906 - DNA, 13 bp, D. melanogaster
gaagcaaaaagta

SEQ ID NO: 619907 - DNA, 14 bp, D. melanogaster
gaagcaaaagcaac

SEQ ID NO: 619908 - DNA, 13 bp, D. melanogaster
gaagcaaaagttt

SEQ ID NO: 619909 - DNA, 13 bp, D. melanogaster
gaagcaaacaaat

SEQ ID NO: 619910 - DNA, 13 bp, D. melanogaster
gaagcaaatagga

SEQ ID NO: 619911 - DNA, 14 bp, D. melanogaster
gaagcaaatttaaa

SEQ ID NO: 619912 - DNA, 13 bp, D. melanogaster
gaagcaacagcaa

SEQ ID NO: 619913 - DNA, 14 bp, D. melanogaster
gaagcaacagcaac

SEQ ID NO: 619914 - DNA, 13 bp, D. melanogaster
gaagcaagcgtgc

SEQ ID NO: 619915 - DNA, 13 bp, D. melanogaster
gaagcaataattt

SEQ ID NO: 619916 - DNA, 13 bp, D. melanogaster
gaagcaattgaaa

SEQ ID NO: 619917 - DNA, 13 bp, D. melanogaster
gaagcaatttgca

SEQ ID NO: 619918 - DNA, 13 bp, D. melanogaster
gaagcacacacac

SEQ ID NO: 619919 - DNA, 14 bp, D. melanogaster
gaagcacacacaca

SEQ ID NO: 619920 - DNA, 13 bp, D. melanogaster
gaagcacatttgc

SEQ ID NO: 619921 - DNA, 13 bp, D. melanogaster
gaagcactttaaa

SEQ ID NO: 619922 - DNA, 13 bp, D. melanogaster
gaagcagaacaga

SEQ ID NO: 619923 - DNA, 14 bp, D. melanogaster
gaagcagaacagat

SEQ ID NO: 619924 - DNA, 15 bp, D. melanogaster
gaagcagaagcagaa

SEQ ID NO: 619925 - DNA, 14 bp, D. melanogaster
gaagcagcaacaac

SEQ ID NO: 619926 - DNA, 13 bp, D. melanogaster
gaagcagcagaag

SEQ ID NO: 619927 - DNA, 13 bp, D. melanogaster
gaagcagcagcaa

SEQ ID NO: 619928 - DNA, 13 bp, D. melanogaster
gaagcagcagcgg

SEQ ID NO: 619929 - DNA, 13 bp, D. melanogaster
gaagcagcggcag

SEQ ID NO: 619930 - DNA, 14 bp, D. melanogaster
gaagcaggagcagg

SEQ ID NO: 619931 - DNA, 13 bp, D. melanogaster
gaagcaggcagag

SEQ ID NO: 619932 - DNA, 13 bp, D. melanogaster
gaagcatcaaaaa

SEQ ID NO: 619933 - DNA, 13 bp, D. melanogaster
gaagcatttaaaa

SEQ ID NO: 619934 - DNA, 13 bp, D. melanogaster
gaagccaaaaact

SEQ ID NO: 619935 - DNA, 13 bp, D. melanogaster
gaagccaaagcaa

SEQ ID NO: 619936 - DNA, 13 bp, D. melanogaster
gaagccaaagcca

SEQ ID NO: 619937 - DNA, 14 bp, D. melanogaster
gaagccaaagccaa

SEQ ID NO: 619938 - DNA, 13 bp, D. melanogaster
gaagccaaaggaa

SEQ ID NO: 619939 - DNA, 13 bp, D. melanogaster
gaagccaaaggca

SEQ ID NO: 619940 - DNA, 13 bp, D. melanogaster
gaagccaaagtca

SEQ ID NO: 619941 - DNA, 13 bp, D. melanogaster
gaagccaaataaa

SEQ ID NO: 619942 - DNA, 13 bp, D. melanogaster
gaagccaactctt

SEQ ID NO: 619943 - DNA, 13 bp, D. melanogaster
gaagccaactggg

SEQ ID NO: 619944 - DNA, 13 bp, D. melanogaster
gaagccaagccaa

SEQ ID NO: 619945 - DNA, 13 bp, D. melanogaster
gaagccacattaa

SEQ ID NO: 619946 - DNA, 13 bp, D. melanogaster
gaagccagaaaac

SEQ ID NO: 619947 - DNA, 13 bp, D. melanogaster
gaagccatcaata

SEQ ID NO: 619948 - DNA, 13 bp, D. melanogaster
gaagcgaaatgaa

SEQ ID NO: 619949 - DNA, 13 bp, D. melanogaster
gaagcgaaccaaa

SEQ ID NO: 619950 - DNA, 13 bp, D. melanogaster
gaagcgaagcgaa

SEQ ID NO: 619951 - DNA, 13 bp, D. melanogaster
gaagcgaagtgaa

SEQ ID NO: 619952 - DNA, 13 bp, D. melanogaster
gaagcgaatcgaa

SEQ ID NO: 619953 - DNA, 13 bp, D. melanogaster
gaagcgatgaatc

SEQ ID NO: 619954 - DNA, 14 bp, D. melanogaster
gaagcgcagagaga

SEQ ID NO: 619955 - DNA, 13 bp, D. melanogaster
gaagcggcagaaa

SEQ ID NO: 619956 - DNA, 13 bp, D. melanogaster
gaagcggcagcaa

SEQ ID NO: 619957 - DNA, 13 bp, D. melanogaster
gaagcgtccacca

SEQ ID NO: 619958 - DNA, 13 bp, D. melanogaster
gaagcgttcttgg

SEQ ID NO: 619959 - DNA, 13 bp, D. melanogaster
gaagcgtttccga

SEQ ID NO: 619960 - DNA, 13 bp, D. melanogaster
gaagctaaaggaa

SEQ ID NO: 619961 - DNA, 13 bp, D. melanogaster
gaagctaggaact

SEQ ID NO: 619962 - DNA, 14 bp, D. melanogaster
gaagctatcgagtg

SEQ ID NO: 619963 - DNA, 14 bp, D. melanogaster
gaagctatttcttt

SEQ ID NO: 619964 - DNA, 13 bp, D. melanogaster
gaagctcagatta

SEQ ID NO: 619965 - DNA, 13 bp, D. melanogaster
gaagctcatgcat

SEQ ID NO: 619966 - DNA, 13 bp, D. melanogaster
gaagctccactgt

SEQ ID NO: 619967 - DNA, 13 bp, D. melanogaster
gaagctgaaacaa

SEQ ID NO: 619968 - DNA, 14 bp, D. melanogaster
gaagctgaagctga

SEQ ID NO: 619969 - DNA, 13 bp, D. melanogaster
gaagctgatgctg

SEQ ID NO: 619970 - DNA, 13 bp, D. melanogaster
gaagctgatgtcc

SEQ ID NO: 619971 - DNA, 13 bp, D. melanogaster
gaagctggaaatt

SEQ ID NO: 619972 - DNA, 13 bp, D. melanogaster
gaagctggagctg

SEQ ID NO: 619973 - DNA, 13 bp, D. melanogaster
gaagctggagtct

SEQ ID NO: 619974 - DNA, 13 bp, D. melanogaster
gaagctgggttcg

SEQ ID NO: 619975 - DNA, 13 bp, D. melanogaster
gaagcttctaaaa

SEQ ID NO: 619976 - DNA, 13 bp, D. melanogaster
gaagcttttcctt

SEQ ID NO: 619977 - DNA, 13 bp, D. melanogaster
gaaggaaacaacc

SEQ ID NO: 619978 - DNA, 13 bp, D. melanogaster
gaaggaagcgttt

SEQ ID NO: 619979 - DNA, 14 bp, D. melanogaster
gaaggaagcgtttc

SEQ ID NO: 619980 - DNA, 13 bp, D. melanogaster
gaaggaagtggcg

SEQ ID NO: 619981 - DNA, 13 bp, D. melanogaster
gaaggaataaagt

SEQ ID NO: 619982 - DNA, 13 bp, D. melanogaster
gaaggacacaaag

SEQ ID NO: 619983 - DNA, 14 bp, D. melanogaster
gaaggacacaaagg

SEQ ID NO: 619984 - DNA, 13 bp, D. melanogaster
gaaggaccaacaa

SEQ ID NO: 619985 - DNA, 14 bp, D. melanogaster
gaaggacgaaggac

SEQ ID NO: 619986 - DNA, 13 bp, D. melanogaster
gaaggaggagccc

SEQ ID NO: 619987 - DNA, 13 bp, D. melanogaster
gaaggaggccaca

SEQ ID NO: 619988 - DNA, 14 bp, D. melanogaster
gaaggagtcctttg

SEQ ID NO: 619989 - DNA, 13 bp, D. melanogaster
gaaggagtttggt

SEQ ID NO: 619990 - DNA, 13 bp, D. melanogaster
gaaggcaaaaagt

SEQ ID NO: 619991 - DNA, 13 bp, D. melanogaster
gaaggcaaacatt

SEQ ID NO: 619992 - DNA, 13 bp, D. melanogaster
gaaggcaacaaca

SEQ ID NO: 619993 - DNA, 13 bp, D. melanogaster
gaaggcaatgaaa

SEQ ID NO: 619994 - DNA, 13 bp, D. melanogaster
gaaggcagcgaaa

SEQ ID NO: 619995 - DNA, 13 bp, D. melanogaster
gaaggccaaaaac

SEQ ID NO: 619996 - DNA, 14 bp, D. melanogaster
gaaggcgaaaaaat

SEQ ID NO: 619997 - DNA, 13 bp, D. melanogaster
gaaggcgaaggcg

SEQ ID NO: 619998 - DNA, 13 bp, D. melanogaster
gaaggcgttaaac

SEQ ID NO: 619999 - DNA, 13 bp, D. melanogaster
gaaggctggcaac

SEQ ID NO: 620000 - DNA, 13 bp, D. melanogaster
gaaggctggcaag

SEQ ID NO: 620001 - DNA, 13 bp, D. melanogaster
gaagggcattgag

SEQ ID NO: 620002 - DNA, 14 bp, D. melanogaster
gaaggggactttat

SEQ ID NO: 620003 - DNA, 13 bp, D. melanogaster
gaaggggcgtggc

SEQ ID NO: 620004 - DNA, 13 bp, D. melanogaster
gaagggtatcttg

SEQ ID NO: 620005 - DNA, 14 bp, D. melanogaster
gaagggtttctgga

SEQ ID NO: 620006 - DNA, 13 bp, D. melanogaster
gaaggtaatgatt

SEQ ID NO: 620007 - DNA, 13 bp, D. melanogaster
gaaggtagcctct

SEQ ID NO: 620008 - DNA, 13 bp, D. melanogaster
gaaggtgagcttc

SEQ ID NO: 620009 - DNA, 13 bp, D. melanogaster
gaaggtgctcgaa

SEQ ID NO: 620010 - DNA, 14 bp, D. melanogaster
gaaggttgagatta

SEQ ID NO: 620011 - DNA, 14 bp, D. melanogaster
gaagtaaaattaag

SEQ ID NO: 620012 - DNA, 13 bp, D. melanogaster
gaagtaagaaaca

SEQ ID NO: 620013 - DNA, 14 bp, D. melanogaster
gaagtacatacata

SEQ ID NO: 620014 - DNA, 13 bp, D. melanogaster
gaagtacattttc

SEQ ID NO: 620015 - DNA, 13 bp, D. melanogaster
gaagtacgaaaag

SEQ ID NO: 620016 - DNA, 13 bp, D. melanogaster
gaagtagtagtag

SEQ ID NO: 620017 - DNA, 13 bp, D. melanogaster
gaagtattggaat

SEQ ID NO: 620018 - DNA, 13 bp, D. melanogaster
gaagtatttatat

SEQ ID NO: 620019 - DNA, 13 bp, D. melanogaster
gaagtatttattt

SEQ ID NO: 620020 - DNA, 13 bp, D. melanogaster
gaagtcaacaaag

SEQ ID NO: 620021 - DNA, 13 bp, D. melanogaster
gaagtcccaaaga

SEQ ID NO: 620022 - DNA, 13 bp, D. melanogaster
gaagtcgaagtcg

SEQ ID NO: 620023 - DNA, 13 bp, D. melanogaster
gaagtcgactata

SEQ ID NO: 620024 - DNA, 13 bp, D. melanogaster
gaagtcgcatttt

SEQ ID NO: 620025 - DNA, 13 bp, D. melanogaster
gaagtgaaagtga

SEQ ID NO: 620026 - DNA, 13 bp, D. melanogaster
gaagtgaaataca

SEQ ID NO: 620027 - DNA, 13 bp, D. melanogaster
gaagtgaaatgaa

SEQ ID NO: 620028 - DNA, 14 bp, D. melanogaster
gaagtgaagaattt

SEQ ID NO: 620029 - DNA, 13 bp, D. melanogaster
gaagtgaagtgaa

SEQ ID NO: 620030 - DNA, 14 bp, D. melanogaster
gaagtgaagtgaag

SEQ ID NO: 620031 - DNA, 13 bp, D. melanogaster
gaagtgaataata

SEQ ID NO: 620032 - DNA, 13 bp, D. melanogaster
gaagtgaattaaa

SEQ ID NO: 620033 - DNA, 13 bp, D. melanogaster
gaagtgagagatt

SEQ ID NO: 620034 - DNA, 13 bp, D. melanogaster
gaagtgatgaaga

SEQ ID NO: 620035 - DNA, 14 bp, D. melanogaster
gaagtgattcgaaa

SEQ ID NO: 620036 - DNA, 13 bp, D. melanogaster
gaagtgcaaaaag

SEQ ID NO: 620037 - DNA, 13 bp, D. melanogaster
gaagtgcaacttt

SEQ ID NO: 620038 - DNA, 15 bp, D. melanogaster
gaagtgcacccaata

SEQ ID NO: 620039 - DNA, 13 bp, D. melanogaster
gaagtggaaatga

SEQ ID NO: 620040 - DNA, 13 bp, D. melanogaster
gaagtggaagtgc

SEQ ID NO: 620041 - DNA, 14 bp, D. melanogaster
gaagtggaagtggc

SEQ ID NO: 620042 - DNA, 13 bp, D. melanogaster
gaagtggatgtgg

SEQ ID NO: 620043 - DNA, 14 bp, D. melanogaster
gaagtggatgtgga

SEQ ID NO: 620044 - DNA, 13 bp, D. melanogaster
gaagtggcagcca

SEQ ID NO: 620045 - DNA, 14 bp, D. melanogaster
gaagtggcagccag

SEQ ID NO: 620046 - DNA, 13 bp, D. melanogaster
gaagtggcagtgt

SEQ ID NO: 620047 - DNA, 13 bp, D. melanogaster
gaagtggccagca

SEQ ID NO: 620048 - DNA, 13 bp, D. melanogaster
gaagtggcgtatg

SEQ ID NO: 620049 - DNA, 13 bp, D. melanogaster
gaagtggctggtt

SEQ ID NO: 620050 - DNA, 13 bp, D. melanogaster
gaagtgggaattt

SEQ ID NO: 620051 - DNA, 13 bp, D. melanogaster
gaagtgggcaaaa

SEQ ID NO: 620052 - DNA, 13 bp, D. melanogaster
gaagttaaatatt

SEQ ID NO: 620053 - DNA, 13 bp, D. melanogaster
gaagttaaatttt

SEQ ID NO: 620054 - DNA, 13 bp, D. melanogaster
gaagttaatattt

SEQ ID NO: 620055 - DNA, 13 bp, D. melanogaster
gaagttacaacta

SEQ ID NO: 620056 - DNA, 13 bp, D. melanogaster
gaagttagtggag

SEQ ID NO: 620057 - DNA, 13 bp, D. melanogaster
gaagttattttga

SEQ ID NO: 620058 - DNA, 13 bp, D. melanogaster
gaagttcaaaatc

SEQ ID NO: 620059 - DNA, 14 bp, D. melanogaster
gaagttcgactgta

SEQ ID NO: 620060 - DNA, 13 bp, D. melanogaster
gaagttctccaga

SEQ ID NO: 620061 - DNA, 13 bp, D. melanogaster
gaagttcttagac

SEQ ID NO: 620062 - DNA, 13 bp, D. melanogaster
gaagttctttgac

SEQ ID NO: 620063 - DNA, 14 bp, D. melanogaster
gaagttctttggct

SEQ ID NO: 620064 - DNA, 13 bp, D. melanogaster
gaagttgaaacag

SEQ ID NO: 620065 - DNA, 13 bp, D. melanogaster
gaagttgaagctg

SEQ ID NO: 620066 - DNA, 13 bp, D. melanogaster
gaagttgaagtgg

SEQ ID NO: 620067 - DNA, 13 bp, D. melanogaster
gaagttgaatcaa

SEQ ID NO: 620068 - DNA, 13 bp, D. melanogaster
gaagttggagttg

SEQ ID NO: 620069 - DNA, 14 bp, D. melanogaster
gaagttggccaaaa

SEQ ID NO: 620070 - DNA, 13 bp, D. melanogaster
gaagttggccctg

SEQ ID NO: 620071 - DNA, 13 bp, D. melanogaster
gaagttgggaaaa

SEQ ID NO: 620072 - DNA, 13 bp, D. melanogaster
gaagttgtggaag

SEQ ID NO: 620073 - DNA, 13 bp, D. melanogaster
gaagttgttgatt

SEQ ID NO: 620074 - DNA, 13 bp, D. melanogaster
gaagttgttgttg

SEQ ID NO: 620075 - DNA, 13 bp, D. melanogaster
gaagtttgactgt

SEQ ID NO: 620076 - DNA, 13 bp, D. melanogaster
gaagtttggaaaa

SEQ ID NO: 620077 - DNA, 13 bp, D. melanogaster
gaagttttaaata

SEQ ID NO: 620078 - DNA, 13 bp, D. melanogaster
gaagtttttaaaa

SEQ ID NO: 620079 - DNA, 14 bp, D. melanogaster
gaagtttttcctac

SEQ ID NO: 620080 - DNA, 14 bp, D. melanogaster
gaataaaaagcaat

SEQ ID NO: 620081 - DNA, 13 bp, D. melanogaster
gaataaaaatgtt

SEQ ID NO: 620082 - DNA, 13 bp, D. melanogaster
gaataaaatatgt

SEQ ID NO: 620083 - DNA, 13 bp, D. melanogaster
gaataaaatgatt

SEQ ID NO: 620084 - DNA, 13 bp, D. melanogaster
gaataaaatgcca

SEQ ID NO: 620085 - DNA, 13 bp, D. melanogaster
gaataaacaacac

SEQ ID NO: 620086 - DNA, 13 bp, D. melanogaster
gaataaacgcgaa

SEQ ID NO: 620087 - DNA, 13 bp, D. melanogaster
gaataaacttttt

SEQ ID NO: 620088 - DNA, 13 bp, D. melanogaster
gaataaataaatc

SEQ ID NO: 620089 - DNA, 14 bp, D. melanogaster
gaataaatatgtca

SEQ ID NO: 620090 - DNA, 13 bp, D. melanogaster
gaataaatcaaat

SEQ ID NO: 620091 - DNA, 13 bp, D. melanogaster
gaataaatcgaat

SEQ ID NO: 620092 - DNA, 13 bp, D. melanogaster
gaataaatgtttt

SEQ ID NO: 620093 - DNA, 13 bp, D. melanogaster
gaataaattaaca

SEQ ID NO: 620094 - DNA, 13 bp, D. melanogaster
gaataaattatgc

SEQ ID NO: 620095 - DNA, 13 bp, D. melanogaster
gaataaatttgaa

SEQ ID NO: 620096 - DNA, 13 bp, D. melanogaster
gaataacaacaac

SEQ ID NO: 620097 - DNA, 14 bp, D. melanogaster
gaataacaacaaca

SEQ ID NO: 620098 - DNA, 13 bp, D. melanogaster
gaataacaatcgg

SEQ ID NO: 620099 - DNA, 13 bp, D. melanogaster
gaataacatatgc

SEQ ID NO: 620100 - DNA, 14 bp, D. melanogaster
gaataactgattcg

SEQ ID NO: 620101 - DNA, 13 bp, D. melanogaster
gaataactgtttt

SEQ ID NO: 620102 - DNA, 13 bp, D. melanogaster
gaataataataca

SEQ ID NO: 620103 - DNA, 13 bp, D. melanogaster
gaataatattgaa

SEQ ID NO: 620104 - DNA, 13 bp, D. melanogaster
gaataatgaaatt

SEQ ID NO: 620105 - DNA, 13 bp, D. melanogaster
gaataattacaaa

SEQ ID NO: 620106 - DNA, 13 bp, D. melanogaster
gaataattgcaaa

SEQ ID NO: 620107 - DNA, 13 bp, D. melanogaster
gaataattgtatt

SEQ ID NO: 620108 - DNA, 13 bp, D. melanogaster
gaataatttgtaa

SEQ ID NO: 620109 - DNA, 13 bp, D. melanogaster
gaataatttgtgt

SEQ ID NO: 620110 - DNA, 13 bp, D. melanogaster
gaataatttgttt

SEQ ID NO: 620111 - DNA, 14 bp, D. melanogaster
gaataatttgtttc

SEQ ID NO: 620112 - DNA, 13 bp, D. melanogaster
gaatacaaaatca

SEQ ID NO: 620113 - DNA, 13 bp, D. melanogaster
gaatacaaagaga

SEQ ID NO: 620114 - DNA, 13 bp, D. melanogaster
gaatacaaataat

SEQ ID NO: 620115 - DNA, 13 bp, D. melanogaster
gaatacaaataca

SEQ ID NO: 620116 - DNA, 13 bp, D. melanogaster
gaatacaacaaat

SEQ ID NO: 620117 - DNA, 13 bp, D. melanogaster
gaatacaacctaa

SEQ ID NO: 620118 - DNA, 13 bp, D. melanogaster
gaatacaatattt

SEQ ID NO: 620119 - DNA, 13 bp, D. melanogaster
gaatacaatttaa

SEQ ID NO: 620120 - DNA, 13 bp, D. melanogaster
gaatacaatttta

SEQ ID NO: 620121 - DNA, 13 bp, D. melanogaster
gaatacatataaa

SEQ ID NO: 620122 - DNA, 13 bp, D. melanogaster
gaatacatatgta

SEQ ID NO: 620123 - DNA, 13 bp, D. melanogaster
gaatacattcgtt

SEQ ID NO: 620124 - DNA, 13 bp, D. melanogaster
gaatacattttaa

SEQ ID NO: 620125 - DNA, 13 bp, D. melanogaster
gaatacattttgt

SEQ ID NO: 620126 - DNA, 13 bp, D. melanogaster
gaataccactatt

SEQ ID NO: 620127 - DNA, 13 bp, D. melanogaster
gaataccagttta

SEQ ID NO: 620128 - DNA, 13 bp, D. melanogaster
gaatacgaataca

SEQ ID NO: 620129 - DNA, 13 bp, D. melanogaster
gaatacgtccacg

SEQ ID NO: 620130 - DNA, 13 bp, D. melanogaster
gaatacttaaata

SEQ ID NO: 620131 - DNA, 13 bp, D. melanogaster
gaatacttttcaa

SEQ ID NO: 620132 - DNA, 13 bp, D. melanogaster
gaataggctttat

SEQ ID NO: 620133 - DNA, 13 bp, D. melanogaster
gaatataaaaacc

SEQ ID NO: 620134 - DNA, 13 bp, D. melanogaster
gaatataaacaat

SEQ ID NO: 620135 - DNA, 13 bp, D. melanogaster
gaatataaatgtt

SEQ ID NO: 620136 - DNA, 13 bp, D. melanogaster
gaatataaattga

SEQ ID NO: 620137 - DNA, 13 bp, D. melanogaster
gaatataaatttg

SEQ ID NO: 620138 - DNA, 13 bp, D. melanogaster
gaatataacttta

SEQ ID NO: 620139 - DNA, 13 bp, D. melanogaster
gaatataataaac

SEQ ID NO: 620140 - DNA, 13 bp, D. melanogaster
gaatataatgtaa

SEQ ID NO: 620141 - DNA, 13 bp, D. melanogaster
gaatatacaaatt

SEQ ID NO: 620142 - DNA, 13 bp, D. melanogaster
gaatatacataca

SEQ ID NO: 620143 - DNA, 14 bp, D. melanogaster
gaatatacatacat

SEQ ID NO: 620144 - DNA, 13 bp, D. melanogaster
gaatatataaaca

SEQ ID NO: 620145 - DNA, 13 bp, D. melanogaster
gaatatataaact

SEQ ID NO: 620146 - DNA, 13 bp, D. melanogaster
gaatatatacaaa

SEQ ID NO: 620147 - DNA, 14 bp, D. melanogaster
gaatatatagatat

SEQ ID NO: 620148 - DNA, 13 bp, D. melanogaster
gaatatatataca

SEQ ID NO: 620149 - DNA, 14 bp, D. melanogaster
gaatatatatacat

SEQ ID NO: 620150 - DNA, 14 bp, D. melanogaster
gaatatatatgtat

SEQ ID NO: 620151 - DNA, 13 bp, D. melanogaster
gaatatatatgtt

SEQ ID NO: 620152 - DNA, 13 bp, D. melanogaster
gaatatatgagta

SEQ ID NO: 620153 - DNA, 13 bp, D. melanogaster
gaatatatgtata

SEQ ID NO: 620154 - DNA, 13 bp, D. melanogaster
gaatatatgttta

SEQ ID NO: 620155 - DNA, 13 bp, D. melanogaster
gaatatattgaaa

SEQ ID NO: 620156 - DNA, 13 bp, D. melanogaster
gaatatatttttg

SEQ ID NO: 620157 - DNA, 13 bp, D. melanogaster
gaatatcaaatat

SEQ ID NO: 620158 - DNA, 13 bp, D. melanogaster
gaatatcaagaaa

SEQ ID NO: 620159 - DNA, 13 bp, D. melanogaster
gaatatcaataaa

SEQ ID NO: 620160 - DNA, 13 bp, D. melanogaster
gaatatcaatttt

SEQ ID NO: 620161 - DNA, 13 bp, D. melanogaster
gaatatcgaatat

SEQ ID NO: 620162 - DNA, 13 bp, D. melanogaster
gaatatctaaaaa

SEQ ID NO: 620163 - DNA, 13 bp, D. melanogaster
gaatatcttaagg

SEQ ID NO: 620164 - DNA, 13 bp, D. melanogaster
gaatatgaaaatg

SEQ ID NO: 620165 - DNA, 13 bp, D. melanogaster
gaatatgaaatat

SEQ ID NO: 620166 - DNA, 13 bp, D. melanogaster
gaatatgaaatga

SEQ ID NO: 620167 - DNA, 13 bp, D. melanogaster
gaatatgaaattg

SEQ ID NO: 620168 - DNA, 13 bp, D. melanogaster
gaatatgaatata

SEQ ID NO: 620169 - DNA, 13 bp, D. melanogaster
gaatatgaatttt

SEQ ID NO: 620170 - DNA, 13 bp, D. melanogaster
gaatatggaaatg

SEQ ID NO: 620171 - DNA, 13 bp, D. melanogaster
gaatatggaatat

SEQ ID NO: 620172 - DNA, 13 bp, D. melanogaster
gaatatggaatgc

SEQ ID NO: 620173 - DNA, 13 bp, D. melanogaster
gaatatgtattta

SEQ ID NO: 620174 - DNA, 13 bp, D. melanogaster
gaatatgttgttt

SEQ ID NO: 620175 - DNA, 13 bp, D. melanogaster
gaatatgttttaa

SEQ ID NO: 620176 - DNA, 13 bp, D. melanogaster
gaatattattcaa

SEQ ID NO: 620177 - DNA, 13 bp, D. melanogaster
gaatattcaattt

SEQ ID NO: 620178 - DNA, 13 bp, D. melanogaster
gaatattcattta

SEQ ID NO: 620179 - DNA, 13 bp, D. melanogaster
gaatattcgaaat

SEQ ID NO: 620180 - DNA, 13 bp, D. melanogaster
gaatattctagtg

SEQ ID NO: 620181 - DNA, 13 bp, D. melanogaster
gaatattctctaa

SEQ ID NO: 620182 - DNA, 13 bp, D. melanogaster
gaatattgcaaaa

SEQ ID NO: 620183 - DNA, 13 bp, D. melanogaster
gaatattgttgac

SEQ ID NO: 620184 - DNA, 13 bp, D. melanogaster
gaatattgttgtt

SEQ ID NO: 620185 - DNA, 13 bp, D. melanogaster
gaatatttataga

SEQ ID NO: 620186 - DNA, 13 bp, D. melanogaster
gaatatttatcaa

SEQ ID NO: 620187 - DNA, 13 bp, D. melanogaster
gaatatttatttg

SEQ ID NO: 620188 - DNA, 13 bp, D. melanogaster
gaatatttgaaat

SEQ ID NO: 620189 - DNA, 13 bp, D. melanogaster
gaatatttgaata

SEQ ID NO: 620190 - DNA, 13 bp, D. melanogaster
gaatatttgcata

SEQ ID NO: 620191 - DNA, 13 bp, D. melanogaster
gaatatttggaaa

SEQ ID NO: 620192 - DNA, 13 bp, D. melanogaster
gaatatttgtatt

SEQ ID NO: 620193 - DNA, 13 bp, D. melanogaster
gaatatttgtgat

SEQ ID NO: 620194 - DNA, 13 bp, D. melanogaster
gaatattttgaaa

SEQ ID NO: 620195 - DNA, 14 bp, D. melanogaster
gaatattttgaaaa

SEQ ID NO: 620196 - DNA, 14 bp, D. melanogaster
gaatattttgtttg

SEQ ID NO: 620197 - DNA, 13 bp, D. melanogaster
gaatatttttaga

SEQ ID NO: 620198 - DNA, 14 bp, D. melanogaster
gaatcaaaaaatat

SEQ ID NO: 620199 - DNA, 13 bp, D. melanogaster
gaatcaaaaatat

SEQ ID NO: 620200 - DNA, 13 bp, D. melanogaster
gaatcaaaatttc

SEQ ID NO: 620201 - DNA, 13 bp, D. melanogaster
gaatcaaacgctg

SEQ ID NO: 620202 - DNA, 13 bp, D. melanogaster
gaatcaaaggaaa

SEQ ID NO: 620203 - DNA, 13 bp, D. melanogaster
gaatcaaatcaaa

SEQ ID NO: 620204 - DNA, 13 bp, D. melanogaster
gaatcaaatcgaa

SEQ ID NO: 620205 - DNA, 13 bp, D. melanogaster
gaatcaaatgaaa

SEQ ID NO: 620206 - DNA, 13 bp, D. melanogaster
gaatcaaatgaat

SEQ ID NO: 620207 - DNA, 13 bp, D. melanogaster
gaatcaaattgaa

SEQ ID NO: 620208 - DNA, 13 bp, D. melanogaster
gaatcaacaaaca

SEQ ID NO: 620209 - DNA, 13 bp, D. melanogaster
gaatcaataaaat

SEQ ID NO: 620210 - DNA, 13 bp, D. melanogaster
gaatcaataaatt

SEQ ID NO: 620211 - DNA, 13 bp, D. melanogaster
gaatcaatacggt

SEQ ID NO: 620212 - DNA, 13 bp, D. melanogaster
gaatcaatagaag

SEQ ID NO: 620213 - DNA, 13 bp, D. melanogaster
gaatcaatattta

SEQ ID NO: 620214 - DNA, 13 bp, D. melanogaster
gaatcaattaaaa

SEQ ID NO: 620215 - DNA, 13 bp, D. melanogaster
gaatcaattgcag

SEQ ID NO: 620216 - DNA, 14 bp, D. melanogaster
gaatcaattgcagg

SEQ ID NO: 620217 - DNA, 14 bp, D. melanogaster
gaatcaccaaagaa

SEQ ID NO: 620218 - DNA, 13 bp, D. melanogaster
gaatcagaaacag

SEQ ID NO: 620219 - DNA, 14 bp, D. melanogaster
gaatcagaaacaga

SEQ ID NO: 620220 - DNA, 13 bp, D. melanogaster
gaatcagaaccta

SEQ ID NO: 620221 - DNA, 13 bp, D. melanogaster
gaatcagaatcag

SEQ ID NO: 620222 - DNA, 14 bp, D. melanogaster
gaatcagaatcaga

SEQ ID NO: 620223 - DNA, 13 bp, D. melanogaster
gaatcaggagcag

SEQ ID NO: 620224 - DNA, 13 bp, D. melanogaster
gaatcaggatatt

SEQ ID NO: 620225 - DNA, 13 bp, D. melanogaster
gaatcataaaaat

SEQ ID NO: 620226 - DNA, 13 bp, D. melanogaster
gaatcataataat

SEQ ID NO: 620227 - DNA, 13 bp, D. melanogaster
gaatcatatttta

SEQ ID NO: 620228 - DNA, 13 bp, D. melanogaster
gaatcatcatcat

SEQ ID NO: 620229 - DNA, 14 bp, D. melanogaster
gaatccaaatccga

SEQ ID NO: 620230 - DNA, 13 bp, D. melanogaster
gaatccaagagca

SEQ ID NO: 620231 - DNA, 13 bp, D. melanogaster
gaatccaataagc

SEQ ID NO: 620232 - DNA, 13 bp, D. melanogaster
gaatccaatccaa

SEQ ID NO: 620233 - DNA, 13 bp, D. melanogaster
gaatccaatcgaa

SEQ ID NO: 620234 - DNA, 14 bp, D. melanogaster
gaatccacttgcca

SEQ ID NO: 620235 - DNA, 13 bp, D. melanogaster
gaatccagacatt

SEQ ID NO: 620236 - DNA, 13 bp, D. melanogaster
gaatccattaaaa

SEQ ID NO: 620237 - DNA, 14 bp, D. melanogaster
gaatcccaatccca

SEQ ID NO: 620238 - DNA, 13 bp, D. melanogaster
gaatccgaaagaa

SEQ ID NO: 620239 - DNA, 13 bp, D. melanogaster
gaatccgaatcag

SEQ ID NO: 620240 - DNA, 13 bp, D. melanogaster
gaatccgaatccg

SEQ ID NO: 620241 - DNA, 14 bp, D. melanogaster
gaatccgaatccgt

SEQ ID NO: 620242 - DNA, 13 bp, D. melanogaster
gaatccgaatctg

SEQ ID NO: 620243 - DNA, 14 bp, D. melanogaster
gaatccgagtccga

SEQ ID NO: 620244 - DNA, 13 bp, D. melanogaster
gaatccgattccg

SEQ ID NO: 620245 - DNA, 14 bp, D. melanogaster
gaatccgattccga

SEQ ID NO: 620246 - DNA, 13 bp, D. melanogaster
gaatccgcatccg

SEQ ID NO: 620247 - DNA, 13 bp, D. melanogaster
gaatccggaatcc

SEQ ID NO: 620248 - DNA, 13 bp, D. melanogaster
gaatccgtatccg

SEQ ID NO: 620249 - DNA, 13 bp, D. melanogaster
gaatcctctgttg

SEQ ID NO: 620250 - DNA, 13 bp, D. melanogaster
gaatcctgaatcc

SEQ ID NO: 620251 - DNA, 13 bp, D. melanogaster
gaatcgaaacgaa

SEQ ID NO: 620252 - DNA, 13 bp, D. melanogaster
gaatcgaaacgga

SEQ ID NO: 620253 - DNA, 13 bp, D. melanogaster
gaatcgaaatcag

SEQ ID NO: 620254 - DNA, 14 bp, D. melanogaster
gaatcgaaatcgaa

SEQ ID NO: 620255 - DNA, 13 bp, D. melanogaster
gaatcgaaatcgg

SEQ ID NO: 620256 - DNA, 13 bp, D. melanogaster
gaatcgaacaaaa

SEQ ID NO: 620257 - DNA, 13 bp, D. melanogaster
gaatcgaatcaaa

SEQ ID NO: 620258 - DNA, 14 bp, D. melanogaster
gaatcgaatcgaat

SEQ ID NO: 620259 - DNA, 13 bp, D. melanogaster
gaatcgaatggat

SEQ ID NO: 620260 - DNA, 13 bp, D. melanogaster
gaatcgaattgaa

SEQ ID NO: 620261 - DNA, 14 bp, D. melanogaster
gaatcgaattgaat

SEQ ID NO: 620262 - DNA, 14 bp, D. melanogaster
gaatcgaggaggag

SEQ ID NO: 620263 - DNA, 13 bp, D. melanogaster
gaatcgcatcgaa

SEQ ID NO: 620264 - DNA, 14 bp, D. melanogaster
gaatcgcatcgaat

SEQ ID NO: 620265 - DNA, 13 bp, D. melanogaster
gaatcgctttggt

SEQ ID NO: 620266 - DNA, 13 bp, D. melanogaster
gaatcggaaatat

SEQ ID NO: 620267 - DNA, 13 bp, D. melanogaster
gaatcggaatccg

SEQ ID NO: 620268 - DNA, 14 bp, D. melanogaster
gaatcggaatccga

SEQ ID NO: 620269 - DNA, 13 bp, D. melanogaster
gaatcggaatcga

SEQ ID NO: 620270 - DNA, 14 bp, D. melanogaster
gaatcggaatcgaa

SEQ ID NO: 620271 - DNA, 14 bp, D. melanogaster
gaatcggaatcggg

SEQ ID NO: 620272 - DNA, 13 bp, D. melanogaster
gaatcggaatgga

SEQ ID NO: 620273 - DNA, 13 bp, D. melanogaster
gaatcggaattgg

SEQ ID NO: 620274 - DNA, 14 bp, D. melanogaster
gaatcggattcgga

SEQ ID NO: 620275 - DNA, 13 bp, D. melanogaster
gaatcgggaatcg

SEQ ID NO: 620276 - DNA, 14 bp, D. melanogaster
gaatcgggaatcgg

SEQ ID NO: 620277 - DNA, 13 bp, D. melanogaster
gaatctaatattt

SEQ ID NO: 620278 - DNA, 13 bp, D. melanogaster
gaatctagcatac

SEQ ID NO: 620279 - DNA, 13 bp, D. melanogaster
gaatctcctgcca

SEQ ID NO: 620280 - DNA, 14 bp, D. melanogaster
gaatctgaaactga

SEQ ID NO: 620281 - DNA, 13 bp, D. melanogaster
gaatctgaaagtt

SEQ ID NO: 620282 - DNA, 13 bp, D. melanogaster
gaatctgaagctg

SEQ ID NO: 620283 - DNA, 13 bp, D. melanogaster
gaatctgaatccg

SEQ ID NO: 620284 - DNA, 14 bp, D. melanogaster
gaatctgaatccga

SEQ ID NO: 620285 - DNA, 14 bp, D. melanogaster
gaatctgaatctgc

SEQ ID NO: 620286 - DNA, 13 bp, D. melanogaster
gaatctgcatctg

SEQ ID NO: 620287 - DNA, 13 bp, D. melanogaster
gaatctggagtcc

SEQ ID NO: 620288 - DNA, 13 bp, D. melanogaster
gaatctgtatctg

SEQ ID NO: 620289 - DNA, 13 bp, D. melanogaster
gaatctgtatttt

SEQ ID NO: 620290 - DNA, 14 bp, D. melanogaster
gaatctgtatttta

SEQ ID NO: 620291 - DNA, 13 bp, D. melanogaster
gaatgaaaaacca

SEQ ID NO: 620292 - DNA, 13 bp, D. melanogaster
gaatgaaaacatt

SEQ ID NO: 620293 - DNA, 13 bp, D. melanogaster
gaatgaaaacgaa

SEQ ID NO: 620294 - DNA, 14 bp, D. melanogaster
gaatgaaaacgaaa

SEQ ID NO: 620295 - DNA, 13 bp, D. melanogaster
gaatgaaaacttt

SEQ ID NO: 620296 - DNA, 13 bp, D. melanogaster
gaatgaaaagcag

SEQ ID NO: 620297 - DNA, 14 bp, D. melanogaster
gaatgaaaatatga

SEQ ID NO: 620298 - DNA, 13 bp, D. melanogaster
gaatgaaaattga

SEQ ID NO: 620299 - DNA, 13 bp, D. melanogaster
gaatgaaaattta

SEQ ID NO: 620300 - DNA, 13 bp, D. melanogaster
gaatgaaagcaaa

SEQ ID NO: 620301 - DNA, 13 bp, D. melanogaster
gaatgaaatcaaa

SEQ ID NO: 620302 - DNA, 14 bp, D. melanogaster
gaatgaaatgaaat

SEQ ID NO: 620303 - DNA, 14 bp, D. melanogaster
gaatgaaatgaatg

SEQ ID NO: 620304 - DNA, 13 bp, D. melanogaster
gaatgaaatgcaa

SEQ ID NO: 620305 - DNA, 13 bp, D. melanogaster
gaatgaaatggaa

SEQ ID NO: 620306 - DNA, 13 bp, D. melanogaster
gaatgaaattcaa

SEQ ID NO: 620307 - DNA, 13 bp, D. melanogaster
gaatgaaatttga

SEQ ID NO: 620308 - DNA, 13 bp, D. melanogaster
gaatgaaatttgc

SEQ ID NO: 620309 - DNA, 13 bp, D. melanogaster
gaatgaactgaaa

SEQ ID NO: 620310 - DNA, 13 bp, D. melanogaster
gaatgaactttta

SEQ ID NO: 620311 - DNA, 13 bp, D. melanogaster
gaatgaataaatg

SEQ ID NO: 620312 - DNA, 13 bp, D. melanogaster
gaatgaatgaaat

SEQ ID NO: 620313 - DNA, 13 bp, D. melanogaster
gaatgaatgaatt

SEQ ID NO: 620314 - DNA, 13 bp, D. melanogaster
gaatgaatgagaa

SEQ ID NO: 620315 - DNA, 13 bp, D. melanogaster
gaatgaatgagcg

SEQ ID NO: 620316 - DNA, 13 bp, D. melanogaster
gaatgaatggatg

SEQ ID NO: 620317 - DNA, 13 bp, D. melanogaster
gaatgaatggcaa

SEQ ID NO: 620318 - DNA, 14 bp, D. melanogaster
gaatgaatgtagaa

SEQ ID NO: 620319 - DNA, 14 bp, D. melanogaster
gaatgactgaatga

SEQ ID NO: 620320 - DNA, 13 bp, D. melanogaster
gaatgagaatgag

SEQ ID NO: 620321 - DNA, 13 bp, D. melanogaster
gaatgagtgagtg

SEQ ID NO: 620322 - DNA, 13 bp, D. melanogaster
gaatgatgtcaat

SEQ ID NO: 620323 - DNA, 13 bp, D. melanogaster
gaatgatttaaat

SEQ ID NO: 620324 - DNA, 13 bp, D. melanogaster
gaatgatttttat

SEQ ID NO: 620325 - DNA, 13 bp, D. melanogaster
gaatgcaaaagat

SEQ ID NO: 620326 - DNA, 13 bp, D. melanogaster
gaatgcaaaatat

SEQ ID NO: 620327 - DNA, 13 bp, D. melanogaster
gaatgcaaacaaa

SEQ ID NO: 620328 - DNA, 14 bp, D. melanogaster
gaatgcaaataaat

SEQ ID NO: 620329 - DNA, 13 bp, D. melanogaster
gaatgcaaatatt

SEQ ID NO: 620330 - DNA, 13 bp, D. melanogaster
gaatgcaaatcga

SEQ ID NO: 620331 - DNA, 14 bp, D. melanogaster
gaatgcaaatgaaa

SEQ ID NO: 620332 - DNA, 13 bp, D. melanogaster
gaatgcaaatgca

SEQ ID NO: 620333 - DNA, 14 bp, D. melanogaster
gaatgcaaatgcaa

SEQ ID NO: 620334 - DNA, 13 bp, D. melanogaster
gaatgcaaatgtt

SEQ ID NO: 620335 - DNA, 13 bp, D. melanogaster
gaatgcaaattga

SEQ ID NO: 620336 - DNA, 13 bp, D. melanogaster
gaatgcaaatttc

SEQ ID NO: 620337 - DNA, 13 bp, D. melanogaster
gaatgcaataaaa

SEQ ID NO: 620338 - DNA, 13 bp, D. melanogaster
gaatgcaatgatg

SEQ ID NO: 620339 - DNA, 13 bp, D. melanogaster
gaatgcaattttc

SEQ ID NO: 620340 - DNA, 13 bp, D. melanogaster
gaatgcacaaaaa

SEQ ID NO: 620341 - DNA, 14 bp, D. melanogaster
gaatgcacccaaaa

SEQ ID NO: 620342 - DNA, 13 bp, D. melanogaster
gaatgcacctgca

SEQ ID NO: 620343 - DNA, 13 bp, D. melanogaster
gaatgcagttgca

SEQ ID NO: 620344 - DNA, 13 bp, D. melanogaster
gaatgcagtttta

SEQ ID NO: 620345 - DNA, 13 bp, D. melanogaster
gaatgcataaaat

SEQ ID NO: 620346 - DNA, 13 bp, D. melanogaster
gaatgcataaata

SEQ ID NO: 620347 - DNA, 13 bp, D. melanogaster
gaatgcatatgtt

SEQ ID NO: 620348 - DNA, 13 bp, D. melanogaster
gaatgcatttgaa

SEQ ID NO: 620349 - DNA, 13 bp, D. melanogaster
gaatgcatttttt

SEQ ID NO: 620350 - DNA, 13 bp, D. melanogaster
gaatgccaaaaaa

SEQ ID NO: 620351 - DNA, 14 bp, D. melanogaster
gaatgccaaacaaa

SEQ ID NO: 620352 - DNA, 13 bp, D. melanogaster
gaatgccaaatga

SEQ ID NO: 620353 - DNA, 13 bp, D. melanogaster
gaatgccaatggg

SEQ ID NO: 620354 - DNA, 13 bp, D. melanogaster
gaatgccacccga

SEQ ID NO: 620355 - DNA, 13 bp, D. melanogaster
gaatgccagaatg

SEQ ID NO: 620356 - DNA, 13 bp, D. melanogaster
gaatgccatatct

SEQ ID NO: 620357 - DNA, 13 bp, D. melanogaster
gaatgccattcga

SEQ ID NO: 620358 - DNA, 13 bp, D. melanogaster
gaatgccattgaa

SEQ ID NO: 620359 - DNA, 13 bp, D. melanogaster
gaatgcccaagtc

SEQ ID NO: 620360 - DNA, 13 bp, D. melanogaster
gaatgccgaatgc

SEQ ID NO: 620361 - DNA, 13 bp, D. melanogaster
gaatgcgaaatgc

SEQ ID NO: 620362 - DNA, 14 bp, D. melanogaster
gaatgcgaatacga

SEQ ID NO: 620363 - DNA, 13 bp, D. melanogaster
gaatgcgaatgcg

SEQ ID NO: 620364 - DNA, 13 bp, D. melanogaster
gaatgcgaatgtg

SEQ ID NO: 620365 - DNA, 13 bp, D. melanogaster
gaatgcgaccaac

SEQ ID NO: 620366 - DNA, 13 bp, D. melanogaster
gaatgcgagtgca

SEQ ID NO: 620367 - DNA, 13 bp, D. melanogaster
gaatgcgagtgtg

SEQ ID NO: 620368 - DNA, 13 bp, D. melanogaster
gaatgcggacaat

SEQ ID NO: 620369 - DNA, 13 bp, D. melanogaster
gaatgcgtgtgtg

SEQ ID NO: 620370 - DNA, 13 bp, D. melanogaster
gaatgctaagtta

SEQ ID NO: 620371 - DNA, 13 bp, D. melanogaster
gaatgctacaaat

SEQ ID NO: 620372 - DNA, 13 bp, D. melanogaster
gaatgctatagtc

SEQ ID NO: 620373 - DNA, 14 bp, D. melanogaster
gaatgctatagtca

SEQ ID NO: 620374 - DNA, 13 bp, D. melanogaster
gaatgctctactt

SEQ ID NO: 620375 - DNA, 13 bp, D. melanogaster
gaatgctgaatga

SEQ ID NO: 620376 - DNA, 13 bp, D. melanogaster
gaatgctgaatgc

SEQ ID NO: 620377 - DNA, 19 bp, D. melanogaster
gaatgctgagcatgcactt

SEQ ID NO: 620378 - DNA, 13 bp, D. melanogaster
gaatgctgcttta

SEQ ID NO: 620379 - DNA, 13 bp, D. melanogaster
gaatgctttaaat

SEQ ID NO: 620380 - DNA, 13 bp, D. melanogaster
gaatgctttttga

SEQ ID NO: 620381 - DNA, 13 bp, D. melanogaster
gaatggaaaagta

SEQ ID NO: 620382 - DNA, 14 bp, D. melanogaster
gaatggaaaatgga

SEQ ID NO: 620383 - DNA, 13 bp, D. melanogaster
gaatggaaaatgt

SEQ ID NO: 620384 - DNA, 13 bp, D. melanogaster
gaatggaaacgaa

SEQ ID NO: 620385 - DNA, 13 bp, D. melanogaster
gaatggaaatgaa

SEQ ID NO: 620386 - DNA, 13 bp, D. melanogaster
gaatggaaatgag

SEQ ID NO: 620387 - DNA, 13 bp, D. melanogaster
gaatggaaatgcg

SEQ ID NO: 620388 - DNA, 13 bp, D. melanogaster
gaatggaaatgga

SEQ ID NO: 620389 - DNA, 13 bp, D. melanogaster
gaatggaaatggg

SEQ ID NO: 620390 - DNA, 13 bp, D. melanogaster
gaatggaaatggt

SEQ ID NO: 620391 - DNA, 13 bp, D. melanogaster
gaatggaacggaa

SEQ ID NO: 620392 - DNA, 13 bp, D. melanogaster
gaatggaatcatg

SEQ ID NO: 620393 - DNA, 13 bp, D. melanogaster
gaatggaatgaaa

SEQ ID NO: 620394 - DNA, 13 bp, D. melanogaster
gaatggaatgaat

SEQ ID NO: 620395 - DNA, 13 bp, D. melanogaster
gaatggaatgcca

SEQ ID NO: 620396 - DNA, 13 bp, D. melanogaster
gaatggaatggag

SEQ ID NO: 620397 - DNA, 13 bp, D. melanogaster
gaatggaatggga

SEQ ID NO: 620398 - DNA, 13 bp, D. melanogaster
gaatggaatgggg

SEQ ID NO: 620399 - DNA, 13 bp, D. melanogaster
gaatggaatggtg

SEQ ID NO: 620400 - DNA, 14 bp, D. melanogaster
gaatggaattgaaa

SEQ ID NO: 620401 - DNA, 13 bp, D. melanogaster
gaatggaattggg

SEQ ID NO: 620402 - DNA, 13 bp, D. melanogaster
gaatggacgaact

SEQ ID NO: 620403 - DNA, 13 bp, D. melanogaster
gaatggagaatgg

SEQ ID NO: 620404 - DNA, 14 bp, D. melanogaster
gaatggagaatgga

SEQ ID NO: 620405 - DNA, 13 bp, D. melanogaster
gaatggagtggag

SEQ ID NO: 620406 - DNA, 13 bp, D. melanogaster
gaatggataaatg

SEQ ID NO: 620407 - DNA, 14 bp, D. melanogaster
gaatggatggatgg

SEQ ID NO: 620408 - DNA, 13 bp, D. melanogaster
gaatggattggat

SEQ ID NO: 620409 - DNA, 13 bp, D. melanogaster
gaatggcaaaaaa

SEQ ID NO: 620410 - DNA, 13 bp, D. melanogaster
gaatggcaaacaa

SEQ ID NO: 620411 - DNA, 13 bp, D. melanogaster
gaatggcaaacgg

SEQ ID NO: 620412 - DNA, 13 bp, D. melanogaster
gaatggcaaatgg

SEQ ID NO: 620413 - DNA, 13 bp, D. melanogaster
gaatggcacaaag

SEQ ID NO: 620414 - DNA, 13 bp, D. melanogaster
gaatggcctcctt

SEQ ID NO: 620415 - DNA, 13 bp, D. melanogaster
gaatggcggagca

SEQ ID NO: 620416 - DNA, 13 bp, D. melanogaster
gaatgggaatgaa

SEQ ID NO: 620417 - DNA, 13 bp, D. melanogaster
gaatgggaatgga

SEQ ID NO: 620418 - DNA, 14 bp, D. melanogaster
gaatgggaatggca

SEQ ID NO: 620419 - DNA, 13 bp, D. melanogaster
gaatgggaattgg

SEQ ID NO: 620420 - DNA, 13 bp, D. melanogaster
gaatgggatcttt

SEQ ID NO: 620421 - DNA, 13 bp, D. melanogaster
gaatgggcgtggc

SEQ ID NO: 620422 - DNA, 13 bp, D. melanogaster
gaatggtcaagcg

SEQ ID NO: 620423 - DNA, 13 bp, D. melanogaster
gaatggtggtctt

SEQ ID NO: 620424 - DNA, 13 bp, D. melanogaster
gaatgtaaatgaa

SEQ ID NO: 620425 - DNA, 13 bp, D. melanogaster
gaatgtatataaa

SEQ ID NO: 620426 - DNA, 13 bp, D. melanogaster
gaatgtatttata

SEQ ID NO: 620427 - DNA, 13 bp, D. melanogaster
gaatgtcaaaaag

SEQ ID NO: 620428 - DNA, 13 bp, D. melanogaster
gaatgtcagcatt

SEQ ID NO: 620429 - DNA, 14 bp, D. melanogaster
gaatgtcatccgtt

SEQ ID NO: 620430 - DNA, 13 bp, D. melanogaster
gaatgtgaatata

SEQ ID NO: 620431 - DNA, 13 bp, D. melanogaster
gaatgtgaatgtg

SEQ ID NO: 620432 - DNA, 14 bp, D. melanogaster
gaatgtgaatgtga

SEQ ID NO: 620433 - DNA, 13 bp, D. melanogaster
gaatgtgagtata

SEQ ID NO: 620434 - DNA, 13 bp, D. melanogaster
gaatgtgcctgct

SEQ ID NO: 620435 - DNA, 13 bp, D. melanogaster
gaatgtggatgtg

SEQ ID NO: 620436 - DNA, 14 bp, D. melanogaster
gaatgtggatgtgg

SEQ ID NO: 620437 - DNA, 13 bp, D. melanogaster
gaatgtgtcagtg

SEQ ID NO: 620438 - DNA, 13 bp, D. melanogaster
gaatgtgtgggtg

SEQ ID NO: 620439 - DNA, 13 bp, D. melanogaster
gaatgtgtgtttg

SEQ ID NO: 620440 - DNA, 13 bp, D. melanogaster
gaatgtgttaaaa

SEQ ID NO: 620441 - DNA, 13 bp, D. melanogaster
gaatgttgaatgt

SEQ ID NO: 620442 - DNA, 13 bp, D. melanogaster
gaatgttgtcaac

SEQ ID NO: 620443 - DNA, 13 bp, D. melanogaster
gaatgtttatgtt

SEQ ID NO: 620444 - DNA, 13 bp, D. melanogaster
gaatgttttcccc

SEQ ID NO: 620445 - DNA, 13 bp, D. melanogaster
gaatgttttgaaa

SEQ ID NO: 620446 - DNA, 14 bp, D. melanogaster
gaattaaacataaa

SEQ ID NO: 620447 - DNA, 13 bp, D. melanogaster
gaattaaactaaa

SEQ ID NO: 620448 - DNA, 13 bp, D. melanogaster
gaattaaactaat

SEQ ID NO: 620449 - DNA, 13 bp, D. melanogaster
gaattaataacaa

SEQ ID NO: 620450 - DNA, 13 bp, D. melanogaster
gaattacaaatta

SEQ ID NO: 620451 - DNA, 13 bp, D. melanogaster
gaattacaacctg

SEQ ID NO: 620452 - DNA, 13 bp, D. melanogaster
gaattagaagtag

SEQ ID NO: 620453 - DNA, 13 bp, D. melanogaster
gaattataaaagc

SEQ ID NO: 620454 - DNA, 13 bp, D. melanogaster
gaattatacaaaa

SEQ ID NO: 620455 - DNA, 13 bp, D. melanogaster
gaattatgaaata

SEQ ID NO: 620456 - DNA, 13 bp, D. melanogaster
gaattatgtgagc

SEQ ID NO: 620457 - DNA, 13 bp, D. melanogaster
gaattattattac

SEQ ID NO: 620458 - DNA, 13 bp, D. melanogaster
gaattattattga

SEQ ID NO: 620459 - DNA, 13 bp, D. melanogaster
gaattattgtaaa

SEQ ID NO: 620460 - DNA, 13 bp, D. melanogaster
gaattatttaaac

SEQ ID NO: 620461 - DNA, 13 bp, D. melanogaster
gaattatttactg

SEQ ID NO: 620462 - DNA, 13 bp, D. melanogaster
gaattatttgaaa

SEQ ID NO: 620463 - DNA, 13 bp, D. melanogaster
gaattattttcat

SEQ ID NO: 620464 - DNA, 13 bp, D. melanogaster
gaattcaaaatca

SEQ ID NO: 620465 - DNA, 13 bp, D. melanogaster
gaattcaaaattt

SEQ ID NO: 620466 - DNA, 13 bp, D. melanogaster
gaattcaaacaaa

SEQ ID NO: 620467 - DNA, 13 bp, D. melanogaster
gaattcaaatatt

SEQ ID NO: 620468 - DNA, 13 bp, D. melanogaster
gaattcaaattaa

SEQ ID NO: 620469 - DNA, 13 bp, D. melanogaster
gaattcaaattca

SEQ ID NO: 620470 - DNA, 13 bp, D. melanogaster
gaattcaaatttg

SEQ ID NO: 620471 - DNA, 13 bp, D. melanogaster
gaattcaacaagg

SEQ ID NO: 620472 - DNA, 13 bp, D. melanogaster
gaattcaacattt

SEQ ID NO: 620473 - DNA, 13 bp, D. melanogaster
gaattcaacgatg

SEQ ID NO: 620474 - DNA, 13 bp, D. melanogaster
gaattcaagtttt

SEQ ID NO: 620475 - DNA, 13 bp, D. melanogaster
gaattcaatgaaa

SEQ ID NO: 620476 - DNA, 13 bp, D. melanogaster
gaattcaattatt

SEQ ID NO: 620477 - DNA, 13 bp, D. melanogaster
gaattcaattcaa

SEQ ID NO: 620478 - DNA, 14 bp, D. melanogaster
gaattcaattcaat

SEQ ID NO: 620479 - DNA, 13 bp, D. melanogaster
gaattcaatttgc

SEQ ID NO: 620480 - DNA, 13 bp, D. melanogaster
gaattcaatttgg

SEQ ID NO: 620481 - DNA, 13 bp, D. melanogaster
gaattcaatttta

SEQ ID NO: 620482 - DNA, 13 bp, D. melanogaster
gaattcagcatgt

SEQ ID NO: 620483 - DNA, 13 bp, D. melanogaster
gaattcagcgaat

SEQ ID NO: 620484 - DNA, 13 bp, D. melanogaster
gaattcatatggt

SEQ ID NO: 620485 - DNA, 13 bp, D. melanogaster
gaattcatattta

SEQ ID NO: 620486 - DNA, 13 bp, D. melanogaster
gaattcattaatt

SEQ ID NO: 620487 - DNA, 13 bp, D. melanogaster
gaattcatttaat

SEQ ID NO: 620488 - DNA, 13 bp, D. melanogaster
gaattccaaaata

SEQ ID NO: 620489 - DNA, 13 bp, D. melanogaster
gaattccaagaaa

SEQ ID NO: 620490 - DNA, 13 bp, D. melanogaster
gaattccaatact

SEQ ID NO: 620491 - DNA, 13 bp, D. melanogaster
gaattccattttt

SEQ ID NO: 620492 - DNA, 14 bp, D. melanogaster
gaattcccaaactt

SEQ ID NO: 620493 - DNA, 13 bp, D. melanogaster
gaattccccagca

SEQ ID NO: 620494 - DNA, 14 bp, D. melanogaster
gaattccctgtttt

SEQ ID NO: 620495 - DNA, 13 bp, D. melanogaster
gaattcctaaaaa

SEQ ID NO: 620496 - DNA, 13 bp, D. melanogaster
gaattcgaaaaca

SEQ ID NO: 620497 - DNA, 14 bp, D. melanogaster
gaattcgaaaacac

SEQ ID NO: 620498 - DNA, 13 bp, D. melanogaster
gaattcgaaaatt

SEQ ID NO: 620499 - DNA, 13 bp, D. melanogaster
gaattcgattaaa

SEQ ID NO: 620500 - DNA, 13 bp, D. melanogaster
gaattcgatttga

SEQ ID NO: 620501 - DNA, 13 bp, D. melanogaster
gaattcgattttg

SEQ ID NO: 620502 - DNA, 13 bp, D. melanogaster
gaattcgcattta

SEQ ID NO: 620503 - DNA, 13 bp, D. melanogaster
gaattcgtagctt

SEQ ID NO: 620504 - DNA, 13 bp, D. melanogaster
gaattcgttatta

SEQ ID NO: 620505 - DNA, 13 bp, D. melanogaster
gaattctaaaata

SEQ ID NO: 620506 - DNA, 14 bp, D. melanogaster
gaattctaaacagc

SEQ ID NO: 620507 - DNA, 13 bp, D. melanogaster
gaattctataatt

SEQ ID NO: 620508 - DNA, 13 bp, D. melanogaster
gaattcttgattt

SEQ ID NO: 620509 - DNA, 13 bp, D. melanogaster
gaattcttgcttt

SEQ ID NO: 620510 - DNA, 13 bp, D. melanogaster
gaattgaaaacaa

SEQ ID NO: 620511 - DNA, 13 bp, D. melanogaster
gaattgaaacgaa

SEQ ID NO: 620512 - DNA, 13 bp, D. melanogaster
gaattgaaataga

SEQ ID NO: 620513 - DNA, 13 bp, D. melanogaster
gaattgaaattaa

SEQ ID NO: 620514 - DNA, 13 bp, D. melanogaster
gaattgaaattat

SEQ ID NO: 620515 - DNA, 13 bp, D. melanogaster
gaattgaaattga

SEQ ID NO: 620516 - DNA, 13 bp, D. melanogaster
gaattgaaattgg

SEQ ID NO: 620517 - DNA, 13 bp, D. melanogaster
gaattgaacaaaa

SEQ ID NO: 620518 - DNA, 14 bp, D. melanogaster
gaattgaacattct

SEQ ID NO: 620519 - DNA, 13 bp, D. melanogaster
gaattgaacttga

SEQ ID NO: 620520 - DNA, 13 bp, D. melanogaster
gaattgaatggca

SEQ ID NO: 620521 - DNA, 13 bp, D. melanogaster
gaattgaattatt

SEQ ID NO: 620522 - DNA, 13 bp, D. melanogaster
gaattgaattcat

SEQ ID NO: 620523 - DNA, 14 bp, D. melanogaster
gaattgaattgaat

SEQ ID NO: 620524 - DNA, 13 bp, D. melanogaster
gaattgaatttgt

SEQ ID NO: 620525 - DNA, 13 bp, D. melanogaster
gaattgaccaaag

SEQ ID NO: 620526 - DNA, 13 bp, D. melanogaster
gaattgagcttct

SEQ ID NO: 620527 - DNA, 13 bp, D. melanogaster
gaattgattgaaa

SEQ ID NO: 620528 - DNA, 13 bp, D. melanogaster
gaattgattgatt

SEQ ID NO: 620529 - DNA, 13 bp, D. melanogaster
gaattgcacaaaa

SEQ ID NO: 620530 - DNA, 13 bp, D. melanogaster
gaattgcagaaag

SEQ ID NO: 620531 - DNA, 13 bp, D. melanogaster
gaattgcaggccg

SEQ ID NO: 620532 - DNA, 13 bp, D. melanogaster
gaattgcataaat

SEQ ID NO: 620533 - DNA, 13 bp, D. melanogaster
gaattgcattaac

SEQ ID NO: 620534 - DNA, 13 bp, D. melanogaster
gaattgcatttaa

SEQ ID NO: 620535 - DNA, 13 bp, D. melanogaster
gaattggaaataa

SEQ ID NO: 620536 - DNA, 13 bp, D. melanogaster
gaattggaaatgc

SEQ ID NO: 620537 - DNA, 13 bp, D. melanogaster
gaattggaagtgg

SEQ ID NO: 620538 - DNA, 13 bp, D. melanogaster
gaattggaatcgg

SEQ ID NO: 620539 - DNA, 14 bp, D. melanogaster
gaattggaatcgga

SEQ ID NO: 620540 - DNA, 14 bp, D. melanogaster
gaattggaattgaa

SEQ ID NO: 620541 - DNA, 13 bp, D. melanogaster
gaattggatgata

SEQ ID NO: 620542 - DNA, 15 bp, D. melanogaster
gaattggcaaggaga

SEQ ID NO: 620543 - DNA, 13 bp, D. melanogaster
gaattggccaaaa

SEQ ID NO: 620544 - DNA, 13 bp, D. melanogaster
gaattgggattta

SEQ ID NO: 620545 - DNA, 13 bp, D. melanogaster
gaattggtcaatt

SEQ ID NO: 620546 - DNA, 13 bp, D. melanogaster
gaattgtaataaa

SEQ ID NO: 620547 - DNA, 13 bp, D. melanogaster
gaattgtataaga

SEQ ID NO: 620548 - DNA, 13 bp, D. melanogaster
gaattgtatatat

SEQ ID NO: 620549 - DNA, 13 bp, D. melanogaster
gaattgtatgttg

SEQ ID NO: 620550 - DNA, 13 bp, D. melanogaster
gaattgtcgtttc

SEQ ID NO: 620551 - DNA, 13 bp, D. melanogaster
gaattgtgaaaaa

SEQ ID NO: 620552 - DNA, 14 bp, D. melanogaster
gaattgttggaaat

SEQ ID NO: 620553 - DNA, 13 bp, D. melanogaster
gaattgttggcag

SEQ ID NO: 620554 - DNA, 13 bp, D. melanogaster
gaattgttgttaa

SEQ ID NO: 620555 - DNA, 13 bp, D. melanogaster
gaattgtttaaat

SEQ ID NO: 620556 - DNA, 13 bp, D. melanogaster
gaattgtttaggg

SEQ ID NO: 620557 - DNA, 13 bp, D. melanogaster
gaattgtttttaa

SEQ ID NO: 620558 - DNA, 13 bp, D. melanogaster
gaatttaaaaaca

SEQ ID NO: 620559 - DNA, 13 bp, D. melanogaster
gaatttaaaacaa

SEQ ID NO: 620560 - DNA, 13 bp, D. melanogaster
gaatttaaactta

SEQ ID NO: 620561 - DNA, 13 bp, D. melanogaster
gaatttaaagcaa

SEQ ID NO: 620562 - DNA, 13 bp, D. melanogaster
gaatttaaatcaa

SEQ ID NO: 620563 - DNA, 13 bp, D. melanogaster
gaatttaaatgaa

SEQ ID NO: 620564 - DNA, 13 bp, D. melanogaster
gaatttaaattga

SEQ ID NO: 620565 - DNA, 13 bp, D. melanogaster
gaatttaaattgc

SEQ ID NO: 620566 - DNA, 13 bp, D. melanogaster
gaatttaagccaa

SEQ ID NO: 620567 - DNA, 13 bp, D. melanogaster
gaatttaaggaat

SEQ ID NO: 620568 - DNA, 13 bp, D. melanogaster
gaatttaataaac

SEQ ID NO: 620569 - DNA, 14 bp, D. melanogaster
gaatttaatagcca

SEQ ID NO: 620570 - DNA, 13 bp, D. melanogaster
gaatttaatgaaa

SEQ ID NO: 620571 - DNA, 13 bp, D. melanogaster
gaatttaatgtta

SEQ ID NO: 620572 - DNA, 14 bp, D. melanogaster
gaatttaatgttaa

SEQ ID NO: 620573 - DNA, 13 bp, D. melanogaster
gaatttaattaga

SEQ ID NO: 620574 - DNA, 13 bp, D. melanogaster
gaatttaattgct

SEQ ID NO: 620575 - DNA, 13 bp, D. melanogaster
gaatttaatttct

SEQ ID NO: 620576 - DNA, 14 bp, D. melanogaster
gaatttacaaaaat

SEQ ID NO: 620577 - DNA, 13 bp, D. melanogaster
gaatttacatggt

SEQ ID NO: 620578 - DNA, 13 bp, D. melanogaster
gaatttaccaact

SEQ ID NO: 620579 - DNA, 13 bp, D. melanogaster
gaatttacttaat

SEQ ID NO: 620580 - DNA, 13 bp, D. melanogaster
gaatttactttta

SEQ ID NO: 620581 - DNA, 13 bp, D. melanogaster
gaatttagtatac

SEQ ID NO: 620582 - DNA, 13 bp, D. melanogaster
gaatttatacaaa

SEQ ID NO: 620583 - DNA, 13 bp, D. melanogaster
gaatttatattga

SEQ ID NO: 620584 - DNA, 13 bp, D. melanogaster
gaatttatctaca

SEQ ID NO: 620585 - DNA, 13 bp, D. melanogaster
gaatttatgaatg

SEQ ID NO: 620586 - DNA, 13 bp, D. melanogaster
gaatttatgaatt

SEQ ID NO: 620587 - DNA, 13 bp, D. melanogaster
gaatttatgcaaa

SEQ ID NO: 620588 - DNA, 13 bp, D. melanogaster
gaatttatgcata

SEQ ID NO: 620589 - DNA, 13 bp, D. melanogaster
gaatttatgcatt

SEQ ID NO: 620590 - DNA, 13 bp, D. melanogaster
gaatttatgtaaa

SEQ ID NO: 620591 - DNA, 13 bp, D. melanogaster
gaatttatgtatt

SEQ ID NO: 620592 - DNA, 13 bp, D. melanogaster
gaatttattatca

SEQ ID NO: 620593 - DNA, 13 bp, D. melanogaster
gaatttattgaat

SEQ ID NO: 620594 - DNA, 13 bp, D. melanogaster
gaatttattgatt

SEQ ID NO: 620595 - DNA, 13 bp, D. melanogaster
gaatttattttct

SEQ ID NO: 620596 - DNA, 13 bp, D. melanogaster
gaatttcaaaaat

SEQ ID NO: 620597 - DNA, 13 bp, D. melanogaster
gaatttcaaatga

SEQ ID NO: 620598 - DNA, 13 bp, D. melanogaster
gaatttcaaattt

SEQ ID NO: 620599 - DNA, 13 bp, D. melanogaster
gaatttcaagttt

SEQ ID NO: 620600 - DNA, 14 bp, D. melanogaster
gaatttcaataaaa

SEQ ID NO: 620601 - DNA, 14 bp, D. melanogaster
gaatttcaataaat

SEQ ID NO: 620602 - DNA, 13 bp, D. melanogaster
gaatttcaattga

SEQ ID NO: 620603 - DNA, 13 bp, D. melanogaster
gaatttcatttga

SEQ ID NO: 620604 - DNA, 13 bp, D. melanogaster
gaatttcatttgg

SEQ ID NO: 620605 - DNA, 14 bp, D. melanogaster
gaatttcatttgtt

SEQ ID NO: 620606 - DNA, 13 bp, D. melanogaster
gaatttccaaatt

SEQ ID NO: 620607 - DNA, 13 bp, D. melanogaster
gaatttccattta

SEQ ID NO: 620608 - DNA, 13 bp, D. melanogaster
gaatttccatttg

SEQ ID NO: 620609 - DNA, 13 bp, D. melanogaster
gaatttccatttt

SEQ ID NO: 620610 - DNA, 13 bp, D. melanogaster
gaatttcccattt

SEQ ID NO: 620611 - DNA, 13 bp, D. melanogaster
gaatttccgaaga

SEQ ID NO: 620612 - DNA, 13 bp, D. melanogaster
gaatttccttttt

SEQ ID NO: 620613 - DNA, 14 bp, D. melanogaster
gaatttcctttttc

SEQ ID NO: 620614 - DNA, 13 bp, D. melanogaster
gaatttcgatttg

SEQ ID NO: 620615 - DNA, 13 bp, D. melanogaster
gaatttcgatttt

SEQ ID NO: 620616 - DNA, 13 bp, D. melanogaster
gaatttcgcaaaa

SEQ ID NO: 620617 - DNA, 13 bp, D. melanogaster
gaatttcgtttgt

SEQ ID NO: 620618 - DNA, 13 bp, D. melanogaster
gaatttctaatta

SEQ ID NO: 620619 - DNA, 13 bp, D. melanogaster
gaatttctggttt

SEQ ID NO: 620620 - DNA, 13 bp, D. melanogaster
gaatttcttatcg

SEQ ID NO: 620621 - DNA, 13 bp, D. melanogaster
gaatttcttgttt

SEQ ID NO: 620622 - DNA, 13 bp, D. melanogaster
gaatttgaaaatg

SEQ ID NO: 620623 - DNA, 13 bp, D. melanogaster
gaatttgaaatat

SEQ ID NO: 620624 - DNA, 13 bp, D. melanogaster
gaatttgaaattg

SEQ ID NO: 620625 - DNA, 13 bp, D. melanogaster
gaatttgaataga

SEQ ID NO: 620626 - DNA, 13 bp, D. melanogaster
gaatttgaatgaa

SEQ ID NO: 620627 - DNA, 14 bp, D. melanogaster
gaatttgaattcga

SEQ ID NO: 620628 - DNA, 14 bp, D. melanogaster
gaatttgaatttaa

SEQ ID NO: 620629 - DNA, 13 bp, D. melanogaster
gaatttgaatttt

SEQ ID NO: 620630 - DNA, 13 bp, D. melanogaster
gaatttgacaaaa

SEQ ID NO: 620631 - DNA, 14 bp, D. melanogaster
gaatttgacaaaag

SEQ ID NO: 620632 - DNA, 14 bp, D. melanogaster
gaatttgatgatcc

SEQ ID NO: 620633 - DNA, 13 bp, D. melanogaster
gaatttgatttga

SEQ ID NO: 620634 - DNA, 13 bp, D. melanogaster
gaatttgcatttg

SEQ ID NO: 620635 - DNA, 13 bp, D. melanogaster
gaatttggaaaag

SEQ ID NO: 620636 - DNA, 13 bp, D. melanogaster
gaatttgtaaatt

SEQ ID NO: 620637 - DNA, 13 bp, D. melanogaster
gaatttgtatatt

SEQ ID NO: 620638 - DNA, 13 bp, D. melanogaster
gaatttgtatctg

SEQ ID NO: 620639 - DNA, 13 bp, D. melanogaster
gaatttgttgtcc

SEQ ID NO: 620640 - DNA, 15 bp, D. melanogaster
gaatttgttgtttcg

SEQ ID NO: 620641 - DNA, 13 bp, D. melanogaster
gaatttgtttaaa

SEQ ID NO: 620642 - DNA, 13 bp, D. melanogaster
gaatttgtttgta

SEQ ID NO: 620643 - DNA, 13 bp, D. melanogaster
gaattttaaaaca

SEQ ID NO: 620644 - DNA, 14 bp, D. melanogaster
gaattttaaaatgt

SEQ ID NO: 620645 - DNA, 13 bp, D. melanogaster
gaattttaaagga

SEQ ID NO: 620646 - DNA, 13 bp, D. melanogaster
gaattttaaatac

SEQ ID NO: 620647 - DNA, 14 bp, D. melanogaster
gaattttaaattcc

SEQ ID NO: 620648 - DNA, 13 bp, D. melanogaster
gaattttaacttt

SEQ ID NO: 620649 - DNA, 13 bp, D. melanogaster
gaattttaagcaa

SEQ ID NO: 620650 - DNA, 13 bp, D. melanogaster
gaattttaagtgc

SEQ ID NO: 620651 - DNA, 13 bp, D. melanogaster
gaattttaattag

SEQ ID NO: 620652 - DNA, 13 bp, D. melanogaster
gaattttaattga

SEQ ID NO: 620653 - DNA, 13 bp, D. melanogaster
gaattttaatttc

SEQ ID NO: 620654 - DNA, 13 bp, D. melanogaster
gaattttatgaat

SEQ ID NO: 620655 - DNA, 13 bp, D. melanogaster
gaattttcaatta

SEQ ID NO: 620656 - DNA, 13 bp, D. melanogaster
gaattttcacttt

SEQ ID NO: 620657 - DNA, 13 bp, D. melanogaster
gaattttcagtta

SEQ ID NO: 620658 - DNA, 13 bp, D. melanogaster
gaattttcctatt

SEQ ID NO: 620659 - DNA, 13 bp, D. melanogaster
gaattttcctgtt

SEQ ID NO: 620660 - DNA, 14 bp, D. melanogaster
gaattttcctgttt

SEQ ID NO: 620661 - DNA, 13 bp, D. melanogaster
gaattttcgaaaa

SEQ ID NO: 620662 - DNA, 14 bp, D. melanogaster
gaattttcgaaaaa

SEQ ID NO: 620663 - DNA, 13 bp, D. melanogaster
gaattttcgtcat

SEQ ID NO: 620664 - DNA, 13 bp, D. melanogaster
gaattttcgtttt

SEQ ID NO: 620665 - DNA, 13 bp, D. melanogaster
gaattttctgttg

SEQ ID NO: 620666 - DNA, 13 bp, D. melanogaster
gaattttctttcc

SEQ ID NO: 620667 - DNA, 13 bp, D. melanogaster
gaattttgaataa

SEQ ID NO: 620668 - DNA, 13 bp, D. melanogaster
gaattttgaattt

SEQ ID NO: 620669 - DNA, 13 bp, D. melanogaster
gaattttgatata

SEQ ID NO: 620670 - DNA, 13 bp, D. melanogaster
gaattttgattga

SEQ ID NO: 620671 - DNA, 13 bp, D. melanogaster
gaattttgcaatc

SEQ ID NO: 620672 - DNA, 13 bp, D. melanogaster
gaattttgcatat

SEQ ID NO: 620673 - DNA, 13 bp, D. melanogaster
gaattttgccaaa

SEQ ID NO: 620674 - DNA, 13 bp, D. melanogaster
gaattttggaaaa

SEQ ID NO: 620675 - DNA, 13 bp, D. melanogaster
gaattttggccaa

SEQ ID NO: 620676 - DNA, 13 bp, D. melanogaster
gaattttgtcaaa

SEQ ID NO: 620677 - DNA, 13 bp, D. melanogaster
gaattttgttctt

SEQ ID NO: 620678 - DNA, 13 bp, D. melanogaster
gaattttgtttaa

SEQ ID NO: 620679 - DNA, 13 bp, D. melanogaster
gaatttttaaaga

SEQ ID NO: 620680 - DNA, 13 bp, D. melanogaster
gaatttttaattg

SEQ ID NO: 620681 - DNA, 13 bp, D. melanogaster
gaatttttattca

SEQ ID NO: 620682 - DNA, 14 bp, D. melanogaster
gaatttttcacttt

SEQ ID NO: 620683 - DNA, 13 bp, D. melanogaster
gaatttttcgcat

SEQ ID NO: 620684 - DNA, 37 bp, D. melanogaster
gaatttttcgcatggtgccaattgatcaaaaataata

SEQ ID NO: 620685 - DNA, 13 bp, D. melanogaster
gaatttttcttta

SEQ ID NO: 620686 - DNA, 14 bp, D. melanogaster
gaatttttctttat

SEQ ID NO: 620687 - DNA, 13 bp, D. melanogaster
gaatttttgatta

SEQ ID NO: 620688 - DNA, 13 bp, D. melanogaster
gaatttttgcatt

SEQ ID NO: 620689 - DNA, 13 bp, D. melanogaster
gaatttttggaat

SEQ ID NO: 620690 - DNA, 13 bp, D. melanogaster
gaatttttgtaaa

SEQ ID NO: 620691 - DNA, 13 bp, D. melanogaster
gaatttttgtgga

SEQ ID NO: 620692 - DNA, 13 bp, D. melanogaster
gaattttttactt

SEQ ID NO: 620693 - DNA, 13 bp, D. melanogaster
gaattttttcgcc

SEQ ID NO: 620694 - DNA, 13 bp, D. melanogaster
gaattttttgctt

SEQ ID NO: 620695 - DNA, 13 bp, D. melanogaster
gacaaaaactttt

SEQ ID NO: 620696 - DNA, 13 bp, D. melanogaster
gacaaaaagcgcc

SEQ ID NO: 620697 - DNA, 13 bp, D. melanogaster
gacaaaaattcaa

SEQ ID NO: 620698 - DNA, 13 bp, D. melanogaster
gacaaaacaaatt

SEQ ID NO: 620699 - DNA, 13 bp, D. melanogaster
gacaaaaccgatt

SEQ ID NO: 620700 - DNA, 13 bp, D. melanogaster
gacaaaacttttg

SEQ ID NO: 620701 - DNA, 13 bp, D. melanogaster
gacaaaagcaatt

SEQ ID NO: 620702 - DNA, 13 bp, D. melanogaster
gacaaaagcggtg

SEQ ID NO: 620703 - DNA, 13 bp, D. melanogaster
gacaaaagctgcc

SEQ ID NO: 620704 - DNA, 13 bp, D. melanogaster
gacaaaaggagat

SEQ ID NO: 620705 - DNA, 13 bp, D. melanogaster
gacaaaaggcgaa

SEQ ID NO: 620706 - DNA, 13 bp, D. melanogaster
gacaaaagtacca

SEQ ID NO: 620707 - DNA, 14 bp, D. melanogaster
gacaaaatagatga

SEQ ID NO: 620708 - DNA, 13 bp, D. melanogaster
gacaaaatcaaat

SEQ ID NO: 620709 - DNA, 13 bp, D. melanogaster
gacaaaatttgaa

SEQ ID NO: 620710 - DNA, 13 bp, D. melanogaster
gacaaacaaattt

SEQ ID NO: 620711 - DNA, 13 bp, D. melanogaster
gacaaacacaaat

SEQ ID NO: 620712 - DNA, 13 bp, D. melanogaster
gacaaacgaaaat

SEQ ID NO: 620713 - DNA, 13 bp, D. melanogaster
gacaaacggacat

SEQ ID NO: 620714 - DNA, 13 bp, D. melanogaster
gacaaactgtatg

SEQ ID NO: 620715 - DNA, 14 bp, D. melanogaster
gacaaacttgaaaa

SEQ ID NO: 620716 - DNA, 13 bp, D. melanogaster
gacaaactttcaa

SEQ ID NO: 620717 - DNA, 13 bp, D. melanogaster
gacaaagaaaatg

SEQ ID NO: 620718 - DNA, 13 bp, D. melanogaster
gacaaaggaaatg

SEQ ID NO: 620719 - DNA, 13 bp, D. melanogaster
gacaaagtaaatt

SEQ ID NO: 620720 - DNA, 13 bp, D. melanogaster
gacaaagttttcc

SEQ ID NO: 620721 - DNA, 13 bp, D. melanogaster
gacaaataaacag

SEQ ID NO: 620722 - DNA, 14 bp, D. melanogaster
gacaaatattctta

SEQ ID NO: 620723 - DNA, 14 bp, D. melanogaster
gacaaatatttaat

SEQ ID NO: 620724 - DNA, 13 bp, D. melanogaster
gacaaatatttac

SEQ ID NO: 620725 - DNA, 13 bp, D. melanogaster
gacaaatcctgaa

SEQ ID NO: 620726 - DNA, 14 bp, D. melanogaster
gacaaatgtgagtt

SEQ ID NO: 620727 - DNA, 13 bp, D. melanogaster
gacaaatgtgttt

SEQ ID NO: 620728 - DNA, 13 bp, D. melanogaster
gacaaattagaat

SEQ ID NO: 620729 - DNA, 13 bp, D. melanogaster
gacaaattcgaag

SEQ ID NO: 620730 - DNA, 13 bp, D. melanogaster
gacaaattgaaaa

SEQ ID NO: 620731 - DNA, 13 bp, D. melanogaster
gacaaattttcaa

SEQ ID NO: 620732 - DNA, 13 bp, D. melanogaster
gacaacaaatgaa

SEQ ID NO: 620733 - DNA, 13 bp, D. melanogaster
gacaacaaatgca

SEQ ID NO: 620734 - DNA, 13 bp, D. melanogaster
gacaacaaattca

SEQ ID NO: 620735 - DNA, 14 bp, D. melanogaster
gacaacaaattcaa

SEQ ID NO: 620736 - DNA, 13 bp, D. melanogaster
gacaacaaattga

SEQ ID NO: 620737 - DNA, 13 bp, D. melanogaster
gacaacaaatttg

SEQ ID NO: 620738 - DNA, 13 bp, D. melanogaster
gacaacaacaagc

SEQ ID NO: 620739 - DNA, 13 bp, D. melanogaster
gacaacaacaata

SEQ ID NO: 620740 - DNA, 14 bp, D. melanogaster
gacaacaacaataa

SEQ ID NO: 620741 - DNA, 13 bp, D. melanogaster
gacaacaacagcg

SEQ ID NO: 620742 - DNA, 13 bp, D. melanogaster
gacaacaacatct

SEQ ID NO: 620743 - DNA, 13 bp, D. melanogaster
gacaacaacgacg

SEQ ID NO: 620744 - DNA, 13 bp, D. melanogaster
gacaacaatggca

SEQ ID NO: 620745 - DNA, 14 bp, D. melanogaster
gacaacacatacgg

SEQ ID NO: 620746 - DNA, 13 bp, D. melanogaster
gacaacagaggat

SEQ ID NO: 620747 - DNA, 13 bp, D. melanogaster
gacaacagcaaca

SEQ ID NO: 620748 - DNA, 14 bp, D. melanogaster
gacaacagcaacag

SEQ ID NO: 620749 - DNA, 13 bp, D. melanogaster
gacaacagcagca

SEQ ID NO: 620750 - DNA, 14 bp, D. melanogaster
gacaacagcagcaa

SEQ ID NO: 620751 - DNA, 13 bp, D. melanogaster
gacaacagcagcg

SEQ ID NO: 620752 - DNA, 13 bp, D. melanogaster
gacaacagcgaat

SEQ ID NO: 620753 - DNA, 13 bp, D. melanogaster
gacaacatttgct

SEQ ID NO: 620754 - DNA, 13 bp, D. melanogaster
gacaacccattgg

SEQ ID NO: 620755 - DNA, 13 bp, D. melanogaster
gacaaccgacaac

SEQ ID NO: 620756 - DNA, 13 bp, D. melanogaster
gacaacctgacct

SEQ ID NO: 620757 - DNA, 14 bp, D. melanogaster
gacaacgacaacga

SEQ ID NO: 620758 - DNA, 13 bp, D. melanogaster
gacaacgacaact

SEQ ID NO: 620759 - DNA, 13 bp, D. melanogaster
gacaacgacaatg

SEQ ID NO: 620760 - DNA, 13 bp, D. melanogaster
gacaacgacactg

SEQ ID NO: 620761 - DNA, 13 bp, D. melanogaster
gacaacgatgacg

SEQ ID NO: 620762 - DNA, 13 bp, D. melanogaster
gacaacggaacaa

SEQ ID NO: 620763 - DNA, 13 bp, D. melanogaster
gacaacggcagca

SEQ ID NO: 620764 - DNA, 13 bp, D. melanogaster
gacaactgcaaca

SEQ ID NO: 620765 - DNA, 13 bp, D. melanogaster
gacaacttaacac

SEQ ID NO: 620766 - DNA, 13 bp, D. melanogaster
gacaacttgggat

SEQ ID NO: 620767 - DNA, 13 bp, D. melanogaster
gacaagaaaactg

SEQ ID NO: 620768 - DNA, 13 bp, D. melanogaster
gacaagaatgaat

SEQ ID NO: 620769 - DNA, 13 bp, D. melanogaster
gacaagcgaatgc

SEQ ID NO: 620770 - DNA, 14 bp, D. melanogaster
gacaagcgaatgca

SEQ ID NO: 620771 - DNA, 13 bp, D. melanogaster
gacaaggatgggg

SEQ ID NO: 620772 - DNA, 13 bp, D. melanogaster
gacaataacaaat

SEQ ID NO: 620773 - DNA, 13 bp, D. melanogaster
gacaataacaaca

SEQ ID NO: 620774 - DNA, 14 bp, D. melanogaster
gacaataacaacaa

SEQ ID NO: 620775 - DNA, 13 bp, D. melanogaster
gacaatataatgg

SEQ ID NO: 620776 - DNA, 13 bp, D. melanogaster
gacaatattcatg

SEQ ID NO: 620777 - DNA, 13 bp, D. melanogaster
gacaatattttat

SEQ ID NO: 620778 - DNA, 13 bp, D. melanogaster
gacaatcagcagc

SEQ ID NO: 620779 - DNA, 14 bp, D. melanogaster
gacaatcagcagca

SEQ ID NO: 620780 - DNA, 13 bp, D. melanogaster
gacaatcccaaac

SEQ ID NO: 620781 - DNA, 13 bp, D. melanogaster
gacaatgaaaagt

SEQ ID NO: 620782 - DNA, 13 bp, D. melanogaster
gacaatgacaacg

SEQ ID NO: 620783 - DNA, 13 bp, D. melanogaster
gacaatgagacga

SEQ ID NO: 620784 - DNA, 13 bp, D. melanogaster
gacaatgcacgac

SEQ ID NO: 620785 - DNA, 13 bp, D. melanogaster
gacaatgccaaat

SEQ ID NO: 620786 - DNA, 13 bp, D. melanogaster
gacaatggactgc

SEQ ID NO: 620787 - DNA, 14 bp, D. melanogaster
gacaatggccaaaa

SEQ ID NO: 620788 - DNA, 14 bp, D. melanogaster
gacaatgtgaacaa

SEQ ID NO: 620789 - DNA, 13 bp, D. melanogaster
gacaatgttgcag

SEQ ID NO: 620790 - DNA, 13 bp, D. melanogaster
gacaatgttgtgc

SEQ ID NO: 620791 - DNA, 13 bp, D. melanogaster
gacaattacaaaa

SEQ ID NO: 620792 - DNA, 13 bp, D. melanogaster
gacaattcaaatt

SEQ ID NO: 620793 - DNA, 13 bp, D. melanogaster
gacaattcccaaa

SEQ ID NO: 620794 - DNA, 13 bp, D. melanogaster
gacaattgaattt

SEQ ID NO: 620795 - DNA, 13 bp, D. melanogaster
gacaatttaatta

SEQ ID NO: 620796 - DNA, 13 bp, D. melanogaster
gacaatttctcat

SEQ ID NO: 620797 - DNA, 13 bp, D. melanogaster
gacaatttgaaaa

SEQ ID NO: 620798 - DNA, 13 bp, D. melanogaster
gacaattttgtgt

SEQ ID NO: 620799 - DNA, 14 bp, D. melanogaster
gacaattttgtgtt

SEQ ID NO: 620800 - DNA, 13 bp, D. melanogaster
gacaattttttaa

SEQ ID NO: 620801 - DNA, 13 bp, D. melanogaster
gacaatttttttt

SEQ ID NO: 620802 - DNA, 14 bp, D. melanogaster
gacaattttttttt

SEQ ID NO: 620803 - DNA, 13 bp, D. melanogaster
gacacaaagaaat

SEQ ID NO: 620804 - DNA, 13 bp, D. melanogaster
gacacaacaacat

SEQ ID NO: 620805 - DNA, 13 bp, D. melanogaster
gacacaagcactc

SEQ ID NO: 620806 - DNA, 13 bp, D. melanogaster
gacacaagtcgag

SEQ ID NO: 620807 - DNA, 13 bp, D. melanogaster
gacacaattggtc

SEQ ID NO: 620808 - DNA, 13 bp, D. melanogaster
gacacacacatgc

SEQ ID NO: 620809 - DNA, 13 bp, D. melanogaster
gacacacacgcac

SEQ ID NO: 620810 - DNA, 14 bp, D. melanogaster
gacacacacgcaca

SEQ ID NO: 620811 - DNA, 13 bp, D. melanogaster
gacacacactcac

SEQ ID NO: 620812 - DNA, 13 bp, D. melanogaster
gacacacactgga

SEQ ID NO: 620813 - DNA, 13 bp, D. melanogaster
gacacacagacac

SEQ ID NO: 620814 - DNA, 14 bp, D. melanogaster
gacacacagacaca

SEQ ID NO: 620815 - DNA, 13 bp, D. melanogaster
gacacacagatac

SEQ ID NO: 620816 - DNA, 14 bp, D. melanogaster
gacacacagataca

SEQ ID NO: 620817 - DNA, 14 bp, D. melanogaster
gacacacatgtcct

SEQ ID NO: 620818 - DNA, 13 bp, D. melanogaster
gacacactcacac

SEQ ID NO: 620819 - DNA, 13 bp, D. melanogaster
gacacagacacag

SEQ ID NO: 620820 - DNA, 14 bp, D. melanogaster
gacacagacacaga

SEQ ID NO: 620821 - DNA, 14 bp, D. melanogaster
gacacagatacaga

SEQ ID NO: 620822 - DNA, 13 bp, D. melanogaster
gacacaggacaca

SEQ ID NO: 620823 - DNA, 14 bp, D. melanogaster
gacacaggacacag

SEQ ID NO: 620824 - DNA, 13 bp, D. melanogaster
gacacattcattt

SEQ ID NO: 620825 - DNA, 13 bp, D. melanogaster
gacacattttatt

SEQ ID NO: 620826 - DNA, 13 bp, D. melanogaster
gacacatttttaa

SEQ ID NO: 620827 - DNA, 13 bp, D. melanogaster
gacaccaaccacg

SEQ ID NO: 620828 - DNA, 13 bp, D. melanogaster
gacaccaatcttc

SEQ ID NO: 620829 - DNA, 13 bp, D. melanogaster
gacaccaccctca

SEQ ID NO: 620830 - DNA, 13 bp, D. melanogaster
gacaccagaatca

SEQ ID NO: 620831 - DNA, 13 bp, D. melanogaster
gacaccagcagtt

SEQ ID NO: 620832 - DNA, 13 bp, D. melanogaster
gacaccatacaga

SEQ ID NO: 620833 - DNA, 13 bp, D. melanogaster
gacacctgctcaa

SEQ ID NO: 620834 - DNA, 13 bp, D. melanogaster
gacacgcacacac

SEQ ID NO: 620835 - DNA, 13 bp, D. melanogaster
gacacgcccactc

SEQ ID NO: 620836 - DNA, 13 bp, D. melanogaster
gacacgcccactt

SEQ ID NO: 620837 - DNA, 13 bp, D. melanogaster
gacacgccccctt

SEQ ID NO: 620838 - DNA, 14 bp, D. melanogaster
gacacggatacgga

SEQ ID NO: 620839 - DNA, 13 bp, D. melanogaster
gacacggcattaa

SEQ ID NO: 620840 - DNA, 13 bp, D. melanogaster
gacactcactcac

SEQ ID NO: 620841 - DNA, 13 bp, D. melanogaster
gacactgagaaaa

SEQ ID NO: 620842 - DNA, 13 bp, D. melanogaster
gacactgatgaaa

SEQ ID NO: 620843 - DNA, 13 bp, D. melanogaster
gacactgcatgtg

SEQ ID NO: 620844 - DNA, 13 bp, D. melanogaster
gacactttgaaat

SEQ ID NO: 620845 - DNA, 13 bp, D. melanogaster
gacagaaagagac

SEQ ID NO: 620846 - DNA, 13 bp, D. melanogaster
gacagaaagtttg

SEQ ID NO: 620847 - DNA, 13 bp, D. melanogaster
gacagaaccattt

SEQ ID NO: 620848 - DNA, 13 bp, D. melanogaster
gacagaattttac

SEQ ID NO: 620849 - DNA, 13 bp, D. melanogaster
gacagacagacac

SEQ ID NO: 620850 - DNA, 13 bp, D. melanogaster
gacagacagacag

SEQ ID NO: 620851 - DNA, 13 bp, D. melanogaster
gacagacagacga

SEQ ID NO: 620852 - DNA, 13 bp, D. melanogaster
gacagacaggcag

SEQ ID NO: 620853 - DNA, 13 bp, D. melanogaster
gacagacaggcgg

SEQ ID NO: 620854 - DNA, 14 bp, D. melanogaster
gacagacggacaga

SEQ ID NO: 620855 - DNA, 13 bp, D. melanogaster
gacagacggacat

SEQ ID NO: 620856 - DNA, 13 bp, D. melanogaster
gacagactgacag

SEQ ID NO: 620857 - DNA, 13 bp, D. melanogaster
gacagagaacgag

SEQ ID NO: 620858 - DNA, 14 bp, D. melanogaster
gacagagacagaga

SEQ ID NO: 620859 - DNA, 13 bp, D. melanogaster
gacagagacagcg

SEQ ID NO: 620860 - DNA, 13 bp, D. melanogaster
gacagagacggag

SEQ ID NO: 620861 - DNA, 13 bp, D. melanogaster
gacagagacggcg

SEQ ID NO: 620862 - DNA, 13 bp, D. melanogaster
gacagagatggaa

SEQ ID NO: 620863 - DNA, 13 bp, D. melanogaster
gacagagcgagag

SEQ ID NO: 620864 - DNA, 13 bp, D. melanogaster
gacagagtgtggc

SEQ ID NO: 620865 - DNA, 13 bp, D. melanogaster
gacagcaacaaat

SEQ ID NO: 620866 - DNA, 13 bp, D. melanogaster
gacagcaacaacg

SEQ ID NO: 620867 - DNA, 13 bp, D. melanogaster
gacagcaattaaa

SEQ ID NO: 620868 - DNA, 13 bp, D. melanogaster
gacagcaatttaa

SEQ ID NO: 620869 - DNA, 13 bp, D. melanogaster
gacagcaatttgc

SEQ ID NO: 620870 - DNA, 13 bp, D. melanogaster
gacagcagcaaca

SEQ ID NO: 620871 - DNA, 14 bp, D. melanogaster
gacagcagcaacag

SEQ ID NO: 620872 - DNA, 14 bp, D. melanogaster
gacagcagcaacat

SEQ ID NO: 620873 - DNA, 14 bp, D. melanogaster
gacagcagcagcaa

SEQ ID NO: 620874 - DNA, 13 bp, D. melanogaster
gacagcagcagcc

SEQ ID NO: 620875 - DNA, 13 bp, D. melanogaster
gacagcagcagcg

SEQ ID NO: 620876 - DNA, 13 bp, D. melanogaster
gacagcagcgagg

SEQ ID NO: 620877 - DNA, 13 bp, D. melanogaster
gacagccacaaaa

SEQ ID NO: 620878 - DNA, 13 bp, D. melanogaster
gacagccggcaaa

SEQ ID NO: 620879 - DNA, 13 bp, D. melanogaster
gacagcgaaaaca

SEQ ID NO: 620880 - DNA, 13 bp, D. melanogaster
gacagcgacaaca

SEQ ID NO: 620881 - DNA, 14 bp, D. melanogaster
gacagcggcaacaa

SEQ ID NO: 620882 - DNA, 13 bp, D. melanogaster
gacagcggcactt

SEQ ID NO: 620883 - DNA, 14 bp, D. melanogaster
gacagcggcactta

SEQ ID NO: 620884 - DNA, 13 bp, D. melanogaster
gacagctgaaaat

SEQ ID NO: 620885 - DNA, 13 bp, D. melanogaster
gacaggacgacag

SEQ ID NO: 620886 - DNA, 13 bp, D. melanogaster
gacaggagcaggg

SEQ ID NO: 620887 - DNA, 13 bp, D. melanogaster
gacaggatcttgg

SEQ ID NO: 620888 - DNA, 13 bp, D. melanogaster
gacaggcaaacaa

SEQ ID NO: 620889 - DNA, 13 bp, D. melanogaster
gacaggcagacag

SEQ ID NO: 620890 - DNA, 14 bp, D. melanogaster
gacaggcagacaga

SEQ ID NO: 620891 - DNA, 13 bp, D. melanogaster
gacaggcggctca

SEQ ID NO: 620892 - DNA, 14 bp, D. melanogaster
gacagggacaggga

SEQ ID NO: 620893 - DNA, 13 bp, D. melanogaster
gacaggttcatcg

SEQ ID NO: 620894 - DNA, 13 bp, D. melanogaster
gacagtgaacaaa

SEQ ID NO: 620895 - DNA, 13 bp, D. melanogaster
gacagtgcgtttc

SEQ ID NO: 620896 - DNA, 13 bp, D. melanogaster
gacagtgggcgcc

SEQ ID NO: 620897 - DNA, 13 bp, D. melanogaster
gacagttggacag

SEQ ID NO: 620898 - DNA, 13 bp, D. melanogaster
gacagttttattt

SEQ ID NO: 620899 - DNA, 13 bp, D. melanogaster
gacagttttgtgc

SEQ ID NO: 620900 - DNA, 13 bp, D. melanogaster
gacataaaacgag

SEQ ID NO: 620901 - DNA, 13 bp, D. melanogaster
gacataaattaaa

SEQ ID NO: 620902 - DNA, 13 bp, D. melanogaster
gacataaatttat

SEQ ID NO: 620903 - DNA, 13 bp, D. melanogaster
gacataattgtat

SEQ ID NO: 620904 - DNA, 13 bp, D. melanogaster
gacatacatacat

SEQ ID NO: 620905 - DNA, 14 bp, D. melanogaster
gacatacatacata

SEQ ID NO: 620906 - DNA, 13 bp, D. melanogaster
gacatacgcattc

SEQ ID NO: 620907 - DNA, 13 bp, D. melanogaster
gacatagacgcag

SEQ ID NO: 620908 - DNA, 13 bp, D. melanogaster
gacatagtaaatg

SEQ ID NO: 620909 - DNA, 13 bp, D. melanogaster
gacatatatataa

SEQ ID NO: 620910 - DNA, 13 bp, D. melanogaster
gacatatatttat

SEQ ID NO: 620911 - DNA, 14 bp, D. melanogaster
gacatatttattct

SEQ ID NO: 620912 - DNA, 13 bp, D. melanogaster
gacatcattcagc

SEQ ID NO: 620913 - DNA, 13 bp, D. melanogaster
gacatccagtaat

SEQ ID NO: 620914 - DNA, 13 bp, D. melanogaster
gacatcgacactt

SEQ ID NO: 620915 - DNA, 13 bp, D. melanogaster
gacatcgacatcg

SEQ ID NO: 620916 - DNA, 13 bp, D. melanogaster
gacatcgagcggt

SEQ ID NO: 620917 - DNA, 13 bp, D. melanogaster
gacatctgtttga

SEQ ID NO: 620918 - DNA, 14 bp, D. melanogaster
gacatcttttccaa

SEQ ID NO: 620919 - DNA, 13 bp, D. melanogaster
gacatcttttttt

SEQ ID NO: 620920 - DNA, 13 bp, D. melanogaster
gacatgaaaaata

SEQ ID NO: 620921 - DNA, 14 bp, D. melanogaster
gacatgaaaaatac

SEQ ID NO: 620922 - DNA, 13 bp, D. melanogaster
gacatgaaaaatg

SEQ ID NO: 620923 - DNA, 13 bp, D. melanogaster
gacatgaaacgtt

SEQ ID NO: 620924 - DNA, 13 bp, D. melanogaster
gacatgaaatatt

SEQ ID NO: 620925 - DNA, 13 bp, D. melanogaster
gacatgcaaaatg

SEQ ID NO: 620926 - DNA, 13 bp, D. melanogaster
gacatggaaatgg

SEQ ID NO: 620927 - DNA, 13 bp, D. melanogaster
gacatggacatgg

SEQ ID NO: 620928 - DNA, 13 bp, D. melanogaster
gacatggacgtgg

SEQ ID NO: 620929 - DNA, 13 bp, D. melanogaster
gacatggccaaat

SEQ ID NO: 620930 - DNA, 13 bp, D. melanogaster
gacatggccagat

SEQ ID NO: 620931 - DNA, 13 bp, D. melanogaster
gacatgggtgcat

SEQ ID NO: 620932 - DNA, 13 bp, D. melanogaster
gacatggtcagat

SEQ ID NO: 620933 - DNA, 13 bp, D. melanogaster
gacatgtttattg

SEQ ID NO: 620934 - DNA, 13 bp, D. melanogaster
gacattaaaaaac

SEQ ID NO: 620935 - DNA, 13 bp, D. melanogaster
gacattaaaatgc

SEQ ID NO: 620936 - DNA, 13 bp, D. melanogaster
gacattaaatcaa

SEQ ID NO: 620937 - DNA, 13 bp, D. melanogaster
gacattaatgaat

SEQ ID NO: 620938 - DNA, 13 bp, D. melanogaster
gacattaattaat

SEQ ID NO: 620939 - DNA, 13 bp, D. melanogaster
gacattacattct

SEQ ID NO: 620940 - DNA, 13 bp, D. melanogaster
gacattactcata

SEQ ID NO: 620941 - DNA, 13 bp, D. melanogaster
gacattatcaaat

SEQ ID NO: 620942 - DNA, 13 bp, D. melanogaster
gacattatttact

SEQ ID NO: 620943 - DNA, 13 bp, D. melanogaster
gacattccacatt

SEQ ID NO: 620944 - DNA, 13 bp, D. melanogaster
gacattccagata

SEQ ID NO: 620945 - DNA, 14 bp, D. melanogaster
gacattcgctgttg

SEQ ID NO: 620946 - DNA, 13 bp, D. melanogaster
gacattgaaattg

SEQ ID NO: 620947 - DNA, 13 bp, D. melanogaster
gacattgacaatg

SEQ ID NO: 620948 - DNA, 13 bp, D. melanogaster
gacattgacattg

SEQ ID NO: 620949 - DNA, 13 bp, D. melanogaster
gacattgtgggca

SEQ ID NO: 620950 - DNA, 13 bp, D. melanogaster
gacattgtgggta

SEQ ID NO: 620951 - DNA, 13 bp, D. melanogaster
gacatttaattta

SEQ ID NO: 620952 - DNA, 13 bp, D. melanogaster
gacatttatttat

SEQ ID NO: 620953 - DNA, 13 bp, D. melanogaster
gacatttgaaaat

SEQ ID NO: 620954 - DNA, 13 bp, D. melanogaster
gacatttgacatt

SEQ ID NO: 620955 - DNA, 13 bp, D. melanogaster
gacatttgcattt

SEQ ID NO: 620956 - DNA, 13 bp, D. melanogaster
gacatttgccaaa

SEQ ID NO: 620957 - DNA, 13 bp, D. melanogaster
gacatttgctcct

SEQ ID NO: 620958 - DNA, 13 bp, D. melanogaster
gacatttggcatt

SEQ ID NO: 620959 - DNA, 13 bp, D. melanogaster
gacatttggccaa

SEQ ID NO: 620960 - DNA, 13 bp, D. melanogaster
gacattttagttt

SEQ ID NO: 620961 - DNA, 13 bp, D. melanogaster
gacatttttatga

SEQ ID NO: 620962 - DNA, 14 bp, D. melanogaster
gacatttttccaaa

SEQ ID NO: 620963 - DNA, 13 bp, D. melanogaster
gaccaaaaaccga

SEQ ID NO: 620964 - DNA, 13 bp, D. melanogaster
gaccaaaaatcaa

SEQ ID NO: 620965 - DNA, 13 bp, D. melanogaster
gaccaaaatattt

SEQ ID NO: 620966 - DNA, 13 bp, D. melanogaster
gaccaaagaccaa

SEQ ID NO: 620967 - DNA, 13 bp, D. melanogaster
gaccaaagccaaa

SEQ ID NO: 620968 - DNA, 13 bp, D. melanogaster
gaccaaatacaag

SEQ ID NO: 620969 - DNA, 13 bp, D. melanogaster
gaccaaatgaaat

SEQ ID NO: 620970 - DNA, 14 bp, D. melanogaster
gaccaaattattac

SEQ ID NO: 620971 - DNA, 13 bp, D. melanogaster
gaccaacaacaat

SEQ ID NO: 620972 - DNA, 13 bp, D. melanogaster
gaccaacggcact

SEQ ID NO: 620973 - DNA, 13 bp, D. melanogaster
gaccaactgactg

SEQ ID NO: 620974 - DNA, 13 bp, D. melanogaster
gaccaagaccaag

SEQ ID NO: 620975 - DNA, 13 bp, D. melanogaster
gaccaaggaccaa

SEQ ID NO: 620976 - DNA, 14 bp, D. melanogaster
gaccaaggaccaag

SEQ ID NO: 620977 - DNA, 13 bp, D. melanogaster
gaccaataaaatt

SEQ ID NO: 620978 - DNA, 14 bp, D. melanogaster
gaccaataaaatta

SEQ ID NO: 620979 - DNA, 13 bp, D. melanogaster
gaccaattctcaa

SEQ ID NO: 620980 - DNA, 14 bp, D. melanogaster
gaccaattctcaaa

SEQ ID NO: 620981 - DNA, 13 bp, D. melanogaster
gaccacactaaga

SEQ ID NO: 620982 - DNA, 13 bp, D. melanogaster
gaccaccattcag

SEQ ID NO: 620983 - DNA, 13 bp, D. melanogaster
gaccacccataca

SEQ ID NO: 620984 - DNA, 13 bp, D. melanogaster
gaccaccgaccac

SEQ ID NO: 620985 - DNA, 13 bp, D. melanogaster
gaccacgaccacg

SEQ ID NO: 620986 - DNA, 13 bp, D. melanogaster
gaccacgcccact

SEQ ID NO: 620987 - DNA, 14 bp, D. melanogaster
gaccacgcccactc

SEQ ID NO: 620988 - DNA, 13 bp, D. melanogaster
gaccagaccagac

SEQ ID NO: 620989 - DNA, 13 bp, D. melanogaster
gaccagaggcctc

SEQ ID NO: 620990 - DNA, 13 bp, D. melanogaster
gaccagccagcca

SEQ ID NO: 620991 - DNA, 13 bp, D. melanogaster
gaccaggaccagg

SEQ ID NO: 620992 - DNA, 14 bp, D. melanogaster
gaccaggaccagga

SEQ ID NO: 620993 - DNA, 13 bp, D. melanogaster
gaccaggccaaaa

SEQ ID NO: 620994 - DNA, 13 bp, D. melanogaster
gaccaggcctcca

SEQ ID NO: 620995 - DNA, 13 bp, D. melanogaster
gaccataaataaa

SEQ ID NO: 620996 - DNA, 13 bp, D. melanogaster
gaccatataaata

SEQ ID NO: 620997 - DNA, 13 bp, D. melanogaster
gaccatatccgaa

SEQ ID NO: 620998 - DNA, 13 bp, D. melanogaster
gaccatatgaagt

SEQ ID NO: 620999 - DNA, 14 bp, D. melanogaster
gaccatcgaccatc

SEQ ID NO: 621000 - DNA, 13 bp, D. melanogaster
gaccatgtgaact

SEQ ID NO: 621001 - DNA, 14 bp, D. melanogaster
gaccatgttgcggg

SEQ ID NO: 621002 - DNA, 14 bp, D. melanogaster
gaccattatcgtct

SEQ ID NO: 621003 - DNA, 14 bp, D. melanogaster
gaccatttacaaaa

SEQ ID NO: 621004 - DNA, 13 bp, D. melanogaster
gaccatttttggc

SEQ ID NO: 621005 - DNA, 13 bp, D. melanogaster
gacccaaaaatta

SEQ ID NO: 621006 - DNA, 13 bp, D. melanogaster
gacccaatcctcc

SEQ ID NO: 621007 - DNA, 13 bp, D. melanogaster
gacccactgtgcc

SEQ ID NO: 621008 - DNA, 13 bp, D. melanogaster
gacccagacccag

SEQ ID NO: 621009 - DNA, 14 bp, D. melanogaster
gacccagtacactg

SEQ ID NO: 621010 - DNA, 13 bp, D. melanogaster
gaccccagccagt

SEQ ID NO: 621011 - DNA, 13 bp, D. melanogaster
gacccctgaccct

SEQ ID NO: 621012 - DNA, 13 bp, D. melanogaster
gacccggacccgg

SEQ ID NO: 621013 - DNA, 13 bp, D. melanogaster
gaccgaccgacca

SEQ ID NO: 621014 - DNA, 13 bp, D. melanogaster
gaccgaccgaccg

SEQ ID NO: 621015 - DNA, 13 bp, D. melanogaster
gaccgcaaatgcc

SEQ ID NO: 621016 - DNA, 13 bp, D. melanogaster
gaccgcccatata

SEQ ID NO: 621017 - DNA, 14 bp, D. melanogaster
gaccggcaatgtcc

SEQ ID NO: 621018 - DNA, 14 bp, D. melanogaster
gaccgttttcctgg

SEQ ID NO: 621019 - DNA, 13 bp, D. melanogaster
gacctaaatgaaa

SEQ ID NO: 621020 - DNA, 13 bp, D. melanogaster
gacctaatgtctg

SEQ ID NO: 621021 - DNA, 13 bp, D. melanogaster
gacctacaaccag

SEQ ID NO: 621022 - DNA, 13 bp, D. melanogaster
gacctacttaaag

SEQ ID NO: 621023 - DNA, 13 bp, D. melanogaster
gacctctactgct

SEQ ID NO: 621024 - DNA, 13 bp, D. melanogaster
gacctgcaaagtg

SEQ ID NO: 621025 - DNA, 13 bp, D. melanogaster
gacctgccacgcc

SEQ ID NO: 621026 - DNA, 13 bp, D. melanogaster
gacctgttcgatg

SEQ ID NO: 621027 - DNA, 13 bp, D. melanogaster
gaccttatcggaa

SEQ ID NO: 621028 - DNA, 13 bp, D. melanogaster
gaccttggtttta

SEQ ID NO: 621029 - DNA, 13 bp, D. melanogaster
gacctttccacca

SEQ ID NO: 621030 - DNA, 15 bp, D. melanogaster
gacgaaaacggagga

SEQ ID NO: 621031 - DNA, 13 bp, D. melanogaster
gacgaaagccagt

SEQ ID NO: 621032 - DNA, 14 bp, D. melanogaster
gacgaacaggacga

SEQ ID NO: 621033 - DNA, 13 bp, D. melanogaster
gacgaacggacag

SEQ ID NO: 621034 - DNA, 13 bp, D. melanogaster
gacgaacggacgg

SEQ ID NO: 621035 - DNA, 13 bp, D. melanogaster
gacgaagacgaag

SEQ ID NO: 621036 - DNA, 13 bp, D. melanogaster
gacgaagatcgca

SEQ ID NO: 621037 - DNA, 13 bp, D. melanogaster
gacgaaggacgaa

SEQ ID NO: 621038 - DNA, 14 bp, D. melanogaster
gacgaaggacgagg

SEQ ID NO: 621039 - DNA, 13 bp, D. melanogaster
gacgaaggacgat

SEQ ID NO: 621040 - DNA, 14 bp, D. melanogaster
gacgacaacgacga

SEQ ID NO: 621041 - DNA, 13 bp, D. melanogaster
gacgacaaggaca

SEQ ID NO: 621042 - DNA, 13 bp, D. melanogaster
gacgacaaggacg

SEQ ID NO: 621043 - DNA, 13 bp, D. melanogaster
gacgacataattt

SEQ ID NO: 621044 - DNA, 13 bp, D. melanogaster
gacgacccagacg

SEQ ID NO: 621045 - DNA, 13 bp, D. melanogaster
gacgacgacgaac

SEQ ID NO: 621046 - DNA, 13 bp, D. melanogaster
gacgacgacgaca

SEQ ID NO: 621047 - DNA, 14 bp, D. melanogaster
gacgacgacgacag

SEQ ID NO: 621048 - DNA, 13 bp, D. melanogaster
gacgacgacgacg

SEQ ID NO: 621049 - DNA, 14 bp, D. melanogaster
gacgacgacgacga

SEQ ID NO: 621050 - DNA, 14 bp, D. melanogaster
gacgacgacgacgg

SEQ ID NO: 621051 - DNA, 14 bp, D. melanogaster
gacgacgacgacgt

SEQ ID NO: 621052 - DNA, 13 bp, D. melanogaster
gacgacgacgagg

SEQ ID NO: 621053 - DNA, 14 bp, D. melanogaster
gacgacgacgagga

SEQ ID NO: 621054 - DNA, 13 bp, D. melanogaster
gacgacgacgatg

SEQ ID NO: 621055 - DNA, 14 bp, D. melanogaster
gacgacgacgatgg

SEQ ID NO: 621056 - DNA, 13 bp, D. melanogaster
gacgacgacgtcg

SEQ ID NO: 621057 - DNA, 14 bp, D. melanogaster
gacgacgatgatgc

SEQ ID NO: 621058 - DNA, 13 bp, D. melanogaster
gacgacggcgatg

SEQ ID NO: 621059 - DNA, 13 bp, D. melanogaster
gacgacttcgaaa

SEQ ID NO: 621060 - DNA, 14 bp, D. melanogaster
gacgacttcgaaat

SEQ ID NO: 621061 - DNA, 13 bp, D. melanogaster
gacgagaacttct

SEQ ID NO: 621062 - DNA, 13 bp, D. melanogaster
gacgagacgagac

SEQ ID NO: 621063 - DNA, 14 bp, D. melanogaster
gacgagatggccaa

SEQ ID NO: 621064 - DNA, 14 bp, D. melanogaster
gacgaggacgagga

SEQ ID NO: 621065 - DNA, 13 bp, D. melanogaster
gacgaggcagagc

SEQ ID NO: 621066 - DNA, 13 bp, D. melanogaster
gacgaggtgcaaa

SEQ ID NO: 621067 - DNA, 13 bp, D. melanogaster
gacgataaaacaa

SEQ ID NO: 621068 - DNA, 13 bp, D. melanogaster
gacgataataaaa

SEQ ID NO: 621069 - DNA, 13 bp, D. melanogaster
gacgataatagtt

SEQ ID NO: 621070 - DNA, 13 bp, D. melanogaster
gacgataatgatg

SEQ ID NO: 621071 - DNA, 13 bp, D. melanogaster
gacgatagtcaac

SEQ ID NO: 621072 - DNA, 13 bp, D. melanogaster
gacgatgacgaag

SEQ ID NO: 621073 - DNA, 13 bp, D. melanogaster
gacgatgacgaca

SEQ ID NO: 621074 - DNA, 14 bp, D. melanogaster
gacgatgacgacga

SEQ ID NO: 621075 - DNA, 13 bp, D. melanogaster
gacgatgacgatg

SEQ ID NO: 621076 - DNA, 14 bp, D. melanogaster
gacgatgacgatga

SEQ ID NO: 621077 - DNA, 14 bp, D. melanogaster
gacgatgacgatgg

SEQ ID NO: 621078 - DNA, 18 bp, D. melanogaster
gacgatgatgatgatgat

SEQ ID NO: 621079 - DNA, 14 bp, D. melanogaster
gacgatgatgatgc

SEQ ID NO: 621080 - DNA, 13 bp, D. melanogaster
gacgatgatgatt

SEQ ID NO: 621081 - DNA, 13 bp, D. melanogaster
gacgatgatgctg

SEQ ID NO: 621082 - DNA, 13 bp, D. melanogaster
gacgatgatggcg

SEQ ID NO: 621083 - DNA, 13 bp, D. melanogaster
gacgatggcgacg

SEQ ID NO: 621084 - DNA, 13 bp, D. melanogaster
gacgatggcgatg

SEQ ID NO: 621085 - DNA, 13 bp, D. melanogaster
gacgatgtggcaa

SEQ ID NO: 621086 - DNA, 13 bp, D. melanogaster
gacgcagaacaag

SEQ ID NO: 621087 - DNA, 14 bp, D. melanogaster
gacgcagcgcaagt

SEQ ID NO: 621088 - DNA, 13 bp, D. melanogaster
gacgcaggacgaa

SEQ ID NO: 621089 - DNA, 13 bp, D. melanogaster
gacgccattttgt

SEQ ID NO: 621090 - DNA, 13 bp, D. melanogaster
gacgcccagctga

SEQ ID NO: 621091 - DNA, 14 bp, D. melanogaster
gacgccggcagcga

SEQ ID NO: 621092 - DNA, 13 bp, D. melanogaster
gacgctgctgctg

SEQ ID NO: 621093 - DNA, 14 bp, D. melanogaster
gacgctggaaaatc

SEQ ID NO: 621094 - DNA, 13 bp, D. melanogaster
gacgctggcagcg

SEQ ID NO: 621095 - DNA, 13 bp, D. melanogaster
gacggaaccggag

SEQ ID NO: 621096 - DNA, 13 bp, D. melanogaster
gacggaagccaca

SEQ ID NO: 621097 - DNA, 14 bp, D. melanogaster
gacggacaaacgga

SEQ ID NO: 621098 - DNA, 13 bp, D. melanogaster
gacggacaggcag

SEQ ID NO: 621099 - DNA, 13 bp, D. melanogaster
gacggacagggcc

SEQ ID NO: 621100 - DNA, 14 bp, D. melanogaster
gacggacatggcca

SEQ ID NO: 621101 - DNA, 13 bp, D. melanogaster
gacggacggacgg

SEQ ID NO: 621102 - DNA, 13 bp, D. melanogaster
gacggacggactg

SEQ ID NO: 621103 - DNA, 13 bp, D. melanogaster
gacggactgactg

SEQ ID NO: 621104 - DNA, 14 bp, D. melanogaster
gacggatggacgga

SEQ ID NO: 621105 - DNA, 13 bp, D. melanogaster
gacggatggctgt

SEQ ID NO: 621106 - DNA, 13 bp, D. melanogaster
gacggatttttga

SEQ ID NO: 621107 - DNA, 14 bp, D. melanogaster
gacggcaaaaagtt

SEQ ID NO: 621108 - DNA, 13 bp, D. melanogaster
gacggcaacaaaa

SEQ ID NO: 621109 - DNA, 13 bp, D. melanogaster
gacggcaacaaca

SEQ ID NO: 621110 - DNA, 13 bp, D. melanogaster
gacggcaactaat

SEQ ID NO: 621111 - DNA, 13 bp, D. melanogaster
gacggcaactgga

SEQ ID NO: 621112 - DNA, 14 bp, D. melanogaster
gacggcaactggaa

SEQ ID NO: 621113 - DNA, 13 bp, D. melanogaster
gacggcagcaaca

SEQ ID NO: 621114 - DNA, 13 bp, D. melanogaster
gacggcaggaggc

SEQ ID NO: 621115 - DNA, 13 bp, D. melanogaster
gacggcgacgacg

SEQ ID NO: 621116 - DNA, 13 bp, D. melanogaster
gacggcgactgcg

SEQ ID NO: 621117 - DNA, 13 bp, D. melanogaster
gacggcggcaatt

SEQ ID NO: 621118 - DNA, 13 bp, D. melanogaster
gacggtgaagaaa

SEQ ID NO: 621119 - DNA, 14 bp, D. melanogaster
gacgtatatactca

SEQ ID NO: 621120 - DNA, 13 bp, D. melanogaster
gacgtatgcgcaa

SEQ ID NO: 621121 - DNA, 13 bp, D. melanogaster
gacgtcgacggcg

SEQ ID NO: 621122 - DNA, 14 bp, D. melanogaster
gacgtcgacgtcgc

SEQ ID NO: 621123 - DNA, 13 bp, D. melanogaster
gacgtcgatgact

SEQ ID NO: 621124 - DNA, 13 bp, D. melanogaster
gacgtcgcagtcg

SEQ ID NO: 621125 - DNA, 13 bp, D. melanogaster
gacgtcgccgtcg

SEQ ID NO: 621126 - DNA, 13 bp, D. melanogaster
gacgtggatgtgg

SEQ ID NO: 621127 - DNA, 14 bp, D. melanogaster
gacgtggatgtgga

SEQ ID NO: 621128 - DNA, 15 bp, D. melanogaster
gacgtggatgtggat

SEQ ID NO: 621129 - DNA, 13 bp, D. melanogaster
gacgttcatttcg

SEQ ID NO: 621130 - DNA, 13 bp, D. melanogaster
gacgttcgcagca

SEQ ID NO: 621131 - DNA, 13 bp, D. melanogaster
gacgttgagctga

SEQ ID NO: 621132 - DNA, 13 bp, D. melanogaster
gacgttgctgctg

SEQ ID NO: 621133 - DNA, 13 bp, D. melanogaster
gacgtttaacaag

SEQ ID NO: 621134 - DNA, 14 bp, D. melanogaster
gacgtttaacaagt

SEQ ID NO: 621135 - DNA, 14 bp, D. melanogaster
gacgttttgtagca

SEQ ID NO: 621136 - DNA, 13 bp, D. melanogaster
gactaaaaatcaa

SEQ ID NO: 621137 - DNA, 13 bp, D. melanogaster
gactaacaataag

SEQ ID NO: 621138 - DNA, 13 bp, D. melanogaster
gactaacagatac

SEQ ID NO: 621139 - DNA, 14 bp, D. melanogaster
gactaacagatacc

SEQ ID NO: 621140 - DNA, 13 bp, D. melanogaster
gactaataaaaat

SEQ ID NO: 621141 - DNA, 13 bp, D. melanogaster
gactaattttccc

SEQ ID NO: 621142 - DNA, 14 bp, D. melanogaster
gactacaaaaataa

SEQ ID NO: 621143 - DNA, 13 bp, D. melanogaster
gactacgactacg

SEQ ID NO: 621144 - DNA, 14 bp, D. melanogaster
gactacgactacga

SEQ ID NO: 621145 - DNA, 15 bp, D. melanogaster
gactacggactacgg

SEQ ID NO: 621146 - DNA, 13 bp, D. melanogaster
gactactaaatca

SEQ ID NO: 621147 - DNA, 13 bp, D. melanogaster
gactataaaaaat

SEQ ID NO: 621148 - DNA, 14 bp, D. melanogaster
gactataaaattta

SEQ ID NO: 621149 - DNA, 13 bp, D. melanogaster
gactataacattc

SEQ ID NO: 621150 - DNA, 14 bp, D. melanogaster
gactatagcattct

SEQ ID NO: 621151 - DNA, 14 bp, D. melanogaster
gactatagcgttct

SEQ ID NO: 621152 - DNA, 13 bp, D. melanogaster
gactatcagatat

SEQ ID NO: 621153 - DNA, 14 bp, D. melanogaster
gactatcgccaaat

SEQ ID NO: 621154 - DNA, 13 bp, D. melanogaster
gactatgacattt

SEQ ID NO: 621155 - DNA, 13 bp, D. melanogaster
gactattagatac

SEQ ID NO: 621156 - DNA, 13 bp, D. melanogaster
gactattgagggt

SEQ ID NO: 621157 - DNA, 13 bp, D. melanogaster
gactatttttatt

SEQ ID NO: 621158 - DNA, 13 bp, D. melanogaster
gactcaaaaatta

SEQ ID NO: 621159 - DNA, 13 bp, D. melanogaster
gactcaaacaagt

SEQ ID NO: 621160 - DNA, 13 bp, D. melanogaster
gactcaagcgaca

SEQ ID NO: 621161 - DNA, 14 bp, D. melanogaster
gactcacacacaca

SEQ ID NO: 621162 - DNA, 13 bp, D. melanogaster
gactcacatggcg

SEQ ID NO: 621163 - DNA, 13 bp, D. melanogaster
gactcaccagcgc

SEQ ID NO: 621164 - DNA, 13 bp, D. melanogaster
gactcagattcag

SEQ ID NO: 621165 - DNA, 13 bp, D. melanogaster
gactcaggactca

SEQ ID NO: 621166 - DNA, 13 bp, D. melanogaster
gactcagtggcac

SEQ ID NO: 621167 - DNA, 13 bp, D. melanogaster
gactccaacacac

SEQ ID NO: 621168 - DNA, 13 bp, D. melanogaster
gactccaactcca

SEQ ID NO: 621169 - DNA, 13 bp, D. melanogaster
gactccaatagcg

SEQ ID NO: 621170 - DNA, 13 bp, D. melanogaster
gactccactccac

SEQ ID NO: 621171 - DNA, 13 bp, D. melanogaster
gactccctctccg

SEQ ID NO: 621172 - DNA, 13 bp, D. melanogaster
gactccgactccg

SEQ ID NO: 621173 - DNA, 13 bp, D. melanogaster
gactcgactcgac

SEQ ID NO: 621174 - DNA, 13 bp, D. melanogaster
gactcggattcgg

SEQ ID NO: 621175 - DNA, 14 bp, D. melanogaster
gactcggattcgga

SEQ ID NO: 621176 - DNA, 13 bp, D. melanogaster
gactctgaacctt

SEQ ID NO: 621177 - DNA, 13 bp, D. melanogaster
gactctgactctg

SEQ ID NO: 621178 - DNA, 13 bp, D. melanogaster
gactctgcagttt

SEQ ID NO: 621179 - DNA, 13 bp, D. melanogaster
gactctttaacat

SEQ ID NO: 621180 - DNA, 13 bp, D. melanogaster
gactgaaaactga

SEQ ID NO: 621181 - DNA, 13 bp, D. melanogaster
gactgaatttatt

SEQ ID NO: 621182 - DNA, 14 bp, D. melanogaster
gactgaatttattt

SEQ ID NO: 621183 - DNA, 13 bp, D. melanogaster
gactgacagacag

SEQ ID NO: 621184 - DNA, 13 bp, D. melanogaster
gactgactgacga

SEQ ID NO: 621185 - DNA, 13 bp, D. melanogaster
gactgactgactt

SEQ ID NO: 621186 - DNA, 13 bp, D. melanogaster
gactgactgatct

SEQ ID NO: 621187 - DNA, 13 bp, D. melanogaster
gactgactgattg

SEQ ID NO: 621188 - DNA, 13 bp, D. melanogaster
gactgactgccgc

SEQ ID NO: 621189 - DNA, 13 bp, D. melanogaster
gactgactggctg

SEQ ID NO: 621190 - DNA, 13 bp, D. melanogaster
gactgagactgag

SEQ ID NO: 621191 - DNA, 13 bp, D. melanogaster
gactgagtataat

SEQ ID NO: 621192 - DNA, 14 bp, D. melanogaster
gactgattgattga

SEQ ID NO: 621193 - DNA, 13 bp, D. melanogaster
gactgattttttt

SEQ ID NO: 621194 - DNA, 13 bp, D. melanogaster
gactgcaacgctg

SEQ ID NO: 621195 - DNA, 14 bp, D. melanogaster
gactgcaactgcaa

SEQ ID NO: 621196 - DNA, 13 bp, D. melanogaster
gactgcagcgagg

SEQ ID NO: 621197 - DNA, 13 bp, D. melanogaster
gactgccacgccc

SEQ ID NO: 621198 - DNA, 13 bp, D. melanogaster
gactgccagtcaa

SEQ ID NO: 621199 - DNA, 14 bp, D. melanogaster
gactgccagtcaag

SEQ ID NO: 621200 - DNA, 13 bp, D. melanogaster
gactgccgcgctc

SEQ ID NO: 621201 - DNA, 13 bp, D. melanogaster
gactgcgactgca

SEQ ID NO: 621202 - DNA, 13 bp, D. melanogaster
gactgcgagcgca

SEQ ID NO: 621203 - DNA, 13 bp, D. melanogaster
gactgcgccagta

SEQ ID NO: 621204 - DNA, 13 bp, D. melanogaster
gactgcgctgcct

SEQ ID NO: 621205 - DNA, 13 bp, D. melanogaster
gactgctgactgc

SEQ ID NO: 621206 - DNA, 13 bp, D. melanogaster
gactgctgctgct

SEQ ID NO: 621207 - DNA, 14 bp, D. melanogaster
gactgctgctgctg

SEQ ID NO: 621208 - DNA, 13 bp, D. melanogaster
gactggaagaaca

SEQ ID NO: 621209 - DNA, 13 bp, D. melanogaster
gactggaagaaga

SEQ ID NO: 621210 - DNA, 13 bp, D. melanogaster
gactggactggac

SEQ ID NO: 621211 - DNA, 13 bp, D. melanogaster
gactggagctgat

SEQ ID NO: 621212 - DNA, 13 bp, D. melanogaster
gactggatgactg

SEQ ID NO: 621213 - DNA, 13 bp, D. melanogaster
gactggcaagaaa

SEQ ID NO: 621214 - DNA, 13 bp, D. melanogaster
gactggcaggact

SEQ ID NO: 621215 - DNA, 13 bp, D. melanogaster
gactggcgactgg

SEQ ID NO: 621216 - DNA, 13 bp, D. melanogaster
gactggctgacag

SEQ ID NO: 621217 - DNA, 13 bp, D. melanogaster
gactggctgactg

SEQ ID NO: 621218 - DNA, 14 bp, D. melanogaster
gactggctgactgg

SEQ ID NO: 621219 - DNA, 13 bp, D. melanogaster
gactggctggctg

SEQ ID NO: 621220 - DNA, 14 bp, D. melanogaster
gactggctggctgg

SEQ ID NO: 621221 - DNA, 14 bp, D. melanogaster
gactgggaatggga

SEQ ID NO: 621222 - DNA, 14 bp, D. melanogaster
gactgggattggga

SEQ ID NO: 621223 - DNA, 13 bp, D. melanogaster
gactgggcgtggc

SEQ ID NO: 621224 - DNA, 14 bp, D. melanogaster
gactgggttcgcga

SEQ ID NO: 621225 - DNA, 13 bp, D. melanogaster
gactggtcaaaca

SEQ ID NO: 621226 - DNA, 13 bp, D. melanogaster
gactggtttataa

SEQ ID NO: 621227 - DNA, 13 bp, D. melanogaster
gactgtatatttt

SEQ ID NO: 621228 - DNA, 13 bp, D. melanogaster
gactgtgactgtg

SEQ ID NO: 621229 - DNA, 13 bp, D. melanogaster
gactgtggatctg

SEQ ID NO: 621230 - DNA, 13 bp, D. melanogaster
gactgtgtgcgtg

SEQ ID NO: 621231 - DNA, 13 bp, D. melanogaster
gactgtttttgta

SEQ ID NO: 621232 - DNA, 13 bp, D. melanogaster
gacttaaaaataa

SEQ ID NO: 621233 - DNA, 13 bp, D. melanogaster
gacttaactggcg

SEQ ID NO: 621234 - DNA, 13 bp, D. melanogaster
gacttaataaata

SEQ ID NO: 621235 - DNA, 14 bp, D. melanogaster
gacttacaatccga

SEQ ID NO: 621236 - DNA, 13 bp, D. melanogaster
gacttagaacaat

SEQ ID NO: 621237 - DNA, 15 bp, D. melanogaster
gacttatccaaaaaa

SEQ ID NO: 621238 - DNA, 13 bp, D. melanogaster
gacttattattat

SEQ ID NO: 621239 - DNA, 13 bp, D. melanogaster
gacttcagtagct

SEQ ID NO: 621240 - DNA, 14 bp, D. melanogaster
gacttccgtttccg

SEQ ID NO: 621241 - DNA, 13 bp, D. melanogaster
gacttccttttaa

SEQ ID NO: 621242 - DNA, 13 bp, D. melanogaster
gacttcgacttcg

SEQ ID NO: 621243 - DNA, 14 bp, D. melanogaster
gacttcgacttcga

SEQ ID NO: 621244 - DNA, 13 bp, D. melanogaster
gacttctgctttt

SEQ ID NO: 621245 - DNA, 13 bp, D. melanogaster
gacttgaaaaaaa

SEQ ID NO: 621246 - DNA, 13 bp, D. melanogaster
gacttggacgagt

SEQ ID NO: 621247 - DNA, 13 bp, D. melanogaster
gacttggacttga

SEQ ID NO: 621248 - DNA, 13 bp, D. melanogaster
gacttggacttgg

SEQ ID NO: 621249 - DNA, 14 bp, D. melanogaster
gacttggacttgga

SEQ ID NO: 621250 - DNA, 14 bp, D. melanogaster
gacttggaggagtt

SEQ ID NO: 621251 - DNA, 13 bp, D. melanogaster
gacttggatttgg

SEQ ID NO: 621252 - DNA, 13 bp, D. melanogaster
gacttggccaact

SEQ ID NO: 621253 - DNA, 13 bp, D. melanogaster
gacttggccaagt

SEQ ID NO: 621254 - DNA, 13 bp, D. melanogaster
gacttggccataa

SEQ ID NO: 621255 - DNA, 13 bp, D. melanogaster
gacttggcctggc

SEQ ID NO: 621256 - DNA, 13 bp, D. melanogaster
gacttgggcattc

SEQ ID NO: 621257 - DNA, 14 bp, D. melanogaster
gacttgttcgaatt

SEQ ID NO: 621258 - DNA, 13 bp, D. melanogaster
gacttgttttata

SEQ ID NO: 621259 - DNA, 13 bp, D. melanogaster
gacttgttttatt

SEQ ID NO: 621260 - DNA, 13 bp, D. melanogaster
gactttaaataaa

SEQ ID NO: 621261 - DNA, 13 bp, D. melanogaster
gactttagacttt

SEQ ID NO: 621262 - DNA, 13 bp, D. melanogaster
gactttatattag

SEQ ID NO: 621263 - DNA, 13 bp, D. melanogaster
gactttatcctga

SEQ ID NO: 621264 - DNA, 13 bp, D. melanogaster
gactttattaaag

SEQ ID NO: 621265 - DNA, 13 bp, D. melanogaster
gactttattaact

SEQ ID NO: 621266 - DNA, 13 bp, D. melanogaster
gactttattcctt

SEQ ID NO: 621267 - DNA, 14 bp, D. melanogaster
gactttcaagttat

SEQ ID NO: 621268 - DNA, 13 bp, D. melanogaster
gactttcgacttt

SEQ ID NO: 621269 - DNA, 13 bp, D. melanogaster
gactttgaacttg

SEQ ID NO: 621270 - DNA, 13 bp, D. melanogaster
gactttgacttgg

SEQ ID NO: 621271 - DNA, 13 bp, D. melanogaster
gactttgactttg

SEQ ID NO: 621272 - DNA, 14 bp, D. melanogaster
gactttgatattaa

SEQ ID NO: 621273 - DNA, 13 bp, D. melanogaster
gactttgatttga

SEQ ID NO: 621274 - DNA, 13 bp, D. melanogaster
gactttggcattg

SEQ ID NO: 621275 - DNA, 13 bp, D. melanogaster
gactttggctcgt

SEQ ID NO: 621276 - DNA, 13 bp, D. melanogaster
gactttggctttg

SEQ ID NO: 621277 - DNA, 13 bp, D. melanogaster
gactttgggcttt

SEQ ID NO: 621278 - DNA, 13 bp, D. melanogaster
gactttgtgaatc

SEQ ID NO: 621279 - DNA, 13 bp, D. melanogaster
gactttgttttgt

SEQ ID NO: 621280 - DNA, 13 bp, D. melanogaster
gacttttatttat

SEQ ID NO: 621281 - DNA, 13 bp, D. melanogaster
gacttttgaggtg

SEQ ID NO: 621282 - DNA, 13 bp, D. melanogaster
gacttttgcaata

SEQ ID NO: 621283 - DNA, 13 bp, D. melanogaster
gacttttgtttgt

SEQ ID NO: 621284 - DNA, 14 bp, D. melanogaster
gactttttccattt

SEQ ID NO: 621285 - DNA, 13 bp, D. melanogaster
gagaaaaaatcca

SEQ ID NO: 621286 - DNA, 14 bp, D. melanogaster
gagaaaaacacttg

SEQ ID NO: 621287 - DNA, 13 bp, D. melanogaster
gagaaaaacatgg

SEQ ID NO: 621288 - DNA, 13 bp, D. melanogaster
gagaaaaatgcaa

SEQ ID NO: 621289 - DNA, 14 bp, D. melanogaster
gagaaaaatgccga

SEQ ID NO: 621290 - DNA, 13 bp, D. melanogaster
gagaaaaatgtat

SEQ ID NO: 621291 - DNA, 13 bp, D. melanogaster
gagaaaaattcaa

SEQ ID NO: 621292 - DNA, 13 bp, D. melanogaster
gagaaaaccccgt

SEQ ID NO: 621293 - DNA, 13 bp, D. melanogaster
gagaaaagtttgc

SEQ ID NO: 621294 - DNA, 13 bp, D. melanogaster
gagaaaataattt

SEQ ID NO: 621295 - DNA, 13 bp, D. melanogaster
gagaaaatatttg

SEQ ID NO: 621296 - DNA, 13 bp, D. melanogaster
gagaaaatgtttg

SEQ ID NO: 621297 - DNA, 13 bp, D. melanogaster
gagaaaattatga

SEQ ID NO: 621298 - DNA, 14 bp, D. melanogaster
gagaaaattattat

SEQ ID NO: 621299 - DNA, 13 bp, D. melanogaster
gagaaaattgtaa

SEQ ID NO: 621300 - DNA, 13 bp, D. melanogaster
gagaaacaaagcc

SEQ ID NO: 621301 - DNA, 13 bp, D. melanogaster
gagaaaccccagt

SEQ ID NO: 621302 - DNA, 13 bp, D. melanogaster
gagaaacccctta

SEQ ID NO: 621303 - DNA, 13 bp, D. melanogaster
gagaaagcaaacg

SEQ ID NO: 621304 - DNA, 13 bp, D. melanogaster
gagaaaggacagc

SEQ ID NO: 621305 - DNA, 13 bp, D. melanogaster
gagaaatacaaat

SEQ ID NO: 621306 - DNA, 13 bp, D. melanogaster
gagaaatatttgg

SEQ ID NO: 621307 - DNA, 14 bp, D. melanogaster
gagaaatatttggc

SEQ ID NO: 621308 - DNA, 13 bp, D. melanogaster
gagaaatattttt

SEQ ID NO: 621309 - DNA, 13 bp, D. melanogaster
gagaaatgcattt

SEQ ID NO: 621310 - DNA, 13 bp, D. melanogaster
gagaaatggaaat

SEQ ID NO: 621311 - DNA, 13 bp, D. melanogaster
gagaaatggcaaa

SEQ ID NO: 621312 - DNA, 13 bp, D. melanogaster
gagaaatgtgaaa

SEQ ID NO: 621313 - DNA, 13 bp, D. melanogaster
gagaaattaaaca

SEQ ID NO: 621314 - DNA, 13 bp, D. melanogaster
gagaaattgaaat

SEQ ID NO: 621315 - DNA, 13 bp, D. melanogaster
gagaaattgtcgt

SEQ ID NO: 621316 - DNA, 13 bp, D. melanogaster
gagaaatttatat

SEQ ID NO: 621317 - DNA, 14 bp, D. melanogaster
gagaaatttcattt

SEQ ID NO: 621318 - DNA, 13 bp, D. melanogaster
gagaaatttgcat

SEQ ID NO: 621319 - DNA, 13 bp, D. melanogaster
gagaaattttatc

SEQ ID NO: 621320 - DNA, 13 bp, D. melanogaster
gagaacacacaca

SEQ ID NO: 621321 - DNA, 13 bp, D. melanogaster
gagaacacttttt

SEQ ID NO: 621322 - DNA, 13 bp, D. melanogaster
gagaacatttttt

SEQ ID NO: 621323 - DNA, 13 bp, D. melanogaster
gagaaccctcaac

SEQ ID NO: 621324 - DNA, 13 bp, D. melanogaster
gagaacgaaagcg

SEQ ID NO: 621325 - DNA, 14 bp, D. melanogaster
gagaacgagaacga

SEQ ID NO: 621326 - DNA, 13 bp, D. melanogaster
gagaacgagaggc

SEQ ID NO: 621327 - DNA, 13 bp, D. melanogaster
gagaacgcgtata

SEQ ID NO: 621328 - DNA, 13 bp, D. melanogaster
gagaacggagaat

SEQ ID NO: 621329 - DNA, 13 bp, D. melanogaster
gagaactgaaatc

SEQ ID NO: 621330 - DNA, 13 bp, D. melanogaster
gagaactgcaagg

SEQ ID NO: 621331 - DNA, 13 bp, D. melanogaster
gagaactggagaa

SEQ ID NO: 621332 - DNA, 13 bp, D. melanogaster
gagaactggttca

SEQ ID NO: 621333 - DNA, 13 bp, D. melanogaster
gagaacttagcgg

SEQ ID NO: 621334 - DNA, 13 bp, D. melanogaster
gagaactttaatt

SEQ ID NO: 621335 - DNA, 13 bp, D. melanogaster
gagaactttgaag

SEQ ID NO: 621336 - DNA, 13 bp, D. melanogaster
gagaacttttggc

SEQ ID NO: 621337 - DNA, 13 bp, D. melanogaster
gagaagaatggcc

SEQ ID NO: 621338 - DNA, 13 bp, D. melanogaster
gagaagagcacaa

SEQ ID NO: 621339 - DNA, 14 bp, D. melanogaster
gagaagagtttctt

SEQ ID NO: 621340 - DNA, 14 bp, D. melanogaster
gagaagatcttctt

SEQ ID NO: 621341 - DNA, 13 bp, D. melanogaster
gagaagcaacaat

SEQ ID NO: 621342 - DNA, 14 bp, D. melanogaster
gagaagcaacaatt

SEQ ID NO: 621343 - DNA, 13 bp, D. melanogaster
gagaagcagaaac

SEQ ID NO: 621344 - DNA, 13 bp, D. melanogaster
gagaagcatatcg

SEQ ID NO: 621345 - DNA, 13 bp, D. melanogaster
gagaagccaactc

SEQ ID NO: 621346 - DNA, 13 bp, D. melanogaster
gagaagccagaaa

SEQ ID NO: 621347 - DNA, 14 bp, D. melanogaster
gagaagccagaaat

SEQ ID NO: 621348 - DNA, 13 bp, D. melanogaster
gagaaggaaatgc

SEQ ID NO: 621349 - DNA, 14 bp, D. melanogaster
gagaaggaaatgct

SEQ ID NO: 621350 - DNA, 13 bp, D. melanogaster
gagaagtgtgcca

SEQ ID NO: 621351 - DNA, 14 bp, D. melanogaster
gagaagtgtgccaa

SEQ ID NO: 621352 - DNA, 13 bp, D. melanogaster
gagaagttaagcc

SEQ ID NO: 621353 - DNA, 13 bp, D. melanogaster
gagaatagagata

SEQ ID NO: 621354 - DNA, 13 bp, D. melanogaster
gagaatagtttgg

SEQ ID NO: 621355 - DNA, 13 bp, D. melanogaster
gagaatatgcaaa

SEQ ID NO: 621356 - DNA, 13 bp, D. melanogaster
gagaatcaactgg

SEQ ID NO: 621357 - DNA, 13 bp, D. melanogaster
gagaatcggagaa

SEQ ID NO: 621358 - DNA, 13 bp, D. melanogaster
gagaatgaaaatg

SEQ ID NO: 621359 - DNA, 13 bp, D. melanogaster
gagaatgaaatgt

SEQ ID NO: 621360 - DNA, 13 bp, D. melanogaster
gagaatgagaatg

SEQ ID NO: 621361 - DNA, 13 bp, D. melanogaster
gagaatgctatat

SEQ ID NO: 621362 - DNA, 13 bp, D. melanogaster
gagaatggaatgg

SEQ ID NO: 621363 - DNA, 13 bp, D. melanogaster
gagaatggagaat

SEQ ID NO: 621364 - DNA, 13 bp, D. melanogaster
gagaatggcaatc

SEQ ID NO: 621365 - DNA, 13 bp, D. melanogaster
gagaatgggaatg

SEQ ID NO: 621366 - DNA, 14 bp, D. melanogaster
gagaatgggaatgg

SEQ ID NO: 621367 - DNA, 13 bp, D. melanogaster
gagaattataata

SEQ ID NO: 621368 - DNA, 13 bp, D. melanogaster
gagaattgtcatc

SEQ ID NO: 621369 - DNA, 13 bp, D. melanogaster
gagaatttaattt

SEQ ID NO: 621370 - DNA, 13 bp, D. melanogaster
gagaatttcaata

SEQ ID NO: 621371 - DNA, 14 bp, D. melanogaster
gagaatttcaataa

SEQ ID NO: 621372 - DNA, 14 bp, D. melanogaster
gagacaaagacgca

SEQ ID NO: 621373 - DNA, 13 bp, D. melanogaster
gagacaaattaga

SEQ ID NO: 621374 - DNA, 13 bp, D. melanogaster
gagacaagctcca

SEQ ID NO: 621375 - DNA, 13 bp, D. melanogaster
gagacaccaatct

SEQ ID NO: 621376 - DNA, 13 bp, D. melanogaster
gagacacgtgaaa

SEQ ID NO: 621377 - DNA, 13 bp, D. melanogaster
gagacagacagac

SEQ ID NO: 621378 - DNA, 13 bp, D. melanogaster
gagacagagacag

SEQ ID NO: 621379 - DNA, 13 bp, D. melanogaster
gagacagaggcag

SEQ ID NO: 621380 - DNA, 13 bp, D. melanogaster
gagacatcgaacg

SEQ ID NO: 621381 - DNA, 13 bp, D. melanogaster
gagacattaaaaa

SEQ ID NO: 621382 - DNA, 13 bp, D. melanogaster
gagacgagaacgc

SEQ ID NO: 621383 - DNA, 13 bp, D. melanogaster
gagacgagacgag

SEQ ID NO: 621384 - DNA, 13 bp, D. melanogaster
gagacggcgacag

SEQ ID NO: 621385 - DNA, 13 bp, D. melanogaster
gagactgaattgt

SEQ ID NO: 621386 - DNA, 13 bp, D. melanogaster
gagacttaaatat

SEQ ID NO: 621387 - DNA, 13 bp, D. melanogaster
gagacttcctcaa

SEQ ID NO: 621388 - DNA, 13 bp, D. melanogaster
gagacttggacga

SEQ ID NO: 621389 - DNA, 13 bp, D. melanogaster
gagactttcaaat

SEQ ID NO: 621390 - DNA, 13 bp, D. melanogaster
gagagaacgctat

SEQ ID NO: 621391 - DNA, 13 bp, D. melanogaster
gagagaagcaaca

SEQ ID NO: 621392 - DNA, 14 bp, D. melanogaster
gagagacagacaga

SEQ ID NO: 621393 - DNA, 14 bp, D. melanogaster
gagagagagagatt

SEQ ID NO: 621394 - DNA, 13 bp, D. melanogaster
gagagagagagcc

SEQ ID NO: 621395 - DNA, 14 bp, D. melanogaster
gagagagagagcta

SEQ ID NO: 621396 - DNA, 14 bp, D. melanogaster
gagagagagagtgt

SEQ ID NO: 621397 - DNA, 14 bp, D. melanogaster
gagagagagatggc

SEQ ID NO: 621398 - DNA, 13 bp, D. melanogaster
gagagagagcaac

SEQ ID NO: 621399 - DNA, 13 bp, D. melanogaster
gagagagagcagc

SEQ ID NO: 621400 - DNA, 14 bp, D. melanogaster
gagagagagcagct

SEQ ID NO: 621401 - DNA, 14 bp, D. melanogaster
gagagagagcgagc

SEQ ID NO: 621402 - DNA, 13 bp, D. melanogaster
gagagagagcgcg

SEQ ID NO: 621403 - DNA, 14 bp, D. melanogaster
gagagagagcgcga

SEQ ID NO: 621404 - DNA, 13 bp, D. melanogaster
gagagagagcggc

SEQ ID NO: 621405 - DNA, 14 bp, D. melanogaster
gagagagagcttat

SEQ ID NO: 621406 - DNA, 14 bp, D. melanogaster
gagagagagtgagt

SEQ ID NO: 621407 - DNA, 13 bp, D. melanogaster
gagagagagtgtg

SEQ ID NO: 621408 - DNA, 13 bp, D. melanogaster
gagagagcagcag

SEQ ID NO: 621409 - DNA, 14 bp, D. melanogaster
gagagagcaggcag

SEQ ID NO: 621410 - DNA, 13 bp, D. melanogaster
gagagagtgagtg

SEQ ID NO: 621411 - DNA, 13 bp, D. melanogaster
gagagagtgtgtg

SEQ ID NO: 621412 - DNA, 13 bp, D. melanogaster
gagagagttgctc

SEQ ID NO: 621413 - DNA, 13 bp, D. melanogaster
gagagatggccat

SEQ ID NO: 621414 - DNA, 13 bp, D. melanogaster
gagagcaaataaa

SEQ ID NO: 621415 - DNA, 14 bp, D. melanogaster
gagagcaacaacaa

SEQ ID NO: 621416 - DNA, 13 bp, D. melanogaster
gagagcaagaacg

SEQ ID NO: 621417 - DNA, 13 bp, D. melanogaster
gagagcaagttca

SEQ ID NO: 621418 - DNA, 13 bp, D. melanogaster
gagagcacacaca

SEQ ID NO: 621419 - DNA, 13 bp, D. melanogaster
gagagcagcaaca

SEQ ID NO: 621420 - DNA, 13 bp, D. melanogaster
gagagcataagaa

SEQ ID NO: 621421 - DNA, 13 bp, D. melanogaster
gagagcatacgtt

SEQ ID NO: 621422 - DNA, 13 bp, D. melanogaster
gagagcattgctc

SEQ ID NO: 621423 - DNA, 13 bp, D. melanogaster
gagagccaaaaga

SEQ ID NO: 621424 - DNA, 13 bp, D. melanogaster
gagagccaaagag

SEQ ID NO: 621425 - DNA, 13 bp, D. melanogaster
gagagcctggagc

SEQ ID NO: 621426 - DNA, 13 bp, D. melanogaster
gagagcgaagagc

SEQ ID NO: 621427 - DNA, 13 bp, D. melanogaster
gagagcgacagag

SEQ ID NO: 621428 - DNA, 14 bp, D. melanogaster
gagagcgacagaga

SEQ ID NO: 621429 - DNA, 13 bp, D. melanogaster
gagagcgagatag

SEQ ID NO: 621430 - DNA, 14 bp, D. melanogaster
gagagcgagcgaga

SEQ ID NO: 621431 - DNA, 13 bp, D. melanogaster
gagagcgagcgcg

SEQ ID NO: 621432 - DNA, 13 bp, D. melanogaster
gagagcgataaat

SEQ ID NO: 621433 - DNA, 13 bp, D. melanogaster
gagagcgcaaaaa

SEQ ID NO: 621434 - DNA, 13 bp, D. melanogaster
gagagcgcctaat

SEQ ID NO: 621435 - DNA, 13 bp, D. melanogaster
gagagcgcgagag

SEQ ID NO: 621436 - DNA, 13 bp, D. melanogaster
gagagcgcggcag

SEQ ID NO: 621437 - DNA, 13 bp, D. melanogaster
gagagctggagag

SEQ ID NO: 621438 - DNA, 13 bp, D. melanogaster
gagaggtttggtt

SEQ ID NO: 621439 - DNA, 13 bp, D. melanogaster
gagagtaaggaat

SEQ ID NO: 621440 - DNA, 13 bp, D. melanogaster
gagagtggaaaac

SEQ ID NO: 621441 - DNA, 13 bp, D. melanogaster
gagagtgtgtgtt

SEQ ID NO: 621442 - DNA, 13 bp, D. melanogaster
gagagttggccaa

SEQ ID NO: 621443 - DNA, 14 bp, D. melanogaster
gagagttggccaag

SEQ ID NO: 621444 - DNA, 13 bp, D. melanogaster
gagataaagtgcc

SEQ ID NO: 621445 - DNA, 13 bp, D. melanogaster
gagatacaaatac

SEQ ID NO: 621446 - DNA, 14 bp, D. melanogaster
gagatacagataca

SEQ ID NO: 621447 - DNA, 13 bp, D. melanogaster
gagatacatacat

SEQ ID NO: 621448 - DNA, 13 bp, D. melanogaster
gagatagaaaacc

SEQ ID NO: 621449 - DNA, 13 bp, D. melanogaster
gagatagagatag

SEQ ID NO: 621450 - DNA, 13 bp, D. melanogaster
gagatagagatgg

SEQ ID NO: 621451 - DNA, 14 bp, D. melanogaster
gagatagatagaga

SEQ ID NO: 621452 - DNA, 13 bp, D. melanogaster
gagatagatagat

SEQ ID NO: 621453 - DNA, 13 bp, D. melanogaster
gagatatataaat

SEQ ID NO: 621454 - DNA, 13 bp, D. melanogaster
gagatatccgtgg

SEQ ID NO: 621455 - DNA, 13 bp, D. melanogaster
gagatatctgcac

SEQ ID NO: 621456 - DNA, 13 bp, D. melanogaster
gagatatgaattt

SEQ ID NO: 621457 - DNA, 13 bp, D. melanogaster
gagatatggccaa

SEQ ID NO: 621458 - DNA, 13 bp, D. melanogaster
gagatatgtatgt

SEQ ID NO: 621459 - DNA, 14 bp, D. melanogaster
gagatatgtatgta

SEQ ID NO: 621460 - DNA, 13 bp, D. melanogaster
gagatattcgaca

SEQ ID NO: 621461 - DNA, 13 bp, D. melanogaster
gagatcaagaaac

SEQ ID NO: 621462 - DNA, 13 bp, D. melanogaster
gagatcagtcagt

SEQ ID NO: 621463 - DNA, 13 bp, D. melanogaster
gagatccggcaga

SEQ ID NO: 621464 - DNA, 13 bp, D. melanogaster
gagatcggagatc

SEQ ID NO: 621465 - DNA, 13 bp, D. melanogaster
gagatcggtgagg

SEQ ID NO: 621466 - DNA, 13 bp, D. melanogaster
gagatctcaggaa

SEQ ID NO: 621467 - DNA, 14 bp, D. melanogaster
gagatctcgacgtt

SEQ ID NO: 621468 - DNA, 13 bp, D. melanogaster
gagatctcgggaa

SEQ ID NO: 621469 - DNA, 13 bp, D. melanogaster
gagatgaagatgg

SEQ ID NO: 621470 - DNA, 13 bp, D. melanogaster
gagatgatcacct

SEQ ID NO: 621471 - DNA, 14 bp, D. melanogaster
gagatgatgatgat

SEQ ID NO: 621472 - DNA, 14 bp, D. melanogaster
gagatgcagatgca

SEQ ID NO: 621473 - DNA, 13 bp, D. melanogaster
gagatggaaagca

SEQ ID NO: 621474 - DNA, 14 bp, D. melanogaster
gagatggaaatgga

SEQ ID NO: 621475 - DNA, 13 bp, D. melanogaster
gagatggagatgc

SEQ ID NO: 621476 - DNA, 13 bp, D. melanogaster
gagatggagatgg

SEQ ID NO: 621477 - DNA, 14 bp, D. melanogaster
gagatggagatggc

SEQ ID NO: 621478 - DNA, 13 bp, D. melanogaster
gagatggataaaa

SEQ ID NO: 621479 - DNA, 14 bp, D. melanogaster
gagatggataaaat

SEQ ID NO: 621480 - DNA, 13 bp, D. melanogaster
gagatggatggat

SEQ ID NO: 621481 - DNA, 13 bp, D. melanogaster
gagatggccaaaa

SEQ ID NO: 621482 - DNA, 13 bp, D. melanogaster
gagatggccaaca

SEQ ID NO: 621483 - DNA, 13 bp, D. melanogaster
gagatggccatta

SEQ ID NO: 621484 - DNA, 13 bp, D. melanogaster
gagatggcgatag

SEQ ID NO: 621485 - DNA, 13 bp, D. melanogaster
gagatggcgatgg

SEQ ID NO: 621486 - DNA, 13 bp, D. melanogaster
gagatgggaatgg

SEQ ID NO: 621487 - DNA, 13 bp, D. melanogaster
gagatgggcaaac

SEQ ID NO: 621488 - DNA, 13 bp, D. melanogaster
gagatggtgatgg

SEQ ID NO: 621489 - DNA, 13 bp, D. melanogaster
gagatgtttgaaa

SEQ ID NO: 621490 - DNA, 13 bp, D. melanogaster
gagattgagattg

SEQ ID NO: 621491 - DNA, 13 bp, D. melanogaster
gagattgccgcaa

SEQ ID NO: 621492 - DNA, 14 bp, D. melanogaster
gagattggaaagcg

SEQ ID NO: 621493 - DNA, 13 bp, D. melanogaster
gagattgtcttgg

SEQ ID NO: 621494 - DNA, 13 bp, D. melanogaster
gagatttgtggag

SEQ ID NO: 621495 - DNA, 13 bp, D. melanogaster
gagattttaaata

SEQ ID NO: 621496 - DNA, 13 bp, D. melanogaster
gagcaaaaatatt

SEQ ID NO: 621497 - DNA, 13 bp, D. melanogaster
gagcaaaaggagc

SEQ ID NO: 621498 - DNA, 13 bp, D. melanogaster
gagcaaaataaat

SEQ ID NO: 621499 - DNA, 14 bp, D. melanogaster
gagcaaaatatttc

SEQ ID NO: 621500 - DNA, 13 bp, D. melanogaster
gagcaaaatcaaa

SEQ ID NO: 621501 - DNA, 13 bp, D. melanogaster
gagcaaacaaaat

SEQ ID NO: 621502 - DNA, 13 bp, D. melanogaster
gagcaaacaaacg

SEQ ID NO: 621503 - DNA, 13 bp, D. melanogaster
gagcaaacaatag

SEQ ID NO: 621504 - DNA, 13 bp, D. melanogaster
gagcaaacaattt

SEQ ID NO: 621505 - DNA, 13 bp, D. melanogaster
gagcaaacatttg

SEQ ID NO: 621506 - DNA, 13 bp, D. melanogaster
gagcaaagacatg

SEQ ID NO: 621507 - DNA, 14 bp, D. melanogaster
gagcaaagactacg

SEQ ID NO: 621508 - DNA, 13 bp, D. melanogaster
gagcaaagcaaac

SEQ ID NO: 621509 - DNA, 13 bp, D. melanogaster
gagcaaaggctca

SEQ ID NO: 621510 - DNA, 13 bp, D. melanogaster
gagcaaagggatc

SEQ ID NO: 621511 - DNA, 13 bp, D. melanogaster
gagcaaagtattt

SEQ ID NO: 621512 - DNA, 13 bp, D. melanogaster
gagcaaagtgaaa

SEQ ID NO: 621513 - DNA, 13 bp, D. melanogaster
gagcaaagtgcaa

SEQ ID NO: 621514 - DNA, 13 bp, D. melanogaster
gagcaaatgaaaa

SEQ ID NO: 621515 - DNA, 13 bp, D. melanogaster
gagcaaattaaat

SEQ ID NO: 621516 - DNA, 13 bp, D. melanogaster
gagcaaattgaaa

SEQ ID NO: 621517 - DNA, 13 bp, D. melanogaster
gagcaacaaaagc

SEQ ID NO: 621518 - DNA, 14 bp, D. melanogaster
gagcaacaataaca

SEQ ID NO: 621519 - DNA, 13 bp, D. melanogaster
gagcaacagcaaa

SEQ ID NO: 621520 - DNA, 13 bp, D. melanogaster
gagcaacagcaac

SEQ ID NO: 621521 - DNA, 13 bp, D. melanogaster
gagcaacagcaat

SEQ ID NO: 621522 - DNA, 13 bp, D. melanogaster
gagcaacgggtat

SEQ ID NO: 621523 - DNA, 13 bp, D. melanogaster
gagcaacgtttta

SEQ ID NO: 621524 - DNA, 13 bp, D. melanogaster
gagcaactacata

SEQ ID NO: 621525 - DNA, 13 bp, D. melanogaster
gagcaactgcaac

SEQ ID NO: 621526 - DNA, 13 bp, D. melanogaster
gagcaactgcatc

SEQ ID NO: 621527 - DNA, 13 bp, D. melanogaster
gagcaacttaatc

SEQ ID NO: 621528 - DNA, 14 bp, D. melanogaster
gagcaagaaaagcg

SEQ ID NO: 621529 - DNA, 13 bp, D. melanogaster
gagcaagtgcagc

SEQ ID NO: 621530 - DNA, 14 bp, D. melanogaster
gagcaagttcagaa

SEQ ID NO: 621531 - DNA, 13 bp, D. melanogaster
gagcaataaatta

SEQ ID NO: 621532 - DNA, 13 bp, D. melanogaster
gagcaataaattt

SEQ ID NO: 621533 - DNA, 14 bp, D. melanogaster
gagcaatatcagca

SEQ ID NO: 621534 - DNA, 13 bp, D. melanogaster
gagcaatccgatc

SEQ ID NO: 621535 - DNA, 13 bp, D. melanogaster
gagcaatgaaaat

SEQ ID NO: 621536 - DNA, 13 bp, D. melanogaster
gagcaatgctctc

SEQ ID NO: 621537 - DNA, 13 bp, D. melanogaster
gagcaattaaaaa

SEQ ID NO: 621538 - DNA, 14 bp, D. melanogaster
gagcaattagaaga

SEQ ID NO: 621539 - DNA, 13 bp, D. melanogaster
gagcaattttctg

SEQ ID NO: 621540 - DNA, 13 bp, D. melanogaster
gagcaatttttat

SEQ ID NO: 621541 - DNA, 13 bp, D. melanogaster
gagcacaacaaca

SEQ ID NO: 621542 - DNA, 13 bp, D. melanogaster
gagcacaataaat

SEQ ID NO: 621543 - DNA, 13 bp, D. melanogaster
gagcacaatcaaa

SEQ ID NO: 621544 - DNA, 14 bp, D. melanogaster
gagcacaatcaaag

SEQ ID NO: 621545 - DNA, 13 bp, D. melanogaster
gagcacacacaaa

SEQ ID NO: 621546 - DNA, 13 bp, D. melanogaster
gagcacacacaca

SEQ ID NO: 621547 - DNA, 14 bp, D. melanogaster
gagcacacacacac

SEQ ID NO: 621548 - DNA, 13 bp, D. melanogaster
gagcacagcagta

SEQ ID NO: 621549 - DNA, 13 bp, D. melanogaster
gagcaccctcacc

SEQ ID NO: 621550 - DNA, 13 bp, D. melanogaster
gagcaccttcaca

SEQ ID NO: 621551 - DNA, 13 bp, D. melanogaster
gagcactgaaaaa

SEQ ID NO: 621552 - DNA, 13 bp, D. melanogaster
gagcactgagcac

SEQ ID NO: 621553 - DNA, 13 bp, D. melanogaster
gagcactgtgggg

SEQ ID NO: 621554 - DNA, 13 bp, D. melanogaster
gagcacttgttga

SEQ ID NO: 621555 - DNA, 13 bp, D. melanogaster
gagcactttaaca

SEQ ID NO: 621556 - DNA, 13 bp, D. melanogaster
gagcactttctgg

SEQ ID NO: 621557 - DNA, 13 bp, D. melanogaster
gagcagaaaataa

SEQ ID NO: 621558 - DNA, 13 bp, D. melanogaster
gagcagaaatgaa

SEQ ID NO: 621559 - DNA, 13 bp, D. melanogaster
gagcagaagcagg

SEQ ID NO: 621560 - DNA, 13 bp, D. melanogaster
gagcagaaggagc

SEQ ID NO: 621561 - DNA, 13 bp, D. melanogaster
gagcagaattcgc

SEQ ID NO: 621562 - DNA, 13 bp, D. melanogaster
gagcagagagcag

SEQ ID NO: 621563 - DNA, 13 bp, D. melanogaster
gagcagagcaaaa

SEQ ID NO: 621564 - DNA, 13 bp, D. melanogaster
gagcagagcagag

SEQ ID NO: 621565 - DNA, 14 bp, D. melanogaster
gagcagagcagagc

SEQ ID NO: 621566 - DNA, 13 bp, D. melanogaster
gagcagagcagca

SEQ ID NO: 621567 - DNA, 13 bp, D. melanogaster
gagcagagcggag

SEQ ID NO: 621568 - DNA, 14 bp, D. melanogaster
gagcagatatagta

SEQ ID NO: 621569 - DNA, 13 bp, D. melanogaster
gagcagatggagc

SEQ ID NO: 621570 - DNA, 13 bp, D. melanogaster
gagcagcaacaac

SEQ ID NO: 621571 - DNA, 14 bp, D. melanogaster
gagcagcaacaaca

SEQ ID NO: 621572 - DNA, 13 bp, D. melanogaster
gagcagcaacatg

SEQ ID NO: 621573 - DNA, 13 bp, D. melanogaster
gagcagcacaaaa

SEQ ID NO: 621574 - DNA, 13 bp, D. melanogaster
gagcagcagaagc

SEQ ID NO: 621575 - DNA, 13 bp, D. melanogaster
gagcagcagagca

SEQ ID NO: 621576 - DNA, 13 bp, D. melanogaster
gagcagcagcaaa

SEQ ID NO: 621577 - DNA, 14 bp, D. melanogaster
gagcagcagcaaca

SEQ ID NO: 621578 - DNA, 13 bp, D. melanogaster
gagcagcagcaga

SEQ ID NO: 621579 - DNA, 15 bp, D. melanogaster
gagcagcagcagcaa

SEQ ID NO: 621580 - DNA, 14 bp, D. melanogaster
gagcagcagcagcc

SEQ ID NO: 621581 - DNA, 13 bp, D. melanogaster
gagcagcagcagg

SEQ ID NO: 621582 - DNA, 14 bp, D. melanogaster
gagcagcagcagga

SEQ ID NO: 621583 - DNA, 13 bp, D. melanogaster
gagcagcagcagt

SEQ ID NO: 621584 - DNA, 13 bp, D. melanogaster
gagcagcagcatc

SEQ ID NO: 621585 - DNA, 13 bp, D. melanogaster
gagcagcagcggc

SEQ ID NO: 621586 - DNA, 13 bp, D. melanogaster
gagcagcagctgc

SEQ ID NO: 621587 - DNA, 13 bp, D. melanogaster
gagcagcaggaaa

SEQ ID NO: 621588 - DNA, 14 bp, D. melanogaster
gagcagcaggaaaa

SEQ ID NO: 621589 - DNA, 13 bp, D. melanogaster
gagcagcaggagc

SEQ ID NO: 621590 - DNA, 14 bp, D. melanogaster
gagcagcaggagca

SEQ ID NO: 621591 - DNA, 13 bp, D. melanogaster
gagcagccaaaaa

SEQ ID NO: 621592 - DNA, 13 bp, D. melanogaster
gagcagccagcaa

SEQ ID NO: 621593 - DNA, 13 bp, D. melanogaster
gagcagccagcag

SEQ ID NO: 621594 - DNA, 13 bp, D. melanogaster
gagcagccagcca

SEQ ID NO: 621595 - DNA, 13 bp, D. melanogaster
gagcagcctgttt

SEQ ID NO: 621596 - DNA, 13 bp, D. melanogaster
gagcagcgacaac

SEQ ID NO: 621597 - DNA, 13 bp, D. melanogaster
gagcagcggaaaa

SEQ ID NO: 621598 - DNA, 14 bp, D. melanogaster
gagcagcggcaaca

SEQ ID NO: 621599 - DNA, 13 bp, D. melanogaster
gagcagctaaaga

SEQ ID NO: 621600 - DNA, 15 bp, D. melanogaster
gagcagctaaagacg

SEQ ID NO: 621601 - DNA, 13 bp, D. melanogaster
gagcagctccatc

SEQ ID NO: 621602 - DNA, 13 bp, D. melanogaster
gagcagctgcagc

SEQ ID NO: 621603 - DNA, 13 bp, D. melanogaster
gagcagctgctgc

SEQ ID NO: 621604 - DNA, 13 bp, D. melanogaster
gagcagctttgtt

SEQ ID NO: 621605 - DNA, 14 bp, D. melanogaster
gagcaggaacagga

SEQ ID NO: 621606 - DNA, 13 bp, D. melanogaster
gagcaggagcaac

SEQ ID NO: 621607 - DNA, 14 bp, D. melanogaster
gagcaggagcagaa

SEQ ID NO: 621608 - DNA, 13 bp, D. melanogaster
gagcaggagcagt

SEQ ID NO: 621609 - DNA, 13 bp, D. melanogaster
gagcaggagctag

SEQ ID NO: 621610 - DNA, 14 bp, D. melanogaster
gagcaggagctagc

SEQ ID NO: 621611 - DNA, 13 bp, D. melanogaster
gagcaggcatttc

SEQ ID NO: 621612 - DNA, 13 bp, D. melanogaster
gagcaggccaccg

SEQ ID NO: 621613 - DNA, 13 bp, D. melanogaster
gagcagggaaaac

SEQ ID NO: 621614 - DNA, 13 bp, D. melanogaster
gagcagggagcag

SEQ ID NO: 621615 - DNA, 13 bp, D. melanogaster
gagcagggtgttc

SEQ ID NO: 621616 - DNA, 13 bp, D. melanogaster
gagcaggtgtctg

SEQ ID NO: 621617 - DNA, 13 bp, D. melanogaster
gagcagtaaatga

SEQ ID NO: 621618 - DNA, 13 bp, D. melanogaster
gagcagtgagcag

SEQ ID NO: 621619 - DNA, 13 bp, D. melanogaster
gagcagtgcatta

SEQ ID NO: 621620 - DNA, 13 bp, D. melanogaster
gagcagtgccaat

SEQ ID NO: 621621 - DNA, 13 bp, D. melanogaster
gagcagttcttgt

SEQ ID NO: 621622 - DNA, 13 bp, D. melanogaster
gagcataaaaaat

SEQ ID NO: 621623 - DNA, 13 bp, D. melanogaster
gagcataaattaa

SEQ ID NO: 621624 - DNA, 13 bp, D. melanogaster
gagcatacatata

SEQ ID NO: 621625 - DNA, 14 bp, D. melanogaster
gagcatattggcaa

SEQ ID NO: 621626 - DNA, 14 bp, D. melanogaster
gagcatcaggattt

SEQ ID NO: 621627 - DNA, 13 bp, D. melanogaster
gagcatcatcaac

SEQ ID NO: 621628 - DNA, 14 bp, D. melanogaster
gagcatcatcaaca

SEQ ID NO: 621629 - DNA, 13 bp, D. melanogaster
gagcatgtgtgcg

SEQ ID NO: 621630 - DNA, 13 bp, D. melanogaster
gagcatgtgtgtg

SEQ ID NO: 621631 - DNA, 13 bp, D. melanogaster
gagcatgttggca

SEQ ID NO: 621632 - DNA, 13 bp, D. melanogaster
gagcattaatcaa

SEQ ID NO: 621633 - DNA, 13 bp, D. melanogaster
gagcattcaaaaa

SEQ ID NO: 621634 - DNA, 13 bp, D. melanogaster
gagcattctgcga

SEQ ID NO: 621635 - DNA, 13 bp, D. melanogaster
gagcattgctctt

SEQ ID NO: 621636 - DNA, 13 bp, D. melanogaster
gagcattggtaag

SEQ ID NO: 621637 - DNA, 13 bp, D. melanogaster
gagcatttccttt

SEQ ID NO: 621638 - DNA, 13 bp, D. melanogaster
gagcattttgttt

SEQ ID NO: 621639 - DNA, 13 bp, D. melanogaster
gagcatttttaaa

SEQ ID NO: 621640 - DNA, 13 bp, D. melanogaster
gagcatttttatg

SEQ ID NO: 621641 - DNA, 14 bp, D. melanogaster
gagcattttttatt

SEQ ID NO: 621642 - DNA, 13 bp, D. melanogaster
gagccaaaaagga

SEQ ID NO: 621643 - DNA, 13 bp, D. melanogaster
gagccaaaagagc

SEQ ID NO: 621644 - DNA, 14 bp, D. melanogaster
gagccaaagccaaa

SEQ ID NO: 621645 - DNA, 13 bp, D. melanogaster
gagccaaaggagc

SEQ ID NO: 621646 - DNA, 13 bp, D. melanogaster
gagccaacaacaa

SEQ ID NO: 621647 - DNA, 13 bp, D. melanogaster
gagccaaggcaaa

SEQ ID NO: 621648 - DNA, 13 bp, D. melanogaster
gagccaatgattt

SEQ ID NO: 621649 - DNA, 13 bp, D. melanogaster
gagccacaacaac

SEQ ID NO: 621650 - DNA, 13 bp, D. melanogaster
gagccaccgaaaa

SEQ ID NO: 621651 - DNA, 13 bp, D. melanogaster
gagccacgcccac

SEQ ID NO: 621652 - DNA, 13 bp, D. melanogaster
gagccacggccaa

SEQ ID NO: 621653 - DNA, 14 bp, D. melanogaster
gagccacggcgaaa

SEQ ID NO: 621654 - DNA, 13 bp, D. melanogaster
gagccactatcaa

SEQ ID NO: 621655 - DNA, 13 bp, D. melanogaster
gagccactgcagc

SEQ ID NO: 621656 - DNA, 14 bp, D. melanogaster
gagccagagccaga

SEQ ID NO: 621657 - DNA, 13 bp, D. melanogaster
gagccaggagcag

SEQ ID NO: 621658 - DNA, 14 bp, D. melanogaster
gagccaggagccag

SEQ ID NO: 621659 - DNA, 13 bp, D. melanogaster
gagccagtttgtt

SEQ ID NO: 621660 - DNA, 14 bp, D. melanogaster
gagccatttcaaat

SEQ ID NO: 621661 - DNA, 13 bp, D. melanogaster
gagccatttttga

SEQ ID NO: 621662 - DNA, 13 bp, D. melanogaster
gagcccaaaattg

SEQ ID NO: 621663 - DNA, 13 bp, D. melanogaster
gagcccagggtgc

SEQ ID NO: 621664 - DNA, 13 bp, D. melanogaster
gagcccccaaaaa

SEQ ID NO: 621665 - DNA, 13 bp, D. melanogaster
gagccgaaagaga

SEQ ID NO: 621666 - DNA, 13 bp, D. melanogaster
gagccgaagcagg

SEQ ID NO: 621667 - DNA, 13 bp, D. melanogaster
gagccgagcagta

SEQ ID NO: 621668 - DNA, 13 bp, D. melanogaster
gagccgagctgag

SEQ ID NO: 621669 - DNA, 13 bp, D. melanogaster
gagccgatcaggt

SEQ ID NO: 621670 - DNA, 13 bp, D. melanogaster
gagccgcacaaac

SEQ ID NO: 621671 - DNA, 14 bp, D. melanogaster
gagccgcacaaacg

SEQ ID NO: 621672 - DNA, 13 bp, D. melanogaster
gagccggatttaa

SEQ ID NO: 621673 - DNA, 13 bp, D. melanogaster
gagccgtttgtta

SEQ ID NO: 621674 - DNA, 13 bp, D. melanogaster
gagccttttgtga

SEQ ID NO: 621675 - DNA, 14 bp, D. melanogaster
gagcgaaaagcgaa

SEQ ID NO: 621676 - DNA, 13 bp, D. melanogaster
gagcgaaaattgc

SEQ ID NO: 621677 - DNA, 14 bp, D. melanogaster
gagcgaaagagatg

SEQ ID NO: 621678 - DNA, 13 bp, D. melanogaster
gagcgaaataaat

SEQ ID NO: 621679 - DNA, 13 bp, D. melanogaster
gagcgaaatgcca

SEQ ID NO: 621680 - DNA, 13 bp, D. melanogaster
gagcgacagagac

SEQ ID NO: 621681 - DNA, 13 bp, D. melanogaster
gagcgacatcggg

SEQ ID NO: 621682 - DNA, 13 bp, D. melanogaster
gagcgactgagta

SEQ ID NO: 621683 - DNA, 14 bp, D. melanogaster
gagcgagacagaga

SEQ ID NO: 621684 - DNA, 13 bp, D. melanogaster
gagcgagacagca

SEQ ID NO: 621685 - DNA, 13 bp, D. melanogaster
gagcgagacggag

SEQ ID NO: 621686 - DNA, 13 bp, D. melanogaster
gagcgagagagca

SEQ ID NO: 621687 - DNA, 14 bp, D. melanogaster
gagcgagagagcag

SEQ ID NO: 621688 - DNA, 13 bp, D. melanogaster
gagcgagagagcg

SEQ ID NO: 621689 - DNA, 14 bp, D. melanogaster
gagcgagagagcga

SEQ ID NO: 621690 - DNA, 14 bp, D. melanogaster
gagcgagagagcgc

SEQ ID NO: 621691 - DNA, 14 bp, D. melanogaster
gagcgagagcgaga

SEQ ID NO: 621692 - DNA, 13 bp, D. melanogaster
gagcgagaggcag

SEQ ID NO: 621693 - DNA, 13 bp, D. melanogaster
gagcgagatagag

SEQ ID NO: 621694 - DNA, 14 bp, D. melanogaster
gagcgagatagcaa

SEQ ID NO: 621695 - DNA, 13 bp, D. melanogaster
gagcgagatggag

SEQ ID NO: 621696 - DNA, 13 bp, D. melanogaster
gagcgagatggcg

SEQ ID NO: 621697 - DNA, 13 bp, D. melanogaster
gagcgagcgaaag

SEQ ID NO: 621698 - DNA, 13 bp, D. melanogaster
gagcgagcgagag

SEQ ID NO: 621699 - DNA, 14 bp, D. melanogaster
gagcgagcgagagc

SEQ ID NO: 621700 - DNA, 14 bp, D. melanogaster
gagcgagcgagatg

SEQ ID NO: 621701 - DNA, 14 bp, D. melanogaster
gagcgagcgagcga

SEQ ID NO: 621702 - DNA, 13 bp, D. melanogaster
gagcgaggcatgt

SEQ ID NO: 621703 - DNA, 13 bp, D. melanogaster
gagcgagtgaaaa

SEQ ID NO: 621704 - DNA, 13 bp, D. melanogaster
gagcgagtgtgtg

SEQ ID NO: 621705 - DNA, 13 bp, D. melanogaster
gagcgcaaaaatg

SEQ ID NO: 621706 - DNA, 13 bp, D. melanogaster
gagcgcaaaagtt

SEQ ID NO: 621707 - DNA, 13 bp, D. melanogaster
gagcgctacagcg

SEQ ID NO: 621708 - DNA, 13 bp, D. melanogaster
gagcggaaaatgg

SEQ ID NO: 621709 - DNA, 13 bp, D. melanogaster
gagcggaactttt

SEQ ID NO: 621710 - DNA, 13 bp, D. melanogaster
gagcggagagcgc

SEQ ID NO: 621711 - DNA, 13 bp, D. melanogaster
gagcggagcagag

SEQ ID NO: 621712 - DNA, 14 bp, D. melanogaster
gagcggagcggagc

SEQ ID NO: 621713 - DNA, 13 bp, D. melanogaster
gagcggaggacag

SEQ ID NO: 621714 - DNA, 13 bp, D. melanogaster
gagcggcaaaaaa

SEQ ID NO: 621715 - DNA, 13 bp, D. melanogaster
gagcggcaaacaa

SEQ ID NO: 621716 - DNA, 14 bp, D. melanogaster
gagcggcaaatgtg

SEQ ID NO: 621717 - DNA, 13 bp, D. melanogaster
gagcggcaacaac

SEQ ID NO: 621718 - DNA, 13 bp, D. melanogaster
gagcggcagagag

SEQ ID NO: 621719 - DNA, 13 bp, D. melanogaster
gagcggcagcagc

SEQ ID NO: 621720 - DNA, 13 bp, D. melanogaster
gagcggcgaaaaa

SEQ ID NO: 621721 - DNA, 13 bp, D. melanogaster
gagcggcgaggac

SEQ ID NO: 621722 - DNA, 13 bp, D. melanogaster
gagcgggaaaatg

SEQ ID NO: 621723 - DNA, 13 bp, D. melanogaster
gagcgggacagag

SEQ ID NO: 621724 - DNA, 13 bp, D. melanogaster
gagcgggagagca

SEQ ID NO: 621725 - DNA, 14 bp, D. melanogaster
gagcgtatgcaaat

SEQ ID NO: 621726 - DNA, 13 bp, D. melanogaster
gagcgtgtgtgcg

SEQ ID NO: 621727 - DNA, 13 bp, D. melanogaster
gagcgttgcgttt

SEQ ID NO: 621728 - DNA, 13 bp, D. melanogaster
gagcgttggccag

SEQ ID NO: 621729 - DNA, 14 bp, D. melanogaster
gagcgttttttttt

SEQ ID NO: 621730 - DNA, 13 bp, D. melanogaster
gagctaaacaaaa

SEQ ID NO: 621731 - DNA, 13 bp, D. melanogaster
gagctacaacaat

SEQ ID NO: 621732 - DNA, 13 bp, D. melanogaster
gagctacgtggaa

SEQ ID NO: 621733 - DNA, 13 bp, D. melanogaster
gagctcacagaaa

SEQ ID NO: 621734 - DNA, 13 bp, D. melanogaster
gagctcatgaaaa

SEQ ID NO: 621735 - DNA, 13 bp, D. melanogaster
gagctccagctcc

SEQ ID NO: 621736 - DNA, 13 bp, D. melanogaster
gagctctccaaag

SEQ ID NO: 621737 - DNA, 13 bp, D. melanogaster
gagctctggaatc

SEQ ID NO: 621738 - DNA, 13 bp, D. melanogaster
gagctgaaaataa

SEQ ID NO: 621739 - DNA, 13 bp, D. melanogaster
gagctgaggaaaa

SEQ ID NO: 621740 - DNA, 13 bp, D. melanogaster
gagctgagttgag

SEQ ID NO: 621741 - DNA, 13 bp, D. melanogaster
gagctgcaaaaaa

SEQ ID NO: 621742 - DNA, 13 bp, D. melanogaster
gagctgcaaaaag

SEQ ID NO: 621743 - DNA, 13 bp, D. melanogaster
gagctgcaaagtg

SEQ ID NO: 621744 - DNA, 14 bp, D. melanogaster
gagctgcaaagtgc

SEQ ID NO: 621745 - DNA, 13 bp, D. melanogaster
gagctgcaaccag

SEQ ID NO: 621746 - DNA, 14 bp, D. melanogaster
gagctgcacacagc

SEQ ID NO: 621747 - DNA, 13 bp, D. melanogaster
gagctgcacgtgt

SEQ ID NO: 621748 - DNA, 13 bp, D. melanogaster
gagctgcagcagc

SEQ ID NO: 621749 - DNA, 13 bp, D. melanogaster
gagctgccaaaaa

SEQ ID NO: 621750 - DNA, 13 bp, D. melanogaster
gagctgcgagctg

SEQ ID NO: 621751 - DNA, 13 bp, D. melanogaster
gagctgctaagtg

SEQ ID NO: 621752 - DNA, 13 bp, D. melanogaster
gagctgctgccgc

SEQ ID NO: 621753 - DNA, 13 bp, D. melanogaster
gagctgctgctcc

SEQ ID NO: 621754 - DNA, 13 bp, D. melanogaster
gagctggaaaagc

SEQ ID NO: 621755 - DNA, 13 bp, D. melanogaster
gagctggagatgg

SEQ ID NO: 621756 - DNA, 13 bp, D. melanogaster
gagctggagcagc

SEQ ID NO: 621757 - DNA, 14 bp, D. melanogaster
gagctggagctgaa

SEQ ID NO: 621758 - DNA, 13 bp, D. melanogaster
gagctggaggagc

SEQ ID NO: 621759 - DNA, 13 bp, D. melanogaster
gagctggagttgg

SEQ ID NO: 621760 - DNA, 13 bp, D. melanogaster
gagctggccaaaa

SEQ ID NO: 621761 - DNA, 13 bp, D. melanogaster
gagctggccaaga

SEQ ID NO: 621762 - DNA, 13 bp, D. melanogaster
gagctggcctttc

SEQ ID NO: 621763 - DNA, 13 bp, D. melanogaster
gagctgggaaaaa

SEQ ID NO: 621764 - DNA, 13 bp, D. melanogaster
gagctgggagctg

SEQ ID NO: 621765 - DNA, 13 bp, D. melanogaster
gagctgtcctatc

SEQ ID NO: 621766 - DNA, 13 bp, D. melanogaster
gagctgtggaaaa

SEQ ID NO: 621767 - DNA, 13 bp, D. melanogaster
gagcttcgtcatt

SEQ ID NO: 621768 - DNA, 13 bp, D. melanogaster
gagcttctctcac

SEQ ID NO: 621769 - DNA, 13 bp, D. melanogaster
gagcttggagctt

SEQ ID NO: 621770 - DNA, 13 bp, D. melanogaster
gagctttccttgg

SEQ ID NO: 621771 - DNA, 13 bp, D. melanogaster
gagcttttccttt

SEQ ID NO: 621772 - DNA, 13 bp, D. melanogaster
gaggaaaaacaat

SEQ ID NO: 621773 - DNA, 13 bp, D. melanogaster
gaggaaaactgaa

SEQ ID NO: 621774 - DNA, 13 bp, D. melanogaster
gaggaaaagcagc

SEQ ID NO: 621775 - DNA, 13 bp, D. melanogaster
gaggaaaatcaaa

SEQ ID NO: 621776 - DNA, 13 bp, D. melanogaster
gaggaaaatccaa

SEQ ID NO: 621777 - DNA, 13 bp, D. melanogaster
gaggaaaatcgca

SEQ ID NO: 621778 - DNA, 13 bp, D. melanogaster
gaggaaagccaaa

SEQ ID NO: 621779 - DNA, 14 bp, D. melanogaster
gaggaaatacatac

SEQ ID NO: 621780 - DNA, 13 bp, D. melanogaster
gaggaaatgctgc

SEQ ID NO: 621781 - DNA, 13 bp, D. melanogaster
gaggaaattaaat

SEQ ID NO: 621782 - DNA, 14 bp, D. melanogaster
gaggaactgcaaaa

SEQ ID NO: 621783 - DNA, 13 bp, D. melanogaster
gaggaagttgaag

SEQ ID NO: 621784 - DNA, 13 bp, D. melanogaster
gaggaattttatt

SEQ ID NO: 621785 - DNA, 13 bp, D. melanogaster
gaggacacactct

SEQ ID NO: 621786 - DNA, 13 bp, D. melanogaster
gaggacactatcg

SEQ ID NO: 621787 - DNA, 13 bp, D. melanogaster
gaggacgaaggac

SEQ ID NO: 621788 - DNA, 13 bp, D. melanogaster
gaggacgaggatg

SEQ ID NO: 621789 - DNA, 13 bp, D. melanogaster
gaggacgaggtgg

SEQ ID NO: 621790 - DNA, 14 bp, D. melanogaster
gaggacgaggtggt

SEQ ID NO: 621791 - DNA, 13 bp, D. melanogaster
gaggagaaaaact

SEQ ID NO: 621792 - DNA, 14 bp, D. melanogaster
gaggagaagagttt

SEQ ID NO: 621793 - DNA, 13 bp, D. melanogaster
gaggagaagcctc

SEQ ID NO: 621794 - DNA, 13 bp, D. melanogaster
gaggagacaccaa

SEQ ID NO: 621795 - DNA, 13 bp, D. melanogaster
gaggagcaacagc

SEQ ID NO: 621796 - DNA, 13 bp, D. melanogaster
gaggagcagcagc

SEQ ID NO: 621797 - DNA, 14 bp, D. melanogaster
gaggagcagcagca

SEQ ID NO: 621798 - DNA, 14 bp, D. melanogaster
gaggagcattccat

SEQ ID NO: 621799 - DNA, 13 bp, D. melanogaster
gaggagccgcaca

SEQ ID NO: 621800 - DNA, 13 bp, D. melanogaster
gaggagctgctgc

SEQ ID NO: 621801 - DNA, 13 bp, D. melanogaster
gaggagctggagg

SEQ ID NO: 621802 - DNA, 13 bp, D. melanogaster
gaggaggagcagc

SEQ ID NO: 621803 - DNA, 13 bp, D. melanogaster
gaggaggagctgc

SEQ ID NO: 621804 - DNA, 13 bp, D. melanogaster
gaggagttaacac

SEQ ID NO: 621805 - DNA, 13 bp, D. melanogaster
gaggatacggaaa

SEQ ID NO: 621806 - DNA, 14 bp, D. melanogaster
gaggatgaggacga

SEQ ID NO: 621807 - DNA, 13 bp, D. melanogaster
gaggattacgggc

SEQ ID NO: 621808 - DNA, 13 bp, D. melanogaster
gaggcaaagaagc

SEQ ID NO: 621809 - DNA, 13 bp, D. melanogaster
gaggcaaagcaaa

SEQ ID NO: 621810 - DNA, 13 bp, D. melanogaster
gaggcaaataaaa

SEQ ID NO: 621811 - DNA, 13 bp, D. melanogaster
gaggcaaatcaaa

SEQ ID NO: 621812 - DNA, 13 bp, D. melanogaster
gaggcaacgctcg

SEQ ID NO: 621813 - DNA, 13 bp, D. melanogaster
gaggcaataaaaa

SEQ ID NO: 621814 - DNA, 13 bp, D. melanogaster
gaggcaattaaaa

SEQ ID NO: 621815 - DNA, 13 bp, D. melanogaster
gaggcacacgagt

SEQ ID NO: 621816 - DNA, 13 bp, D. melanogaster
gaggcacttaaaa

SEQ ID NO: 621817 - DNA, 13 bp, D. melanogaster
gaggcacttttgc

SEQ ID NO: 621818 - DNA, 13 bp, D. melanogaster
gaggcagaaataa

SEQ ID NO: 621819 - DNA, 13 bp, D. melanogaster
gaggcagaagcag

SEQ ID NO: 621820 - DNA, 14 bp, D. melanogaster
gaggcagaggtggt

SEQ ID NO: 621821 - DNA, 13 bp, D. melanogaster
gaggcagatcgca

SEQ ID NO: 621822 - DNA, 13 bp, D. melanogaster
gaggcagcagcag

SEQ ID NO: 621823 - DNA, 14 bp, D. melanogaster
gaggcagcagcagc

SEQ ID NO: 621824 - DNA, 13 bp, D. melanogaster
gaggcagccaagc

SEQ ID NO: 621825 - DNA, 13 bp, D. melanogaster
gaggcagcgactg

SEQ ID NO: 621826 - DNA, 13 bp, D. melanogaster
gaggcagcggcag

SEQ ID NO: 621827 - DNA, 13 bp, D. melanogaster
gaggcagctaagc

SEQ ID NO: 621828 - DNA, 13 bp, D. melanogaster
gaggcaggagcct

SEQ ID NO: 621829 - DNA, 13 bp, D. melanogaster
gaggcaggccgcc

SEQ ID NO: 621830 - DNA, 13 bp, D. melanogaster
gaggcagtcatta

SEQ ID NO: 621831 - DNA, 13 bp, D. melanogaster
gaggcagtggcag

SEQ ID NO: 621832 - DNA, 13 bp, D. melanogaster
gaggccaaaagga

SEQ ID NO: 621833 - DNA, 13 bp, D. melanogaster
gaggccaacaaaa

SEQ ID NO: 621834 - DNA, 13 bp, D. melanogaster
gaggcccaaaaat

SEQ ID NO: 621835 - DNA, 13 bp, D. melanogaster
gaggcgaaacaaa

SEQ ID NO: 621836 - DNA, 13 bp, D. melanogaster
gaggcggaatgcg

SEQ ID NO: 621837 - DNA, 13 bp, D. melanogaster
gaggcggcactcg

SEQ ID NO: 621838 - DNA, 13 bp, D. melanogaster
gaggcggtctctt

SEQ ID NO: 621839 - DNA, 13 bp, D. melanogaster
gaggcggtggaca

SEQ ID NO: 621840 - DNA, 13 bp, D. melanogaster
gaggctcaacatc

SEQ ID NO: 621841 - DNA, 13 bp, D. melanogaster
gaggctccactgt

SEQ ID NO: 621842 - DNA, 13 bp, D. melanogaster
gaggctcctttga

SEQ ID NO: 621843 - DNA, 13 bp, D. melanogaster
gaggctgaatctc

SEQ ID NO: 621844 - DNA, 13 bp, D. melanogaster
gaggctgctactg

SEQ ID NO: 621845 - DNA, 13 bp, D. melanogaster
gagggaaaacatt

SEQ ID NO: 621846 - DNA, 15 bp, D. melanogaster
gagggaaccaaggct

SEQ ID NO: 621847 - DNA, 13 bp, D. melanogaster
gagggatgggcat

SEQ ID NO: 621848 - DNA, 13 bp, D. melanogaster
gagggatttggtc

SEQ ID NO: 621849 - DNA, 13 bp, D. melanogaster
gagggcagtcaaa

SEQ ID NO: 621850 - DNA, 13 bp, D. melanogaster
gagggcgtggcag

SEQ ID NO: 621851 - DNA, 13 bp, D. melanogaster
gagggcgtggtcg

SEQ ID NO: 621852 - DNA, 13 bp, D. melanogaster
gaggggaaaactg

SEQ ID NO: 621853 - DNA, 14 bp, D. melanogaster
gaggggcgtggcag

SEQ ID NO: 621854 - DNA, 14 bp, D. melanogaster
gagggggcgtggca

SEQ ID NO: 621855 - DNA, 13 bp, D. melanogaster
gaggggtggccgc

SEQ ID NO: 621856 - DNA, 13 bp, D. melanogaster
gagggtcagcatt

SEQ ID NO: 621857 - DNA, 13 bp, D. melanogaster
gagggtggtgtgc

SEQ ID NO: 621858 - DNA, 13 bp, D. melanogaster
gagggttcttaac

SEQ ID NO: 621859 - DNA, 13 bp, D. melanogaster
gaggtaaccaaaa

SEQ ID NO: 621860 - DNA, 13 bp, D. melanogaster
gaggtaaccgaag

SEQ ID NO: 621861 - DNA, 13 bp, D. melanogaster
gaggtagatgact

SEQ ID NO: 621862 - DNA, 13 bp, D. melanogaster
gaggtataaggtt

SEQ ID NO: 621863 - DNA, 13 bp, D. melanogaster
gaggtatttggga

SEQ ID NO: 621864 - DNA, 14 bp, D. melanogaster
gaggtcactgcact

SEQ ID NO: 621865 - DNA, 13 bp, D. melanogaster
gaggtcatcaata

SEQ ID NO: 621866 - DNA, 13 bp, D. melanogaster
gaggtgaagggca

SEQ ID NO: 621867 - DNA, 13 bp, D. melanogaster
gaggtgctaccct

SEQ ID NO: 621868 - DNA, 13 bp, D. melanogaster
gaggtggagaaac

SEQ ID NO: 621869 - DNA, 14 bp, D. melanogaster
gaggtggagaaact

SEQ ID NO: 621870 - DNA, 14 bp, D. melanogaster
gaggtggtaaccaa

SEQ ID NO: 621871 - DNA, 13 bp, D. melanogaster
gaggtggtcaaaa

SEQ ID NO: 621872 - DNA, 13 bp, D. melanogaster
gaggtgtatacac

SEQ ID NO: 621873 - DNA, 13 bp, D. melanogaster
gaggtgtatgtgg

SEQ ID NO: 621874 - DNA, 13 bp, D. melanogaster
gaggttacatctt

SEQ ID NO: 621875 - DNA, 14 bp, D. melanogaster
gaggtttggtttta

SEQ ID NO: 621876 - DNA, 13 bp, D. melanogaster
gaggtttttaagc

SEQ ID NO: 621877 - DNA, 14 bp, D. melanogaster
gagtaaaaacaaga

SEQ ID NO: 621878 - DNA, 13 bp, D. melanogaster
gagtaaacaaata

SEQ ID NO: 621879 - DNA, 13 bp, D. melanogaster
gagtaacctccac

SEQ ID NO: 621880 - DNA, 13 bp, D. melanogaster
gagtaacgagtat

SEQ ID NO: 621881 - DNA, 13 bp, D. melanogaster
gagtaacgggtac

SEQ ID NO: 621882 - DNA, 13 bp, D. melanogaster
gagtaacgggtat

SEQ ID NO: 621883 - DNA, 14 bp, D. melanogaster
gagtaacgggtata

SEQ ID NO: 621884 - DNA, 13 bp, D. melanogaster
gagtaatgggtat

SEQ ID NO: 621885 - DNA, 14 bp, D. melanogaster
gagtacaaattgtt

SEQ ID NO: 621886 - DNA, 13 bp, D. melanogaster
gagtacaacaaaa

SEQ ID NO: 621887 - DNA, 13 bp, D. melanogaster
gagtacaacggaa

SEQ ID NO: 621888 - DNA, 13 bp, D. melanogaster
gagtacagtgtta

SEQ ID NO: 621889 - DNA, 13 bp, D. melanogaster
gagtacatatgta

SEQ ID NO: 621890 - DNA, 13 bp, D. melanogaster
gagtaccttaaac

SEQ ID NO: 621891 - DNA, 13 bp, D. melanogaster
gagtacgatttcg

SEQ ID NO: 621892 - DNA, 13 bp, D. melanogaster
gagtagaaagtgg

SEQ ID NO: 621893 - DNA, 13 bp, D. melanogaster
gagtagtgaactt

SEQ ID NO: 621894 - DNA, 13 bp, D. melanogaster
gagtagtttttga

SEQ ID NO: 621895 - DNA, 13 bp, D. melanogaster
gagtataaaatgg

SEQ ID NO: 621896 - DNA, 13 bp, D. melanogaster
gagtataaatata

SEQ ID NO: 621897 - DNA, 13 bp, D. melanogaster
gagtataaggaca

SEQ ID NO: 621898 - DNA, 13 bp, D. melanogaster
gagtataatgaat

SEQ ID NO: 621899 - DNA, 13 bp, D. melanogaster
gagtatacaccat

SEQ ID NO: 621900 - DNA, 13 bp, D. melanogaster
gagtataccacag

SEQ ID NO: 621901 - DNA, 13 bp, D. melanogaster
gagtatatataaa

SEQ ID NO: 621902 - DNA, 13 bp, D. melanogaster
gagtatatatata

SEQ ID NO: 621903 - DNA, 14 bp, D. melanogaster
gagtatatatatat

SEQ ID NO: 621904 - DNA, 13 bp, D. melanogaster
gagtatatatatt

SEQ ID NO: 621905 - DNA, 13 bp, D. melanogaster
gagtatcgggtat

SEQ ID NO: 621906 - DNA, 13 bp, D. melanogaster
gagtatctgtgtg

SEQ ID NO: 621907 - DNA, 14 bp, D. melanogaster
gagtatctgtgtgc

SEQ ID NO: 621908 - DNA, 13 bp, D. melanogaster
gagtatgggtatg

SEQ ID NO: 621909 - DNA, 14 bp, D. melanogaster
gagtatgtgtgtgt

SEQ ID NO: 621910 - DNA, 13 bp, D. melanogaster
gagtatttaaaat

SEQ ID NO: 621911 - DNA, 13 bp, D. melanogaster
gagtcaaaagaag

SEQ ID NO: 621912 - DNA, 13 bp, D. melanogaster
gagtcacatccgg

SEQ ID NO: 621913 - DNA, 13 bp, D. melanogaster
gagtcagagtcag

SEQ ID NO: 621914 - DNA, 13 bp, D. melanogaster
gagtcagtcagtc

SEQ ID NO: 621915 - DNA, 13 bp, D. melanogaster
gagtcagtcgaat

SEQ ID NO: 621916 - DNA, 13 bp, D. melanogaster
gagtccaaaaaaa

SEQ ID NO: 621917 - DNA, 13 bp, D. melanogaster
gagtccaagtcca

SEQ ID NO: 621918 - DNA, 14 bp, D. melanogaster
gagtccacagtttt

SEQ ID NO: 621919 - DNA, 13 bp, D. melanogaster
gagtcccgaccaa

SEQ ID NO: 621920 - DNA, 13 bp, D. melanogaster
gagtccggagtcc

SEQ ID NO: 621921 - DNA, 13 bp, D. melanogaster
gagtcctgaatcc

SEQ ID NO: 621922 - DNA, 14 bp, D. melanogaster
gagtcctgagtcct

SEQ ID NO: 621923 - DNA, 13 bp, D. melanogaster
gagtcctggctgc

SEQ ID NO: 621924 - DNA, 13 bp, D. melanogaster
gagtccttcgtcc

SEQ ID NO: 621925 - DNA, 13 bp, D. melanogaster
gagtcctttgtga

SEQ ID NO: 621926 - DNA, 14 bp, D. melanogaster
gagtcctttgtgat

SEQ ID NO: 621927 - DNA, 13 bp, D. melanogaster
gagtcgaaataca

SEQ ID NO: 621928 - DNA, 13 bp, D. melanogaster
gagtcgagtcgag

SEQ ID NO: 621929 - DNA, 14 bp, D. melanogaster
gagtcgagtcgagt

SEQ ID NO: 621930 - DNA, 14 bp, D. melanogaster
gagtcgagttgagt

SEQ ID NO: 621931 - DNA, 13 bp, D. melanogaster
gagtcgatctgga

SEQ ID NO: 621932 - DNA, 14 bp, D. melanogaster
gagtcgatctggcc

SEQ ID NO: 621933 - DNA, 13 bp, D. melanogaster
gagtcgatctggt

SEQ ID NO: 621934 - DNA, 13 bp, D. melanogaster
gagtctcttaaga

SEQ ID NO: 621935 - DNA, 13 bp, D. melanogaster
gagtctgcgatcc

SEQ ID NO: 621936 - DNA, 13 bp, D. melanogaster
gagtctggcaccc

SEQ ID NO: 621937 - DNA, 14 bp, D. melanogaster
gagtctggtccaat

SEQ ID NO: 621938 - DNA, 13 bp, D. melanogaster
gagtcttctgtct

SEQ ID NO: 621939 - DNA, 13 bp, D. melanogaster
gagtgaaaaaatc

SEQ ID NO: 621940 - DNA, 14 bp, D. melanogaster
gagtgaaagtgaaa

SEQ ID NO: 621941 - DNA, 13 bp, D. melanogaster
gagtgaagtgaac

SEQ ID NO: 621942 - DNA, 13 bp, D. melanogaster
gagtgaagtggag

SEQ ID NO: 621943 - DNA, 13 bp, D. melanogaster
gagtgaatgaatg

SEQ ID NO: 621944 - DNA, 13 bp, D. melanogaster
gagtgaatgagtg

SEQ ID NO: 621945 - DNA, 13 bp, D. melanogaster
gagtgagcggaaa

SEQ ID NO: 621946 - DNA, 13 bp, D. melanogaster
gagtgagtgactg

SEQ ID NO: 621947 - DNA, 13 bp, D. melanogaster
gagtgagtgagtg

SEQ ID NO: 621948 - DNA, 13 bp, D. melanogaster
gagtgagtgagtt

SEQ ID NO: 621949 - DNA, 13 bp, D. melanogaster
gagtgagtggaaa

SEQ ID NO: 621950 - DNA, 13 bp, D. melanogaster
gagtgagtgtgcg

SEQ ID NO: 621951 - DNA, 14 bp, D. melanogaster
gagtgagtgtgtgt

SEQ ID NO: 621952 - DNA, 13 bp, D. melanogaster
gagtgataacatt

SEQ ID NO: 621953 - DNA, 13 bp, D. melanogaster
gagtgcaaaaaaa

SEQ ID NO: 621954 - DNA, 13 bp, D. melanogaster
gagtgcaaataaa

SEQ ID NO: 621955 - DNA, 13 bp, D. melanogaster
gagtgcaaatatt

SEQ ID NO: 621956 - DNA, 13 bp, D. melanogaster
gagtgcaactgca

SEQ ID NO: 621957 - DNA, 13 bp, D. melanogaster
gagtgcaataaaa

SEQ ID NO: 621958 - DNA, 13 bp, D. melanogaster
gagtgcaataaat

SEQ ID NO: 621959 - DNA, 13 bp, D. melanogaster
gagtgcacacaca

SEQ ID NO: 621960 - DNA, 13 bp, D. melanogaster
gagtgcagcaaat

SEQ ID NO: 621961 - DNA, 13 bp, D. melanogaster
gagtgcagtgcag

SEQ ID NO: 621962 - DNA, 13 bp, D. melanogaster
gagtgcattttat

SEQ ID NO: 621963 - DNA, 13 bp, D. melanogaster
gagtgccaaatgg

SEQ ID NO: 621964 - DNA, 14 bp, D. melanogaster
gagtgccacgccca

SEQ ID NO: 621965 - DNA, 13 bp, D. melanogaster
gagtgcccactgt

SEQ ID NO: 621966 - DNA, 13 bp, D. melanogaster
gagtgccgaagat

SEQ ID NO: 621967 - DNA, 13 bp, D. melanogaster
gagtgcctgtgtg

SEQ ID NO: 621968 - DNA, 13 bp, D. melanogaster
gagtgcgagagag

SEQ ID NO: 621969 - DNA, 14 bp, D. melanogaster
gagtgcgagagaga

SEQ ID NO: 621970 - DNA, 13 bp, D. melanogaster
gagtgcgagtgag

SEQ ID NO: 621971 - DNA, 13 bp, D. melanogaster
gagtgcgagtgcg

SEQ ID NO: 621972 - DNA, 13 bp, D. melanogaster
gagtgcgagtggc

SEQ ID NO: 621973 - DNA, 13 bp, D. melanogaster
gagtgcgcacaat

SEQ ID NO: 621974 - DNA, 13 bp, D. melanogaster
gagtgcggaaaat

SEQ ID NO: 621975 - DNA, 13 bp, D. melanogaster
gagtgctcactgt

SEQ ID NO: 621976 - DNA, 13 bp, D. melanogaster
gagtgcttgtgtc

SEQ ID NO: 621977 - DNA, 13 bp, D. melanogaster
gagtggaaaagcc

SEQ ID NO: 621978 - DNA, 13 bp, D. melanogaster
gagtggaaaagcg

SEQ ID NO: 621979 - DNA, 13 bp, D. melanogaster
gagtggaaaattt

SEQ ID NO: 621980 - DNA, 13 bp, D. melanogaster
gagtggaaatcaa

SEQ ID NO: 621981 - DNA, 13 bp, D. melanogaster
gagtggaaatgga

SEQ ID NO: 621982 - DNA, 13 bp, D. melanogaster
gagtggaagtcag

SEQ ID NO: 621983 - DNA, 13 bp, D. melanogaster
gagtggaagtgga

SEQ ID NO: 621984 - DNA, 13 bp, D. melanogaster
gagtggaatctct

SEQ ID NO: 621985 - DNA, 13 bp, D. melanogaster
gagtggaatggag

SEQ ID NO: 621986 - DNA, 13 bp, D. melanogaster
gagtggagtgcag

SEQ ID NO: 621987 - DNA, 13 bp, D. melanogaster
gagtggagtggaa

SEQ ID NO: 621988 - DNA, 14 bp, D. melanogaster
gagtggagtggagt

SEQ ID NO: 621989 - DNA, 13 bp, D. melanogaster
gagtggatgtgga

SEQ ID NO: 621990 - DNA, 13 bp, D. melanogaster
gagtggattgcgc

SEQ ID NO: 621991 - DNA, 13 bp, D. melanogaster
gagtggcaaggag

SEQ ID NO: 621992 - DNA, 13 bp, D. melanogaster
gagtggcaagtgg

SEQ ID NO: 621993 - DNA, 13 bp, D. melanogaster
gagtggcgcttcc

SEQ ID NO: 621994 - DNA, 13 bp, D. melanogaster
gagtgggaaaact

SEQ ID NO: 621995 - DNA, 14 bp, D. melanogaster
gagtgggaaaacta

SEQ ID NO: 621996 - DNA, 13 bp, D. melanogaster
gagtgggagagcg

SEQ ID NO: 621997 - DNA, 14 bp, D. melanogaster
gagtgggagtggca

SEQ ID NO: 621998 - DNA, 13 bp, D. melanogaster
gagtgggcaatgc

SEQ ID NO: 621999 - DNA, 13 bp, D. melanogaster
gagtgggcatggc

SEQ ID NO: 622000 - DNA, 13 bp, D. melanogaster
gagtgggcgtgac

SEQ ID NO: 622001 - DNA, 14 bp, D. melanogaster
gagtgggcgtggca

SEQ ID NO: 622002 - DNA, 14 bp, D. melanogaster
gagtgggcgtggtc

SEQ ID NO: 622003 - DNA, 13 bp, D. melanogaster
gagtgggtggatt

SEQ ID NO: 622004 - DNA, 14 bp, D. melanogaster
gagtggtggtgggc

SEQ ID NO: 622005 - DNA, 13 bp, D. melanogaster
gagtggttggggc

SEQ ID NO: 622006 - DNA, 15 bp, D. melanogaster
gagtggttggggctg

SEQ ID NO: 622007 - DNA, 13 bp, D. melanogaster
gagtgtaaacaaa

SEQ ID NO: 622008 - DNA, 13 bp, D. melanogaster
gagtgtacaatgt

SEQ ID NO: 622009 - DNA, 13 bp, D. melanogaster
gagtgtagagtgt

SEQ ID NO: 622010 - DNA, 13 bp, D. melanogaster
gagtgtatgagtg

SEQ ID NO: 622011 - DNA, 13 bp, D. melanogaster
gagtgtatgggtg

SEQ ID NO: 622012 - DNA, 13 bp, D. melanogaster
gagtgtatgtgtg

SEQ ID NO: 622013 - DNA, 13 bp, D. melanogaster
gagtgtcataaat

SEQ ID NO: 622014 - DNA, 13 bp, D. melanogaster
gagtgtccaaaaa

SEQ ID NO: 622015 - DNA, 13 bp, D. melanogaster
gagtgtccatatt

SEQ ID NO: 622016 - DNA, 13 bp, D. melanogaster
gagtgtgaatgtg

SEQ ID NO: 622017 - DNA, 13 bp, D. melanogaster
gagtgtgagagag

SEQ ID NO: 622018 - DNA, 14 bp, D. melanogaster
gagtgtgagagaga

SEQ ID NO: 622019 - DNA, 13 bp, D. melanogaster
gagtgtgattgtg

SEQ ID NO: 622020 - DNA, 13 bp, D. melanogaster
gagtgtgcgagtg

SEQ ID NO: 622021 - DNA, 14 bp, D. melanogaster
gagtgtgcgagtgt

SEQ ID NO: 622022 - DNA, 13 bp, D. melanogaster
gagtgtgcgtgcg

SEQ ID NO: 622023 - DNA, 13 bp, D. melanogaster
gagtgtgcgtgtg

SEQ ID NO: 622024 - DNA, 13 bp, D. melanogaster
gagtgtggagtgt

SEQ ID NO: 622025 - DNA, 13 bp, D. melanogaster
gagtgtggcacat

SEQ ID NO: 622026 - DNA, 13 bp, D. melanogaster
gagtgtggtaatg

SEQ ID NO: 622027 - DNA, 14 bp, D. melanogaster
gagtgtgtatgtgt

SEQ ID NO: 622028 - DNA, 13 bp, D. melanogaster
gagtgtgtgagtg

SEQ ID NO: 622029 - DNA, 13 bp, D. melanogaster
gagtgtgtgcgaa

SEQ ID NO: 622030 - DNA, 13 bp, D. melanogaster
gagtgtgtgcgag

SEQ ID NO: 622031 - DNA, 13 bp, D. melanogaster
gagtgtgtgcgtt

SEQ ID NO: 622032 - DNA, 13 bp, D. melanogaster
gagtgtgtggcac

SEQ ID NO: 622033 - DNA, 13 bp, D. melanogaster
gagtgtgtgtatt

SEQ ID NO: 622034 - DNA, 13 bp, D. melanogaster
gagtgtgtgtgcg

SEQ ID NO: 622035 - DNA, 14 bp, D. melanogaster
gagtgtgtgtgcga

SEQ ID NO: 622036 - DNA, 13 bp, D. melanogaster
gagtgtgtgtgct

SEQ ID NO: 622037 - DNA, 13 bp, D. melanogaster
gagtgtgtgtgta

SEQ ID NO: 622038 - DNA, 13 bp, D. melanogaster
gagtgtgtttgcc

SEQ ID NO: 622039 - DNA, 13 bp, D. melanogaster
gagtgttgaaaat

SEQ ID NO: 622040 - DNA, 13 bp, D. melanogaster
gagtgttgtcatc

SEQ ID NO: 622041 - DNA, 13 bp, D. melanogaster
gagtgtttatgta

SEQ ID NO: 622042 - DNA, 13 bp, D. melanogaster
gagtgtttgagtg

SEQ ID NO: 622043 - DNA, 13 bp, D. melanogaster
gagtgtttgcaat

SEQ ID NO: 622044 - DNA, 13 bp, D. melanogaster
gagttaagaaata

SEQ ID NO: 622045 - DNA, 13 bp, D. melanogaster
gagttataaaaat

SEQ ID NO: 622046 - DNA, 13 bp, D. melanogaster
gagttatcaaagc

SEQ ID NO: 622047 - DNA, 13 bp, D. melanogaster
gagttatcttaag

SEQ ID NO: 622048 - DNA, 14 bp, D. melanogaster
gagttcaaaaagat

SEQ ID NO: 622049 - DNA, 15 bp, D. melanogaster
gagttcaacgaggta

SEQ ID NO: 622050 - DNA, 13 bp, D. melanogaster
gagttcaatgagc

SEQ ID NO: 622051 - DNA, 14 bp, D. melanogaster
gagttcagttcagt

SEQ ID NO: 622052 - DNA, 14 bp, D. melanogaster
gagttcattaaaaa

SEQ ID NO: 622053 - DNA, 13 bp, D. melanogaster
gagttcattagaa

SEQ ID NO: 622054 - DNA, 13 bp, D. melanogaster
gagttcctccgtc

SEQ ID NO: 622055 - DNA, 13 bp, D. melanogaster
gagttcctcgact

SEQ ID NO: 622056 - DNA, 13 bp, D. melanogaster
gagttccttacct

SEQ ID NO: 622057 - DNA, 14 bp, D. melanogaster
gagttcgaaaagaa

SEQ ID NO: 622058 - DNA, 13 bp, D. melanogaster
gagttcgttctaa

SEQ ID NO: 622059 - DNA, 13 bp, D. melanogaster
gagttctccgact

SEQ ID NO: 622060 - DNA, 13 bp, D. melanogaster
gagttcttaaaaa

SEQ ID NO: 622061 - DNA, 13 bp, D. melanogaster
gagttcttatctc

SEQ ID NO: 622062 - DNA, 13 bp, D. melanogaster
gagttgaagttga

SEQ ID NO: 622063 - DNA, 13 bp, D. melanogaster
gagttgagttgag

SEQ ID NO: 622064 - DNA, 13 bp, D. melanogaster
gagttgatgagcc

SEQ ID NO: 622065 - DNA, 13 bp, D. melanogaster
gagttgcagttgg

SEQ ID NO: 622066 - DNA, 13 bp, D. melanogaster
gagttgctgctgc

SEQ ID NO: 622067 - DNA, 14 bp, D. melanogaster
gagttgctgctgct

SEQ ID NO: 622068 - DNA, 13 bp, D. melanogaster
gagttggaggaag

SEQ ID NO: 622069 - DNA, 13 bp, D. melanogaster
gagttggcaaaaa

SEQ ID NO: 622070 - DNA, 13 bp, D. melanogaster
gagttggccaaaa

SEQ ID NO: 622071 - DNA, 14 bp, D. melanogaster
gagttggccaaaag

SEQ ID NO: 622072 - DNA, 13 bp, D. melanogaster
gagttggccaaag

SEQ ID NO: 622073 - DNA, 13 bp, D. melanogaster
gagttggccaaga

SEQ ID NO: 622074 - DNA, 13 bp, D. melanogaster
gagttggctggca

SEQ ID NO: 622075 - DNA, 13 bp, D. melanogaster
gagttgggaaaaa

SEQ ID NO: 622076 - DNA, 13 bp, D. melanogaster
gagttgtgtttta

SEQ ID NO: 622077 - DNA, 13 bp, D. melanogaster
gagttgttggcca

SEQ ID NO: 622078 - DNA, 13 bp, D. melanogaster
gagtttaacaaag

SEQ ID NO: 622079 - DNA, 13 bp, D. melanogaster
gagtttacaaact

SEQ ID NO: 622080 - DNA, 13 bp, D. melanogaster
gagtttatatgta

SEQ ID NO: 622081 - DNA, 13 bp, D. melanogaster
gagtttatttaaa

SEQ ID NO: 622082 - DNA, 14 bp, D. melanogaster
gagtttatttacaa

SEQ ID NO: 622083 - DNA, 13 bp, D. melanogaster
gagtttccctgtt

SEQ ID NO: 622084 - DNA, 13 bp, D. melanogaster
gagtttccgaaag

SEQ ID NO: 622085 - DNA, 13 bp, D. melanogaster
gagtttcgagttt

SEQ ID NO: 622086 - DNA, 13 bp, D. melanogaster
gagtttcggtttt

SEQ ID NO: 622087 - DNA, 13 bp, D. melanogaster
gagtttcttacca

SEQ ID NO: 622088 - DNA, 13 bp, D. melanogaster
gagtttgacggca

SEQ ID NO: 622089 - DNA, 13 bp, D. melanogaster
gagtttgcttttg

SEQ ID NO: 622090 - DNA, 14 bp, D. melanogaster
gagttttaagcatt

SEQ ID NO: 622091 - DNA, 13 bp, D. melanogaster
gagttttaattta

SEQ ID NO: 622092 - DNA, 13 bp, D. melanogaster
gagttttcacgaa

SEQ ID NO: 622093 - DNA, 13 bp, D. melanogaster
gagttttgccaaa

SEQ ID NO: 622094 - DNA, 13 bp, D. melanogaster
gagttttgggctt

SEQ ID NO: 622095 - DNA, 13 bp, D. melanogaster
gagttttggggct

SEQ ID NO: 622096 - DNA, 14 bp, D. melanogaster
gagttttgtcattt

SEQ ID NO: 622097 - DNA, 13 bp, D. melanogaster
gagttttgttaat

SEQ ID NO: 622098 - DNA, 14 bp, D. melanogaster
gagtttttaattaa

SEQ ID NO: 622099 - DNA, 13 bp, D. melanogaster
gagtttttcaaat

SEQ ID NO: 622100 - DNA, 13 bp, D. melanogaster
gagttttttgcca

SEQ ID NO: 622101 - DNA, 13 bp, D. melanogaster
gataaaaaacatt

SEQ ID NO: 622102 - DNA, 13 bp, D. melanogaster
gataaaaacattt

SEQ ID NO: 622103 - DNA, 13 bp, D. melanogaster
gataaaaaccgaa

SEQ ID NO: 622104 - DNA, 13 bp, D. melanogaster
gataaaaatatac

SEQ ID NO: 622105 - DNA, 14 bp, D. melanogaster
gataaaaattattg

SEQ ID NO: 622106 - DNA, 13 bp, D. melanogaster
gataaaacatttt

SEQ ID NO: 622107 - DNA, 14 bp, D. melanogaster
gataaaaccaaacc

SEQ ID NO: 622108 - DNA, 13 bp, D. melanogaster
gataaaacgcagc

SEQ ID NO: 622109 - DNA, 13 bp, D. melanogaster
gataaaagtgcaa

SEQ ID NO: 622110 - DNA, 13 bp, D. melanogaster
gataaaatgattt

SEQ ID NO: 622111 - DNA, 13 bp, D. melanogaster
gataaaattcgaa

SEQ ID NO: 622112 - DNA, 13 bp, D. melanogaster
gataaaatttgga

SEQ ID NO: 622113 - DNA, 13 bp, D. melanogaster
gataaacaaaatt

SEQ ID NO: 622114 - DNA, 13 bp, D. melanogaster
gataaacaacaac

SEQ ID NO: 622115 - DNA, 14 bp, D. melanogaster
gataaacagaaaat

SEQ ID NO: 622116 - DNA, 13 bp, D. melanogaster
gataaacagaaat

SEQ ID NO: 622117 - DNA, 13 bp, D. melanogaster
gataaacataaac

SEQ ID NO: 622118 - DNA, 13 bp, D. melanogaster
gataaacgacgcc

SEQ ID NO: 622119 - DNA, 13 bp, D. melanogaster
gataaactttttt

SEQ ID NO: 622120 - DNA, 13 bp, D. melanogaster
gataaagatacag

SEQ ID NO: 622121 - DNA, 13 bp, D. melanogaster
gataaaggagccg

SEQ ID NO: 622122 - DNA, 13 bp, D. melanogaster
gataaatatgtat

SEQ ID NO: 622123 - DNA, 13 bp, D. melanogaster
gataaatattttc

SEQ ID NO: 622124 - DNA, 13 bp, D. melanogaster
gataaatcaaatt

SEQ ID NO: 622125 - DNA, 13 bp, D. melanogaster
gataaatgataag

SEQ ID NO: 622126 - DNA, 13 bp, D. melanogaster
gataaatgcagat

SEQ ID NO: 622127 - DNA, 13 bp, D. melanogaster
gataaatgcatta

SEQ ID NO: 622128 - DNA, 13 bp, D. melanogaster
gataaatgcattt

SEQ ID NO: 622129 - DNA, 13 bp, D. melanogaster
gataaatgtaaat

SEQ ID NO: 622130 - DNA, 13 bp, D. melanogaster
gataaatgtgagt

SEQ ID NO: 622131 - DNA, 13 bp, D. melanogaster
gataaatgttttt

SEQ ID NO: 622132 - DNA, 13 bp, D. melanogaster
gataacaacaaca

SEQ ID NO: 622133 - DNA, 13 bp, D. melanogaster
gataacaataatt

SEQ ID NO: 622134 - DNA, 13 bp, D. melanogaster
gataacatacaaa

SEQ ID NO: 622135 - DNA, 14 bp, D. melanogaster
gataacatacaaaa

SEQ ID NO: 622136 - DNA, 13 bp, D. melanogaster
gataacatgaaaa

SEQ ID NO: 622137 - DNA, 13 bp, D. melanogaster
gataacattttaa

SEQ ID NO: 622138 - DNA, 13 bp, D. melanogaster
gataaccaattat

SEQ ID NO: 622139 - DNA, 13 bp, D. melanogaster
gataacgaagaaa

SEQ ID NO: 622140 - DNA, 14 bp, D. melanogaster
gataacgataacga

SEQ ID NO: 622141 - DNA, 13 bp, D. melanogaster
gataactgacttt

SEQ ID NO: 622142 - DNA, 13 bp, D. melanogaster
gataacttcaaaa

SEQ ID NO: 622143 - DNA, 13 bp, D. melanogaster
gataacttcgatt

SEQ ID NO: 622144 - DNA, 13 bp, D. melanogaster
gataagaaattct

SEQ ID NO: 622145 - DNA, 13 bp, D. melanogaster
gataagcaaacaa

SEQ ID NO: 622146 - DNA, 13 bp, D. melanogaster
gataagctcaaaa

SEQ ID NO: 622147 - DNA, 13 bp, D. melanogaster
gataagctcgaaa

SEQ ID NO: 622148 - DNA, 13 bp, D. melanogaster
gataaggaaacta

SEQ ID NO: 622149 - DNA, 13 bp, D. melanogaster
gataaggataagg

SEQ ID NO: 622150 - DNA, 13 bp, D. melanogaster
gataaggttcaaa

SEQ ID NO: 622151 - DNA, 13 bp, D. melanogaster
gataagtatttcg

SEQ ID NO: 622152 - DNA, 13 bp, D. melanogaster
gataagtcgagca

SEQ ID NO: 622153 - DNA, 13 bp, D. melanogaster
gataagtgaattg

SEQ ID NO: 622154 - DNA, 13 bp, D. melanogaster
gataataaaatca

SEQ ID NO: 622155 - DNA, 13 bp, D. melanogaster
gataataaatgta

SEQ ID NO: 622156 - DNA, 14 bp, D. melanogaster
gataataaatttgc

SEQ ID NO: 622157 - DNA, 14 bp, D. melanogaster
gataataacaatat

SEQ ID NO: 622158 - DNA, 13 bp, D. melanogaster
gataataatgatc

SEQ ID NO: 622159 - DNA, 13 bp, D. melanogaster
gataataatggtg

SEQ ID NO: 622160 - DNA, 13 bp, D. melanogaster
gataatagaacca

SEQ ID NO: 622161 - DNA, 13 bp, D. melanogaster
gataatagtttct

SEQ ID NO: 622162 - DNA, 13 bp, D. melanogaster
gataatatcgata

SEQ ID NO: 622163 - DNA, 14 bp, D. melanogaster
gataatattgagaa

SEQ ID NO: 622164 - DNA, 13 bp, D. melanogaster
gataatatttgta

SEQ ID NO: 622165 - DNA, 13 bp, D. melanogaster
gataatgacaaca

SEQ ID NO: 622166 - DNA, 14 bp, D. melanogaster
gataatgataatga

SEQ ID NO: 622167 - DNA, 13 bp, D. melanogaster
gataatgatccga

SEQ ID NO: 622168 - DNA, 14 bp, D. melanogaster
gataatgatgataa

SEQ ID NO: 622169 - DNA, 13 bp, D. melanogaster
gataatgatgatg

SEQ ID NO: 622170 - DNA, 14 bp, D. melanogaster
gataatgatgatga

SEQ ID NO: 622171 - DNA, 14 bp, D. melanogaster
gataatgatgatgg

SEQ ID NO: 622172 - DNA, 13 bp, D. melanogaster
gataatgatgatt

SEQ ID NO: 622173 - DNA, 13 bp, D. melanogaster
gataatgatgttg

SEQ ID NO: 622174 - DNA, 13 bp, D. melanogaster
gataatggaccaa

SEQ ID NO: 622175 - DNA, 13 bp, D. melanogaster
gataatggataat

SEQ ID NO: 622176 - DNA, 14 bp, D. melanogaster
gataatggataatg

SEQ ID NO: 622177 - DNA, 13 bp, D. melanogaster
gataatgtccgaa

SEQ ID NO: 622178 - DNA, 13 bp, D. melanogaster
gataattattgtt

SEQ ID NO: 622179 - DNA, 13 bp, D. melanogaster
gataattgaaaat

SEQ ID NO: 622180 - DNA, 13 bp, D. melanogaster
gataattgataat

SEQ ID NO: 622181 - DNA, 13 bp, D. melanogaster
gataattgatttt

SEQ ID NO: 622182 - DNA, 13 bp, D. melanogaster
gatacaaaaatat

SEQ ID NO: 622183 - DNA, 13 bp, D. melanogaster
gatacaaaagaat

SEQ ID NO: 622184 - DNA, 14 bp, D. melanogaster
gatacaaaagaatc

SEQ ID NO: 622185 - DNA, 14 bp, D. melanogaster
gatacaaaagtatc

SEQ ID NO: 622186 - DNA, 13 bp, D. melanogaster
gatacaaaataca

SEQ ID NO: 622187 - DNA, 13 bp, D. melanogaster
gatacaaatacaa

SEQ ID NO: 622188 - DNA, 13 bp, D. melanogaster
gatacaaatcaaa

SEQ ID NO: 622189 - DNA, 13 bp, D. melanogaster
gatacaaatgctt

SEQ ID NO: 622190 - DNA, 13 bp, D. melanogaster
gatacaaattgaa

SEQ ID NO: 622191 - DNA, 13 bp, D. melanogaster
gatacaaattgga

SEQ ID NO: 622192 - DNA, 14 bp, D. melanogaster
gatacaaattggaa

SEQ ID NO: 622193 - DNA, 13 bp, D. melanogaster
gatacaatatctt

SEQ ID NO: 622194 - DNA, 13 bp, D. melanogaster
gatacaattgtat

SEQ ID NO: 622195 - DNA, 13 bp, D. melanogaster
gatacacactcac

SEQ ID NO: 622196 - DNA, 13 bp, D. melanogaster
gatacagaaacag

SEQ ID NO: 622197 - DNA, 13 bp, D. melanogaster
gatacagagatac

SEQ ID NO: 622198 - DNA, 15 bp, D. melanogaster
gatacagatacagaa

SEQ ID NO: 622199 - DNA, 14 bp, D. melanogaster
gatacagatacagg

SEQ ID NO: 622200 - DNA, 13 bp, D. melanogaster
gatacagataccg

SEQ ID NO: 622201 - DNA, 13 bp, D. melanogaster
gatacagatacga

SEQ ID NO: 622202 - DNA, 14 bp, D. melanogaster
gatacagatacgag

SEQ ID NO: 622203 - DNA, 13 bp, D. melanogaster
gatacagatacgg

SEQ ID NO: 622204 - DNA, 13 bp, D. melanogaster
gatacagatactc

SEQ ID NO: 622205 - DNA, 14 bp, D. melanogaster
gatacagatactga

SEQ ID NO: 622206 - DNA, 13 bp, D. melanogaster
gatacagatgcat

SEQ ID NO: 622207 - DNA, 13 bp, D. melanogaster
gatacatagatag

SEQ ID NO: 622208 - DNA, 13 bp, D. melanogaster
gatacatatacat

SEQ ID NO: 622209 - DNA, 13 bp, D. melanogaster
gatacatatatgt

SEQ ID NO: 622210 - DNA, 13 bp, D. melanogaster
gatacatatctta

SEQ ID NO: 622211 - DNA, 13 bp, D. melanogaster
gatacatatgtat

SEQ ID NO: 622212 - DNA, 14 bp, D. melanogaster
gatacatatgtata

SEQ ID NO: 622213 - DNA, 13 bp, D. melanogaster
gatacatttataa

SEQ ID NO: 622214 - DNA, 13 bp, D. melanogaster
gatacatttcaaa

SEQ ID NO: 622215 - DNA, 13 bp, D. melanogaster
gatacatttgcag

SEQ ID NO: 622216 - DNA, 13 bp, D. melanogaster
gatacattttcaa

SEQ ID NO: 622217 - DNA, 13 bp, D. melanogaster
gatacattttggt

SEQ ID NO: 622218 - DNA, 13 bp, D. melanogaster
gataccagataca

SEQ ID NO: 622219 - DNA, 13 bp, D. melanogaster
gataccattggtc

SEQ ID NO: 622220 - DNA, 13 bp, D. melanogaster
gataccgagtttc

SEQ ID NO: 622221 - DNA, 14 bp, D. melanogaster
gataccgataccga

SEQ ID NO: 622222 - DNA, 13 bp, D. melanogaster
gataccgctgagg

SEQ ID NO: 622223 - DNA, 13 bp, D. melanogaster
gatacctcacaaa

SEQ ID NO: 622224 - DNA, 13 bp, D. melanogaster
gatacgaaacgaa

SEQ ID NO: 622225 - DNA, 13 bp, D. melanogaster
gatacgatacgat

SEQ ID NO: 622226 - DNA, 13 bp, D. melanogaster
gatacgatgcgat

SEQ ID NO: 622227 - DNA, 13 bp, D. melanogaster
gatacgcagatac

SEQ ID NO: 622228 - DNA, 13 bp, D. melanogaster
gatacgcccataa

SEQ ID NO: 622229 - DNA, 13 bp, D. melanogaster
gatacggatacaa

SEQ ID NO: 622230 - DNA, 14 bp, D. melanogaster
gatacggatacaaa

SEQ ID NO: 622231 - DNA, 13 bp, D. melanogaster
gatacggatacag

SEQ ID NO: 622232 - DNA, 14 bp, D. melanogaster
gatacggatacaga

SEQ ID NO: 622233 - DNA, 16 bp, D. melanogaster
gatacggatacagata

SEQ ID NO: 622234 - DNA, 14 bp, D. melanogaster
gatacggatacgga

SEQ ID NO: 622235 - DNA, 13 bp, D. melanogaster
gatacggattcgg

SEQ ID NO: 622236 - DNA, 15 bp, D. melanogaster
gatacgtttgtgcgg

SEQ ID NO: 622237 - DNA, 13 bp, D. melanogaster
gatactatcgata

SEQ ID NO: 622238 - DNA, 13 bp, D. melanogaster
gatactgagatac

SEQ ID NO: 622239 - DNA, 13 bp, D. melanogaster
gatactgataagg

SEQ ID NO: 622240 - DNA, 13 bp, D. melanogaster
gatactgatactg

SEQ ID NO: 622241 - DNA, 13 bp, D. melanogaster
gatactggatact

SEQ ID NO: 622242 - DNA, 13 bp, D. melanogaster
gatactggtgcag

SEQ ID NO: 622243 - DNA, 13 bp, D. melanogaster
gatacttccctca

SEQ ID NO: 622244 - DNA, 13 bp, D. melanogaster
gatacttttgtat

SEQ ID NO: 622245 - DNA, 13 bp, D. melanogaster
gatagaaagattt

SEQ ID NO: 622246 - DNA, 13 bp, D. melanogaster
gatagaaattcca

SEQ ID NO: 622247 - DNA, 13 bp, D. melanogaster
gatagacagacag

SEQ ID NO: 622248 - DNA, 13 bp, D. melanogaster
gatagagatagat

SEQ ID NO: 622249 - DNA, 13 bp, D. melanogaster
gatagagatggag

SEQ ID NO: 622250 - DNA, 13 bp, D. melanogaster
gatagatggttag

SEQ ID NO: 622251 - DNA, 13 bp, D. melanogaster
gatagcaacaaca

SEQ ID NO: 622252 - DNA, 14 bp, D. melanogaster
gatagcatatcggt

SEQ ID NO: 622253 - DNA, 14 bp, D. melanogaster
gatagcatcatagc

SEQ ID NO: 622254 - DNA, 14 bp, D. melanogaster
gatagccaaaaacc

SEQ ID NO: 622255 - DNA, 13 bp, D. melanogaster
gatagccacacgc

SEQ ID NO: 622256 - DNA, 13 bp, D. melanogaster
gatagtaaggaaa

SEQ ID NO: 622257 - DNA, 13 bp, D. melanogaster
gatagtacatcgg

SEQ ID NO: 622258 - DNA, 13 bp, D. melanogaster
gatagtcgaggaa

SEQ ID NO: 622259 - DNA, 13 bp, D. melanogaster
gatagttaagagg

SEQ ID NO: 622260 - DNA, 14 bp, D. melanogaster
gatagttccgataa

SEQ ID NO: 622261 - DNA, 13 bp, D. melanogaster
gatataaaagcag

SEQ ID NO: 622262 - DNA, 13 bp, D. melanogaster
gatataaacaaat

SEQ ID NO: 622263 - DNA, 13 bp, D. melanogaster
gatataaagatat

SEQ ID NO: 622264 - DNA, 13 bp, D. melanogaster
gatataagtcata

SEQ ID NO: 622265 - DNA, 13 bp, D. melanogaster
gatatacaaaatt

SEQ ID NO: 622266 - DNA, 14 bp, D. melanogaster
gatatacaaaatta

SEQ ID NO: 622267 - DNA, 13 bp, D. melanogaster
gatatacaaataa

SEQ ID NO: 622268 - DNA, 14 bp, D. melanogaster
gatatacaaataaa

SEQ ID NO: 622269 - DNA, 13 bp, D. melanogaster
gatatacaaattt

SEQ ID NO: 622270 - DNA, 14 bp, D. melanogaster
gatatacaatatat

SEQ ID NO: 622271 - DNA, 13 bp, D. melanogaster
gatatacaatttt

SEQ ID NO: 622272 - DNA, 15 bp, D. melanogaster
gatatacatacatat

SEQ ID NO: 622273 - DNA, 13 bp, D. melanogaster
gatatacatatag

SEQ ID NO: 622274 - DNA, 14 bp, D. melanogaster
gatatacatatata

SEQ ID NO: 622275 - DNA, 14 bp, D. melanogaster
gatatacatatatg

SEQ ID NO: 622276 - DNA, 14 bp, D. melanogaster
gatatacatatatt

SEQ ID NO: 622277 - DNA, 14 bp, D. melanogaster
gatatacatatgtg

SEQ ID NO: 622278 - DNA, 13 bp, D. melanogaster
gatataccaaaga

SEQ ID NO: 622279 - DNA, 13 bp, D. melanogaster
gatatactcgaaa

SEQ ID NO: 622280 - DNA, 13 bp, D. melanogaster
gatatagaattga

SEQ ID NO: 622281 - DNA, 13 bp, D. melanogaster
gatatagatacaa

SEQ ID NO: 622282 - DNA, 13 bp, D. melanogaster
gatatagtagcaa

SEQ ID NO: 622283 - DNA, 13 bp, D. melanogaster
gatatagtcttct

SEQ ID NO: 622284 - DNA, 13 bp, D. melanogaster
gatatatacaatt

SEQ ID NO: 622285 - DNA, 14 bp, D. melanogaster
gatatatacacata

SEQ ID NO: 622286 - DNA, 13 bp, D. melanogaster
gatatatacatac

SEQ ID NO: 622287 - DNA, 14 bp, D. melanogaster
gatatatacataca

SEQ ID NO: 622288 - DNA, 13 bp, D. melanogaster
gatatatacatat

SEQ ID NO: 622289 - DNA, 14 bp, D. melanogaster
gatatatacatata

SEQ ID NO: 622290 - DNA, 13 bp, D. melanogaster
gatatatactata

SEQ ID NO: 622291 - DNA, 13 bp, D. melanogaster
gatatatagtata

SEQ ID NO: 622292 - DNA, 13 bp, D. melanogaster
gatatatatacat

SEQ ID NO: 622293 - DNA, 14 bp, D. melanogaster
gatatatatacata

SEQ ID NO: 622294 - DNA, 13 bp, D. melanogaster
gatatatatactt

SEQ ID NO: 622295 - DNA, 13 bp, D. melanogaster
gatatatatatac

SEQ ID NO: 622296 - DNA, 14 bp, D. melanogaster
gatatatatataca

SEQ ID NO: 622297 - DNA, 13 bp, D. melanogaster
gatatatatatag

SEQ ID NO: 622298 - DNA, 13 bp, D. melanogaster
gatatatatatga

SEQ ID NO: 622299 - DNA, 13 bp, D. melanogaster
gatatatatatgt

SEQ ID NO: 622300 - DNA, 14 bp, D. melanogaster
gatatatatatgta

SEQ ID NO: 622301 - DNA, 13 bp, D. melanogaster
gatatatatcttt

SEQ ID NO: 622302 - DNA, 13 bp, D. melanogaster
gatatatatgtaa

SEQ ID NO: 622303 - DNA, 13 bp, D. melanogaster
gatatatggatac

SEQ ID NO: 622304 - DNA, 13 bp, D. melanogaster
gatatatgtataa

SEQ ID NO: 622305 - DNA, 13 bp, D. melanogaster
gatatatgtatat

SEQ ID NO: 622306 - DNA, 14 bp, D. melanogaster
gatatatgtatata

SEQ ID NO: 622307 - DNA, 14 bp, D. melanogaster
gatatatgtatatt

SEQ ID NO: 622308 - DNA, 14 bp, D. melanogaster
gatatatgtatgta

SEQ ID NO: 622309 - DNA, 13 bp, D. melanogaster
gatatatgtgtat

SEQ ID NO: 622310 - DNA, 13 bp, D. melanogaster
gatatattgctga

SEQ ID NO: 622311 - DNA, 13 bp, D. melanogaster
gatatattgtata

SEQ ID NO: 622312 - DNA, 13 bp, D. melanogaster
gatatatttatac

SEQ ID NO: 622313 - DNA, 13 bp, D. melanogaster
gatatatttatag

SEQ ID NO: 622314 - DNA, 13 bp, D. melanogaster
gatatatttatgt

SEQ ID NO: 622315 - DNA, 13 bp, D. melanogaster
gatatatttgttg

SEQ ID NO: 622316 - DNA, 13 bp, D. melanogaster
gatatatttttga

SEQ ID NO: 622317 - DNA, 13 bp, D. melanogaster
gatatcaacggat

SEQ ID NO: 622318 - DNA, 13 bp, D. melanogaster
gatatcagcaatg

SEQ ID NO: 622319 - DNA, 13 bp, D. melanogaster
gatatcagccaaa

SEQ ID NO: 622320 - DNA, 13 bp, D. melanogaster
gatatctataaga

SEQ ID NO: 622321 - DNA, 13 bp, D. melanogaster
gatatctctgtgg

SEQ ID NO: 622322 - DNA, 14 bp, D. melanogaster
gatatctgcaccag

SEQ ID NO: 622323 - DNA, 13 bp, D. melanogaster
gatatgaatataa

SEQ ID NO: 622324 - DNA, 13 bp, D. melanogaster
gatatgacaacca

SEQ ID NO: 622325 - DNA, 13 bp, D. melanogaster
gatatgagaataa

SEQ ID NO: 622326 - DNA, 14 bp, D. melanogaster
gatatgatatgata

SEQ ID NO: 622327 - DNA, 13 bp, D. melanogaster
gatatgatgatat

SEQ ID NO: 622328 - DNA, 13 bp, D. melanogaster
gatatgatgcact

SEQ ID NO: 622329 - DNA, 13 bp, D. melanogaster
gatatgattaata

SEQ ID NO: 622330 - DNA, 13 bp, D. melanogaster
gatatgcaaatga

SEQ ID NO: 622331 - DNA, 13 bp, D. melanogaster
gatatgccaaaaa

SEQ ID NO: 622332 - DNA, 13 bp, D. melanogaster
gatatgccttgtt

SEQ ID NO: 622333 - DNA, 13 bp, D. melanogaster
gatatggaaatga

SEQ ID NO: 622334 - DNA, 13 bp, D. melanogaster
gatatggaaatgg

SEQ ID NO: 622335 - DNA, 13 bp, D. melanogaster
gatatgtacatac

SEQ ID NO: 622336 - DNA, 14 bp, D. melanogaster
gatatgtacataca

SEQ ID NO: 622337 - DNA, 13 bp, D. melanogaster
gatatgtacatat

SEQ ID NO: 622338 - DNA, 15 bp, D. melanogaster
gatatgtatcattta

SEQ ID NO: 622339 - DNA, 13 bp, D. melanogaster
gatatgtatgtac

SEQ ID NO: 622340 - DNA, 13 bp, D. melanogaster
gatatgtggatat

SEQ ID NO: 622341 - DNA, 13 bp, D. melanogaster
gatatgtgtacat

SEQ ID NO: 622342 - DNA, 13 bp, D. melanogaster
gatatgtgtgtat

SEQ ID NO: 622343 - DNA, 13 bp, D. melanogaster
gatatgttcaata

SEQ ID NO: 622344 - DNA, 13 bp, D. melanogaster
gatattaatcacg

SEQ ID NO: 622345 - DNA, 13 bp, D. melanogaster
gatattacgtata

SEQ ID NO: 622346 - DNA, 13 bp, D. melanogaster
gatattacttttg

SEQ ID NO: 622347 - DNA, 13 bp, D. melanogaster
gatattatgatat

SEQ ID NO: 622348 - DNA, 13 bp, D. melanogaster
gatattattgcca

SEQ ID NO: 622349 - DNA, 14 bp, D. melanogaster
gatattcaaatgca

SEQ ID NO: 622350 - DNA, 13 bp, D. melanogaster
gatattcaacagg

SEQ ID NO: 622351 - DNA, 13 bp, D. melanogaster
gatattcatatat

SEQ ID NO: 622352 - DNA, 13 bp, D. melanogaster
gatattccagaaa

SEQ ID NO: 622353 - DNA, 13 bp, D. melanogaster
gatattcgcattt

SEQ ID NO: 622354 - DNA, 13 bp, D. melanogaster
gatattctactgt

SEQ ID NO: 622355 - DNA, 13 bp, D. melanogaster
gatattgatttgg

SEQ ID NO: 622356 - DNA, 13 bp, D. melanogaster
gatattgcaacaa

SEQ ID NO: 622357 - DNA, 13 bp, D. melanogaster
gatattgcagata

SEQ ID NO: 622358 - DNA, 13 bp, D. melanogaster
gatattggagaat

SEQ ID NO: 622359 - DNA, 14 bp, D. melanogaster
gatattgttggaaa

SEQ ID NO: 622360 - DNA, 13 bp, D. melanogaster
gatatttacaaat

SEQ ID NO: 622361 - DNA, 13 bp, D. melanogaster
gatatttatattc

SEQ ID NO: 622362 - DNA, 13 bp, D. melanogaster
gatatttcaatat

SEQ ID NO: 622363 - DNA, 13 bp, D. melanogaster
gatatttcattta

SEQ ID NO: 622364 - DNA, 13 bp, D. melanogaster
gatatttccaaat

SEQ ID NO: 622365 - DNA, 14 bp, D. melanogaster
gatatttctttaaa

SEQ ID NO: 622366 - DNA, 13 bp, D. melanogaster
gatatttgatatt

SEQ ID NO: 622367 - DNA, 13 bp, D. melanogaster
gatatttgcaatt

SEQ ID NO: 622368 - DNA, 13 bp, D. melanogaster
gatatttgcatat

SEQ ID NO: 622369 - DNA, 13 bp, D. melanogaster
gatatttgtataa

SEQ ID NO: 622370 - DNA, 13 bp, D. melanogaster
gatattttaaact

SEQ ID NO: 622371 - DNA, 13 bp, D. melanogaster
gatatttttcagt

SEQ ID NO: 622372 - DNA, 13 bp, D. melanogaster
gatatttttccat

SEQ ID NO: 622373 - DNA, 13 bp, D. melanogaster
gatatttttctgt

SEQ ID NO: 622374 - DNA, 13 bp, D. melanogaster
gatattttttcac

SEQ ID NO: 622375 - DNA, 13 bp, D. melanogaster
gatcaaaaatata

SEQ ID NO: 622376 - DNA, 14 bp, D. melanogaster
gatcaaaaatatat

SEQ ID NO: 622377 - DNA, 14 bp, D. melanogaster
gatcaaaagctaaa

SEQ ID NO: 622378 - DNA, 13 bp, D. melanogaster
gatcaaaatgaaa

SEQ ID NO: 622379 - DNA, 13 bp, D. melanogaster
gatcaaacatcat

SEQ ID NO: 622380 - DNA, 13 bp, D. melanogaster
gatcaaagcaaaa

SEQ ID NO: 622381 - DNA, 13 bp, D. melanogaster
gatcaaatgaaaa

SEQ ID NO: 622382 - DNA, 14 bp, D. melanogaster
gatcaaatgtttca

SEQ ID NO: 622383 - DNA, 14 bp, D. melanogaster
gatcaaattaagtt

SEQ ID NO: 622384 - DNA, 13 bp, D. melanogaster
gatcaacaaagat

SEQ ID NO: 622385 - DNA, 13 bp, D. melanogaster
gatcaacaacaag

SEQ ID NO: 622386 - DNA, 13 bp, D. melanogaster
gatcaacaaccac

SEQ ID NO: 622387 - DNA, 13 bp, D. melanogaster
gatcaacaagctt

SEQ ID NO: 622388 - DNA, 13 bp, D. melanogaster
gatcaacaattaa

SEQ ID NO: 622389 - DNA, 13 bp, D. melanogaster
gatcaacattaat

SEQ ID NO: 622390 - DNA, 13 bp, D. melanogaster
gatcaacccactg

SEQ ID NO: 622391 - DNA, 14 bp, D. melanogaster
gatcaagaatatat

SEQ ID NO: 622392 - DNA, 13 bp, D. melanogaster
gatcaagaatatt

SEQ ID NO: 622393 - DNA, 13 bp, D. melanogaster
gatcaagagttat

SEQ ID NO: 622394 - DNA, 13 bp, D. melanogaster
gatcaaggctctc

SEQ ID NO: 622395 - DNA, 13 bp, D. melanogaster
gatcaataaaaat

SEQ ID NO: 622396 - DNA, 13 bp, D. melanogaster
gatcaatgaaaat

SEQ ID NO: 622397 - DNA, 14 bp, D. melanogaster
gatcaatgaaaata

SEQ ID NO: 622398 - DNA, 13 bp, D. melanogaster
gatcaattaaaat

SEQ ID NO: 622399 - DNA, 13 bp, D. melanogaster
gatcacagctgtt

SEQ ID NO: 622400 - DNA, 14 bp, D. melanogaster
gatcacctgtttgg

SEQ ID NO: 622401 - DNA, 13 bp, D. melanogaster
gatcactcacctg

SEQ ID NO: 622402 - DNA, 13 bp, D. melanogaster
gatcactgatcac

SEQ ID NO: 622403 - DNA, 13 bp, D. melanogaster
gatcacttctgat

SEQ ID NO: 622404 - DNA, 13 bp, D. melanogaster
gatcactttacca

SEQ ID NO: 622405 - DNA, 13 bp, D. melanogaster
gatcagaaaaaat

SEQ ID NO: 622406 - DNA, 13 bp, D. melanogaster
gatcagaatcaat

SEQ ID NO: 622407 - DNA, 13 bp, D. melanogaster
gatcagagcattt

SEQ ID NO: 622408 - DNA, 13 bp, D. melanogaster
gatcagatataaa

SEQ ID NO: 622409 - DNA, 13 bp, D. melanogaster
gatcagatcagat

SEQ ID NO: 622410 - DNA, 13 bp, D. melanogaster
gatcagatcattg

SEQ ID NO: 622411 - DNA, 13 bp, D. melanogaster
gatcagcaggcat

SEQ ID NO: 622412 - DNA, 14 bp, D. melanogaster
gatcagcatcagca

SEQ ID NO: 622413 - DNA, 13 bp, D. melanogaster
gatcagcgataga

SEQ ID NO: 622414 - DNA, 13 bp, D. melanogaster
gatcaggactctg

SEQ ID NO: 622415 - DNA, 13 bp, D. melanogaster
gatcaggagcagg

SEQ ID NO: 622416 - DNA, 14 bp, D. melanogaster
gatcaggatcaata

SEQ ID NO: 622417 - DNA, 13 bp, D. melanogaster
gatcaggatcact

SEQ ID NO: 622418 - DNA, 13 bp, D. melanogaster
gatcagtcagtca

SEQ ID NO: 622419 - DNA, 14 bp, D. melanogaster
gatcagtcagtcag

SEQ ID NO: 622420 - DNA, 13 bp, D. melanogaster
gatcataattatg

SEQ ID NO: 622421 - DNA, 13 bp, D. melanogaster
gatcatagatcag

SEQ ID NO: 622422 - DNA, 14 bp, D. melanogaster
gatcatcatcatca

SEQ ID NO: 622423 - DNA, 13 bp, D. melanogaster
gatcatcatggaa

SEQ ID NO: 622424 - DNA, 14 bp, D. melanogaster
gatcatccagctgc

SEQ ID NO: 622425 - DNA, 14 bp, D. melanogaster
gatcatgaatattt

SEQ ID NO: 622426 - DNA, 13 bp, D. melanogaster
gatcattttaagt

SEQ ID NO: 622427 - DNA, 13 bp, D. melanogaster
gatccaaacagaa

SEQ ID NO: 622428 - DNA, 13 bp, D. melanogaster
gatccaacaaaat

SEQ ID NO: 622429 - DNA, 13 bp, D. melanogaster
gatccaatccaat

SEQ ID NO: 622430 - DNA, 14 bp, D. melanogaster
gatccaatccaatc

SEQ ID NO: 622431 - DNA, 14 bp, D. melanogaster
gatccaattcaagg

SEQ ID NO: 622432 - DNA, 13 bp, D. melanogaster
gatccaattcgat

SEQ ID NO: 622433 - DNA, 13 bp, D. melanogaster
gatccacagtcaa

SEQ ID NO: 622434 - DNA, 13 bp, D. melanogaster
gatcccaatccca

SEQ ID NO: 622435 - DNA, 14 bp, D. melanogaster
gatcccagatccca

SEQ ID NO: 622436 - DNA, 13 bp, D. melanogaster
gatcccagcggca

SEQ ID NO: 622437 - DNA, 13 bp, D. melanogaster
gatcccattcttt

SEQ ID NO: 622438 - DNA, 13 bp, D. melanogaster
gatccccaatggg

SEQ ID NO: 622439 - DNA, 13 bp, D. melanogaster
gatccccgatccc

SEQ ID NO: 622440 - DNA, 13 bp, D. melanogaster
gatcccgatccca

SEQ ID NO: 622441 - DNA, 14 bp, D. melanogaster
gatcccgatcccaa

SEQ ID NO: 622442 - DNA, 13 bp, D. melanogaster
gatcccgatcccc

SEQ ID NO: 622443 - DNA, 13 bp, D. melanogaster
gatcccgatccct

SEQ ID NO: 622444 - DNA, 13 bp, D. melanogaster
gatccgaatccga

SEQ ID NO: 622445 - DNA, 13 bp, D. melanogaster
gatccgatccaat

SEQ ID NO: 622446 - DNA, 14 bp, D. melanogaster
gatccgatccaatc

SEQ ID NO: 622447 - DNA, 13 bp, D. melanogaster
gatccgatcccat

SEQ ID NO: 622448 - DNA, 14 bp, D. melanogaster
gatccgatcccatc

SEQ ID NO: 622449 - DNA, 13 bp, D. melanogaster
gatccgatccgag

SEQ ID NO: 622450 - DNA, 13 bp, D. melanogaster
gatccggatctta

SEQ ID NO: 622451 - DNA, 13 bp, D. melanogaster
gatccgttgatat

SEQ ID NO: 622452 - DNA, 13 bp, D. melanogaster
gatcctaatcaag

SEQ ID NO: 622453 - DNA, 13 bp, D. melanogaster
gatcctccgatgt

SEQ ID NO: 622454 - DNA, 13 bp, D. melanogaster
gatcctcttcttt

SEQ ID NO: 622455 - DNA, 13 bp, D. melanogaster
gatcctgatcaag

SEQ ID NO: 622456 - DNA, 13 bp, D. melanogaster
gatcctgatcctg

SEQ ID NO: 622457 - DNA, 13 bp, D. melanogaster
gatccttggggaa

SEQ ID NO: 622458 - DNA, 13 bp, D. melanogaster
gatcgaatcggat

SEQ ID NO: 622459 - DNA, 13 bp, D. melanogaster
gatcgaatgtgtt

SEQ ID NO: 622460 - DNA, 13 bp, D. melanogaster
gatcgatcgatcg

SEQ ID NO: 622461 - DNA, 14 bp, D. melanogaster
gatcgatcgatcga

SEQ ID NO: 622462 - DNA, 13 bp, D. melanogaster
gatcgatcgattg

SEQ ID NO: 622463 - DNA, 13 bp, D. melanogaster
gatcgatctggca

SEQ ID NO: 622464 - DNA, 13 bp, D. melanogaster
gatcgatggatcg

SEQ ID NO: 622465 - DNA, 14 bp, D. melanogaster
gatcgcaagaagag

SEQ ID NO: 622466 - DNA, 13 bp, D. melanogaster
gatcgcagatcgc

SEQ ID NO: 622467 - DNA, 13 bp, D. melanogaster
gatcgcatcgcat

SEQ ID NO: 622468 - DNA, 13 bp, D. melanogaster
gatcgccttttgt

SEQ ID NO: 622469 - DNA, 13 bp, D. melanogaster
gatcgcttaaata

SEQ ID NO: 622470 - DNA, 14 bp, D. melanogaster
gatcggagaaaaaa

SEQ ID NO: 622471 - DNA, 13 bp, D. melanogaster
gatcggagatcgg

SEQ ID NO: 622472 - DNA, 13 bp, D. melanogaster
gatcggatcggag

SEQ ID NO: 622473 - DNA, 14 bp, D. melanogaster
gatcggatcggatt

SEQ ID NO: 622474 - DNA, 13 bp, D. melanogaster
gatcggatcgggt

SEQ ID NO: 622475 - DNA, 13 bp, D. melanogaster
gatcggatcggtt

SEQ ID NO: 622476 - DNA, 14 bp, D. melanogaster
gatcggatgggatg

SEQ ID NO: 622477 - DNA, 13 bp, D. melanogaster
gatcggattggat

SEQ ID NO: 622478 - DNA, 14 bp, D. melanogaster
gatcggattggatt

SEQ ID NO: 622479 - DNA, 14 bp, D. melanogaster
gatcgggatcggga

SEQ ID NO: 622480 - DNA, 13 bp, D. melanogaster
gatcggggatcgg

SEQ ID NO: 622481 - DNA, 14 bp, D. melanogaster
gatcggggatcggg

SEQ ID NO: 622482 - DNA, 13 bp, D. melanogaster
gatcggtgattat

SEQ ID NO: 622483 - DNA, 13 bp, D. melanogaster
gatcggtggatcg

SEQ ID NO: 622484 - DNA, 13 bp, D. melanogaster
gatcgtatcggat

SEQ ID NO: 622485 - DNA, 14 bp, D. melanogaster
gatcgtatcgtatc

SEQ ID NO: 622486 - DNA, 13 bp, D. melanogaster
gatcgtcgtcctc

SEQ ID NO: 622487 - DNA, 13 bp, D. melanogaster
gatcgttaagcag

SEQ ID NO: 622488 - DNA, 15 bp, D. melanogaster
gatcgttgactgtgc

SEQ ID NO: 622489 - DNA, 13 bp, D. melanogaster
gatctaaatcgat

SEQ ID NO: 622490 - DNA, 13 bp, D. melanogaster
gatctaatcgaaa

SEQ ID NO: 622491 - DNA, 13 bp, D. melanogaster
gatctacaatgat

SEQ ID NO: 622492 - DNA, 13 bp, D. melanogaster
gatctatatatat

SEQ ID NO: 622493 - DNA, 13 bp, D. melanogaster
gatctatatccat

SEQ ID NO: 622494 - DNA, 13 bp, D. melanogaster
gatctattcctga

SEQ ID NO: 622495 - DNA, 14 bp, D. melanogaster
gatctcaacgttca

SEQ ID NO: 622496 - DNA, 13 bp, D. melanogaster
gatctcagaaact

SEQ ID NO: 622497 - DNA, 14 bp, D. melanogaster
gatctccacgatct

SEQ ID NO: 622498 - DNA, 13 bp, D. melanogaster
gatctccgatctc

SEQ ID NO: 622499 - DNA, 13 bp, D. melanogaster
gatctgaaaacaa

SEQ ID NO: 622500 - DNA, 13 bp, D. melanogaster
gatctgaaatcca

SEQ ID NO: 622501 - DNA, 13 bp, D. melanogaster
gatctgacaaaag

SEQ ID NO: 622502 - DNA, 14 bp, D. melanogaster
gatctgaccgagat

SEQ ID NO: 622503 - DNA, 13 bp, D. melanogaster
gatctgatccgat

SEQ ID NO: 622504 - DNA, 13 bp, D. melanogaster
gatctgcgatctg

SEQ ID NO: 622505 - DNA, 13 bp, D. melanogaster
gatctggaagatt

SEQ ID NO: 622506 - DNA, 13 bp, D. melanogaster
gatctggagatca

SEQ ID NO: 622507 - DNA, 13 bp, D. melanogaster
gatctggcaacgc

SEQ ID NO: 622508 - DNA, 13 bp, D. melanogaster
gatctggccatgt

SEQ ID NO: 622509 - DNA, 13 bp, D. melanogaster
gatctggctggca

SEQ ID NO: 622510 - DNA, 14 bp, D. melanogaster
gatctggctggcag

SEQ ID NO: 622511 - DNA, 14 bp, D. melanogaster
gatctgggatctgg

SEQ ID NO: 622512 - DNA, 13 bp, D. melanogaster
gatctggtggtaa

SEQ ID NO: 622513 - DNA, 13 bp, D. melanogaster
gatctgttgcatg

SEQ ID NO: 622514 - DNA, 13 bp, D. melanogaster
gatcttcacgatc

SEQ ID NO: 622515 - DNA, 13 bp, D. melanogaster
gatcttggccaga

SEQ ID NO: 622516 - DNA, 13 bp, D. melanogaster
gatcttggccagc

SEQ ID NO: 622517 - DNA, 13 bp, D. melanogaster
gatctttagatac

SEQ ID NO: 622518 - DNA, 13 bp, D. melanogaster
gatgaaaaaatcg

SEQ ID NO: 622519 - DNA, 14 bp, D. melanogaster
gatgaaaacaagaa

SEQ ID NO: 622520 - DNA, 13 bp, D. melanogaster
gatgaaatgaaat

SEQ ID NO: 622521 - DNA, 13 bp, D. melanogaster
gatgaaattcaat

SEQ ID NO: 622522 - DNA, 13 bp, D. melanogaster
gatgaaccgccac

SEQ ID NO: 622523 - DNA, 13 bp, D. melanogaster
gatgaacctgtca

SEQ ID NO: 622524 - DNA, 14 bp, D. melanogaster
gatgaacgtttcaa

SEQ ID NO: 622525 - DNA, 13 bp, D. melanogaster
gatgaagaagtaa

SEQ ID NO: 622526 - DNA, 13 bp, D. melanogaster
gatgaagatgaag

SEQ ID NO: 622527 - DNA, 13 bp, D. melanogaster
gatgaagatgata

SEQ ID NO: 622528 - DNA, 13 bp, D. melanogaster
gatgaagatgatg

SEQ ID NO: 622529 - DNA, 13 bp, D. melanogaster
gatgaaggcaaat

SEQ ID NO: 622530 - DNA, 13 bp, D. melanogaster
gatgaatcaaaaa

SEQ ID NO: 622531 - DNA, 13 bp, D. melanogaster
gatgaatgaaaat

SEQ ID NO: 622532 - DNA, 13 bp, D. melanogaster
gatgaatgtcaaa

SEQ ID NO: 622533 - DNA, 14 bp, D. melanogaster
gatgaattcattat

SEQ ID NO: 622534 - DNA, 13 bp, D. melanogaster
gatgaattgatta

SEQ ID NO: 622535 - DNA, 13 bp, D. melanogaster
gatgaatttaaat

SEQ ID NO: 622536 - DNA, 13 bp, D. melanogaster
gatgacaacaaaa

SEQ ID NO: 622537 - DNA, 13 bp, D. melanogaster
gatgacaatgttg

SEQ ID NO: 622538 - DNA, 14 bp, D. melanogaster
gatgaccgacgctt

SEQ ID NO: 622539 - DNA, 13 bp, D. melanogaster
gatgaccgttttg

SEQ ID NO: 622540 - DNA, 13 bp, D. melanogaster
gatgacgacgatg

SEQ ID NO: 622541 - DNA, 14 bp, D. melanogaster
gatgacgacgatga

SEQ ID NO: 622542 - DNA, 13 bp, D. melanogaster
gatgacgatgact

SEQ ID NO: 622543 - DNA, 13 bp, D. melanogaster
gatgacgatgatg

SEQ ID NO: 622544 - DNA, 14 bp, D. melanogaster
gatgacgatgatga

SEQ ID NO: 622545 - DNA, 14 bp, D. melanogaster
gatgacgatgatgt

SEQ ID NO: 622546 - DNA, 13 bp, D. melanogaster
gatgacgatgctg

SEQ ID NO: 622547 - DNA, 13 bp, D. melanogaster
gatgacgatggtg

SEQ ID NO: 622548 - DNA, 13 bp, D. melanogaster
gatgacggtttgg

SEQ ID NO: 622549 - DNA, 13 bp, D. melanogaster
gatgacgttgatg

SEQ ID NO: 622550 - DNA, 13 bp, D. melanogaster
gatgactaataat

SEQ ID NO: 622551 - DNA, 14 bp, D. melanogaster
gatgactatagcat

SEQ ID NO: 622552 - DNA, 14 bp, D. melanogaster
gatgactcctggaa

SEQ ID NO: 622553 - DNA, 13 bp, D. melanogaster
gatgacttaatgg

SEQ ID NO: 622554 - DNA, 13 bp, D. melanogaster
gatgacttagtag

SEQ ID NO: 622555 - DNA, 13 bp, D. melanogaster
gatgagaagaatg

SEQ ID NO: 622556 - DNA, 13 bp, D. melanogaster
gatgagaatcgag

SEQ ID NO: 622557 - DNA, 14 bp, D. melanogaster
gatgagaatcgagg

SEQ ID NO: 622558 - DNA, 13 bp, D. melanogaster
gatgagagacaaa

SEQ ID NO: 622559 - DNA, 14 bp, D. melanogaster
gatgagatgagatg

SEQ ID NO: 622560 - DNA, 13 bp, D. melanogaster
gatgagatgggat

SEQ ID NO: 622561 - DNA, 13 bp, D. melanogaster
gatgagattaaaa

SEQ ID NO: 622562 - DNA, 13 bp, D. melanogaster
gatgagcaaacaa

SEQ ID NO: 622563 - DNA, 14 bp, D. melanogaster
gatgagcatcatca

SEQ ID NO: 622564 - DNA, 13 bp, D. melanogaster
gatgagcatcgaa

SEQ ID NO: 622565 - DNA, 13 bp, D. melanogaster
gatgagctgttga

SEQ ID NO: 622566 - DNA, 13 bp, D. melanogaster
gatgaggacatgt

SEQ ID NO: 622567 - DNA, 13 bp, D. melanogaster
gatgaggatgagc

SEQ ID NO: 622568 - DNA, 13 bp, D. melanogaster
gatgaggatgagg

SEQ ID NO: 622569 - DNA, 14 bp, D. melanogaster
gatgaggatgagga

SEQ ID NO: 622570 - DNA, 13 bp, D. melanogaster
gatgaggatgcgg

SEQ ID NO: 622571 - DNA, 14 bp, D. melanogaster
gatgaggatgcgga

SEQ ID NO: 622572 - DNA, 13 bp, D. melanogaster
gatgaggctgcta

SEQ ID NO: 622573 - DNA, 14 bp, D. melanogaster
gatgataaatcttc

SEQ ID NO: 622574 - DNA, 13 bp, D. melanogaster
gatgataataatg

SEQ ID NO: 622575 - DNA, 13 bp, D. melanogaster
gatgataatgata

SEQ ID NO: 622576 - DNA, 14 bp, D. melanogaster
gatgataatgataa

SEQ ID NO: 622577 - DNA, 13 bp, D. melanogaster
gatgataatgatg

SEQ ID NO: 622578 - DNA, 14 bp, D. melanogaster
gatgataatgatga

SEQ ID NO: 622579 - DNA, 13 bp, D. melanogaster
gatgatatcgagt

SEQ ID NO: 622580 - DNA, 13 bp, D. melanogaster
gatgatcagcgat

SEQ ID NO: 622581 - DNA, 13 bp, D. melanogaster
gatgatcttggtg

SEQ ID NO: 622582 - DNA, 13 bp, D. melanogaster
gatgatgaaaaat

SEQ ID NO: 622583 - DNA, 13 bp, D. melanogaster
gatgatgaaatcg

SEQ ID NO: 622584 - DNA, 13 bp, D. melanogaster
gatgatgaaccca

SEQ ID NO: 622585 - DNA, 14 bp, D. melanogaster
gatgatgaagaagt

SEQ ID NO: 622586 - DNA, 14 bp, D. melanogaster
gatgatgaagatga

SEQ ID NO: 622587 - DNA, 13 bp, D. melanogaster
gatgatgacaaaa

SEQ ID NO: 622588 - DNA, 14 bp, D. melanogaster
gatgatgacgatgg

SEQ ID NO: 622589 - DNA, 13 bp, D. melanogaster
gatgatgacgccg

SEQ ID NO: 622590 - DNA, 13 bp, D. melanogaster
gatgatgagccag

SEQ ID NO: 622591 - DNA, 13 bp, D. melanogaster
gatgatgaggtgg

SEQ ID NO: 622592 - DNA, 13 bp, D. melanogaster
gatgatgatcatg

SEQ ID NO: 622593 - DNA, 13 bp, D. melanogaster
gatgatgatgaaa

SEQ ID NO: 622594 - DNA, 14 bp, D. melanogaster
gatgatgatgaaat

SEQ ID NO: 622595 - DNA, 13 bp, D. melanogaster
gatgatgatgaat

SEQ ID NO: 622596 - DNA, 14 bp, D. melanogaster
gatgatgatgaatg

SEQ ID NO: 622597 - DNA, 13 bp, D. melanogaster
gatgatgatgaga

SEQ ID NO: 622598 - DNA, 13 bp, D. melanogaster
gatgatgatgagc

SEQ ID NO: 622599 - DNA, 14 bp, D. melanogaster
gatgatgatgatat

SEQ ID NO: 622600 - DNA, 14 bp, D. melanogaster
gatgatgatgatca

SEQ ID NO: 622601 - DNA, 13 bp, D. melanogaster
gatgatgatgatg

SEQ ID NO: 622602 - DNA, 14 bp, D. melanogaster
gatgatgatgatgg

SEQ ID NO: 622603 - DNA, 14 bp, D. melanogaster
gatgatgatgattc

SEQ ID NO: 622604 - DNA, 14 bp, D. melanogaster
gatgatgatgattt

SEQ ID NO: 622605 - DNA, 13 bp, D. melanogaster
gatgatgatgccg

SEQ ID NO: 622606 - DNA, 13 bp, D. melanogaster
gatgatgatgcga

SEQ ID NO: 622607 - DNA, 14 bp, D. melanogaster
gatgatgatgctga

SEQ ID NO: 622608 - DNA, 14 bp, D. melanogaster
gatgatgatggcaa

SEQ ID NO: 622609 - DNA, 13 bp, D. melanogaster
gatgatgatggcc

SEQ ID NO: 622610 - DNA, 14 bp, D. melanogaster
gatgatgatggcga

SEQ ID NO: 622611 - DNA, 13 bp, D. melanogaster
gatgatgatggga

SEQ ID NO: 622612 - DNA, 13 bp, D. melanogaster
gatgatgatgggc

SEQ ID NO: 622613 - DNA, 13 bp, D. melanogaster
gatgatgatggta

SEQ ID NO: 622614 - DNA, 13 bp, D. melanogaster
gatgatgatgtcg

SEQ ID NO: 622615 - DNA, 13 bp, D. melanogaster
gatgatgatgtgc

SEQ ID NO: 622616 - DNA, 13 bp, D. melanogaster
gatgatgatgtta

SEQ ID NO: 622617 - DNA, 13 bp, D. melanogaster
gatgatgatgttg

SEQ ID NO: 622618 - DNA, 14 bp, D. melanogaster
gatgatgatgttga

SEQ ID NO: 622619 - DNA, 14 bp, D. melanogaster
gatgatgatgttgc

SEQ ID NO: 622620 - DNA, 14 bp, D. melanogaster
gatgatgatgttgg

SEQ ID NO: 622621 - DNA, 13 bp, D. melanogaster
gatgatgattgtg

SEQ ID NO: 622622 - DNA, 13 bp, D. melanogaster
gatgatgctgatg

SEQ ID NO: 622623 - DNA, 13 bp, D. melanogaster
gatgatggcgatg

SEQ ID NO: 622624 - DNA, 13 bp, D. melanogaster
gatgatgtcgatg

SEQ ID NO: 622625 - DNA, 14 bp, D. melanogaster
gatgatgttacccc

SEQ ID NO: 622626 - DNA, 13 bp, D. melanogaster
gatgatgttgctg

SEQ ID NO: 622627 - DNA, 13 bp, D. melanogaster
gatgattatgatg

SEQ ID NO: 622628 - DNA, 14 bp, D. melanogaster
gatgattatgatgt

SEQ ID NO: 622629 - DNA, 13 bp, D. melanogaster
gatgattattatt

SEQ ID NO: 622630 - DNA, 13 bp, D. melanogaster
gatgattcaatta

SEQ ID NO: 622631 - DNA, 14 bp, D. melanogaster
gatgattttccgca

SEQ ID NO: 622632 - DNA, 13 bp, D. melanogaster
gatgattttttaa

SEQ ID NO: 622633 - DNA, 13 bp, D. melanogaster
gatgcaaaaggat

SEQ ID NO: 622634 - DNA, 13 bp, D. melanogaster
gatgcaaaccgta

SEQ ID NO: 622635 - DNA, 13 bp, D. melanogaster
gatgcaaaggaaa

SEQ ID NO: 622636 - DNA, 13 bp, D. melanogaster
gatgcaaatgcaa

SEQ ID NO: 622637 - DNA, 13 bp, D. melanogaster
gatgcaattttcg

SEQ ID NO: 622638 - DNA, 13 bp, D. melanogaster
gatgcacagagaa

SEQ ID NO: 622639 - DNA, 13 bp, D. melanogaster
gatgcactgcaaa

SEQ ID NO: 622640 - DNA, 13 bp, D. melanogaster
gatgcactgcagc

SEQ ID NO: 622641 - DNA, 13 bp, D. melanogaster
gatgcactgcatc

SEQ ID NO: 622642 - DNA, 13 bp, D. melanogaster
gatgcactggaaa

SEQ ID NO: 622643 - DNA, 14 bp, D. melanogaster
gatgcactggaaaa

SEQ ID NO: 622644 - DNA, 13 bp, D. melanogaster
gatgcagatacac

SEQ ID NO: 622645 - DNA, 13 bp, D. melanogaster
gatgcagatgagg

SEQ ID NO: 622646 - DNA, 13 bp, D. melanogaster
gatgcagatgcac

SEQ ID NO: 622647 - DNA, 13 bp, D. melanogaster
gatgcagcaaacg

SEQ ID NO: 622648 - DNA, 13 bp, D. melanogaster
gatgcagctgcaa

SEQ ID NO: 622649 - DNA, 13 bp, D. melanogaster
gatgcagctgcag

SEQ ID NO: 622650 - DNA, 13 bp, D. melanogaster
gatgcagtgcagc

SEQ ID NO: 622651 - DNA, 13 bp, D. melanogaster
gatgcagtgcatc

SEQ ID NO: 622652 - DNA, 14 bp, D. melanogaster
gatgcagttcgccg

SEQ ID NO: 622653 - DNA, 13 bp, D. melanogaster
gatgcagttgcag

SEQ ID NO: 622654 - DNA, 13 bp, D. melanogaster
gatgcagttgctc

SEQ ID NO: 622655 - DNA, 13 bp, D. melanogaster
gatgcattttata

SEQ ID NO: 622656 - DNA, 13 bp, D. melanogaster
gatgcatttttaa

SEQ ID NO: 622657 - DNA, 13 bp, D. melanogaster
gatgcatttttta

SEQ ID NO: 622658 - DNA, 13 bp, D. melanogaster
gatgccaaaaaat

SEQ ID NO: 622659 - DNA, 13 bp, D. melanogaster
gatgccaacgcca

SEQ ID NO: 622660 - DNA, 13 bp, D. melanogaster
gatgccactttgt

SEQ ID NO: 622661 - DNA, 13 bp, D. melanogaster
gatgcccagatac

SEQ ID NO: 622662 - DNA, 13 bp, D. melanogaster
gatgcccgatgcc

SEQ ID NO: 622663 - DNA, 13 bp, D. melanogaster
gatgccgacagtg

SEQ ID NO: 622664 - DNA, 13 bp, D. melanogaster
gatgccgatgatg

SEQ ID NO: 622665 - DNA, 14 bp, D. melanogaster
gatgccgatgatga

SEQ ID NO: 622666 - DNA, 13 bp, D. melanogaster
gatgccgatgcca

SEQ ID NO: 622667 - DNA, 13 bp, D. melanogaster
gatgccgatgctg

SEQ ID NO: 622668 - DNA, 15 bp, D. melanogaster
gatgcctttttttgg

SEQ ID NO: 622669 - DNA, 13 bp, D. melanogaster
gatgcgatacgat

SEQ ID NO: 622670 - DNA, 13 bp, D. melanogaster
gatgcgatccgat

SEQ ID NO: 622671 - DNA, 13 bp, D. melanogaster
gatgcgatgcgat

SEQ ID NO: 622672 - DNA, 14 bp, D. melanogaster
gatgcgatgcgatg

SEQ ID NO: 622673 - DNA, 14 bp, D. melanogaster
gatgcggatgagga

SEQ ID NO: 622674 - DNA, 13 bp, D. melanogaster
gatgcggatgcag

SEQ ID NO: 622675 - DNA, 14 bp, D. melanogaster
gatgcggatgcgga

SEQ ID NO: 622676 - DNA, 13 bp, D. melanogaster
gatgcgtgtgtgt

SEQ ID NO: 622677 - DNA, 14 bp, D. melanogaster
gatgctaaatctgc

SEQ ID NO: 622678 - DNA, 13 bp, D. melanogaster
gatgctcggatgc

SEQ ID NO: 622679 - DNA, 13 bp, D. melanogaster
gatgctgatgatg

SEQ ID NO: 622680 - DNA, 14 bp, D. melanogaster
gatgctgatgatga

SEQ ID NO: 622681 - DNA, 13 bp, D. melanogaster
gatgctgatgcag

SEQ ID NO: 622682 - DNA, 13 bp, D. melanogaster
gatgctgatgccg

SEQ ID NO: 622683 - DNA, 13 bp, D. melanogaster
gatgctgatgcgg

SEQ ID NO: 622684 - DNA, 14 bp, D. melanogaster
gatgctgatgctgc

SEQ ID NO: 622685 - DNA, 13 bp, D. melanogaster
gatgctgatggtg

SEQ ID NO: 622686 - DNA, 13 bp, D. melanogaster
gatgctgctgatg

SEQ ID NO: 622687 - DNA, 13 bp, D. melanogaster
gatgctgctgatt

SEQ ID NO: 622688 - DNA, 14 bp, D. melanogaster
gatgctgctgattg

SEQ ID NO: 622689 - DNA, 13 bp, D. melanogaster
gatgctgctgcca

SEQ ID NO: 622690 - DNA, 14 bp, D. melanogaster
gatgctgctgctga

SEQ ID NO: 622691 - DNA, 14 bp, D. melanogaster
gatgctgctgctgt

SEQ ID NO: 622692 - DNA, 13 bp, D. melanogaster
gatgctgcttctg

SEQ ID NO: 622693 - DNA, 13 bp, D. melanogaster
gatgctgggatgc

SEQ ID NO: 622694 - DNA, 13 bp, D. melanogaster
gatgctgtaaatg

SEQ ID NO: 622695 - DNA, 13 bp, D. melanogaster
gatgctgttgctg

SEQ ID NO: 622696 - DNA, 14 bp, D. melanogaster
gatgctgttgctgc

SEQ ID NO: 622697 - DNA, 13 bp, D. melanogaster
gatgcttctggcg

SEQ ID NO: 622698 - DNA, 13 bp, D. melanogaster
gatgctttcttca

SEQ ID NO: 622699 - DNA, 13 bp, D. melanogaster
gatggaaaaacat

SEQ ID NO: 622700 - DNA, 13 bp, D. melanogaster
gatggaaaacaaa

SEQ ID NO: 622701 - DNA, 13 bp, D. melanogaster
gatggaaaagttt

SEQ ID NO: 622702 - DNA, 13 bp, D. melanogaster
gatggaaaatgga

SEQ ID NO: 622703 - DNA, 13 bp, D. melanogaster
gatggaaaatttt

SEQ ID NO: 622704 - DNA, 13 bp, D. melanogaster
gatggaaatgaaa

SEQ ID NO: 622705 - DNA, 14 bp, D. melanogaster
gatggaaatggaaa

SEQ ID NO: 622706 - DNA, 13 bp, D. melanogaster
gatggaaatgtaa

SEQ ID NO: 622707 - DNA, 14 bp, D. melanogaster
gatggaatccactt

SEQ ID NO: 622708 - DNA, 13 bp, D. melanogaster
gatggaatccaga

SEQ ID NO: 622709 - DNA, 13 bp, D. melanogaster
gatggaatttatg

SEQ ID NO: 622710 - DNA, 13 bp, D. melanogaster
gatggacgatgga

SEQ ID NO: 622711 - DNA, 13 bp, D. melanogaster
gatggactgaaag

SEQ ID NO: 622712 - DNA, 13 bp, D. melanogaster
gatggagatgaag

SEQ ID NO: 622713 - DNA, 14 bp, D. melanogaster
gatggagatgaaga

SEQ ID NO: 622714 - DNA, 13 bp, D. melanogaster
gatggagatgcag

SEQ ID NO: 622715 - DNA, 13 bp, D. melanogaster
gatggagatggag

SEQ ID NO: 622716 - DNA, 13 bp, D. melanogaster
gatggagatggcg

SEQ ID NO: 622717 - DNA, 13 bp, D. melanogaster
gatggagcagcag

SEQ ID NO: 622718 - DNA, 13 bp, D. melanogaster
gatggagctgctc

SEQ ID NO: 622719 - DNA, 13 bp, D. melanogaster
gatggagttggag

SEQ ID NO: 622720 - DNA, 13 bp, D. melanogaster
gatggatagatgg

SEQ ID NO: 622721 - DNA, 14 bp, D. melanogaster
gatggatagatgga

SEQ ID NO: 622722 - DNA, 13 bp, D. melanogaster
gatggatcatcat

SEQ ID NO: 622723 - DNA, 13 bp, D. melanogaster
gatggatggatag

SEQ ID NO: 622724 - DNA, 13 bp, D. melanogaster
gatggatggatgg

SEQ ID NO: 622725 - DNA, 13 bp, D. melanogaster
gatggatggctgg

SEQ ID NO: 622726 - DNA, 13 bp, D. melanogaster
gatggatgggatg

SEQ ID NO: 622727 - DNA, 13 bp, D. melanogaster
gatggatggttga

SEQ ID NO: 622728 - DNA, 13 bp, D. melanogaster
gatggatgtggat

SEQ ID NO: 622729 - DNA, 14 bp, D. melanogaster
gatggatgtggatg

SEQ ID NO: 622730 - DNA, 14 bp, D. melanogaster
gatggattgcaatg

SEQ ID NO: 622731 - DNA, 13 bp, D. melanogaster
gatggcaaaaagg

SEQ ID NO: 622732 - DNA, 13 bp, D. melanogaster
gatggcaaaagga

SEQ ID NO: 622733 - DNA, 13 bp, D. melanogaster
gatggcaaaagtg

SEQ ID NO: 622734 - DNA, 13 bp, D. melanogaster
gatggcaaacaaa

SEQ ID NO: 622735 - DNA, 13 bp, D. melanogaster
gatggcaaatcaa

SEQ ID NO: 622736 - DNA, 13 bp, D. melanogaster
gatggcaagaatg

SEQ ID NO: 622737 - DNA, 13 bp, D. melanogaster
gatggcaatggcg

SEQ ID NO: 622738 - DNA, 14 bp, D. melanogaster
gatggcaatggcga

SEQ ID NO: 622739 - DNA, 13 bp, D. melanogaster
gatggcagcgtga

SEQ ID NO: 622740 - DNA, 13 bp, D. melanogaster
gatggcatagaaa

SEQ ID NO: 622741 - DNA, 13 bp, D. melanogaster
gatggcatagctc

SEQ ID NO: 622742 - DNA, 13 bp, D. melanogaster
gatggcattttta

SEQ ID NO: 622743 - DNA, 13 bp, D. melanogaster
gatggccaaaagc

SEQ ID NO: 622744 - DNA, 14 bp, D. melanogaster
gatggccaacagag

SEQ ID NO: 622745 - DNA, 13 bp, D. melanogaster
gatggccaagaat

SEQ ID NO: 622746 - DNA, 13 bp, D. melanogaster
gatggccagcaaa

SEQ ID NO: 622747 - DNA, 13 bp, D. melanogaster
gatggccagtatg

SEQ ID NO: 622748 - DNA, 13 bp, D. melanogaster
gatggcccaaaaa

SEQ ID NO: 622749 - DNA, 13 bp, D. melanogaster
gatggccgatggc

SEQ ID NO: 622750 - DNA, 13 bp, D. melanogaster
gatggcgagaagt

SEQ ID NO: 622751 - DNA, 13 bp, D. melanogaster
gatggcgagatgg

SEQ ID NO: 622752 - DNA, 13 bp, D. melanogaster
gatggcgatagtg

SEQ ID NO: 622753 - DNA, 13 bp, D. melanogaster
gatggcgatggag

SEQ ID NO: 622754 - DNA, 14 bp, D. melanogaster
gatggcgatggaga

SEQ ID NO: 622755 - DNA, 13 bp, D. melanogaster
gatggctcgtacc

SEQ ID NO: 622756 - DNA, 13 bp, D. melanogaster
gatggctgatggc

SEQ ID NO: 622757 - DNA, 13 bp, D. melanogaster
gatggctgcgttt

SEQ ID NO: 622758 - DNA, 13 bp, D. melanogaster
gatggctggctgg

SEQ ID NO: 622759 - DNA, 13 bp, D. melanogaster
gatggcttattgg

SEQ ID NO: 622760 - DNA, 13 bp, D. melanogaster
gatgggaaatcaa

SEQ ID NO: 622761 - DNA, 13 bp, D. melanogaster
gatgggaatggaa

SEQ ID NO: 622762 - DNA, 14 bp, D. melanogaster
gatgggatatttaa

SEQ ID NO: 622763 - DNA, 13 bp, D. melanogaster
gatgggatgggat

SEQ ID NO: 622764 - DNA, 14 bp, D. melanogaster
gatgggatgggatg

SEQ ID NO: 622765 - DNA, 13 bp, D. melanogaster
gatgggattggat

SEQ ID NO: 622766 - DNA, 13 bp, D. melanogaster
gatgggcaaaaga

SEQ ID NO: 622767 - DNA, 13 bp, D. melanogaster
gatgggcggaaaa

SEQ ID NO: 622768 - DNA, 13 bp, D. melanogaster
gatgggctgatgg

SEQ ID NO: 622769 - DNA, 14 bp, D. melanogaster
gatggggatgtgga

SEQ ID NO: 622770 - DNA, 14 bp, D. melanogaster
gatggtgatggcga

SEQ ID NO: 622771 - DNA, 13 bp, D. melanogaster
gatggtgatggtg

SEQ ID NO: 622772 - DNA, 13 bp, D. melanogaster
gatggtgatgttg

SEQ ID NO: 622773 - DNA, 13 bp, D. melanogaster
gatggtgctgatg

SEQ ID NO: 622774 - DNA, 13 bp, D. melanogaster
gatggtggaaaat

SEQ ID NO: 622775 - DNA, 13 bp, D. melanogaster
gatggtgtgcgtg

SEQ ID NO: 622776 - DNA, 13 bp, D. melanogaster
gatgtaatatata

SEQ ID NO: 622777 - DNA, 13 bp, D. melanogaster
gatgtaatttaaa

SEQ ID NO: 622778 - DNA, 13 bp, D. melanogaster
gatgtacatatac

SEQ ID NO: 622779 - DNA, 13 bp, D. melanogaster
gatgtacatatgt

SEQ ID NO: 622780 - DNA, 14 bp, D. melanogaster
gatgtacatatgta

SEQ ID NO: 622781 - DNA, 13 bp, D. melanogaster
gatgtactatccg

SEQ ID NO: 622782 - DNA, 13 bp, D. melanogaster
gatgtactttaga

SEQ ID NO: 622783 - DNA, 13 bp, D. melanogaster
gatgtagatgtag

SEQ ID NO: 622784 - DNA, 13 bp, D. melanogaster
gatgtagatgtgg

SEQ ID NO: 622785 - DNA, 14 bp, D. melanogaster
gatgtatgtacata

SEQ ID NO: 622786 - DNA, 13 bp, D. melanogaster
gatgtatgtatgt

SEQ ID NO: 622787 - DNA, 13 bp, D. melanogaster
gatgtatgtgtgt

SEQ ID NO: 622788 - DNA, 13 bp, D. melanogaster
gatgtcaatattg

SEQ ID NO: 622789 - DNA, 13 bp, D. melanogaster
gatgtcatctaca

SEQ ID NO: 622790 - DNA, 13 bp, D. melanogaster
gatgtcattcaga

SEQ ID NO: 622791 - DNA, 13 bp, D. melanogaster
gatgtcccaaatt

SEQ ID NO: 622792 - DNA, 13 bp, D. melanogaster
gatgtcctgctgc

SEQ ID NO: 622793 - DNA, 13 bp, D. melanogaster
gatgtcgatgtcg

SEQ ID NO: 622794 - DNA, 14 bp, D. melanogaster
gatgtcgatgtcga

SEQ ID NO: 622795 - DNA, 13 bp, D. melanogaster
gatgtctgtgggc

SEQ ID NO: 622796 - DNA, 13 bp, D. melanogaster
gatgtctttgggc

SEQ ID NO: 622797 - DNA, 13 bp, D. melanogaster
gatgtgaatgtga

SEQ ID NO: 622798 - DNA, 14 bp, D. melanogaster
gatgtgaatgtgaa

SEQ ID NO: 622799 - DNA, 13 bp, D. melanogaster
gatgtgaatgtgg

SEQ ID NO: 622800 - DNA, 13 bp, D. melanogaster
gatgtgcaaaaaa

SEQ ID NO: 622801 - DNA, 13 bp, D. melanogaster
gatgtgcctgctg

SEQ ID NO: 622802 - DNA, 13 bp, D. melanogaster
gatgtgcttaaag

SEQ ID NO: 622803 - DNA, 13 bp, D. melanogaster
gatgtggaaatgg

SEQ ID NO: 622804 - DNA, 13 bp, D. melanogaster
gatgtggaagtgg

SEQ ID NO: 622805 - DNA, 13 bp, D. melanogaster
gatgtggacgatg

SEQ ID NO: 622806 - DNA, 13 bp, D. melanogaster
gatgtggatgcgg

SEQ ID NO: 622807 - DNA, 14 bp, D. melanogaster
gatgtggatgggga

SEQ ID NO: 622808 - DNA, 13 bp, D. melanogaster
gatgtggatgtgg

SEQ ID NO: 622809 - DNA, 13 bp, D. melanogaster
gatgtggatgtgt

SEQ ID NO: 622810 - DNA, 13 bp, D. melanogaster
gatgtggatgttg

SEQ ID NO: 622811 - DNA, 13 bp, D. melanogaster
gatgtggcaatca

SEQ ID NO: 622812 - DNA, 14 bp, D. melanogaster
gatgtggcaatcac

SEQ ID NO: 622813 - DNA, 14 bp, D. melanogaster
gatgtggccaagga

SEQ ID NO: 622814 - DNA, 13 bp, D. melanogaster
gatgtgtcaaaaa

SEQ ID NO: 622815 - DNA, 13 bp, D. melanogaster
gatgtgttcggac

SEQ ID NO: 622816 - DNA, 13 bp, D. melanogaster
gatgttaatgttt

SEQ ID NO: 622817 - DNA, 13 bp, D. melanogaster
gatgttgaaaaaa

SEQ ID NO: 622818 - DNA, 13 bp, D. melanogaster
gatgttgagcctc

SEQ ID NO: 622819 - DNA, 13 bp, D. melanogaster
gatgttgatgtgg

SEQ ID NO: 622820 - DNA, 13 bp, D. melanogaster
gatgttgatgttg

SEQ ID NO: 622821 - DNA, 14 bp, D. melanogaster
gatgttgatgttga

SEQ ID NO: 622822 - DNA, 13 bp, D. melanogaster
gatgttgcacaag

SEQ ID NO: 622823 - DNA, 14 bp, D. melanogaster
gatgttgcacaaga

SEQ ID NO: 622824 - DNA, 13 bp, D. melanogaster
gatgttgcagttt

SEQ ID NO: 622825 - DNA, 13 bp, D. melanogaster
gatgttgccgctg

SEQ ID NO: 622826 - DNA, 14 bp, D. melanogaster
gatgttgccgctgc

SEQ ID NO: 622827 - DNA, 13 bp, D. melanogaster
gatgttgctgatg

SEQ ID NO: 622828 - DNA, 13 bp, D. melanogaster
gatgttgctgctc

SEQ ID NO: 622829 - DNA, 14 bp, D. melanogaster
gatgttgctgctgc

SEQ ID NO: 622830 - DNA, 14 bp, D. melanogaster
gatgttgctgctgg

SEQ ID NO: 622831 - DNA, 13 bp, D. melanogaster
gatgttggataat

SEQ ID NO: 622832 - DNA, 13 bp, D. melanogaster
gatgttggatgtt

SEQ ID NO: 622833 - DNA, 13 bp, D. melanogaster
gatgttgttgctg

SEQ ID NO: 622834 - DNA, 14 bp, D. melanogaster
gatgttgttgctgc

SEQ ID NO: 622835 - DNA, 13 bp, D. melanogaster
gatgttgttgtcg

SEQ ID NO: 622836 - DNA, 13 bp, D. melanogaster
gatgtttaacatt

SEQ ID NO: 622837 - DNA, 13 bp, D. melanogaster
gatgtttgttctt

SEQ ID NO: 622838 - DNA, 13 bp, D. melanogaster
gatgtttttaaat

SEQ ID NO: 622839 - DNA, 13 bp, D. melanogaster
gatgttttttaaa

SEQ ID NO: 622840 - DNA, 13 bp, D. melanogaster
gattaaaaatcaa

SEQ ID NO: 622841 - DNA, 13 bp, D. melanogaster
gattaaaaatctg

SEQ ID NO: 622842 - DNA, 13 bp, D. melanogaster
gattaaaactaaa

SEQ ID NO: 622843 - DNA, 13 bp, D. melanogaster
gattaaatagttt

SEQ ID NO: 622844 - DNA, 13 bp, D. melanogaster
gattaaatgtatt

SEQ ID NO: 622845 - DNA, 13 bp, D. melanogaster
gattaaattgaaa

SEQ ID NO: 622846 - DNA, 13 bp, D. melanogaster
gattaaatttgat

SEQ ID NO: 622847 - DNA, 13 bp, D. melanogaster
gattaaattttga

SEQ ID NO: 622848 - DNA, 13 bp, D. melanogaster
gattaacatttaa

SEQ ID NO: 622849 - DNA, 13 bp, D. melanogaster
gattaacatttta

SEQ ID NO: 622850 - DNA, 13 bp, D. melanogaster
gattaacggattg

SEQ ID NO: 622851 - DNA, 13 bp, D. melanogaster
gattaacttttga

SEQ ID NO: 622852 - DNA, 13 bp, D. melanogaster
gattaagcgaata

SEQ ID NO: 622853 - DNA, 13 bp, D. melanogaster
gattaaggaaaat

SEQ ID NO: 622854 - DNA, 13 bp, D. melanogaster
gattaagttgctc

SEQ ID NO: 622855 - DNA, 13 bp, D. melanogaster
gattaataaattg

SEQ ID NO: 622856 - DNA, 13 bp, D. melanogaster
gattaataacaat

SEQ ID NO: 622857 - DNA, 14 bp, D. melanogaster
gattaataataaca

SEQ ID NO: 622858 - DNA, 13 bp, D. melanogaster
gattaattaattg

SEQ ID NO: 622859 - DNA, 13 bp, D. melanogaster
gattaattgatta

SEQ ID NO: 622860 - DNA, 13 bp, D. melanogaster
gattaatttgatt

SEQ ID NO: 622861 - DNA, 13 bp, D. melanogaster
gattacaattatg

SEQ ID NO: 622862 - DNA, 13 bp, D. melanogaster
gattacagataat

SEQ ID NO: 622863 - DNA, 13 bp, D. melanogaster
gattacgacggca

SEQ ID NO: 622864 - DNA, 13 bp, D. melanogaster
gattacgcaggtc

SEQ ID NO: 622865 - DNA, 13 bp, D. melanogaster
gattagattagat

SEQ ID NO: 622866 - DNA, 13 bp, D. melanogaster
gattagcgaaatg

SEQ ID NO: 622867 - DNA, 13 bp, D. melanogaster
gattagtttacca

SEQ ID NO: 622868 - DNA, 14 bp, D. melanogaster
gattagtttaccac

SEQ ID NO: 622869 - DNA, 13 bp, D. melanogaster
gattagttttgat

SEQ ID NO: 622870 - DNA, 14 bp, D. melanogaster
gattagttttgatg

SEQ ID NO: 622871 - DNA, 13 bp, D. melanogaster
gattatagaaaac

SEQ ID NO: 622872 - DNA, 13 bp, D. melanogaster
gattatattgtgg

SEQ ID NO: 622873 - DNA, 13 bp, D. melanogaster
gattatcgccaaa

SEQ ID NO: 622874 - DNA, 13 bp, D. melanogaster
gattatgattata

SEQ ID NO: 622875 - DNA, 14 bp, D. melanogaster
gattatgattatga

SEQ ID NO: 622876 - DNA, 14 bp, D. melanogaster
gattatgattatta

SEQ ID NO: 622877 - DNA, 13 bp, D. melanogaster
gattattaaaaac

SEQ ID NO: 622878 - DNA, 14 bp, D. melanogaster
gattattatgatta

SEQ ID NO: 622879 - DNA, 13 bp, D. melanogaster
gattatttattga

SEQ ID NO: 622880 - DNA, 13 bp, D. melanogaster
gattatttttcat

SEQ ID NO: 622881 - DNA, 13 bp, D. melanogaster
gattcaaataaaa

SEQ ID NO: 622882 - DNA, 13 bp, D. melanogaster
gattcaacttctt

SEQ ID NO: 622883 - DNA, 13 bp, D. melanogaster
gattcaatgacaa

SEQ ID NO: 622884 - DNA, 13 bp, D. melanogaster
gattcaatgagat

SEQ ID NO: 622885 - DNA, 13 bp, D. melanogaster
gattcaattcgat

SEQ ID NO: 622886 - DNA, 14 bp, D. melanogaster
gattcaattcgatt

SEQ ID NO: 622887 - DNA, 14 bp, D. melanogaster
gattcactcaaaaa

SEQ ID NO: 622888 - DNA, 13 bp, D. melanogaster
gattcagaatcag

SEQ ID NO: 622889 - DNA, 13 bp, D. melanogaster
gattcagatccag

SEQ ID NO: 622890 - DNA, 13 bp, D. melanogaster
gattcagatgggc

SEQ ID NO: 622891 - DNA, 13 bp, D. melanogaster
gattcagcataca

SEQ ID NO: 622892 - DNA, 13 bp, D. melanogaster
gattcaggattca

SEQ ID NO: 622893 - DNA, 13 bp, D. melanogaster
gattcagttcgcg

SEQ ID NO: 622894 - DNA, 13 bp, D. melanogaster
gattcatattata

SEQ ID NO: 622895 - DNA, 13 bp, D. melanogaster
gattcatgtaacg

SEQ ID NO: 622896 - DNA, 13 bp, D. melanogaster
gattccaattccg

SEQ ID NO: 622897 - DNA, 13 bp, D. melanogaster
gattccaccggcg

SEQ ID NO: 622898 - DNA, 13 bp, D. melanogaster
gattccatcaaat

SEQ ID NO: 622899 - DNA, 14 bp, D. melanogaster
gattccatcagata

SEQ ID NO: 622900 - DNA, 15 bp, D. melanogaster
gattccatgccaacg

SEQ ID NO: 622901 - DNA, 13 bp, D. melanogaster
gattcccattccc

SEQ ID NO: 622902 - DNA, 13 bp, D. melanogaster
gattcccgattcc

SEQ ID NO: 622903 - DNA, 13 bp, D. melanogaster
gattccgaatccg

SEQ ID NO: 622904 - DNA, 14 bp, D. melanogaster
gattccgaatccga

SEQ ID NO: 622905 - DNA, 14 bp, D. melanogaster
gattccgattcaga

SEQ ID NO: 622906 - DNA, 13 bp, D. melanogaster
gattccgattcca

SEQ ID NO: 622907 - DNA, 14 bp, D. melanogaster
gattccgattccaa

SEQ ID NO: 622908 - DNA, 13 bp, D. melanogaster
gattccgattccc

SEQ ID NO: 622909 - DNA, 13 bp, D. melanogaster
gattccgattcct

SEQ ID NO: 622910 - DNA, 13 bp, D. melanogaster
gattccgattctg

SEQ ID NO: 622911 - DNA, 13 bp, D. melanogaster
gattccgatttcg

SEQ ID NO: 622912 - DNA, 14 bp, D. melanogaster
gattccgatttcga

SEQ ID NO: 622913 - DNA, 13 bp, D. melanogaster
gattcctctcaaa

SEQ ID NO: 622914 - DNA, 13 bp, D. melanogaster
gattcctcttcat

SEQ ID NO: 622915 - DNA, 13 bp, D. melanogaster
gattcctgatctg

SEQ ID NO: 622916 - DNA, 13 bp, D. melanogaster
gattccttcgcag

SEQ ID NO: 622917 - DNA, 13 bp, D. melanogaster
gattcctttaagc

SEQ ID NO: 622918 - DNA, 13 bp, D. melanogaster
gattcgaatattc

SEQ ID NO: 622919 - DNA, 13 bp, D. melanogaster
gattcgaatcgat

SEQ ID NO: 622920 - DNA, 13 bp, D. melanogaster
gattcgattcaat

SEQ ID NO: 622921 - DNA, 13 bp, D. melanogaster
gattcgattcgac

SEQ ID NO: 622922 - DNA, 13 bp, D. melanogaster
gattcgattcgag

SEQ ID NO: 622923 - DNA, 13 bp, D. melanogaster
gattcgattcgat

SEQ ID NO: 622924 - DNA, 14 bp, D. melanogaster
gattcgattcgttt

SEQ ID NO: 622925 - DNA, 13 bp, D. melanogaster
gattcgattggat

SEQ ID NO: 622926 - DNA, 14 bp, D. melanogaster
gattcgattggatt

SEQ ID NO: 622927 - DNA, 14 bp, D. melanogaster
gattcgatttcgat

SEQ ID NO: 622928 - DNA, 13 bp, D. melanogaster
gattcgatttgat

SEQ ID NO: 622929 - DNA, 13 bp, D. melanogaster
gattcgattttat

SEQ ID NO: 622930 - DNA, 13 bp, D. melanogaster
gattcgctgaaaa

SEQ ID NO: 622931 - DNA, 13 bp, D. melanogaster
gattcggaatcgg

SEQ ID NO: 622932 - DNA, 13 bp, D. melanogaster
gattcggactcgg

SEQ ID NO: 622933 - DNA, 13 bp, D. melanogaster
gattcggatacgg

SEQ ID NO: 622934 - DNA, 14 bp, D. melanogaster
gattcggatacgga

SEQ ID NO: 622935 - DNA, 13 bp, D. melanogaster
gattcggatgcgg

SEQ ID NO: 622936 - DNA, 14 bp, D. melanogaster
gattcggatgcgga

SEQ ID NO: 622937 - DNA, 13 bp, D. melanogaster
gattcggattcag

SEQ ID NO: 622938 - DNA, 14 bp, D. melanogaster
gattcggattcaga

SEQ ID NO: 622939 - DNA, 13 bp, D. melanogaster
gattcggattcga

SEQ ID NO: 622940 - DNA, 13 bp, D. melanogaster
gattcggattcgg

SEQ ID NO: 622941 - DNA, 14 bp, D. melanogaster
gattcggattcgga

SEQ ID NO: 622942 - DNA, 13 bp, D. melanogaster
gattcggattctg

SEQ ID NO: 622943 - DNA, 14 bp, D. melanogaster
gattcggattggga

SEQ ID NO: 622944 - DNA, 13 bp, D. melanogaster
gattcgggggttc

SEQ ID NO: 622945 - DNA, 13 bp, D. melanogaster
gattcgggttcgg

SEQ ID NO: 622946 - DNA, 13 bp, D. melanogaster
gattcggttttgg

SEQ ID NO: 622947 - DNA, 13 bp, D. melanogaster
gattcggtttttg

SEQ ID NO: 622948 - DNA, 13 bp, D. melanogaster
gattcgttaaaaa

SEQ ID NO: 622949 - DNA, 13 bp, D. melanogaster
gattcgttgaaag

SEQ ID NO: 622950 - DNA, 14 bp, D. melanogaster
gattcgtttcgatt

SEQ ID NO: 622951 - DNA, 13 bp, D. melanogaster
gattcgtttcgtt

SEQ ID NO: 622952 - DNA, 13 bp, D. melanogaster
gattcgttttatt

SEQ ID NO: 622953 - DNA, 13 bp, D. melanogaster
gattctaaattca

SEQ ID NO: 622954 - DNA, 13 bp, D. melanogaster
gattctattaaat

SEQ ID NO: 622955 - DNA, 13 bp, D. melanogaster
gattctcctacac

SEQ ID NO: 622956 - DNA, 13 bp, D. melanogaster
gattctcgattct

SEQ ID NO: 622957 - DNA, 13 bp, D. melanogaster
gattctgagaacc

SEQ ID NO: 622958 - DNA, 14 bp, D. melanogaster
gattctgattccga

SEQ ID NO: 622959 - DNA, 13 bp, D. melanogaster
gattctgattcgg

SEQ ID NO: 622960 - DNA, 14 bp, D. melanogaster
gattctgattcgga

SEQ ID NO: 622961 - DNA, 13 bp, D. melanogaster
gattctgattggg

SEQ ID NO: 622962 - DNA, 14 bp, D. melanogaster
gattctgattgggc

SEQ ID NO: 622963 - DNA, 13 bp, D. melanogaster
gattctgattttg

SEQ ID NO: 622964 - DNA, 14 bp, D. melanogaster
gattctgcagttgc

SEQ ID NO: 622965 - DNA, 13 bp, D. melanogaster
gattctgcccgcc

SEQ ID NO: 622966 - DNA, 13 bp, D. melanogaster
gattctggattct

SEQ ID NO: 622967 - DNA, 13 bp, D. melanogaster
gattctgtgcgga

SEQ ID NO: 622968 - DNA, 13 bp, D. melanogaster
gattctgtttctg

SEQ ID NO: 622969 - DNA, 13 bp, D. melanogaster
gattgaaataaat

SEQ ID NO: 622970 - DNA, 13 bp, D. melanogaster
gattgaaatcgaa

SEQ ID NO: 622971 - DNA, 13 bp, D. melanogaster
gattgaattgaat

SEQ ID NO: 622972 - DNA, 13 bp, D. melanogaster
gattgaattggat

SEQ ID NO: 622973 - DNA, 13 bp, D. melanogaster
gattgaccaaatg

SEQ ID NO: 622974 - DNA, 13 bp, D. melanogaster
gattgagattcag

SEQ ID NO: 622975 - DNA, 13 bp, D. melanogaster
gattgagcttgaa

SEQ ID NO: 622976 - DNA, 14 bp, D. melanogaster
gattgatacgtttg

SEQ ID NO: 622977 - DNA, 15 bp, D. melanogaster
gattgatattaatca

SEQ ID NO: 622978 - DNA, 13 bp, D. melanogaster
gattgatattgat

SEQ ID NO: 622979 - DNA, 13 bp, D. melanogaster
gattgatggattg

SEQ ID NO: 622980 - DNA, 13 bp, D. melanogaster
gattgatggccaa

SEQ ID NO: 622981 - DNA, 13 bp, D. melanogaster
gattgattgatga

SEQ ID NO: 622982 - DNA, 14 bp, D. melanogaster
gattgattgattga

SEQ ID NO: 622983 - DNA, 14 bp, D. melanogaster
gattgattggcatt

SEQ ID NO: 622984 - DNA, 13 bp, D. melanogaster
gattgattgtttg

SEQ ID NO: 622985 - DNA, 13 bp, D. melanogaster
gattgatttaaaa

SEQ ID NO: 622986 - DNA, 13 bp, D. melanogaster
gattgattttgat

SEQ ID NO: 622987 - DNA, 13 bp, D. melanogaster
gattgcaaataaa

SEQ ID NO: 622988 - DNA, 13 bp, D. melanogaster
gattgcaatattt

SEQ ID NO: 622989 - DNA, 13 bp, D. melanogaster
gattgcaatgaaa

SEQ ID NO: 622990 - DNA, 14 bp, D. melanogaster
gattgcaatgaaaa

SEQ ID NO: 622991 - DNA, 13 bp, D. melanogaster
gattgcagaatgt

SEQ ID NO: 622992 - DNA, 13 bp, D. melanogaster
gattgcagcgcag

SEQ ID NO: 622993 - DNA, 13 bp, D. melanogaster
gattgcagtggcc

SEQ ID NO: 622994 - DNA, 13 bp, D. melanogaster
gattgcatttaaa

SEQ ID NO: 622995 - DNA, 13 bp, D. melanogaster
gattgcatttaat

SEQ ID NO: 622996 - DNA, 13 bp, D. melanogaster
gattgcattttta

SEQ ID NO: 622997 - DNA, 13 bp, D. melanogaster
gattgccattctc

SEQ ID NO: 622998 - DNA, 14 bp, D. melanogaster
gattgccatttggc

SEQ ID NO: 622999 - DNA, 13 bp, D. melanogaster
gattgcccacatt

SEQ ID NO: 623000 - DNA, 13 bp, D. melanogaster
gattgcccccgca

SEQ ID NO: 623001 - DNA, 13 bp, D. melanogaster
gattgcccttttt

SEQ ID NO: 623002 - DNA, 13 bp, D. melanogaster
gattgccgcaaac

SEQ ID NO: 623003 - DNA, 14 bp, D. melanogaster
gattgccgcaaact

SEQ ID NO: 623004 - DNA, 13 bp, D. melanogaster
gattgcgattgcg

SEQ ID NO: 623005 - DNA, 13 bp, D. melanogaster
gattgcgattgtg

SEQ ID NO: 623006 - DNA, 13 bp, D. melanogaster
gattgctgatttt

SEQ ID NO: 623007 - DNA, 14 bp, D. melanogaster
gattgctgattttg

SEQ ID NO: 623008 - DNA, 13 bp, D. melanogaster
gattggaaaatat

SEQ ID NO: 623009 - DNA, 13 bp, D. melanogaster
gattggaaatgtg

SEQ ID NO: 623010 - DNA, 13 bp, D. melanogaster
gattggaaattta

SEQ ID NO: 623011 - DNA, 13 bp, D. melanogaster
gattggaacgccg

SEQ ID NO: 623012 - DNA, 13 bp, D. melanogaster
gattggaattgga

SEQ ID NO: 623013 - DNA, 13 bp, D. melanogaster
gattggatgggat

SEQ ID NO: 623014 - DNA, 13 bp, D. melanogaster
gattggatgttta

SEQ ID NO: 623015 - DNA, 13 bp, D. melanogaster
gattggattggaa

SEQ ID NO: 623016 - DNA, 13 bp, D. melanogaster
gattggattggct

SEQ ID NO: 623017 - DNA, 13 bp, D. melanogaster
gattggattggtt

SEQ ID NO: 623018 - DNA, 13 bp, D. melanogaster
gattggcaaaaaa

SEQ ID NO: 623019 - DNA, 13 bp, D. melanogaster
gattggcaatgtg

SEQ ID NO: 623020 - DNA, 14 bp, D. melanogaster
gattggctgctatt

SEQ ID NO: 623021 - DNA, 13 bp, D. melanogaster
gattgggaatggg

SEQ ID NO: 623022 - DNA, 14 bp, D. melanogaster
gattgggaatttaa

SEQ ID NO: 623023 - DNA, 13 bp, D. melanogaster
gattgggacattt

SEQ ID NO: 623024 - DNA, 14 bp, D. melanogaster
gattgggattgggc

SEQ ID NO: 623025 - DNA, 13 bp, D. melanogaster
gattgggcaaagc

SEQ ID NO: 623026 - DNA, 13 bp, D. melanogaster
gattgggcgtggc

SEQ ID NO: 623027 - DNA, 13 bp, D. melanogaster
gattggtcgtctt

SEQ ID NO: 623028 - DNA, 13 bp, D. melanogaster
gattggtggttga

SEQ ID NO: 623029 - DNA, 13 bp, D. melanogaster
gattgtatgtttc

SEQ ID NO: 623030 - DNA, 13 bp, D. melanogaster
gattgtattgatt

SEQ ID NO: 623031 - DNA, 13 bp, D. melanogaster
gattgtcgataac

SEQ ID NO: 623032 - DNA, 13 bp, D. melanogaster
gattgtgattgtg

SEQ ID NO: 623033 - DNA, 13 bp, D. melanogaster
gattgtggaacgc

SEQ ID NO: 623034 - DNA, 13 bp, D. melanogaster
gattgtgtgtctg

SEQ ID NO: 623035 - DNA, 13 bp, D. melanogaster
gattgttacagct

SEQ ID NO: 623036 - DNA, 13 bp, D. melanogaster
gattgttatttaa

SEQ ID NO: 623037 - DNA, 13 bp, D. melanogaster
gattgttgagttc

SEQ ID NO: 623038 - DNA, 13 bp, D. melanogaster
gattgtttcggag

SEQ ID NO: 623039 - DNA, 13 bp, D. melanogaster
gattgttttcaat

SEQ ID NO: 623040 - DNA, 13 bp, D. melanogaster
gattgttttcaga

SEQ ID NO: 623041 - DNA, 13 bp, D. melanogaster
gattgttttcatt

SEQ ID NO: 623042 - DNA, 13 bp, D. melanogaster
gattgttttcgag

SEQ ID NO: 623043 - DNA, 13 bp, D. melanogaster
gatttaaaacaaa

SEQ ID NO: 623044 - DNA, 13 bp, D. melanogaster
gatttaaaatact

SEQ ID NO: 623045 - DNA, 13 bp, D. melanogaster
gatttaaaatgca

SEQ ID NO: 623046 - DNA, 13 bp, D. melanogaster
gatttaaacaaat

SEQ ID NO: 623047 - DNA, 13 bp, D. melanogaster
gatttaaacatga

SEQ ID NO: 623048 - DNA, 14 bp, D. melanogaster
gatttaaacatgaa

SEQ ID NO: 623049 - DNA, 13 bp, D. melanogaster
gatttaaaccaag

SEQ ID NO: 623050 - DNA, 13 bp, D. melanogaster
gatttaaagattt

SEQ ID NO: 623051 - DNA, 13 bp, D. melanogaster
gatttaaatcgtt

SEQ ID NO: 623052 - DNA, 14 bp, D. melanogaster
gatttaaatgcaaa

SEQ ID NO: 623053 - DNA, 13 bp, D. melanogaster
gatttaaatgcat

SEQ ID NO: 623054 - DNA, 13 bp, D. melanogaster
gatttaaatgttt

SEQ ID NO: 623055 - DNA, 13 bp, D. melanogaster
gatttaaatttgt

SEQ ID NO: 623056 - DNA, 13 bp, D. melanogaster
gatttaagaataa

SEQ ID NO: 623057 - DNA, 13 bp, D. melanogaster
gatttaataaaga

SEQ ID NO: 623058 - DNA, 13 bp, D. melanogaster
gatttaatagatt

SEQ ID NO: 623059 - DNA, 13 bp, D. melanogaster
gatttaatataca

SEQ ID NO: 623060 - DNA, 13 bp, D. melanogaster
gatttaatattga

SEQ ID NO: 623061 - DNA, 13 bp, D. melanogaster
gatttaatgcatt

SEQ ID NO: 623062 - DNA, 13 bp, D. melanogaster
gatttaattacaa

SEQ ID NO: 623063 - DNA, 14 bp, D. melanogaster
gatttaattgcggt

SEQ ID NO: 623064 - DNA, 13 bp, D. melanogaster
gatttaattgctt

SEQ ID NO: 623065 - DNA, 13 bp, D. melanogaster
gatttaatttgat

SEQ ID NO: 623066 - DNA, 13 bp, D. melanogaster
gatttaattttac

SEQ ID NO: 623067 - DNA, 13 bp, D. melanogaster
gatttaccaaaaa

SEQ ID NO: 623068 - DNA, 13 bp, D. melanogaster
gatttacttaacc

SEQ ID NO: 623069 - DNA, 14 bp, D. melanogaster
gatttagatcaatt

SEQ ID NO: 623070 - DNA, 13 bp, D. melanogaster
gatttagatttta

SEQ ID NO: 623071 - DNA, 13 bp, D. melanogaster
gatttagccaaaa

SEQ ID NO: 623072 - DNA, 13 bp, D. melanogaster
gatttagtttaaa

SEQ ID NO: 623073 - DNA, 13 bp, D. melanogaster
gatttatgaattt

SEQ ID NO: 623074 - DNA, 13 bp, D. melanogaster
gatttatggtatt

SEQ ID NO: 623075 - DNA, 13 bp, D. melanogaster
gatttatgtatat

SEQ ID NO: 623076 - DNA, 13 bp, D. melanogaster
gatttatgtggca

SEQ ID NO: 623077 - DNA, 13 bp, D. melanogaster
gatttatgtgtgc

SEQ ID NO: 623078 - DNA, 13 bp, D. melanogaster
gatttatgttaat

SEQ ID NO: 623079 - DNA, 13 bp, D. melanogaster
gatttatgttgca

SEQ ID NO: 623080 - DNA, 13 bp, D. melanogaster
gatttatgtttaa

SEQ ID NO: 623081 - DNA, 13 bp, D. melanogaster
gatttattatgca

SEQ ID NO: 623082 - DNA, 13 bp, D. melanogaster
gatttatttaagt

SEQ ID NO: 623083 - DNA, 13 bp, D. melanogaster
gatttatttcaat

SEQ ID NO: 623084 - DNA, 13 bp, D. melanogaster
gatttatttggca

SEQ ID NO: 623085 - DNA, 13 bp, D. melanogaster
gatttattttgac

SEQ ID NO: 623086 - DNA, 13 bp, D. melanogaster
gatttcaaaatat

SEQ ID NO: 623087 - DNA, 13 bp, D. melanogaster
gatttcaaaatta

SEQ ID NO: 623088 - DNA, 13 bp, D. melanogaster
gatttcaaataaa

SEQ ID NO: 623089 - DNA, 13 bp, D. melanogaster
gatttcaatattt

SEQ ID NO: 623090 - DNA, 13 bp, D. melanogaster
gatttcaatgggc

SEQ ID NO: 623091 - DNA, 13 bp, D. melanogaster
gatttcaattgaa

SEQ ID NO: 623092 - DNA, 13 bp, D. melanogaster
gatttcaattgca

SEQ ID NO: 623093 - DNA, 13 bp, D. melanogaster
gatttcaattgtt

SEQ ID NO: 623094 - DNA, 14 bp, D. melanogaster
gatttcaatttcaa

SEQ ID NO: 623095 - DNA, 14 bp, D. melanogaster
gatttcagagaaca

SEQ ID NO: 623096 - DNA, 13 bp, D. melanogaster
gatttcataattt

SEQ ID NO: 623097 - DNA, 13 bp, D. melanogaster
gatttcatattta

SEQ ID NO: 623098 - DNA, 13 bp, D. melanogaster
gatttcatcaaat

SEQ ID NO: 623099 - DNA, 13 bp, D. melanogaster
gatttcattaaaa

SEQ ID NO: 623100 - DNA, 13 bp, D. melanogaster
gatttcattaaat

SEQ ID NO: 623101 - DNA, 13 bp, D. melanogaster
gatttcattataa

SEQ ID NO: 623102 - DNA, 13 bp, D. melanogaster
gatttcattgttt

SEQ ID NO: 623103 - DNA, 14 bp, D. melanogaster
gatttcattgtttt

SEQ ID NO: 623104 - DNA, 14 bp, D. melanogaster
gatttcatttcatt

SEQ ID NO: 623105 - DNA, 13 bp, D. melanogaster
gatttcatttgat

SEQ ID NO: 623106 - DNA, 13 bp, D. melanogaster
gatttcatttgtt

SEQ ID NO: 623107 - DNA, 13 bp, D. melanogaster
gatttccaataaa

SEQ ID NO: 623108 - DNA, 13 bp, D. melanogaster
gatttccattttg

SEQ ID NO: 623109 - DNA, 13 bp, D. melanogaster
gatttcccaaaaa

SEQ ID NO: 623110 - DNA, 13 bp, D. melanogaster
gatttcctcgact

SEQ ID NO: 623111 - DNA, 13 bp, D. melanogaster
gatttcctttgtt

SEQ ID NO: 623112 - DNA, 13 bp, D. melanogaster
gatttcgaatttg

SEQ ID NO: 623113 - DNA, 14 bp, D. melanogaster
gatttcgattccga

SEQ ID NO: 623114 - DNA, 13 bp, D. melanogaster
gatttcgattcga

SEQ ID NO: 623115 - DNA, 14 bp, D. melanogaster
gatttcgattcgat

SEQ ID NO: 623116 - DNA, 13 bp, D. melanogaster
gatttcgattctg

SEQ ID NO: 623117 - DNA, 13 bp, D. melanogaster
gatttcgattgcg

SEQ ID NO: 623118 - DNA, 14 bp, D. melanogaster
gatttcgatttcaa

SEQ ID NO: 623119 - DNA, 13 bp, D. melanogaster
gatttcgatttcc

SEQ ID NO: 623120 - DNA, 14 bp, D. melanogaster
gatttcgatttcga

SEQ ID NO: 623121 - DNA, 14 bp, D. melanogaster
gatttcgatttcgg

SEQ ID NO: 623122 - DNA, 13 bp, D. melanogaster
gatttcgatttct

SEQ ID NO: 623123 - DNA, 13 bp, D. melanogaster
gatttcgatttgc

SEQ ID NO: 623124 - DNA, 13 bp, D. melanogaster
gatttcgatttgg

SEQ ID NO: 623125 - DNA, 13 bp, D. melanogaster
gatttcgtttggc

SEQ ID NO: 623126 - DNA, 13 bp, D. melanogaster
gatttctaattaa

SEQ ID NO: 623127 - DNA, 14 bp, D. melanogaster
gatttctatatgga

SEQ ID NO: 623128 - DNA, 13 bp, D. melanogaster
gatttctcatttt

SEQ ID NO: 623129 - DNA, 13 bp, D. melanogaster
gatttctgatgag

SEQ ID NO: 623130 - DNA, 13 bp, D. melanogaster
gatttctgatttt

SEQ ID NO: 623131 - DNA, 13 bp, D. melanogaster
gatttctgcatgc

SEQ ID NO: 623132 - DNA, 13 bp, D. melanogaster
gatttctgggtta

SEQ ID NO: 623133 - DNA, 13 bp, D. melanogaster
gatttctgtttat

SEQ ID NO: 623134 - DNA, 13 bp, D. melanogaster
gatttcttatgct

SEQ ID NO: 623135 - DNA, 13 bp, D. melanogaster
gatttcttctacg

SEQ ID NO: 623136 - DNA, 13 bp, D. melanogaster
gatttctttatta

SEQ ID NO: 623137 - DNA, 13 bp, D. melanogaster
gatttctttcagt

SEQ ID NO: 623138 - DNA, 13 bp, D. melanogaster
gatttctttcgtt

SEQ ID NO: 623139 - DNA, 13 bp, D. melanogaster
gatttctttgaaa

SEQ ID NO: 623140 - DNA, 14 bp, D. melanogaster
gatttctttgaaat

SEQ ID NO: 623141 - DNA, 13 bp, D. melanogaster
gatttctttgaat

SEQ ID NO: 623142 - DNA, 14 bp, D. melanogaster
gatttcttttaatt

SEQ ID NO: 623143 - DNA, 13 bp, D. melanogaster
gatttgaaaagta

SEQ ID NO: 623144 - DNA, 13 bp, D. melanogaster
gatttgaaaataa

SEQ ID NO: 623145 - DNA, 13 bp, D. melanogaster
gatttgaaaatat

SEQ ID NO: 623146 - DNA, 13 bp, D. melanogaster
gatttgaataaat

SEQ ID NO: 623147 - DNA, 13 bp, D. melanogaster
gatttgaatattt

SEQ ID NO: 623148 - DNA, 13 bp, D. melanogaster
gatttgacaccac

SEQ ID NO: 623149 - DNA, 13 bp, D. melanogaster
gatttgataatgt

SEQ ID NO: 623150 - DNA, 13 bp, D. melanogaster
gatttgatgaaaa

SEQ ID NO: 623151 - DNA, 13 bp, D. melanogaster
gatttgattcgat

SEQ ID NO: 623152 - DNA, 13 bp, D. melanogaster
gatttgattgcaa

SEQ ID NO: 623153 - DNA, 13 bp, D. melanogaster
gatttgatttagt

SEQ ID NO: 623154 - DNA, 13 bp, D. melanogaster
gatttgatttatg

SEQ ID NO: 623155 - DNA, 13 bp, D. melanogaster
gatttgatttgag

SEQ ID NO: 623156 - DNA, 13 bp, D. melanogaster
gatttgatttgat

SEQ ID NO: 623157 - DNA, 13 bp, D. melanogaster
gatttgattttga

SEQ ID NO: 623158 - DNA, 13 bp, D. melanogaster
gatttgcataatt

SEQ ID NO: 623159 - DNA, 13 bp, D. melanogaster
gatttgcatatat

SEQ ID NO: 623160 - DNA, 13 bp, D. melanogaster
gatttgcattcaa

SEQ ID NO: 623161 - DNA, 13 bp, D. melanogaster
gatttgcattgca

SEQ ID NO: 623162 - DNA, 13 bp, D. melanogaster
gatttgcattgcc

SEQ ID NO: 623163 - DNA, 13 bp, D. melanogaster
gatttgccaaaaa

SEQ ID NO: 623164 - DNA, 14 bp, D. melanogaster
gatttgccaaacaa

SEQ ID NO: 623165 - DNA, 13 bp, D. melanogaster
gatttgccatttg

SEQ ID NO: 623166 - DNA, 13 bp, D. melanogaster
gatttgccttttt

SEQ ID NO: 623167 - DNA, 13 bp, D. melanogaster
gatttgcgatttg

SEQ ID NO: 623168 - DNA, 13 bp, D. melanogaster
gatttgcggacgc

SEQ ID NO: 623169 - DNA, 13 bp, D. melanogaster
gatttgctaaaaa

SEQ ID NO: 623170 - DNA, 13 bp, D. melanogaster
gatttgctgctgc

SEQ ID NO: 623171 - DNA, 13 bp, D. melanogaster
gatttgctggcaa

SEQ ID NO: 623172 - DNA, 13 bp, D. melanogaster
gatttgcttgttt

SEQ ID NO: 623173 - DNA, 13 bp, D. melanogaster
gatttgcttttga

SEQ ID NO: 623174 - DNA, 13 bp, D. melanogaster
gatttgcttttgt

SEQ ID NO: 623175 - DNA, 13 bp, D. melanogaster
gatttggaaattt

SEQ ID NO: 623176 - DNA, 13 bp, D. melanogaster
gatttggattcgg

SEQ ID NO: 623177 - DNA, 14 bp, D. melanogaster
gatttggattcgga

SEQ ID NO: 623178 - DNA, 13 bp, D. melanogaster
gatttggatttaa

SEQ ID NO: 623179 - DNA, 13 bp, D. melanogaster
gatttggatttcg

SEQ ID NO: 623180 - DNA, 13 bp, D. melanogaster
gatttggatttga

SEQ ID NO: 623181 - DNA, 14 bp, D. melanogaster
gatttggatttgga

SEQ ID NO: 623182 - DNA, 13 bp, D. melanogaster
gatttggatttta

SEQ ID NO: 623183 - DNA, 13 bp, D. melanogaster
gatttggcaaaaa

SEQ ID NO: 623184 - DNA, 13 bp, D. melanogaster
gatttggccaatt

SEQ ID NO: 623185 - DNA, 13 bp, D. melanogaster
gatttggcttcta

SEQ ID NO: 623186 - DNA, 13 bp, D. melanogaster
gatttgggaaaca

SEQ ID NO: 623187 - DNA, 14 bp, D. melanogaster
gatttgggtttgcg

SEQ ID NO: 623188 - DNA, 13 bp, D. melanogaster
gatttggtcggaa

SEQ ID NO: 623189 - DNA, 13 bp, D. melanogaster
gatttggttgaaa

SEQ ID NO: 623190 - DNA, 13 bp, D. melanogaster
gatttggttggga

SEQ ID NO: 623191 - DNA, 13 bp, D. melanogaster
gatttggtttgat

SEQ ID NO: 623192 - DNA, 13 bp, D. melanogaster
gatttgtacagac

SEQ ID NO: 623193 - DNA, 13 bp, D. melanogaster
gatttgtacattt

SEQ ID NO: 623194 - DNA, 13 bp, D. melanogaster
gatttgtaccata

SEQ ID NO: 623195 - DNA, 13 bp, D. melanogaster
gatttgtatatat

SEQ ID NO: 623196 - DNA, 13 bp, D. melanogaster
gatttgtcttcat

SEQ ID NO: 623197 - DNA, 13 bp, D. melanogaster
gatttgtgatttg

SEQ ID NO: 623198 - DNA, 13 bp, D. melanogaster
gatttgtggagtt

SEQ ID NO: 623199 - DNA, 13 bp, D. melanogaster
gatttgtggccaa

SEQ ID NO: 623200 - DNA, 13 bp, D. melanogaster
gatttgtgtaatt

SEQ ID NO: 623201 - DNA, 13 bp, D. melanogaster
gatttgtgtgatt

SEQ ID NO: 623202 - DNA, 13 bp, D. melanogaster
gatttgtttacaa

SEQ ID NO: 623203 - DNA, 14 bp, D. melanogaster
gatttgtttacaag

SEQ ID NO: 623204 - DNA, 13 bp, D. melanogaster
gatttgtttacca

SEQ ID NO: 623205 - DNA, 13 bp, D. melanogaster
gatttgtttgcca

SEQ ID NO: 623206 - DNA, 13 bp, D. melanogaster
gatttgtttgctt

SEQ ID NO: 623207 - DNA, 13 bp, D. melanogaster
gattttaaaatca

SEQ ID NO: 623208 - DNA, 13 bp, D. melanogaster
gattttaaactaa

SEQ ID NO: 623209 - DNA, 13 bp, D. melanogaster
gattttaaataac

SEQ ID NO: 623210 - DNA, 13 bp, D. melanogaster
gattttaataatg

SEQ ID NO: 623211 - DNA, 14 bp, D. melanogaster
gattttaatattca

SEQ ID NO: 623212 - DNA, 13 bp, D. melanogaster
gattttaatggca

SEQ ID NO: 623213 - DNA, 13 bp, D. melanogaster
gattttaattgaa

SEQ ID NO: 623214 - DNA, 13 bp, D. melanogaster
gattttaatttct

SEQ ID NO: 623215 - DNA, 13 bp, D. melanogaster
gattttacagttt

SEQ ID NO: 623216 - DNA, 14 bp, D. melanogaster
gattttacagtttt

SEQ ID NO: 623217 - DNA, 13 bp, D. melanogaster
gattttacatttg

SEQ ID NO: 623218 - DNA, 13 bp, D. melanogaster
gattttagcattt

SEQ ID NO: 623219 - DNA, 13 bp, D. melanogaster
gattttagttatc

SEQ ID NO: 623220 - DNA, 14 bp, D. melanogaster
gattttataaatag

SEQ ID NO: 623221 - DNA, 13 bp, D. melanogaster
gattttatcaaga

SEQ ID NO: 623222 - DNA, 13 bp, D. melanogaster
gattttatgaaaa

SEQ ID NO: 623223 - DNA, 13 bp, D. melanogaster
gattttatgaaat

SEQ ID NO: 623224 - DNA, 13 bp, D. melanogaster
gattttatgcaaa

SEQ ID NO: 623225 - DNA, 13 bp, D. melanogaster
gattttatggcaa

SEQ ID NO: 623226 - DNA, 13 bp, D. melanogaster
gattttattcata

SEQ ID NO: 623227 - DNA, 13 bp, D. melanogaster
gattttatttcat

SEQ ID NO: 623228 - DNA, 13 bp, D. melanogaster
gattttatttgga

SEQ ID NO: 623229 - DNA, 13 bp, D. melanogaster
gattttcaaaaag

SEQ ID NO: 623230 - DNA, 13 bp, D. melanogaster
gattttcaaaatg

SEQ ID NO: 623231 - DNA, 13 bp, D. melanogaster
gattttcaaattt

SEQ ID NO: 623232 - DNA, 13 bp, D. melanogaster
gattttcaatgca

SEQ ID NO: 623233 - DNA, 13 bp, D. melanogaster
gattttcaattat

SEQ ID NO: 623234 - DNA, 13 bp, D. melanogaster
gattttcaattca

SEQ ID NO: 623235 - DNA, 13 bp, D. melanogaster
gattttcatttaa

SEQ ID NO: 623236 - DNA, 13 bp, D. melanogaster
gattttccaaaaa

SEQ ID NO: 623237 - DNA, 13 bp, D. melanogaster
gattttccaatgc

SEQ ID NO: 623238 - DNA, 13 bp, D. melanogaster
gattttccaccca

SEQ ID NO: 623239 - DNA, 13 bp, D. melanogaster
gattttccagcca

SEQ ID NO: 623240 - DNA, 13 bp, D. melanogaster
gattttccagcgc

SEQ ID NO: 623241 - DNA, 14 bp, D. melanogaster
gattttccatatat

SEQ ID NO: 623242 - DNA, 15 bp, D. melanogaster
gattttccgattttc

SEQ ID NO: 623243 - DNA, 13 bp, D. melanogaster
gattttccgcttt

SEQ ID NO: 623244 - DNA, 13 bp, D. melanogaster
gattttcctcttt

SEQ ID NO: 623245 - DNA, 13 bp, D. melanogaster
gattttcctgctc

SEQ ID NO: 623246 - DNA, 13 bp, D. melanogaster
gattttccttttg

SEQ ID NO: 623247 - DNA, 13 bp, D. melanogaster
gattttcgaaaat

SEQ ID NO: 623248 - DNA, 14 bp, D. melanogaster
gattttcgaaaatt

SEQ ID NO: 623249 - DNA, 13 bp, D. melanogaster
gattttcgatttt

SEQ ID NO: 623250 - DNA, 14 bp, D. melanogaster
gattttcgattttc

SEQ ID NO: 623251 - DNA, 13 bp, D. melanogaster
gattttcgcaaag

SEQ ID NO: 623252 - DNA, 14 bp, D. melanogaster
gattttcgcaaaga

SEQ ID NO: 623253 - DNA, 13 bp, D. melanogaster
gattttctcgatt

SEQ ID NO: 623254 - DNA, 13 bp, D. melanogaster
gattttcttcaat

SEQ ID NO: 623255 - DNA, 13 bp, D. melanogaster
gattttctttaaa

SEQ ID NO: 623256 - DNA, 13 bp, D. melanogaster
gattttgaaaaga

SEQ ID NO: 623257 - DNA, 14 bp, D. melanogaster
gattttgaaaagaa

SEQ ID NO: 623258 - DNA, 13 bp, D. melanogaster
gattttgaagata

SEQ ID NO: 623259 - DNA, 13 bp, D. melanogaster
gattttgagattt

SEQ ID NO: 623260 - DNA, 14 bp, D. melanogaster
gattttgagtttga

SEQ ID NO: 623261 - DNA, 13 bp, D. melanogaster
gattttgataaat

SEQ ID NO: 623262 - DNA, 13 bp, D. melanogaster
gattttgatataa

SEQ ID NO: 623263 - DNA, 13 bp, D. melanogaster
gattttgatatat

SEQ ID NO: 623264 - DNA, 13 bp, D. melanogaster
gattttgattaat

SEQ ID NO: 623265 - DNA, 13 bp, D. melanogaster
gattttgatttca

SEQ ID NO: 623266 - DNA, 14 bp, D. melanogaster
gattttgatttgat

SEQ ID NO: 623267 - DNA, 14 bp, D. melanogaster
gattttgatttgga

SEQ ID NO: 623268 - DNA, 14 bp, D. melanogaster
gattttgcactttt

SEQ ID NO: 623269 - DNA, 13 bp, D. melanogaster
gattttgcataaa

SEQ ID NO: 623270 - DNA, 13 bp, D. melanogaster
gattttgccaaaa

SEQ ID NO: 623271 - DNA, 13 bp, D. melanogaster
gattttggaaaat

SEQ ID NO: 623272 - DNA, 13 bp, D. melanogaster
gattttgggttga

SEQ ID NO: 623273 - DNA, 13 bp, D. melanogaster
gattttggttaaa

SEQ ID NO: 623274 - DNA, 13 bp, D. melanogaster
gattttgtaaaat

SEQ ID NO: 623275 - DNA, 13 bp, D. melanogaster
gattttgtaatta

SEQ ID NO: 623276 - DNA, 13 bp, D. melanogaster
gattttgtgaaga

SEQ ID NO: 623277 - DNA, 13 bp, D. melanogaster
gattttgtgagtt

SEQ ID NO: 623278 - DNA, 14 bp, D. melanogaster
gattttgtgtatgg

SEQ ID NO: 623279 - DNA, 14 bp, D. melanogaster
gattttgttaaaaa

SEQ ID NO: 623280 - DNA, 13 bp, D. melanogaster
gattttgttaaat

SEQ ID NO: 623281 - DNA, 13 bp, D. melanogaster
gattttgttatct

SEQ ID NO: 623282 - DNA, 13 bp, D. melanogaster
gattttgttcatt

SEQ ID NO: 623283 - DNA, 13 bp, D. melanogaster
gattttgttcctg

SEQ ID NO: 623284 - DNA, 13 bp, D. melanogaster
gattttgtttggc

SEQ ID NO: 623285 - DNA, 13 bp, D. melanogaster
gattttgttttcg

SEQ ID NO: 623286 - DNA, 14 bp, D. melanogaster
gatttttaaaggca

SEQ ID NO: 623287 - DNA, 13 bp, D. melanogaster
gatttttaagtta

SEQ ID NO: 623288 - DNA, 13 bp, D. melanogaster
gatttttagagaa

SEQ ID NO: 623289 - DNA, 13 bp, D. melanogaster
gatttttatgaat

SEQ ID NO: 623290 - DNA, 13 bp, D. melanogaster
gatttttatgatg

SEQ ID NO: 623291 - DNA, 13 bp, D. melanogaster
gatttttattaag

SEQ ID NO: 623292 - DNA, 13 bp, D. melanogaster
gatttttattgaa

SEQ ID NO: 623293 - DNA, 13 bp, D. melanogaster
gatttttcaaaaa

SEQ ID NO: 623294 - DNA, 13 bp, D. melanogaster
gatttttcaaaat

SEQ ID NO: 623295 - DNA, 13 bp, D. melanogaster
gatttttcaatgg

SEQ ID NO: 623296 - DNA, 13 bp, D. melanogaster
gatttttcacagt

SEQ ID NO: 623297 - DNA, 13 bp, D. melanogaster
gatttttcatttg

SEQ ID NO: 623298 - DNA, 13 bp, D. melanogaster
gatttttcgaaaa

SEQ ID NO: 623299 - DNA, 14 bp, D. melanogaster
gatttttcgatttt

SEQ ID NO: 623300 - DNA, 13 bp, D. melanogaster
gatttttcttcgt

SEQ ID NO: 623301 - DNA, 13 bp, D. melanogaster
gatttttctttcg

SEQ ID NO: 623302 - DNA, 13 bp, D. melanogaster
gatttttgattgc

SEQ ID NO: 623303 - DNA, 13 bp, D. melanogaster
gatttttgccatt

SEQ ID NO: 623304 - DNA, 13 bp, D. melanogaster
gatttttggcgaa

SEQ ID NO: 623305 - DNA, 13 bp, D. melanogaster
gattttttacatc

SEQ ID NO: 623306 - DNA, 13 bp, D. melanogaster
gattttttcaact

SEQ ID NO: 623307 - DNA, 13 bp, D. melanogaster
gattttttcccat

SEQ ID NO: 623308 - DNA, 13 bp, D. melanogaster
gattttttgtaaa

SEQ ID NO: 623309 - DNA, 13 bp, D. melanogaster
gatttttttggaa

SEQ ID NO: 623310 - DNA, 13 bp, D. melanogaster
gattttttttcca

SEQ ID NO: 623311 - DNA, 13 bp, D. melanogaster
gcaaaaaaaagtg

SEQ ID NO: 623312 - DNA, 13 bp, D. melanogaster
gcaaaaaaaattt

SEQ ID NO: 623313 - DNA, 13 bp, D. melanogaster
gcaaaaaaccctt

SEQ ID NO: 623314 - DNA, 13 bp, D. melanogaster
gcaaaaaacgtac

SEQ ID NO: 623315 - DNA, 13 bp, D. melanogaster
gcaaaaaactaca

SEQ ID NO: 623316 - DNA, 13 bp, D. melanogaster
gcaaaaaactgca

SEQ ID NO: 623317 - DNA, 14 bp, D. melanogaster
gcaaaaaacttttt

SEQ ID NO: 623318 - DNA, 13 bp, D. melanogaster
gcaaaaaagaatt

SEQ ID NO: 623319 - DNA, 13 bp, D. melanogaster
gcaaaaaagtgaa

SEQ ID NO: 623320 - DNA, 13 bp, D. melanogaster
gcaaaaaagtgca

SEQ ID NO: 623321 - DNA, 13 bp, D. melanogaster
gcaaaaaagttta

SEQ ID NO: 623322 - DNA, 13 bp, D. melanogaster
gcaaaaaagtttt

SEQ ID NO: 623323 - DNA, 13 bp, D. melanogaster
gcaaaaaatcgga

SEQ ID NO: 623324 - DNA, 14 bp, D. melanogaster
gcaaaaaatgatga

SEQ ID NO: 623325 - DNA, 14 bp, D. melanogaster
gcaaaaaatgcaaa

SEQ ID NO: 623326 - DNA, 13 bp, D. melanogaster
gcaaaaaatggca

SEQ ID NO: 623327 - DNA, 13 bp, D. melanogaster
gcaaaaaatggcc

SEQ ID NO: 623328 - DNA, 14 bp, D. melanogaster
gcaaaaaatgggca

SEQ ID NO: 623329 - DNA, 13 bp, D. melanogaster
gcaaaaaatgttt

SEQ ID NO: 623330 - DNA, 14 bp, D. melanogaster
gcaaaaaattgaaa

SEQ ID NO: 623331 - DNA, 13 bp, D. melanogaster
gcaaaaaattgac

SEQ ID NO: 623332 - DNA, 14 bp, D. melanogaster
gcaaaaaattgcaa

SEQ ID NO: 623333 - DNA, 13 bp, D. melanogaster
gcaaaaaattgcc

SEQ ID NO: 623334 - DNA, 13 bp, D. melanogaster
gcaaaaacaaatt

SEQ ID NO: 623335 - DNA, 13 bp, D. melanogaster
gcaaaaacaatga

SEQ ID NO: 623336 - DNA, 13 bp, D. melanogaster
gcaaaaacaatgg

SEQ ID NO: 623337 - DNA, 13 bp, D. melanogaster
gcaaaaacagagc

SEQ ID NO: 623338 - DNA, 13 bp, D. melanogaster
gcaaaaacagctg

SEQ ID NO: 623339 - DNA, 13 bp, D. melanogaster
gcaaaaacagtcg

SEQ ID NO: 623340 - DNA, 13 bp, D. melanogaster
gcaaaaacatata

SEQ ID NO: 623341 - DNA, 13 bp, D. melanogaster
gcaaaaaccattt

SEQ ID NO: 623342 - DNA, 13 bp, D. melanogaster
gcaaaaacgaaat

SEQ ID NO: 623343 - DNA, 13 bp, D. melanogaster
gcaaaaacgcaat

SEQ ID NO: 623344 - DNA, 13 bp, D. melanogaster
gcaaaaacgcatt

SEQ ID NO: 623345 - DNA, 13 bp, D. melanogaster
gcaaaaactaaag

SEQ ID NO: 623346 - DNA, 14 bp, D. melanogaster
gcaaaaactacgaa

SEQ ID NO: 623347 - DNA, 13 bp, D. melanogaster
gcaaaaactatta

SEQ ID NO: 623348 - DNA, 13 bp, D. melanogaster
gcaaaaactgcat

SEQ ID NO: 623349 - DNA, 13 bp, D. melanogaster
gcaaaaactgttt

SEQ ID NO: 623350 - DNA, 13 bp, D. melanogaster
gcaaaaactttca

SEQ ID NO: 623351 - DNA, 13 bp, D. melanogaster
gcaaaaacttttc

SEQ ID NO: 623352 - DNA, 13 bp, D. melanogaster
gcaaaaagagcga

SEQ ID NO: 623353 - DNA, 13 bp, D. melanogaster
gcaaaaagccaac

SEQ ID NO: 623354 - DNA, 14 bp, D. melanogaster
gcaaaaagcgcaaa

SEQ ID NO: 623355 - DNA, 13 bp, D. melanogaster
gcaaaaaggatat

SEQ ID NO: 623356 - DNA, 13 bp, D. melanogaster
gcaaaaaggcagc

SEQ ID NO: 623357 - DNA, 13 bp, D. melanogaster
gcaaaaaggcgaa

SEQ ID NO: 623358 - DNA, 13 bp, D. melanogaster
gcaaaaagtaatt

SEQ ID NO: 623359 - DNA, 13 bp, D. melanogaster
gcaaaaagtacaa

SEQ ID NO: 623360 - DNA, 13 bp, D. melanogaster
gcaaaaagtggca

SEQ ID NO: 623361 - DNA, 13 bp, D. melanogaster
gcaaaaagttaat

SEQ ID NO: 623362 - DNA, 14 bp, D. melanogaster
gcaaaaagttaatt

SEQ ID NO: 623363 - DNA, 13 bp, D. melanogaster
gcaaaaagttgca

SEQ ID NO: 623364 - DNA, 13 bp, D. melanogaster
gcaaaaagttgtt

SEQ ID NO: 623365 - DNA, 13 bp, D. melanogaster
gcaaaaagtttaa

SEQ ID NO: 623366 - DNA, 13 bp, D. melanogaster
gcaaaaagtttat

SEQ ID NO: 623367 - DNA, 13 bp, D. melanogaster
gcaaaaagttttc

SEQ ID NO: 623368 - DNA, 14 bp, D. melanogaster
gcaaaaataaatat

SEQ ID NO: 623369 - DNA, 13 bp, D. melanogaster
gcaaaaataatga

SEQ ID NO: 623370 - DNA, 13 bp, D. melanogaster
gcaaaaatacaca

SEQ ID NO: 623371 - DNA, 14 bp, D. melanogaster
gcaaaaatatattt

SEQ ID NO: 623372 - DNA, 13 bp, D. melanogaster
gcaaaaatattgc

SEQ ID NO: 623373 - DNA, 13 bp, D. melanogaster
gcaaaaatatttg

SEQ ID NO: 623374 - DNA, 14 bp, D. melanogaster
gcaaaaatatttga

SEQ ID NO: 623375 - DNA, 13 bp, D. melanogaster
gcaaaaatcattt

SEQ ID NO: 623376 - DNA, 13 bp, D. melanogaster
gcaaaaatcgaat

SEQ ID NO: 623377 - DNA, 13 bp, D. melanogaster
gcaaaaatctttt

SEQ ID NO: 623378 - DNA, 14 bp, D. melanogaster
gcaaaaatgaaaat

SEQ ID NO: 623379 - DNA, 13 bp, D. melanogaster
gcaaaaatgaaat

SEQ ID NO: 623380 - DNA, 13 bp, D. melanogaster
gcaaaaatgcaag

SEQ ID NO: 623381 - DNA, 13 bp, D. melanogaster
gcaaaaatgcatt

SEQ ID NO: 623382 - DNA, 14 bp, D. melanogaster
gcaaaaatggcaaa

SEQ ID NO: 623383 - DNA, 13 bp, D. melanogaster
gcaaaaatgtaaa

SEQ ID NO: 623384 - DNA, 13 bp, D. melanogaster
gcaaaaatgtatt

SEQ ID NO: 623385 - DNA, 14 bp, D. melanogaster
gcaaaaatgtattt

SEQ ID NO: 623386 - DNA, 13 bp, D. melanogaster
gcaaaaattaata

SEQ ID NO: 623387 - DNA, 14 bp, D. melanogaster
gcaaaaattaattt

SEQ ID NO: 623388 - DNA, 13 bp, D. melanogaster
gcaaaaattataa

SEQ ID NO: 623389 - DNA, 13 bp, D. melanogaster
gcaaaaattgaat

SEQ ID NO: 623390 - DNA, 13 bp, D. melanogaster
gcaaaaattgaga

SEQ ID NO: 623391 - DNA, 13 bp, D. melanogaster
gcaaaaattggaa

SEQ ID NO: 623392 - DNA, 13 bp, D. melanogaster
gcaaaaatttaaa

SEQ ID NO: 623393 - DNA, 14 bp, D. melanogaster
gcaaaaatttaatt

SEQ ID NO: 623394 - DNA, 14 bp, D. melanogaster
gcaaaacaaaagct

SEQ ID NO: 623395 - DNA, 13 bp, D. melanogaster
gcaaaacaaagcg

SEQ ID NO: 623396 - DNA, 13 bp, D. melanogaster
gcaaaacaaaggc

SEQ ID NO: 623397 - DNA, 13 bp, D. melanogaster
gcaaaacaaatat

SEQ ID NO: 623398 - DNA, 13 bp, D. melanogaster
gcaaaacaaatcg

SEQ ID NO: 623399 - DNA, 13 bp, D. melanogaster
gcaaaacaaatga

SEQ ID NO: 623400 - DNA, 13 bp, D. melanogaster
gcaaaacaaatgg

SEQ ID NO: 623401 - DNA, 13 bp, D. melanogaster
gcaaaacaaatta

SEQ ID NO: 623402 - DNA, 13 bp, D. melanogaster
gcaaaacaatcaa

SEQ ID NO: 623403 - DNA, 13 bp, D. melanogaster
gcaaaacaatgaa

SEQ ID NO: 623404 - DNA, 13 bp, D. melanogaster
gcaaaacaatggc

SEQ ID NO: 623405 - DNA, 13 bp, D. melanogaster
gcaaaacaattgc

SEQ ID NO: 623406 - DNA, 13 bp, D. melanogaster
gcaaaacagcagc

SEQ ID NO: 623407 - DNA, 13 bp, D. melanogaster
gcaaaacatttaa

SEQ ID NO: 623408 - DNA, 13 bp, D. melanogaster
gcaaaacatttcc

SEQ ID NO: 623409 - DNA, 13 bp, D. melanogaster
gcaaaacatttga

SEQ ID NO: 623410 - DNA, 13 bp, D. melanogaster
gcaaaaccaatga

SEQ ID NO: 623411 - DNA, 13 bp, D. melanogaster
gcaaaaccaattt

SEQ ID NO: 623412 - DNA, 13 bp, D. melanogaster
gcaaaacgaaagc

SEQ ID NO: 623413 - DNA, 13 bp, D. melanogaster
gcaaaacgcaaat

SEQ ID NO: 623414 - DNA, 13 bp, D. melanogaster
gcaaaacgttttt

SEQ ID NO: 623415 - DNA, 13 bp, D. melanogaster
gcaaaactatttg

SEQ ID NO: 623416 - DNA, 13 bp, D. melanogaster
gcaaaactggaaa

SEQ ID NO: 623417 - DNA, 13 bp, D. melanogaster
gcaaaactttcgc

SEQ ID NO: 623418 - DNA, 13 bp, D. melanogaster
gcaaaactttggc

SEQ ID NO: 623419 - DNA, 13 bp, D. melanogaster
gcaaaacttttat

SEQ ID NO: 623420 - DNA, 13 bp, D. melanogaster
gcaaaacttttgc

SEQ ID NO: 623421 - DNA, 14 bp, D. melanogaster
gcaaaacttttgcc

SEQ ID NO: 623422 - DNA, 13 bp, D. melanogaster
gcaaaactttttc

SEQ ID NO: 623423 - DNA, 13 bp, D. melanogaster
gcaaaagaaaatg

SEQ ID NO: 623424 - DNA, 13 bp, D. melanogaster
gcaaaagaaaatt

SEQ ID NO: 623425 - DNA, 13 bp, D. melanogaster
gcaaaagaaattg

SEQ ID NO: 623426 - DNA, 13 bp, D. melanogaster
gcaaaagagacgg

SEQ ID NO: 623427 - DNA, 14 bp, D. melanogaster
gcaaaagcaaaagt

SEQ ID NO: 623428 - DNA, 13 bp, D. melanogaster
gcaaaagcaaacc

SEQ ID NO: 623429 - DNA, 13 bp, D. melanogaster
gcaaaagcaaagc

SEQ ID NO: 623430 - DNA, 13 bp, D. melanogaster
gcaaaagcaaatc

SEQ ID NO: 623431 - DNA, 13 bp, D. melanogaster
gcaaaagcaactt

SEQ ID NO: 623432 - DNA, 13 bp, D. melanogaster
gcaaaagcaataa

SEQ ID NO: 623433 - DNA, 13 bp, D. melanogaster
gcaaaagcaatta

SEQ ID NO: 623434 - DNA, 13 bp, D. melanogaster
gcaaaagcaattt

SEQ ID NO: 623435 - DNA, 13 bp, D. melanogaster
gcaaaagcaggcg

SEQ ID NO: 623436 - DNA, 13 bp, D. melanogaster
gcaaaagccataa

SEQ ID NO: 623437 - DNA, 13 bp, D. melanogaster
gcaaaagccgata

SEQ ID NO: 623438 - DNA, 14 bp, D. melanogaster
gcaaaagccgatag

SEQ ID NO: 623439 - DNA, 13 bp, D. melanogaster
gcaaaagctgaaa

SEQ ID NO: 623440 - DNA, 13 bp, D. melanogaster
gcaaaaggaaaat

SEQ ID NO: 623441 - DNA, 13 bp, D. melanogaster
gcaaaaggaaata

SEQ ID NO: 623442 - DNA, 13 bp, D. melanogaster
gcaaaaggacgaa

SEQ ID NO: 623443 - DNA, 13 bp, D. melanogaster
gcaaaaggagcaa

SEQ ID NO: 623444 - DNA, 14 bp, D. melanogaster
gcaaaaggagctgg

SEQ ID NO: 623445 - DNA, 13 bp, D. melanogaster
gcaaaaggatttg

SEQ ID NO: 623446 - DNA, 13 bp, D. melanogaster
gcaaaaggatttt

SEQ ID NO: 623447 - DNA, 13 bp, D. melanogaster
gcaaaaggcaaac

SEQ ID NO: 623448 - DNA, 13 bp, D. melanogaster
gcaaaaggcagca

SEQ ID NO: 623449 - DNA, 13 bp, D. melanogaster
gcaaaaggccaaa

SEQ ID NO: 623450 - DNA, 13 bp, D. melanogaster
gcaaaaggggcgg

SEQ ID NO: 623451 - DNA, 13 bp, D. melanogaster
gcaaaaggttttc

SEQ ID NO: 623452 - DNA, 13 bp, D. melanogaster
gcaaaagtaaagt

SEQ ID NO: 623453 - DNA, 13 bp, D. melanogaster
gcaaaagtatctg

SEQ ID NO: 623454 - DNA, 13 bp, D. melanogaster
gcaaaagtatttc

SEQ ID NO: 623455 - DNA, 13 bp, D. melanogaster
gcaaaagtatttt

SEQ ID NO: 623456 - DNA, 13 bp, D. melanogaster
gcaaaagtgcaaa

SEQ ID NO: 623457 - DNA, 13 bp, D. melanogaster
gcaaaagtgcatt

SEQ ID NO: 623458 - DNA, 13 bp, D. melanogaster
gcaaaagtgtgtg

SEQ ID NO: 623459 - DNA, 13 bp, D. melanogaster
gcaaaagttaatt

SEQ ID NO: 623460 - DNA, 13 bp, D. melanogaster
gcaaaagttcaat

SEQ ID NO: 623461 - DNA, 13 bp, D. melanogaster
gcaaaagttcatt

SEQ ID NO: 623462 - DNA, 13 bp, D. melanogaster
gcaaaagttgctg

SEQ ID NO: 623463 - DNA, 13 bp, D. melanogaster
gcaaaagttgttg

SEQ ID NO: 623464 - DNA, 13 bp, D. melanogaster
gcaaaagtttaat

SEQ ID NO: 623465 - DNA, 13 bp, D. melanogaster
gcaaaagtttatt

SEQ ID NO: 623466 - DNA, 13 bp, D. melanogaster
gcaaaagtttcaa

SEQ ID NO: 623467 - DNA, 13 bp, D. melanogaster
gcaaaagtttcga

SEQ ID NO: 623468 - DNA, 13 bp, D. melanogaster
gcaaaagtttgcg

SEQ ID NO: 623469 - DNA, 13 bp, D. melanogaster
gcaaaagtttggc

SEQ ID NO: 623470 - DNA, 13 bp, D. melanogaster
gcaaaagttttcg

SEQ ID NO: 623471 - DNA, 13 bp, D. melanogaster
gcaaaagttttgc

SEQ ID NO: 623472 - DNA, 14 bp, D. melanogaster
gcaaaagtttttaa

SEQ ID NO: 623473 - DNA, 13 bp, D. melanogaster
gcaaaagtttttg

SEQ ID NO: 623474 - DNA, 14 bp, D. melanogaster
gcaaaagttttttt

SEQ ID NO: 623475 - DNA, 13 bp, D. melanogaster
gcaaaataaaatt

SEQ ID NO: 623476 - DNA, 13 bp, D. melanogaster
gcaaaataaatac

SEQ ID NO: 623477 - DNA, 13 bp, D. melanogaster
gcaaaataaatga

SEQ ID NO: 623478 - DNA, 13 bp, D. melanogaster
gcaaaataaatgc

SEQ ID NO: 623479 - DNA, 13 bp, D. melanogaster
gcaaaataaatta

SEQ ID NO: 623480 - DNA, 13 bp, D. melanogaster
gcaaaataataat

SEQ ID NO: 623481 - DNA, 13 bp, D. melanogaster
gcaaaatagtttt

SEQ ID NO: 623482 - DNA, 14 bp, D. melanogaster
gcaaaatataatga

SEQ ID NO: 623483 - DNA, 14 bp, D. melanogaster
gcaaaatatataaa

SEQ ID NO: 623484 - DNA, 13 bp, D. melanogaster
gcaaaatattgtg

SEQ ID NO: 623485 - DNA, 14 bp, D. melanogaster
gcaaaatatttata

SEQ ID NO: 623486 - DNA, 14 bp, D. melanogaster
gcaaaatatttatt

SEQ ID NO: 623487 - DNA, 13 bp, D. melanogaster
gcaaaatatttcc

SEQ ID NO: 623488 - DNA, 13 bp, D. melanogaster
gcaaaatatttgc

SEQ ID NO: 623489 - DNA, 13 bp, D. melanogaster
gcaaaatattttt

SEQ ID NO: 623490 - DNA, 13 bp, D. melanogaster
gcaaaatcaaaag

SEQ ID NO: 623491 - DNA, 13 bp, D. melanogaster
gcaaaatcaaagc

SEQ ID NO: 623492 - DNA, 13 bp, D. melanogaster
gcaaaatcaagtt

SEQ ID NO: 623493 - DNA, 13 bp, D. melanogaster
gcaaaatcaataa

SEQ ID NO: 623494 - DNA, 13 bp, D. melanogaster
gcaaaatcaatca

SEQ ID NO: 623495 - DNA, 13 bp, D. melanogaster
gcaaaatcaattt

SEQ ID NO: 623496 - DNA, 14 bp, D. melanogaster
gcaaaatcagttgc

SEQ ID NO: 623497 - DNA, 13 bp, D. melanogaster
gcaaaatcgaaag

SEQ ID NO: 623498 - DNA, 13 bp, D. melanogaster
gcaaaatcgatca

SEQ ID NO: 623499 - DNA, 13 bp, D. melanogaster
gcaaaatctctga

SEQ ID NO: 623500 - DNA, 13 bp, D. melanogaster
gcaaaatgaaaac

SEQ ID NO: 623501 - DNA, 13 bp, D. melanogaster
gcaaaatgaaaat

SEQ ID NO: 623502 - DNA, 14 bp, D. melanogaster
gcaaaatgaaaatg

SEQ ID NO: 623503 - DNA, 13 bp, D. melanogaster
gcaaaatgaagaa

SEQ ID NO: 623504 - DNA, 13 bp, D. melanogaster
gcaaaatgaagtt

SEQ ID NO: 623505 - DNA, 13 bp, D. melanogaster
gcaaaatgatatt

SEQ ID NO: 623506 - DNA, 13 bp, D. melanogaster
gcaaaatgattaa

SEQ ID NO: 623507 - DNA, 13 bp, D. melanogaster
gcaaaatgattta

SEQ ID NO: 623508 - DNA, 13 bp, D. melanogaster
gcaaaatgcaaaa

SEQ ID NO: 623509 - DNA, 14 bp, D. melanogaster
gcaaaatgcaaaac

SEQ ID NO: 623510 - DNA, 13 bp, D. melanogaster
gcaaaatgcaaac

SEQ ID NO: 623511 - DNA, 13 bp, D. melanogaster
gcaaaatgcaact

SEQ ID NO: 623512 - DNA, 13 bp, D. melanogaster
gcaaaatgcaatc

SEQ ID NO: 623513 - DNA, 13 bp, D. melanogaster
gcaaaatgcaatt

SEQ ID NO: 623514 - DNA, 13 bp, D. melanogaster
gcaaaatgcatat

SEQ ID NO: 623515 - DNA, 13 bp, D. melanogaster
gcaaaatgcattt

SEQ ID NO: 623516 - DNA, 13 bp, D. melanogaster
gcaaaatgccaaa

SEQ ID NO: 623517 - DNA, 13 bp, D. melanogaster
gcaaaatgccacg

SEQ ID NO: 623518 - DNA, 13 bp, D. melanogaster
gcaaaatgcgaaa

SEQ ID NO: 623519 - DNA, 13 bp, D. melanogaster
gcaaaatggaaac

SEQ ID NO: 623520 - DNA, 14 bp, D. melanogaster
gcaaaatggaaaca

SEQ ID NO: 623521 - DNA, 13 bp, D. melanogaster
gcaaaatggaaag

SEQ ID NO: 623522 - DNA, 13 bp, D. melanogaster
gcaaaatggaaca

SEQ ID NO: 623523 - DNA, 13 bp, D. melanogaster
gcaaaatggcaaa

SEQ ID NO: 623524 - DNA, 13 bp, D. melanogaster
gcaaaatggcaac

SEQ ID NO: 623525 - DNA, 13 bp, D. melanogaster
gcaaaatggtaaa

SEQ ID NO: 623526 - DNA, 13 bp, D. melanogaster
gcaaaatgtaaaa

SEQ ID NO: 623527 - DNA, 14 bp, D. melanogaster
gcaaaatgtaattt

SEQ ID NO: 623528 - DNA, 13 bp, D. melanogaster
gcaaaatgtgaaa

SEQ ID NO: 623529 - DNA, 14 bp, D. melanogaster
gcaaaatgttattt

SEQ ID NO: 623530 - DNA, 14 bp, D. melanogaster
gcaaaatgtttaaa

SEQ ID NO: 623531 - DNA, 13 bp, D. melanogaster
gcaaaatgtttat

SEQ ID NO: 623532 - DNA, 13 bp, D. melanogaster
gcaaaatgtttgc

SEQ ID NO: 623533 - DNA, 14 bp, D. melanogaster
gcaaaatgtttgca

SEQ ID NO: 623534 - DNA, 13 bp, D. melanogaster
gcaaaatgtttta

SEQ ID NO: 623535 - DNA, 13 bp, D. melanogaster
gcaaaatgttttt

SEQ ID NO: 623536 - DNA, 13 bp, D. melanogaster
gcaaaattacaag

SEQ ID NO: 623537 - DNA, 13 bp, D. melanogaster
gcaaaattatgaa

SEQ ID NO: 623538 - DNA, 13 bp, D. melanogaster
gcaaaattattta

SEQ ID NO: 623539 - DNA, 13 bp, D. melanogaster
gcaaaattccaat

SEQ ID NO: 623540 - DNA, 13 bp, D. melanogaster
gcaaaattccttt

SEQ ID NO: 623541 - DNA, 13 bp, D. melanogaster
gcaaaattctttc

SEQ ID NO: 623542 - DNA, 13 bp, D. melanogaster
gcaaaattgaaat

SEQ ID NO: 623543 - DNA, 13 bp, D. melanogaster
gcaaaattgattt

SEQ ID NO: 623544 - DNA, 13 bp, D. melanogaster
gcaaaattggaaa

SEQ ID NO: 623545 - DNA, 13 bp, D. melanogaster
gcaaaattgtatt

SEQ ID NO: 623546 - DNA, 13 bp, D. melanogaster
gcaaaattgtcaa

SEQ ID NO: 623547 - DNA, 13 bp, D. melanogaster
gcaaaattgtttg

SEQ ID NO: 623548 - DNA, 13 bp, D. melanogaster
gcaaaatttacaa

SEQ ID NO: 623549 - DNA, 13 bp, D. melanogaster
gcaaaattttaat

SEQ ID NO: 623550 - DNA, 14 bp, D. melanogaster
gcaaaattttaatt

SEQ ID NO: 623551 - DNA, 13 bp, D. melanogaster
gcaaacaaaaatt

SEQ ID NO: 623552 - DNA, 13 bp, D. melanogaster
gcaaacaaaacgc

SEQ ID NO: 623553 - DNA, 13 bp, D. melanogaster
gcaaacaaaagcg

SEQ ID NO: 623554 - DNA, 13 bp, D. melanogaster
gcaaacaaaaggg

SEQ ID NO: 623555 - DNA, 13 bp, D. melanogaster
gcaaacaaaagtt

SEQ ID NO: 623556 - DNA, 13 bp, D. melanogaster
gcaaacaaaatgg

SEQ ID NO: 623557 - DNA, 13 bp, D. melanogaster
gcaaacaaaatgt

SEQ ID NO: 623558 - DNA, 14 bp, D. melanogaster
gcaaacaaacaaat

SEQ ID NO: 623559 - DNA, 13 bp, D. melanogaster
gcaaacaaacagg

SEQ ID NO: 623560 - DNA, 13 bp, D. melanogaster
gcaaacaaagcca

SEQ ID NO: 623561 - DNA, 13 bp, D. melanogaster
gcaaacaaagcga

SEQ ID NO: 623562 - DNA, 13 bp, D. melanogaster
gcaaacaaaggcc

SEQ ID NO: 623563 - DNA, 13 bp, D. melanogaster
gcaaacaaagtga

SEQ ID NO: 623564 - DNA, 13 bp, D. melanogaster
gcaaacaaatatt

SEQ ID NO: 623565 - DNA, 13 bp, D. melanogaster
gcaaacaaatcaa

SEQ ID NO: 623566 - DNA, 13 bp, D. melanogaster
gcaaacaaatcat

SEQ ID NO: 623567 - DNA, 13 bp, D. melanogaster
gcaaacaaatcca

SEQ ID NO: 623568 - DNA, 13 bp, D. melanogaster
gcaaacaaatgaa

SEQ ID NO: 623569 - DNA, 13 bp, D. melanogaster
gcaaacaaatgag

SEQ ID NO: 623570 - DNA, 13 bp, D. melanogaster
gcaaacaaatgct

SEQ ID NO: 623571 - DNA, 13 bp, D. melanogaster
gcaaacaaatttc

SEQ ID NO: 623572 - DNA, 13 bp, D. melanogaster
gcaaacaacaaat

SEQ ID NO: 623573 - DNA, 14 bp, D. melanogaster
gcaaacaacaataa

SEQ ID NO: 623574 - DNA, 13 bp, D. melanogaster
gcaaacaacattt

SEQ ID NO: 623575 - DNA, 13 bp, D. melanogaster
gcaaacaacgaca

SEQ ID NO: 623576 - DNA, 13 bp, D. melanogaster
gcaaacaactaaa

SEQ ID NO: 623577 - DNA, 13 bp, D. melanogaster
gcaaacaactggc

SEQ ID NO: 623578 - DNA, 13 bp, D. melanogaster
gcaaacaactttt

SEQ ID NO: 623579 - DNA, 13 bp, D. melanogaster
gcaaacaagaatt

SEQ ID NO: 623580 - DNA, 13 bp, D. melanogaster
gcaaacaagcaac

SEQ ID NO: 623581 - DNA, 13 bp, D. melanogaster
gcaaacaaggcaa

SEQ ID NO: 623582 - DNA, 13 bp, D. melanogaster
gcaaacaagtcaa

SEQ ID NO: 623583 - DNA, 13 bp, D. melanogaster
gcaaacaataagc

SEQ ID NO: 623584 - DNA, 13 bp, D. melanogaster
gcaaacaatcaaa

SEQ ID NO: 623585 - DNA, 13 bp, D. melanogaster
gcaaacaatgaaa

SEQ ID NO: 623586 - DNA, 13 bp, D. melanogaster
gcaaacaatgcaa

SEQ ID NO: 623587 - DNA, 13 bp, D. melanogaster
gcaaacaatggca

SEQ ID NO: 623588 - DNA, 14 bp, D. melanogaster
gcaaacaattaaaa

SEQ ID NO: 623589 - DNA, 13 bp, D. melanogaster
gcaaacaattcaa

SEQ ID NO: 623590 - DNA, 14 bp, D. melanogaster
gcaaacaattgaaa

SEQ ID NO: 623591 - DNA, 13 bp, D. melanogaster
gcaaacaattgca

SEQ ID NO: 623592 - DNA, 13 bp, D. melanogaster
gcaaacaatttat

SEQ ID NO: 623593 - DNA, 13 bp, D. melanogaster
gcaaacaatttgc

SEQ ID NO: 623594 - DNA, 14 bp, D. melanogaster
gcaaacaatttgcc

SEQ ID NO: 623595 - DNA, 13 bp, D. melanogaster
gcaaacacaaaat

SEQ ID NO: 623596 - DNA, 13 bp, D. melanogaster
gcaaacacaaata

SEQ ID NO: 623597 - DNA, 14 bp, D. melanogaster
gcaaacacaaataa

SEQ ID NO: 623598 - DNA, 13 bp, D. melanogaster
gcaaacacaaatg

SEQ ID NO: 623599 - DNA, 13 bp, D. melanogaster
gcaaacacaatta

SEQ ID NO: 623600 - DNA, 14 bp, D. melanogaster
gcaaacacacaaat

SEQ ID NO: 623601 - DNA, 13 bp, D. melanogaster
gcaaacacacgaa

SEQ ID NO: 623602 - DNA, 13 bp, D. melanogaster
gcaaacacactca

SEQ ID NO: 623603 - DNA, 13 bp, D. melanogaster
gcaaacacatgca

SEQ ID NO: 623604 - DNA, 14 bp, D. melanogaster
gcaaacactctgtt

SEQ ID NO: 623605 - DNA, 13 bp, D. melanogaster
gcaaacacttgaa

SEQ ID NO: 623606 - DNA, 13 bp, D. melanogaster
gcaaacacttggc

SEQ ID NO: 623607 - DNA, 13 bp, D. melanogaster
gcaaacactttgt

SEQ ID NO: 623608 - DNA, 13 bp, D. melanogaster
gcaaacagaaagt

SEQ ID NO: 623609 - DNA, 13 bp, D. melanogaster
gcaaacagagcaa

SEQ ID NO: 623610 - DNA, 13 bp, D. melanogaster
gcaaacagtgcgt

SEQ ID NO: 623611 - DNA, 13 bp, D. melanogaster
gcaaacagtgtgc

SEQ ID NO: 623612 - DNA, 13 bp, D. melanogaster
gcaaacagttgca

SEQ ID NO: 623613 - DNA, 13 bp, D. melanogaster
gcaaacagtttaa

SEQ ID NO: 623614 - DNA, 13 bp, D. melanogaster
gcaaacagtttgc

SEQ ID NO: 623615 - DNA, 13 bp, D. melanogaster
gcaaacataaaca

SEQ ID NO: 623616 - DNA, 13 bp, D. melanogaster
gcaaacataaatc

SEQ ID NO: 623617 - DNA, 13 bp, D. melanogaster
gcaaacatacaaa

SEQ ID NO: 623618 - DNA, 13 bp, D. melanogaster
gcaaacatacata

SEQ ID NO: 623619 - DNA, 13 bp, D. melanogaster
gcaaacatcaaca

SEQ ID NO: 623620 - DNA, 13 bp, D. melanogaster
gcaaacattaaat

SEQ ID NO: 623621 - DNA, 13 bp, D. melanogaster
gcaaacattcaaa

SEQ ID NO: 623622 - DNA, 13 bp, D. melanogaster
gcaaacatttcga

SEQ ID NO: 623623 - DNA, 13 bp, D. melanogaster
gcaaacatttcgc

SEQ ID NO: 623624 - DNA, 13 bp, D. melanogaster
gcaaacatttcta

SEQ ID NO: 623625 - DNA, 13 bp, D. melanogaster
gcaaacatttgca

SEQ ID NO: 623626 - DNA, 14 bp, D. melanogaster
gcaaacatttgcca

SEQ ID NO: 623627 - DNA, 13 bp, D. melanogaster
gcaaacatttgtg

SEQ ID NO: 623628 - DNA, 13 bp, D. melanogaster
gcaaacatttgtt

SEQ ID NO: 623629 - DNA, 13 bp, D. melanogaster
gcaaacattttaa

SEQ ID NO: 623630 - DNA, 13 bp, D. melanogaster
gcaaacattttat

SEQ ID NO: 623631 - DNA, 13 bp, D. melanogaster
gcaaacattttca

SEQ ID NO: 623632 - DNA, 13 bp, D. melanogaster
gcaaacattttga

SEQ ID NO: 623633 - DNA, 14 bp, D. melanogaster
gcaaacattttgag

SEQ ID NO: 623634 - DNA, 13 bp, D. melanogaster
gcaaacatttttg

SEQ ID NO: 623635 - DNA, 14 bp, D. melanogaster
gcaaacatttttgc

SEQ ID NO: 623636 - DNA, 13 bp, D. melanogaster
gcaaacccaaatc

SEQ ID NO: 623637 - DNA, 13 bp, D. melanogaster
gcaaacccaattt

SEQ ID NO: 623638 - DNA, 13 bp, D. melanogaster
gcaaaccgaaatg

SEQ ID NO: 623639 - DNA, 13 bp, D. melanogaster
gcaaacgaaaatt

SEQ ID NO: 623640 - DNA, 14 bp, D. melanogaster
gcaaacgaaacgaa

SEQ ID NO: 623641 - DNA, 13 bp, D. melanogaster
gcaaacgaaataa

SEQ ID NO: 623642 - DNA, 13 bp, D. melanogaster
gcaaacgaaatga

SEQ ID NO: 623643 - DNA, 13 bp, D. melanogaster
gcaaacgagaaat

SEQ ID NO: 623644 - DNA, 13 bp, D. melanogaster
gcaaacgataaaa

SEQ ID NO: 623645 - DNA, 14 bp, D. melanogaster
gcaaacgattccag

SEQ ID NO: 623646 - DNA, 13 bp, D. melanogaster
gcaaacgcaaaag

SEQ ID NO: 623647 - DNA, 14 bp, D. melanogaster
gcaaacgcaaacgc

SEQ ID NO: 623648 - DNA, 13 bp, D. melanogaster
gcaaacgcaaatg

SEQ ID NO: 623649 - DNA, 13 bp, D. melanogaster
gcaaacgcacaaa

SEQ ID NO: 623650 - DNA, 13 bp, D. melanogaster
gcaaacgcacaca

SEQ ID NO: 623651 - DNA, 13 bp, D. melanogaster
gcaaacggaaaag

SEQ ID NO: 623652 - DNA, 13 bp, D. melanogaster
gcaaacggcctcg

SEQ ID NO: 623653 - DNA, 13 bp, D. melanogaster
gcaaacgggaaaa

SEQ ID NO: 623654 - DNA, 13 bp, D. melanogaster
gcaaacgggctgc

SEQ ID NO: 623655 - DNA, 13 bp, D. melanogaster
gcaaacgggtttc

SEQ ID NO: 623656 - DNA, 13 bp, D. melanogaster
gcaaacgttaaaa

SEQ ID NO: 623657 - DNA, 13 bp, D. melanogaster
gcaaacgtttttt

SEQ ID NO: 623658 - DNA, 14 bp, D. melanogaster
gcaaacgtttttta

SEQ ID NO: 623659 - DNA, 13 bp, D. melanogaster
gcaaactataaaa

SEQ ID NO: 623660 - DNA, 13 bp, D. melanogaster
gcaaactcaatta

SEQ ID NO: 623661 - DNA, 13 bp, D. melanogaster
gcaaactgaattt

SEQ ID NO: 623662 - DNA, 13 bp, D. melanogaster
gcaaactgcaaaa

SEQ ID NO: 623663 - DNA, 13 bp, D. melanogaster
gcaaactgcagca

SEQ ID NO: 623664 - DNA, 13 bp, D. melanogaster
gcaaactgccaaa

SEQ ID NO: 623665 - DNA, 13 bp, D. melanogaster
gcaaactggcaaa

SEQ ID NO: 623666 - DNA, 13 bp, D. melanogaster
gcaaactggtttc

SEQ ID NO: 623667 - DNA, 13 bp, D. melanogaster
gcaaactgtttgc

SEQ ID NO: 623668 - DNA, 13 bp, D. melanogaster
gcaaacttaaatg

SEQ ID NO: 623669 - DNA, 13 bp, D. melanogaster
gcaaacttcgaca

SEQ ID NO: 623670 - DNA, 13 bp, D. melanogaster
gcaaactttaaaa

SEQ ID NO: 623671 - DNA, 13 bp, D. melanogaster
gcaaactttgcag

SEQ ID NO: 623672 - DNA, 13 bp, D. melanogaster
gcaaacttttatt

SEQ ID NO: 623673 - DNA, 13 bp, D. melanogaster
gcaaacttttcaa

SEQ ID NO: 623674 - DNA, 13 bp, D. melanogaster
gcaaacttttcac

SEQ ID NO: 623675 - DNA, 14 bp, D. melanogaster
gcaaactttttggc

SEQ ID NO: 623676 - DNA, 13 bp, D. melanogaster
gcaaacttttttc

SEQ ID NO: 623677 - DNA, 13 bp, D. melanogaster
gcaaagaaaactc

SEQ ID NO: 623678 - DNA, 13 bp, D. melanogaster
gcaaagaaaagtg

SEQ ID NO: 623679 - DNA, 13 bp, D. melanogaster
gcaaagaaattca

SEQ ID NO: 623680 - DNA, 13 bp, D. melanogaster
gcaaagaattttg

SEQ ID NO: 623681 - DNA, 13 bp, D. melanogaster
gcaaagacatgag

SEQ ID NO: 623682 - DNA, 13 bp, D. melanogaster
gcaaagagaaaat

SEQ ID NO: 623683 - DNA, 13 bp, D. melanogaster
gcaaagaggcaaa

SEQ ID NO: 623684 - DNA, 13 bp, D. melanogaster
gcaaagatacaaa

SEQ ID NO: 623685 - DNA, 13 bp, D. melanogaster
gcaaagatacttt

SEQ ID NO: 623686 - DNA, 13 bp, D. melanogaster
gcaaagcaaaagg

SEQ ID NO: 623687 - DNA, 14 bp, D. melanogaster
gcaaagcaaaatgt

SEQ ID NO: 623688 - DNA, 13 bp, D. melanogaster
gcaaagcaaaatt

SEQ ID NO: 623689 - DNA, 13 bp, D. melanogaster
gcaaagcaaagcc

SEQ ID NO: 623690 - DNA, 14 bp, D. melanogaster
gcaaagcaaataaa

SEQ ID NO: 623691 - DNA, 13 bp, D. melanogaster
gcaaagcaataaa

SEQ ID NO: 623692 - DNA, 13 bp, D. melanogaster
gcaaagcagcaaa

SEQ ID NO: 623693 - DNA, 13 bp, D. melanogaster
gcaaagcagccac

SEQ ID NO: 623694 - DNA, 13 bp, D. melanogaster
gcaaagccaaagc

SEQ ID NO: 623695 - DNA, 13 bp, D. melanogaster
gcaaagccacaaa

SEQ ID NO: 623696 - DNA, 13 bp, D. melanogaster
gcaaagccgaaaa

SEQ ID NO: 623697 - DNA, 13 bp, D. melanogaster
gcaaagcgaaatg

SEQ ID NO: 623698 - DNA, 13 bp, D. melanogaster
gcaaagctgcaaa

SEQ ID NO: 623699 - DNA, 13 bp, D. melanogaster
gcaaaggaaaata

SEQ ID NO: 623700 - DNA, 13 bp, D. melanogaster
gcaaaggaaattg

SEQ ID NO: 623701 - DNA, 14 bp, D. melanogaster
gcaaaggaagttgg

SEQ ID NO: 623702 - DNA, 13 bp, D. melanogaster
gcaaaggcaaaac

SEQ ID NO: 623703 - DNA, 13 bp, D. melanogaster
gcaaaggcaaaca

SEQ ID NO: 623704 - DNA, 13 bp, D. melanogaster
gcaaaggcaaata

SEQ ID NO: 623705 - DNA, 13 bp, D. melanogaster
gcaaaggcaactg

SEQ ID NO: 623706 - DNA, 13 bp, D. melanogaster
gcaaaggcaatga

SEQ ID NO: 623707 - DNA, 13 bp, D. melanogaster
gcaaaggcagcaa

SEQ ID NO: 623708 - DNA, 13 bp, D. melanogaster
gcaaaggcagcga

SEQ ID NO: 623709 - DNA, 13 bp, D. melanogaster
gcaaaggcgaaat

SEQ ID NO: 623710 - DNA, 13 bp, D. melanogaster
gcaaaggcttcaa

SEQ ID NO: 623711 - DNA, 13 bp, D. melanogaster
gcaaagggatctg

SEQ ID NO: 623712 - DNA, 14 bp, D. melanogaster
gcaaagtaaaagtt

SEQ ID NO: 623713 - DNA, 13 bp, D. melanogaster
gcaaagtaaaata

SEQ ID NO: 623714 - DNA, 14 bp, D. melanogaster
gcaaagtaaacaaa

SEQ ID NO: 623715 - DNA, 13 bp, D. melanogaster
gcaaagtaaataa

SEQ ID NO: 623716 - DNA, 13 bp, D. melanogaster
gcaaagtaatttc

SEQ ID NO: 623717 - DNA, 13 bp, D. melanogaster
gcaaagtaatttg

SEQ ID NO: 623718 - DNA, 13 bp, D. melanogaster
gcaaagtaatttt

SEQ ID NO: 623719 - DNA, 13 bp, D. melanogaster
gcaaagtactcga

SEQ ID NO: 623720 - DNA, 14 bp, D. melanogaster
gcaaagtactcgag

SEQ ID NO: 623721 - DNA, 13 bp, D. melanogaster
gcaaagtatgcaa

SEQ ID NO: 623722 - DNA, 13 bp, D. melanogaster
gcaaagtattttg

SEQ ID NO: 623723 - DNA, 13 bp, D. melanogaster
gcaaagtcaaaaa

SEQ ID NO: 623724 - DNA, 13 bp, D. melanogaster
gcaaagtcaacaa

SEQ ID NO: 623725 - DNA, 13 bp, D. melanogaster
gcaaagtgaaagt

SEQ ID NO: 623726 - DNA, 14 bp, D. melanogaster
gcaaagtgaaagta

SEQ ID NO: 623727 - DNA, 13 bp, D. melanogaster
gcaaagtgcaaaa

SEQ ID NO: 623728 - DNA, 13 bp, D. melanogaster
gcaaagtgcaaat

SEQ ID NO: 623729 - DNA, 13 bp, D. melanogaster
gcaaagtgcaatg

SEQ ID NO: 623730 - DNA, 13 bp, D. melanogaster
gcaaagtgcactt

SEQ ID NO: 623731 - DNA, 13 bp, D. melanogaster
gcaaagtgcatgc

SEQ ID NO: 623732 - DNA, 13 bp, D. melanogaster
gcaaagtgccaat

SEQ ID NO: 623733 - DNA, 13 bp, D. melanogaster
gcaaagtggcagc

SEQ ID NO: 623734 - DNA, 13 bp, D. melanogaster
gcaaagtggccaa

SEQ ID NO: 623735 - DNA, 13 bp, D. melanogaster
gcaaagtggctgc

SEQ ID NO: 623736 - DNA, 13 bp, D. melanogaster
gcaaagttcaaaa

SEQ ID NO: 623737 - DNA, 13 bp, D. melanogaster
gcaaagttgaaaa

SEQ ID NO: 623738 - DNA, 13 bp, D. melanogaster
gcaaagttggcca

SEQ ID NO: 623739 - DNA, 13 bp, D. melanogaster
gcaaagtttattt

SEQ ID NO: 623740 - DNA, 13 bp, D. melanogaster
gcaaagttttatg

SEQ ID NO: 623741 - DNA, 13 bp, D. melanogaster
gcaaagttttggc

SEQ ID NO: 623742 - DNA, 13 bp, D. melanogaster
gcaaagtttttct

SEQ ID NO: 623743 - DNA, 13 bp, D. melanogaster
gcaaagtttttgg

SEQ ID NO: 623744 - DNA, 14 bp, D. melanogaster
gcaaagtttttggc

SEQ ID NO: 623745 - DNA, 14 bp, D. melanogaster
gcaaataaaaatta

SEQ ID NO: 623746 - DNA, 13 bp, D. melanogaster
gcaaataaaacac

SEQ ID NO: 623747 - DNA, 14 bp, D. melanogaster
gcaaataaaacgaa

SEQ ID NO: 623748 - DNA, 13 bp, D. melanogaster
gcaaataaaacgt

SEQ ID NO: 623749 - DNA, 13 bp, D. melanogaster
gcaaataaaagtt

SEQ ID NO: 623750 - DNA, 13 bp, D. melanogaster
gcaaataaaattt

SEQ ID NO: 623751 - DNA, 14 bp, D. melanogaster
gcaaataaaatttg

SEQ ID NO: 623752 - DNA, 14 bp, D. melanogaster
gcaaataaacaaat

SEQ ID NO: 623753 - DNA, 13 bp, D. melanogaster
gcaaataaacaac

SEQ ID NO: 623754 - DNA, 13 bp, D. melanogaster
gcaaataaacaga

SEQ ID NO: 623755 - DNA, 13 bp, D. melanogaster
gcaaataaactaa

SEQ ID NO: 623756 - DNA, 14 bp, D. melanogaster
gcaaataaagacat

SEQ ID NO: 623757 - DNA, 13 bp, D. melanogaster
gcaaataaagcaa

SEQ ID NO: 623758 - DNA, 13 bp, D. melanogaster
gcaaataaaggaa

SEQ ID NO: 623759 - DNA, 13 bp, D. melanogaster
gcaaataaagtta

SEQ ID NO: 623760 - DNA, 14 bp, D. melanogaster
gcaaataaataaac

SEQ ID NO: 623761 - DNA, 14 bp, D. melanogaster
gcaaataaataaat

SEQ ID NO: 623762 - DNA, 13 bp, D. melanogaster
gcaaataaataca

SEQ ID NO: 623763 - DNA, 13 bp, D. melanogaster
gcaaataaatatt

SEQ ID NO: 623764 - DNA, 13 bp, D. melanogaster
gcaaataaatcaa

SEQ ID NO: 623765 - DNA, 14 bp, D. melanogaster
gcaaataaatcaaa

SEQ ID NO: 623766 - DNA, 13 bp, D. melanogaster
gcaaataaatcat

SEQ ID NO: 623767 - DNA, 13 bp, D. melanogaster
gcaaataaatgca

SEQ ID NO: 623768 - DNA, 13 bp, D. melanogaster
gcaaataaatgtg

SEQ ID NO: 623769 - DNA, 13 bp, D. melanogaster
gcaaataaatgtt

SEQ ID NO: 623770 - DNA, 13 bp, D. melanogaster
gcaaataaattaa

SEQ ID NO: 623771 - DNA, 14 bp, D. melanogaster
gcaaataaattaca

SEQ ID NO: 623772 - DNA, 14 bp, D. melanogaster
gcaaataaattatt

SEQ ID NO: 623773 - DNA, 14 bp, D. melanogaster
gcaaataaattgca

SEQ ID NO: 623774 - DNA, 13 bp, D. melanogaster
gcaaataaccaaa

SEQ ID NO: 623775 - DNA, 13 bp, D. melanogaster
gcaaataagaaat

SEQ ID NO: 623776 - DNA, 13 bp, D. melanogaster
gcaaataagcaaa

SEQ ID NO: 623777 - DNA, 13 bp, D. melanogaster
gcaaataagtttc

SEQ ID NO: 623778 - DNA, 13 bp, D. melanogaster
gcaaataataaat

SEQ ID NO: 623779 - DNA, 13 bp, D. melanogaster
gcaaataataaca

SEQ ID NO: 623780 - DNA, 13 bp, D. melanogaster
gcaaataataata

SEQ ID NO: 623781 - DNA, 13 bp, D. melanogaster
gcaaataataatt

SEQ ID NO: 623782 - DNA, 13 bp, D. melanogaster
gcaaataatcaat

SEQ ID NO: 623783 - DNA, 13 bp, D. melanogaster
gcaaataatgaaa

SEQ ID NO: 623784 - DNA, 13 bp, D. melanogaster
gcaaataatgtaa

SEQ ID NO: 623785 - DNA, 14 bp, D. melanogaster
gcaaataattaaat

SEQ ID NO: 623786 - DNA, 13 bp, D. melanogaster
gcaaataattaca

SEQ ID NO: 623787 - DNA, 13 bp, D. melanogaster
gcaaataattgca

SEQ ID NO: 623788 - DNA, 13 bp, D. melanogaster
gcaaatacaaaat

SEQ ID NO: 623789 - DNA, 13 bp, D. melanogaster
gcaaatacaaaca

SEQ ID NO: 623790 - DNA, 13 bp, D. melanogaster
gcaaatacaaagg

SEQ ID NO: 623791 - DNA, 13 bp, D. melanogaster
gcaaatacaacaa

SEQ ID NO: 623792 - DNA, 13 bp, D. melanogaster
gcaaatacaatcg

SEQ ID NO: 623793 - DNA, 13 bp, D. melanogaster
gcaaatacacaaa

SEQ ID NO: 623794 - DNA, 13 bp, D. melanogaster
gcaaataccaaca

SEQ ID NO: 623795 - DNA, 13 bp, D. melanogaster
gcaaatacttttg

SEQ ID NO: 623796 - DNA, 13 bp, D. melanogaster
gcaaatagaaaat

SEQ ID NO: 623797 - DNA, 14 bp, D. melanogaster
gcaaatagcaaata

SEQ ID NO: 623798 - DNA, 13 bp, D. melanogaster
gcaaatagcaata

SEQ ID NO: 623799 - DNA, 13 bp, D. melanogaster
gcaaatagccaaa

SEQ ID NO: 623800 - DNA, 13 bp, D. melanogaster
gcaaatagctaaa

SEQ ID NO: 623801 - DNA, 13 bp, D. melanogaster
gcaaataggcaaa

SEQ ID NO: 623802 - DNA, 13 bp, D. melanogaster
gcaaatagttttt

SEQ ID NO: 623803 - DNA, 13 bp, D. melanogaster
gcaaatataaaat

SEQ ID NO: 623804 - DNA, 13 bp, D. melanogaster
gcaaatataaaca

SEQ ID NO: 623805 - DNA, 13 bp, D. melanogaster
gcaaatataatta

SEQ ID NO: 623806 - DNA, 13 bp, D. melanogaster
gcaaatatacaaa

SEQ ID NO: 623807 - DNA, 13 bp, D. melanogaster
gcaaatatagaaa

SEQ ID NO: 623808 - DNA, 13 bp, D. melanogaster
gcaaatatataaa

SEQ ID NO: 623809 - DNA, 13 bp, D. melanogaster
gcaaatatatcta

SEQ ID NO: 623810 - DNA, 14 bp, D. melanogaster
gcaaatatatctat

SEQ ID NO: 623811 - DNA, 13 bp, D. melanogaster
gcaaatatatgca

SEQ ID NO: 623812 - DNA, 13 bp, D. melanogaster
gcaaatatgccaa

SEQ ID NO: 623813 - DNA, 13 bp, D. melanogaster
gcaaatatggcag

SEQ ID NO: 623814 - DNA, 13 bp, D. melanogaster
gcaaatatgtttg

SEQ ID NO: 623815 - DNA, 13 bp, D. melanogaster
gcaaatattgatt

SEQ ID NO: 623816 - DNA, 13 bp, D. melanogaster
gcaaatattgttg

SEQ ID NO: 623817 - DNA, 14 bp, D. melanogaster
gcaaatatttaaat

SEQ ID NO: 623818 - DNA, 13 bp, D. melanogaster
gcaaatatttaat

SEQ ID NO: 623819 - DNA, 13 bp, D. melanogaster
gcaaatatttaca

SEQ ID NO: 623820 - DNA, 13 bp, D. melanogaster
gcaaatatttacc

SEQ ID NO: 623821 - DNA, 13 bp, D. melanogaster
gcaaatatttata

SEQ ID NO: 623822 - DNA, 13 bp, D. melanogaster
gcaaatatttatt

SEQ ID NO: 623823 - DNA, 14 bp, D. melanogaster
gcaaatatttcaaa

SEQ ID NO: 623824 - DNA, 13 bp, D. melanogaster
gcaaatatttcac

SEQ ID NO: 623825 - DNA, 14 bp, D. melanogaster
gcaaatatttcatt

SEQ ID NO: 623826 - DNA, 13 bp, D. melanogaster
gcaaatatttcca

SEQ ID NO: 623827 - DNA, 13 bp, D. melanogaster
gcaaatatttgag

SEQ ID NO: 623828 - DNA, 13 bp, D. melanogaster
gcaaatatttgca

SEQ ID NO: 623829 - DNA, 14 bp, D. melanogaster
gcaaatatttgcca

SEQ ID NO: 623830 - DNA, 13 bp, D. melanogaster
gcaaatatttgta

SEQ ID NO: 623831 - DNA, 13 bp, D. melanogaster
gcaaatattttca

SEQ ID NO: 623832 - DNA, 13 bp, D. melanogaster
gcaaatattttgc

SEQ ID NO: 623833 - DNA, 14 bp, D. melanogaster
gcaaatatttttta

SEQ ID NO: 623834 - DNA, 13 bp, D. melanogaster
gcaaatcaaacaa

SEQ ID NO: 623835 - DNA, 14 bp, D. melanogaster
gcaaatcaaacaat

SEQ ID NO: 623836 - DNA, 13 bp, D. melanogaster
gcaaatcaaagcc

SEQ ID NO: 623837 - DNA, 14 bp, D. melanogaster
gcaaatcaaatcaa

SEQ ID NO: 623838 - DNA, 13 bp, D. melanogaster
gcaaatcaaatta

SEQ ID NO: 623839 - DNA, 13 bp, D. melanogaster
gcaaatcaataaa

SEQ ID NO: 623840 - DNA, 13 bp, D. melanogaster
gcaaatcaatcaa

SEQ ID NO: 623841 - DNA, 13 bp, D. melanogaster
gcaaatcaatttg

SEQ ID NO: 623842 - DNA, 13 bp, D. melanogaster
gcaaatcagctga

SEQ ID NO: 623843 - DNA, 13 bp, D. melanogaster
gcaaatcagctgt

SEQ ID NO: 623844 - DNA, 13 bp, D. melanogaster
gcaaatccaaatc

SEQ ID NO: 623845 - DNA, 13 bp, D. melanogaster
gcaaatccaatta

SEQ ID NO: 623846 - DNA, 13 bp, D. melanogaster
gcaaatcccattt

SEQ ID NO: 623847 - DNA, 13 bp, D. melanogaster
gcaaatcccgctc

SEQ ID NO: 623848 - DNA, 13 bp, D. melanogaster
gcaaatcgaaaac

SEQ ID NO: 623849 - DNA, 13 bp, D. melanogaster
gcaaatcgaataa

SEQ ID NO: 623850 - DNA, 13 bp, D. melanogaster
gcaaatcgatgga

SEQ ID NO: 623851 - DNA, 13 bp, D. melanogaster
gcaaatcgattga

SEQ ID NO: 623852 - DNA, 13 bp, D. melanogaster
gcaaatcgattgg

SEQ ID NO: 623853 - DNA, 14 bp, D. melanogaster
gcaaatcgattggg

SEQ ID NO: 623854 - DNA, 13 bp, D. melanogaster
gcaaatcgctggc

SEQ ID NO: 623855 - DNA, 13 bp, D. melanogaster
gcaaatcggtgat

SEQ ID NO: 623856 - DNA, 13 bp, D. melanogaster
gcaaatctgttgg

SEQ ID NO: 623857 - DNA, 13 bp, D. melanogaster
gcaaatgaaaaat

SEQ ID NO: 623858 - DNA, 13 bp, D. melanogaster
gcaaatgaaaagc

SEQ ID NO: 623859 - DNA, 13 bp, D. melanogaster
gcaaatgaaaatg

SEQ ID NO: 623860 - DNA, 14 bp, D. melanogaster
gcaaatgaaaatgg

SEQ ID NO: 623861 - DNA, 13 bp, D. melanogaster
gcaaatgaaagaa

SEQ ID NO: 623862 - DNA, 13 bp, D. melanogaster
gcaaatgaaatga

SEQ ID NO: 623863 - DNA, 14 bp, D. melanogaster
gcaaatgaaatgaa

SEQ ID NO: 623864 - DNA, 13 bp, D. melanogaster
gcaaatgaaatgc

SEQ ID NO: 623865 - DNA, 13 bp, D. melanogaster
gcaaatgaaattt

SEQ ID NO: 623866 - DNA, 13 bp, D. melanogaster
gcaaatgaagcaa

SEQ ID NO: 623867 - DNA, 13 bp, D. melanogaster
gcaaatgaagttg

SEQ ID NO: 623868 - DNA, 13 bp, D. melanogaster
gcaaatgaataaa

SEQ ID NO: 623869 - DNA, 13 bp, D. melanogaster
gcaaatgaatata

SEQ ID NO: 623870 - DNA, 13 bp, D. melanogaster
gcaaatgaatgaa

SEQ ID NO: 623871 - DNA, 13 bp, D. melanogaster
gcaaatgaatggc

SEQ ID NO: 623872 - DNA, 13 bp, D. melanogaster
gcaaatgaattgt

SEQ ID NO: 623873 - DNA, 13 bp, D. melanogaster
gcaaatgaattta

SEQ ID NO: 623874 - DNA, 13 bp, D. melanogaster
gcaaatgaatttc

SEQ ID NO: 623875 - DNA, 13 bp, D. melanogaster
gcaaatgaatttt

SEQ ID NO: 623876 - DNA, 13 bp, D. melanogaster
gcaaatgacaaaa

SEQ ID NO: 623877 - DNA, 13 bp, D. melanogaster
gcaaatgacaaac

SEQ ID NO: 623878 - DNA, 13 bp, D. melanogaster
gcaaatgacattt

SEQ ID NO: 623879 - DNA, 13 bp, D. melanogaster
gcaaatgagcaaa

SEQ ID NO: 623880 - DNA, 13 bp, D. melanogaster
gcaaatgagcagc

SEQ ID NO: 623881 - DNA, 13 bp, D. melanogaster
gcaaatgataaat

SEQ ID NO: 623882 - DNA, 13 bp, D. melanogaster
gcaaatgatcaac

SEQ ID NO: 623883 - DNA, 13 bp, D. melanogaster
gcaaatgattttg

SEQ ID NO: 623884 - DNA, 13 bp, D. melanogaster
gcaaatgcaaaaa

SEQ ID NO: 623885 - DNA, 13 bp, D. melanogaster
gcaaatgcaaaac

SEQ ID NO: 623886 - DNA, 13 bp, D. melanogaster
gcaaatgcaaaag

SEQ ID NO: 623887 - DNA, 14 bp, D. melanogaster
gcaaatgcaaaatg

SEQ ID NO: 623888 - DNA, 14 bp, D. melanogaster
gcaaatgcaaacaa

SEQ ID NO: 623889 - DNA, 16 bp, D. melanogaster
gcaaatgcaaatgcaa

SEQ ID NO: 623890 - DNA, 14 bp, D. melanogaster
gcaaatgcaaattg

SEQ ID NO: 623891 - DNA, 13 bp, D. melanogaster
gcaaatgcaagtg

SEQ ID NO: 623892 - DNA, 13 bp, D. melanogaster
gcaaatgcaataa

SEQ ID NO: 623893 - DNA, 13 bp, D. melanogaster
gcaaatgcaatat

SEQ ID NO: 623894 - DNA, 13 bp, D. melanogaster
gcaaatgcaattg

SEQ ID NO: 623895 - DNA, 13 bp, D. melanogaster
gcaaatgcaattt

SEQ ID NO: 623896 - DNA, 13 bp, D. melanogaster
gcaaatgcacaaa

SEQ ID NO: 623897 - DNA, 13 bp, D. melanogaster
gcaaatgcagcaa

SEQ ID NO: 623898 - DNA, 14 bp, D. melanogaster
gcaaatgcagcaaa

SEQ ID NO: 623899 - DNA, 13 bp, D. melanogaster
gcaaatgcagcca

SEQ ID NO: 623900 - DNA, 13 bp, D. melanogaster
gcaaatgcagctg

SEQ ID NO: 623901 - DNA, 13 bp, D. melanogaster
gcaaatgcataat

SEQ ID NO: 623902 - DNA, 13 bp, D. melanogaster
gcaaatgcattaa

SEQ ID NO: 623903 - DNA, 13 bp, D. melanogaster
gcaaatgcattca

SEQ ID NO: 623904 - DNA, 13 bp, D. melanogaster
gcaaatgcatttc

SEQ ID NO: 623905 - DNA, 13 bp, D. melanogaster
gcaaatgcatttg

SEQ ID NO: 623906 - DNA, 13 bp, D. melanogaster
gcaaatgccaaat

SEQ ID NO: 623907 - DNA, 13 bp, D. melanogaster
gcaaatgccattt

SEQ ID NO: 623908 - DNA, 14 bp, D. melanogaster
gcaaatgctagtgg

SEQ ID NO: 623909 - DNA, 13 bp, D. melanogaster
gcaaatgctcaac

SEQ ID NO: 623910 - DNA, 13 bp, D. melanogaster
gcaaatgctgcaa

SEQ ID NO: 623911 - DNA, 13 bp, D. melanogaster
gcaaatgctggat

SEQ ID NO: 623912 - DNA, 13 bp, D. melanogaster
gcaaatggaaaat

SEQ ID NO: 623913 - DNA, 14 bp, D. melanogaster
gcaaatggaaaatg

SEQ ID NO: 623914 - DNA, 14 bp, D. melanogaster
gcaaatggaaatgc

SEQ ID NO: 623915 - DNA, 14 bp, D. melanogaster
gcaaatggaaatgg

SEQ ID NO: 623916 - DNA, 13 bp, D. melanogaster
gcaaatggaattg

SEQ ID NO: 623917 - DNA, 13 bp, D. melanogaster
gcaaatggagaaa

SEQ ID NO: 623918 - DNA, 14 bp, D. melanogaster
gcaaatggcaaatg

SEQ ID NO: 623919 - DNA, 13 bp, D. melanogaster
gcaaatggcaatg

SEQ ID NO: 623920 - DNA, 14 bp, D. melanogaster
gcaaatggcaatgg

SEQ ID NO: 623921 - DNA, 13 bp, D. melanogaster
gcaaatggcagcc

SEQ ID NO: 623922 - DNA, 13 bp, D. melanogaster
gcaaatggcatta

SEQ ID NO: 623923 - DNA, 13 bp, D. melanogaster
gcaaatggccaaa

SEQ ID NO: 623924 - DNA, 13 bp, D. melanogaster
gcaaatggccagc

SEQ ID NO: 623925 - DNA, 13 bp, D. melanogaster
gcaaatggggaaa

SEQ ID NO: 623926 - DNA, 13 bp, D. melanogaster
gcaaatgtaaaat

SEQ ID NO: 623927 - DNA, 13 bp, D. melanogaster
gcaaatgtaatta

SEQ ID NO: 623928 - DNA, 13 bp, D. melanogaster
gcaaatgtatttt

SEQ ID NO: 623929 - DNA, 13 bp, D. melanogaster
gcaaatgtgaatg

SEQ ID NO: 623930 - DNA, 13 bp, D. melanogaster
gcaaatgtggata

SEQ ID NO: 623931 - DNA, 14 bp, D. melanogaster
gcaaatgtggatac

SEQ ID NO: 623932 - DNA, 14 bp, D. melanogaster
gcaaatgtggccaa

SEQ ID NO: 623933 - DNA, 13 bp, D. melanogaster
gcaaatgtgtttt

SEQ ID NO: 623934 - DNA, 13 bp, D. melanogaster
gcaaatgttgatg

SEQ ID NO: 623935 - DNA, 13 bp, D. melanogaster
gcaaatgtttggc

SEQ ID NO: 623936 - DNA, 13 bp, D. melanogaster
gcaaatgtttgtg

SEQ ID NO: 623937 - DNA, 13 bp, D. melanogaster
gcaaatgttttcc

SEQ ID NO: 623938 - DNA, 13 bp, D. melanogaster
gcaaatgttttta

SEQ ID NO: 623939 - DNA, 13 bp, D. melanogaster
gcaaattaaattg

SEQ ID NO: 623940 - DNA, 14 bp, D. melanogaster
gcaaattaaattgt

SEQ ID NO: 623941 - DNA, 13 bp, D. melanogaster
gcaaattaaattt

SEQ ID NO: 623942 - DNA, 13 bp, D. melanogaster
gcaaattaagtga

SEQ ID NO: 623943 - DNA, 13 bp, D. melanogaster
gcaaattaatggc

SEQ ID NO: 623944 - DNA, 13 bp, D. melanogaster
gcaaattaattat

SEQ ID NO: 623945 - DNA, 13 bp, D. melanogaster
gcaaattacattt

SEQ ID NO: 623946 - DNA, 13 bp, D. melanogaster
gcaaattactttg

SEQ ID NO: 623947 - DNA, 13 bp, D. melanogaster
gcaaattactttt

SEQ ID NO: 623948 - DNA, 13 bp, D. melanogaster
gcaaattagaaaa

SEQ ID NO: 623949 - DNA, 14 bp, D. melanogaster
gcaaattagaaaat

SEQ ID NO: 623950 - DNA, 13 bp, D. melanogaster
gcaaattagattt

SEQ ID NO: 623951 - DNA, 13 bp, D. melanogaster
gcaaattagcaaa

SEQ ID NO: 623952 - DNA, 13 bp, D. melanogaster
gcaaattaggcaa

SEQ ID NO: 623953 - DNA, 14 bp, D. melanogaster
gcaaattatgcaaa

SEQ ID NO: 623954 - DNA, 13 bp, D. melanogaster
gcaaattatgcat

SEQ ID NO: 623955 - DNA, 13 bp, D. melanogaster
gcaaattattaga

SEQ ID NO: 623956 - DNA, 13 bp, D. melanogaster
gcaaattattcaa

SEQ ID NO: 623957 - DNA, 13 bp, D. melanogaster
gcaaattattgtt

SEQ ID NO: 623958 - DNA, 13 bp, D. melanogaster
gcaaattatttta

SEQ ID NO: 623959 - DNA, 13 bp, D. melanogaster
gcaaattcaaatt

SEQ ID NO: 623960 - DNA, 13 bp, D. melanogaster
gcaaattcaatta

SEQ ID NO: 623961 - DNA, 13 bp, D. melanogaster
gcaaattcaattt

SEQ ID NO: 623962 - DNA, 14 bp, D. melanogaster
gcaaattcaatttg

SEQ ID NO: 623963 - DNA, 13 bp, D. melanogaster
gcaaattcgaatg

SEQ ID NO: 623964 - DNA, 13 bp, D. melanogaster
gcaaattctttgt

SEQ ID NO: 623965 - DNA, 13 bp, D. melanogaster
gcaaattgaaagc

SEQ ID NO: 623966 - DNA, 14 bp, D. melanogaster
gcaaattgaaattg

SEQ ID NO: 623967 - DNA, 13 bp, D. melanogaster
gcaaattgaacaa

SEQ ID NO: 623968 - DNA, 13 bp, D. melanogaster
gcaaattgaattg

SEQ ID NO: 623969 - DNA, 13 bp, D. melanogaster
gcaaattgaattt

SEQ ID NO: 623970 - DNA, 14 bp, D. melanogaster
gcaaattgaattta

SEQ ID NO: 623971 - DNA, 14 bp, D. melanogaster
gcaaattgaatttc

SEQ ID NO: 623972 - DNA, 13 bp, D. melanogaster
gcaaattgagtgc

SEQ ID NO: 623973 - DNA, 13 bp, D. melanogaster
gcaaattgagttt

SEQ ID NO: 623974 - DNA, 13 bp, D. melanogaster
gcaaattgataaa

SEQ ID NO: 623975 - DNA, 13 bp, D. melanogaster
gcaaattgatttg

SEQ ID NO: 623976 - DNA, 13 bp, D. melanogaster
gcaaattgatttt

SEQ ID NO: 623977 - DNA, 14 bp, D. melanogaster
gcaaattgatttta

SEQ ID NO: 623978 - DNA, 13 bp, D. melanogaster
gcaaattgcaaaa

SEQ ID NO: 623979 - DNA, 14 bp, D. melanogaster
gcaaattgcaaaat

SEQ ID NO: 623980 - DNA, 13 bp, D. melanogaster
gcaaattgcaaat

SEQ ID NO: 623981 - DNA, 14 bp, D. melanogaster
gcaaattgcaaatg

SEQ ID NO: 623982 - DNA, 14 bp, D. melanogaster
gcaaattgcaaatt

SEQ ID NO: 623983 - DNA, 13 bp, D. melanogaster
gcaaattgcaatt

SEQ ID NO: 623984 - DNA, 13 bp, D. melanogaster
gcaaattgcagtg

SEQ ID NO: 623985 - DNA, 13 bp, D. melanogaster
gcaaattgcataa

SEQ ID NO: 623986 - DNA, 13 bp, D. melanogaster
gcaaattgcattg

SEQ ID NO: 623987 - DNA, 13 bp, D. melanogaster
gcaaattgcattt

SEQ ID NO: 623988 - DNA, 14 bp, D. melanogaster
gcaaattgcatttt

SEQ ID NO: 623989 - DNA, 13 bp, D. melanogaster
gcaaattgccaac

SEQ ID NO: 623990 - DNA, 13 bp, D. melanogaster
gcaaattgccagc

SEQ ID NO: 623991 - DNA, 13 bp, D. melanogaster
gcaaattgcgcaa

SEQ ID NO: 623992 - DNA, 13 bp, D. melanogaster
gcaaattgctcaa

SEQ ID NO: 623993 - DNA, 13 bp, D. melanogaster
gcaaattgctgca

SEQ ID NO: 623994 - DNA, 13 bp, D. melanogaster
gcaaattgctggg

SEQ ID NO: 623995 - DNA, 13 bp, D. melanogaster
gcaaattggcagc

SEQ ID NO: 623996 - DNA, 13 bp, D. melanogaster
gcaaattggcatt

SEQ ID NO: 623997 - DNA, 13 bp, D. melanogaster
gcaaattggccag

SEQ ID NO: 623998 - DNA, 13 bp, D. melanogaster
gcaaattgtattg

SEQ ID NO: 623999 - DNA, 13 bp, D. melanogaster
gcaaattgtgaaa

SEQ ID NO: 624000 - DNA, 13 bp, D. melanogaster
gcaaattgtgatt

SEQ ID NO: 624001 - DNA, 13 bp, D. melanogaster
gcaaattgtgcaa

SEQ ID NO: 624002 - DNA, 13 bp, D. melanogaster
gcaaattgtgtaa

SEQ ID NO: 624003 - DNA, 13 bp, D. melanogaster
gcaaattgtgttt

SEQ ID NO: 624004 - DNA, 13 bp, D. melanogaster
gcaaattgttaaa

SEQ ID NO: 624005 - DNA, 13 bp, D. melanogaster
gcaaattgttaat

SEQ ID NO: 624006 - DNA, 13 bp, D. melanogaster
gcaaattgtttac

SEQ ID NO: 624007 - DNA, 13 bp, D. melanogaster
gcaaattgtttgc

SEQ ID NO: 624008 - DNA, 13 bp, D. melanogaster
gcaaattgttttc

SEQ ID NO: 624009 - DNA, 13 bp, D. melanogaster
gcaaatttaacaa

SEQ ID NO: 624010 - DNA, 13 bp, D. melanogaster
gcaaatttaattg

SEQ ID NO: 624011 - DNA, 13 bp, D. melanogaster
gcaaatttatgca

SEQ ID NO: 624012 - DNA, 13 bp, D. melanogaster
gcaaatttattca

SEQ ID NO: 624013 - DNA, 13 bp, D. melanogaster
gcaaatttcattt

SEQ ID NO: 624014 - DNA, 13 bp, D. melanogaster
gcaaatttcgaat

SEQ ID NO: 624015 - DNA, 13 bp, D. melanogaster
gcaaatttgatta

SEQ ID NO: 624016 - DNA, 13 bp, D. melanogaster
gcaaatttgcata

SEQ ID NO: 624017 - DNA, 13 bp, D. melanogaster
gcaaatttgccat

SEQ ID NO: 624018 - DNA, 13 bp, D. melanogaster
gcaaatttgctgg

SEQ ID NO: 624019 - DNA, 13 bp, D. melanogaster
gcaaatttgttga

SEQ ID NO: 624020 - DNA, 13 bp, D. melanogaster
gcaaatttgttgc

SEQ ID NO: 624021 - DNA, 14 bp, D. melanogaster
gcaaattttaatga

SEQ ID NO: 624022 - DNA, 13 bp, D. melanogaster
gcaaattttatga

SEQ ID NO: 624023 - DNA, 13 bp, D. melanogaster
gcaaattttcatt

SEQ ID NO: 624024 - DNA, 13 bp, D. melanogaster
gcaaattttcgaa

SEQ ID NO: 624025 - DNA, 13 bp, D. melanogaster
gcaaatttttaaa

SEQ ID NO: 624026 - DNA, 13 bp, D. melanogaster
gcaaatttttaat

SEQ ID NO: 624027 - DNA, 13 bp, D. melanogaster
gcaaatttttata

SEQ ID NO: 624028 - DNA, 13 bp, D. melanogaster
gcaaattttttga

SEQ ID NO: 624029 - DNA, 13 bp, D. melanogaster
gcaacaaaaagcc

SEQ ID NO: 624030 - DNA, 13 bp, D. melanogaster
gcaacaaaaagcg

SEQ ID NO: 624031 - DNA, 13 bp, D. melanogaster
gcaacaaaaagtg

SEQ ID NO: 624032 - DNA, 13 bp, D. melanogaster
gcaacaaaaatga

SEQ ID NO: 624033 - DNA, 13 bp, D. melanogaster
gcaacaaaaatgt

SEQ ID NO: 624034 - DNA, 13 bp, D. melanogaster
gcaacaaaaattg

SEQ ID NO: 624035 - DNA, 14 bp, D. melanogaster
gcaacaaaagcagc

SEQ ID NO: 624036 - DNA, 13 bp, D. melanogaster
gcaacaaaagcat

SEQ ID NO: 624037 - DNA, 13 bp, D. melanogaster
gcaacaaaagcca

SEQ ID NO: 624038 - DNA, 13 bp, D. melanogaster
gcaacaaaagccg

SEQ ID NO: 624039 - DNA, 13 bp, D. melanogaster
gcaacaaaatatt

SEQ ID NO: 624040 - DNA, 13 bp, D. melanogaster
gcaacaaaatcaa

SEQ ID NO: 624041 - DNA, 14 bp, D. melanogaster
gcaacaaaatgaaa

SEQ ID NO: 624042 - DNA, 13 bp, D. melanogaster
gcaacaaaatggc

SEQ ID NO: 624043 - DNA, 13 bp, D. melanogaster
gcaacaaaattaa

SEQ ID NO: 624044 - DNA, 13 bp, D. melanogaster
gcaacaaaattac

SEQ ID NO: 624045 - DNA, 14 bp, D. melanogaster
gcaacaaaattagc

SEQ ID NO: 624046 - DNA, 13 bp, D. melanogaster
gcaacaaactaaa

SEQ ID NO: 624047 - DNA, 13 bp, D. melanogaster
gcaacaaactgtc

SEQ ID NO: 624048 - DNA, 13 bp, D. melanogaster
gcaacaaaggcaa

SEQ ID NO: 624049 - DNA, 13 bp, D. melanogaster
gcaacaaagtaga

SEQ ID NO: 624050 - DNA, 13 bp, D. melanogaster
gcaacaaagtgct

SEQ ID NO: 624051 - DNA, 13 bp, D. melanogaster
gcaacaaagtgtt

SEQ ID NO: 624052 - DNA, 13 bp, D. melanogaster
gcaacaaagttgc

SEQ ID NO: 624053 - DNA, 14 bp, D. melanogaster
gcaacaaatacaaa

SEQ ID NO: 624054 - DNA, 13 bp, D. melanogaster
gcaacaaatcgcc

SEQ ID NO: 624055 - DNA, 13 bp, D. melanogaster
gcaacaaatgaaa

SEQ ID NO: 624056 - DNA, 13 bp, D. melanogaster
gcaacaaatgcaa

SEQ ID NO: 624057 - DNA, 13 bp, D. melanogaster
gcaacaaatggca

SEQ ID NO: 624058 - DNA, 13 bp, D. melanogaster
gcaacaaatgttg

SEQ ID NO: 624059 - DNA, 14 bp, D. melanogaster
gcaacaaatgttgc

SEQ ID NO: 624060 - DNA, 13 bp, D. melanogaster
gcaacaaattaaa

SEQ ID NO: 624061 - DNA, 14 bp, D. melanogaster
gcaacaaattaaat

SEQ ID NO: 624062 - DNA, 13 bp, D. melanogaster
gcaacaaattaat

SEQ ID NO: 624063 - DNA, 13 bp, D. melanogaster
gcaacaaattcaa

SEQ ID NO: 624064 - DNA, 13 bp, D. melanogaster
gcaacaaattgaa

SEQ ID NO: 624065 - DNA, 14 bp, D. melanogaster
gcaacaaattgaaa

SEQ ID NO: 624066 - DNA, 14 bp, D. melanogaster
gcaacaaattgcag

SEQ ID NO: 624067 - DNA, 13 bp, D. melanogaster
gcaacaaattgtt

SEQ ID NO: 624068 - DNA, 13 bp, D. melanogaster
gcaacaaatttgc

SEQ ID NO: 624069 - DNA, 14 bp, D. melanogaster
gcaacaacaaagcg

SEQ ID NO: 624070 - DNA, 14 bp, D. melanogaster
gcaacaacaaaggc

SEQ ID NO: 624071 - DNA, 13 bp, D. melanogaster
gcaacaacaaata

SEQ ID NO: 624072 - DNA, 14 bp, D. melanogaster
gcaacaacaaataa

SEQ ID NO: 624073 - DNA, 13 bp, D. melanogaster
gcaacaacaaatc

SEQ ID NO: 624074 - DNA, 13 bp, D. melanogaster
gcaacaacaaatg

SEQ ID NO: 624075 - DNA, 13 bp, D. melanogaster
gcaacaacaaatt

SEQ ID NO: 624076 - DNA, 14 bp, D. melanogaster
gcaacaacaaattg

SEQ ID NO: 624077 - DNA, 14 bp, D. melanogaster
gcaacaacaacaat

SEQ ID NO: 624078 - DNA, 14 bp, D. melanogaster
gcaacaacaacatt

SEQ ID NO: 624079 - DNA, 13 bp, D. melanogaster
gcaacaacaacga

SEQ ID NO: 624080 - DNA, 14 bp, D. melanogaster
gcaacaacaacgag

SEQ ID NO: 624081 - DNA, 13 bp, D. melanogaster
gcaacaacaactg

SEQ ID NO: 624082 - DNA, 13 bp, D. melanogaster
gcaacaacaactt

SEQ ID NO: 624083 - DNA, 13 bp, D. melanogaster
gcaacaacaagcc

SEQ ID NO: 624084 - DNA, 13 bp, D. melanogaster
gcaacaacaagcg

SEQ ID NO: 624085 - DNA, 13 bp, D. melanogaster
gcaacaacaagtc

SEQ ID NO: 624086 - DNA, 13 bp, D. melanogaster
gcaacaacaataa

SEQ ID NO: 624087 - DNA, 14 bp, D. melanogaster
gcaacaacaataat

SEQ ID NO: 624088 - DNA, 13 bp, D. melanogaster
gcaacaacaatca

SEQ ID NO: 624089 - DNA, 14 bp, D. melanogaster
gcaacaacaatcaa

SEQ ID NO: 624090 - DNA, 14 bp, D. melanogaster
gcaacaacaatggg

SEQ ID NO: 624091 - DNA, 14 bp, D. melanogaster
gcaacaacaattac

SEQ ID NO: 624092 - DNA, 14 bp, D. melanogaster
gcaacaacagcaat

SEQ ID NO: 624093 - DNA, 16 bp, D. melanogaster
gcaacaacagcagcaa

SEQ ID NO: 624094 - DNA, 13 bp, D. melanogaster
gcaacaacagcat

SEQ ID NO: 624095 - DNA, 13 bp, D. melanogaster
gcaacaacagccg

SEQ ID NO: 624096 - DNA, 13 bp, D. melanogaster
gcaacaacagcta

SEQ ID NO: 624097 - DNA, 13 bp, D. melanogaster
gcaacaacataat

SEQ ID NO: 624098 - DNA, 13 bp, D. melanogaster
gcaacaacatcat

SEQ ID NO: 624099 - DNA, 13 bp, D. melanogaster
gcaacaacatcga

SEQ ID NO: 624100 - DNA, 14 bp, D. melanogaster
gcaacaacgacaac

SEQ ID NO: 624101 - DNA, 13 bp, D. melanogaster
gcaacaacggcaa

SEQ ID NO: 624102 - DNA, 14 bp, D. melanogaster
gcaacaacggcaac

SEQ ID NO: 624103 - DNA, 13 bp, D. melanogaster
gcaacaactgaaa

SEQ ID NO: 624104 - DNA, 13 bp, D. melanogaster
gcaacaactgcaa

SEQ ID NO: 624105 - DNA, 14 bp, D. melanogaster
gcaacaactgcaac

SEQ ID NO: 624106 - DNA, 14 bp, D. melanogaster
gcaacaactgctgc

SEQ ID NO: 624107 - DNA, 13 bp, D. melanogaster
gcaacaagcgaca

SEQ ID NO: 624108 - DNA, 13 bp, D. melanogaster
gcaacaagtgttt

SEQ ID NO: 624109 - DNA, 13 bp, D. melanogaster
gcaacaagttttt

SEQ ID NO: 624110 - DNA, 13 bp, D. melanogaster
gcaacaataaaca

SEQ ID NO: 624111 - DNA, 13 bp, D. melanogaster
gcaacaataaata

SEQ ID NO: 624112 - DNA, 13 bp, D. melanogaster
gcaacaataacaa

SEQ ID NO: 624113 - DNA, 14 bp, D. melanogaster
gcaacaataacaaa

SEQ ID NO: 624114 - DNA, 14 bp, D. melanogaster
gcaacaataacaac

SEQ ID NO: 624115 - DNA, 13 bp, D. melanogaster
gcaacaataacac

SEQ ID NO: 624116 - DNA, 13 bp, D. melanogaster
gcaacaataatgc

SEQ ID NO: 624117 - DNA, 13 bp, D. melanogaster
gcaacaataattg

SEQ ID NO: 624118 - DNA, 13 bp, D. melanogaster
gcaacaatcaatt

SEQ ID NO: 624119 - DNA, 13 bp, D. melanogaster
gcaacaatgcagc

SEQ ID NO: 624120 - DNA, 13 bp, D. melanogaster
gcaacaatgcata

SEQ ID NO: 624121 - DNA, 14 bp, D. melanogaster
gcaacaatggcaac

SEQ ID NO: 624122 - DNA, 13 bp, D. melanogaster
gcaacaatggcag

SEQ ID NO: 624123 - DNA, 13 bp, D. melanogaster
gcaacaatgtaaa

SEQ ID NO: 624124 - DNA, 13 bp, D. melanogaster
gcaacaatgttgt

SEQ ID NO: 624125 - DNA, 13 bp, D. melanogaster
gcaacaattacaa

SEQ ID NO: 624126 - DNA, 13 bp, D. melanogaster
gcaacaattcaat

SEQ ID NO: 624127 - DNA, 13 bp, D. melanogaster
gcaacaattgaaa

SEQ ID NO: 624128 - DNA, 13 bp, D. melanogaster
gcaacaattgcag

SEQ ID NO: 624129 - DNA, 14 bp, D. melanogaster
gcaacaattgcagc

SEQ ID NO: 624130 - DNA, 13 bp, D. melanogaster
gcaacaattgcat

SEQ ID NO: 624131 - DNA, 13 bp, D. melanogaster
gcaacaattgttg

SEQ ID NO: 624132 - DNA, 13 bp, D. melanogaster
gcaacaatttcga

SEQ ID NO: 624133 - DNA, 13 bp, D. melanogaster
gcaacaatttgct

SEQ ID NO: 624134 - DNA, 13 bp, D. melanogaster
gcaacaatttttc

SEQ ID NO: 624135 - DNA, 13 bp, D. melanogaster
gcaacaatttttg

SEQ ID NO: 624136 - DNA, 13 bp, D. melanogaster
gcaacaatttttt

SEQ ID NO: 624137 - DNA, 13 bp, D. melanogaster
gcaacacaaaagc

SEQ ID NO: 624138 - DNA, 13 bp, D. melanogaster
gcaacacaaaata

SEQ ID NO: 624139 - DNA, 13 bp, D. melanogaster
gcaacacaaaatg

SEQ ID NO: 624140 - DNA, 13 bp, D. melanogaster
gcaacacaaatgc

SEQ ID NO: 624141 - DNA, 13 bp, D. melanogaster
gcaacaccaatgc

SEQ ID NO: 624142 - DNA, 13 bp, D. melanogaster
gcaacactgccac

SEQ ID NO: 624143 - DNA, 13 bp, D. melanogaster
gcaacagaaaaat

SEQ ID NO: 624144 - DNA, 13 bp, D. melanogaster
gcaacagaaataa

SEQ ID NO: 624145 - DNA, 13 bp, D. melanogaster
gcaacagaaatta

SEQ ID NO: 624146 - DNA, 13 bp, D. melanogaster
gcaacagaaattt

SEQ ID NO: 624147 - DNA, 13 bp, D. melanogaster
gcaacagaacagc

SEQ ID NO: 624148 - DNA, 14 bp, D. melanogaster
gcaacagcaaaagc

SEQ ID NO: 624149 - DNA, 13 bp, D. melanogaster
gcaacagcaaaca

SEQ ID NO: 624150 - DNA, 15 bp, D. melanogaster
gcaacagcaacaact

SEQ ID NO: 624151 - DNA, 14 bp, D. melanogaster
gcaacagcaacaag

SEQ ID NO: 624152 - DNA, 13 bp, D. melanogaster
gcaacagcaacac

SEQ ID NO: 624153 - DNA, 14 bp, D. melanogaster
gcaacagcaacaca

SEQ ID NO: 624154 - DNA, 14 bp, D. melanogaster
gcaacagcaacagt

SEQ ID NO: 624155 - DNA, 14 bp, D. melanogaster
gcaacagcaacatg

SEQ ID NO: 624156 - DNA, 13 bp, D. melanogaster
gcaacagcaacga

SEQ ID NO: 624157 - DNA, 13 bp, D. melanogaster
gcaacagcaacta

SEQ ID NO: 624158 - DNA, 13 bp, D. melanogaster
gcaacagcaagag

SEQ ID NO: 624159 - DNA, 13 bp, D. melanogaster
gcaacagcaataa

SEQ ID NO: 624160 - DNA, 13 bp, D. melanogaster
gcaacagcagcaa

SEQ ID NO: 624161 - DNA, 15 bp, D. melanogaster
gcaacagcagcaact

SEQ ID NO: 624162 - DNA, 14 bp, D. melanogaster
gcaacagcagcaga

SEQ ID NO: 624163 - DNA, 13 bp, D. melanogaster
gcaacagcagcga

SEQ ID NO: 624164 - DNA, 13 bp, D. melanogaster
gcaacagccaaag

SEQ ID NO: 624165 - DNA, 13 bp, D. melanogaster
gcaacagcgaaaa

SEQ ID NO: 624166 - DNA, 13 bp, D. melanogaster
gcaacagctgatt

SEQ ID NO: 624167 - DNA, 13 bp, D. melanogaster
gcaacagctgcca

SEQ ID NO: 624168 - DNA, 13 bp, D. melanogaster
gcaacagctgccg

SEQ ID NO: 624169 - DNA, 13 bp, D. melanogaster
gcaacagctgctg

SEQ ID NO: 624170 - DNA, 13 bp, D. melanogaster
gcaacagctgttc

SEQ ID NO: 624171 - DNA, 13 bp, D. melanogaster
gcaacagctgttg

SEQ ID NO: 624172 - DNA, 13 bp, D. melanogaster
gcaacagcttgat

SEQ ID NO: 624173 - DNA, 13 bp, D. melanogaster
gcaacagtagcaa

SEQ ID NO: 624174 - DNA, 14 bp, D. melanogaster
gcaacagtgcgtat

SEQ ID NO: 624175 - DNA, 13 bp, D. melanogaster
gcaacagtggcag

SEQ ID NO: 624176 - DNA, 13 bp, D. melanogaster
gcaacagttgaaa

SEQ ID NO: 624177 - DNA, 13 bp, D. melanogaster
gcaacataaatac

SEQ ID NO: 624178 - DNA, 13 bp, D. melanogaster
gcaacatatgttg

SEQ ID NO: 624179 - DNA, 13 bp, D. melanogaster
gcaacatatttgc

SEQ ID NO: 624180 - DNA, 13 bp, D. melanogaster
gcaacatcagaag

SEQ ID NO: 624181 - DNA, 13 bp, D. melanogaster
gcaacatcagcaa

SEQ ID NO: 624182 - DNA, 14 bp, D. melanogaster
gcaacatcagcaac

SEQ ID NO: 624183 - DNA, 13 bp, D. melanogaster
gcaacatcattaa

SEQ ID NO: 624184 - DNA, 13 bp, D. melanogaster
gcaacatcgagca

SEQ ID NO: 624185 - DNA, 13 bp, D. melanogaster
gcaacatgaaaat

SEQ ID NO: 624186 - DNA, 13 bp, D. melanogaster
gcaacatgattgt

SEQ ID NO: 624187 - DNA, 13 bp, D. melanogaster
gcaacatgcaaaa

SEQ ID NO: 624188 - DNA, 13 bp, D. melanogaster
gcaacatgcaaca

SEQ ID NO: 624189 - DNA, 14 bp, D. melanogaster
gcaacatgcaacat

SEQ ID NO: 624190 - DNA, 13 bp, D. melanogaster
gcaacatgcaact

SEQ ID NO: 624191 - DNA, 13 bp, D. melanogaster
gcaacatgcaatg

SEQ ID NO: 624192 - DNA, 13 bp, D. melanogaster
gcaacatgcagca

SEQ ID NO: 624193 - DNA, 14 bp, D. melanogaster
gcaacatgcagcat

SEQ ID NO: 624194 - DNA, 13 bp, D. melanogaster
gcaacatgctgca

SEQ ID NO: 624195 - DNA, 13 bp, D. melanogaster
gcaacatggcaac

SEQ ID NO: 624196 - DNA, 13 bp, D. melanogaster
gcaacatgtggca

SEQ ID NO: 624197 - DNA, 13 bp, D. melanogaster
gcaacatgttcga

SEQ ID NO: 624198 - DNA, 13 bp, D. melanogaster
gcaacatgttgca

SEQ ID NO: 624199 - DNA, 14 bp, D. melanogaster
gcaacatgttgcac

SEQ ID NO: 624200 - DNA, 13 bp, D. melanogaster
gcaacatgttgcc

SEQ ID NO: 624201 - DNA, 13 bp, D. melanogaster
gcaacattaattt

SEQ ID NO: 624202 - DNA, 13 bp, D. melanogaster
gcaacattatttt

SEQ ID NO: 624203 - DNA, 13 bp, D. melanogaster
gcaacattgttgc

SEQ ID NO: 624204 - DNA, 13 bp, D. melanogaster
gcaacatttccat

SEQ ID NO: 624205 - DNA, 13 bp, D. melanogaster
gcaacatttgcaa

SEQ ID NO: 624206 - DNA, 13 bp, D. melanogaster
gcaacatttgctg

SEQ ID NO: 624207 - DNA, 13 bp, D. melanogaster
gcaacatttgctt

SEQ ID NO: 624208 - DNA, 13 bp, D. melanogaster
gcaacatttggca

SEQ ID NO: 624209 - DNA, 14 bp, D. melanogaster
gcaacatttgttgc

SEQ ID NO: 624210 - DNA, 13 bp, D. melanogaster
gcaacattttacc

SEQ ID NO: 624211 - DNA, 14 bp, D. melanogaster
gcaacattttacct

SEQ ID NO: 624212 - DNA, 13 bp, D. melanogaster
gcaacattttcaa

SEQ ID NO: 624213 - DNA, 13 bp, D. melanogaster
gcaacattttcat

SEQ ID NO: 624214 - DNA, 13 bp, D. melanogaster
gcaacattttcga

SEQ ID NO: 624215 - DNA, 13 bp, D. melanogaster
gcaacattttcgc

SEQ ID NO: 624216 - DNA, 13 bp, D. melanogaster
gcaacattttctt

SEQ ID NO: 624217 - DNA, 13 bp, D. melanogaster
gcaacatttttgg

SEQ ID NO: 624218 - DNA, 13 bp, D. melanogaster
gcaacatttttgt

SEQ ID NO: 624219 - DNA, 13 bp, D. melanogaster
gcaaccaattaaa

SEQ ID NO: 624220 - DNA, 13 bp, D. melanogaster
gcaaccagcaaca

SEQ ID NO: 624221 - DNA, 13 bp, D. melanogaster
gcaaccagccaaa

SEQ ID NO: 624222 - DNA, 14 bp, D. melanogaster
gcaaccatttattt

SEQ ID NO: 624223 - DNA, 13 bp, D. melanogaster
gcaaccgaaaaca

SEQ ID NO: 624224 - DNA, 13 bp, D. melanogaster
gcaaccgaaaata

SEQ ID NO: 624225 - DNA, 13 bp, D. melanogaster
gcaaccgaaacag

SEQ ID NO: 624226 - DNA, 13 bp, D. melanogaster
gcaaccgcaaaaa

SEQ ID NO: 624227 - DNA, 13 bp, D. melanogaster
gcaacctgcaact

SEQ ID NO: 624228 - DNA, 13 bp, D. melanogaster
gcaacgaaaatga

SEQ ID NO: 624229 - DNA, 13 bp, D. melanogaster
gcaacgaaatgtt

SEQ ID NO: 624230 - DNA, 13 bp, D. melanogaster
gcaacgacaacaa

SEQ ID NO: 624231 - DNA, 14 bp, D. melanogaster
gcaacgacaacaac

SEQ ID NO: 624232 - DNA, 13 bp, D. melanogaster
gcaacgacaacga

SEQ ID NO: 624233 - DNA, 13 bp, D. melanogaster
gcaacgcaaattg

SEQ ID NO: 624234 - DNA, 13 bp, D. melanogaster
gcaacgcaacgca

SEQ ID NO: 624235 - DNA, 13 bp, D. melanogaster
gcaacgcccacaa

SEQ ID NO: 624236 - DNA, 13 bp, D. melanogaster
gcaacgcccacac

SEQ ID NO: 624237 - DNA, 14 bp, D. melanogaster
gcaacgcggcgtat

SEQ ID NO: 624238 - DNA, 13 bp, D. melanogaster
gcaacggcaacag

SEQ ID NO: 624239 - DNA, 13 bp, D. melanogaster
gcaacggcaacgg

SEQ ID NO: 624240 - DNA, 13 bp, D. melanogaster
gcaacggcagcaa

SEQ ID NO: 624241 - DNA, 14 bp, D. melanogaster
gcaacggcagcaac

SEQ ID NO: 624242 - DNA, 13 bp, D. melanogaster
gcaacggcagcag

SEQ ID NO: 624243 - DNA, 13 bp, D. melanogaster
gcaacggggcgta

SEQ ID NO: 624244 - DNA, 13 bp, D. melanogaster
gcaacgtgcaaca

SEQ ID NO: 624245 - DNA, 13 bp, D. melanogaster
gcaacgtgcaacg

SEQ ID NO: 624246 - DNA, 14 bp, D. melanogaster
gcaacgtgcaacgt

SEQ ID NO: 624247 - DNA, 14 bp, D. melanogaster
gcaacgtggcgtat

SEQ ID NO: 624248 - DNA, 13 bp, D. melanogaster
gcaactaaaaaat

SEQ ID NO: 624249 - DNA, 13 bp, D. melanogaster
gcaactaaaaata

SEQ ID NO: 624250 - DNA, 13 bp, D. melanogaster
gcaactaaaataa

SEQ ID NO: 624251 - DNA, 13 bp, D. melanogaster
gcaactaagtgtt

SEQ ID NO: 624252 - DNA, 13 bp, D. melanogaster
gcaactaagtttt

SEQ ID NO: 624253 - DNA, 13 bp, D. melanogaster
gcaactaattaaa

SEQ ID NO: 624254 - DNA, 13 bp, D. melanogaster
gcaactacaacaa

SEQ ID NO: 624255 - DNA, 14 bp, D. melanogaster
gcaactacaacaac

SEQ ID NO: 624256 - DNA, 13 bp, D. melanogaster
gcaactacataga

SEQ ID NO: 624257 - DNA, 13 bp, D. melanogaster
gcaactagcaaca

SEQ ID NO: 624258 - DNA, 13 bp, D. melanogaster
gcaactagcaact

SEQ ID NO: 624259 - DNA, 14 bp, D. melanogaster
gcaactagcaacta

SEQ ID NO: 624260 - DNA, 13 bp, D. melanogaster
gcaactagcaatt

SEQ ID NO: 624261 - DNA, 14 bp, D. melanogaster
gcaactagcaattt

SEQ ID NO: 624262 - DNA, 13 bp, D. melanogaster
gcaactatttata

SEQ ID NO: 624263 - DNA, 13 bp, D. melanogaster
gcaactcgcaact

SEQ ID NO: 624264 - DNA, 13 bp, D. melanogaster
gcaactgaaactg

SEQ ID NO: 624265 - DNA, 13 bp, D. melanogaster
gcaactgaaatgc

SEQ ID NO: 624266 - DNA, 14 bp, D. melanogaster
gcaactgaacccaa

SEQ ID NO: 624267 - DNA, 13 bp, D. melanogaster
gcaactgaattta

SEQ ID NO: 624268 - DNA, 13 bp, D. melanogaster
gcaactgcaaaat

SEQ ID NO: 624269 - DNA, 13 bp, D. melanogaster
gcaactgcaaatg

SEQ ID NO: 624270 - DNA, 13 bp, D. melanogaster
gcaactgcaacaa

SEQ ID NO: 624271 - DNA, 14 bp, D. melanogaster
gcaactgcaacaac

SEQ ID NO: 624272 - DNA, 13 bp, D. melanogaster
gcaactgcaacac

SEQ ID NO: 624273 - DNA, 13 bp, D. melanogaster
gcaactgcaacag

SEQ ID NO: 624274 - DNA, 15 bp, D. melanogaster
gcaactgcaacagca

SEQ ID NO: 624275 - DNA, 13 bp, D. melanogaster
gcaactgcaacca

SEQ ID NO: 624276 - DNA, 13 bp, D. melanogaster
gcaactgcaacgg

SEQ ID NO: 624277 - DNA, 13 bp, D. melanogaster
gcaactgcaacta

SEQ ID NO: 624278 - DNA, 13 bp, D. melanogaster
gcaactgcaactg

SEQ ID NO: 624279 - DNA, 14 bp, D. melanogaster
gcaactgcaactga

SEQ ID NO: 624280 - DNA, 14 bp, D. melanogaster
gcaactgcaactgc

SEQ ID NO: 624281 - DNA, 14 bp, D. melanogaster
gcaactgcaactgt

SEQ ID NO: 624282 - DNA, 13 bp, D. melanogaster
gcaactgcaactt

SEQ ID NO: 624283 - DNA, 14 bp, D. melanogaster
gcaactgcaacttc

SEQ ID NO: 624284 - DNA, 13 bp, D. melanogaster
gcaactgcaatcg

SEQ ID NO: 624285 - DNA, 13 bp, D. melanogaster
gcaactgcaatgc

SEQ ID NO: 624286 - DNA, 14 bp, D. melanogaster
gcaactgcaattgc

SEQ ID NO: 624287 - DNA, 13 bp, D. melanogaster
gcaactgcaattt

SEQ ID NO: 624288 - DNA, 14 bp, D. melanogaster
gcaactgcagaatc

SEQ ID NO: 624289 - DNA, 14 bp, D. melanogaster
gcaactgcagcaac

SEQ ID NO: 624290 - DNA, 13 bp, D. melanogaster
gcaactgcagcac

SEQ ID NO: 624291 - DNA, 13 bp, D. melanogaster
gcaactgcagcca

SEQ ID NO: 624292 - DNA, 13 bp, D. melanogaster
gcaactgcagcgg

SEQ ID NO: 624293 - DNA, 13 bp, D. melanogaster
gcaactgcagctg

SEQ ID NO: 624294 - DNA, 14 bp, D. melanogaster
gcaactgcagctgc

SEQ ID NO: 624295 - DNA, 13 bp, D. melanogaster
gcaactgcagtgc

SEQ ID NO: 624296 - DNA, 13 bp, D. melanogaster
gcaactgccaact

SEQ ID NO: 624297 - DNA, 13 bp, D. melanogaster
gcaactgccacaa

SEQ ID NO: 624298 - DNA, 14 bp, D. melanogaster
gcaactgccacaac

SEQ ID NO: 624299 - DNA, 13 bp, D. melanogaster
gcaactgccactg

SEQ ID NO: 624300 - DNA, 14 bp, D. melanogaster
gcaactgccactgc

SEQ ID NO: 624301 - DNA, 13 bp, D. melanogaster
gcaactgcgactg

SEQ ID NO: 624302 - DNA, 14 bp, D. melanogaster
gcaactgcgactgc

SEQ ID NO: 624303 - DNA, 13 bp, D. melanogaster
gcaactgcggcaa

SEQ ID NO: 624304 - DNA, 13 bp, D. melanogaster
gcaactgctgcaa

SEQ ID NO: 624305 - DNA, 14 bp, D. melanogaster
gcaactgctgcaac

SEQ ID NO: 624306 - DNA, 13 bp, D. melanogaster
gcaactgctgcac

SEQ ID NO: 624307 - DNA, 13 bp, D. melanogaster
gcaactgctgctg

SEQ ID NO: 624308 - DNA, 14 bp, D. melanogaster
gcaactgctgctgc

SEQ ID NO: 624309 - DNA, 13 bp, D. melanogaster
gcaactggaaaat

SEQ ID NO: 624310 - DNA, 13 bp, D. melanogaster
gcaactggaacac

SEQ ID NO: 624311 - DNA, 13 bp, D. melanogaster
gcaactggcaaca

SEQ ID NO: 624312 - DNA, 13 bp, D. melanogaster
gcaactggcaacc

SEQ ID NO: 624313 - DNA, 13 bp, D. melanogaster
gcaactggcaact

SEQ ID NO: 624314 - DNA, 13 bp, D. melanogaster
gcaactgggagtt

SEQ ID NO: 624315 - DNA, 13 bp, D. melanogaster
gcaactgttgcaa

SEQ ID NO: 624316 - DNA, 13 bp, D. melanogaster
gcaactgtttttg

SEQ ID NO: 624317 - DNA, 13 bp, D. melanogaster
gcaacttaatttg

SEQ ID NO: 624318 - DNA, 14 bp, D. melanogaster
gcaacttaatttga

SEQ ID NO: 624319 - DNA, 13 bp, D. melanogaster
gcaacttgaatat

SEQ ID NO: 624320 - DNA, 14 bp, D. melanogaster
gcaacttgcaacag

SEQ ID NO: 624321 - DNA, 13 bp, D. melanogaster
gcaacttgcaact

SEQ ID NO: 624322 - DNA, 13 bp, D. melanogaster
gcaacttgcagct

SEQ ID NO: 624323 - DNA, 13 bp, D. melanogaster
gcaacttggccag

SEQ ID NO: 624324 - DNA, 13 bp, D. melanogaster
gcaacttgttgct

SEQ ID NO: 624325 - DNA, 13 bp, D. melanogaster
gcaactttggcca

SEQ ID NO: 624326 - DNA, 13 bp, D. melanogaster
gcaactttgtggc

SEQ ID NO: 624327 - DNA, 13 bp, D. melanogaster
gcaactttgttgc

SEQ ID NO: 624328 - DNA, 13 bp, D. melanogaster
gcaacttttattg

SEQ ID NO: 624329 - DNA, 13 bp, D. melanogaster
gcaacttttcaat

SEQ ID NO: 624330 - DNA, 13 bp, D. melanogaster
gcaacttttgcca

SEQ ID NO: 624331 - DNA, 13 bp, D. melanogaster
gcaacttttgcgc

SEQ ID NO: 624332 - DNA, 13 bp, D. melanogaster
gcaacttttggcc

SEQ ID NO: 624333 - DNA, 13 bp, D. melanogaster
gcaactttttggc

SEQ ID NO: 624334 - DNA, 13 bp, D. melanogaster
gcaactttttgtg

SEQ ID NO: 624335 - DNA, 14 bp, D. melanogaster
gcaacttttttttt

SEQ ID NO: 624336 - DNA, 13 bp, D. melanogaster
gcaagaaaaatgc

SEQ ID NO: 624337 - DNA, 13 bp, D. melanogaster
gcaagaaaagcga

SEQ ID NO: 624338 - DNA, 13 bp, D. melanogaster
gcaagaaaattga

SEQ ID NO: 624339 - DNA, 13 bp, D. melanogaster
gcaagaaatggaa

SEQ ID NO: 624340 - DNA, 13 bp, D. melanogaster
gcaagaacagctg

SEQ ID NO: 624341 - DNA, 14 bp, D. melanogaster
gcaagaacagctgc

SEQ ID NO: 624342 - DNA, 13 bp, D. melanogaster
gcaagaagaatat

SEQ ID NO: 624343 - DNA, 14 bp, D. melanogaster
gcaagaagaatatt

SEQ ID NO: 624344 - DNA, 14 bp, D. melanogaster
gcaagaagaatgtt

SEQ ID NO: 624345 - DNA, 14 bp, D. melanogaster
gcaagaagagggtt

SEQ ID NO: 624346 - DNA, 13 bp, D. melanogaster
gcaagacgaccaa

SEQ ID NO: 624347 - DNA, 13 bp, D. melanogaster
gcaagacgatttg

SEQ ID NO: 624348 - DNA, 13 bp, D. melanogaster
gcaagagataaag

SEQ ID NO: 624349 - DNA, 13 bp, D. melanogaster
gcaagagatgttg

SEQ ID NO: 624350 - DNA, 14 bp, D. melanogaster
gcaagagcaacaac

SEQ ID NO: 624351 - DNA, 13 bp, D. melanogaster
gcaagagcaacag

SEQ ID NO: 624352 - DNA, 13 bp, D. melanogaster
gcaagataaataa

SEQ ID NO: 624353 - DNA, 13 bp, D. melanogaster
gcaagatagaaac

SEQ ID NO: 624354 - DNA, 13 bp, D. melanogaster
gcaagatggcctt

SEQ ID NO: 624355 - DNA, 13 bp, D. melanogaster
gcaagcaaaaaat

SEQ ID NO: 624356 - DNA, 13 bp, D. melanogaster
gcaagcaaatcaa

SEQ ID NO: 624357 - DNA, 14 bp, D. melanogaster
gcaagcaaattaaa

SEQ ID NO: 624358 - DNA, 13 bp, D. melanogaster
gcaagcaaattat

SEQ ID NO: 624359 - DNA, 14 bp, D. melanogaster
gcaagcaagcaagc

SEQ ID NO: 624360 - DNA, 13 bp, D. melanogaster
gcaagcaataaaa

SEQ ID NO: 624361 - DNA, 13 bp, D. melanogaster
gcaagcaatttgt

SEQ ID NO: 624362 - DNA, 13 bp, D. melanogaster
gcaagcacacaca

SEQ ID NO: 624363 - DNA, 13 bp, D. melanogaster
gcaagcagcaaca

SEQ ID NO: 624364 - DNA, 13 bp, D. melanogaster
gcaagcagtgcaa

SEQ ID NO: 624365 - DNA, 13 bp, D. melanogaster
gcaagcattgaaa

SEQ ID NO: 624366 - DNA, 13 bp, D. melanogaster
gcaagcatttcta

SEQ ID NO: 624367 - DNA, 13 bp, D. melanogaster
gcaagccaaacaa

SEQ ID NO: 624368 - DNA, 13 bp, D. melanogaster
gcaagccaacaaa

SEQ ID NO: 624369 - DNA, 13 bp, D. melanogaster
gcaagcgtgtggc

SEQ ID NO: 624370 - DNA, 13 bp, D. melanogaster
gcaagctgaatac

SEQ ID NO: 624371 - DNA, 13 bp, D. melanogaster
gcaagctgagcag

SEQ ID NO: 624372 - DNA, 14 bp, D. melanogaster
gcaagctgagcagc

SEQ ID NO: 624373 - DNA, 13 bp, D. melanogaster
gcaagctggcaaa

SEQ ID NO: 624374 - DNA, 13 bp, D. melanogaster
gcaaggaaaacac

SEQ ID NO: 624375 - DNA, 13 bp, D. melanogaster
gcaaggaaaataa

SEQ ID NO: 624376 - DNA, 13 bp, D. melanogaster
gcaaggaaataaa

SEQ ID NO: 624377 - DNA, 13 bp, D. melanogaster
gcaaggaaatcga

SEQ ID NO: 624378 - DNA, 13 bp, D. melanogaster
gcaaggacaacaa

SEQ ID NO: 624379 - DNA, 13 bp, D. melanogaster
gcaaggacaatca

SEQ ID NO: 624380 - DNA, 13 bp, D. melanogaster
gcaaggacatgga

SEQ ID NO: 624381 - DNA, 14 bp, D. melanogaster
gcaaggaccaagga

SEQ ID NO: 624382 - DNA, 13 bp, D. melanogaster
gcaaggcaaaaag

SEQ ID NO: 624383 - DNA, 13 bp, D. melanogaster
gcaaggcaaataa

SEQ ID NO: 624384 - DNA, 14 bp, D. melanogaster
gcaaggcaaggcaa

SEQ ID NO: 624385 - DNA, 13 bp, D. melanogaster
gcaagggaaaatt

SEQ ID NO: 624386 - DNA, 13 bp, D. melanogaster
gcaagggcctgca

SEQ ID NO: 624387 - DNA, 13 bp, D. melanogaster
gcaaggtcacact

SEQ ID NO: 624388 - DNA, 13 bp, D. melanogaster
gcaagtaaattaa

SEQ ID NO: 624389 - DNA, 13 bp, D. melanogaster
gcaagtaattctt

SEQ ID NO: 624390 - DNA, 13 bp, D. melanogaster
gcaagtcaaacaa

SEQ ID NO: 624391 - DNA, 13 bp, D. melanogaster
gcaagtgaaagtg

SEQ ID NO: 624392 - DNA, 13 bp, D. melanogaster
gcaagtgaaataa

SEQ ID NO: 624393 - DNA, 13 bp, D. melanogaster
gcaagtgcaaaaa

SEQ ID NO: 624394 - DNA, 13 bp, D. melanogaster
gcaagtgcaaaca

SEQ ID NO: 624395 - DNA, 13 bp, D. melanogaster
gcaagtgcaacag

SEQ ID NO: 624396 - DNA, 13 bp, D. melanogaster
gcaagtgcaacat

SEQ ID NO: 624397 - DNA, 13 bp, D. melanogaster
gcaagtgcaactg

SEQ ID NO: 624398 - DNA, 14 bp, D. melanogaster
gcaagtgcaactgc

SEQ ID NO: 624399 - DNA, 13 bp, D. melanogaster
gcaagtgcaagcg

SEQ ID NO: 624400 - DNA, 13 bp, D. melanogaster
gcaagtgcaattg

SEQ ID NO: 624401 - DNA, 13 bp, D. melanogaster
gcaagtgcactcg

SEQ ID NO: 624402 - DNA, 13 bp, D. melanogaster
gcaagtgcatttg

SEQ ID NO: 624403 - DNA, 13 bp, D. melanogaster
gcaagtgctgctg

SEQ ID NO: 624404 - DNA, 13 bp, D. melanogaster
gcaagtggaaaaa

SEQ ID NO: 624405 - DNA, 13 bp, D. melanogaster
gcaagtggaaaat

SEQ ID NO: 624406 - DNA, 13 bp, D. melanogaster
gcaagtggaactt

SEQ ID NO: 624407 - DNA, 13 bp, D. melanogaster
gcaagtggattcc

SEQ ID NO: 624408 - DNA, 14 bp, D. melanogaster
gcaagtggattcca

SEQ ID NO: 624409 - DNA, 13 bp, D. melanogaster
gcaagtggcatgt

SEQ ID NO: 624410 - DNA, 13 bp, D. melanogaster
gcaagtgggtggc

SEQ ID NO: 624411 - DNA, 13 bp, D. melanogaster
gcaagtgtgtgcg

SEQ ID NO: 624412 - DNA, 13 bp, D. melanogaster
gcaagtgtgtgtg

SEQ ID NO: 624413 - DNA, 14 bp, D. melanogaster
gcaagtgtgtgtgt

SEQ ID NO: 624414 - DNA, 13 bp, D. melanogaster
gcaagtgtttttt

SEQ ID NO: 624415 - DNA, 13 bp, D. melanogaster
gcaagttaaattt

SEQ ID NO: 624416 - DNA, 13 bp, D. melanogaster
gcaagttgacaaa

SEQ ID NO: 624417 - DNA, 13 bp, D. melanogaster
gcaagttgcaaca

SEQ ID NO: 624418 - DNA, 13 bp, D. melanogaster
gcaagttgcagtt

SEQ ID NO: 624419 - DNA, 13 bp, D. melanogaster
gcaagttgccagt

SEQ ID NO: 624420 - DNA, 14 bp, D. melanogaster
gcaataaaaaattt

SEQ ID NO: 624421 - DNA, 13 bp, D. melanogaster
gcaataaaaacgt

SEQ ID NO: 624422 - DNA, 13 bp, D. melanogaster
gcaataaaaagtg

SEQ ID NO: 624423 - DNA, 13 bp, D. melanogaster
gcaataaaaatat

SEQ ID NO: 624424 - DNA, 14 bp, D. melanogaster
gcaataaaaattca

SEQ ID NO: 624425 - DNA, 13 bp, D. melanogaster
gcaataaaacaca

SEQ ID NO: 624426 - DNA, 13 bp, D. melanogaster
gcaataaaaccaa

SEQ ID NO: 624427 - DNA, 13 bp, D. melanogaster
gcaataaaagcaa

SEQ ID NO: 624428 - DNA, 13 bp, D. melanogaster
gcaataaaagtaa

SEQ ID NO: 624429 - DNA, 13 bp, D. melanogaster
gcaataaaatgaa

SEQ ID NO: 624430 - DNA, 13 bp, D. melanogaster
gcaataaaatgca

SEQ ID NO: 624431 - DNA, 13 bp, D. melanogaster
gcaataaagcaat

SEQ ID NO: 624432 - DNA, 13 bp, D. melanogaster
gcaataaagttta

SEQ ID NO: 624433 - DNA, 13 bp, D. melanogaster
gcaataaataaat

SEQ ID NO: 624434 - DNA, 13 bp, D. melanogaster
gcaataaatacat

SEQ ID NO: 624435 - DNA, 13 bp, D. melanogaster
gcaataaatatat

SEQ ID NO: 624436 - DNA, 13 bp, D. melanogaster
gcaataaatattt

SEQ ID NO: 624437 - DNA, 14 bp, D. melanogaster
gcaataaatatttt

SEQ ID NO: 624438 - DNA, 13 bp, D. melanogaster
gcaataaatcaaa

SEQ ID NO: 624439 - DNA, 13 bp, D. melanogaster
gcaataaatcttc

SEQ ID NO: 624440 - DNA, 13 bp, D. melanogaster
gcaataaatgaat

SEQ ID NO: 624441 - DNA, 13 bp, D. melanogaster
gcaataaatgcaa

SEQ ID NO: 624442 - DNA, 13 bp, D. melanogaster
gcaataaatgttt

SEQ ID NO: 624443 - DNA, 14 bp, D. melanogaster
gcaataaattaaaa

SEQ ID NO: 624444 - DNA, 13 bp, D. melanogaster
gcaataaattatg

SEQ ID NO: 624445 - DNA, 13 bp, D. melanogaster
gcaataaattcac

SEQ ID NO: 624446 - DNA, 13 bp, D. melanogaster
gcaataaattcta

SEQ ID NO: 624447 - DNA, 13 bp, D. melanogaster
gcaataaattgct

SEQ ID NO: 624448 - DNA, 13 bp, D. melanogaster
gcaataaatttga

SEQ ID NO: 624449 - DNA, 13 bp, D. melanogaster
gcaataacaaata

SEQ ID NO: 624450 - DNA, 14 bp, D. melanogaster
gcaataacaacaat

SEQ ID NO: 624451 - DNA, 13 bp, D. melanogaster
gcaataacaacag

SEQ ID NO: 624452 - DNA, 14 bp, D. melanogaster
gcaataacaataaa

SEQ ID NO: 624453 - DNA, 14 bp, D. melanogaster
gcaataacaataac

SEQ ID NO: 624454 - DNA, 13 bp, D. melanogaster
gcaataacagtaa

SEQ ID NO: 624455 - DNA, 13 bp, D. melanogaster
gcaataactacaa

SEQ ID NO: 624456 - DNA, 13 bp, D. melanogaster
gcaataactttat

SEQ ID NO: 624457 - DNA, 14 bp, D. melanogaster
gcaataagtaaata

SEQ ID NO: 624458 - DNA, 13 bp, D. melanogaster
gcaataagtgaaa

SEQ ID NO: 624459 - DNA, 13 bp, D. melanogaster
gcaataataaaat

SEQ ID NO: 624460 - DNA, 13 bp, D. melanogaster
gcaataataaata

SEQ ID NO: 624461 - DNA, 13 bp, D. melanogaster
gcaataataatat

SEQ ID NO: 624462 - DNA, 14 bp, D. melanogaster
gcaataatacattt

SEQ ID NO: 624463 - DNA, 13 bp, D. melanogaster
gcaataattcaat

SEQ ID NO: 624464 - DNA, 13 bp, D. melanogaster
gcaataccaacac

SEQ ID NO: 624465 - DNA, 13 bp, D. melanogaster
gcaatagaaaaat

SEQ ID NO: 624466 - DNA, 13 bp, D. melanogaster
gcaatagcagcaa

SEQ ID NO: 624467 - DNA, 13 bp, D. melanogaster
gcaatagttctta

SEQ ID NO: 624468 - DNA, 13 bp, D. melanogaster
gcaatataaaatt

SEQ ID NO: 624469 - DNA, 13 bp, D. melanogaster
gcaatataaattt

SEQ ID NO: 624470 - DNA, 13 bp, D. melanogaster
gcaatataatatt

SEQ ID NO: 624471 - DNA, 13 bp, D. melanogaster
gcaatatatacat

SEQ ID NO: 624472 - DNA, 13 bp, D. melanogaster
gcaatatatttaa

SEQ ID NO: 624473 - DNA, 13 bp, D. melanogaster
gcaatatatttca

SEQ ID NO: 624474 - DNA, 13 bp, D. melanogaster
gcaatatatttta

SEQ ID NO: 624475 - DNA, 13 bp, D. melanogaster
gcaatatcagcaa

SEQ ID NO: 624476 - DNA, 14 bp, D. melanogaster
gcaatatcagcaag

SEQ ID NO: 624477 - DNA, 13 bp, D. melanogaster
gcaatatctacaa

SEQ ID NO: 624478 - DNA, 14 bp, D. melanogaster
gcaatatctacaat

SEQ ID NO: 624479 - DNA, 13 bp, D. melanogaster
gcaatatgatgaa

SEQ ID NO: 624480 - DNA, 13 bp, D. melanogaster
gcaatatgcacaa

SEQ ID NO: 624481 - DNA, 13 bp, D. melanogaster
gcaatattaattt

SEQ ID NO: 624482 - DNA, 13 bp, D. melanogaster
gcaatattagcag

SEQ ID NO: 624483 - DNA, 14 bp, D. melanogaster
gcaatattagcagc

SEQ ID NO: 624484 - DNA, 13 bp, D. melanogaster
gcaatattgaaaa

SEQ ID NO: 624485 - DNA, 13 bp, D. melanogaster
gcaatatttacat

SEQ ID NO: 624486 - DNA, 13 bp, D. melanogaster
gcaatatttataa

SEQ ID NO: 624487 - DNA, 14 bp, D. melanogaster
gcaatatttataaa

SEQ ID NO: 624488 - DNA, 13 bp, D. melanogaster
gcaatatttatat

SEQ ID NO: 624489 - DNA, 13 bp, D. melanogaster
gcaatatttatgg

SEQ ID NO: 624490 - DNA, 13 bp, D. melanogaster
gcaatatttcatt

SEQ ID NO: 624491 - DNA, 13 bp, D. melanogaster
gcaatatttgttg

SEQ ID NO: 624492 - DNA, 13 bp, D. melanogaster
gcaatcaaaaatc

SEQ ID NO: 624493 - DNA, 13 bp, D. melanogaster
gcaatcaaaaatg

SEQ ID NO: 624494 - DNA, 13 bp, D. melanogaster
gcaatcaaaacaa

SEQ ID NO: 624495 - DNA, 13 bp, D. melanogaster
gcaatcaaaacga

SEQ ID NO: 624496 - DNA, 13 bp, D. melanogaster
gcaatcaaaagtt

SEQ ID NO: 624497 - DNA, 13 bp, D. melanogaster
gcaatcaaaataa

SEQ ID NO: 624498 - DNA, 13 bp, D. melanogaster
gcaatcaaaatat

SEQ ID NO: 624499 - DNA, 13 bp, D. melanogaster
gcaatcaaaatca

SEQ ID NO: 624500 - DNA, 13 bp, D. melanogaster
gcaatcaaacaaa

SEQ ID NO: 624501 - DNA, 13 bp, D. melanogaster
gcaatcaaagcaa

SEQ ID NO: 624502 - DNA, 13 bp, D. melanogaster
gcaatcaaatatt

SEQ ID NO: 624503 - DNA, 13 bp, D. melanogaster
gcaatcaaatcaa

SEQ ID NO: 624504 - DNA, 13 bp, D. melanogaster
gcaatcaaatcga

SEQ ID NO: 624505 - DNA, 13 bp, D. melanogaster
gcaatcaaatgaa

SEQ ID NO: 624506 - DNA, 13 bp, D. melanogaster
gcaatcaaatgga

SEQ ID NO: 624507 - DNA, 13 bp, D. melanogaster
gcaatcaaatgtg

SEQ ID NO: 624508 - DNA, 13 bp, D. melanogaster
gcaatcaaatttg

SEQ ID NO: 624509 - DNA, 13 bp, D. melanogaster
gcaatcaataagc

SEQ ID NO: 624510 - DNA, 13 bp, D. melanogaster
gcaatcaatttga

SEQ ID NO: 624511 - DNA, 13 bp, D. melanogaster
gcaatcacacagc

SEQ ID NO: 624512 - DNA, 13 bp, D. melanogaster
gcaatcagcaaac

SEQ ID NO: 624513 - DNA, 13 bp, D. melanogaster
gcaatcatcatta

SEQ ID NO: 624514 - DNA, 13 bp, D. melanogaster
gcaatcattttga

SEQ ID NO: 624515 - DNA, 13 bp, D. melanogaster
gcaatccaaaaaa

SEQ ID NO: 624516 - DNA, 13 bp, D. melanogaster
gcaatccactcaa

SEQ ID NO: 624517 - DNA, 13 bp, D. melanogaster
gcaatcccaatcc

SEQ ID NO: 624518 - DNA, 13 bp, D. melanogaster
gcaatccgatcaa

SEQ ID NO: 624519 - DNA, 14 bp, D. melanogaster
gcaatcgaaaaaaa

SEQ ID NO: 624520 - DNA, 14 bp, D. melanogaster
gcaatcgaaaaata

SEQ ID NO: 624521 - DNA, 13 bp, D. melanogaster
gcaatcgaaataa

SEQ ID NO: 624522 - DNA, 13 bp, D. melanogaster
gcaatcgaaatcg

SEQ ID NO: 624523 - DNA, 13 bp, D. melanogaster
gcaatcgaaatta

SEQ ID NO: 624524 - DNA, 13 bp, D. melanogaster
gcaatcgaatcga

SEQ ID NO: 624525 - DNA, 13 bp, D. melanogaster
gcaatcgatttta

SEQ ID NO: 624526 - DNA, 13 bp, D. melanogaster
gcaatcgcaatcg

SEQ ID NO: 624527 - DNA, 14 bp, D. melanogaster
gcaatcgcaatcgc

SEQ ID NO: 624528 - DNA, 13 bp, D. melanogaster
gcaatcgcaattg

SEQ ID NO: 624529 - DNA, 13 bp, D. melanogaster
gcaatcgcgtgaa

SEQ ID NO: 624530 - DNA, 13 bp, D. melanogaster
gcaatcgttatat

SEQ ID NO: 624531 - DNA, 13 bp, D. melanogaster
gcaatgaaaataa

SEQ ID NO: 624532 - DNA, 14 bp, D. melanogaster
gcaatgaaaataaa

SEQ ID NO: 624533 - DNA, 13 bp, D. melanogaster
gcaatgaaaatat

SEQ ID NO: 624534 - DNA, 13 bp, D. melanogaster
gcaatgaaaatgt

SEQ ID NO: 624535 - DNA, 14 bp, D. melanogaster
gcaatgaaaatgtt

SEQ ID NO: 624536 - DNA, 13 bp, D. melanogaster
gcaatgaaatgca

SEQ ID NO: 624537 - DNA, 13 bp, D. melanogaster
gcaatgacaacaa

SEQ ID NO: 624538 - DNA, 13 bp, D. melanogaster
gcaatgagaaatt

SEQ ID NO: 624539 - DNA, 14 bp, D. melanogaster
gcaatgcaaaaaaa

SEQ ID NO: 624540 - DNA, 13 bp, D. melanogaster
gcaatgcaaaaat

SEQ ID NO: 624541 - DNA, 13 bp, D. melanogaster
gcaatgcaaagcc

SEQ ID NO: 624542 - DNA, 13 bp, D. melanogaster
gcaatgcaaatgc

SEQ ID NO: 624543 - DNA, 13 bp, D. melanogaster
gcaatgcaaatgg

SEQ ID NO: 624544 - DNA, 13 bp, D. melanogaster
gcaatgcaaattt

SEQ ID NO: 624545 - DNA, 13 bp, D. melanogaster
gcaatgcaacaaa

SEQ ID NO: 624546 - DNA, 13 bp, D. melanogaster
gcaatgcaactaa

SEQ ID NO: 624547 - DNA, 13 bp, D. melanogaster
gcaatgcaattaa

SEQ ID NO: 624548 - DNA, 13 bp, D. melanogaster
gcaatgcaattgc

SEQ ID NO: 624549 - DNA, 13 bp, D. melanogaster
gcaatgcacccat

SEQ ID NO: 624550 - DNA, 13 bp, D. melanogaster
gcaatgccaaagt

SEQ ID NO: 624551 - DNA, 13 bp, D. melanogaster
gcaatgccaacaa

SEQ ID NO: 624552 - DNA, 13 bp, D. melanogaster
gcaatgccaattt

SEQ ID NO: 624553 - DNA, 13 bp, D. melanogaster
gcaatgccacaaa

SEQ ID NO: 624554 - DNA, 13 bp, D. melanogaster
gcaatgccagaaa

SEQ ID NO: 624555 - DNA, 13 bp, D. melanogaster
gcaatgccagcaa

SEQ ID NO: 624556 - DNA, 13 bp, D. melanogaster
gcaatgccataaa

SEQ ID NO: 624557 - DNA, 13 bp, D. melanogaster
gcaatgcgaaatg

SEQ ID NO: 624558 - DNA, 13 bp, D. melanogaster
gcaatgctctccc

SEQ ID NO: 624559 - DNA, 13 bp, D. melanogaster
gcaatggaaaact

SEQ ID NO: 624560 - DNA, 13 bp, D. melanogaster
gcaatggaaattg

SEQ ID NO: 624561 - DNA, 13 bp, D. melanogaster
gcaatggaatgaa

SEQ ID NO: 624562 - DNA, 13 bp, D. melanogaster
gcaatggagtaat

SEQ ID NO: 624563 - DNA, 13 bp, D. melanogaster
gcaatggcaaagg

SEQ ID NO: 624564 - DNA, 13 bp, D. melanogaster
gcaatggcaaagt

SEQ ID NO: 624565 - DNA, 13 bp, D. melanogaster
gcaatggcaaatt

SEQ ID NO: 624566 - DNA, 13 bp, D. melanogaster
gcaatggcaacaa

SEQ ID NO: 624567 - DNA, 14 bp, D. melanogaster
gcaatggcaacaat

SEQ ID NO: 624568 - DNA, 13 bp, D. melanogaster
gcaatggcaacgg

SEQ ID NO: 624569 - DNA, 13 bp, D. melanogaster
gcaatggcaataa

SEQ ID NO: 624570 - DNA, 13 bp, D. melanogaster
gcaatggcaatga

SEQ ID NO: 624571 - DNA, 13 bp, D. melanogaster
gcaatggcaatgg

SEQ ID NO: 624572 - DNA, 13 bp, D. melanogaster
gcaatggcaatgt

SEQ ID NO: 624573 - DNA, 13 bp, D. melanogaster
gcaatggcaatta

SEQ ID NO: 624574 - DNA, 13 bp, D. melanogaster
gcaatggccaaaa

SEQ ID NO: 624575 - DNA, 13 bp, D. melanogaster
gcaatggccaatg

SEQ ID NO: 624576 - DNA, 13 bp, D. melanogaster
gcaatgggaaatg

SEQ ID NO: 624577 - DNA, 13 bp, D. melanogaster
gcaatgggcaatg

SEQ ID NO: 624578 - DNA, 13 bp, D. melanogaster
gcaatggggaaaa

SEQ ID NO: 624579 - DNA, 13 bp, D. melanogaster
gcaatggtgcttg

SEQ ID NO: 624580 - DNA, 13 bp, D. melanogaster
gcaatgtaaataa

SEQ ID NO: 624581 - DNA, 13 bp, D. melanogaster
gcaatgtctgcac

SEQ ID NO: 624582 - DNA, 13 bp, D. melanogaster
gcaatgtcttcaa

SEQ ID NO: 624583 - DNA, 13 bp, D. melanogaster
gcaatgtgatcag

SEQ ID NO: 624584 - DNA, 13 bp, D. melanogaster
gcaatgtgcaaca

SEQ ID NO: 624585 - DNA, 13 bp, D. melanogaster
gcaatgtggcaaa

SEQ ID NO: 624586 - DNA, 13 bp, D. melanogaster
gcaatgtgtgtgt

SEQ ID NO: 624587 - DNA, 13 bp, D. melanogaster
gcaatgttaaatc

SEQ ID NO: 624588 - DNA, 13 bp, D. melanogaster
gcaatgtttttgt

SEQ ID NO: 624589 - DNA, 13 bp, D. melanogaster
gcaattaaaaaca

SEQ ID NO: 624590 - DNA, 14 bp, D. melanogaster
gcaattaaaaacaa

SEQ ID NO: 624591 - DNA, 13 bp, D. melanogaster
gcaattaaaaacg

SEQ ID NO: 624592 - DNA, 13 bp, D. melanogaster
gcaattaaaaagt

SEQ ID NO: 624593 - DNA, 13 bp, D. melanogaster
gcaattaaaaatt

SEQ ID NO: 624594 - DNA, 13 bp, D. melanogaster
gcaattaaaacga

SEQ ID NO: 624595 - DNA, 13 bp, D. melanogaster
gcaattaaaatca

SEQ ID NO: 624596 - DNA, 13 bp, D. melanogaster
gcaattaaaatta

SEQ ID NO: 624597 - DNA, 13 bp, D. melanogaster
gcaattaaaattt

SEQ ID NO: 624598 - DNA, 14 bp, D. melanogaster
gcaattaaaatttt

SEQ ID NO: 624599 - DNA, 13 bp, D. melanogaster
gcaattaaacaaa

SEQ ID NO: 624600 - DNA, 13 bp, D. melanogaster
gcaattaaacaca

SEQ ID NO: 624601 - DNA, 13 bp, D. melanogaster
gcaattaaactaa

SEQ ID NO: 624602 - DNA, 13 bp, D. melanogaster
gcaattaaaggca

SEQ ID NO: 624603 - DNA, 13 bp, D. melanogaster
gcaattaaagttt

SEQ ID NO: 624604 - DNA, 14 bp, D. melanogaster
gcaattaaataaat

SEQ ID NO: 624605 - DNA, 13 bp, D. melanogaster
gcaattaaatcaa

SEQ ID NO: 624606 - DNA, 13 bp, D. melanogaster
gcaattaaatgaa

SEQ ID NO: 624607 - DNA, 13 bp, D. melanogaster
gcaattaaatgga

SEQ ID NO: 624608 - DNA, 13 bp, D. melanogaster
gcaattaaattca

SEQ ID NO: 624609 - DNA, 13 bp, D. melanogaster
gcaattaaattgc

SEQ ID NO: 624610 - DNA, 13 bp, D. melanogaster
gcaattaaattgg

SEQ ID NO: 624611 - DNA, 13 bp, D. melanogaster
gcaattaacacaa

SEQ ID NO: 624612 - DNA, 13 bp, D. melanogaster
gcaattaacattt

SEQ ID NO: 624613 - DNA, 13 bp, D. melanogaster
gcaattaagccaa

SEQ ID NO: 624614 - DNA, 13 bp, D. melanogaster
gcaattaataata

SEQ ID NO: 624615 - DNA, 13 bp, D. melanogaster
gcaattaattaaa

SEQ ID NO: 624616 - DNA, 13 bp, D. melanogaster
gcaattaattaca

SEQ ID NO: 624617 - DNA, 13 bp, D. melanogaster
gcaattaattgag

SEQ ID NO: 624618 - DNA, 13 bp, D. melanogaster
gcaattaatttct

SEQ ID NO: 624619 - DNA, 13 bp, D. melanogaster
gcaattaatttgg

SEQ ID NO: 624620 - DNA, 13 bp, D. melanogaster
gcaattacaaaaa

SEQ ID NO: 624621 - DNA, 13 bp, D. melanogaster
gcaattacaaatg

SEQ ID NO: 624622 - DNA, 13 bp, D. melanogaster
gcaattaccaaat

SEQ ID NO: 624623 - DNA, 13 bp, D. melanogaster
gcaattagcaaat

SEQ ID NO: 624624 - DNA, 13 bp, D. melanogaster
gcaattagcaatt

SEQ ID NO: 624625 - DNA, 13 bp, D. melanogaster
gcaattataaatg

SEQ ID NO: 624626 - DNA, 13 bp, D. melanogaster
gcaattataattt

SEQ ID NO: 624627 - DNA, 13 bp, D. melanogaster
gcaattatcaaaa

SEQ ID NO: 624628 - DNA, 13 bp, D. melanogaster
gcaattatgcatt

SEQ ID NO: 624629 - DNA, 13 bp, D. melanogaster
gcaattattattt

SEQ ID NO: 624630 - DNA, 13 bp, D. melanogaster
gcaattattgtta

SEQ ID NO: 624631 - DNA, 13 bp, D. melanogaster
gcaattattttaa

SEQ ID NO: 624632 - DNA, 13 bp, D. melanogaster
gcaattcaaatac

SEQ ID NO: 624633 - DNA, 13 bp, D. melanogaster
gcaattcaaatgc

SEQ ID NO: 624634 - DNA, 13 bp, D. melanogaster
gcaattcaattaa

SEQ ID NO: 624635 - DNA, 14 bp, D. melanogaster
gcaattcaattcaa

SEQ ID NO: 624636 - DNA, 13 bp, D. melanogaster
gcaattcaatttc

SEQ ID NO: 624637 - DNA, 13 bp, D. melanogaster
gcaattcattggg

SEQ ID NO: 624638 - DNA, 13 bp, D. melanogaster
gcaattcatttgg

SEQ ID NO: 624639 - DNA, 13 bp, D. melanogaster
gcaattccaattc

SEQ ID NO: 624640 - DNA, 13 bp, D. melanogaster
gcaattccagcgg

SEQ ID NO: 624641 - DNA, 13 bp, D. melanogaster
gcaattccccaaa

SEQ ID NO: 624642 - DNA, 13 bp, D. melanogaster
gcaattcgcaatt

SEQ ID NO: 624643 - DNA, 13 bp, D. melanogaster
gcaattgaaacaa

SEQ ID NO: 624644 - DNA, 13 bp, D. melanogaster
gcaattgaatgaa

SEQ ID NO: 624645 - DNA, 13 bp, D. melanogaster
gcaattgaatgac

SEQ ID NO: 624646 - DNA, 13 bp, D. melanogaster
gcaattgacattt

SEQ ID NO: 624647 - DNA, 13 bp, D. melanogaster
gcaattgattctg

SEQ ID NO: 624648 - DNA, 13 bp, D. melanogaster
gcaattgattgat

SEQ ID NO: 624649 - DNA, 13 bp, D. melanogaster
gcaattgcaaact

SEQ ID NO: 624650 - DNA, 13 bp, D. melanogaster
gcaattgcaaatg

SEQ ID NO: 624651 - DNA, 13 bp, D. melanogaster
gcaattgcaactg

SEQ ID NO: 624652 - DNA, 13 bp, D. melanogaster
gcaattgcaactt

SEQ ID NO: 624653 - DNA, 13 bp, D. melanogaster
gcaattgcaatcg

SEQ ID NO: 624654 - DNA, 13 bp, D. melanogaster
gcaattgcaatgg

SEQ ID NO: 624655 - DNA, 14 bp, D. melanogaster
gcaattgcaattgc

SEQ ID NO: 624656 - DNA, 13 bp, D. melanogaster
gcaattgcaattt

SEQ ID NO: 624657 - DNA, 13 bp, D. melanogaster
gcaattgcacttt

SEQ ID NO: 624658 - DNA, 13 bp, D. melanogaster
gcaattgcagctg

SEQ ID NO: 624659 - DNA, 13 bp, D. melanogaster
gcaattgcagctt

SEQ ID NO: 624660 - DNA, 13 bp, D. melanogaster
gcaattgcagttt

SEQ ID NO: 624661 - DNA, 13 bp, D. melanogaster
gcaattgctattg

SEQ ID NO: 624662 - DNA, 13 bp, D. melanogaster
gcaattgctggat

SEQ ID NO: 624663 - DNA, 13 bp, D. melanogaster
gcaattgctgttg

SEQ ID NO: 624664 - DNA, 13 bp, D. melanogaster
gcaattgcttttc

SEQ ID NO: 624665 - DNA, 13 bp, D. melanogaster
gcaattggaaaat

SEQ ID NO: 624666 - DNA, 13 bp, D. melanogaster
gcaattggaattt

SEQ ID NO: 624667 - DNA, 13 bp, D. melanogaster
gcaattggcaaac

SEQ ID NO: 624668 - DNA, 13 bp, D. melanogaster
gcaattggcattg

SEQ ID NO: 624669 - DNA, 13 bp, D. melanogaster
gcaattggccaaa

SEQ ID NO: 624670 - DNA, 13 bp, D. melanogaster
gcaattggccaac

SEQ ID NO: 624671 - DNA, 13 bp, D. melanogaster
gcaattggcgcag

SEQ ID NO: 624672 - DNA, 13 bp, D. melanogaster
gcaattgtacaat

SEQ ID NO: 624673 - DNA, 13 bp, D. melanogaster
gcaattgtgaaat

SEQ ID NO: 624674 - DNA, 14 bp, D. melanogaster
gcaattgtgaaatt

SEQ ID NO: 624675 - DNA, 13 bp, D. melanogaster
gcaattgtgacgc

SEQ ID NO: 624676 - DNA, 13 bp, D. melanogaster
gcaattgttaaaa

SEQ ID NO: 624677 - DNA, 13 bp, D. melanogaster
gcaattgttattg

SEQ ID NO: 624678 - DNA, 13 bp, D. melanogaster
gcaattgttgcaa

SEQ ID NO: 624679 - DNA, 14 bp, D. melanogaster
gcaattgttgctgc

SEQ ID NO: 624680 - DNA, 13 bp, D. melanogaster
gcaattgttttcc

SEQ ID NO: 624681 - DNA, 13 bp, D. melanogaster
gcaatttaaatca

SEQ ID NO: 624682 - DNA, 13 bp, D. melanogaster
gcaatttaaatga

SEQ ID NO: 624683 - DNA, 13 bp, D. melanogaster
gcaatttaaatgc

SEQ ID NO: 624684 - DNA, 13 bp, D. melanogaster
gcaatttaaatta

SEQ ID NO: 624685 - DNA, 13 bp, D. melanogaster
gcaatttaaattc

SEQ ID NO: 624686 - DNA, 13 bp, D. melanogaster
gcaatttaacaat

SEQ ID NO: 624687 - DNA, 13 bp, D. melanogaster
gcaatttaatgcc

SEQ ID NO: 624688 - DNA, 13 bp, D. melanogaster
gcaatttaattaa

SEQ ID NO: 624689 - DNA, 13 bp, D. melanogaster
gcaatttaatttc

SEQ ID NO: 624690 - DNA, 14 bp, D. melanogaster
gcaatttaatttgc

SEQ ID NO: 624691 - DNA, 13 bp, D. melanogaster
gcaatttataaat

SEQ ID NO: 624692 - DNA, 13 bp, D. melanogaster
gcaatttatatgt

SEQ ID NO: 624693 - DNA, 13 bp, D. melanogaster
gcaatttatatta

SEQ ID NO: 624694 - DNA, 13 bp, D. melanogaster
gcaatttatcatt

SEQ ID NO: 624695 - DNA, 14 bp, D. melanogaster
gcaatttatgcaaa

SEQ ID NO: 624696 - DNA, 13 bp, D. melanogaster
gcaatttattgaa

SEQ ID NO: 624697 - DNA, 13 bp, D. melanogaster
gcaatttattgcc

SEQ ID NO: 624698 - DNA, 13 bp, D. melanogaster
gcaatttcaataa

SEQ ID NO: 624699 - DNA, 13 bp, D. melanogaster
gcaatttcaatgg

SEQ ID NO: 624700 - DNA, 13 bp, D. melanogaster
gcaatttcagttt

SEQ ID NO: 624701 - DNA, 13 bp, D. melanogaster
gcaatttcattta

SEQ ID NO: 624702 - DNA, 13 bp, D. melanogaster
gcaatttccaccg

SEQ ID NO: 624703 - DNA, 13 bp, D. melanogaster
gcaatttcctgtt

SEQ ID NO: 624704 - DNA, 13 bp, D. melanogaster
gcaatttcgcaaa

SEQ ID NO: 624705 - DNA, 13 bp, D. melanogaster
gcaatttcggttt

SEQ ID NO: 624706 - DNA, 13 bp, D. melanogaster
gcaatttctttgg

SEQ ID NO: 624707 - DNA, 13 bp, D. melanogaster
gcaatttcttttt

SEQ ID NO: 624708 - DNA, 14 bp, D. melanogaster
gcaatttctttttt

SEQ ID NO: 624709 - DNA, 13 bp, D. melanogaster
gcaatttgaaata

SEQ ID NO: 624710 - DNA, 13 bp, D. melanogaster
gcaatttgaatgc

SEQ ID NO: 624711 - DNA, 13 bp, D. melanogaster
gcaatttgagtgc

SEQ ID NO: 624712 - DNA, 14 bp, D. melanogaster
gcaatttgcaaatt

SEQ ID NO: 624713 - DNA, 13 bp, D. melanogaster
gcaatttgcaatt

SEQ ID NO: 624714 - DNA, 14 bp, D. melanogaster
gcaatttgcaattg

SEQ ID NO: 624715 - DNA, 14 bp, D. melanogaster
gcaatttgcaattt

SEQ ID NO: 624716 - DNA, 13 bp, D. melanogaster
gcaatttgcacag

SEQ ID NO: 624717 - DNA, 13 bp, D. melanogaster
gcaatttgcagcc

SEQ ID NO: 624718 - DNA, 13 bp, D. melanogaster
gcaatttgcatgt

SEQ ID NO: 624719 - DNA, 13 bp, D. melanogaster
gcaatttgctgca

SEQ ID NO: 624720 - DNA, 13 bp, D. melanogaster
gcaatttgctggc

SEQ ID NO: 624721 - DNA, 13 bp, D. melanogaster
gcaatttgctgtt

SEQ ID NO: 624722 - DNA, 13 bp, D. melanogaster
gcaatttggcaaa

SEQ ID NO: 624723 - DNA, 13 bp, D. melanogaster
gcaatttggctaa

SEQ ID NO: 624724 - DNA, 13 bp, D. melanogaster
gcaatttggtggc

SEQ ID NO: 624725 - DNA, 13 bp, D. melanogaster
gcaatttgtatat

SEQ ID NO: 624726 - DNA, 13 bp, D. melanogaster
gcaatttgtcagc

SEQ ID NO: 624727 - DNA, 13 bp, D. melanogaster
gcaatttgtgcaa

SEQ ID NO: 624728 - DNA, 13 bp, D. melanogaster
gcaatttgtgctg

SEQ ID NO: 624729 - DNA, 13 bp, D. melanogaster
gcaatttgttaaa

SEQ ID NO: 624730 - DNA, 13 bp, D. melanogaster
gcaatttgttgaa

SEQ ID NO: 624731 - DNA, 13 bp, D. melanogaster
gcaatttgttgca

SEQ ID NO: 624732 - DNA, 13 bp, D. melanogaster
gcaatttgttgct

SEQ ID NO: 624733 - DNA, 14 bp, D. melanogaster
gcaatttgttgctg

SEQ ID NO: 624734 - DNA, 13 bp, D. melanogaster
gcaatttgttgtt

SEQ ID NO: 624735 - DNA, 13 bp, D. melanogaster
gcaatttgtttat

SEQ ID NO: 624736 - DNA, 13 bp, D. melanogaster
gcaatttgtttgt

SEQ ID NO: 624737 - DNA, 14 bp, D. melanogaster
gcaattttaaattt

SEQ ID NO: 624738 - DNA, 13 bp, D. melanogaster
gcaattttaataa

SEQ ID NO: 624739 - DNA, 13 bp, D. melanogaster
gcaattttaatgc

SEQ ID NO: 624740 - DNA, 13 bp, D. melanogaster
gcaattttataaa

SEQ ID NO: 624741 - DNA, 13 bp, D. melanogaster
gcaattttcaaat

SEQ ID NO: 624742 - DNA, 13 bp, D. melanogaster
gcaattttcaatt

SEQ ID NO: 624743 - DNA, 13 bp, D. melanogaster
gcaattttcagcc

SEQ ID NO: 624744 - DNA, 13 bp, D. melanogaster
gcaattttcataa

SEQ ID NO: 624745 - DNA, 13 bp, D. melanogaster
gcaattttcatgc

SEQ ID NO: 624746 - DNA, 13 bp, D. melanogaster
gcaattttcattt

SEQ ID NO: 624747 - DNA, 13 bp, D. melanogaster
gcaattttccaat

SEQ ID NO: 624748 - DNA, 13 bp, D. melanogaster
gcaattttccatt

SEQ ID NO: 624749 - DNA, 13 bp, D. melanogaster
gcaattttcgttt

SEQ ID NO: 624750 - DNA, 13 bp, D. melanogaster
gcaattttgtaat

SEQ ID NO: 624751 - DNA, 13 bp, D. melanogaster
gcaattttgtggc

SEQ ID NO: 624752 - DNA, 13 bp, D. melanogaster
gcaatttttaaat

SEQ ID NO: 624753 - DNA, 13 bp, D. melanogaster
gcaatttttgcac

SEQ ID NO: 624754 - DNA, 13 bp, D. melanogaster
gcaatttttggca

SEQ ID NO: 624755 - DNA, 13 bp, D. melanogaster
gcaatttttgtgt

SEQ ID NO: 624756 - DNA, 13 bp, D. melanogaster
gcaatttttgttg

SEQ ID NO: 624757 - DNA, 13 bp, D. melanogaster
gcaatttttttat

SEQ ID NO: 624758 - DNA, 13 bp, D. melanogaster
gcacaaaaaagtg

SEQ ID NO: 624759 - DNA, 13 bp, D. melanogaster
gcacaaaaacatt

SEQ ID NO: 624760 - DNA, 13 bp, D. melanogaster
gcacaaaaagtgc

SEQ ID NO: 624761 - DNA, 13 bp, D. melanogaster
gcacaaaaatatt

SEQ ID NO: 624762 - DNA, 13 bp, D. melanogaster
gcacaaaaatcga

SEQ ID NO: 624763 - DNA, 13 bp, D. melanogaster
gcacaaaaatgaa

SEQ ID NO: 624764 - DNA, 13 bp, D. melanogaster
gcacaaaacaacg

SEQ ID NO: 624765 - DNA, 13 bp, D. melanogaster
gcacaaaacaagc

SEQ ID NO: 624766 - DNA, 13 bp, D. melanogaster
gcacaaaacaatt

SEQ ID NO: 624767 - DNA, 13 bp, D. melanogaster
gcacaaaactgcc

SEQ ID NO: 624768 - DNA, 13 bp, D. melanogaster
gcacaaaagccga

SEQ ID NO: 624769 - DNA, 13 bp, D. melanogaster
gcacaaaaggcca

SEQ ID NO: 624770 - DNA, 13 bp, D. melanogaster
gcacaaaagtatg

SEQ ID NO: 624771 - DNA, 13 bp, D. melanogaster
gcacaaaagttgc

SEQ ID NO: 624772 - DNA, 13 bp, D. melanogaster
gcacaaaatatgc

SEQ ID NO: 624773 - DNA, 13 bp, D. melanogaster
gcacaaaatgcaa

SEQ ID NO: 624774 - DNA, 14 bp, D. melanogaster
gcacaaaatgcaaa

SEQ ID NO: 624775 - DNA, 13 bp, D. melanogaster
gcacaaaatgcca

SEQ ID NO: 624776 - DNA, 13 bp, D. melanogaster
gcacaaaattgca

SEQ ID NO: 624777 - DNA, 13 bp, D. melanogaster
gcacaaacaaagc

SEQ ID NO: 624778 - DNA, 13 bp, D. melanogaster
gcacaaacaactt

SEQ ID NO: 624779 - DNA, 13 bp, D. melanogaster
gcacaaacacagc

SEQ ID NO: 624780 - DNA, 13 bp, D. melanogaster
gcacaaacataaa

SEQ ID NO: 624781 - DNA, 13 bp, D. melanogaster
gcacaaactttaa

SEQ ID NO: 624782 - DNA, 13 bp, D. melanogaster
gcacaaagtgata

SEQ ID NO: 624783 - DNA, 13 bp, D. melanogaster
gcacaaagttttg

SEQ ID NO: 624784 - DNA, 13 bp, D. melanogaster
gcacaaataaatt

SEQ ID NO: 624785 - DNA, 13 bp, D. melanogaster
gcacaaataacaa

SEQ ID NO: 624786 - DNA, 13 bp, D. melanogaster
gcacaaatacata

SEQ ID NO: 624787 - DNA, 13 bp, D. melanogaster
gcacaaatattga

SEQ ID NO: 624788 - DNA, 13 bp, D. melanogaster
gcacaaatcaatt

SEQ ID NO: 624789 - DNA, 13 bp, D. melanogaster
gcacaaatgaaat

SEQ ID NO: 624790 - DNA, 13 bp, D. melanogaster
gcacaaattaatt

SEQ ID NO: 624791 - DNA, 13 bp, D. melanogaster
gcacaaattgaaa

SEQ ID NO: 624792 - DNA, 14 bp, D. melanogaster
gcacaaattgaaaa

SEQ ID NO: 624793 - DNA, 13 bp, D. melanogaster
gcacaaattgaat

SEQ ID NO: 624794 - DNA, 13 bp, D. melanogaster
gcacaaattgcag

SEQ ID NO: 624795 - DNA, 13 bp, D. melanogaster
gcacaacaacagc

SEQ ID NO: 624796 - DNA, 14 bp, D. melanogaster
gcacaacacgcaca

SEQ ID NO: 624797 - DNA, 13 bp, D. melanogaster
gcacaactgtacc

SEQ ID NO: 624798 - DNA, 13 bp, D. melanogaster
gcacaagcacaca

SEQ ID NO: 624799 - DNA, 13 bp, D. melanogaster
gcacaaggacatt

SEQ ID NO: 624800 - DNA, 13 bp, D. melanogaster
gcacaagtgtgtg

SEQ ID NO: 624801 - DNA, 13 bp, D. melanogaster
gcacaagttggca

SEQ ID NO: 624802 - DNA, 13 bp, D. melanogaster
gcacaataaaaac

SEQ ID NO: 624803 - DNA, 14 bp, D. melanogaster
gcacaataaataaa

SEQ ID NO: 624804 - DNA, 13 bp, D. melanogaster
gcacaataaattg

SEQ ID NO: 624805 - DNA, 13 bp, D. melanogaster
gcacaataagaag

SEQ ID NO: 624806 - DNA, 13 bp, D. melanogaster
gcacaatgaaaat

SEQ ID NO: 624807 - DNA, 13 bp, D. melanogaster
gcacaatgcacaa

SEQ ID NO: 624808 - DNA, 13 bp, D. melanogaster
gcacaatgccaaa

SEQ ID NO: 624809 - DNA, 13 bp, D. melanogaster
gcacaatttcaaa

SEQ ID NO: 624810 - DNA, 13 bp, D. melanogaster
gcacaattttatt

SEQ ID NO: 624811 - DNA, 13 bp, D. melanogaster
gcacaattttccc

SEQ ID NO: 624812 - DNA, 13 bp, D. melanogaster
gcacacaaaatat

SEQ ID NO: 624813 - DNA, 13 bp, D. melanogaster
gcacacaaaatgc

SEQ ID NO: 624814 - DNA, 14 bp, D. melanogaster
gcacacaaatacac

SEQ ID NO: 624815 - DNA, 13 bp, D. melanogaster
gcacacaaatttg

SEQ ID NO: 624816 - DNA, 14 bp, D. melanogaster
gcacacaacaatgt

SEQ ID NO: 624817 - DNA, 13 bp, D. melanogaster
gcacacaacaatt

SEQ ID NO: 624818 - DNA, 13 bp, D. melanogaster
gcacacaagcaca

SEQ ID NO: 624819 - DNA, 13 bp, D. melanogaster
gcacacaatcgca

SEQ ID NO: 624820 - DNA, 13 bp, D. melanogaster
gcacacacaatgg

SEQ ID NO: 624821 - DNA, 13 bp, D. melanogaster
gcacacacaattg

SEQ ID NO: 624822 - DNA, 13 bp, D. melanogaster
gcacacacacaag

SEQ ID NO: 624823 - DNA, 14 bp, D. melanogaster
gcacacacacacat

SEQ ID NO: 624824 - DNA, 13 bp, D. melanogaster
gcacacacacacg

SEQ ID NO: 624825 - DNA, 13 bp, D. melanogaster
gcacacacacact

SEQ ID NO: 624826 - DNA, 14 bp, D. melanogaster
gcacacacacactc

SEQ ID NO: 624827 - DNA, 14 bp, D. melanogaster
gcacacacacagac

SEQ ID NO: 624828 - DNA, 14 bp, D. melanogaster
gcacacacacatgc

SEQ ID NO: 624829 - DNA, 13 bp, D. melanogaster
gcacacacaccag

SEQ ID NO: 624830 - DNA, 13 bp, D. melanogaster
gcacacacacgca

SEQ ID NO: 624831 - DNA, 14 bp, D. melanogaster
gcacacacacgcac

SEQ ID NO: 624832 - DNA, 13 bp, D. melanogaster
gcacacacactcg

SEQ ID NO: 624833 - DNA, 14 bp, D. melanogaster
gcacacacactcgc

SEQ ID NO: 624834 - DNA, 13 bp, D. melanogaster
gcacacacagaca

SEQ ID NO: 624835 - DNA, 14 bp, D. melanogaster
gcacacacagacac

SEQ ID NO: 624836 - DNA, 13 bp, D. melanogaster
gcacacacataaa

SEQ ID NO: 624837 - DNA, 14 bp, D. melanogaster
gcacacacataaat

SEQ ID NO: 624838 - DNA, 14 bp, D. melanogaster
gcacacacatacac

SEQ ID NO: 624839 - DNA, 14 bp, D. melanogaster
gcacacacatacat

SEQ ID NO: 624840 - DNA, 13 bp, D. melanogaster
gcacacacatact

SEQ ID NO: 624841 - DNA, 13 bp, D. melanogaster
gcacacacatatg

SEQ ID NO: 624842 - DNA, 14 bp, D. melanogaster
gcacacacatgtgt

SEQ ID NO: 624843 - DNA, 13 bp, D. melanogaster
gcacacacattaa

SEQ ID NO: 624844 - DNA, 13 bp, D. melanogaster
gcacacacatttt

SEQ ID NO: 624845 - DNA, 13 bp, D. melanogaster
gcacacacgcaca

SEQ ID NO: 624846 - DNA, 14 bp, D. melanogaster
gcacacacgcacac

SEQ ID NO: 624847 - DNA, 13 bp, D. melanogaster
gcacacacgcata

SEQ ID NO: 624848 - DNA, 13 bp, D. melanogaster
gcacacactcaca

SEQ ID NO: 624849 - DNA, 13 bp, D. melanogaster
gcacacactgcgt

SEQ ID NO: 624850 - DNA, 13 bp, D. melanogaster
gcacacacttaca

SEQ ID NO: 624851 - DNA, 13 bp, D. melanogaster
gcacacagaaatg

SEQ ID NO: 624852 - DNA, 14 bp, D. melanogaster
gcacacagacacac

SEQ ID NO: 624853 - DNA, 13 bp, D. melanogaster
gcacacagagaaa

SEQ ID NO: 624854 - DNA, 13 bp, D. melanogaster
gcacacagataca

SEQ ID NO: 624855 - DNA, 14 bp, D. melanogaster
gcacacagatacac

SEQ ID NO: 624856 - DNA, 14 bp, D. melanogaster
gcacacagatactc

SEQ ID NO: 624857 - DNA, 13 bp, D. melanogaster
gcacacagcgaaa

SEQ ID NO: 624858 - DNA, 13 bp, D. melanogaster
gcacacagctgca

SEQ ID NO: 624859 - DNA, 13 bp, D. melanogaster
gcacacataaagt

SEQ ID NO: 624860 - DNA, 13 bp, D. melanogaster
gcacacataaatc

SEQ ID NO: 624861 - DNA, 13 bp, D. melanogaster
gcacacataaatt

SEQ ID NO: 624862 - DNA, 13 bp, D. melanogaster
gcacacatacaaa

SEQ ID NO: 624863 - DNA, 14 bp, D. melanogaster
gcacacatacacat

SEQ ID NO: 624864 - DNA, 13 bp, D. melanogaster
gcacacatacata

SEQ ID NO: 624865 - DNA, 14 bp, D. melanogaster
gcacacatacatac

SEQ ID NO: 624866 - DNA, 14 bp, D. melanogaster
gcacacatacatat

SEQ ID NO: 624867 - DNA, 13 bp, D. melanogaster
gcacacatagaaa

SEQ ID NO: 624868 - DNA, 13 bp, D. melanogaster
gcacacatatata

SEQ ID NO: 624869 - DNA, 14 bp, D. melanogaster
gcacacatatatat

SEQ ID NO: 624870 - DNA, 13 bp, D. melanogaster
gcacacatatgta

SEQ ID NO: 624871 - DNA, 14 bp, D. melanogaster
gcacacatatgtat

SEQ ID NO: 624872 - DNA, 13 bp, D. melanogaster
gcacacatgcaca

SEQ ID NO: 624873 - DNA, 13 bp, D. melanogaster
gcacacatggcgt

SEQ ID NO: 624874 - DNA, 13 bp, D. melanogaster
gcacacatttttt

SEQ ID NO: 624875 - DNA, 13 bp, D. melanogaster
gcacaccaaggat

SEQ ID NO: 624876 - DNA, 13 bp, D. melanogaster
gcacaccaccctc

SEQ ID NO: 624877 - DNA, 14 bp, D. melanogaster
gcacaccaccctcg

SEQ ID NO: 624878 - DNA, 13 bp, D. melanogaster
gcacacccataca

SEQ ID NO: 624879 - DNA, 14 bp, D. melanogaster
gcacaccccaatcc

SEQ ID NO: 624880 - DNA, 13 bp, D. melanogaster
gcacacgacaatt

SEQ ID NO: 624881 - DNA, 13 bp, D. melanogaster
gcacacgcacaca

SEQ ID NO: 624882 - DNA, 14 bp, D. melanogaster
gcacacgcacacac

SEQ ID NO: 624883 - DNA, 14 bp, D. melanogaster
gcacacgcacacat

SEQ ID NO: 624884 - DNA, 13 bp, D. melanogaster
gcacacgcacacc

SEQ ID NO: 624885 - DNA, 14 bp, D. melanogaster
gcacacgcacacca

SEQ ID NO: 624886 - DNA, 13 bp, D. melanogaster
gcacacgcacacg

SEQ ID NO: 624887 - DNA, 14 bp, D. melanogaster
gcacacgcacgcac

SEQ ID NO: 624888 - DNA, 13 bp, D. melanogaster
gcacacgcataca

SEQ ID NO: 624889 - DNA, 13 bp, D. melanogaster
gcacacgctgcgt

SEQ ID NO: 624890 - DNA, 13 bp, D. melanogaster
gcacacggaaaaa

SEQ ID NO: 624891 - DNA, 13 bp, D. melanogaster
gcacacgtgcagc

SEQ ID NO: 624892 - DNA, 13 bp, D. melanogaster
gcacactcacaca

SEQ ID NO: 624893 - DNA, 14 bp, D. melanogaster
gcacactcacacac

SEQ ID NO: 624894 - DNA, 13 bp, D. melanogaster
gcacactgaaaga

SEQ ID NO: 624895 - DNA, 13 bp, D. melanogaster
gcacactgtttgc

SEQ ID NO: 624896 - DNA, 13 bp, D. melanogaster
gcacacttacaca

SEQ ID NO: 624897 - DNA, 13 bp, D. melanogaster
gcacacttctcag

SEQ ID NO: 624898 - DNA, 14 bp, D. melanogaster
gcacacttctcagc

SEQ ID NO: 624899 - DNA, 13 bp, D. melanogaster
gcacactttggga

SEQ ID NO: 624900 - DNA, 13 bp, D. melanogaster
gcacacttttttt

SEQ ID NO: 624901 - DNA, 13 bp, D. melanogaster
gcacagaaaataa

SEQ ID NO: 624902 - DNA, 13 bp, D. melanogaster
gcacagacacaaa

SEQ ID NO: 624903 - DNA, 13 bp, D. melanogaster
gcacagagagaaa

SEQ ID NO: 624904 - DNA, 13 bp, D. melanogaster
gcacagatacaga

SEQ ID NO: 624905 - DNA, 14 bp, D. melanogaster
gcacagatacagat

SEQ ID NO: 624906 - DNA, 13 bp, D. melanogaster
gcacagattttct

SEQ ID NO: 624907 - DNA, 13 bp, D. melanogaster
gcacagcaacaaa

SEQ ID NO: 624908 - DNA, 13 bp, D. melanogaster
gcacagcaacaac

SEQ ID NO: 624909 - DNA, 13 bp, D. melanogaster
gcacagcacagca

SEQ ID NO: 624910 - DNA, 14 bp, D. melanogaster
gcacagcacagcac

SEQ ID NO: 624911 - DNA, 13 bp, D. melanogaster
gcacagcacattt

SEQ ID NO: 624912 - DNA, 14 bp, D. melanogaster
gcacagcacatttc

SEQ ID NO: 624913 - DNA, 13 bp, D. melanogaster
gcacagcacgaaa

SEQ ID NO: 624914 - DNA, 13 bp, D. melanogaster
gcacagcagcaac

SEQ ID NO: 624915 - DNA, 13 bp, D. melanogaster
gcacagccatttt

SEQ ID NO: 624916 - DNA, 13 bp, D. melanogaster
gcacagcgaaaaa

SEQ ID NO: 624917 - DNA, 13 bp, D. melanogaster
gcacagctaaaat

SEQ ID NO: 624918 - DNA, 13 bp, D. melanogaster
gcacagctgattt

SEQ ID NO: 624919 - DNA, 13 bp, D. melanogaster
gcacagctggcgc

SEQ ID NO: 624920 - DNA, 14 bp, D. melanogaster
gcacaggaaaaaat

SEQ ID NO: 624921 - DNA, 13 bp, D. melanogaster
gcacaggaagaaa

SEQ ID NO: 624922 - DNA, 13 bp, D. melanogaster
gcacaggcacagg

SEQ ID NO: 624923 - DNA, 13 bp, D. melanogaster
gcacagtcaacga

SEQ ID NO: 624924 - DNA, 13 bp, D. melanogaster
gcacagtgaaaaa

SEQ ID NO: 624925 - DNA, 13 bp, D. melanogaster
gcacagtgagaaa

SEQ ID NO: 624926 - DNA, 13 bp, D. melanogaster
gcacagtgccaga

SEQ ID NO: 624927 - DNA, 13 bp, D. melanogaster
gcacagtgggaca

SEQ ID NO: 624928 - DNA, 14 bp, D. melanogaster
gcacagtgggacaa

SEQ ID NO: 624929 - DNA, 13 bp, D. melanogaster
gcacagtgggcag

SEQ ID NO: 624930 - DNA, 13 bp, D. melanogaster
gcacagtgggcca

SEQ ID NO: 624931 - DNA, 13 bp, D. melanogaster
gcacagtgggtca

SEQ ID NO: 624932 - DNA, 13 bp, D. melanogaster
gcacagtgggtcg

SEQ ID NO: 624933 - DNA, 13 bp, D. melanogaster
gcacagttggcac

SEQ ID NO: 624934 - DNA, 13 bp, D. melanogaster
gcacagtttcgtg

SEQ ID NO: 624935 - DNA, 13 bp, D. melanogaster
gcacataaaatgg

SEQ ID NO: 624936 - DNA, 13 bp, D. melanogaster
gcacataaataaa

SEQ ID NO: 624937 - DNA, 13 bp, D. melanogaster
gcacataaataat

SEQ ID NO: 624938 - DNA, 14 bp, D. melanogaster
gcacataacaagat

SEQ ID NO: 624939 - DNA, 13 bp, D. melanogaster
gcacataataaaa

SEQ ID NO: 624940 - DNA, 13 bp, D. melanogaster
gcacataattaca

SEQ ID NO: 624941 - DNA, 13 bp, D. melanogaster
gcacataatttaa

SEQ ID NO: 624942 - DNA, 13 bp, D. melanogaster
gcacatacacaca

SEQ ID NO: 624943 - DNA, 14 bp, D. melanogaster
gcacatacacacac

SEQ ID NO: 624944 - DNA, 13 bp, D. melanogaster
gcacatacacatg

SEQ ID NO: 624945 - DNA, 13 bp, D. melanogaster
gcacatacataca

SEQ ID NO: 624946 - DNA, 14 bp, D. melanogaster
gcacatacatacat

SEQ ID NO: 624947 - DNA, 13 bp, D. melanogaster
gcacatacatata

SEQ ID NO: 624948 - DNA, 14 bp, D. melanogaster
gcacatacatatgt

SEQ ID NO: 624949 - DNA, 13 bp, D. melanogaster
gcacatacattgc

SEQ ID NO: 624950 - DNA, 13 bp, D. melanogaster
gcacatacgcaca

SEQ ID NO: 624951 - DNA, 14 bp, D. melanogaster
gcacatatacatat

SEQ ID NO: 624952 - DNA, 14 bp, D. melanogaster
gcacatatatatat

SEQ ID NO: 624953 - DNA, 13 bp, D. melanogaster
gcacatatatatg

SEQ ID NO: 624954 - DNA, 13 bp, D. melanogaster
gcacatatatttc

SEQ ID NO: 624955 - DNA, 13 bp, D. melanogaster
gcacatatgcaaa

SEQ ID NO: 624956 - DNA, 13 bp, D. melanogaster
gcacatatgtatt

SEQ ID NO: 624957 - DNA, 13 bp, D. melanogaster
gcacatatttatt

SEQ ID NO: 624958 - DNA, 13 bp, D. melanogaster
gcacatcacaaat

SEQ ID NO: 624959 - DNA, 13 bp, D. melanogaster
gcacatcgcacat

SEQ ID NO: 624960 - DNA, 14 bp, D. melanogaster
gcacatgacaacag

SEQ ID NO: 624961 - DNA, 13 bp, D. melanogaster
gcacatgcaaatg

SEQ ID NO: 624962 - DNA, 13 bp, D. melanogaster
gcacatgcacatg

SEQ ID NO: 624963 - DNA, 14 bp, D. melanogaster
gcacatgcacatgc

SEQ ID NO: 624964 - DNA, 14 bp, D. melanogaster
gcacatgcttaaaa

SEQ ID NO: 624965 - DNA, 13 bp, D. melanogaster
gcacatgggcaat

SEQ ID NO: 624966 - DNA, 14 bp, D. melanogaster
gcacatgggcaata

SEQ ID NO: 624967 - DNA, 13 bp, D. melanogaster
gcacatgtacata

SEQ ID NO: 624968 - DNA, 13 bp, D. melanogaster
gcacatgtatgta

SEQ ID NO: 624969 - DNA, 13 bp, D. melanogaster
gcacatgtgtgtg

SEQ ID NO: 624970 - DNA, 14 bp, D. melanogaster
gcacatgtgtgtgt

SEQ ID NO: 624971 - DNA, 13 bp, D. melanogaster
gcacattaaaatg

SEQ ID NO: 624972 - DNA, 13 bp, D. melanogaster
gcacattaaattg

SEQ ID NO: 624973 - DNA, 13 bp, D. melanogaster
gcacattaaattt

SEQ ID NO: 624974 - DNA, 13 bp, D. melanogaster
gcacattcaaaat

SEQ ID NO: 624975 - DNA, 13 bp, D. melanogaster
gcacattgaagcc

SEQ ID NO: 624976 - DNA, 13 bp, D. melanogaster
gcacattgcacat

SEQ ID NO: 624977 - DNA, 13 bp, D. melanogaster
gcacatttaatta

SEQ ID NO: 624978 - DNA, 13 bp, D. melanogaster
gcacatttcaatt

SEQ ID NO: 624979 - DNA, 13 bp, D. melanogaster
gcacatttcattt

SEQ ID NO: 624980 - DNA, 13 bp, D. melanogaster
gcacatttccatt

SEQ ID NO: 624981 - DNA, 13 bp, D. melanogaster
gcacatttgttta

SEQ ID NO: 624982 - DNA, 13 bp, D. melanogaster
gcacatttttcgc

SEQ ID NO: 624983 - DNA, 13 bp, D. melanogaster
gcacatttttctt

SEQ ID NO: 624984 - DNA, 13 bp, D. melanogaster
gcaccaaacactc

SEQ ID NO: 624985 - DNA, 13 bp, D. melanogaster
gcaccaaagaggc

SEQ ID NO: 624986 - DNA, 13 bp, D. melanogaster
gcaccaagatatt

SEQ ID NO: 624987 - DNA, 13 bp, D. melanogaster
gcaccaccaccag

SEQ ID NO: 624988 - DNA, 13 bp, D. melanogaster
gcaccaccacctc

SEQ ID NO: 624989 - DNA, 13 bp, D. melanogaster
gcaccacccactc

SEQ ID NO: 624990 - DNA, 13 bp, D. melanogaster
gcaccacgcaaca

SEQ ID NO: 624991 - DNA, 13 bp, D. melanogaster
gcaccacttttac

SEQ ID NO: 624992 - DNA, 13 bp, D. melanogaster
gcaccagcagcaa

SEQ ID NO: 624993 - DNA, 13 bp, D. melanogaster
gcaccagctgcca

SEQ ID NO: 624994 - DNA, 14 bp, D. melanogaster
gcaccagctgccaa

SEQ ID NO: 624995 - DNA, 13 bp, D. melanogaster
gcaccaggcagtg

SEQ ID NO: 624996 - DNA, 15 bp, D. melanogaster
gcaccatatttggct

SEQ ID NO: 624997 - DNA, 13 bp, D. melanogaster
gcaccatgcacca

SEQ ID NO: 624998 - DNA, 13 bp, D. melanogaster
gcaccattgccga

SEQ ID NO: 624999 - DNA, 13 bp, D. melanogaster
gcacccaactgca

SEQ ID NO: 625000 - DNA, 13 bp, D. melanogaster
gcacccattgagt

SEQ ID NO: 625001 - DNA, 13 bp, D. melanogaster
gcacccgaatcaa

SEQ ID NO: 625002 - DNA, 13 bp, D. melanogaster
gcacccgctactt

SEQ ID NO: 625003 - DNA, 14 bp, D. melanogaster
gcaccctgggctcc

SEQ ID NO: 625004 - DNA, 13 bp, D. melanogaster
gcaccgcacacac

SEQ ID NO: 625005 - DNA, 13 bp, D. melanogaster
gcaccgcaccgca

SEQ ID NO: 625006 - DNA, 13 bp, D. melanogaster
gcaccgcccactt

SEQ ID NO: 625007 - DNA, 13 bp, D. melanogaster
gcaccggaaaaaa

SEQ ID NO: 625008 - DNA, 13 bp, D. melanogaster
gcacctcctccat

SEQ ID NO: 625009 - DNA, 13 bp, D. melanogaster
gcacctgcaaaca

SEQ ID NO: 625010 - DNA, 13 bp, D. melanogaster
gcacgaaagtcac

SEQ ID NO: 625011 - DNA, 13 bp, D. melanogaster
gcacgaagtgcgg

SEQ ID NO: 625012 - DNA, 13 bp, D. melanogaster
gcacgaatctatt

SEQ ID NO: 625013 - DNA, 13 bp, D. melanogaster
gcacgagaaatat

SEQ ID NO: 625014 - DNA, 14 bp, D. melanogaster
gcacgagaaatatt

SEQ ID NO: 625015 - DNA, 14 bp, D. melanogaster
gcacgcacacaaac

SEQ ID NO: 625016 - DNA, 13 bp, D. melanogaster
gcacgcacacaca

SEQ ID NO: 625017 - DNA, 14 bp, D. melanogaster
gcacgcacacacaa

SEQ ID NO: 625018 - DNA, 14 bp, D. melanogaster
gcacgcacacacat

SEQ ID NO: 625019 - DNA, 13 bp, D. melanogaster
gcacgcacacagg

SEQ ID NO: 625020 - DNA, 13 bp, D. melanogaster
gcacgcacacatg

SEQ ID NO: 625021 - DNA, 13 bp, D. melanogaster
gcacgcacactca

SEQ ID NO: 625022 - DNA, 13 bp, D. melanogaster
gcacgcacactcg

SEQ ID NO: 625023 - DNA, 13 bp, D. melanogaster
gcacgcacgcaca

SEQ ID NO: 625024 - DNA, 13 bp, D. melanogaster
gcacgcatgcgca

SEQ ID NO: 625025 - DNA, 14 bp, D. melanogaster
gcacggactgcagc

SEQ ID NO: 625026 - DNA, 13 bp, D. melanogaster
gcacggagcacgg

SEQ ID NO: 625027 - DNA, 13 bp, D. melanogaster
gcacgtgtgtgtg

SEQ ID NO: 625028 - DNA, 14 bp, D. melanogaster
gcacgtgtgtgtgt

SEQ ID NO: 625029 - DNA, 13 bp, D. melanogaster
gcactaaaaataa

SEQ ID NO: 625030 - DNA, 13 bp, D. melanogaster
gcactaaaaatat

SEQ ID NO: 625031 - DNA, 13 bp, D. melanogaster
gcactaaaataaa

SEQ ID NO: 625032 - DNA, 13 bp, D. melanogaster
gcactaaataaat

SEQ ID NO: 625033 - DNA, 13 bp, D. melanogaster
gcactaaatcaaa

SEQ ID NO: 625034 - DNA, 13 bp, D. melanogaster
gcactacaaacat

SEQ ID NO: 625035 - DNA, 13 bp, D. melanogaster
gcactcaaagaaa

SEQ ID NO: 625036 - DNA, 13 bp, D. melanogaster
gcactcaaattgc

SEQ ID NO: 625037 - DNA, 13 bp, D. melanogaster
gcactcaacaatc

SEQ ID NO: 625038 - DNA, 13 bp, D. melanogaster
gcactcaatttaa

SEQ ID NO: 625039 - DNA, 13 bp, D. melanogaster
gcactcacacaaa

SEQ ID NO: 625040 - DNA, 13 bp, D. melanogaster
gcactcacacaca

SEQ ID NO: 625041 - DNA, 14 bp, D. melanogaster
gcactcacacacac

SEQ ID NO: 625042 - DNA, 14 bp, D. melanogaster
gcactcacacacgc

SEQ ID NO: 625043 - DNA, 13 bp, D. melanogaster
gcactcacgcaca

SEQ ID NO: 625044 - DNA, 14 bp, D. melanogaster
gcactcactcacac

SEQ ID NO: 625045 - DNA, 13 bp, D. melanogaster
gcactcagagaaa

SEQ ID NO: 625046 - DNA, 13 bp, D. melanogaster
gcactcattagca

SEQ ID NO: 625047 - DNA, 13 bp, D. melanogaster
gcactccactcca

SEQ ID NO: 625048 - DNA, 13 bp, D. melanogaster
gcactcccttcct

SEQ ID NO: 625049 - DNA, 13 bp, D. melanogaster
gcactcctatccc

SEQ ID NO: 625050 - DNA, 13 bp, D. melanogaster
gcactcgaaaaaa

SEQ ID NO: 625051 - DNA, 13 bp, D. melanogaster
gcactcgaaaaat

SEQ ID NO: 625052 - DNA, 13 bp, D. melanogaster
gcactcgaaatgc

SEQ ID NO: 625053 - DNA, 13 bp, D. melanogaster
gcactcgaagaaa

SEQ ID NO: 625054 - DNA, 13 bp, D. melanogaster
gcactcgcacaca

SEQ ID NO: 625055 - DNA, 14 bp, D. melanogaster
gcactcgcacacac

SEQ ID NO: 625056 - DNA, 14 bp, D. melanogaster
gcactcgcactcgc

SEQ ID NO: 625057 - DNA, 15 bp, D. melanogaster
gcactcgcgaattgg

SEQ ID NO: 625058 - DNA, 13 bp, D. melanogaster
gcactcgctgccg

SEQ ID NO: 625059 - DNA, 13 bp, D. melanogaster
gcactcggagaaa

SEQ ID NO: 625060 - DNA, 14 bp, D. melanogaster
gcactcggaggcag

SEQ ID NO: 625061 - DNA, 13 bp, D. melanogaster
gcactctgcagtt

SEQ ID NO: 625062 - DNA, 13 bp, D. melanogaster
gcactctgcccaa

SEQ ID NO: 625063 - DNA, 14 bp, D. melanogaster
gcactctttttttt

SEQ ID NO: 625064 - DNA, 13 bp, D. melanogaster
gcactgaaaaaaa

SEQ ID NO: 625065 - DNA, 14 bp, D. melanogaster
gcactgaaaaaaaa

SEQ ID NO: 625066 - DNA, 13 bp, D. melanogaster
gcactgaaaaaat

SEQ ID NO: 625067 - DNA, 13 bp, D. melanogaster
gcactgaaaacaa

SEQ ID NO: 625068 - DNA, 13 bp, D. melanogaster
gcactgaaaagaa

SEQ ID NO: 625069 - DNA, 13 bp, D. melanogaster
gcactgaaagaaa

SEQ ID NO: 625070 - DNA, 13 bp, D. melanogaster
gcactgaaataaa

SEQ ID NO: 625071 - DNA, 13 bp, D. melanogaster
gcactgaaatatt

SEQ ID NO: 625072 - DNA, 13 bp, D. melanogaster
gcactgaacgaaa

SEQ ID NO: 625073 - DNA, 13 bp, D. melanogaster
gcactgaagaaaa

SEQ ID NO: 625074 - DNA, 13 bp, D. melanogaster
gcactgagaaaaa

SEQ ID NO: 625075 - DNA, 13 bp, D. melanogaster
gcactgagaacaa

SEQ ID NO: 625076 - DNA, 13 bp, D. melanogaster
gcactgagagaaa

SEQ ID NO: 625077 - DNA, 14 bp, D. melanogaster
gcactgagagaaat

SEQ ID NO: 625078 - DNA, 13 bp, D. melanogaster
gcactgagcaaaa

SEQ ID NO: 625079 - DNA, 13 bp, D. melanogaster
gcactgagcgaaa

SEQ ID NO: 625080 - DNA, 14 bp, D. melanogaster
gcactgagcgaaaa

SEQ ID NO: 625081 - DNA, 13 bp, D. melanogaster
gcactgaggaaaa

SEQ ID NO: 625082 - DNA, 13 bp, D. melanogaster
gcactgcaaaaaa

SEQ ID NO: 625083 - DNA, 14 bp, D. melanogaster
gcactgcaaaaaaa

SEQ ID NO: 625084 - DNA, 13 bp, D. melanogaster
gcactgcaaatat

SEQ ID NO: 625085 - DNA, 13 bp, D. melanogaster
gcactgcaacagt

SEQ ID NO: 625086 - DNA, 13 bp, D. melanogaster
gcactgcaacatt

SEQ ID NO: 625087 - DNA, 13 bp, D. melanogaster
gcactgcaagaaa

SEQ ID NO: 625088 - DNA, 13 bp, D. melanogaster
gcactgcaattgc

SEQ ID NO: 625089 - DNA, 13 bp, D. melanogaster
gcactgcacgaaa

SEQ ID NO: 625090 - DNA, 13 bp, D. melanogaster
gcactgcagttgc

SEQ ID NO: 625091 - DNA, 13 bp, D. melanogaster
gcactgccagcaa

SEQ ID NO: 625092 - DNA, 13 bp, D. melanogaster
gcactgcgaaaaa

SEQ ID NO: 625093 - DNA, 14 bp, D. melanogaster
gcactgcgaaaaaa

SEQ ID NO: 625094 - DNA, 14 bp, D. melanogaster
gcactgcgaaaaat

SEQ ID NO: 625095 - DNA, 13 bp, D. melanogaster
gcactgcgaaaat

SEQ ID NO: 625096 - DNA, 13 bp, D. melanogaster
gcactgcgagaaa

SEQ ID NO: 625097 - DNA, 14 bp, D. melanogaster
gcactgcgagaaaa

SEQ ID NO: 625098 - DNA, 13 bp, D. melanogaster
gcactgcgcgaaa

SEQ ID NO: 625099 - DNA, 13 bp, D. melanogaster
gcactgctatttc

SEQ ID NO: 625100 - DNA, 13 bp, D. melanogaster
gcactgctatttt

SEQ ID NO: 625101 - DNA, 14 bp, D. melanogaster
gcactgctattttt

SEQ ID NO: 625102 - DNA, 13 bp, D. melanogaster
gcactggaaaaat

SEQ ID NO: 625103 - DNA, 13 bp, D. melanogaster
gcactggcaaaaa

SEQ ID NO: 625104 - DNA, 13 bp, D. melanogaster
gcactggcacaca

SEQ ID NO: 625105 - DNA, 14 bp, D. melanogaster
gcactggcactggc

SEQ ID NO: 625106 - DNA, 13 bp, D. melanogaster
gcactggcagtgg

SEQ ID NO: 625107 - DNA, 13 bp, D. melanogaster
gcactggccaaaa

SEQ ID NO: 625108 - DNA, 14 bp, D. melanogaster
gcactgggaaaaat

SEQ ID NO: 625109 - DNA, 13 bp, D. melanogaster
gcactgggagaaa

SEQ ID NO: 625110 - DNA, 14 bp, D. melanogaster
gcactgggagaaat

SEQ ID NO: 625111 - DNA, 13 bp, D. melanogaster
gcactgggcacgg

SEQ ID NO: 625112 - DNA, 13 bp, D. melanogaster
gcactggggaaaa

SEQ ID NO: 625113 - DNA, 13 bp, D. melanogaster
gcactgtaattta

SEQ ID NO: 625114 - DNA, 13 bp, D. melanogaster
gcactgtggggca

SEQ ID NO: 625115 - DNA, 13 bp, D. melanogaster
gcacttaaaagaa

SEQ ID NO: 625116 - DNA, 13 bp, D. melanogaster
gcacttaaatatt

SEQ ID NO: 625117 - DNA, 13 bp, D. melanogaster
gcacttaaatgca

SEQ ID NO: 625118 - DNA, 13 bp, D. melanogaster
gcacttaaattaa

SEQ ID NO: 625119 - DNA, 13 bp, D. melanogaster
gcacttaatgcaa

SEQ ID NO: 625120 - DNA, 14 bp, D. melanogaster
gcacttacacacac

SEQ ID NO: 625121 - DNA, 13 bp, D. melanogaster
gcacttacataaa

SEQ ID NO: 625122 - DNA, 13 bp, D. melanogaster
gcacttagcagct

SEQ ID NO: 625123 - DNA, 13 bp, D. melanogaster
gcacttattttta

SEQ ID NO: 625124 - DNA, 13 bp, D. melanogaster
gcacttccgtttc

SEQ ID NO: 625125 - DNA, 13 bp, D. melanogaster
gcacttgaaaaat

SEQ ID NO: 625126 - DNA, 13 bp, D. melanogaster
gcacttgaaacaa

SEQ ID NO: 625127 - DNA, 13 bp, D. melanogaster
gcacttgcaaaaa

SEQ ID NO: 625128 - DNA, 13 bp, D. melanogaster
gcacttgcaaaat

SEQ ID NO: 625129 - DNA, 13 bp, D. melanogaster
gcacttgcaactg

SEQ ID NO: 625130 - DNA, 14 bp, D. melanogaster
gcacttgcacttgc

SEQ ID NO: 625131 - DNA, 13 bp, D. melanogaster
gcacttgcagttg

SEQ ID NO: 625132 - DNA, 13 bp, D. melanogaster
gcacttgcattta

SEQ ID NO: 625133 - DNA, 13 bp, D. melanogaster
gcacttgcatttg

SEQ ID NO: 625134 - DNA, 13 bp, D. melanogaster
gcacttgctgcaa

SEQ ID NO: 625135 - DNA, 13 bp, D. melanogaster
gcacttgctgctg

SEQ ID NO: 625136 - DNA, 14 bp, D. melanogaster
gcacttggaaaaat

SEQ ID NO: 625137 - DNA, 13 bp, D. melanogaster
gcacttggcaaat

SEQ ID NO: 625138 - DNA, 13 bp, D. melanogaster
gcacttggcactt

SEQ ID NO: 625139 - DNA, 13 bp, D. melanogaster
gcacttggcagca

SEQ ID NO: 625140 - DNA, 13 bp, D. melanogaster
gcacttggcattt

SEQ ID NO: 625141 - DNA, 13 bp, D. melanogaster
gcacttggccaac

SEQ ID NO: 625142 - DNA, 13 bp, D. melanogaster
gcacttggccagc

SEQ ID NO: 625143 - DNA, 13 bp, D. melanogaster
gcacttggccatt

SEQ ID NO: 625144 - DNA, 13 bp, D. melanogaster
gcacttgttgttg

SEQ ID NO: 625145 - DNA, 13 bp, D. melanogaster
gcactttaagtgc

SEQ ID NO: 625146 - DNA, 13 bp, D. melanogaster
gcactttaattga

SEQ ID NO: 625147 - DNA, 14 bp, D. melanogaster
gcactttacacttt

SEQ ID NO: 625148 - DNA, 14 bp, D. melanogaster
gcactttatctctt

SEQ ID NO: 625149 - DNA, 13 bp, D. melanogaster
gcactttcaattt

SEQ ID NO: 625150 - DNA, 14 bp, D. melanogaster
gcactttccatggc

SEQ ID NO: 625151 - DNA, 13 bp, D. melanogaster
gcactttgaaggc

SEQ ID NO: 625152 - DNA, 13 bp, D. melanogaster
gcactttgatttg

SEQ ID NO: 625153 - DNA, 13 bp, D. melanogaster
gcactttgcataa

SEQ ID NO: 625154 - DNA, 13 bp, D. melanogaster
gcactttgcattg

SEQ ID NO: 625155 - DNA, 13 bp, D. melanogaster
gcactttgcgatg

SEQ ID NO: 625156 - DNA, 13 bp, D. melanogaster
gcactttgctggc

SEQ ID NO: 625157 - DNA, 13 bp, D. melanogaster
gcactttggcact

SEQ ID NO: 625158 - DNA, 13 bp, D. melanogaster
gcactttggcagc

SEQ ID NO: 625159 - DNA, 13 bp, D. melanogaster
gcactttggcttt

SEQ ID NO: 625160 - DNA, 13 bp, D. melanogaster
gcacttttaaaaa

SEQ ID NO: 625161 - DNA, 13 bp, D. melanogaster
gcacttttatttg

SEQ ID NO: 625162 - DNA, 14 bp, D. melanogaster
gcacttttatttgg

SEQ ID NO: 625163 - DNA, 13 bp, D. melanogaster
gcacttttcacgt

SEQ ID NO: 625164 - DNA, 13 bp, D. melanogaster
gcacttttccact

SEQ ID NO: 625165 - DNA, 13 bp, D. melanogaster
gcacttttccatt

SEQ ID NO: 625166 - DNA, 13 bp, D. melanogaster
gcacttttccggc

SEQ ID NO: 625167 - DNA, 13 bp, D. melanogaster
gcacttttgcact

SEQ ID NO: 625168 - DNA, 13 bp, D. melanogaster
gcacttttgcggc

SEQ ID NO: 625169 - DNA, 13 bp, D. melanogaster
gcacttttggcca

SEQ ID NO: 625170 - DNA, 13 bp, D. melanogaster
gcactttttcaca

SEQ ID NO: 625171 - DNA, 13 bp, D. melanogaster
gcactttttgttg

SEQ ID NO: 625172 - DNA, 13 bp, D. melanogaster
gcacttttttata

SEQ ID NO: 625173 - DNA, 13 bp, D. melanogaster
gcacttttttccc

SEQ ID NO: 625174 - DNA, 13 bp, D. melanogaster
gcacttttttcgc

SEQ ID NO: 625175 - DNA, 14 bp, D. melanogaster
gcactttttttata

SEQ ID NO: 625176 - DNA, 13 bp, D. melanogaster
gcagaaaaagtat

SEQ ID NO: 625177 - DNA, 13 bp, D. melanogaster
gcagaaaaatgaa

SEQ ID NO: 625178 - DNA, 13 bp, D. melanogaster
gcagaaaagcgaa

SEQ ID NO: 625179 - DNA, 13 bp, D. melanogaster
gcagaaaagtttt

SEQ ID NO: 625180 - DNA, 13 bp, D. melanogaster
gcagaaaatatat

SEQ ID NO: 625181 - DNA, 13 bp, D. melanogaster
gcagaaaatgcaa

SEQ ID NO: 625182 - DNA, 13 bp, D. melanogaster
gcagaaaatggca

SEQ ID NO: 625183 - DNA, 13 bp, D. melanogaster
gcagaaaattgtt

SEQ ID NO: 625184 - DNA, 13 bp, D. melanogaster
gcagaaacacgaa

SEQ ID NO: 625185 - DNA, 14 bp, D. melanogaster
gcagaaacagaaac

SEQ ID NO: 625186 - DNA, 14 bp, D. melanogaster
gcagaaacagcagc

SEQ ID NO: 625187 - DNA, 13 bp, D. melanogaster
gcagaaaccgcaa

SEQ ID NO: 625188 - DNA, 13 bp, D. melanogaster
gcagaaacgcatt

SEQ ID NO: 625189 - DNA, 14 bp, D. melanogaster
gcagaaagagacgg

SEQ ID NO: 625190 - DNA, 13 bp, D. melanogaster
gcagaaagatgga

SEQ ID NO: 625191 - DNA, 13 bp, D. melanogaster
gcagaaaggcaaa

SEQ ID NO: 625192 - DNA, 13 bp, D. melanogaster
gcagaaagttttc

SEQ ID NO: 625193 - DNA, 13 bp, D. melanogaster
gcagaaatatata

SEQ ID NO: 625194 - DNA, 13 bp, D. melanogaster
gcagaaatatgaa

SEQ ID NO: 625195 - DNA, 13 bp, D. melanogaster
gcagaaatcgcgc

SEQ ID NO: 625196 - DNA, 13 bp, D. melanogaster
gcagaaatggttc

SEQ ID NO: 625197 - DNA, 13 bp, D. melanogaster
gcagaaattaaaa

SEQ ID NO: 625198 - DNA, 13 bp, D. melanogaster
gcagaaattcaat

SEQ ID NO: 625199 - DNA, 13 bp, D. melanogaster
gcagaacagatat

SEQ ID NO: 625200 - DNA, 13 bp, D. melanogaster
gcagaaccgtttc

SEQ ID NO: 625201 - DNA, 14 bp, D. melanogaster
gcagaacttaaaaa

SEQ ID NO: 625202 - DNA, 13 bp, D. melanogaster
gcagaacttttct

SEQ ID NO: 625203 - DNA, 13 bp, D. melanogaster
gcagaagaaaagc

SEQ ID NO: 625204 - DNA, 13 bp, D. melanogaster
gcagaagaaagcg

SEQ ID NO: 625205 - DNA, 14 bp, D. melanogaster
gcagaagaaagcgt

SEQ ID NO: 625206 - DNA, 13 bp, D. melanogaster
gcagaagaagcag

SEQ ID NO: 625207 - DNA, 14 bp, D. melanogaster
gcagaagaagcagc

SEQ ID NO: 625208 - DNA, 16 bp, D. melanogaster
gcagaagaagcagctg

SEQ ID NO: 625209 - DNA, 13 bp, D. melanogaster
gcagaagagcagc

SEQ ID NO: 625210 - DNA, 13 bp, D. melanogaster
gcagaagaggaca

SEQ ID NO: 625211 - DNA, 13 bp, D. melanogaster
gcagaagcaacaa

SEQ ID NO: 625212 - DNA, 13 bp, D. melanogaster
gcagaagcagaaa

SEQ ID NO: 625213 - DNA, 13 bp, D. melanogaster
gcagaagcagaag

SEQ ID NO: 625214 - DNA, 16 bp, D. melanogaster
gcagaagcagcagcaa

SEQ ID NO: 625215 - DNA, 14 bp, D. melanogaster
gcagaagcagcggc

SEQ ID NO: 625216 - DNA, 14 bp, D. melanogaster
gcagaagcggctga

SEQ ID NO: 625217 - DNA, 13 bp, D. melanogaster
gcagaaggagcag

SEQ ID NO: 625218 - DNA, 13 bp, D. melanogaster
gcagaaggagctg

SEQ ID NO: 625219 - DNA, 13 bp, D. melanogaster
gcagaagtagcag

SEQ ID NO: 625220 - DNA, 13 bp, D. melanogaster
gcagaagtggcag

SEQ ID NO: 625221 - DNA, 13 bp, D. melanogaster
gcagaagtgtcga

SEQ ID NO: 625222 - DNA, 13 bp, D. melanogaster
gcagaatataata

SEQ ID NO: 625223 - DNA, 13 bp, D. melanogaster
gcagaatcagcca

SEQ ID NO: 625224 - DNA, 13 bp, D. melanogaster
gcagaatgcaatg

SEQ ID NO: 625225 - DNA, 13 bp, D. melanogaster
gcagaatgcagaa

SEQ ID NO: 625226 - DNA, 14 bp, D. melanogaster
gcagaatgcagaat

SEQ ID NO: 625227 - DNA, 13 bp, D. melanogaster
gcagaatgcgaaa

SEQ ID NO: 625228 - DNA, 13 bp, D. melanogaster
gcagaatgtggca

SEQ ID NO: 625229 - DNA, 14 bp, D. melanogaster
gcagaatgtggcag

SEQ ID NO: 625230 - DNA, 13 bp, D. melanogaster
gcagaattcgacg

SEQ ID NO: 625231 - DNA, 13 bp, D. melanogaster
gcagacaaaagcg

SEQ ID NO: 625232 - DNA, 14 bp, D. melanogaster
gcagacaaaagcgc

SEQ ID NO: 625233 - DNA, 13 bp, D. melanogaster
gcagacaaacact

SEQ ID NO: 625234 - DNA, 13 bp, D. melanogaster
gcagacaaacaga

SEQ ID NO: 625235 - DNA, 14 bp, D. melanogaster
gcagacaaacgaga

SEQ ID NO: 625236 - DNA, 13 bp, D. melanogaster
gcagacaaagcga

SEQ ID NO: 625237 - DNA, 13 bp, D. melanogaster
gcagacaaaggac

SEQ ID NO: 625238 - DNA, 13 bp, D. melanogaster
gcagacaaataaa

SEQ ID NO: 625239 - DNA, 13 bp, D. melanogaster
gcagacaacattt

SEQ ID NO: 625240 - DNA, 13 bp, D. melanogaster
gcagacaacttta

SEQ ID NO: 625241 - DNA, 13 bp, D. melanogaster
gcagacaatgaaa

SEQ ID NO: 625242 - DNA, 13 bp, D. melanogaster
gcagacaatgcaa

SEQ ID NO: 625243 - DNA, 13 bp, D. melanogaster
gcagacacaaaca

SEQ ID NO: 625244 - DNA, 13 bp, D. melanogaster
gcagacaccgctg

SEQ ID NO: 625245 - DNA, 13 bp, D. melanogaster
gcagacagacgga

SEQ ID NO: 625246 - DNA, 13 bp, D. melanogaster
gcagacagagaga

SEQ ID NO: 625247 - DNA, 13 bp, D. melanogaster
gcagacaggaaaa

SEQ ID NO: 625248 - DNA, 13 bp, D. melanogaster
gcagacataaaaa

SEQ ID NO: 625249 - DNA, 14 bp, D. melanogaster
gcagacatcgagcg

SEQ ID NO: 625250 - DNA, 13 bp, D. melanogaster
gcagacattttta

SEQ ID NO: 625251 - DNA, 13 bp, D. melanogaster
gcagacccaaaag

SEQ ID NO: 625252 - DNA, 13 bp, D. melanogaster
gcagacgacgacg

SEQ ID NO: 625253 - DNA, 13 bp, D. melanogaster
gcagacggacgga

SEQ ID NO: 625254 - DNA, 13 bp, D. melanogaster
gcagacgttcgaa

SEQ ID NO: 625255 - DNA, 13 bp, D. melanogaster
gcagactgatttt

SEQ ID NO: 625256 - DNA, 14 bp, D. melanogaster
gcagactgattttt

SEQ ID NO: 625257 - DNA, 13 bp, D. melanogaster
gcagagcaaacaa

SEQ ID NO: 625258 - DNA, 13 bp, D. melanogaster
gcagagcaaattg

SEQ ID NO: 625259 - DNA, 13 bp, D. melanogaster
gcagagcaacaac

SEQ ID NO: 625260 - DNA, 13 bp, D. melanogaster
gcagagcagaaaa

SEQ ID NO: 625261 - DNA, 13 bp, D. melanogaster
gcagagcagaaga

SEQ ID NO: 625262 - DNA, 13 bp, D. melanogaster
gcagagcagagca

SEQ ID NO: 625263 - DNA, 13 bp, D. melanogaster
gcagagcagagcc

SEQ ID NO: 625264 - DNA, 13 bp, D. melanogaster
gcagagcagcaaa

SEQ ID NO: 625265 - DNA, 13 bp, D. melanogaster
gcagagcagcagc

SEQ ID NO: 625266 - DNA, 13 bp, D. melanogaster
gcagagcagccaa

SEQ ID NO: 625267 - DNA, 13 bp, D. melanogaster
gcagagcgagagg

SEQ ID NO: 625268 - DNA, 13 bp, D. melanogaster
gcagagcggcaaa

SEQ ID NO: 625269 - DNA, 13 bp, D. melanogaster
gcagagcgtgttg

SEQ ID NO: 625270 - DNA, 13 bp, D. melanogaster
gcagaggaaaaac

SEQ ID NO: 625271 - DNA, 13 bp, D. melanogaster
gcagaggaaaagc

SEQ ID NO: 625272 - DNA, 13 bp, D. melanogaster
gcagaggaaattt

SEQ ID NO: 625273 - DNA, 13 bp, D. melanogaster
gcagaggagcaga

SEQ ID NO: 625274 - DNA, 13 bp, D. melanogaster
gcagaggcagcag

SEQ ID NO: 625275 - DNA, 14 bp, D. melanogaster
gcagaggcagcagc

SEQ ID NO: 625276 - DNA, 14 bp, D. melanogaster
gcagaggcagcgac

SEQ ID NO: 625277 - DNA, 13 bp, D. melanogaster
gcagagtatggac

SEQ ID NO: 625278 - DNA, 14 bp, D. melanogaster
gcagagtgccaaca

SEQ ID NO: 625279 - DNA, 13 bp, D. melanogaster
gcagagtggcgag

SEQ ID NO: 625280 - DNA, 14 bp, D. melanogaster
gcagagttttcatt

SEQ ID NO: 625281 - DNA, 13 bp, D. melanogaster
gcagataaagata

SEQ ID NO: 625282 - DNA, 13 bp, D. melanogaster
gcagataaagcgc

SEQ ID NO: 625283 - DNA, 13 bp, D. melanogaster
gcagataaataaa

SEQ ID NO: 625284 - DNA, 13 bp, D. melanogaster
gcagatacacaga

SEQ ID NO: 625285 - DNA, 13 bp, D. melanogaster
gcagatacagata

SEQ ID NO: 625286 - DNA, 14 bp, D. melanogaster
gcagatacagatac

SEQ ID NO: 625287 - DNA, 13 bp, D. melanogaster
gcagatacagatg

SEQ ID NO: 625288 - DNA, 14 bp, D. melanogaster
gcagatagcagata

SEQ ID NO: 625289 - DNA, 14 bp, D. melanogaster
gcagatatatatat

SEQ ID NO: 625290 - DNA, 13 bp, D. melanogaster
gcagatatatatt

SEQ ID NO: 625291 - DNA, 13 bp, D. melanogaster
gcagatatctcta

SEQ ID NO: 625292 - DNA, 14 bp, D. melanogaster
gcagatccagatgc

SEQ ID NO: 625293 - DNA, 13 bp, D. melanogaster
gcagatccctttg

SEQ ID NO: 625294 - DNA, 13 bp, D. melanogaster
gcagatcgtgtgc

SEQ ID NO: 625295 - DNA, 13 bp, D. melanogaster
gcagatgaagatg

SEQ ID NO: 625296 - DNA, 13 bp, D. melanogaster
gcagatgatgatg

SEQ ID NO: 625297 - DNA, 14 bp, D. melanogaster
gcagatgatgatga

SEQ ID NO: 625298 - DNA, 14 bp, D. melanogaster
gcagatgctgctgc

SEQ ID NO: 625299 - DNA, 13 bp, D. melanogaster
gcagatggaaaag

SEQ ID NO: 625300 - DNA, 13 bp, D. melanogaster
gcagatggaaaat

SEQ ID NO: 625301 - DNA, 14 bp, D. melanogaster
gcagatggagatgg

SEQ ID NO: 625302 - DNA, 13 bp, D. melanogaster
gcagatggcatac

SEQ ID NO: 625303 - DNA, 14 bp, D. melanogaster
gcagatgtgcccga

SEQ ID NO: 625304 - DNA, 14 bp, D. melanogaster
gcagattcagattc

SEQ ID NO: 625305 - DNA, 13 bp, D. melanogaster
gcagattgcagat

SEQ ID NO: 625306 - DNA, 13 bp, D. melanogaster
gcagattgtattt

SEQ ID NO: 625307 - DNA, 13 bp, D. melanogaster
gcagatttagcat

SEQ ID NO: 625308 - DNA, 13 bp, D. melanogaster
gcagatttatcat

SEQ ID NO: 625309 - DNA, 13 bp, D. melanogaster
gcagatttatggc

SEQ ID NO: 625310 - DNA, 13 bp, D. melanogaster
gcagcaaaaaagg

SEQ ID NO: 625311 - DNA, 13 bp, D. melanogaster
gcagcaaaaaata

SEQ ID NO: 625312 - DNA, 13 bp, D. melanogaster
gcagcaaaaacat

SEQ ID NO: 625313 - DNA, 13 bp, D. melanogaster
gcagcaaaaactt

SEQ ID NO: 625314 - DNA, 13 bp, D. melanogaster
gcagcaaaaagca

SEQ ID NO: 625315 - DNA, 13 bp, D. melanogaster
gcagcaaaaatat

SEQ ID NO: 625316 - DNA, 13 bp, D. melanogaster
gcagcaaaaattg

SEQ ID NO: 625317 - DNA, 13 bp, D. melanogaster
gcagcaaaacttt

SEQ ID NO: 625318 - DNA, 14 bp, D. melanogaster
gcagcaaaagcaac

SEQ ID NO: 625319 - DNA, 13 bp, D. melanogaster
gcagcaaaagcgg

SEQ ID NO: 625320 - DNA, 13 bp, D. melanogaster
gcagcaaaagttt

SEQ ID NO: 625321 - DNA, 13 bp, D. melanogaster
gcagcaaaatgtt

SEQ ID NO: 625322 - DNA, 13 bp, D. melanogaster
gcagcaaacaaac

SEQ ID NO: 625323 - DNA, 13 bp, D. melanogaster
gcagcaaacaaag

SEQ ID NO: 625324 - DNA, 13 bp, D. melanogaster
gcagcaaacaatt

SEQ ID NO: 625325 - DNA, 13 bp, D. melanogaster
gcagcaaacacaa

SEQ ID NO: 625326 - DNA, 13 bp, D. melanogaster
gcagcaaacagca

SEQ ID NO: 625327 - DNA, 13 bp, D. melanogaster
gcagcaaaccaaa

SEQ ID NO: 625328 - DNA, 13 bp, D. melanogaster
gcagcaaacccaa

SEQ ID NO: 625329 - DNA, 13 bp, D. melanogaster
gcagcaaacgaaa

SEQ ID NO: 625330 - DNA, 13 bp, D. melanogaster
gcagcaaacgtat

SEQ ID NO: 625331 - DNA, 13 bp, D. melanogaster
gcagcaaacgtcg

SEQ ID NO: 625332 - DNA, 13 bp, D. melanogaster
gcagcaaagcaaa

SEQ ID NO: 625333 - DNA, 13 bp, D. melanogaster
gcagcaaagcagc

SEQ ID NO: 625334 - DNA, 13 bp, D. melanogaster
gcagcaaaggcga

SEQ ID NO: 625335 - DNA, 13 bp, D. melanogaster
gcagcaaagtgaa

SEQ ID NO: 625336 - DNA, 13 bp, D. melanogaster
gcagcaaagtgca

SEQ ID NO: 625337 - DNA, 13 bp, D. melanogaster
gcagcaaagtttt

SEQ ID NO: 625338 - DNA, 13 bp, D. melanogaster
gcagcaaataaaa

SEQ ID NO: 625339 - DNA, 14 bp, D. melanogaster
gcagcaaataaaat

SEQ ID NO: 625340 - DNA, 13 bp, D. melanogaster
gcagcaaatcaaa

SEQ ID NO: 625341 - DNA, 13 bp, D. melanogaster
gcagcaaatccgc

SEQ ID NO: 625342 - DNA, 13 bp, D. melanogaster
gcagcaaatgaaa

SEQ ID NO: 625343 - DNA, 13 bp, D. melanogaster
gcagcaaatgcaa

SEQ ID NO: 625344 - DNA, 13 bp, D. melanogaster
gcagcaaatggaa

SEQ ID NO: 625345 - DNA, 13 bp, D. melanogaster
gcagcaaattaat

SEQ ID NO: 625346 - DNA, 14 bp, D. melanogaster
gcagcaaattgaaa

SEQ ID NO: 625347 - DNA, 13 bp, D. melanogaster
gcagcaaattgca

SEQ ID NO: 625348 - DNA, 13 bp, D. melanogaster
gcagcaaattgtg

SEQ ID NO: 625349 - DNA, 13 bp, D. melanogaster
gcagcaacaaaag

SEQ ID NO: 625350 - DNA, 14 bp, D. melanogaster
gcagcaacaaaagg

SEQ ID NO: 625351 - DNA, 13 bp, D. melanogaster
gcagcaacaaaca

SEQ ID NO: 625352 - DNA, 13 bp, D. melanogaster
gcagcaacaaagg

SEQ ID NO: 625353 - DNA, 13 bp, D. melanogaster
gcagcaacaaagt

SEQ ID NO: 625354 - DNA, 13 bp, D. melanogaster
gcagcaacaaatg

SEQ ID NO: 625355 - DNA, 14 bp, D. melanogaster
gcagcaacaaattg

SEQ ID NO: 625356 - DNA, 15 bp, D. melanogaster
gcagcaacaacaacg

SEQ ID NO: 625357 - DNA, 14 bp, D. melanogaster
gcagcaacaacaag

SEQ ID NO: 625358 - DNA, 15 bp, D. melanogaster
gcagcaacaacaagc

SEQ ID NO: 625359 - DNA, 14 bp, D. melanogaster
gcagcaacaacaat

SEQ ID NO: 625360 - DNA, 14 bp, D. melanogaster
gcagcaacaaccac

SEQ ID NO: 625361 - DNA, 13 bp, D. melanogaster
gcagcaacaacgc

SEQ ID NO: 625362 - DNA, 13 bp, D. melanogaster
gcagcaacaagag

SEQ ID NO: 625363 - DNA, 13 bp, D. melanogaster
gcagcaacaataa

SEQ ID NO: 625364 - DNA, 14 bp, D. melanogaster
gcagcaacaataaa

SEQ ID NO: 625365 - DNA, 13 bp, D. melanogaster
gcagcaacaccaa

SEQ ID NO: 625366 - DNA, 14 bp, D. melanogaster
gcagcaacagcaaa

SEQ ID NO: 625367 - DNA, 15 bp, D. melanogaster
gcagcaacagcaact

SEQ ID NO: 625368 - DNA, 14 bp, D. melanogaster
gcagcaacagcaag

SEQ ID NO: 625369 - DNA, 13 bp, D. melanogaster
gcagcaacagcac

SEQ ID NO: 625370 - DNA, 22 bp, D. melanogaster
gcagcaacagcagcagcaacaa

SEQ ID NO: 625371 - DNA, 14 bp, D. melanogaster
gcagcaacagcagt

SEQ ID NO: 625372 - DNA, 13 bp, D. melanogaster
gcagcaacatcac

SEQ ID NO: 625373 - DNA, 13 bp, D. melanogaster
gcagcaacatcga

SEQ ID NO: 625374 - DNA, 13 bp, D. melanogaster
gcagcaacatctg

SEQ ID NO: 625375 - DNA, 14 bp, D. melanogaster
gcagcaacatctgc

SEQ ID NO: 625376 - DNA, 13 bp, D. melanogaster
gcagcaacatgat

SEQ ID NO: 625377 - DNA, 14 bp, D. melanogaster
gcagcaacatgatt

SEQ ID NO: 625378 - DNA, 13 bp, D. melanogaster
gcagcaaccacaa

SEQ ID NO: 625379 - DNA, 13 bp, D. melanogaster
gcagcaactacaa

SEQ ID NO: 625380 - DNA, 13 bp, D. melanogaster
gcagcaactgaaa

SEQ ID NO: 625381 - DNA, 15 bp, D. melanogaster
gcagcaactgcaaca

SEQ ID NO: 625382 - DNA, 14 bp, D. melanogaster
gcagcaactgcagc

SEQ ID NO: 625383 - DNA, 17 bp, D. melanogaster
gcagcaactgcagcagc

SEQ ID NO: 625384 - DNA, 13 bp, D. melanogaster
gcagcaactgttg

SEQ ID NO: 625385 - DNA, 13 bp, D. melanogaster
gcagcaacttgtt

SEQ ID NO: 625386 - DNA, 13 bp, D. melanogaster
gcagcaagcagca

SEQ ID NO: 625387 - DNA, 13 bp, D. melanogaster
gcagcaagctgag

SEQ ID NO: 625388 - DNA, 13 bp, D. melanogaster
gcagcaaggacaa

SEQ ID NO: 625389 - DNA, 13 bp, D. melanogaster
gcagcaaggacga

SEQ ID NO: 625390 - DNA, 13 bp, D. melanogaster
gcagcaagtgcaa

SEQ ID NO: 625391 - DNA, 13 bp, D. melanogaster
gcagcaagtggaa

SEQ ID NO: 625392 - DNA, 13 bp, D. melanogaster
gcagcaagtggca

SEQ ID NO: 625393 - DNA, 13 bp, D. melanogaster
gcagcaataataa

SEQ ID NO: 625394 - DNA, 13 bp, D. melanogaster
gcagcaatgccgt

SEQ ID NO: 625395 - DNA, 13 bp, D. melanogaster
gcagcaatgttgc

SEQ ID NO: 625396 - DNA, 13 bp, D. melanogaster
gcagcaattaatt

SEQ ID NO: 625397 - DNA, 13 bp, D. melanogaster
gcagcaattcgct

SEQ ID NO: 625398 - DNA, 13 bp, D. melanogaster
gcagcaattgcaa

SEQ ID NO: 625399 - DNA, 14 bp, D. melanogaster
gcagcaattgcagc

SEQ ID NO: 625400 - DNA, 13 bp, D. melanogaster
gcagcaatttgca

SEQ ID NO: 625401 - DNA, 13 bp, D. melanogaster
gcagcacaaaaag

SEQ ID NO: 625402 - DNA, 13 bp, D. melanogaster
gcagcacaaatat

SEQ ID NO: 625403 - DNA, 13 bp, D. melanogaster
gcagcacaaattg

SEQ ID NO: 625404 - DNA, 13 bp, D. melanogaster
gcagcacaacaac

SEQ ID NO: 625405 - DNA, 13 bp, D. melanogaster
gcagcacattcaa

SEQ ID NO: 625406 - DNA, 13 bp, D. melanogaster
gcagcacttgaaa

SEQ ID NO: 625407 - DNA, 13 bp, D. melanogaster
gcagcagaaaaca

SEQ ID NO: 625408 - DNA, 13 bp, D. melanogaster
gcagcagaaaact

SEQ ID NO: 625409 - DNA, 13 bp, D. melanogaster
gcagcagaaaagc

SEQ ID NO: 625410 - DNA, 13 bp, D. melanogaster
gcagcagaaagca

SEQ ID NO: 625411 - DNA, 13 bp, D. melanogaster
gcagcagaacaaa

SEQ ID NO: 625412 - DNA, 13 bp, D. melanogaster
gcagcagaagcaa

SEQ ID NO: 625413 - DNA, 14 bp, D. melanogaster
gcagcagaagcaga

SEQ ID NO: 625414 - DNA, 18 bp, D. melanogaster
gcagcagaagcagcaaca

SEQ ID NO: 625415 - DNA, 15 bp, D. melanogaster
gcagcagaagcagcg

SEQ ID NO: 625416 - DNA, 13 bp, D. melanogaster
gcagcagaagctg

SEQ ID NO: 625417 - DNA, 13 bp, D. melanogaster
gcagcagaaggaa

SEQ ID NO: 625418 - DNA, 13 bp, D. melanogaster
gcagcagagaagc

SEQ ID NO: 625419 - DNA, 14 bp, D. melanogaster
gcagcagcaaaaaa

SEQ ID NO: 625420 - DNA, 13 bp, D. melanogaster
gcagcagcaaata

SEQ ID NO: 625421 - DNA, 14 bp, D. melanogaster
gcagcagcaacaca

SEQ ID NO: 625422 - DNA, 14 bp, D. melanogaster
gcagcagcaacagt

SEQ ID NO: 625423 - DNA, 15 bp, D. melanogaster
gcagcagcaacatcg

SEQ ID NO: 625424 - DNA, 14 bp, D. melanogaster
gcagcagcaacatg

SEQ ID NO: 625425 - DNA, 13 bp, D. melanogaster
gcagcagcaacgt

SEQ ID NO: 625426 - DNA, 13 bp, D. melanogaster
gcagcagcaactc

SEQ ID NO: 625427 - DNA, 13 bp, D. melanogaster
gcagcagcaactg

SEQ ID NO: 625428 - DNA, 13 bp, D. melanogaster
gcagcagcaatat

SEQ ID NO: 625429 - DNA, 13 bp, D. melanogaster
gcagcagcaatca

SEQ ID NO: 625430 - DNA, 13 bp, D. melanogaster
gcagcagcacctg

SEQ ID NO: 625431 - DNA, 13 bp, D. melanogaster
gcagcagcagaaa

SEQ ID NO: 625432 - DNA, 14 bp, D. melanogaster
gcagcagcagaaaa

SEQ ID NO: 625433 - DNA, 14 bp, D. melanogaster
gcagcagcagaaga

SEQ ID NO: 625434 - DNA, 13 bp, D. melanogaster
gcagcagcagagg

SEQ ID NO: 625435 - DNA, 16 bp, D. melanogaster
gcagcagcagcaccag

SEQ ID NO: 625436 - DNA, 14 bp, D. melanogaster
gcagcagcagccaa

SEQ ID NO: 625437 - DNA, 14 bp, D. melanogaster
gcagcagcagccac

SEQ ID NO: 625438 - DNA, 13 bp, D. melanogaster
gcagcagcagccc

SEQ ID NO: 625439 - DNA, 14 bp, D. melanogaster
gcagcagcagcgac

SEQ ID NO: 625440 - DNA, 13 bp, D. melanogaster
gcagcagcagcgc

SEQ ID NO: 625441 - DNA, 13 bp, D. melanogaster
gcagcagcagcgt

SEQ ID NO: 625442 - DNA, 13 bp, D. melanogaster
gcagcagcagcta

SEQ ID NO: 625443 - DNA, 13 bp, D. melanogaster
gcagcagcagctg

SEQ ID NO: 625444 - DNA, 13 bp, D. melanogaster
gcagcagcagctt

SEQ ID NO: 625445 - DNA, 13 bp, D. melanogaster
gcagcagcaggat

SEQ ID NO: 625446 - DNA, 13 bp, D. melanogaster
gcagcagcaggcg

SEQ ID NO: 625447 - DNA, 13 bp, D. melanogaster
gcagcagcagtcg

SEQ ID NO: 625448 - DNA, 13 bp, D. melanogaster
gcagcagcagtgg

SEQ ID NO: 625449 - DNA, 13 bp, D. melanogaster
gcagcagcagttg

SEQ ID NO: 625450 - DNA, 13 bp, D. melanogaster
gcagcagcatccg

SEQ ID NO: 625451 - DNA, 13 bp, D. melanogaster
gcagcagcatcga

SEQ ID NO: 625452 - DNA, 13 bp, D. melanogaster
gcagcagcattaa

SEQ ID NO: 625453 - DNA, 13 bp, D. melanogaster
gcagcagcattga

SEQ ID NO: 625454 - DNA, 13 bp, D. melanogaster
gcagcagcatttt

SEQ ID NO: 625455 - DNA, 13 bp, D. melanogaster
gcagcagccaaag

SEQ ID NO: 625456 - DNA, 13 bp, D. melanogaster
gcagcagccacaa

SEQ ID NO: 625457 - DNA, 14 bp, D. melanogaster
gcagcagccacaaa

SEQ ID NO: 625458 - DNA, 13 bp, D. melanogaster
gcagcagccacca

SEQ ID NO: 625459 - DNA, 13 bp, D. melanogaster
gcagcagccactt

SEQ ID NO: 625460 - DNA, 13 bp, D. melanogaster
gcagcagccgaag

SEQ ID NO: 625461 - DNA, 13 bp, D. melanogaster
gcagcagccgcaa

SEQ ID NO: 625462 - DNA, 13 bp, D. melanogaster
gcagcagcgacag

SEQ ID NO: 625463 - DNA, 14 bp, D. melanogaster
gcagcagcgcagca

SEQ ID NO: 625464 - DNA, 13 bp, D. melanogaster
gcagcagcgctgc

SEQ ID NO: 625465 - DNA, 13 bp, D. melanogaster
gcagcagcggaaa

SEQ ID NO: 625466 - DNA, 13 bp, D. melanogaster
gcagcagcggcaa

SEQ ID NO: 625467 - DNA, 13 bp, D. melanogaster
gcagcagctctta

SEQ ID NO: 625468 - DNA, 13 bp, D. melanogaster
gcagcagctgaaa

SEQ ID NO: 625469 - DNA, 14 bp, D. melanogaster
gcagcagctgaaaa

SEQ ID NO: 625470 - DNA, 13 bp, D. melanogaster
gcagcagctgcaa

SEQ ID NO: 625471 - DNA, 14 bp, D. melanogaster
gcagcagctgcaac

SEQ ID NO: 625472 - DNA, 13 bp, D. melanogaster
gcagcagctgctg

SEQ ID NO: 625473 - DNA, 13 bp, D. melanogaster
gcagcagctggca

SEQ ID NO: 625474 - DNA, 13 bp, D. melanogaster
gcagcagctgtca

SEQ ID NO: 625475 - DNA, 13 bp, D. melanogaster
gcagcagctgttc

SEQ ID NO: 625476 - DNA, 13 bp, D. melanogaster
gcagcagcttaaa

SEQ ID NO: 625477 - DNA, 13 bp, D. melanogaster
gcagcaggaaaaa

SEQ ID NO: 625478 - DNA, 14 bp, D. melanogaster
gcagcaggaaaaag

SEQ ID NO: 625479 - DNA, 13 bp, D. melanogaster
gcagcaggaaaat

SEQ ID NO: 625480 - DNA, 13 bp, D. melanogaster
gcagcaggaaaca

SEQ ID NO: 625481 - DNA, 13 bp, D. melanogaster
gcagcaggaagca

SEQ ID NO: 625482 - DNA, 13 bp, D. melanogaster
gcagcaggacatc

SEQ ID NO: 625483 - DNA, 13 bp, D. melanogaster
gcagcaggacatt

SEQ ID NO: 625484 - DNA, 13 bp, D. melanogaster
gcagcaggagcaa

SEQ ID NO: 625485 - DNA, 14 bp, D. melanogaster
gcagcaggagcaac

SEQ ID NO: 625486 - DNA, 14 bp, D. melanogaster
gcagcaggagcaga

SEQ ID NO: 625487 - DNA, 14 bp, D. melanogaster
gcagcaggagcagc

SEQ ID NO: 625488 - DNA, 13 bp, D. melanogaster
gcagcaggagcat

SEQ ID NO: 625489 - DNA, 14 bp, D. melanogaster
gcagcaggaggagc

SEQ ID NO: 625490 - DNA, 13 bp, D. melanogaster
gcagcaggatgtg

SEQ ID NO: 625491 - DNA, 13 bp, D. melanogaster
gcagcaggcaaaa

SEQ ID NO: 625492 - DNA, 13 bp, D. melanogaster
gcagcaggcaaca

SEQ ID NO: 625493 - DNA, 13 bp, D. melanogaster
gcagcaggcagca

SEQ ID NO: 625494 - DNA, 14 bp, D. melanogaster
gcagcaggcagcag

SEQ ID NO: 625495 - DNA, 13 bp, D. melanogaster
gcagcaggcagcg

SEQ ID NO: 625496 - DNA, 13 bp, D. melanogaster
gcagcaggcggag

SEQ ID NO: 625497 - DNA, 13 bp, D. melanogaster
gcagcaggcgtcg

SEQ ID NO: 625498 - DNA, 13 bp, D. melanogaster
gcagcagggaaaa

SEQ ID NO: 625499 - DNA, 13 bp, D. melanogaster
gcagcagtagaag

SEQ ID NO: 625500 - DNA, 15 bp, D. melanogaster
gcagcagtagcagca

SEQ ID NO: 625501 - DNA, 13 bp, D. melanogaster
gcagcagtctgta

SEQ ID NO: 625502 - DNA, 13 bp, D. melanogaster
gcagcagtggaaa

SEQ ID NO: 625503 - DNA, 13 bp, D. melanogaster
gcagcagtggagt

SEQ ID NO: 625504 - DNA, 13 bp, D. melanogaster
gcagcagtggcaa

SEQ ID NO: 625505 - DNA, 13 bp, D. melanogaster
gcagcagtggcag

SEQ ID NO: 625506 - DNA, 13 bp, D. melanogaster
gcagcagttcatc

SEQ ID NO: 625507 - DNA, 13 bp, D. melanogaster
gcagcagttgcaa

SEQ ID NO: 625508 - DNA, 13 bp, D. melanogaster
gcagcagttggca

SEQ ID NO: 625509 - DNA, 14 bp, D. melanogaster
gcagcagttgttgc

SEQ ID NO: 625510 - DNA, 14 bp, D. melanogaster
gcagcagtttacct

SEQ ID NO: 625511 - DNA, 13 bp, D. melanogaster
gcagcagttttcc

SEQ ID NO: 625512 - DNA, 13 bp, D. melanogaster
gcagcataaaaat

SEQ ID NO: 625513 - DNA, 13 bp, D. melanogaster
gcagcataaatta

SEQ ID NO: 625514 - DNA, 13 bp, D. melanogaster
gcagcataattaa

SEQ ID NO: 625515 - DNA, 13 bp, D. melanogaster
gcagcatcaaaaa

SEQ ID NO: 625516 - DNA, 13 bp, D. melanogaster
gcagcatcagcaa

SEQ ID NO: 625517 - DNA, 13 bp, D. melanogaster
gcagcatcagcat

SEQ ID NO: 625518 - DNA, 14 bp, D. melanogaster
gcagcatcagcatc

SEQ ID NO: 625519 - DNA, 13 bp, D. melanogaster
gcagcatcatcag

SEQ ID NO: 625520 - DNA, 14 bp, D. melanogaster
gcagcatctggaga

SEQ ID NO: 625521 - DNA, 13 bp, D. melanogaster
gcagcatgcaaca

SEQ ID NO: 625522 - DNA, 14 bp, D. melanogaster
gcagcatgcaacat

SEQ ID NO: 625523 - DNA, 13 bp, D. melanogaster
gcagcatgcagca

SEQ ID NO: 625524 - DNA, 13 bp, D. melanogaster
gcagcatgttgca

SEQ ID NO: 625525 - DNA, 13 bp, D. melanogaster
gcagcatgttgct

SEQ ID NO: 625526 - DNA, 14 bp, D. melanogaster
gcagcattcgttta

SEQ ID NO: 625527 - DNA, 14 bp, D. melanogaster
gcagcattgccagc

SEQ ID NO: 625528 - DNA, 13 bp, D. melanogaster
gcagcatttaaat

SEQ ID NO: 625529 - DNA, 13 bp, D. melanogaster
gcagcatttcaat

SEQ ID NO: 625530 - DNA, 13 bp, D. melanogaster
gcagcattttaaa

SEQ ID NO: 625531 - DNA, 13 bp, D. melanogaster
gcagcattttatt

SEQ ID NO: 625532 - DNA, 13 bp, D. melanogaster
gcagcattttcaa

SEQ ID NO: 625533 - DNA, 13 bp, D. melanogaster
gcagccaaaaaac

SEQ ID NO: 625534 - DNA, 13 bp, D. melanogaster
gcagccaaaaaca

SEQ ID NO: 625535 - DNA, 13 bp, D. melanogaster
gcagccaaaaagg

SEQ ID NO: 625536 - DNA, 13 bp, D. melanogaster
gcagccaaaaagt

SEQ ID NO: 625537 - DNA, 13 bp, D. melanogaster
gcagccaaaaatt

SEQ ID NO: 625538 - DNA, 13 bp, D. melanogaster
gcagccaaaacaa

SEQ ID NO: 625539 - DNA, 13 bp, D. melanogaster
gcagccaaaagaa

SEQ ID NO: 625540 - DNA, 13 bp, D. melanogaster
gcagccaaaagtt

SEQ ID NO: 625541 - DNA, 13 bp, D. melanogaster
gcagccaaaataa

SEQ ID NO: 625542 - DNA, 13 bp, D. melanogaster
gcagccaaacgaa

SEQ ID NO: 625543 - DNA, 13 bp, D. melanogaster
gcagccaaagaaa

SEQ ID NO: 625544 - DNA, 13 bp, D. melanogaster
gcagccaaagcag

SEQ ID NO: 625545 - DNA, 13 bp, D. melanogaster
gcagccaaataaa

SEQ ID NO: 625546 - DNA, 13 bp, D. melanogaster
gcagccaaatgca

SEQ ID NO: 625547 - DNA, 13 bp, D. melanogaster
gcagccaaatggc

SEQ ID NO: 625548 - DNA, 13 bp, D. melanogaster
gcagccaagaaaa

SEQ ID NO: 625549 - DNA, 13 bp, D. melanogaster
gcagccaagcaaa

SEQ ID NO: 625550 - DNA, 13 bp, D. melanogaster
gcagccaagcagc

SEQ ID NO: 625551 - DNA, 13 bp, D. melanogaster
gcagccaagcgac

SEQ ID NO: 625552 - DNA, 13 bp, D. melanogaster
gcagccaagtttt

SEQ ID NO: 625553 - DNA, 13 bp, D. melanogaster
gcagccaattgca

SEQ ID NO: 625554 - DNA, 13 bp, D. melanogaster
gcagccaatttaa

SEQ ID NO: 625555 - DNA, 13 bp, D. melanogaster
gcagccacaaaaa

SEQ ID NO: 625556 - DNA, 13 bp, D. melanogaster
gcagccacaacaa

SEQ ID NO: 625557 - DNA, 13 bp, D. melanogaster
gcagccacacaaa

SEQ ID NO: 625558 - DNA, 13 bp, D. melanogaster
gcagccacacaca

SEQ ID NO: 625559 - DNA, 13 bp, D. melanogaster
gcagccacagaaa

SEQ ID NO: 625560 - DNA, 13 bp, D. melanogaster
gcagccacagcaa

SEQ ID NO: 625561 - DNA, 14 bp, D. melanogaster
gcagccacgcccac

SEQ ID NO: 625562 - DNA, 13 bp, D. melanogaster
gcagccactttgc

SEQ ID NO: 625563 - DNA, 13 bp, D. melanogaster
gcagccagacaaa

SEQ ID NO: 625564 - DNA, 13 bp, D. melanogaster
gcagccagcaaat

SEQ ID NO: 625565 - DNA, 13 bp, D. melanogaster
gcagccagccaaa

SEQ ID NO: 625566 - DNA, 13 bp, D. melanogaster
gcagccagccaag

SEQ ID NO: 625567 - DNA, 13 bp, D. melanogaster
gcagccagcgaaa

SEQ ID NO: 625568 - DNA, 13 bp, D. melanogaster
gcagccagcgagc

SEQ ID NO: 625569 - DNA, 13 bp, D. melanogaster
gcagccaggaaaa

SEQ ID NO: 625570 - DNA, 13 bp, D. melanogaster
gcagccaggacac

SEQ ID NO: 625571 - DNA, 13 bp, D. melanogaster
gcagccaggactc

SEQ ID NO: 625572 - DNA, 13 bp, D. melanogaster
gcagccaggcagc

SEQ ID NO: 625573 - DNA, 13 bp, D. melanogaster
gcagccagtgaaa

SEQ ID NO: 625574 - DNA, 13 bp, D. melanogaster
gcagccataagat

SEQ ID NO: 625575 - DNA, 14 bp, D. melanogaster
gcagccatcaatca

SEQ ID NO: 625576 - DNA, 14 bp, D. melanogaster
gcagccatcatcat

SEQ ID NO: 625577 - DNA, 13 bp, D. melanogaster
gcagccattttca

SEQ ID NO: 625578 - DNA, 13 bp, D. melanogaster
gcagccattttgg

SEQ ID NO: 625579 - DNA, 13 bp, D. melanogaster
gcagcccgaagaa

SEQ ID NO: 625580 - DNA, 13 bp, D. melanogaster
gcagcccgtttgc

SEQ ID NO: 625581 - DNA, 13 bp, D. melanogaster
gcagccgaaaaaa

SEQ ID NO: 625582 - DNA, 14 bp, D. melanogaster
gcagccgaaaaaaa

SEQ ID NO: 625583 - DNA, 13 bp, D. melanogaster
gcagccgaaaaat

SEQ ID NO: 625584 - DNA, 13 bp, D. melanogaster
gcagccgaaaatg

SEQ ID NO: 625585 - DNA, 13 bp, D. melanogaster
gcagccgagcagc

SEQ ID NO: 625586 - DNA, 13 bp, D. melanogaster
gcagccgcaaaaa

SEQ ID NO: 625587 - DNA, 13 bp, D. melanogaster
gcagccgcaaaac

SEQ ID NO: 625588 - DNA, 13 bp, D. melanogaster
gcagccgcaaatt

SEQ ID NO: 625589 - DNA, 13 bp, D. melanogaster
gcagccgcagaaa

SEQ ID NO: 625590 - DNA, 13 bp, D. melanogaster
gcagccgcagaag

SEQ ID NO: 625591 - DNA, 14 bp, D. melanogaster
gcagccgcagcaac

SEQ ID NO: 625592 - DNA, 13 bp, D. melanogaster
gcagccgcagtcg

SEQ ID NO: 625593 - DNA, 13 bp, D. melanogaster
gcagccgcattcg

SEQ ID NO: 625594 - DNA, 14 bp, D. melanogaster
gcagccgcattcgc

SEQ ID NO: 625595 - DNA, 13 bp, D. melanogaster
gcagccgccgcag

SEQ ID NO: 625596 - DNA, 13 bp, D. melanogaster
gcagccgcttttg

SEQ ID NO: 625597 - DNA, 13 bp, D. melanogaster
gcagccggaaaag

SEQ ID NO: 625598 - DNA, 13 bp, D. melanogaster
gcagccggaaaat

SEQ ID NO: 625599 - DNA, 13 bp, D. melanogaster
gcagccggcgaaa

SEQ ID NO: 625600 - DNA, 14 bp, D. melanogaster
gcagccggctttga

SEQ ID NO: 625601 - DNA, 13 bp, D. melanogaster
gcagcctcatcaa

SEQ ID NO: 625602 - DNA, 13 bp, D. melanogaster
gcagcctggccaa

SEQ ID NO: 625603 - DNA, 13 bp, D. melanogaster
gcagcctgtttag

SEQ ID NO: 625604 - DNA, 13 bp, D. melanogaster
gcagcgaaaaatg

SEQ ID NO: 625605 - DNA, 13 bp, D. melanogaster
gcagcgaaaacaa

SEQ ID NO: 625606 - DNA, 14 bp, D. melanogaster
gcagcgaaaacaaa

SEQ ID NO: 625607 - DNA, 13 bp, D. melanogaster
gcagcgaaaataa

SEQ ID NO: 625608 - DNA, 13 bp, D. melanogaster
gcagcgaaagaaa

SEQ ID NO: 625609 - DNA, 13 bp, D. melanogaster
gcagcgaaagaga

SEQ ID NO: 625610 - DNA, 13 bp, D. melanogaster
gcagcgaaagttt

SEQ ID NO: 625611 - DNA, 13 bp, D. melanogaster
gcagcgaaatcaa

SEQ ID NO: 625612 - DNA, 13 bp, D. melanogaster
gcagcgaaatgaa

SEQ ID NO: 625613 - DNA, 13 bp, D. melanogaster
gcagcgaataaaa

SEQ ID NO: 625614 - DNA, 13 bp, D. melanogaster
gcagcgacaaaaa

SEQ ID NO: 625615 - DNA, 13 bp, D. melanogaster
gcagcgacaacaa

SEQ ID NO: 625616 - DNA, 14 bp, D. melanogaster
gcagcgacaacaac

SEQ ID NO: 625617 - DNA, 14 bp, D. melanogaster
gcagcgacgccgac

SEQ ID NO: 625618 - DNA, 14 bp, D. melanogaster
gcagcgacgtcgac

SEQ ID NO: 625619 - DNA, 14 bp, D. melanogaster
gcagcgacgtcggc

SEQ ID NO: 625620 - DNA, 13 bp, D. melanogaster
gcagcgactgcga

SEQ ID NO: 625621 - DNA, 13 bp, D. melanogaster
gcagcgagggagc

SEQ ID NO: 625622 - DNA, 13 bp, D. melanogaster
gcagcgagtgccg

SEQ ID NO: 625623 - DNA, 13 bp, D. melanogaster
gcagcgcaaattg

SEQ ID NO: 625624 - DNA, 13 bp, D. melanogaster
gcagcgcaaattt

SEQ ID NO: 625625 - DNA, 13 bp, D. melanogaster
gcagcgcaagttt

SEQ ID NO: 625626 - DNA, 14 bp, D. melanogaster
gcagcgcaagtttg

SEQ ID NO: 625627 - DNA, 13 bp, D. melanogaster
gcagcgcacaaaa

SEQ ID NO: 625628 - DNA, 13 bp, D. melanogaster
gcagcgcagcagc

SEQ ID NO: 625629 - DNA, 14 bp, D. melanogaster
gcagcgcagcagca

SEQ ID NO: 625630 - DNA, 13 bp, D. melanogaster
gcagcgcagcgca

SEQ ID NO: 625631 - DNA, 14 bp, D. melanogaster
gcagcgcagcgcag

SEQ ID NO: 625632 - DNA, 14 bp, D. melanogaster
gcagcgcagctacg

SEQ ID NO: 625633 - DNA, 13 bp, D. melanogaster
gcagcgcagtcgc

SEQ ID NO: 625634 - DNA, 14 bp, D. melanogaster
gcagcgcagtcggc

SEQ ID NO: 625635 - DNA, 13 bp, D. melanogaster
gcagcgcagtgca

SEQ ID NO: 625636 - DNA, 13 bp, D. melanogaster
gcagcgccaacaa

SEQ ID NO: 625637 - DNA, 13 bp, D. melanogaster
gcagcgcctagtg

SEQ ID NO: 625638 - DNA, 13 bp, D. melanogaster
gcagcgcgcaggg

SEQ ID NO: 625639 - DNA, 13 bp, D. melanogaster
gcagcgctgccag

SEQ ID NO: 625640 - DNA, 13 bp, D. melanogaster
gcagcgctgctgc

SEQ ID NO: 625641 - DNA, 13 bp, D. melanogaster
gcagcggaaaatt

SEQ ID NO: 625642 - DNA, 13 bp, D. melanogaster
gcagcggaaatgc

SEQ ID NO: 625643 - DNA, 13 bp, D. melanogaster
gcagcggaaattg

SEQ ID NO: 625644 - DNA, 13 bp, D. melanogaster
gcagcggaagttg

SEQ ID NO: 625645 - DNA, 13 bp, D. melanogaster
gcagcggacgtaa

SEQ ID NO: 625646 - DNA, 13 bp, D. melanogaster
gcagcggagcggc

SEQ ID NO: 625647 - DNA, 14 bp, D. melanogaster
gcagcggagcggcg

SEQ ID NO: 625648 - DNA, 13 bp, D. melanogaster
gcagcggcaaaaa

SEQ ID NO: 625649 - DNA, 13 bp, D. melanogaster
gcagcggcaaaag

SEQ ID NO: 625650 - DNA, 13 bp, D. melanogaster
gcagcggcaaagt

SEQ ID NO: 625651 - DNA, 13 bp, D. melanogaster
gcagcggcaaatg

SEQ ID NO: 625652 - DNA, 13 bp, D. melanogaster
gcagcggcaaatt

SEQ ID NO: 625653 - DNA, 13 bp, D. melanogaster
gcagcggcaacaa

SEQ ID NO: 625654 - DNA, 14 bp, D. melanogaster
gcagcggcaacaaa

SEQ ID NO: 625655 - DNA, 14 bp, D. melanogaster
gcagcggcaacaac

SEQ ID NO: 625656 - DNA, 13 bp, D. melanogaster
gcagcggcaacag

SEQ ID NO: 625657 - DNA, 14 bp, D. melanogaster
gcagcggcaacagc

SEQ ID NO: 625658 - DNA, 13 bp, D. melanogaster
gcagcggcaacat

SEQ ID NO: 625659 - DNA, 14 bp, D. melanogaster
gcagcggcaacatc

SEQ ID NO: 625660 - DNA, 13 bp, D. melanogaster
gcagcggcagaag

SEQ ID NO: 625661 - DNA, 14 bp, D. melanogaster
gcagcggcagaagc

SEQ ID NO: 625662 - DNA, 13 bp, D. melanogaster
gcagcggcagagg

SEQ ID NO: 625663 - DNA, 14 bp, D. melanogaster
gcagcggcagaggc

SEQ ID NO: 625664 - DNA, 14 bp, D. melanogaster
gcagcggcagcaga

SEQ ID NO: 625665 - DNA, 14 bp, D. melanogaster
gcagcggcagcagc

SEQ ID NO: 625666 - DNA, 14 bp, D. melanogaster
gcagcggcagcagg

SEQ ID NO: 625667 - DNA, 14 bp, D. melanogaster
gcagcggcagcagt

SEQ ID NO: 625668 - DNA, 13 bp, D. melanogaster
gcagcggcagcat

SEQ ID NO: 625669 - DNA, 13 bp, D. melanogaster
gcagcggcagcca

SEQ ID NO: 625670 - DNA, 13 bp, D. melanogaster
gcagcggcagccg

SEQ ID NO: 625671 - DNA, 14 bp, D. melanogaster
gcagcggcagcgac

SEQ ID NO: 625672 - DNA, 13 bp, D. melanogaster
gcagcggcagctg

SEQ ID NO: 625673 - DNA, 14 bp, D. melanogaster
gcagcggcagtggc

SEQ ID NO: 625674 - DNA, 13 bp, D. melanogaster
gcagcggcatcat

SEQ ID NO: 625675 - DNA, 13 bp, D. melanogaster
gcagcggcgaaaa

SEQ ID NO: 625676 - DNA, 13 bp, D. melanogaster
gcagcggcgcagc

SEQ ID NO: 625677 - DNA, 13 bp, D. melanogaster
gcagcggcggcaa

SEQ ID NO: 625678 - DNA, 14 bp, D. melanogaster
gcagcggcggcaac

SEQ ID NO: 625679 - DNA, 13 bp, D. melanogaster
gcagcggcggcag

SEQ ID NO: 625680 - DNA, 13 bp, D. melanogaster
gcagcggctgctg

SEQ ID NO: 625681 - DNA, 13 bp, D. melanogaster
gcagcgggaaaaa

SEQ ID NO: 625682 - DNA, 13 bp, D. melanogaster
gcagcgggaaaac

SEQ ID NO: 625683 - DNA, 13 bp, D. melanogaster
gcagcgggaaaat

SEQ ID NO: 625684 - DNA, 13 bp, D. melanogaster
gcagcgtatatat

SEQ ID NO: 625685 - DNA, 13 bp, D. melanogaster
gcagcgtcgcagc

SEQ ID NO: 625686 - DNA, 13 bp, D. melanogaster
gcagcgttcttgg

SEQ ID NO: 625687 - DNA, 13 bp, D. melanogaster
gcagctaaaaaaa

SEQ ID NO: 625688 - DNA, 13 bp, D. melanogaster
gcagctaagcaaa

SEQ ID NO: 625689 - DNA, 13 bp, D. melanogaster
gcagctaagcgaa

SEQ ID NO: 625690 - DNA, 14 bp, D. melanogaster
gcagctaagcgaat

SEQ ID NO: 625691 - DNA, 23 bp, D. melanogaster
gcagctaagcgaattatactgta

SEQ ID NO: 625692 - DNA, 13 bp, D. melanogaster
gcagctaattacc

SEQ ID NO: 625693 - DNA, 13 bp, D. melanogaster
gcagctaatttaa

SEQ ID NO: 625694 - DNA, 13 bp, D. melanogaster
gcagctacaaaaa

SEQ ID NO: 625695 - DNA, 13 bp, D. melanogaster
gcagctacaacaa

SEQ ID NO: 625696 - DNA, 13 bp, D. melanogaster
gcagctacagtga

SEQ ID NO: 625697 - DNA, 13 bp, D. melanogaster
gcagctacgcgga

SEQ ID NO: 625698 - DNA, 13 bp, D. melanogaster
gcagctatttacc

SEQ ID NO: 625699 - DNA, 13 bp, D. melanogaster
gcagctcaagtgg

SEQ ID NO: 625700 - DNA, 17 bp, D. melanogaster
gcagctcaagtggtcaa

SEQ ID NO: 625701 - DNA, 13 bp, D. melanogaster
gcagctcacctgc

SEQ ID NO: 625702 - DNA, 13 bp, D. melanogaster
gcagctcataaaa

SEQ ID NO: 625703 - DNA, 13 bp, D. melanogaster
gcagctcattaaa

SEQ ID NO: 625704 - DNA, 13 bp, D. melanogaster
gcagctcattaat

SEQ ID NO: 625705 - DNA, 13 bp, D. melanogaster
gcagctcatttgc

SEQ ID NO: 625706 - DNA, 13 bp, D. melanogaster
gcagctccaaaaa

SEQ ID NO: 625707 - DNA, 13 bp, D. melanogaster
gcagctccagctc

SEQ ID NO: 625708 - DNA, 14 bp, D. melanogaster
gcagctcctacaaa

SEQ ID NO: 625709 - DNA, 14 bp, D. melanogaster
gcagctcctgcagc

SEQ ID NO: 625710 - DNA, 13 bp, D. melanogaster
gcagctcgcagct

SEQ ID NO: 625711 - DNA, 13 bp, D. melanogaster
gcagctcggaaaa

SEQ ID NO: 625712 - DNA, 13 bp, D. melanogaster
gcagctctactcc

SEQ ID NO: 625713 - DNA, 13 bp, D. melanogaster
gcagctctcggac

SEQ ID NO: 625714 - DNA, 13 bp, D. melanogaster
gcagctcttactg

SEQ ID NO: 625715 - DNA, 13 bp, D. melanogaster
gcagctgaaaaaa

SEQ ID NO: 625716 - DNA, 13 bp, D. melanogaster
gcagctgaaaaat

SEQ ID NO: 625717 - DNA, 13 bp, D. melanogaster
gcagctgaaaact

SEQ ID NO: 625718 - DNA, 13 bp, D. melanogaster
gcagctgaaaagc

SEQ ID NO: 625719 - DNA, 13 bp, D. melanogaster
gcagctgacaaaa

SEQ ID NO: 625720 - DNA, 13 bp, D. melanogaster
gcagctgagtttt

SEQ ID NO: 625721 - DNA, 13 bp, D. melanogaster
gcagctgcaaaaa

SEQ ID NO: 625722 - DNA, 13 bp, D. melanogaster
gcagctgcaaata

SEQ ID NO: 625723 - DNA, 13 bp, D. melanogaster
gcagctgcaacaa

SEQ ID NO: 625724 - DNA, 13 bp, D. melanogaster
gcagctgcaactg

SEQ ID NO: 625725 - DNA, 14 bp, D. melanogaster
gcagctgcaactgc

SEQ ID NO: 625726 - DNA, 13 bp, D. melanogaster
gcagctgcaactt

SEQ ID NO: 625727 - DNA, 14 bp, D. melanogaster
gcagctgcaacttt

SEQ ID NO: 625728 - DNA, 13 bp, D. melanogaster
gcagctgcaagtg

SEQ ID NO: 625729 - DNA, 13 bp, D. melanogaster
gcagctgcaatcg

SEQ ID NO: 625730 - DNA, 13 bp, D. melanogaster
gcagctgcaattg

SEQ ID NO: 625731 - DNA, 14 bp, D. melanogaster
gcagctgcaattgc

SEQ ID NO: 625732 - DNA, 13 bp, D. melanogaster
gcagctgcaattt

SEQ ID NO: 625733 - DNA, 13 bp, D. melanogaster
gcagctgcagagg

SEQ ID NO: 625734 - DNA, 13 bp, D. melanogaster
gcagctgcagcaa

SEQ ID NO: 625735 - DNA, 14 bp, D. melanogaster
gcagctgcagcaac

SEQ ID NO: 625736 - DNA, 13 bp, D. melanogaster
gcagctgcagcca

SEQ ID NO: 625737 - DNA, 13 bp, D. melanogaster
gcagctgcagcgg

SEQ ID NO: 625738 - DNA, 14 bp, D. melanogaster
gcagctgcagctgc

SEQ ID NO: 625739 - DNA, 14 bp, D. melanogaster
gcagctgcagctgt

SEQ ID NO: 625740 - DNA, 13 bp, D. melanogaster
gcagctgcagctt

SEQ ID NO: 625741 - DNA, 13 bp, D. melanogaster
gcagctgcaggaa

SEQ ID NO: 625742 - DNA, 14 bp, D. melanogaster
gcagctgcagttgc

SEQ ID NO: 625743 - DNA, 13 bp, D. melanogaster
gcagctgcagttt

SEQ ID NO: 625744 - DNA, 13 bp, D. melanogaster
gcagctgcataaa

SEQ ID NO: 625745 - DNA, 13 bp, D. melanogaster
gcagctgcatctg

SEQ ID NO: 625746 - DNA, 13 bp, D. melanogaster
gcagctgcatttc

SEQ ID NO: 625747 - DNA, 13 bp, D. melanogaster
gcagctgccacaa

SEQ ID NO: 625748 - DNA, 13 bp, D. melanogaster
gcagctgccacag

SEQ ID NO: 625749 - DNA, 13 bp, D. melanogaster
gcagctgccgctg

SEQ ID NO: 625750 - DNA, 13 bp, D. melanogaster
gcagctgcctttg

SEQ ID NO: 625751 - DNA, 13 bp, D. melanogaster
gcagctgctgaaa

SEQ ID NO: 625752 - DNA, 13 bp, D. melanogaster
gcagctgctgatg

SEQ ID NO: 625753 - DNA, 14 bp, D. melanogaster
gcagctgctgcagc

SEQ ID NO: 625754 - DNA, 13 bp, D. melanogaster
gcagctgctgccg

SEQ ID NO: 625755 - DNA, 13 bp, D. melanogaster
gcagctgctgctc

SEQ ID NO: 625756 - DNA, 14 bp, D. melanogaster
gcagctgctgctgc

SEQ ID NO: 625757 - DNA, 13 bp, D. melanogaster
gcagctgctgctt

SEQ ID NO: 625758 - DNA, 13 bp, D. melanogaster
gcagctgctgttg

SEQ ID NO: 625759 - DNA, 13 bp, D. melanogaster
gcagctgcttctg

SEQ ID NO: 625760 - DNA, 13 bp, D. melanogaster
gcagctgcttctt

SEQ ID NO: 625761 - DNA, 14 bp, D. melanogaster
gcagctgcttcttc

SEQ ID NO: 625762 - DNA, 13 bp, D. melanogaster
gcagctgcttttc

SEQ ID NO: 625763 - DNA, 13 bp, D. melanogaster
gcagctggaaaaa

SEQ ID NO: 625764 - DNA, 13 bp, D. melanogaster
gcagctggaaaag

SEQ ID NO: 625765 - DNA, 13 bp, D. melanogaster
gcagctggaaaat

SEQ ID NO: 625766 - DNA, 13 bp, D. melanogaster
gcagctggagcag

SEQ ID NO: 625767 - DNA, 13 bp, D. melanogaster
gcagctggagctg

SEQ ID NO: 625768 - DNA, 13 bp, D. melanogaster
gcagctggaggag

SEQ ID NO: 625769 - DNA, 13 bp, D. melanogaster
gcagctggagttc

SEQ ID NO: 625770 - DNA, 14 bp, D. melanogaster
gcagctggatgatc

SEQ ID NO: 625771 - DNA, 13 bp, D. melanogaster
gcagctggcagcg

SEQ ID NO: 625772 - DNA, 13 bp, D. melanogaster
gcagctggcagct

SEQ ID NO: 625773 - DNA, 13 bp, D. melanogaster
gcagctgggaaaa

SEQ ID NO: 625774 - DNA, 13 bp, D. melanogaster
gcagctgggaaat

SEQ ID NO: 625775 - DNA, 13 bp, D. melanogaster
gcagctgggtgat

SEQ ID NO: 625776 - DNA, 13 bp, D. melanogaster
gcagctggtgcaa

SEQ ID NO: 625777 - DNA, 13 bp, D. melanogaster
gcagctgtgtgtg

SEQ ID NO: 625778 - DNA, 13 bp, D. melanogaster
gcagctgttcttg

SEQ ID NO: 625779 - DNA, 13 bp, D. melanogaster
gcagctgttgcag

SEQ ID NO: 625780 - DNA, 13 bp, D. melanogaster
gcagctgttgcca

SEQ ID NO: 625781 - DNA, 13 bp, D. melanogaster
gcagctgttggcc

SEQ ID NO: 625782 - DNA, 13 bp, D. melanogaster
gcagctgtttggc

SEQ ID NO: 625783 - DNA, 13 bp, D. melanogaster
gcagcttaaagac

SEQ ID NO: 625784 - DNA, 13 bp, D. melanogaster
gcagcttaaataa

SEQ ID NO: 625785 - DNA, 13 bp, D. melanogaster
gcagcttattgag

SEQ ID NO: 625786 - DNA, 13 bp, D. melanogaster
gcagcttctgttg

SEQ ID NO: 625787 - DNA, 13 bp, D. melanogaster
gcagcttgcagct

SEQ ID NO: 625788 - DNA, 13 bp, D. melanogaster
gcagcttgttgga

SEQ ID NO: 625789 - DNA, 13 bp, D. melanogaster
gcagcttgtttaa

SEQ ID NO: 625790 - DNA, 13 bp, D. melanogaster
gcagcttttgtct

SEQ ID NO: 625791 - DNA, 13 bp, D. melanogaster
gcagcttttgttt

SEQ ID NO: 625792 - DNA, 13 bp, D. melanogaster
gcaggaaaaactt

SEQ ID NO: 625793 - DNA, 13 bp, D. melanogaster
gcaggaaaagcag

SEQ ID NO: 625794 - DNA, 13 bp, D. melanogaster
gcaggaaaagcgg

SEQ ID NO: 625795 - DNA, 13 bp, D. melanogaster
gcaggaaaagttt

SEQ ID NO: 625796 - DNA, 13 bp, D. melanogaster
gcaggaaaataaa

SEQ ID NO: 625797 - DNA, 13 bp, D. melanogaster
gcaggaaaatcgg

SEQ ID NO: 625798 - DNA, 13 bp, D. melanogaster
gcaggaaaatggg

SEQ ID NO: 625799 - DNA, 13 bp, D. melanogaster
gcaggaaatgaaa

SEQ ID NO: 625800 - DNA, 13 bp, D. melanogaster
gcaggaaatgcaa

SEQ ID NO: 625801 - DNA, 13 bp, D. melanogaster
gcaggaacaacaa

SEQ ID NO: 625802 - DNA, 13 bp, D. melanogaster
gcaggaacagcaa

SEQ ID NO: 625803 - DNA, 13 bp, D. melanogaster
gcaggaactgttt

SEQ ID NO: 625804 - DNA, 13 bp, D. melanogaster
gcaggaagccaaa

SEQ ID NO: 625805 - DNA, 13 bp, D. melanogaster
gcaggaaggaata

SEQ ID NO: 625806 - DNA, 13 bp, D. melanogaster
gcaggaagtgcag

SEQ ID NO: 625807 - DNA, 14 bp, D. melanogaster
gcaggaatggaaaa

SEQ ID NO: 625808 - DNA, 13 bp, D. melanogaster
gcaggacaatggc

SEQ ID NO: 625809 - DNA, 13 bp, D. melanogaster
gcaggacacacac

SEQ ID NO: 625810 - DNA, 13 bp, D. melanogaster
gcaggacgaaagg

SEQ ID NO: 625811 - DNA, 13 bp, D. melanogaster
gcaggacgaagga

SEQ ID NO: 625812 - DNA, 14 bp, D. melanogaster
gcaggacgaaggac

SEQ ID NO: 625813 - DNA, 13 bp, D. melanogaster
gcaggacgagcag

SEQ ID NO: 625814 - DNA, 13 bp, D. melanogaster
gcaggacgaggag

SEQ ID NO: 625815 - DNA, 14 bp, D. melanogaster
gcaggacgcaggac

SEQ ID NO: 625816 - DNA, 13 bp, D. melanogaster
gcaggagaaaatt

SEQ ID NO: 625817 - DNA, 13 bp, D. melanogaster
gcaggagaaatat

SEQ ID NO: 625818 - DNA, 13 bp, D. melanogaster
gcaggagcaaaaa

SEQ ID NO: 625819 - DNA, 13 bp, D. melanogaster
gcaggagcaaagg

SEQ ID NO: 625820 - DNA, 13 bp, D. melanogaster
gcaggagcaacat

SEQ ID NO: 625821 - DNA, 14 bp, D. melanogaster
gcaggagcagaagc

SEQ ID NO: 625822 - DNA, 13 bp, D. melanogaster
gcaggagcagcac

SEQ ID NO: 625823 - DNA, 13 bp, D. melanogaster
gcaggagcagcag

SEQ ID NO: 625824 - DNA, 14 bp, D. melanogaster
gcaggagcagcagg

SEQ ID NO: 625825 - DNA, 13 bp, D. melanogaster
gcaggagcagcca

SEQ ID NO: 625826 - DNA, 13 bp, D. melanogaster
gcaggagcagtag

SEQ ID NO: 625827 - DNA, 13 bp, D. melanogaster
gcaggagctggag

SEQ ID NO: 625828 - DNA, 13 bp, D. melanogaster
gcaggaggaaaat

SEQ ID NO: 625829 - DNA, 13 bp, D. melanogaster
gcaggaggagctg

SEQ ID NO: 625830 - DNA, 13 bp, D. melanogaster
gcaggaggcagga

SEQ ID NO: 625831 - DNA, 13 bp, D. melanogaster
gcaggagtagcag

SEQ ID NO: 625832 - DNA, 13 bp, D. melanogaster
gcaggataacaaa

SEQ ID NO: 625833 - DNA, 13 bp, D. melanogaster
gcaggatgcagga

SEQ ID NO: 625834 - DNA, 13 bp, D. melanogaster
gcaggatgccgtg

SEQ ID NO: 625835 - DNA, 13 bp, D. melanogaster
gcaggatgtgagg

SEQ ID NO: 625836 - DNA, 13 bp, D. melanogaster
gcaggatttttgt

SEQ ID NO: 625837 - DNA, 13 bp, D. melanogaster
gcaggcaaaacaa

SEQ ID NO: 625838 - DNA, 13 bp, D. melanogaster
gcaggcaaatgaa

SEQ ID NO: 625839 - DNA, 13 bp, D. melanogaster
gcaggcaacaaaa

SEQ ID NO: 625840 - DNA, 13 bp, D. melanogaster
gcaggcaacaatg

SEQ ID NO: 625841 - DNA, 13 bp, D. melanogaster
gcaggcaacattt

SEQ ID NO: 625842 - DNA, 13 bp, D. melanogaster
gcaggcaataaat

SEQ ID NO: 625843 - DNA, 13 bp, D. melanogaster
gcaggcagaagga

SEQ ID NO: 625844 - DNA, 13 bp, D. melanogaster
gcaggcagcaaca

SEQ ID NO: 625845 - DNA, 13 bp, D. melanogaster
gcaggcagcagac

SEQ ID NO: 625846 - DNA, 13 bp, D. melanogaster
gcaggcagcattt

SEQ ID NO: 625847 - DNA, 13 bp, D. melanogaster
gcaggcagccaaa

SEQ ID NO: 625848 - DNA, 13 bp, D. melanogaster
gcaggcagccagc

SEQ ID NO: 625849 - DNA, 13 bp, D. melanogaster
gcaggcagcgcag

SEQ ID NO: 625850 - DNA, 13 bp, D. melanogaster
gcaggcaggcaaa

SEQ ID NO: 625851 - DNA, 13 bp, D. melanogaster
gcaggcaggcagt

SEQ ID NO: 625852 - DNA, 13 bp, D. melanogaster
gcaggcagttggc

SEQ ID NO: 625853 - DNA, 13 bp, D. melanogaster
gcaggcatccatc

SEQ ID NO: 625854 - DNA, 13 bp, D. melanogaster
gcaggcatttttc

SEQ ID NO: 625855 - DNA, 13 bp, D. melanogaster
gcaggccaaaaaa

SEQ ID NO: 625856 - DNA, 13 bp, D. melanogaster
gcaggccaaaaac

SEQ ID NO: 625857 - DNA, 13 bp, D. melanogaster
gcaggccaccgaa

SEQ ID NO: 625858 - DNA, 13 bp, D. melanogaster
gcaggccataaaa

SEQ ID NO: 625859 - DNA, 13 bp, D. melanogaster
gcaggcgaaaatg

SEQ ID NO: 625860 - DNA, 13 bp, D. melanogaster
gcaggcgaacaaa

SEQ ID NO: 625861 - DNA, 13 bp, D. melanogaster
gcaggcgaacagc

SEQ ID NO: 625862 - DNA, 13 bp, D. melanogaster
gcaggcggaaaat

SEQ ID NO: 625863 - DNA, 13 bp, D. melanogaster
gcaggcggcaggc

SEQ ID NO: 625864 - DNA, 13 bp, D. melanogaster
gcaggcttaccaa

SEQ ID NO: 625865 - DNA, 13 bp, D. melanogaster
gcagggaaaacaa

SEQ ID NO: 625866 - DNA, 13 bp, D. melanogaster
gcagggcagggca

SEQ ID NO: 625867 - DNA, 13 bp, D. melanogaster
gcaggtaaactgc

SEQ ID NO: 625868 - DNA, 13 bp, D. melanogaster
gcaggtgaaaaat

SEQ ID NO: 625869 - DNA, 13 bp, D. melanogaster
gcaggtggaaagt

SEQ ID NO: 625870 - DNA, 13 bp, D. melanogaster
gcaggtgggcagg

SEQ ID NO: 625871 - DNA, 13 bp, D. melanogaster
gcagtaaaaacaa

SEQ ID NO: 625872 - DNA, 13 bp, D. melanogaster
gcagtaacaacaa

SEQ ID NO: 625873 - DNA, 14 bp, D. melanogaster
gcagtaacaacaac

SEQ ID NO: 625874 - DNA, 13 bp, D. melanogaster
gcagtaacagtaa

SEQ ID NO: 625875 - DNA, 13 bp, D. melanogaster
gcagtaataataa

SEQ ID NO: 625876 - DNA, 18 bp, D. melanogaster
gcagtagcaacagcagca

SEQ ID NO: 625877 - DNA, 15 bp, D. melanogaster
gcagtagcagcagca

SEQ ID NO: 625878 - DNA, 13 bp, D. melanogaster
gcagtatgattta

SEQ ID NO: 625879 - DNA, 14 bp, D. melanogaster
gcagtatttttaga

SEQ ID NO: 625880 - DNA, 13 bp, D. melanogaster
gcagtcaaagccg

SEQ ID NO: 625881 - DNA, 14 bp, D. melanogaster
gcagtcaaagccgg

SEQ ID NO: 625882 - DNA, 13 bp, D. melanogaster
gcagtcaaatctg

SEQ ID NO: 625883 - DNA, 14 bp, D. melanogaster
gcagtcactttcgc

SEQ ID NO: 625884 - DNA, 13 bp, D. melanogaster
gcagtccaaaaac

SEQ ID NO: 625885 - DNA, 13 bp, D. melanogaster
gcagtcgacgtcg

SEQ ID NO: 625886 - DNA, 13 bp, D. melanogaster
gcagtcgcagtat

SEQ ID NO: 625887 - DNA, 13 bp, D. melanogaster
gcagtcgcagtcg

SEQ ID NO: 625888 - DNA, 14 bp, D. melanogaster
gcagtcgcagtcgc

SEQ ID NO: 625889 - DNA, 13 bp, D. melanogaster
gcagtcgcagttg

SEQ ID NO: 625890 - DNA, 14 bp, D. melanogaster
gcagtcgcagttgc

SEQ ID NO: 625891 - DNA, 13 bp, D. melanogaster
gcagtctttttgg

SEQ ID NO: 625892 - DNA, 13 bp, D. melanogaster
gcagtgaaaacaa

SEQ ID NO: 625893 - DNA, 14 bp, D. melanogaster
gcagtgaaaacaaa

SEQ ID NO: 625894 - DNA, 13 bp, D. melanogaster
gcagtgaaaataa

SEQ ID NO: 625895 - DNA, 13 bp, D. melanogaster
gcagtgaaagtgt

SEQ ID NO: 625896 - DNA, 14 bp, D. melanogaster
gcagtgaaagtgtc

SEQ ID NO: 625897 - DNA, 13 bp, D. melanogaster
gcagtgaagaaaa

SEQ ID NO: 625898 - DNA, 13 bp, D. melanogaster
gcagtgacaacaa

SEQ ID NO: 625899 - DNA, 13 bp, D. melanogaster
gcagtgagaaaaa

SEQ ID NO: 625900 - DNA, 13 bp, D. melanogaster
gcagtgatgacag

SEQ ID NO: 625901 - DNA, 13 bp, D. melanogaster
gcagtgatttctt

SEQ ID NO: 625902 - DNA, 13 bp, D. melanogaster
gcagtgcaaaaat

SEQ ID NO: 625903 - DNA, 13 bp, D. melanogaster
gcagtgcaagttt

SEQ ID NO: 625904 - DNA, 13 bp, D. melanogaster
gcagtgcaataaa

SEQ ID NO: 625905 - DNA, 13 bp, D. melanogaster
gcagtgcagcagt

SEQ ID NO: 625906 - DNA, 14 bp, D. melanogaster
gcagtgcagtgcag

SEQ ID NO: 625907 - DNA, 13 bp, D. melanogaster
gcagtgcatcgag

SEQ ID NO: 625908 - DNA, 13 bp, D. melanogaster
gcagtgcattgaa

SEQ ID NO: 625909 - DNA, 13 bp, D. melanogaster
gcagtgccaaaaa

SEQ ID NO: 625910 - DNA, 13 bp, D. melanogaster
gcagtgccaacaa

SEQ ID NO: 625911 - DNA, 13 bp, D. melanogaster
gcagtgccacgcc

SEQ ID NO: 625912 - DNA, 14 bp, D. melanogaster
gcagtgccacgccc

SEQ ID NO: 625913 - DNA, 13 bp, D. melanogaster
gcagtgcgacttt

SEQ ID NO: 625914 - DNA, 13 bp, D. melanogaster
gcagtggaaaatg

SEQ ID NO: 625915 - DNA, 13 bp, D. melanogaster
gcagtggcaaaaa

SEQ ID NO: 625916 - DNA, 13 bp, D. melanogaster
gcagtggcaaaag

SEQ ID NO: 625917 - DNA, 13 bp, D. melanogaster
gcagtggcaaatg

SEQ ID NO: 625918 - DNA, 13 bp, D. melanogaster
gcagtggcaacaa

SEQ ID NO: 625919 - DNA, 13 bp, D. melanogaster
gcagtggcaactg

SEQ ID NO: 625920 - DNA, 13 bp, D. melanogaster
gcagtggcaactt

SEQ ID NO: 625921 - DNA, 13 bp, D. melanogaster
gcagtggcaagtg

SEQ ID NO: 625922 - DNA, 13 bp, D. melanogaster
gcagtggcagcgg

SEQ ID NO: 625923 - DNA, 14 bp, D. melanogaster
gcagtggcagcggc

SEQ ID NO: 625924 - DNA, 13 bp, D. melanogaster
gcagtggcagtgc

SEQ ID NO: 625925 - DNA, 13 bp, D. melanogaster
gcagtggcagtgg

SEQ ID NO: 625926 - DNA, 14 bp, D. melanogaster
gcagtggcagtggc

SEQ ID NO: 625927 - DNA, 13 bp, D. melanogaster
gcagtggcagttg

SEQ ID NO: 625928 - DNA, 14 bp, D. melanogaster
gcagtggcagttgc

SEQ ID NO: 625929 - DNA, 13 bp, D. melanogaster
gcagtggcattgg

SEQ ID NO: 625930 - DNA, 13 bp, D. melanogaster
gcagtgggaaaag

SEQ ID NO: 625931 - DNA, 13 bp, D. melanogaster
gcagtgggaaatg

SEQ ID NO: 625932 - DNA, 13 bp, D. melanogaster
gcagtgggagtgg

SEQ ID NO: 625933 - DNA, 13 bp, D. melanogaster
gcagtgggcagtg

SEQ ID NO: 625934 - DNA, 14 bp, D. melanogaster
gcagtgggcggtgg

SEQ ID NO: 625935 - DNA, 13 bp, D. melanogaster
gcagtgggcgtgg

SEQ ID NO: 625936 - DNA, 14 bp, D. melanogaster
gcagtgggcgtggc

SEQ ID NO: 625937 - DNA, 13 bp, D. melanogaster
gcagtggggactc

SEQ ID NO: 625938 - DNA, 13 bp, D. melanogaster
gcagtgggtggtg

SEQ ID NO: 625939 - DNA, 14 bp, D. melanogaster
gcagtgggtggtgg

SEQ ID NO: 625940 - DNA, 13 bp, D. melanogaster
gcagtgggtggtt

SEQ ID NO: 625941 - DNA, 13 bp, D. melanogaster
gcagtgggtgtgg

SEQ ID NO: 625942 - DNA, 13 bp, D. melanogaster
gcagtgtatgtat

SEQ ID NO: 625943 - DNA, 13 bp, D. melanogaster
gcagtgtgaccag

SEQ ID NO: 625944 - DNA, 13 bp, D. melanogaster
gcagtgttgccaa

SEQ ID NO: 625945 - DNA, 13 bp, D. melanogaster
gcagtgttttttt

SEQ ID NO: 625946 - DNA, 13 bp, D. melanogaster
gcagttaaataaa

SEQ ID NO: 625947 - DNA, 13 bp, D. melanogaster
gcagttaataaaa

SEQ ID NO: 625948 - DNA, 14 bp, D. melanogaster
gcagttacgaaaaa

SEQ ID NO: 625949 - DNA, 13 bp, D. melanogaster
gcagttcatcgat

SEQ ID NO: 625950 - DNA, 14 bp, D. melanogaster
gcagttcatcgatt

SEQ ID NO: 625951 - DNA, 13 bp, D. melanogaster
gcagttcctcgaa

SEQ ID NO: 625952 - DNA, 13 bp, D. melanogaster
gcagttcgattgg

SEQ ID NO: 625953 - DNA, 13 bp, D. melanogaster
gcagttcgcagtt

SEQ ID NO: 625954 - DNA, 13 bp, D. melanogaster
gcagttcttattt

SEQ ID NO: 625955 - DNA, 13 bp, D. melanogaster
gcagttgaaataa

SEQ ID NO: 625956 - DNA, 13 bp, D. melanogaster
gcagttgcaactg

SEQ ID NO: 625957 - DNA, 14 bp, D. melanogaster
gcagttgcaactgc

SEQ ID NO: 625958 - DNA, 14 bp, D. melanogaster
gcagttgcaattgc

SEQ ID NO: 625959 - DNA, 15 bp, D. melanogaster
gcagttgcaattgca

SEQ ID NO: 625960 - DNA, 13 bp, D. melanogaster
gcagttgcagcag

SEQ ID NO: 625961 - DNA, 14 bp, D. melanogaster
gcagttgcagctgc

SEQ ID NO: 625962 - DNA, 13 bp, D. melanogaster
gcagttgcagctt

SEQ ID NO: 625963 - DNA, 13 bp, D. melanogaster
gcagttgcagttc

SEQ ID NO: 625964 - DNA, 14 bp, D. melanogaster
gcagttgcagttgc

SEQ ID NO: 625965 - DNA, 15 bp, D. melanogaster
gcagttgcagttgct

SEQ ID NO: 625966 - DNA, 14 bp, D. melanogaster
gcagttgcagttgt

SEQ ID NO: 625967 - DNA, 13 bp, D. melanogaster
gcagttgcagttt

SEQ ID NO: 625968 - DNA, 14 bp, D. melanogaster
gcagttgcagtttg

SEQ ID NO: 625969 - DNA, 13 bp, D. melanogaster
gcagttgcattcg

SEQ ID NO: 625970 - DNA, 13 bp, D. melanogaster
gcagttgcatttg

SEQ ID NO: 625971 - DNA, 13 bp, D. melanogaster
gcagttgccagtg

SEQ ID NO: 625972 - DNA, 13 bp, D. melanogaster
gcagttgctgctg

SEQ ID NO: 625973 - DNA, 13 bp, D. melanogaster
gcagttgctgttg

SEQ ID NO: 625974 - DNA, 13 bp, D. melanogaster
gcagttggaaaat

SEQ ID NO: 625975 - DNA, 13 bp, D. melanogaster
gcagttggcaaaa

SEQ ID NO: 625976 - DNA, 13 bp, D. melanogaster
gcagttggcaatt

SEQ ID NO: 625977 - DNA, 13 bp, D. melanogaster
gcagttggcagct

SEQ ID NO: 625978 - DNA, 13 bp, D. melanogaster
gcagttggcattt

SEQ ID NO: 625979 - DNA, 14 bp, D. melanogaster
gcagttggccaaaa

SEQ ID NO: 625980 - DNA, 13 bp, D. melanogaster
gcagttggccatt

SEQ ID NO: 625981 - DNA, 13 bp, D. melanogaster
gcagttgggtgca

SEQ ID NO: 625982 - DNA, 13 bp, D. melanogaster
gcagttggtaaat

SEQ ID NO: 625983 - DNA, 13 bp, D. melanogaster
gcagttggtcatt

SEQ ID NO: 625984 - DNA, 13 bp, D. melanogaster
gcagttgtaaaaa

SEQ ID NO: 625985 - DNA, 13 bp, D. melanogaster
gcagttgtagttg

SEQ ID NO: 625986 - DNA, 13 bp, D. melanogaster
gcagttgttgcag

SEQ ID NO: 625987 - DNA, 14 bp, D. melanogaster
gcagttgttgctgc

SEQ ID NO: 625988 - DNA, 14 bp, D. melanogaster
gcagttgttgctgt

SEQ ID NO: 625989 - DNA, 14 bp, D. melanogaster
gcagttgttgtttt

SEQ ID NO: 625990 - DNA, 13 bp, D. melanogaster
gcagtttatttgc

SEQ ID NO: 625991 - DNA, 13 bp, D. melanogaster
gcagtttcagttt

SEQ ID NO: 625992 - DNA, 13 bp, D. melanogaster
gcagtttccattt

SEQ ID NO: 625993 - DNA, 14 bp, D. melanogaster
gcagtttcctggcc

SEQ ID NO: 625994 - DNA, 13 bp, D. melanogaster
gcagtttcttgtt

SEQ ID NO: 625995 - DNA, 13 bp, D. melanogaster
gcagtttgcagtt

SEQ ID NO: 625996 - DNA, 13 bp, D. melanogaster
gcagtttgcattt

SEQ ID NO: 625997 - DNA, 13 bp, D. melanogaster
gcagtttgcggta

SEQ ID NO: 625998 - DNA, 13 bp, D. melanogaster
gcagtttgctggc

SEQ ID NO: 625999 - DNA, 13 bp, D. melanogaster
gcagtttgctttt

SEQ ID NO: 626000 - DNA, 13 bp, D. melanogaster
gcagtttgttgtt

SEQ ID NO: 626001 - DNA, 13 bp, D. melanogaster
gcagtttgttttt

SEQ ID NO: 626002 - DNA, 13 bp, D. melanogaster
gcagttttctttt

SEQ ID NO: 626003 - DNA, 13 bp, D. melanogaster
gcagttttgaccc

SEQ ID NO: 626004 - DNA, 13 bp, D. melanogaster
gcagttttgcagt

SEQ ID NO: 626005 - DNA, 13 bp, D. melanogaster
gcagttttgggcg

SEQ ID NO: 626006 - DNA, 13 bp, D. melanogaster
gcagttttgggtg

SEQ ID NO: 626007 - DNA, 13 bp, D. melanogaster
gcagttttgtgcg

SEQ ID NO: 626008 - DNA, 13 bp, D. melanogaster
gcagtttttcaag

SEQ ID NO: 626009 - DNA, 13 bp, D. melanogaster
gcataaaaactaa

SEQ ID NO: 626010 - DNA, 13 bp, D. melanogaster
gcataaaaagcaa

SEQ ID NO: 626011 - DNA, 13 bp, D. melanogaster
gcataaaaataca

SEQ ID NO: 626012 - DNA, 13 bp, D. melanogaster
gcataaaaatata

SEQ ID NO: 626013 - DNA, 13 bp, D. melanogaster
gcataaaaatcaa

SEQ ID NO: 626014 - DNA, 13 bp, D. melanogaster
gcataaaagtaaa

SEQ ID NO: 626015 - DNA, 13 bp, D. melanogaster
gcataaaagttaa

SEQ ID NO: 626016 - DNA, 13 bp, D. melanogaster
gcataaaataaat

SEQ ID NO: 626017 - DNA, 13 bp, D. melanogaster
gcataaaataaca

SEQ ID NO: 626018 - DNA, 14 bp, D. melanogaster
gcataaaataacaa

SEQ ID NO: 626019 - DNA, 13 bp, D. melanogaster
gcataaaatataa

SEQ ID NO: 626020 - DNA, 13 bp, D. melanogaster
gcataaaatggaa

SEQ ID NO: 626021 - DNA, 13 bp, D. melanogaster
gcataaaattaat

SEQ ID NO: 626022 - DNA, 13 bp, D. melanogaster
gcataaaattatt

SEQ ID NO: 626023 - DNA, 13 bp, D. melanogaster
gcataaaattgaa

SEQ ID NO: 626024 - DNA, 13 bp, D. melanogaster
gcataaacaacaa

SEQ ID NO: 626025 - DNA, 13 bp, D. melanogaster
gcataaacacaca

SEQ ID NO: 626026 - DNA, 14 bp, D. melanogaster
gcataaacataaac

SEQ ID NO: 626027 - DNA, 13 bp, D. melanogaster
gcataaacataat

SEQ ID NO: 626028 - DNA, 13 bp, D. melanogaster
gcataaaccaaaa

SEQ ID NO: 626029 - DNA, 14 bp, D. melanogaster
gcataaataaaaat

SEQ ID NO: 626030 - DNA, 14 bp, D. melanogaster
gcataaataaaatt

SEQ ID NO: 626031 - DNA, 13 bp, D. melanogaster
gcataaataaatg

SEQ ID NO: 626032 - DNA, 14 bp, D. melanogaster
gcataaataaatgc

SEQ ID NO: 626033 - DNA, 13 bp, D. melanogaster
gcataaataacat

SEQ ID NO: 626034 - DNA, 14 bp, D. melanogaster
gcataaataataaa

SEQ ID NO: 626035 - DNA, 13 bp, D. melanogaster
gcataaatacaaa

SEQ ID NO: 626036 - DNA, 13 bp, D. melanogaster
gcataaatataaa

SEQ ID NO: 626037 - DNA, 14 bp, D. melanogaster
gcataaatatttca

SEQ ID NO: 626038 - DNA, 13 bp, D. melanogaster
gcataaatatttg

SEQ ID NO: 626039 - DNA, 13 bp, D. melanogaster
gcataaatcaaaa

SEQ ID NO: 626040 - DNA, 14 bp, D. melanogaster
gcataaatcaaaag

SEQ ID NO: 626041 - DNA, 14 bp, D. melanogaster
gcataaatcaaatg

SEQ ID NO: 626042 - DNA, 14 bp, D. melanogaster
gcataaatcaaatt

SEQ ID NO: 626043 - DNA, 13 bp, D. melanogaster
gcataaatcaagc

SEQ ID NO: 626044 - DNA, 13 bp, D. melanogaster
gcataaatcacac

SEQ ID NO: 626045 - DNA, 13 bp, D. melanogaster
gcataaatgccaa

SEQ ID NO: 626046 - DNA, 13 bp, D. melanogaster
gcataaatgtcaa

SEQ ID NO: 626047 - DNA, 13 bp, D. melanogaster
gcataaatgttta

SEQ ID NO: 626048 - DNA, 13 bp, D. melanogaster
gcataaattaatt

SEQ ID NO: 626049 - DNA, 13 bp, D. melanogaster
gcataaattacaa

SEQ ID NO: 626050 - DNA, 13 bp, D. melanogaster
gcataaattataa

SEQ ID NO: 626051 - DNA, 14 bp, D. melanogaster
gcataaattataaa

SEQ ID NO: 626052 - DNA, 13 bp, D. melanogaster
gcataaattatga

SEQ ID NO: 626053 - DNA, 14 bp, D. melanogaster
gcataaattatgaa

SEQ ID NO: 626054 - DNA, 13 bp, D. melanogaster
gcataaattattt

SEQ ID NO: 626055 - DNA, 13 bp, D. melanogaster
gcataaattcaaa

SEQ ID NO: 626056 - DNA, 13 bp, D. melanogaster
gcataaatttcaa

SEQ ID NO: 626057 - DNA, 13 bp, D. melanogaster
gcataaatttgaa

SEQ ID NO: 626058 - DNA, 13 bp, D. melanogaster
gcataacaaaaat

SEQ ID NO: 626059 - DNA, 13 bp, D. melanogaster
gcataacaaaagt

SEQ ID NO: 626060 - DNA, 13 bp, D. melanogaster
gcataacaaatgc

SEQ ID NO: 626061 - DNA, 13 bp, D. melanogaster
gcataacattttt

SEQ ID NO: 626062 - DNA, 13 bp, D. melanogaster
gcataagcataaa

SEQ ID NO: 626063 - DNA, 13 bp, D. melanogaster
gcataagtataaa

SEQ ID NO: 626064 - DNA, 13 bp, D. melanogaster
gcataataaaata

SEQ ID NO: 626065 - DNA, 13 bp, D. melanogaster
gcataataaataa

SEQ ID NO: 626066 - DNA, 14 bp, D. melanogaster
gcataataaataaa

SEQ ID NO: 626067 - DNA, 13 bp, D. melanogaster
gcataataataat

SEQ ID NO: 626068 - DNA, 13 bp, D. melanogaster
gcataatatattt

SEQ ID NO: 626069 - DNA, 13 bp, D. melanogaster
gcataatcaaatt

SEQ ID NO: 626070 - DNA, 13 bp, D. melanogaster
gcataatgaaaag

SEQ ID NO: 626071 - DNA, 13 bp, D. melanogaster
gcataatgaacat

SEQ ID NO: 626072 - DNA, 13 bp, D. melanogaster
gcataatggccaa

SEQ ID NO: 626073 - DNA, 13 bp, D. melanogaster
gcataattaatga

SEQ ID NO: 626074 - DNA, 14 bp, D. melanogaster
gcataattaatttg

SEQ ID NO: 626075 - DNA, 13 bp, D. melanogaster
gcataattataaa

SEQ ID NO: 626076 - DNA, 13 bp, D. melanogaster
gcataattataat

SEQ ID NO: 626077 - DNA, 13 bp, D. melanogaster
gcataattatttt

SEQ ID NO: 626078 - DNA, 13 bp, D. melanogaster
gcataatttaatt

SEQ ID NO: 626079 - DNA, 13 bp, D. melanogaster
gcataatttagca

SEQ ID NO: 626080 - DNA, 13 bp, D. melanogaster
gcataattttcca

SEQ ID NO: 626081 - DNA, 13 bp, D. melanogaster
gcataattttgaa

SEQ ID NO: 626082 - DNA, 13 bp, D. melanogaster
gcataattttgca

SEQ ID NO: 626083 - DNA, 13 bp, D. melanogaster
gcatacaaaaata

SEQ ID NO: 626084 - DNA, 13 bp, D. melanogaster
gcatacaaatgaa

SEQ ID NO: 626085 - DNA, 13 bp, D. melanogaster
gcatacaaatgca

SEQ ID NO: 626086 - DNA, 13 bp, D. melanogaster
gcatacaaattag

SEQ ID NO: 626087 - DNA, 13 bp, D. melanogaster
gcatacaaattgc

SEQ ID NO: 626088 - DNA, 13 bp, D. melanogaster
gcatacaacgtcc

SEQ ID NO: 626089 - DNA, 13 bp, D. melanogaster
gcatacaatttaa

SEQ ID NO: 626090 - DNA, 13 bp, D. melanogaster
gcatacacacaca

SEQ ID NO: 626091 - DNA, 13 bp, D. melanogaster
gcatacacacata

SEQ ID NO: 626092 - DNA, 13 bp, D. melanogaster
gcatacacacgca

SEQ ID NO: 626093 - DNA, 14 bp, D. melanogaster
gcatacaccaatac

SEQ ID NO: 626094 - DNA, 13 bp, D. melanogaster
gcatacagattct

SEQ ID NO: 626095 - DNA, 13 bp, D. melanogaster
gcatacagtgata

SEQ ID NO: 626096 - DNA, 13 bp, D. melanogaster
gcatacataaata

SEQ ID NO: 626097 - DNA, 13 bp, D. melanogaster
gcatacataaatt

SEQ ID NO: 626098 - DNA, 13 bp, D. melanogaster
gcatacatacata

SEQ ID NO: 626099 - DNA, 13 bp, D. melanogaster
gcatacatataca

SEQ ID NO: 626100 - DNA, 13 bp, D. melanogaster
gcatacatatata

SEQ ID NO: 626101 - DNA, 14 bp, D. melanogaster
gcatacatatatgt

SEQ ID NO: 626102 - DNA, 13 bp, D. melanogaster
gcatacatatgta

SEQ ID NO: 626103 - DNA, 13 bp, D. melanogaster
gcatacatttaat

SEQ ID NO: 626104 - DNA, 13 bp, D. melanogaster
gcatacgacacgt

SEQ ID NO: 626105 - DNA, 13 bp, D. melanogaster
gcatacgcaacgt

SEQ ID NO: 626106 - DNA, 14 bp, D. melanogaster
gcatacgcaacgtg

SEQ ID NO: 626107 - DNA, 13 bp, D. melanogaster
gcatacgcaatgt

SEQ ID NO: 626108 - DNA, 13 bp, D. melanogaster
gcatacgcagtgt

SEQ ID NO: 626109 - DNA, 13 bp, D. melanogaster
gcatacgccacgt

SEQ ID NO: 626110 - DNA, 13 bp, D. melanogaster
gcatacgtacata

SEQ ID NO: 626111 - DNA, 14 bp, D. melanogaster
gcatacgtgtgcac

SEQ ID NO: 626112 - DNA, 14 bp, D. melanogaster
gcatactgcaccct

SEQ ID NO: 626113 - DNA, 13 bp, D. melanogaster
gcatactgcgcag

SEQ ID NO: 626114 - DNA, 14 bp, D. melanogaster
gcatactttcaggc

SEQ ID NO: 626115 - DNA, 13 bp, D. melanogaster
gcatactttcggg

SEQ ID NO: 626116 - DNA, 13 bp, D. melanogaster
gcatactttctgt

SEQ ID NO: 626117 - DNA, 14 bp, D. melanogaster
gcatactttctgtt

SEQ ID NO: 626118 - DNA, 13 bp, D. melanogaster
gcatactttgagg

SEQ ID NO: 626119 - DNA, 13 bp, D. melanogaster
gcatactttgggg

SEQ ID NO: 626120 - DNA, 13 bp, D. melanogaster
gcatactttgtgg

SEQ ID NO: 626121 - DNA, 13 bp, D. melanogaster
gcatacttttaag

SEQ ID NO: 626122 - DNA, 14 bp, D. melanogaster
gcatacttttaagc

SEQ ID NO: 626123 - DNA, 13 bp, D. melanogaster
gcatacttttggg

SEQ ID NO: 626124 - DNA, 14 bp, D. melanogaster
gcatacttttgggc

SEQ ID NO: 626125 - DNA, 13 bp, D. melanogaster
gcatacttttgtg

SEQ ID NO: 626126 - DNA, 13 bp, D. melanogaster
gcatactttttgg

SEQ ID NO: 626127 - DNA, 14 bp, D. melanogaster
gcatactttttggg

SEQ ID NO: 626128 - DNA, 13 bp, D. melanogaster
gcatagcaaacaa

SEQ ID NO: 626129 - DNA, 13 bp, D. melanogaster
gcatagctctcct

SEQ ID NO: 626130 - DNA, 13 bp, D. melanogaster
gcataggccaaca

SEQ ID NO: 626131 - DNA, 13 bp, D. melanogaster
gcatataaaatgc

SEQ ID NO: 626132 - DNA, 14 bp, D. melanogaster
gcatataaataaat

SEQ ID NO: 626133 - DNA, 13 bp, D. melanogaster
gcatataaatcat

SEQ ID NO: 626134 - DNA, 13 bp, D. melanogaster
gcatataaattat

SEQ ID NO: 626135 - DNA, 13 bp, D. melanogaster
gcatataaattgc

SEQ ID NO: 626136 - DNA, 13 bp, D. melanogaster
gcatataaatttc

SEQ ID NO: 626137 - DNA, 13 bp, D. melanogaster
gcatataataaaa

SEQ ID NO: 626138 - DNA, 13 bp, D. melanogaster
gcatatacaattt

SEQ ID NO: 626139 - DNA, 13 bp, D. melanogaster
gcatatacacaca

SEQ ID NO: 626140 - DNA, 14 bp, D. melanogaster
gcatatacacacac

SEQ ID NO: 626141 - DNA, 13 bp, D. melanogaster
gcatatacacata

SEQ ID NO: 626142 - DNA, 13 bp, D. melanogaster
gcatataccatat

SEQ ID NO: 626143 - DNA, 13 bp, D. melanogaster
gcatatataaata

SEQ ID NO: 626144 - DNA, 14 bp, D. melanogaster
gcatatataaatat

SEQ ID NO: 626145 - DNA, 13 bp, D. melanogaster
gcatatataaatc

SEQ ID NO: 626146 - DNA, 13 bp, D. melanogaster
gcatatatacaca

SEQ ID NO: 626147 - DNA, 13 bp, D. melanogaster
gcatatatatata

SEQ ID NO: 626148 - DNA, 14 bp, D. melanogaster
gcatatatatgtac

SEQ ID NO: 626149 - DNA, 13 bp, D. melanogaster
gcatatatattct

SEQ ID NO: 626150 - DNA, 13 bp, D. melanogaster
gcatatatggcca

SEQ ID NO: 626151 - DNA, 13 bp, D. melanogaster
gcatatatgtaca

SEQ ID NO: 626152 - DNA, 13 bp, D. melanogaster
gcatatatgtata

SEQ ID NO: 626153 - DNA, 14 bp, D. melanogaster
gcatatatgtattt

SEQ ID NO: 626154 - DNA, 13 bp, D. melanogaster
gcatatattggtt

SEQ ID NO: 626155 - DNA, 13 bp, D. melanogaster
gcatatattgtat

SEQ ID NO: 626156 - DNA, 13 bp, D. melanogaster
gcatatatttgca

SEQ ID NO: 626157 - DNA, 13 bp, D. melanogaster
gcatatatttgta

SEQ ID NO: 626158 - DNA, 13 bp, D. melanogaster
gcatatcaaatta

SEQ ID NO: 626159 - DNA, 13 bp, D. melanogaster
gcatatgaaaatg

SEQ ID NO: 626160 - DNA, 13 bp, D. melanogaster
gcatatgaacttt

SEQ ID NO: 626161 - DNA, 13 bp, D. melanogaster
gcatatgcaaatt

SEQ ID NO: 626162 - DNA, 14 bp, D. melanogaster
gcatatgcatatat

SEQ ID NO: 626163 - DNA, 13 bp, D. melanogaster
gcatatgcatatt

SEQ ID NO: 626164 - DNA, 14 bp, D. melanogaster
gcatatgctgcagt

SEQ ID NO: 626165 - DNA, 13 bp, D. melanogaster
gcatatgcttttt

SEQ ID NO: 626166 - DNA, 13 bp, D. melanogaster
gcatatgtaaata

SEQ ID NO: 626167 - DNA, 13 bp, D. melanogaster
gcatatgtaaatg

SEQ ID NO: 626168 - DNA, 13 bp, D. melanogaster
gcatatgtataaa

SEQ ID NO: 626169 - DNA, 13 bp, D. melanogaster
gcatatgtggagg

SEQ ID NO: 626170 - DNA, 14 bp, D. melanogaster
gcatatgtggaggt

SEQ ID NO: 626171 - DNA, 13 bp, D. melanogaster
gcatatgtgtgcg

SEQ ID NO: 626172 - DNA, 14 bp, D. melanogaster
gcatatgtgtgtgt

SEQ ID NO: 626173 - DNA, 13 bp, D. melanogaster
gcatattaaaaaa

SEQ ID NO: 626174 - DNA, 13 bp, D. melanogaster
gcatattaaaaac

SEQ ID NO: 626175 - DNA, 14 bp, D. melanogaster
gcatattaaaaaca

SEQ ID NO: 626176 - DNA, 13 bp, D. melanogaster
gcatattaaaaat

SEQ ID NO: 626177 - DNA, 13 bp, D. melanogaster
gcatattaaatat

SEQ ID NO: 626178 - DNA, 13 bp, D. melanogaster
gcatattaaattg

SEQ ID NO: 626179 - DNA, 13 bp, D. melanogaster
gcatattaattgt

SEQ ID NO: 626180 - DNA, 13 bp, D. melanogaster
gcatattacgcat

SEQ ID NO: 626181 - DNA, 13 bp, D. melanogaster
gcatattcaaaaa

SEQ ID NO: 626182 - DNA, 13 bp, D. melanogaster
gcatattcattta

SEQ ID NO: 626183 - DNA, 13 bp, D. melanogaster
gcatattgaacgc

SEQ ID NO: 626184 - DNA, 13 bp, D. melanogaster
gcatattgcaaaa

SEQ ID NO: 626185 - DNA, 13 bp, D. melanogaster
gcatatttaataa

SEQ ID NO: 626186 - DNA, 14 bp, D. melanogaster
gcatatttaattaa

SEQ ID NO: 626187 - DNA, 13 bp, D. melanogaster
gcatatttatatt

SEQ ID NO: 626188 - DNA, 14 bp, D. melanogaster
gcatatttatattt

SEQ ID NO: 626189 - DNA, 13 bp, D. melanogaster
gcatatttattaa

SEQ ID NO: 626190 - DNA, 13 bp, D. melanogaster
gcatatttattta

SEQ ID NO: 626191 - DNA, 13 bp, D. melanogaster
gcatatttatttt

SEQ ID NO: 626192 - DNA, 13 bp, D. melanogaster
gcatatttcataa

SEQ ID NO: 626193 - DNA, 13 bp, D. melanogaster
gcatatttgatga

SEQ ID NO: 626194 - DNA, 13 bp, D. melanogaster
gcatattttataa

SEQ ID NO: 626195 - DNA, 13 bp, D. melanogaster
gcatattttattt

SEQ ID NO: 626196 - DNA, 13 bp, D. melanogaster
gcatattttcttt

SEQ ID NO: 626197 - DNA, 13 bp, D. melanogaster
gcatattttgcat

SEQ ID NO: 626198 - DNA, 13 bp, D. melanogaster
gcatattttgtgg

SEQ ID NO: 626199 - DNA, 13 bp, D. melanogaster
gcatatttttggg

SEQ ID NO: 626200 - DNA, 13 bp, D. melanogaster
gcatcaaaaacaa

SEQ ID NO: 626201 - DNA, 13 bp, D. melanogaster
gcatcaaaatcaa

SEQ ID NO: 626202 - DNA, 13 bp, D. melanogaster
gcatcaaattaaa

SEQ ID NO: 626203 - DNA, 13 bp, D. melanogaster
gcatcaaattgca

SEQ ID NO: 626204 - DNA, 13 bp, D. melanogaster
gcatcaacattgg

SEQ ID NO: 626205 - DNA, 13 bp, D. melanogaster
gcatcaagtatac

SEQ ID NO: 626206 - DNA, 13 bp, D. melanogaster
gcatcaccaactt

SEQ ID NO: 626207 - DNA, 13 bp, D. melanogaster
gcatcagaaaaat

SEQ ID NO: 626208 - DNA, 13 bp, D. melanogaster
gcatcagcaacag

SEQ ID NO: 626209 - DNA, 13 bp, D. melanogaster
gcatcagcaacat

SEQ ID NO: 626210 - DNA, 13 bp, D. melanogaster
gcatcagcagcaa

SEQ ID NO: 626211 - DNA, 13 bp, D. melanogaster
gcatcagcaggag

SEQ ID NO: 626212 - DNA, 13 bp, D. melanogaster
gcatcagcatcag

SEQ ID NO: 626213 - DNA, 14 bp, D. melanogaster
gcatcagcatcagc

SEQ ID NO: 626214 - DNA, 13 bp, D. melanogaster
gcatcagcatcat

SEQ ID NO: 626215 - DNA, 13 bp, D. melanogaster
gcatcataaattt

SEQ ID NO: 626216 - DNA, 13 bp, D. melanogaster
gcatcatagcttc

SEQ ID NO: 626217 - DNA, 13 bp, D. melanogaster
gcatcatcatcaa

SEQ ID NO: 626218 - DNA, 13 bp, D. melanogaster
gcatcatcatcag

SEQ ID NO: 626219 - DNA, 14 bp, D. melanogaster
gcatcatcatcagc

SEQ ID NO: 626220 - DNA, 14 bp, D. melanogaster
gcatcatcatcatt

SEQ ID NO: 626221 - DNA, 13 bp, D. melanogaster
gcatcatcatcgt

SEQ ID NO: 626222 - DNA, 14 bp, D. melanogaster
gcatcatcatcgtc

SEQ ID NO: 626223 - DNA, 13 bp, D. melanogaster
gcatcatgtggaa

SEQ ID NO: 626224 - DNA, 13 bp, D. melanogaster
gcatcattatcat

SEQ ID NO: 626225 - DNA, 14 bp, D. melanogaster
gcatcatttttgtt

SEQ ID NO: 626226 - DNA, 14 bp, D. melanogaster
gcatccacatccat

SEQ ID NO: 626227 - DNA, 14 bp, D. melanogaster
gcatccacatccgc

SEQ ID NO: 626228 - DNA, 14 bp, D. melanogaster
gcatccagaagtaa

SEQ ID NO: 626229 - DNA, 13 bp, D. melanogaster
gcatccagagctt

SEQ ID NO: 626230 - DNA, 13 bp, D. melanogaster
gcatccagcatcc

SEQ ID NO: 626231 - DNA, 13 bp, D. melanogaster
gcatccatatcca

SEQ ID NO: 626232 - DNA, 13 bp, D. melanogaster
gcatccatccaaa

SEQ ID NO: 626233 - DNA, 14 bp, D. melanogaster
gcatccatccatcc

SEQ ID NO: 626234 - DNA, 13 bp, D. melanogaster
gcatcccagcatc

SEQ ID NO: 626235 - DNA, 14 bp, D. melanogaster
gcatcccagcatcc

SEQ ID NO: 626236 - DNA, 13 bp, D. melanogaster
gcatccgaatccg

SEQ ID NO: 626237 - DNA, 13 bp, D. melanogaster
gcatccgcatcca

SEQ ID NO: 626238 - DNA, 13 bp, D. melanogaster
gcatccgcatctg

SEQ ID NO: 626239 - DNA, 13 bp, D. melanogaster
gcatccgtatccg

SEQ ID NO: 626240 - DNA, 13 bp, D. melanogaster
gcatcctgcacaa

SEQ ID NO: 626241 - DNA, 13 bp, D. melanogaster
gcatcctgcatcc

SEQ ID NO: 626242 - DNA, 14 bp, D. melanogaster
gcatcctgcatcct

SEQ ID NO: 626243 - DNA, 13 bp, D. melanogaster
gcatcctgcgagg

SEQ ID NO: 626244 - DNA, 13 bp, D. melanogaster
gcatcctggccag

SEQ ID NO: 626245 - DNA, 13 bp, D. melanogaster
gcatccttggctt

SEQ ID NO: 626246 - DNA, 13 bp, D. melanogaster
gcatcgaagctat

SEQ ID NO: 626247 - DNA, 14 bp, D. melanogaster
gcatcgaatcgaat

SEQ ID NO: 626248 - DNA, 13 bp, D. melanogaster
gcatcgacaacat

SEQ ID NO: 626249 - DNA, 13 bp, D. melanogaster
gcatcgatatata

SEQ ID NO: 626250 - DNA, 13 bp, D. melanogaster
gcatcgcatagag

SEQ ID NO: 626251 - DNA, 13 bp, D. melanogaster
gcatcgcatcgaa

SEQ ID NO: 626252 - DNA, 13 bp, D. melanogaster
gcatcgccatcgc

SEQ ID NO: 626253 - DNA, 13 bp, D. melanogaster
gcatcggcatcgg

SEQ ID NO: 626254 - DNA, 13 bp, D. melanogaster
gcatcgtcatcat

SEQ ID NO: 626255 - DNA, 14 bp, D. melanogaster
gcatcgtcatcatc

SEQ ID NO: 626256 - DNA, 13 bp, D. melanogaster
gcatctgaatctg

SEQ ID NO: 626257 - DNA, 13 bp, D. melanogaster
gcatctgcaagct

SEQ ID NO: 626258 - DNA, 13 bp, D. melanogaster
gcatctgcaccat

SEQ ID NO: 626259 - DNA, 13 bp, D. melanogaster
gcatctgcagcag

SEQ ID NO: 626260 - DNA, 13 bp, D. melanogaster
gcatctgcagctg

SEQ ID NO: 626261 - DNA, 13 bp, D. melanogaster
gcatctgcagttg

SEQ ID NO: 626262 - DNA, 14 bp, D. melanogaster
gcatctgcatctgt

SEQ ID NO: 626263 - DNA, 13 bp, D. melanogaster
gcatctgcatctt

SEQ ID NO: 626264 - DNA, 13 bp, D. melanogaster
gcatctgcatgtg

SEQ ID NO: 626265 - DNA, 13 bp, D. melanogaster
gcatctgcatttg

SEQ ID NO: 626266 - DNA, 14 bp, D. melanogaster
gcatctgctacatg

SEQ ID NO: 626267 - DNA, 13 bp, D. melanogaster
gcatctggagatc

SEQ ID NO: 626268 - DNA, 13 bp, D. melanogaster
gcatctggatctg

SEQ ID NO: 626269 - DNA, 14 bp, D. melanogaster
gcatctggatctgc

SEQ ID NO: 626270 - DNA, 13 bp, D. melanogaster
gcatctgtatctg

SEQ ID NO: 626271 - DNA, 14 bp, D. melanogaster
gcatctgtatctgc

SEQ ID NO: 626272 - DNA, 14 bp, D. melanogaster
gcatctgtatctgt

SEQ ID NO: 626273 - DNA, 13 bp, D. melanogaster
gcatctgtggtta

SEQ ID NO: 626274 - DNA, 14 bp, D. melanogaster
gcatctgtggttat

SEQ ID NO: 626275 - DNA, 13 bp, D. melanogaster
gcatctgtgtgtg

SEQ ID NO: 626276 - DNA, 13 bp, D. melanogaster
gcatcttggccaa

SEQ ID NO: 626277 - DNA, 13 bp, D. melanogaster
gcatctttgacat

SEQ ID NO: 626278 - DNA, 14 bp, D. melanogaster
gcatgaaaagtatt

SEQ ID NO: 626279 - DNA, 13 bp, D. melanogaster
gcatgaaaataaa

SEQ ID NO: 626280 - DNA, 13 bp, D. melanogaster
gcatgaaaatatt

SEQ ID NO: 626281 - DNA, 14 bp, D. melanogaster
gcatgaaaatgaaa

SEQ ID NO: 626282 - DNA, 13 bp, D. melanogaster
gcatgaaaatgca

SEQ ID NO: 626283 - DNA, 13 bp, D. melanogaster
gcatgaaaattgc

SEQ ID NO: 626284 - DNA, 13 bp, D. melanogaster
gcatgaaatgcaa

SEQ ID NO: 626285 - DNA, 13 bp, D. melanogaster
gcatgaataataa

SEQ ID NO: 626286 - DNA, 13 bp, D. melanogaster
gcatgaatggcac

SEQ ID NO: 626287 - DNA, 13 bp, D. melanogaster
gcatgatccatca

SEQ ID NO: 626288 - DNA, 13 bp, D. melanogaster
gcatgatggaatt

SEQ ID NO: 626289 - DNA, 13 bp, D. melanogaster
gcatgcaaaaaaa

SEQ ID NO: 626290 - DNA, 13 bp, D. melanogaster
gcatgcaaaatgc

SEQ ID NO: 626291 - DNA, 13 bp, D. melanogaster
gcatgcaaatcaa

SEQ ID NO: 626292 - DNA, 13 bp, D. melanogaster
gcatgcaaatcga

SEQ ID NO: 626293 - DNA, 13 bp, D. melanogaster
gcatgcaaatgca

SEQ ID NO: 626294 - DNA, 13 bp, D. melanogaster
gcatgcaaatggc

SEQ ID NO: 626295 - DNA, 13 bp, D. melanogaster
gcatgcaaattgg

SEQ ID NO: 626296 - DNA, 13 bp, D. melanogaster
gcatgcaaatttt

SEQ ID NO: 626297 - DNA, 13 bp, D. melanogaster
gcatgcaacagat

SEQ ID NO: 626298 - DNA, 13 bp, D. melanogaster
gcatgcaacagca

SEQ ID NO: 626299 - DNA, 13 bp, D. melanogaster
gcatgcaataaat

SEQ ID NO: 626300 - DNA, 14 bp, D. melanogaster
gcatgcaatttaaa

SEQ ID NO: 626301 - DNA, 13 bp, D. melanogaster
gcatgcacatgca

SEQ ID NO: 626302 - DNA, 13 bp, D. melanogaster
gcatgcagaaatc

SEQ ID NO: 626303 - DNA, 13 bp, D. melanogaster
gcatgcataattt

SEQ ID NO: 626304 - DNA, 13 bp, D. melanogaster
gcatgcatatgca

SEQ ID NO: 626305 - DNA, 13 bp, D. melanogaster
gcatgcatatgta

SEQ ID NO: 626306 - DNA, 13 bp, D. melanogaster
gcatgcattttta

SEQ ID NO: 626307 - DNA, 13 bp, D. melanogaster
gcatgccgcatgc

SEQ ID NO: 626308 - DNA, 13 bp, D. melanogaster
gcatgcgagaaaa

SEQ ID NO: 626309 - DNA, 13 bp, D. melanogaster
gcatgctgcatgc

SEQ ID NO: 626310 - DNA, 13 bp, D. melanogaster
gcatgctgcatgt

SEQ ID NO: 626311 - DNA, 13 bp, D. melanogaster
gcatgcttttagg

SEQ ID NO: 626312 - DNA, 14 bp, D. melanogaster
gcatgcttttaggc

SEQ ID NO: 626313 - DNA, 13 bp, D. melanogaster
gcatggaaaattg

SEQ ID NO: 626314 - DNA, 13 bp, D. melanogaster
gcatggaaatgaa

SEQ ID NO: 626315 - DNA, 13 bp, D. melanogaster
gcatggactggga

SEQ ID NO: 626316 - DNA, 13 bp, D. melanogaster
gcatggagtccac

SEQ ID NO: 626317 - DNA, 14 bp, D. melanogaster
gcatggagtccacc

SEQ ID NO: 626318 - DNA, 14 bp, D. melanogaster
gcatggccaccaaa

SEQ ID NO: 626319 - DNA, 13 bp, D. melanogaster
gcatggtgcatgg

SEQ ID NO: 626320 - DNA, 13 bp, D. melanogaster
gcatggtgccaat

SEQ ID NO: 626321 - DNA, 13 bp, D. melanogaster
gcatgtacataca

SEQ ID NO: 626322 - DNA, 14 bp, D. melanogaster
gcatgtacatacat

SEQ ID NO: 626323 - DNA, 13 bp, D. melanogaster
gcatgtatgtgtg

SEQ ID NO: 626324 - DNA, 14 bp, D. melanogaster
gcatgtatgtgtgt

SEQ ID NO: 626325 - DNA, 14 bp, D. melanogaster
gcatgtccagcacc

SEQ ID NO: 626326 - DNA, 13 bp, D. melanogaster
gcatgtgagcagc

SEQ ID NO: 626327 - DNA, 13 bp, D. melanogaster
gcatgtgagtgtg

SEQ ID NO: 626328 - DNA, 13 bp, D. melanogaster
gcatgtgcatctg

SEQ ID NO: 626329 - DNA, 13 bp, D. melanogaster
gcatgtgcgtgtg

SEQ ID NO: 626330 - DNA, 14 bp, D. melanogaster
gcatgtggcaagtg

SEQ ID NO: 626331 - DNA, 13 bp, D. melanogaster
gcatgtggcatgg

SEQ ID NO: 626332 - DNA, 13 bp, D. melanogaster
gcatgtggctggc

SEQ ID NO: 626333 - DNA, 13 bp, D. melanogaster
gcatgtgtatgtg

SEQ ID NO: 626334 - DNA, 13 bp, D. melanogaster
gcatgtgtgagtg

SEQ ID NO: 626335 - DNA, 13 bp, D. melanogaster
gcatgtgtgcgtg

SEQ ID NO: 626336 - DNA, 13 bp, D. melanogaster
gcatgtgtgtgag

SEQ ID NO: 626337 - DNA, 13 bp, D. melanogaster
gcatgtgtgtggg

SEQ ID NO: 626338 - DNA, 13 bp, D. melanogaster
gcatgtgtgtgtg

SEQ ID NO: 626339 - DNA, 14 bp, D. melanogaster
gcatgtgtgtgtgt

SEQ ID NO: 626340 - DNA, 14 bp, D. melanogaster
gcatgtgtgtgttt

SEQ ID NO: 626341 - DNA, 13 bp, D. melanogaster
gcatgtgtgtttc

SEQ ID NO: 626342 - DNA, 13 bp, D. melanogaster
gcatgtgtttgtg

SEQ ID NO: 626343 - DNA, 13 bp, D. melanogaster
gcatgttctactt

SEQ ID NO: 626344 - DNA, 13 bp, D. melanogaster
gcatgttgcacat

SEQ ID NO: 626345 - DNA, 13 bp, D. melanogaster
gcatgttgctgcc

SEQ ID NO: 626346 - DNA, 14 bp, D. melanogaster
gcatgttgctgctg

SEQ ID NO: 626347 - DNA, 13 bp, D. melanogaster
gcatgttggtcgc

SEQ ID NO: 626348 - DNA, 13 bp, D. melanogaster
gcatgtttggcat

SEQ ID NO: 626349 - DNA, 13 bp, D. melanogaster
gcattaaaaaata

SEQ ID NO: 626350 - DNA, 14 bp, D. melanogaster
gcattaaaaacaaa

SEQ ID NO: 626351 - DNA, 13 bp, D. melanogaster
gcattaaaaagca

SEQ ID NO: 626352 - DNA, 13 bp, D. melanogaster
gcattaaaatatt

SEQ ID NO: 626353 - DNA, 14 bp, D. melanogaster
gcattaaaattaaa

SEQ ID NO: 626354 - DNA, 13 bp, D. melanogaster
gcattaaacaaaa

SEQ ID NO: 626355 - DNA, 13 bp, D. melanogaster
gcattaaaccatc

SEQ ID NO: 626356 - DNA, 13 bp, D. melanogaster
gcattaaagagct

SEQ ID NO: 626357 - DNA, 13 bp, D. melanogaster
gcattaaagataa

SEQ ID NO: 626358 - DNA, 13 bp, D. melanogaster
gcattaaataaaa

SEQ ID NO: 626359 - DNA, 13 bp, D. melanogaster
gcattaaataact

SEQ ID NO: 626360 - DNA, 13 bp, D. melanogaster
gcattaaataata

SEQ ID NO: 626361 - DNA, 13 bp, D. melanogaster
gcattaaatataa

SEQ ID NO: 626362 - DNA, 14 bp, D. melanogaster
gcattaaatattaa

SEQ ID NO: 626363 - DNA, 13 bp, D. melanogaster
gcattaaattaat

SEQ ID NO: 626364 - DNA, 13 bp, D. melanogaster
gcattaaattatt

SEQ ID NO: 626365 - DNA, 13 bp, D. melanogaster
gcattaaatttat

SEQ ID NO: 626366 - DNA, 13 bp, D. melanogaster
gcattaacaattt

SEQ ID NO: 626367 - DNA, 13 bp, D. melanogaster
gcattaacattta

SEQ ID NO: 626368 - DNA, 13 bp, D. melanogaster
gcattaaggaaga

SEQ ID NO: 626369 - DNA, 13 bp, D. melanogaster
gcattaatataaa

SEQ ID NO: 626370 - DNA, 13 bp, D. melanogaster
gcattaatattaa

SEQ ID NO: 626371 - DNA, 13 bp, D. melanogaster
gcattaatcaatt

SEQ ID NO: 626372 - DNA, 13 bp, D. melanogaster
gcattaatgcgtt

SEQ ID NO: 626373 - DNA, 13 bp, D. melanogaster
gcattaattaata

SEQ ID NO: 626374 - DNA, 13 bp, D. melanogaster
gcattaattatgg

SEQ ID NO: 626375 - DNA, 13 bp, D. melanogaster
gcattaatttcgc

SEQ ID NO: 626376 - DNA, 13 bp, D. melanogaster
gcattaattttta

SEQ ID NO: 626377 - DNA, 13 bp, D. melanogaster
gcattagcacatg

SEQ ID NO: 626378 - DNA, 14 bp, D. melanogaster
gcattagcacatgt

SEQ ID NO: 626379 - DNA, 13 bp, D. melanogaster
gcattagcataaa

SEQ ID NO: 626380 - DNA, 13 bp, D. melanogaster
gcattagcattag

SEQ ID NO: 626381 - DNA, 14 bp, D. melanogaster
gcattagcattagc

SEQ ID NO: 626382 - DNA, 13 bp, D. melanogaster
gcattataaatac

SEQ ID NO: 626383 - DNA, 14 bp, D. melanogaster
gcattataaataca

SEQ ID NO: 626384 - DNA, 13 bp, D. melanogaster
gcattataaatta

SEQ ID NO: 626385 - DNA, 13 bp, D. melanogaster
gcattataataaa

SEQ ID NO: 626386 - DNA, 14 bp, D. melanogaster
gcattataattacc

SEQ ID NO: 626387 - DNA, 13 bp, D. melanogaster
gcattatatatat

SEQ ID NO: 626388 - DNA, 13 bp, D. melanogaster
gcattatcatcat

SEQ ID NO: 626389 - DNA, 13 bp, D. melanogaster
gcattatgtacat

SEQ ID NO: 626390 - DNA, 13 bp, D. melanogaster
gcattattattat

SEQ ID NO: 626391 - DNA, 13 bp, D. melanogaster
gcattattattgt

SEQ ID NO: 626392 - DNA, 13 bp, D. melanogaster
gcattattatttt

SEQ ID NO: 626393 - DNA, 13 bp, D. melanogaster
gcattatttatgc

SEQ ID NO: 626394 - DNA, 13 bp, D. melanogaster
gcattatttatta

SEQ ID NO: 626395 - DNA, 13 bp, D. melanogaster
gcattcaaaaaaa

SEQ ID NO: 626396 - DNA, 13 bp, D. melanogaster
gcattcaaaaata

SEQ ID NO: 626397 - DNA, 13 bp, D. melanogaster
gcattcaaaacaa

SEQ ID NO: 626398 - DNA, 13 bp, D. melanogaster
gcattcaaaatgc

SEQ ID NO: 626399 - DNA, 13 bp, D. melanogaster
gcattcaaacaaa

SEQ ID NO: 626400 - DNA, 13 bp, D. melanogaster
gcattcaaatgtt

SEQ ID NO: 626401 - DNA, 13 bp, D. melanogaster
gcattcaaattaa

SEQ ID NO: 626402 - DNA, 13 bp, D. melanogaster
gcattcaaattca

SEQ ID NO: 626403 - DNA, 13 bp, D. melanogaster
gcattcaaatttt

SEQ ID NO: 626404 - DNA, 13 bp, D. melanogaster
gcattcaacattc

SEQ ID NO: 626405 - DNA, 13 bp, D. melanogaster
gcattcaacgtga

SEQ ID NO: 626406 - DNA, 13 bp, D. melanogaster
gcattcaattgaa

SEQ ID NO: 626407 - DNA, 13 bp, D. melanogaster
gcattcacattca

SEQ ID NO: 626408 - DNA, 13 bp, D. melanogaster
gcattcagcattc

SEQ ID NO: 626409 - DNA, 13 bp, D. melanogaster
gcattcaggatgt

SEQ ID NO: 626410 - DNA, 14 bp, D. melanogaster
gcattcaggatgtt

SEQ ID NO: 626411 - DNA, 13 bp, D. melanogaster
gcattcagtttgc

SEQ ID NO: 626412 - DNA, 13 bp, D. melanogaster
gcattcagttttc

SEQ ID NO: 626413 - DNA, 14 bp, D. melanogaster
gcattcagttttcg

SEQ ID NO: 626414 - DNA, 13 bp, D. melanogaster
gcattcatttgaa

SEQ ID NO: 626415 - DNA, 13 bp, D. melanogaster
gcattcattttgt

SEQ ID NO: 626416 - DNA, 13 bp, D. melanogaster
gcattccatttcc

SEQ ID NO: 626417 - DNA, 13 bp, D. melanogaster
gcattcccagcta

SEQ ID NO: 626418 - DNA, 13 bp, D. melanogaster
gcattcgaaaaac

SEQ ID NO: 626419 - DNA, 13 bp, D. melanogaster
gcattcgcacaca

SEQ ID NO: 626420 - DNA, 13 bp, D. melanogaster
gcattcgcaggag

SEQ ID NO: 626421 - DNA, 13 bp, D. melanogaster
gcattcgcatcca

SEQ ID NO: 626422 - DNA, 13 bp, D. melanogaster
gcattcggaaaat

SEQ ID NO: 626423 - DNA, 13 bp, D. melanogaster
gcattcggattcg

SEQ ID NO: 626424 - DNA, 13 bp, D. melanogaster
gcattcggcattc

SEQ ID NO: 626425 - DNA, 13 bp, D. melanogaster
gcattcggcattt

SEQ ID NO: 626426 - DNA, 13 bp, D. melanogaster
gcattcggccgga

SEQ ID NO: 626427 - DNA, 13 bp, D. melanogaster
gcattcgtgttcc

SEQ ID NO: 626428 - DNA, 13 bp, D. melanogaster
gcattcgttttat

SEQ ID NO: 626429 - DNA, 13 bp, D. melanogaster
gcattctatagtt

SEQ ID NO: 626430 - DNA, 13 bp, D. melanogaster
gcattctgcattc

SEQ ID NO: 626431 - DNA, 13 bp, D. melanogaster
gcattctgcgaag

SEQ ID NO: 626432 - DNA, 13 bp, D. melanogaster
gcattcttggagt

SEQ ID NO: 626433 - DNA, 13 bp, D. melanogaster
gcattgaaaatga

SEQ ID NO: 626434 - DNA, 14 bp, D. melanogaster
gcattgaaaatgaa

SEQ ID NO: 626435 - DNA, 13 bp, D. melanogaster
gcattgaaaatgt

SEQ ID NO: 626436 - DNA, 13 bp, D. melanogaster
gcattgaaattaa

SEQ ID NO: 626437 - DNA, 13 bp, D. melanogaster
gcattgaactttg

SEQ ID NO: 626438 - DNA, 13 bp, D. melanogaster
gcattgaatttca

SEQ ID NO: 626439 - DNA, 13 bp, D. melanogaster
gcattgaccacag

SEQ ID NO: 626440 - DNA, 13 bp, D. melanogaster
gcattgaccactt

SEQ ID NO: 626441 - DNA, 13 bp, D. melanogaster
gcattgactttga

SEQ ID NO: 626442 - DNA, 13 bp, D. melanogaster
gcattgattgaaa

SEQ ID NO: 626443 - DNA, 13 bp, D. melanogaster
gcattgattgatt

SEQ ID NO: 626444 - DNA, 13 bp, D. melanogaster
gcattgatttaat

SEQ ID NO: 626445 - DNA, 14 bp, D. melanogaster
gcattgatttaatc

SEQ ID NO: 626446 - DNA, 13 bp, D. melanogaster
gcattgatttttc

SEQ ID NO: 626447 - DNA, 13 bp, D. melanogaster
gcattgcaaaaaa

SEQ ID NO: 626448 - DNA, 13 bp, D. melanogaster
gcattgcaaaatg

SEQ ID NO: 626449 - DNA, 13 bp, D. melanogaster
gcattgcaaatta

SEQ ID NO: 626450 - DNA, 13 bp, D. melanogaster
gcattgcaacaaa

SEQ ID NO: 626451 - DNA, 13 bp, D. melanogaster
gcattgcacattt

SEQ ID NO: 626452 - DNA, 13 bp, D. melanogaster
gcattgcagttgc

SEQ ID NO: 626453 - DNA, 13 bp, D. melanogaster
gcattgcataaat

SEQ ID NO: 626454 - DNA, 14 bp, D. melanogaster
gcattgcataaata

SEQ ID NO: 626455 - DNA, 14 bp, D. melanogaster
gcattgcatacttt

SEQ ID NO: 626456 - DNA, 13 bp, D. melanogaster
gcattgcattgaa

SEQ ID NO: 626457 - DNA, 14 bp, D. melanogaster
gcattgcattgcat

SEQ ID NO: 626458 - DNA, 13 bp, D. melanogaster
gcattgcatttgt

SEQ ID NO: 626459 - DNA, 13 bp, D. melanogaster
gcattgcattttt

SEQ ID NO: 626460 - DNA, 13 bp, D. melanogaster
gcattgcccactc

SEQ ID NO: 626461 - DNA, 13 bp, D. melanogaster
gcattgcgtttat

SEQ ID NO: 626462 - DNA, 13 bp, D. melanogaster
gcattgcttttat

SEQ ID NO: 626463 - DNA, 14 bp, D. melanogaster
gcattggataccat

SEQ ID NO: 626464 - DNA, 13 bp, D. melanogaster
gcattggcaacaa

SEQ ID NO: 626465 - DNA, 13 bp, D. melanogaster
gcattggcagtgg

SEQ ID NO: 626466 - DNA, 14 bp, D. melanogaster
gcattggcattggc

SEQ ID NO: 626467 - DNA, 13 bp, D. melanogaster
gcattgtaaatta

SEQ ID NO: 626468 - DNA, 13 bp, D. melanogaster
gcattgtaaattt

SEQ ID NO: 626469 - DNA, 13 bp, D. melanogaster
gcattgtaattaa

SEQ ID NO: 626470 - DNA, 13 bp, D. melanogaster
gcattgtgaacat

SEQ ID NO: 626471 - DNA, 13 bp, D. melanogaster
gcattgttattgc

SEQ ID NO: 626472 - DNA, 14 bp, D. melanogaster
gcattgttcacgtt

SEQ ID NO: 626473 - DNA, 13 bp, D. melanogaster
gcattgttggaat

SEQ ID NO: 626474 - DNA, 13 bp, D. melanogaster
gcattgtttaatt

SEQ ID NO: 626475 - DNA, 13 bp, D. melanogaster
gcattgtttacat

SEQ ID NO: 626476 - DNA, 13 bp, D. melanogaster
gcattgtttctgt

SEQ ID NO: 626477 - DNA, 13 bp, D. melanogaster
gcattgtttgcat

SEQ ID NO: 626478 - DNA, 13 bp, D. melanogaster
gcattgtttgtct

SEQ ID NO: 626479 - DNA, 13 bp, D. melanogaster
gcattgttttgtt

SEQ ID NO: 626480 - DNA, 13 bp, D. melanogaster
gcattgtttttat

SEQ ID NO: 626481 - DNA, 13 bp, D. melanogaster
gcatttaaaaagt

SEQ ID NO: 626482 - DNA, 14 bp, D. melanogaster
gcatttaaaaatat

SEQ ID NO: 626483 - DNA, 13 bp, D. melanogaster
gcatttaaaattg

SEQ ID NO: 626484 - DNA, 13 bp, D. melanogaster
gcatttaaacaat

SEQ ID NO: 626485 - DNA, 13 bp, D. melanogaster
gcatttaaagtat

SEQ ID NO: 626486 - DNA, 13 bp, D. melanogaster
gcatttaaagttg

SEQ ID NO: 626487 - DNA, 14 bp, D. melanogaster
gcatttaaataaat

SEQ ID NO: 626488 - DNA, 13 bp, D. melanogaster
gcatttaaataca

SEQ ID NO: 626489 - DNA, 13 bp, D. melanogaster
gcatttaaatata

SEQ ID NO: 626490 - DNA, 13 bp, D. melanogaster
gcatttaaatatt

SEQ ID NO: 626491 - DNA, 14 bp, D. melanogaster
gcatttaaatattt

SEQ ID NO: 626492 - DNA, 13 bp, D. melanogaster
gcatttaaatggt

SEQ ID NO: 626493 - DNA, 13 bp, D. melanogaster
gcatttaaatgtg

SEQ ID NO: 626494 - DNA, 13 bp, D. melanogaster
gcatttaaattaa

SEQ ID NO: 626495 - DNA, 13 bp, D. melanogaster
gcatttaaattca

SEQ ID NO: 626496 - DNA, 14 bp, D. melanogaster
gcatttaaatttat

SEQ ID NO: 626497 - DNA, 14 bp, D. melanogaster
gcatttaacatttt

SEQ ID NO: 626498 - DNA, 13 bp, D. melanogaster
gcatttaagcatt

SEQ ID NO: 626499 - DNA, 13 bp, D. melanogaster
gcatttaataatc

SEQ ID NO: 626500 - DNA, 13 bp, D. melanogaster
gcatttaatattt

SEQ ID NO: 626501 - DNA, 13 bp, D. melanogaster
gcatttaatggca

SEQ ID NO: 626502 - DNA, 13 bp, D. melanogaster
gcatttaatgtaa

SEQ ID NO: 626503 - DNA, 13 bp, D. melanogaster
gcatttaattagc

SEQ ID NO: 626504 - DNA, 14 bp, D. melanogaster
gcatttaattattt

SEQ ID NO: 626505 - DNA, 13 bp, D. melanogaster
gcatttaattggc

SEQ ID NO: 626506 - DNA, 13 bp, D. melanogaster
gcatttaatttaa

SEQ ID NO: 626507 - DNA, 13 bp, D. melanogaster
gcatttaattttt

SEQ ID NO: 626508 - DNA, 13 bp, D. melanogaster
gcatttacaaatt

SEQ ID NO: 626509 - DNA, 15 bp, D. melanogaster
gcatttaccaaaaac

SEQ ID NO: 626510 - DNA, 13 bp, D. melanogaster
gcatttactttgc

SEQ ID NO: 626511 - DNA, 13 bp, D. melanogaster
gcatttagaatta

SEQ ID NO: 626512 - DNA, 13 bp, D. melanogaster
gcatttagcattt

SEQ ID NO: 626513 - DNA, 13 bp, D. melanogaster
gcatttataaaaa

SEQ ID NO: 626514 - DNA, 13 bp, D. melanogaster
gcatttataaata

SEQ ID NO: 626515 - DNA, 13 bp, D. melanogaster
gcatttatatatg

SEQ ID NO: 626516 - DNA, 13 bp, D. melanogaster
gcatttatattta

SEQ ID NO: 626517 - DNA, 13 bp, D. melanogaster
gcatttatcaaat

SEQ ID NO: 626518 - DNA, 13 bp, D. melanogaster
gcatttatgagcc

SEQ ID NO: 626519 - DNA, 13 bp, D. melanogaster
gcatttatgcaaa

SEQ ID NO: 626520 - DNA, 13 bp, D. melanogaster
gcatttatgtaaa

SEQ ID NO: 626521 - DNA, 13 bp, D. melanogaster
gcatttatgtttt

SEQ ID NO: 626522 - DNA, 14 bp, D. melanogaster
gcatttattaattt

SEQ ID NO: 626523 - DNA, 13 bp, D. melanogaster
gcatttattgcca

SEQ ID NO: 626524 - DNA, 13 bp, D. melanogaster
gcatttattgtgc

SEQ ID NO: 626525 - DNA, 13 bp, D. melanogaster
gcatttatttatg

SEQ ID NO: 626526 - DNA, 13 bp, D. melanogaster
gcatttatttcaa

SEQ ID NO: 626527 - DNA, 13 bp, D. melanogaster
gcatttatttctt

SEQ ID NO: 626528 - DNA, 13 bp, D. melanogaster
gcatttattttcg

SEQ ID NO: 626529 - DNA, 13 bp, D. melanogaster
gcatttattttct

SEQ ID NO: 626530 - DNA, 14 bp, D. melanogaster
gcatttattttgca

SEQ ID NO: 626531 - DNA, 13 bp, D. melanogaster
gcatttatttttg

SEQ ID NO: 626532 - DNA, 13 bp, D. melanogaster
gcatttcaaaatt

SEQ ID NO: 626533 - DNA, 14 bp, D. melanogaster
gcatttcaaatgca

SEQ ID NO: 626534 - DNA, 13 bp, D. melanogaster
gcatttcaaattg

SEQ ID NO: 626535 - DNA, 13 bp, D. melanogaster
gcatttcaaggtt

SEQ ID NO: 626536 - DNA, 14 bp, D. melanogaster
gcatttcaaggttt

SEQ ID NO: 626537 - DNA, 13 bp, D. melanogaster
gcatttcaataat

SEQ ID NO: 626538 - DNA, 13 bp, D. melanogaster
gcatttcaatcaa

SEQ ID NO: 626539 - DNA, 13 bp, D. melanogaster
gcatttcaattgt

SEQ ID NO: 626540 - DNA, 13 bp, D. melanogaster
gcatttcaatttg

SEQ ID NO: 626541 - DNA, 13 bp, D. melanogaster
gcatttcaccatt

SEQ ID NO: 626542 - DNA, 13 bp, D. melanogaster
gcatttcactttg

SEQ ID NO: 626543 - DNA, 13 bp, D. melanogaster
gcatttcatgcat

SEQ ID NO: 626544 - DNA, 13 bp, D. melanogaster
gcatttcattaaa

SEQ ID NO: 626545 - DNA, 14 bp, D. melanogaster
gcatttcattcatt

SEQ ID NO: 626546 - DNA, 14 bp, D. melanogaster
gcatttcatttaat

SEQ ID NO: 626547 - DNA, 13 bp, D. melanogaster
gcatttcatttgc

SEQ ID NO: 626548 - DNA, 14 bp, D. melanogaster
gcatttcatttgca

SEQ ID NO: 626549 - DNA, 13 bp, D. melanogaster
gcatttcattttc

SEQ ID NO: 626550 - DNA, 13 bp, D. melanogaster
gcatttccacatt

SEQ ID NO: 626551 - DNA, 13 bp, D. melanogaster
gcatttccagctg

SEQ ID NO: 626552 - DNA, 13 bp, D. melanogaster
gcatttccagttt

SEQ ID NO: 626553 - DNA, 13 bp, D. melanogaster
gcatttccattgc

SEQ ID NO: 626554 - DNA, 13 bp, D. melanogaster
gcatttccatttc

SEQ ID NO: 626555 - DNA, 13 bp, D. melanogaster
gcatttccatttt

SEQ ID NO: 626556 - DNA, 13 bp, D. melanogaster
gcatttcctttgc

SEQ ID NO: 626557 - DNA, 13 bp, D. melanogaster
gcatttcctttgg

SEQ ID NO: 626558 - DNA, 13 bp, D. melanogaster
gcatttccttttt

SEQ ID NO: 626559 - DNA, 13 bp, D. melanogaster
gcatttcgaaact

SEQ ID NO: 626560 - DNA, 13 bp, D. melanogaster
gcatttcgaatgg

SEQ ID NO: 626561 - DNA, 13 bp, D. melanogaster
gcatttcgagcga

SEQ ID NO: 626562 - DNA, 13 bp, D. melanogaster
gcatttcgagtgc

SEQ ID NO: 626563 - DNA, 13 bp, D. melanogaster
gcatttcgatttg

SEQ ID NO: 626564 - DNA, 13 bp, D. melanogaster
gcatttcgcattc

SEQ ID NO: 626565 - DNA, 13 bp, D. melanogaster
gcatttcgcattt

SEQ ID NO: 626566 - DNA, 14 bp, D. melanogaster
gcatttcgcatttg

SEQ ID NO: 626567 - DNA, 13 bp, D. melanogaster
gcatttcgctaat

SEQ ID NO: 626568 - DNA, 13 bp, D. melanogaster
gcatttcgctggc

SEQ ID NO: 626569 - DNA, 13 bp, D. melanogaster
gcatttcggattt

SEQ ID NO: 626570 - DNA, 13 bp, D. melanogaster
gcatttcgtttta

SEQ ID NO: 626571 - DNA, 13 bp, D. melanogaster
gcatttctaattt

SEQ ID NO: 626572 - DNA, 13 bp, D. melanogaster
gcatttcttaaat

SEQ ID NO: 626573 - DNA, 13 bp, D. melanogaster
gcatttctttggt

SEQ ID NO: 626574 - DNA, 13 bp, D. melanogaster
gcatttctttttg

SEQ ID NO: 626575 - DNA, 13 bp, D. melanogaster
gcatttgaaaata

SEQ ID NO: 626576 - DNA, 14 bp, D. melanogaster
gcatttgaaaataa

SEQ ID NO: 626577 - DNA, 13 bp, D. melanogaster
gcatttgaaatga

SEQ ID NO: 626578 - DNA, 13 bp, D. melanogaster
gcatttgaaattc

SEQ ID NO: 626579 - DNA, 13 bp, D. melanogaster
gcatttgaatggc

SEQ ID NO: 626580 - DNA, 13 bp, D. melanogaster
gcatttgaatgtg

SEQ ID NO: 626581 - DNA, 13 bp, D. melanogaster
gcatttgaattgt

SEQ ID NO: 626582 - DNA, 13 bp, D. melanogaster
gcatttgaatttt

SEQ ID NO: 626583 - DNA, 13 bp, D. melanogaster
gcatttgataaag

SEQ ID NO: 626584 - DNA, 13 bp, D. melanogaster
gcatttgatcttc

SEQ ID NO: 626585 - DNA, 14 bp, D. melanogaster
gcatttgatcttcg

SEQ ID NO: 626586 - DNA, 13 bp, D. melanogaster
gcatttgattgat

SEQ ID NO: 626587 - DNA, 13 bp, D. melanogaster
gcatttgatttgg

SEQ ID NO: 626588 - DNA, 13 bp, D. melanogaster
gcatttgatttta

SEQ ID NO: 626589 - DNA, 13 bp, D. melanogaster
gcatttgattttt

SEQ ID NO: 626590 - DNA, 13 bp, D. melanogaster
gcatttgcaaatt

SEQ ID NO: 626591 - DNA, 13 bp, D. melanogaster
gcatttgcaatgc

SEQ ID NO: 626592 - DNA, 13 bp, D. melanogaster
gcatttgcagttg

SEQ ID NO: 626593 - DNA, 13 bp, D. melanogaster
gcatttgcataat

SEQ ID NO: 626594 - DNA, 13 bp, D. melanogaster
gcatttgcatatg

SEQ ID NO: 626595 - DNA, 13 bp, D. melanogaster
gcatttgcatctg

SEQ ID NO: 626596 - DNA, 13 bp, D. melanogaster
gcatttgcatgtg

SEQ ID NO: 626597 - DNA, 13 bp, D. melanogaster
gcatttgcattcg

SEQ ID NO: 626598 - DNA, 13 bp, D. melanogaster
gcatttgcattgg

SEQ ID NO: 626599 - DNA, 13 bp, D. melanogaster
gcatttgcattgt

SEQ ID NO: 626600 - DNA, 13 bp, D. melanogaster
gcatttgcatttg

SEQ ID NO: 626601 - DNA, 14 bp, D. melanogaster
gcatttgcatttga

SEQ ID NO: 626602 - DNA, 13 bp, D. melanogaster
gcatttgccattt

SEQ ID NO: 626603 - DNA, 14 bp, D. melanogaster
gcatttgccatttg

SEQ ID NO: 626604 - DNA, 14 bp, D. melanogaster
gcatttgcccaact

SEQ ID NO: 626605 - DNA, 13 bp, D. melanogaster
gcatttgccgctt

SEQ ID NO: 626606 - DNA, 13 bp, D. melanogaster
gcatttgctacct

SEQ ID NO: 626607 - DNA, 13 bp, D. melanogaster
gcatttgctgcaa

SEQ ID NO: 626608 - DNA, 13 bp, D. melanogaster
gcatttgctgcat

SEQ ID NO: 626609 - DNA, 13 bp, D. melanogaster
gcatttgctgcga

SEQ ID NO: 626610 - DNA, 13 bp, D. melanogaster
gcatttgctggcc

SEQ ID NO: 626611 - DNA, 13 bp, D. melanogaster
gcatttgctttgc

SEQ ID NO: 626612 - DNA, 13 bp, D. melanogaster
gcatttgcttttg

SEQ ID NO: 626613 - DNA, 13 bp, D. melanogaster
gcatttgcttttt

SEQ ID NO: 626614 - DNA, 13 bp, D. melanogaster
gcatttggaaatg

SEQ ID NO: 626615 - DNA, 13 bp, D. melanogaster
gcatttggaattc

SEQ ID NO: 626616 - DNA, 13 bp, D. melanogaster
gcatttggatttg

SEQ ID NO: 626617 - DNA, 13 bp, D. melanogaster
gcatttggcaaac

SEQ ID NO: 626618 - DNA, 13 bp, D. melanogaster
gcatttggcaaag

SEQ ID NO: 626619 - DNA, 13 bp, D. melanogaster
gcatttggcattt

SEQ ID NO: 626620 - DNA, 14 bp, D. melanogaster
gcatttggcatttg

SEQ ID NO: 626621 - DNA, 13 bp, D. melanogaster
gcatttggccaaa

SEQ ID NO: 626622 - DNA, 13 bp, D. melanogaster
gcatttggccata

SEQ ID NO: 626623 - DNA, 13 bp, D. melanogaster
gcatttggccatt

SEQ ID NO: 626624 - DNA, 13 bp, D. melanogaster
gcatttggccgga

SEQ ID NO: 626625 - DNA, 13 bp, D. melanogaster
gcatttggcttaa

SEQ ID NO: 626626 - DNA, 13 bp, D. melanogaster
gcatttgggaaat

SEQ ID NO: 626627 - DNA, 13 bp, D. melanogaster
gcatttgtaattt

SEQ ID NO: 626628 - DNA, 13 bp, D. melanogaster
gcatttgtacata

SEQ ID NO: 626629 - DNA, 13 bp, D. melanogaster
gcatttgtatatt

SEQ ID NO: 626630 - DNA, 13 bp, D. melanogaster
gcatttgtatctg

SEQ ID NO: 626631 - DNA, 13 bp, D. melanogaster
gcatttgtgcata

SEQ ID NO: 626632 - DNA, 14 bp, D. melanogaster
gcatttgtgcattt

SEQ ID NO: 626633 - DNA, 13 bp, D. melanogaster
gcatttgtggcat

SEQ ID NO: 626634 - DNA, 13 bp, D. melanogaster
gcatttgtgtgtg

SEQ ID NO: 626635 - DNA, 13 bp, D. melanogaster
gcatttgtgttgg

SEQ ID NO: 626636 - DNA, 13 bp, D. melanogaster
gcatttgttattg

SEQ ID NO: 626637 - DNA, 13 bp, D. melanogaster
gcatttgttgagc

SEQ ID NO: 626638 - DNA, 13 bp, D. melanogaster
gcatttgttggcc

SEQ ID NO: 626639 - DNA, 13 bp, D. melanogaster
gcatttgttgtta

SEQ ID NO: 626640 - DNA, 13 bp, D. melanogaster
gcatttgttgttg

SEQ ID NO: 626641 - DNA, 13 bp, D. melanogaster
gcatttgtttaca

SEQ ID NO: 626642 - DNA, 13 bp, D. melanogaster
gcatttgtttatg

SEQ ID NO: 626643 - DNA, 13 bp, D. melanogaster
gcatttgtttgct

SEQ ID NO: 626644 - DNA, 13 bp, D. melanogaster
gcatttgtttgtt

SEQ ID NO: 626645 - DNA, 13 bp, D. melanogaster
gcatttgttttat

SEQ ID NO: 626646 - DNA, 13 bp, D. melanogaster
gcatttgttttcg

SEQ ID NO: 626647 - DNA, 13 bp, D. melanogaster
gcatttgttttta

SEQ ID NO: 626648 - DNA, 13 bp, D. melanogaster
gcatttgtttttg

SEQ ID NO: 626649 - DNA, 14 bp, D. melanogaster
gcatttgtttttgt

SEQ ID NO: 626650 - DNA, 14 bp, D. melanogaster
gcattttaaacaaa

SEQ ID NO: 626651 - DNA, 13 bp, D. melanogaster
gcattttaaagtt

SEQ ID NO: 626652 - DNA, 13 bp, D. melanogaster
gcattttaaataa

SEQ ID NO: 626653 - DNA, 14 bp, D. melanogaster
gcattttaaatatt

SEQ ID NO: 626654 - DNA, 14 bp, D. melanogaster
gcattttaaattaa

SEQ ID NO: 626655 - DNA, 13 bp, D. melanogaster
gcattttaattgc

SEQ ID NO: 626656 - DNA, 14 bp, D. melanogaster
gcattttaatttta

SEQ ID NO: 626657 - DNA, 13 bp, D. melanogaster
gcattttactttt

SEQ ID NO: 626658 - DNA, 13 bp, D. melanogaster
gcattttataatt

SEQ ID NO: 626659 - DNA, 13 bp, D. melanogaster
gcattttatgtaa

SEQ ID NO: 626660 - DNA, 13 bp, D. melanogaster
gcattttatttaa

SEQ ID NO: 626661 - DNA, 14 bp, D. melanogaster
gcattttatttaat

SEQ ID NO: 626662 - DNA, 13 bp, D. melanogaster
gcattttatttat

SEQ ID NO: 626663 - DNA, 14 bp, D. melanogaster
gcattttatttata

SEQ ID NO: 626664 - DNA, 13 bp, D. melanogaster
gcattttcaaaaa

SEQ ID NO: 626665 - DNA, 13 bp, D. melanogaster
gcattttcaaatt

SEQ ID NO: 626666 - DNA, 13 bp, D. melanogaster
gcattttcaggtt

SEQ ID NO: 626667 - DNA, 13 bp, D. melanogaster
gcattttcataat

SEQ ID NO: 626668 - DNA, 13 bp, D. melanogaster
gcattttcatatt

SEQ ID NO: 626669 - DNA, 13 bp, D. melanogaster
gcattttcattgt

SEQ ID NO: 626670 - DNA, 13 bp, D. melanogaster
gcattttcattta

SEQ ID NO: 626671 - DNA, 14 bp, D. melanogaster
gcattttcatttaa

SEQ ID NO: 626672 - DNA, 13 bp, D. melanogaster
gcattttcatttc

SEQ ID NO: 626673 - DNA, 14 bp, D. melanogaster
gcattttcatttcg

SEQ ID NO: 626674 - DNA, 13 bp, D. melanogaster
gcattttccatat

SEQ ID NO: 626675 - DNA, 13 bp, D. melanogaster
gcattttccgctc

SEQ ID NO: 626676 - DNA, 13 bp, D. melanogaster
gcattttccgctt

SEQ ID NO: 626677 - DNA, 13 bp, D. melanogaster
gcattttccggct

SEQ ID NO: 626678 - DNA, 13 bp, D. melanogaster
gcattttcctctg

SEQ ID NO: 626679 - DNA, 14 bp, D. melanogaster
gcattttcgcattt

SEQ ID NO: 626680 - DNA, 13 bp, D. melanogaster
gcattttctccaa

SEQ ID NO: 626681 - DNA, 13 bp, D. melanogaster
gcattttctgcat

SEQ ID NO: 626682 - DNA, 13 bp, D. melanogaster
gcattttctgctt

SEQ ID NO: 626683 - DNA, 13 bp, D. melanogaster
gcattttctggtc

SEQ ID NO: 626684 - DNA, 14 bp, D. melanogaster
gcattttctttgtt

SEQ ID NO: 626685 - DNA, 13 bp, D. melanogaster
gcattttgaaata

SEQ ID NO: 626686 - DNA, 13 bp, D. melanogaster
gcattttgaatat

SEQ ID NO: 626687 - DNA, 13 bp, D. melanogaster
gcattttgaatgc

SEQ ID NO: 626688 - DNA, 13 bp, D. melanogaster
gcattttgcaaat

SEQ ID NO: 626689 - DNA, 13 bp, D. melanogaster
gcattttgcaatt

SEQ ID NO: 626690 - DNA, 14 bp, D. melanogaster
gcattttgcaattt

SEQ ID NO: 626691 - DNA, 13 bp, D. melanogaster
gcattttgcatat

SEQ ID NO: 626692 - DNA, 13 bp, D. melanogaster
gcattttgcatgc

SEQ ID NO: 626693 - DNA, 13 bp, D. melanogaster
gcattttgcattc

SEQ ID NO: 626694 - DNA, 13 bp, D. melanogaster
gcattttgcattg

SEQ ID NO: 626695 - DNA, 13 bp, D. melanogaster
gcattttgcattt

SEQ ID NO: 626696 - DNA, 14 bp, D. melanogaster
gcattttgcatttt

SEQ ID NO: 626697 - DNA, 13 bp, D. melanogaster
gcattttgccaaa

SEQ ID NO: 626698 - DNA, 13 bp, D. melanogaster
gcattttgccaat

SEQ ID NO: 626699 - DNA, 13 bp, D. melanogaster
gcattttgccagc

SEQ ID NO: 626700 - DNA, 13 bp, D. melanogaster
gcattttggactt

SEQ ID NO: 626701 - DNA, 13 bp, D. melanogaster
gcattttggcatt

SEQ ID NO: 626702 - DNA, 14 bp, D. melanogaster
gcattttggccatt

SEQ ID NO: 626703 - DNA, 13 bp, D. melanogaster
gcattttgggcac

SEQ ID NO: 626704 - DNA, 13 bp, D. melanogaster
gcattttggggca

SEQ ID NO: 626705 - DNA, 13 bp, D. melanogaster
gcattttggtatt

SEQ ID NO: 626706 - DNA, 13 bp, D. melanogaster
gcattttggtgtt

SEQ ID NO: 626707 - DNA, 13 bp, D. melanogaster
gcattttgtaaat

SEQ ID NO: 626708 - DNA, 13 bp, D. melanogaster
gcattttgtgtgc

SEQ ID NO: 626709 - DNA, 13 bp, D. melanogaster
gcattttgttttc

SEQ ID NO: 626710 - DNA, 14 bp, D. melanogaster
gcatttttaaaaaa

SEQ ID NO: 626711 - DNA, 13 bp, D. melanogaster
gcatttttaaaat

SEQ ID NO: 626712 - DNA, 13 bp, D. melanogaster
gcatttttaaacg

SEQ ID NO: 626713 - DNA, 13 bp, D. melanogaster
gcatttttaaata

SEQ ID NO: 626714 - DNA, 13 bp, D. melanogaster
gcatttttaagtt

SEQ ID NO: 626715 - DNA, 13 bp, D. melanogaster
gcatttttaatgc

SEQ ID NO: 626716 - DNA, 14 bp, D. melanogaster
gcatttttaatgca

SEQ ID NO: 626717 - DNA, 13 bp, D. melanogaster
gcatttttaatta

SEQ ID NO: 626718 - DNA, 13 bp, D. melanogaster
gcatttttaattg

SEQ ID NO: 626719 - DNA, 13 bp, D. melanogaster
gcatttttatgac

SEQ ID NO: 626720 - DNA, 13 bp, D. melanogaster
gcatttttatgct

SEQ ID NO: 626721 - DNA, 13 bp, D. melanogaster
gcatttttatggc

SEQ ID NO: 626722 - DNA, 13 bp, D. melanogaster
gcatttttattaa

SEQ ID NO: 626723 - DNA, 13 bp, D. melanogaster
gcatttttattac

SEQ ID NO: 626724 - DNA, 13 bp, D. melanogaster
gcatttttcaaca

SEQ ID NO: 626725 - DNA, 13 bp, D. melanogaster
gcatttttcaata

SEQ ID NO: 626726 - DNA, 13 bp, D. melanogaster
gcatttttcagct

SEQ ID NO: 626727 - DNA, 13 bp, D. melanogaster
gcatttttcattc

SEQ ID NO: 626728 - DNA, 13 bp, D. melanogaster
gcatttttccaaa

SEQ ID NO: 626729 - DNA, 13 bp, D. melanogaster
gcatttttcgctt

SEQ ID NO: 626730 - DNA, 13 bp, D. melanogaster
gcatttttctgta

SEQ ID NO: 626731 - DNA, 13 bp, D. melanogaster
gcatttttgaaca

SEQ ID NO: 626732 - DNA, 13 bp, D. melanogaster
gcatttttgataa

SEQ ID NO: 626733 - DNA, 13 bp, D. melanogaster
gcatttttgatta

SEQ ID NO: 626734 - DNA, 13 bp, D. melanogaster
gcatttttgcaat

SEQ ID NO: 626735 - DNA, 13 bp, D. melanogaster
gcatttttgcttt

SEQ ID NO: 626736 - DNA, 13 bp, D. melanogaster
gcatttttggcaa

SEQ ID NO: 626737 - DNA, 13 bp, D. melanogaster
gcatttttgtgtt

SEQ ID NO: 626738 - DNA, 13 bp, D. melanogaster
gcatttttgttat

SEQ ID NO: 626739 - DNA, 14 bp, D. melanogaster
gcatttttgttatt

SEQ ID NO: 626740 - DNA, 13 bp, D. melanogaster
gcattttttccac

SEQ ID NO: 626741 - DNA, 13 bp, D. melanogaster
gcattttttgtaa

SEQ ID NO: 626742 - DNA, 14 bp, D. melanogaster
gcattttttgtttg

SEQ ID NO: 626743 - DNA, 13 bp, D. melanogaster
gcattttttttaa

SEQ ID NO: 626744 - DNA, 13 bp, D. melanogaster
gccaaaaaactga

SEQ ID NO: 626745 - DNA, 13 bp, D. melanogaster
gccaaaaaagcca

SEQ ID NO: 626746 - DNA, 13 bp, D. melanogaster
gccaaaaaagcga

SEQ ID NO: 626747 - DNA, 13 bp, D. melanogaster
gccaaaaaagttt

SEQ ID NO: 626748 - DNA, 13 bp, D. melanogaster
gccaaaaaataac

SEQ ID NO: 626749 - DNA, 13 bp, D. melanogaster
gccaaaaaataga

SEQ ID NO: 626750 - DNA, 14 bp, D. melanogaster
gccaaaaaatagaa

SEQ ID NO: 626751 - DNA, 13 bp, D. melanogaster
gccaaaaaatatg

SEQ ID NO: 626752 - DNA, 14 bp, D. melanogaster
gccaaaaaatatgt

SEQ ID NO: 626753 - DNA, 13 bp, D. melanogaster
gccaaaaaatcgt

SEQ ID NO: 626754 - DNA, 13 bp, D. melanogaster
gccaaaaaattga

SEQ ID NO: 626755 - DNA, 13 bp, D. melanogaster
gccaaaaaatttt

SEQ ID NO: 626756 - DNA, 13 bp, D. melanogaster
gccaaaaacaatg

SEQ ID NO: 626757 - DNA, 13 bp, D. melanogaster
gccaaaaaccaag

SEQ ID NO: 626758 - DNA, 13 bp, D. melanogaster
gccaaaaaccgaa

SEQ ID NO: 626759 - DNA, 13 bp, D. melanogaster
gccaaaaactgaa

SEQ ID NO: 626760 - DNA, 13 bp, D. melanogaster
gccaaaaactgca

SEQ ID NO: 626761 - DNA, 13 bp, D. melanogaster
gccaaaaacttga

SEQ ID NO: 626762 - DNA, 14 bp, D. melanogaster
gccaaaaactttgc

SEQ ID NO: 626763 - DNA, 13 bp, D. melanogaster
gccaaaaactttt

SEQ ID NO: 626764 - DNA, 14 bp, D. melanogaster
gccaaaaacttttg

SEQ ID NO: 626765 - DNA, 13 bp, D. melanogaster
gccaaaaagaaat

SEQ ID NO: 626766 - DNA, 13 bp, D. melanogaster
gccaaaaagagag

SEQ ID NO: 626767 - DNA, 13 bp, D. melanogaster
gccaaaaagcagc

SEQ ID NO: 626768 - DNA, 13 bp, D. melanogaster
gccaaaaagccaa

SEQ ID NO: 626769 - DNA, 13 bp, D. melanogaster
gccaaaaagccga

SEQ ID NO: 626770 - DNA, 13 bp, D. melanogaster
gccaaaaaggagc

SEQ ID NO: 626771 - DNA, 13 bp, D. melanogaster
gccaaaaaggata

SEQ ID NO: 626772 - DNA, 13 bp, D. melanogaster
gccaaaaaggcaa

SEQ ID NO: 626773 - DNA, 13 bp, D. melanogaster
gccaaaaaggcag

SEQ ID NO: 626774 - DNA, 13 bp, D. melanogaster
gccaaaaagggaa

SEQ ID NO: 626775 - DNA, 13 bp, D. melanogaster
gccaaaaagggtt

SEQ ID NO: 626776 - DNA, 13 bp, D. melanogaster
gccaaaaagtatg

SEQ ID NO: 626777 - DNA, 13 bp, D. melanogaster
gccaaaaagtgtg

SEQ ID NO: 626778 - DNA, 13 bp, D. melanogaster
gccaaaaagttga

SEQ ID NO: 626779 - DNA, 13 bp, D. melanogaster
gccaaaaagttgc

SEQ ID NO: 626780 - DNA, 13 bp, D. melanogaster
gccaaaaagttgg

SEQ ID NO: 626781 - DNA, 13 bp, D. melanogaster
gccaaaaagtttg

SEQ ID NO: 626782 - DNA, 13 bp, D. melanogaster
gccaaaaataaac

SEQ ID NO: 626783 - DNA, 13 bp, D. melanogaster
gccaaaaataagt

SEQ ID NO: 626784 - DNA, 13 bp, D. melanogaster
gccaaaaatcaaa

SEQ ID NO: 626785 - DNA, 13 bp, D. melanogaster
gccaaaaatcacc

SEQ ID NO: 626786 - DNA, 13 bp, D. melanogaster
gccaaaaatcatg

SEQ ID NO: 626787 - DNA, 13 bp, D. melanogaster
gccaaaaatcgca

SEQ ID NO: 626788 - DNA, 13 bp, D. melanogaster
gccaaaaatggtt

SEQ ID NO: 626789 - DNA, 13 bp, D. melanogaster
gccaaaaatgtgc

SEQ ID NO: 626790 - DNA, 13 bp, D. melanogaster
gccaaaaatgttt

SEQ ID NO: 626791 - DNA, 13 bp, D. melanogaster
gccaaaaattaaa

SEQ ID NO: 626792 - DNA, 14 bp, D. melanogaster
gccaaaaattaaat

SEQ ID NO: 626793 - DNA, 13 bp, D. melanogaster
gccaaaaattaca

SEQ ID NO: 626794 - DNA, 13 bp, D. melanogaster
gccaaaaattgaa

SEQ ID NO: 626795 - DNA, 13 bp, D. melanogaster
gccaaaaatttca

SEQ ID NO: 626796 - DNA, 13 bp, D. melanogaster
gccaaaacaaagc

SEQ ID NO: 626797 - DNA, 14 bp, D. melanogaster
gccaaaacaatata

SEQ ID NO: 626798 - DNA, 13 bp, D. melanogaster
gccaaaacaatgc

SEQ ID NO: 626799 - DNA, 13 bp, D. melanogaster
gccaaaacaattt

SEQ ID NO: 626800 - DNA, 13 bp, D. melanogaster
gccaaaacagcag

SEQ ID NO: 626801 - DNA, 14 bp, D. melanogaster
gccaaaacattttg

SEQ ID NO: 626802 - DNA, 13 bp, D. melanogaster
gccaaaaccaaag

SEQ ID NO: 626803 - DNA, 13 bp, D. melanogaster
gccaaaaccgaaa

SEQ ID NO: 626804 - DNA, 13 bp, D. melanogaster
gccaaaacggaaa

SEQ ID NO: 626805 - DNA, 13 bp, D. melanogaster
gccaaaactgcca

SEQ ID NO: 626806 - DNA, 13 bp, D. melanogaster
gccaaaactttgc

SEQ ID NO: 626807 - DNA, 13 bp, D. melanogaster
gccaaaagaaaat

SEQ ID NO: 626808 - DNA, 13 bp, D. melanogaster
gccaaaagaagag

SEQ ID NO: 626809 - DNA, 13 bp, D. melanogaster
gccaaaagagaga

SEQ ID NO: 626810 - DNA, 13 bp, D. melanogaster
gccaaaagaggga

SEQ ID NO: 626811 - DNA, 13 bp, D. melanogaster
gccaaaagcagaa

SEQ ID NO: 626812 - DNA, 13 bp, D. melanogaster
gccaaaagcagag

SEQ ID NO: 626813 - DNA, 13 bp, D. melanogaster
gccaaaagcagca

SEQ ID NO: 626814 - DNA, 14 bp, D. melanogaster
gccaaaagcagcag

SEQ ID NO: 626815 - DNA, 13 bp, D. melanogaster
gccaaaagcagct

SEQ ID NO: 626816 - DNA, 13 bp, D. melanogaster
gccaaaagccaaa

SEQ ID NO: 626817 - DNA, 13 bp, D. melanogaster
gccaaaagccgaa

SEQ ID NO: 626818 - DNA, 13 bp, D. melanogaster
gccaaaagcgaaa

SEQ ID NO: 626819 - DNA, 13 bp, D. melanogaster
gccaaaagcgaag

SEQ ID NO: 626820 - DNA, 13 bp, D. melanogaster
gccaaaagctaaa

SEQ ID NO: 626821 - DNA, 13 bp, D. melanogaster
gccaaaagctgca

SEQ ID NO: 626822 - DNA, 13 bp, D. melanogaster
gccaaaaggacaa

SEQ ID NO: 626823 - DNA, 13 bp, D. melanogaster
gccaaaaggcaaa

SEQ ID NO: 626824 - DNA, 13 bp, D. melanogaster
gccaaaaggccaa

SEQ ID NO: 626825 - DNA, 13 bp, D. melanogaster
gccaaaaggcgag

SEQ ID NO: 626826 - DNA, 13 bp, D. melanogaster
gccaaaagggaaa

SEQ ID NO: 626827 - DNA, 13 bp, D. melanogaster
gccaaaagggata

SEQ ID NO: 626828 - DNA, 14 bp, D. melanogaster
gccaaaagggatac

SEQ ID NO: 626829 - DNA, 13 bp, D. melanogaster
gccaaaagtcaaa

SEQ ID NO: 626830 - DNA, 13 bp, D. melanogaster
gccaaaagtcaac

SEQ ID NO: 626831 - DNA, 13 bp, D. melanogaster
gccaaaagtgcaa

SEQ ID NO: 626832 - DNA, 13 bp, D. melanogaster
gccaaaagtggag

SEQ ID NO: 626833 - DNA, 13 bp, D. melanogaster
gccaaaagtgggt

SEQ ID NO: 626834 - DNA, 13 bp, D. melanogaster
gccaaaagtgttt

SEQ ID NO: 626835 - DNA, 13 bp, D. melanogaster
gccaaaagttgca

SEQ ID NO: 626836 - DNA, 13 bp, D. melanogaster
gccaaaagttgtt

SEQ ID NO: 626837 - DNA, 13 bp, D. melanogaster
gccaaaagttttg

SEQ ID NO: 626838 - DNA, 14 bp, D. melanogaster
gccaaaataaaacg

SEQ ID NO: 626839 - DNA, 13 bp, D. melanogaster
gccaaaataaaat

SEQ ID NO: 626840 - DNA, 13 bp, D. melanogaster
gccaaaatatgca

SEQ ID NO: 626841 - DNA, 13 bp, D. melanogaster
gccaaaatcaaca

SEQ ID NO: 626842 - DNA, 13 bp, D. melanogaster
gccaaaatcaatt

SEQ ID NO: 626843 - DNA, 13 bp, D. melanogaster
gccaaaatgaaaa

SEQ ID NO: 626844 - DNA, 13 bp, D. melanogaster
gccaaaatgaacg

SEQ ID NO: 626845 - DNA, 13 bp, D. melanogaster
gccaaaatgaatt

SEQ ID NO: 626846 - DNA, 13 bp, D. melanogaster
gccaaaatgattt

SEQ ID NO: 626847 - DNA, 13 bp, D. melanogaster
gccaaaatgcatt

SEQ ID NO: 626848 - DNA, 13 bp, D. melanogaster
gccaaaatgccaa

SEQ ID NO: 626849 - DNA, 13 bp, D. melanogaster
gccaaaatgccag

SEQ ID NO: 626850 - DNA, 13 bp, D. melanogaster
gccaaaatgcgaa

SEQ ID NO: 626851 - DNA, 13 bp, D. melanogaster
gccaaaatggcaa

SEQ ID NO: 626852 - DNA, 14 bp, D. melanogaster
gccaaaatggcaaa

SEQ ID NO: 626853 - DNA, 13 bp, D. melanogaster
gccaaaatggcag

SEQ ID NO: 626854 - DNA, 13 bp, D. melanogaster
gccaaaatgggca

SEQ ID NO: 626855 - DNA, 13 bp, D. melanogaster
gccaaaatggttt

SEQ ID NO: 626856 - DNA, 13 bp, D. melanogaster
gccaaaatgttga

SEQ ID NO: 626857 - DNA, 13 bp, D. melanogaster
gccaaaattcagc

SEQ ID NO: 626858 - DNA, 13 bp, D. melanogaster
gccaaaattgaat

SEQ ID NO: 626859 - DNA, 13 bp, D. melanogaster
gccaaaattgatt

SEQ ID NO: 626860 - DNA, 13 bp, D. melanogaster
gccaaacaaaacg

SEQ ID NO: 626861 - DNA, 13 bp, D. melanogaster
gccaaacaaaagt

SEQ ID NO: 626862 - DNA, 13 bp, D. melanogaster
gccaaacaaaatg

SEQ ID NO: 626863 - DNA, 13 bp, D. melanogaster
gccaaacaaagag

SEQ ID NO: 626864 - DNA, 13 bp, D. melanogaster
gccaaacaaaggc

SEQ ID NO: 626865 - DNA, 13 bp, D. melanogaster
gccaaacaaagtt

SEQ ID NO: 626866 - DNA, 13 bp, D. melanogaster
gccaaacaaatca

SEQ ID NO: 626867 - DNA, 13 bp, D. melanogaster
gccaaacaaatgg

SEQ ID NO: 626868 - DNA, 13 bp, D. melanogaster
gccaaacaaattt

SEQ ID NO: 626869 - DNA, 13 bp, D. melanogaster
gccaaacaacaat

SEQ ID NO: 626870 - DNA, 14 bp, D. melanogaster
gccaaacaactttt

SEQ ID NO: 626871 - DNA, 13 bp, D. melanogaster
gccaaacaatgca

SEQ ID NO: 626872 - DNA, 13 bp, D. melanogaster
gccaaacaattgg

SEQ ID NO: 626873 - DNA, 13 bp, D. melanogaster
gccaaacaatttc

SEQ ID NO: 626874 - DNA, 13 bp, D. melanogaster
gccaaacaatttg

SEQ ID NO: 626875 - DNA, 13 bp, D. melanogaster
gccaaacaccgac

SEQ ID NO: 626876 - DNA, 13 bp, D. melanogaster
gccaaacactttg

SEQ ID NO: 626877 - DNA, 13 bp, D. melanogaster
gccaaacagcaaa

SEQ ID NO: 626878 - DNA, 13 bp, D. melanogaster
gccaaacagccaa

SEQ ID NO: 626879 - DNA, 13 bp, D. melanogaster
gccaaacagctgc

SEQ ID NO: 626880 - DNA, 13 bp, D. melanogaster
gccaaacataaaa

SEQ ID NO: 626881 - DNA, 13 bp, D. melanogaster
gccaaacatttgc

SEQ ID NO: 626882 - DNA, 13 bp, D. melanogaster
gccaaacattttt

SEQ ID NO: 626883 - DNA, 13 bp, D. melanogaster
gccaaaccgaacc

SEQ ID NO: 626884 - DNA, 14 bp, D. melanogaster
gccaaaccggtcac

SEQ ID NO: 626885 - DNA, 13 bp, D. melanogaster
gccaaacctttca

SEQ ID NO: 626886 - DNA, 13 bp, D. melanogaster
gccaaacgaaaga

SEQ ID NO: 626887 - DNA, 13 bp, D. melanogaster
gccaaacggcatt

SEQ ID NO: 626888 - DNA, 13 bp, D. melanogaster
gccaaactaattt

SEQ ID NO: 626889 - DNA, 13 bp, D. melanogaster
gccaaactcattt

SEQ ID NO: 626890 - DNA, 13 bp, D. melanogaster
gccaaactgcagc

SEQ ID NO: 626891 - DNA, 13 bp, D. melanogaster
gccaaactgccaa

SEQ ID NO: 626892 - DNA, 13 bp, D. melanogaster
gccaaactgctga

SEQ ID NO: 626893 - DNA, 14 bp, D. melanogaster
gccaaacttttcca

SEQ ID NO: 626894 - DNA, 13 bp, D. melanogaster
gccaaagaaaagc

SEQ ID NO: 626895 - DNA, 13 bp, D. melanogaster
gccaaagaaaatg

SEQ ID NO: 626896 - DNA, 13 bp, D. melanogaster
gccaaagaaaatt

SEQ ID NO: 626897 - DNA, 13 bp, D. melanogaster
gccaaagaaagtt

SEQ ID NO: 626898 - DNA, 13 bp, D. melanogaster
gccaaagaaattt

SEQ ID NO: 626899 - DNA, 13 bp, D. melanogaster
gccaaagacaaat

SEQ ID NO: 626900 - DNA, 13 bp, D. melanogaster
gccaaagagccaa

SEQ ID NO: 626901 - DNA, 13 bp, D. melanogaster
gccaaagataaac

SEQ ID NO: 626902 - DNA, 13 bp, D. melanogaster
gccaaagcacaaa

SEQ ID NO: 626903 - DNA, 13 bp, D. melanogaster
gccaaagcatttg

SEQ ID NO: 626904 - DNA, 13 bp, D. melanogaster
gccaaagccaaag

SEQ ID NO: 626905 - DNA, 15 bp, D. melanogaster
gccaaagccaaagcc

SEQ ID NO: 626906 - DNA, 14 bp, D. melanogaster
gccaaagccaaagt

SEQ ID NO: 626907 - DNA, 13 bp, D. melanogaster
gccaaagccaaat

SEQ ID NO: 626908 - DNA, 13 bp, D. melanogaster
gccaaagccaagc

SEQ ID NO: 626909 - DNA, 13 bp, D. melanogaster
gccaaagccacag

SEQ ID NO: 626910 - DNA, 13 bp, D. melanogaster
gccaaagccgaaa

SEQ ID NO: 626911 - DNA, 13 bp, D. melanogaster
gccaaagccgaag

SEQ ID NO: 626912 - DNA, 13 bp, D. melanogaster
gccaaagcgaaag

SEQ ID NO: 626913 - DNA, 13 bp, D. melanogaster
gccaaagcgaaat

SEQ ID NO: 626914 - DNA, 13 bp, D. melanogaster
gccaaagctaaag

SEQ ID NO: 626915 - DNA, 13 bp, D. melanogaster
gccaaagctgaag

SEQ ID NO: 626916 - DNA, 13 bp, D. melanogaster
gccaaaggaaaag

SEQ ID NO: 626917 - DNA, 13 bp, D. melanogaster
gccaaaggaaaat

SEQ ID NO: 626918 - DNA, 13 bp, D. melanogaster
gccaaaggaattt

SEQ ID NO: 626919 - DNA, 13 bp, D. melanogaster
gccaaaggacaaa

SEQ ID NO: 626920 - DNA, 13 bp, D. melanogaster
gccaaaggacatt

SEQ ID NO: 626921 - DNA, 13 bp, D. melanogaster
gccaaaggaccaa

SEQ ID NO: 626922 - DNA, 13 bp, D. melanogaster
gccaaaggagcaa

SEQ ID NO: 626923 - DNA, 13 bp, D. melanogaster
gccaaaggagctg

SEQ ID NO: 626924 - DNA, 13 bp, D. melanogaster
gccaaaggatttc

SEQ ID NO: 626925 - DNA, 13 bp, D. melanogaster
gccaaaggcaaaa

SEQ ID NO: 626926 - DNA, 13 bp, D. melanogaster
gccaaaggcaaac

SEQ ID NO: 626927 - DNA, 13 bp, D. melanogaster
gccaaagtcaaag

SEQ ID NO: 626928 - DNA, 14 bp, D. melanogaster
gccaaagtcaaagt

SEQ ID NO: 626929 - DNA, 13 bp, D. melanogaster
gccaaagtccaaa

SEQ ID NO: 626930 - DNA, 13 bp, D. melanogaster
gccaaagtgaaaa

SEQ ID NO: 626931 - DNA, 13 bp, D. melanogaster
gccaaagtgcaaa

SEQ ID NO: 626932 - DNA, 13 bp, D. melanogaster
gccaaagtgccaa

SEQ ID NO: 626933 - DNA, 13 bp, D. melanogaster
gccaaagtggaaa

SEQ ID NO: 626934 - DNA, 13 bp, D. melanogaster
gccaaagtgtttt

SEQ ID NO: 626935 - DNA, 13 bp, D. melanogaster
gccaaagttaaat

SEQ ID NO: 626936 - DNA, 13 bp, D. melanogaster
gccaaagttaatt

SEQ ID NO: 626937 - DNA, 13 bp, D. melanogaster
gccaaagttcaaa

SEQ ID NO: 626938 - DNA, 13 bp, D. melanogaster
gccaaagttcttt

SEQ ID NO: 626939 - DNA, 15 bp, D. melanogaster
gccaaagttcttttg

SEQ ID NO: 626940 - DNA, 13 bp, D. melanogaster
gccaaagtttatt

SEQ ID NO: 626941 - DNA, 13 bp, D. melanogaster
gccaaataaaaag

SEQ ID NO: 626942 - DNA, 13 bp, D. melanogaster
gccaaataaaagc

SEQ ID NO: 626943 - DNA, 13 bp, D. melanogaster
gccaaataaaata

SEQ ID NO: 626944 - DNA, 13 bp, D. melanogaster
gccaaataaaatg

SEQ ID NO: 626945 - DNA, 13 bp, D. melanogaster
gccaaataaacaa

SEQ ID NO: 626946 - DNA, 14 bp, D. melanogaster
gccaaataaacaaa

SEQ ID NO: 626947 - DNA, 13 bp, D. melanogaster
gccaaataaatca

SEQ ID NO: 626948 - DNA, 13 bp, D. melanogaster
gccaaataaatta

SEQ ID NO: 626949 - DNA, 13 bp, D. melanogaster
gccaaatacaaaa

SEQ ID NO: 626950 - DNA, 13 bp, D. melanogaster
gccaaataccaaa

SEQ ID NO: 626951 - DNA, 13 bp, D. melanogaster
gccaaatagaaat

SEQ ID NO: 626952 - DNA, 13 bp, D. melanogaster
gccaaatagagca

SEQ ID NO: 626953 - DNA, 13 bp, D. melanogaster
gccaaatatatat

SEQ ID NO: 626954 - DNA, 13 bp, D. melanogaster
gccaaatatttgc

SEQ ID NO: 626955 - DNA, 13 bp, D. melanogaster
gccaaatcaaaat

SEQ ID NO: 626956 - DNA, 13 bp, D. melanogaster
gccaaatccaaat

SEQ ID NO: 626957 - DNA, 13 bp, D. melanogaster
gccaaatcccaat

SEQ ID NO: 626958 - DNA, 15 bp, D. melanogaster
gccaaatcccaataa

SEQ ID NO: 626959 - DNA, 13 bp, D. melanogaster
gccaaatcgaaag

SEQ ID NO: 626960 - DNA, 13 bp, D. melanogaster
gccaaatcgaaat

SEQ ID NO: 626961 - DNA, 13 bp, D. melanogaster
gccaaatcgaatc

SEQ ID NO: 626962 - DNA, 13 bp, D. melanogaster
gccaaatcgattt

SEQ ID NO: 626963 - DNA, 14 bp, D. melanogaster
gccaaatcgattta

SEQ ID NO: 626964 - DNA, 13 bp, D. melanogaster
gccaaatgaaaag

SEQ ID NO: 626965 - DNA, 13 bp, D. melanogaster
gccaaatgaaaat

SEQ ID NO: 626966 - DNA, 13 bp, D. melanogaster
gccaaatgaaagt

SEQ ID NO: 626967 - DNA, 13 bp, D. melanogaster
gccaaatgaaatt

SEQ ID NO: 626968 - DNA, 13 bp, D. melanogaster
gccaaatgaatat

SEQ ID NO: 626969 - DNA, 13 bp, D. melanogaster
gccaaatgaattt

SEQ ID NO: 626970 - DNA, 13 bp, D. melanogaster
gccaaatgacaaa

SEQ ID NO: 626971 - DNA, 14 bp, D. melanogaster
gccaaatgcaaaat

SEQ ID NO: 626972 - DNA, 13 bp, D. melanogaster
gccaaatgcaaat

SEQ ID NO: 626973 - DNA, 14 bp, D. melanogaster
gccaaatgcaaatg

SEQ ID NO: 626974 - DNA, 13 bp, D. melanogaster
gccaaatgcaatt

SEQ ID NO: 626975 - DNA, 13 bp, D. melanogaster
gccaaatgcattt

SEQ ID NO: 626976 - DNA, 13 bp, D. melanogaster
gccaaatgccaag

SEQ ID NO: 626977 - DNA, 13 bp, D. melanogaster
gccaaatgcccca

SEQ ID NO: 626978 - DNA, 13 bp, D. melanogaster
gccaaatgccttt

SEQ ID NO: 626979 - DNA, 13 bp, D. melanogaster
gccaaatgcgaaa

SEQ ID NO: 626980 - DNA, 13 bp, D. melanogaster
gccaaatgcgatt

SEQ ID NO: 626981 - DNA, 13 bp, D. melanogaster
gccaaatgctaat

SEQ ID NO: 626982 - DNA, 13 bp, D. melanogaster
gccaaatgctttt

SEQ ID NO: 626983 - DNA, 13 bp, D. melanogaster
gccaaatggaaaa

SEQ ID NO: 626984 - DNA, 13 bp, D. melanogaster
gccaaatggaaat

SEQ ID NO: 626985 - DNA, 13 bp, D. melanogaster
gccaaatggcaac

SEQ ID NO: 626986 - DNA, 13 bp, D. melanogaster
gccaaatggcaat

SEQ ID NO: 626987 - DNA, 13 bp, D. melanogaster
gccaaatggcatt

SEQ ID NO: 626988 - DNA, 13 bp, D. melanogaster
gccaaatggccaa

SEQ ID NO: 626989 - DNA, 13 bp, D. melanogaster
gccaaatggcgaa

SEQ ID NO: 626990 - DNA, 13 bp, D. melanogaster
gccaaatgtaaac

SEQ ID NO: 626991 - DNA, 13 bp, D. melanogaster
gccaaatgtttac

SEQ ID NO: 626992 - DNA, 13 bp, D. melanogaster
gccaaatgttttt

SEQ ID NO: 626993 - DNA, 13 bp, D. melanogaster
gccaaattaaaca

SEQ ID NO: 626994 - DNA, 13 bp, D. melanogaster
gccaaattaaatg

SEQ ID NO: 626995 - DNA, 13 bp, D. melanogaster
gccaaattaataa

SEQ ID NO: 626996 - DNA, 14 bp, D. melanogaster
gccaaattaataaa

SEQ ID NO: 626997 - DNA, 13 bp, D. melanogaster
gccaaattaattg

SEQ ID NO: 626998 - DNA, 13 bp, D. melanogaster
gccaaattacacg

SEQ ID NO: 626999 - DNA, 13 bp, D. melanogaster
gccaaattcaaat

SEQ ID NO: 627000 - DNA, 13 bp, D. melanogaster
gccaaattcaatt

SEQ ID NO: 627001 - DNA, 13 bp, D. melanogaster
gccaaattgaaaa

SEQ ID NO: 627002 - DNA, 13 bp, D. melanogaster
gccaaattgaaat

SEQ ID NO: 627003 - DNA, 14 bp, D. melanogaster
gccaaattgaaatt

SEQ ID NO: 627004 - DNA, 13 bp, D. melanogaster
gccaaattgaatt

SEQ ID NO: 627005 - DNA, 14 bp, D. melanogaster
gccaaattgaattt

SEQ ID NO: 627006 - DNA, 14 bp, D. melanogaster
gccaaattgatgtg

SEQ ID NO: 627007 - DNA, 13 bp, D. melanogaster
gccaaattgtgtg

SEQ ID NO: 627008 - DNA, 13 bp, D. melanogaster
gccaaattgttgc

SEQ ID NO: 627009 - DNA, 13 bp, D. melanogaster
gccaaatttaaat

SEQ ID NO: 627010 - DNA, 13 bp, D. melanogaster
gccaaatttatga

SEQ ID NO: 627011 - DNA, 13 bp, D. melanogaster
gccaaatttgttt

SEQ ID NO: 627012 - DNA, 13 bp, D. melanogaster
gccaaatttttgg

SEQ ID NO: 627013 - DNA, 14 bp, D. melanogaster
gccaacaaaaaatg

SEQ ID NO: 627014 - DNA, 13 bp, D. melanogaster
gccaacaaaaact

SEQ ID NO: 627015 - DNA, 13 bp, D. melanogaster
gccaacaaaaggc

SEQ ID NO: 627016 - DNA, 13 bp, D. melanogaster
gccaacaaaataa

SEQ ID NO: 627017 - DNA, 13 bp, D. melanogaster
gccaacaaaatga

SEQ ID NO: 627018 - DNA, 13 bp, D. melanogaster
gccaacaaaatgg

SEQ ID NO: 627019 - DNA, 13 bp, D. melanogaster
gccaacaaacttg

SEQ ID NO: 627020 - DNA, 13 bp, D. melanogaster
gccaacaaagcga

SEQ ID NO: 627021 - DNA, 13 bp, D. melanogaster
gccaacaaagtgt

SEQ ID NO: 627022 - DNA, 13 bp, D. melanogaster
gccaacaaagttt

SEQ ID NO: 627023 - DNA, 13 bp, D. melanogaster
gccaacaaataaa

SEQ ID NO: 627024 - DNA, 13 bp, D. melanogaster
gccaacaacaagc

SEQ ID NO: 627025 - DNA, 13 bp, D. melanogaster
gccaacaacaagt

SEQ ID NO: 627026 - DNA, 13 bp, D. melanogaster
gccaacaacaatt

SEQ ID NO: 627027 - DNA, 13 bp, D. melanogaster
gccaacaacatgg

SEQ ID NO: 627028 - DNA, 13 bp, D. melanogaster
gccaacaataaat

SEQ ID NO: 627029 - DNA, 13 bp, D. melanogaster
gccaacaataaca

SEQ ID NO: 627030 - DNA, 13 bp, D. melanogaster
gccaacacacacg

SEQ ID NO: 627031 - DNA, 13 bp, D. melanogaster
gccaacacatttg

SEQ ID NO: 627032 - DNA, 13 bp, D. melanogaster
gccaacagaaaat

SEQ ID NO: 627033 - DNA, 13 bp, D. melanogaster
gccaacagaagca

SEQ ID NO: 627034 - DNA, 13 bp, D. melanogaster
gccaacagcaaat

SEQ ID NO: 627035 - DNA, 14 bp, D. melanogaster
gccaacagcaacaa

SEQ ID NO: 627036 - DNA, 13 bp, D. melanogaster
gccaacagcagct

SEQ ID NO: 627037 - DNA, 13 bp, D. melanogaster
gccaacagctgtt

SEQ ID NO: 627038 - DNA, 13 bp, D. melanogaster
gccaacattatta

SEQ ID NO: 627039 - DNA, 13 bp, D. melanogaster
gccaacattttat

SEQ ID NO: 627040 - DNA, 13 bp, D. melanogaster
gccaacatttttg

SEQ ID NO: 627041 - DNA, 13 bp, D. melanogaster
gccaacatttttt

SEQ ID NO: 627042 - DNA, 13 bp, D. melanogaster
gccaaccacaaat

SEQ ID NO: 627043 - DNA, 13 bp, D. melanogaster
gccaacgaaagtg

SEQ ID NO: 627044 - DNA, 13 bp, D. melanogaster
gccaacgaaatgc

SEQ ID NO: 627045 - DNA, 13 bp, D. melanogaster
gccaacgaaattt

SEQ ID NO: 627046 - DNA, 13 bp, D. melanogaster
gccaacgaagagg

SEQ ID NO: 627047 - DNA, 13 bp, D. melanogaster
gccaacgccaacg

SEQ ID NO: 627048 - DNA, 13 bp, D. melanogaster
gccaacgccagca

SEQ ID NO: 627049 - DNA, 14 bp, D. melanogaster
gccaacgccagcaa

SEQ ID NO: 627050 - DNA, 13 bp, D. melanogaster
gccaacggtgcgt

SEQ ID NO: 627051 - DNA, 13 bp, D. melanogaster
gccaactaaccaa

SEQ ID NO: 627052 - DNA, 13 bp, D. melanogaster
gccaactaattaa

SEQ ID NO: 627053 - DNA, 13 bp, D. melanogaster
gccaactaattgc

SEQ ID NO: 627054 - DNA, 13 bp, D. melanogaster
gccaactaattgg

SEQ ID NO: 627055 - DNA, 13 bp, D. melanogaster
gccaactattaat

SEQ ID NO: 627056 - DNA, 13 bp, D. melanogaster
gccaactatttgg

SEQ ID NO: 627057 - DNA, 13 bp, D. melanogaster
gccaactcaaaaa

SEQ ID NO: 627058 - DNA, 13 bp, D. melanogaster
gccaactcaaatt

SEQ ID NO: 627059 - DNA, 13 bp, D. melanogaster
gccaactcgtttc

SEQ ID NO: 627060 - DNA, 13 bp, D. melanogaster
gccaactcttctc

SEQ ID NO: 627061 - DNA, 13 bp, D. melanogaster
gccaactgaaaat

SEQ ID NO: 627062 - DNA, 13 bp, D. melanogaster
gccaactgacaaa

SEQ ID NO: 627063 - DNA, 13 bp, D. melanogaster
gccaactgacaac

SEQ ID NO: 627064 - DNA, 13 bp, D. melanogaster
gccaactgacagc

SEQ ID NO: 627065 - DNA, 13 bp, D. melanogaster
gccaactgattta

SEQ ID NO: 627066 - DNA, 13 bp, D. melanogaster
gccaactgcaaac

SEQ ID NO: 627067 - DNA, 13 bp, D. melanogaster
gccaactgcaact

SEQ ID NO: 627068 - DNA, 13 bp, D. melanogaster
gccaactgccaac

SEQ ID NO: 627069 - DNA, 13 bp, D. melanogaster
gccaactgcctgc

SEQ ID NO: 627070 - DNA, 13 bp, D. melanogaster
gccaactggcaac

SEQ ID NO: 627071 - DNA, 13 bp, D. melanogaster
gccaactggcagc

SEQ ID NO: 627072 - DNA, 14 bp, D. melanogaster
gccaactggccaac

SEQ ID NO: 627073 - DNA, 13 bp, D. melanogaster
gccaactgggtca

SEQ ID NO: 627074 - DNA, 13 bp, D. melanogaster
gccaacttccttt

SEQ ID NO: 627075 - DNA, 14 bp, D. melanogaster
gccaacttcctttg

SEQ ID NO: 627076 - DNA, 13 bp, D. melanogaster
gccaacttgtttt

SEQ ID NO: 627077 - DNA, 13 bp, D. melanogaster
gccaactttaaag

SEQ ID NO: 627078 - DNA, 13 bp, D. melanogaster
gccaactttatgc

SEQ ID NO: 627079 - DNA, 13 bp, D. melanogaster
gccaacttttgcc

SEQ ID NO: 627080 - DNA, 13 bp, D. melanogaster
gccaacttttgtt

SEQ ID NO: 627081 - DNA, 13 bp, D. melanogaster
gccaactttttgc

SEQ ID NO: 627082 - DNA, 13 bp, D. melanogaster
gccaactttttgt

SEQ ID NO: 627083 - DNA, 13 bp, D. melanogaster
gccaagaaaaatg

SEQ ID NO: 627084 - DNA, 13 bp, D. melanogaster
gccaagaaaatat

SEQ ID NO: 627085 - DNA, 13 bp, D. melanogaster
gccaagaaaattg

SEQ ID NO: 627086 - DNA, 13 bp, D. melanogaster
gccaagaaaccaa

SEQ ID NO: 627087 - DNA, 13 bp, D. melanogaster
gccaagaaatcaa

SEQ ID NO: 627088 - DNA, 13 bp, D. melanogaster
gccaagaatacgg

SEQ ID NO: 627089 - DNA, 13 bp, D. melanogaster
gccaagaatttcg

SEQ ID NO: 627090 - DNA, 13 bp, D. melanogaster
gccaagacaaagg

SEQ ID NO: 627091 - DNA, 13 bp, D. melanogaster
gccaagacaatgg

SEQ ID NO: 627092 - DNA, 13 bp, D. melanogaster
gccaagagcaaaa

SEQ ID NO: 627093 - DNA, 13 bp, D. melanogaster
gccaagagcaaca

SEQ ID NO: 627094 - DNA, 13 bp, D. melanogaster
gccaagagccaaa

SEQ ID NO: 627095 - DNA, 13 bp, D. melanogaster
gccaagagccaag

SEQ ID NO: 627096 - DNA, 13 bp, D. melanogaster
gccaagaggaaga

SEQ ID NO: 627097 - DNA, 14 bp, D. melanogaster
gccaagagtatggc

SEQ ID NO: 627098 - DNA, 14 bp, D. melanogaster
gccaagatagcata

SEQ ID NO: 627099 - DNA, 13 bp, D. melanogaster
gccaagatttatg

SEQ ID NO: 627100 - DNA, 13 bp, D. melanogaster
gccaagcaaataa

SEQ ID NO: 627101 - DNA, 13 bp, D. melanogaster
gccaagcaattta

SEQ ID NO: 627102 - DNA, 13 bp, D. melanogaster
gccaagcaatttg

SEQ ID NO: 627103 - DNA, 13 bp, D. melanogaster
gccaagcagaaac

SEQ ID NO: 627104 - DNA, 14 bp, D. melanogaster
gccaagcagaaaca

SEQ ID NO: 627105 - DNA, 13 bp, D. melanogaster
gccaagcagagta

SEQ ID NO: 627106 - DNA, 13 bp, D. melanogaster
gccaagccaaatc

SEQ ID NO: 627107 - DNA, 13 bp, D. melanogaster
gccaagccaacaa

SEQ ID NO: 627108 - DNA, 13 bp, D. melanogaster
gccaagccaactg

SEQ ID NO: 627109 - DNA, 13 bp, D. melanogaster
gccaagccaactt

SEQ ID NO: 627110 - DNA, 13 bp, D. melanogaster
gccaagccaagcc

SEQ ID NO: 627111 - DNA, 14 bp, D. melanogaster
gccaagccaagcca

SEQ ID NO: 627112 - DNA, 13 bp, D. melanogaster
gccaagccaagtc

SEQ ID NO: 627113 - DNA, 14 bp, D. melanogaster
gccaagccaagtca

SEQ ID NO: 627114 - DNA, 13 bp, D. melanogaster
gccaagccgcaaa

SEQ ID NO: 627115 - DNA, 13 bp, D. melanogaster
gccaagcgaaaat

SEQ ID NO: 627116 - DNA, 13 bp, D. melanogaster
gccaagcgaaatg

SEQ ID NO: 627117 - DNA, 13 bp, D. melanogaster
gccaagcggaaaa

SEQ ID NO: 627118 - DNA, 13 bp, D. melanogaster
gccaagcggccaa

SEQ ID NO: 627119 - DNA, 14 bp, D. melanogaster
gccaagctaaaaaa

SEQ ID NO: 627120 - DNA, 14 bp, D. melanogaster
gccaagctgccact

SEQ ID NO: 627121 - DNA, 13 bp, D. melanogaster
gccaagcttggat

SEQ ID NO: 627122 - DNA, 13 bp, D. melanogaster
gccaaggaaaaca

SEQ ID NO: 627123 - DNA, 13 bp, D. melanogaster
gccaaggaaaata

SEQ ID NO: 627124 - DNA, 13 bp, D. melanogaster
gccaaggaaatgg

SEQ ID NO: 627125 - DNA, 13 bp, D. melanogaster
gccaaggcaaaca

SEQ ID NO: 627126 - DNA, 13 bp, D. melanogaster
gccaaggcaactg

SEQ ID NO: 627127 - DNA, 13 bp, D. melanogaster
gccaagggttaag

SEQ ID NO: 627128 - DNA, 13 bp, D. melanogaster
gccaagtagccaa

SEQ ID NO: 627129 - DNA, 13 bp, D. melanogaster
gccaagtcattga

SEQ ID NO: 627130 - DNA, 13 bp, D. melanogaster
gccaagtgaaaaa

SEQ ID NO: 627131 - DNA, 13 bp, D. melanogaster
gccaagtgaaaag

SEQ ID NO: 627132 - DNA, 13 bp, D. melanogaster
gccaagtgaaagg

SEQ ID NO: 627133 - DNA, 13 bp, D. melanogaster
gccaagtgaaagt

SEQ ID NO: 627134 - DNA, 13 bp, D. melanogaster
gccaagtgcaatg

SEQ ID NO: 627135 - DNA, 13 bp, D. melanogaster
gccaagtgcaatt

SEQ ID NO: 627136 - DNA, 13 bp, D. melanogaster
gccaagtgcacaa

SEQ ID NO: 627137 - DNA, 13 bp, D. melanogaster
gccaagtgcattt

SEQ ID NO: 627138 - DNA, 13 bp, D. melanogaster
gccaagtgccaaa

SEQ ID NO: 627139 - DNA, 14 bp, D. melanogaster
gccaagtgccaagt

SEQ ID NO: 627140 - DNA, 13 bp, D. melanogaster
gccaagtggaaaa

SEQ ID NO: 627141 - DNA, 13 bp, D. melanogaster
gccaagtggaaat

SEQ ID NO: 627142 - DNA, 13 bp, D. melanogaster
gccaagtggaatt

SEQ ID NO: 627143 - DNA, 13 bp, D. melanogaster
gccaagtggcaaa

SEQ ID NO: 627144 - DNA, 13 bp, D. melanogaster
gccaagtggcaag

SEQ ID NO: 627145 - DNA, 13 bp, D. melanogaster
gccaagtggcaga

SEQ ID NO: 627146 - DNA, 13 bp, D. melanogaster
gccaagtggccaa

SEQ ID NO: 627147 - DNA, 13 bp, D. melanogaster
gccaagtggctgg

SEQ ID NO: 627148 - DNA, 13 bp, D. melanogaster
gccaagtgggaaa

SEQ ID NO: 627149 - DNA, 13 bp, D. melanogaster
gccaagtgggcgg

SEQ ID NO: 627150 - DNA, 13 bp, D. melanogaster
gccaagtgtttgt

SEQ ID NO: 627151 - DNA, 13 bp, D. melanogaster
gccaagttctttt

SEQ ID NO: 627152 - DNA, 13 bp, D. melanogaster
gccaagttggcag

SEQ ID NO: 627153 - DNA, 13 bp, D. melanogaster
gccaagtttattt

SEQ ID NO: 627154 - DNA, 13 bp, D. melanogaster
gccaagtttgcca

SEQ ID NO: 627155 - DNA, 14 bp, D. melanogaster
gccaataaaaatat

SEQ ID NO: 627156 - DNA, 13 bp, D. melanogaster
gccaataaaatgt

SEQ ID NO: 627157 - DNA, 13 bp, D. melanogaster
gccaataaatttc

SEQ ID NO: 627158 - DNA, 13 bp, D. melanogaster
gccaataaatttg

SEQ ID NO: 627159 - DNA, 13 bp, D. melanogaster
gccaataacaata

SEQ ID NO: 627160 - DNA, 14 bp, D. melanogaster
gccaataataaaat

SEQ ID NO: 627161 - DNA, 13 bp, D. melanogaster
gccaatacatcaa

SEQ ID NO: 627162 - DNA, 14 bp, D. melanogaster
gccaatagagcggg

SEQ ID NO: 627163 - DNA, 14 bp, D. melanogaster
gccaatatacatcc

SEQ ID NO: 627164 - DNA, 13 bp, D. melanogaster
gccaatatatata

SEQ ID NO: 627165 - DNA, 13 bp, D. melanogaster
gccaatcaaagta

SEQ ID NO: 627166 - DNA, 13 bp, D. melanogaster
gccaatcaattgg

SEQ ID NO: 627167 - DNA, 13 bp, D. melanogaster
gccaatcgattgg

SEQ ID NO: 627168 - DNA, 13 bp, D. melanogaster
gccaatctgcata

SEQ ID NO: 627169 - DNA, 13 bp, D. melanogaster
gccaatgaaatat

SEQ ID NO: 627170 - DNA, 13 bp, D. melanogaster
gccaatgcaaaaa

SEQ ID NO: 627171 - DNA, 13 bp, D. melanogaster
gccaatgcaaaca

SEQ ID NO: 627172 - DNA, 13 bp, D. melanogaster
gccaatgcaaatg

SEQ ID NO: 627173 - DNA, 13 bp, D. melanogaster
gccaatgccaaaa

SEQ ID NO: 627174 - DNA, 13 bp, D. melanogaster
gccaatgccaatg

SEQ ID NO: 627175 - DNA, 14 bp, D. melanogaster
gccaatgccaatgc

SEQ ID NO: 627176 - DNA, 13 bp, D. melanogaster
gccaatggcaaaa

SEQ ID NO: 627177 - DNA, 13 bp, D. melanogaster
gccaatggccaac

SEQ ID NO: 627178 - DNA, 13 bp, D. melanogaster
gccaatggccaag

SEQ ID NO: 627179 - DNA, 13 bp, D. melanogaster
gccaatggccaat

SEQ ID NO: 627180 - DNA, 14 bp, D. melanogaster
gccaatggggaaca

SEQ ID NO: 627181 - DNA, 13 bp, D. melanogaster
gccaatgtcaaat

SEQ ID NO: 627182 - DNA, 13 bp, D. melanogaster
gccaatgttgctg

SEQ ID NO: 627183 - DNA, 13 bp, D. melanogaster
gccaattaattta

SEQ ID NO: 627184 - DNA, 13 bp, D. melanogaster
gccaattaatttg

SEQ ID NO: 627185 - DNA, 13 bp, D. melanogaster
gccaattatgcca

SEQ ID NO: 627186 - DNA, 13 bp, D. melanogaster
gccaattgaaaat

SEQ ID NO: 627187 - DNA, 13 bp, D. melanogaster
gccaattgatcaa

SEQ ID NO: 627188 - DNA, 13 bp, D. melanogaster
gccaattgcaaaa

SEQ ID NO: 627189 - DNA, 13 bp, D. melanogaster
gccaattgcaatt

SEQ ID NO: 627190 - DNA, 13 bp, D. melanogaster
gccaattgcagct

SEQ ID NO: 627191 - DNA, 13 bp, D. melanogaster
gccaattgcagtt

SEQ ID NO: 627192 - DNA, 13 bp, D. melanogaster
gccaattgcattt

SEQ ID NO: 627193 - DNA, 14 bp, D. melanogaster
gccaattgccaatt

SEQ ID NO: 627194 - DNA, 13 bp, D. melanogaster
gccaatttaaaaa

SEQ ID NO: 627195 - DNA, 13 bp, D. melanogaster
gccaatttaaata

SEQ ID NO: 627196 - DNA, 13 bp, D. melanogaster
gccaatttcaatg

SEQ ID NO: 627197 - DNA, 13 bp, D. melanogaster
gccaatttcgagt

SEQ ID NO: 627198 - DNA, 13 bp, D. melanogaster
gccaatttcgatt

SEQ ID NO: 627199 - DNA, 13 bp, D. melanogaster
gccaatttctatc

SEQ ID NO: 627200 - DNA, 13 bp, D. melanogaster
gccaatttctttt

SEQ ID NO: 627201 - DNA, 13 bp, D. melanogaster
gccaatttgcaat

SEQ ID NO: 627202 - DNA, 13 bp, D. melanogaster
gccacaaaaaagt

SEQ ID NO: 627203 - DNA, 13 bp, D. melanogaster
gccacaaaaactt

SEQ ID NO: 627204 - DNA, 13 bp, D. melanogaster
gccacaaaaaggg

SEQ ID NO: 627205 - DNA, 13 bp, D. melanogaster
gccacaaaaaggt

SEQ ID NO: 627206 - DNA, 14 bp, D. melanogaster
gccacaaaaaggta

SEQ ID NO: 627207 - DNA, 13 bp, D. melanogaster
gccacaaaaagtg

SEQ ID NO: 627208 - DNA, 13 bp, D. melanogaster
gccacaaaaatta

SEQ ID NO: 627209 - DNA, 13 bp, D. melanogaster
gccacaaaagcaa

SEQ ID NO: 627210 - DNA, 13 bp, D. melanogaster
gccacaaaagcca

SEQ ID NO: 627211 - DNA, 13 bp, D. melanogaster
gccacaaaagccg

SEQ ID NO: 627212 - DNA, 13 bp, D. melanogaster
gccacaaaagcga

SEQ ID NO: 627213 - DNA, 13 bp, D. melanogaster
gccacaaaatcca

SEQ ID NO: 627214 - DNA, 13 bp, D. melanogaster
gccacaaaatgct

SEQ ID NO: 627215 - DNA, 13 bp, D. melanogaster
gccacaaaatggc

SEQ ID NO: 627216 - DNA, 13 bp, D. melanogaster
gccacaaaatgtt

SEQ ID NO: 627217 - DNA, 13 bp, D. melanogaster
gccacaaagcaaa

SEQ ID NO: 627218 - DNA, 13 bp, D. melanogaster
gccacaaatcaaa

SEQ ID NO: 627219 - DNA, 13 bp, D. melanogaster
gccacaaatgcaa

SEQ ID NO: 627220 - DNA, 13 bp, D. melanogaster
gccacaaatggca

SEQ ID NO: 627221 - DNA, 13 bp, D. melanogaster
gccacaaattgaa

SEQ ID NO: 627222 - DNA, 13 bp, D. melanogaster
gccacaaattgtt

SEQ ID NO: 627223 - DNA, 13 bp, D. melanogaster
gccacaacaactg

SEQ ID NO: 627224 - DNA, 13 bp, D. melanogaster
gccacaacaatag

SEQ ID NO: 627225 - DNA, 14 bp, D. melanogaster
gccacaacatcaac

SEQ ID NO: 627226 - DNA, 13 bp, D. melanogaster
gccacaacatttt

SEQ ID NO: 627227 - DNA, 13 bp, D. melanogaster
gccacaagcaaaa

SEQ ID NO: 627228 - DNA, 13 bp, D. melanogaster
gccacaatatttt

SEQ ID NO: 627229 - DNA, 13 bp, D. melanogaster
gccacaatgtgtt

SEQ ID NO: 627230 - DNA, 16 bp, D. melanogaster
gccacaatgtgttata

SEQ ID NO: 627231 - DNA, 13 bp, D. melanogaster
gccacaatttgtg

SEQ ID NO: 627232 - DNA, 13 bp, D. melanogaster
gccacacaaaagc

SEQ ID NO: 627233 - DNA, 13 bp, D. melanogaster
gccacacaacttg

SEQ ID NO: 627234 - DNA, 13 bp, D. melanogaster
gccacacacacgc

SEQ ID NO: 627235 - DNA, 13 bp, D. melanogaster
gccacacacgcac

SEQ ID NO: 627236 - DNA, 13 bp, D. melanogaster
gccacacatacac

SEQ ID NO: 627237 - DNA, 13 bp, D. melanogaster
gccacacggaaac

SEQ ID NO: 627238 - DNA, 13 bp, D. melanogaster
gccacactcaaac

SEQ ID NO: 627239 - DNA, 14 bp, D. melanogaster
gccacagatacaga

SEQ ID NO: 627240 - DNA, 14 bp, D. melanogaster
gccacagcagcaac

SEQ ID NO: 627241 - DNA, 13 bp, D. melanogaster
gccacagcagctg

SEQ ID NO: 627242 - DNA, 13 bp, D. melanogaster
gccacagcttcat

SEQ ID NO: 627243 - DNA, 13 bp, D. melanogaster
gccacagtgtttt

SEQ ID NO: 627244 - DNA, 13 bp, D. melanogaster
gccacataaatca

SEQ ID NO: 627245 - DNA, 13 bp, D. melanogaster
gccacataaatta

SEQ ID NO: 627246 - DNA, 13 bp, D. melanogaster
gccacatccacat

SEQ ID NO: 627247 - DNA, 13 bp, D. melanogaster
gccacatcgtttc

SEQ ID NO: 627248 - DNA, 13 bp, D. melanogaster
gccacatgcaaca

SEQ ID NO: 627249 - DNA, 13 bp, D. melanogaster
gccacatgccaca

SEQ ID NO: 627250 - DNA, 13 bp, D. melanogaster
gccacatgccacg

SEQ ID NO: 627251 - DNA, 13 bp, D. melanogaster
gccacatgggtgg

SEQ ID NO: 627252 - DNA, 14 bp, D. melanogaster
gccacatgggtggg

SEQ ID NO: 627253 - DNA, 13 bp, D. melanogaster
gccacatgtggca

SEQ ID NO: 627254 - DNA, 13 bp, D. melanogaster
gccacattaaaaa

SEQ ID NO: 627255 - DNA, 13 bp, D. melanogaster
gccacatttaaat

SEQ ID NO: 627256 - DNA, 13 bp, D. melanogaster
gccacatttgccg

SEQ ID NO: 627257 - DNA, 13 bp, D. melanogaster
gccacattttaat

SEQ ID NO: 627258 - DNA, 13 bp, D. melanogaster
gccacatttttgg

SEQ ID NO: 627259 - DNA, 13 bp, D. melanogaster
gccaccaaagcca

SEQ ID NO: 627260 - DNA, 13 bp, D. melanogaster
gccaccaactccc

SEQ ID NO: 627261 - DNA, 13 bp, D. melanogaster
gccaccagacgga

SEQ ID NO: 627262 - DNA, 13 bp, D. melanogaster
gccaccagcaaca

SEQ ID NO: 627263 - DNA, 13 bp, D. melanogaster
gccacccaaaagc

SEQ ID NO: 627264 - DNA, 13 bp, D. melanogaster
gccacccaccgaa

SEQ ID NO: 627265 - DNA, 13 bp, D. melanogaster
gccacccactcca

SEQ ID NO: 627266 - DNA, 13 bp, D. melanogaster
gccacccactcgg

SEQ ID NO: 627267 - DNA, 13 bp, D. melanogaster
gccacccacttgc

SEQ ID NO: 627268 - DNA, 13 bp, D. melanogaster
gccaccgaatgcc

SEQ ID NO: 627269 - DNA, 13 bp, D. melanogaster
gccaccgcaacaa

SEQ ID NO: 627270 - DNA, 13 bp, D. melanogaster
gccaccgcctttg

SEQ ID NO: 627271 - DNA, 13 bp, D. melanogaster
gccaccgtgtgct

SEQ ID NO: 627272 - DNA, 13 bp, D. melanogaster
gccacctgatgaa

SEQ ID NO: 627273 - DNA, 13 bp, D. melanogaster
gccaccttcttct

SEQ ID NO: 627274 - DNA, 13 bp, D. melanogaster
gccaccttttttg

SEQ ID NO: 627275 - DNA, 13 bp, D. melanogaster
gccacgagttcaa

SEQ ID NO: 627276 - DNA, 14 bp, D. melanogaster
gccacgcccacaag

SEQ ID NO: 627277 - DNA, 14 bp, D. melanogaster
gccacgcccacact

SEQ ID NO: 627278 - DNA, 14 bp, D. melanogaster
gccacgcccacatt

SEQ ID NO: 627279 - DNA, 13 bp, D. melanogaster
gccacgcccacct

SEQ ID NO: 627280 - DNA, 14 bp, D. melanogaster
gccacgcccacctg

SEQ ID NO: 627281 - DNA, 13 bp, D. melanogaster
gccacgcccacgt

SEQ ID NO: 627282 - DNA, 13 bp, D. melanogaster
gccacgcccactc

SEQ ID NO: 627283 - DNA, 14 bp, D. melanogaster
gccacgcccactcc

SEQ ID NO: 627284 - DNA, 14 bp, D. melanogaster
gccacgcccactct

SEQ ID NO: 627285 - DNA, 13 bp, D. melanogaster
gccacgcccactg

SEQ ID NO: 627286 - DNA, 14 bp, D. melanogaster
gccacgcccactgc

SEQ ID NO: 627287 - DNA, 14 bp, D. melanogaster
gccacgcccactgg

SEQ ID NO: 627288 - DNA, 14 bp, D. melanogaster
gccacgcccacttg

SEQ ID NO: 627289 - DNA, 13 bp, D. melanogaster
gccacgcccagtc

SEQ ID NO: 627290 - DNA, 13 bp, D. melanogaster
gccacgcccatcg

SEQ ID NO: 627291 - DNA, 13 bp, D. melanogaster
gccacgcccattt

SEQ ID NO: 627292 - DNA, 14 bp, D. melanogaster
gccacgcccatttg

SEQ ID NO: 627293 - DNA, 13 bp, D. melanogaster
gccacgcccccat

SEQ ID NO: 627294 - DNA, 14 bp, D. melanogaster
gccacgcccccatc

SEQ ID NO: 627295 - DNA, 14 bp, D. melanogaster
gccacgcccccatt

SEQ ID NO: 627296 - DNA, 13 bp, D. melanogaster
gccacgcccccta

SEQ ID NO: 627297 - DNA, 14 bp, D. melanogaster
gccacgccccctca

SEQ ID NO: 627298 - DNA, 14 bp, D. melanogaster
gccacgccccctgc

SEQ ID NO: 627299 - DNA, 14 bp, D. melanogaster
gccacgccccctgg

SEQ ID NO: 627300 - DNA, 13 bp, D. melanogaster
gccacgccccctt

SEQ ID NO: 627301 - DNA, 14 bp, D. melanogaster
gccacgcccccttc

SEQ ID NO: 627302 - DNA, 14 bp, D. melanogaster
gccacgcccccttt

SEQ ID NO: 627303 - DNA, 13 bp, D. melanogaster
gccacgcccctaa

SEQ ID NO: 627304 - DNA, 13 bp, D. melanogaster
gccacgcccctcg

SEQ ID NO: 627305 - DNA, 14 bp, D. melanogaster
gccacgcccctttc

SEQ ID NO: 627306 - DNA, 14 bp, D. melanogaster
gccacgcccctttg

SEQ ID NO: 627307 - DNA, 13 bp, D. melanogaster
gccacgcctactt

SEQ ID NO: 627308 - DNA, 13 bp, D. melanogaster
gccacgcctcctt

SEQ ID NO: 627309 - DNA, 13 bp, D. melanogaster
gccacgctgcgta

SEQ ID NO: 627310 - DNA, 13 bp, D. melanogaster
gccacggaaccat

SEQ ID NO: 627311 - DNA, 13 bp, D. melanogaster
gccacggcgaaaa

SEQ ID NO: 627312 - DNA, 13 bp, D. melanogaster
gccactaccagtg

SEQ ID NO: 627313 - DNA, 13 bp, D. melanogaster
gccactacgagtt

SEQ ID NO: 627314 - DNA, 13 bp, D. melanogaster
gccactatcaatc

SEQ ID NO: 627315 - DNA, 13 bp, D. melanogaster
gccactcagccac

SEQ ID NO: 627316 - DNA, 13 bp, D. melanogaster
gccactcgcactc

SEQ ID NO: 627317 - DNA, 14 bp, D. melanogaster
gccactgcaactgc

SEQ ID NO: 627318 - DNA, 13 bp, D. melanogaster
gccactgcaattg

SEQ ID NO: 627319 - DNA, 13 bp, D. melanogaster
gccactgcagcag

SEQ ID NO: 627320 - DNA, 13 bp, D. melanogaster
gccactgcagctg

SEQ ID NO: 627321 - DNA, 13 bp, D. melanogaster
gccactgcagttg

SEQ ID NO: 627322 - DNA, 14 bp, D. melanogaster
gccactgccacagc

SEQ ID NO: 627323 - DNA, 13 bp, D. melanogaster
gccactgccacca

SEQ ID NO: 627324 - DNA, 13 bp, D. melanogaster
gccactgccactt

SEQ ID NO: 627325 - DNA, 13 bp, D. melanogaster
gccactgccattt

SEQ ID NO: 627326 - DNA, 13 bp, D. melanogaster
gccactgccgctg

SEQ ID NO: 627327 - DNA, 13 bp, D. melanogaster
gccactgctgcca

SEQ ID NO: 627328 - DNA, 13 bp, D. melanogaster
gccactgctgttg

SEQ ID NO: 627329 - DNA, 13 bp, D. melanogaster
gccactggcaatt

SEQ ID NO: 627330 - DNA, 13 bp, D. melanogaster
gccactggccact

SEQ ID NO: 627331 - DNA, 13 bp, D. melanogaster
gccactggccatt

SEQ ID NO: 627332 - DNA, 15 bp, D. melanogaster
gccactggggaagcg

SEQ ID NO: 627333 - DNA, 13 bp, D. melanogaster
gccactggtagct

SEQ ID NO: 627334 - DNA, 14 bp, D. melanogaster
gccactgtgtgtgt

SEQ ID NO: 627335 - DNA, 13 bp, D. melanogaster
gccacttaaatgc

SEQ ID NO: 627336 - DNA, 13 bp, D. melanogaster
gccacttaagaaa

SEQ ID NO: 627337 - DNA, 13 bp, D. melanogaster
gccacttccactg

SEQ ID NO: 627338 - DNA, 14 bp, D. melanogaster
gccacttccacttc

SEQ ID NO: 627339 - DNA, 13 bp, D. melanogaster
gccacttgaaaat

SEQ ID NO: 627340 - DNA, 13 bp, D. melanogaster
gccacttgagttt

SEQ ID NO: 627341 - DNA, 13 bp, D. melanogaster
gccacttgcaaca

SEQ ID NO: 627342 - DNA, 13 bp, D. melanogaster
gccacttgccacc

SEQ ID NO: 627343 - DNA, 13 bp, D. melanogaster
gccacttggcaaa

SEQ ID NO: 627344 - DNA, 13 bp, D. melanogaster
gccacttggcagc

SEQ ID NO: 627345 - DNA, 13 bp, D. melanogaster
gccacttggccaa

SEQ ID NO: 627346 - DNA, 13 bp, D. melanogaster
gccacttggctgc

SEQ ID NO: 627347 - DNA, 13 bp, D. melanogaster
gccacttgggagt

SEQ ID NO: 627348 - DNA, 13 bp, D. melanogaster
gccactttgaaat

SEQ ID NO: 627349 - DNA, 13 bp, D. melanogaster
gccacttttggcc

SEQ ID NO: 627350 - DNA, 13 bp, D. melanogaster
gccacttttttgg

SEQ ID NO: 627351 - DNA, 13 bp, D. melanogaster
gccagaaaaagtg

SEQ ID NO: 627352 - DNA, 13 bp, D. melanogaster
gccagaaaacgtc

SEQ ID NO: 627353 - DNA, 13 bp, D. melanogaster
gccagaaaagcaa

SEQ ID NO: 627354 - DNA, 13 bp, D. melanogaster
gccagaaaccacc

SEQ ID NO: 627355 - DNA, 14 bp, D. melanogaster
gccagaaagagagg

SEQ ID NO: 627356 - DNA, 13 bp, D. melanogaster
gccagaaaggcag

SEQ ID NO: 627357 - DNA, 13 bp, D. melanogaster
gccagaagcatcc

SEQ ID NO: 627358 - DNA, 13 bp, D. melanogaster
gccagaagccaaa

SEQ ID NO: 627359 - DNA, 13 bp, D. melanogaster
gccagaagctttt

SEQ ID NO: 627360 - DNA, 13 bp, D. melanogaster
gccagaatgccag

SEQ ID NO: 627361 - DNA, 13 bp, D. melanogaster
gccagacaaaaag

SEQ ID NO: 627362 - DNA, 13 bp, D. melanogaster
gccagacaaacaa

SEQ ID NO: 627363 - DNA, 13 bp, D. melanogaster
gccagagaaggaa

SEQ ID NO: 627364 - DNA, 13 bp, D. melanogaster
gccagagacaaag

SEQ ID NO: 627365 - DNA, 14 bp, D. melanogaster
gccagagagagaga

SEQ ID NO: 627366 - DNA, 13 bp, D. melanogaster
gccagagccagag

SEQ ID NO: 627367 - DNA, 13 bp, D. melanogaster
gccagagcgagag

SEQ ID NO: 627368 - DNA, 13 bp, D. melanogaster
gccagaggaaaat

SEQ ID NO: 627369 - DNA, 13 bp, D. melanogaster
gccagagttgcca

SEQ ID NO: 627370 - DNA, 13 bp, D. melanogaster
gccagatacagat

SEQ ID NO: 627371 - DNA, 13 bp, D. melanogaster
gccagatattcca

SEQ ID NO: 627372 - DNA, 13 bp, D. melanogaster
gccagatcaagtg

SEQ ID NO: 627373 - DNA, 13 bp, D. melanogaster
gccagatcgatcg

SEQ ID NO: 627374 - DNA, 13 bp, D. melanogaster
gccagatgactct

SEQ ID NO: 627375 - DNA, 13 bp, D. melanogaster
gccagcaaaaaca

SEQ ID NO: 627376 - DNA, 13 bp, D. melanogaster
gccagcaaaaagc

SEQ ID NO: 627377 - DNA, 13 bp, D. melanogaster
gccagcaaaaagt

SEQ ID NO: 627378 - DNA, 13 bp, D. melanogaster
gccagcaaaacaa

SEQ ID NO: 627379 - DNA, 13 bp, D. melanogaster
gccagcaaaatgg

SEQ ID NO: 627380 - DNA, 13 bp, D. melanogaster
gccagcaaaatgt

SEQ ID NO: 627381 - DNA, 13 bp, D. melanogaster
gccagcaaacagc

SEQ ID NO: 627382 - DNA, 13 bp, D. melanogaster
gccagcaaagcaa

SEQ ID NO: 627383 - DNA, 13 bp, D. melanogaster
gccagcaaagtga

SEQ ID NO: 627384 - DNA, 13 bp, D. melanogaster
gccagcaaagtgc

SEQ ID NO: 627385 - DNA, 13 bp, D. melanogaster
gccagcaaagttt

SEQ ID NO: 627386 - DNA, 13 bp, D. melanogaster
gccagcaaatcaa

SEQ ID NO: 627387 - DNA, 13 bp, D. melanogaster
gccagcaaatgaa

SEQ ID NO: 627388 - DNA, 13 bp, D. melanogaster
gccagcaaatgca

SEQ ID NO: 627389 - DNA, 13 bp, D. melanogaster
gccagcaaattga

SEQ ID NO: 627390 - DNA, 13 bp, D. melanogaster
gccagcaaattgc

SEQ ID NO: 627391 - DNA, 13 bp, D. melanogaster
gccagcaacaaaa

SEQ ID NO: 627392 - DNA, 14 bp, D. melanogaster
gccagcaacaacaa

SEQ ID NO: 627393 - DNA, 13 bp, D. melanogaster
gccagcaacaata

SEQ ID NO: 627394 - DNA, 13 bp, D. melanogaster
gccagcaacagca

SEQ ID NO: 627395 - DNA, 14 bp, D. melanogaster
gccagcaacagcaa

SEQ ID NO: 627396 - DNA, 13 bp, D. melanogaster
gccagcaacatgc

SEQ ID NO: 627397 - DNA, 13 bp, D. melanogaster
gccagcaacatgt

SEQ ID NO: 627398 - DNA, 13 bp, D. melanogaster
gccagcaactaaa

SEQ ID NO: 627399 - DNA, 14 bp, D. melanogaster
gccagcaactttca

SEQ ID NO: 627400 - DNA, 13 bp, D. melanogaster
gccagcaagaagg

SEQ ID NO: 627401 - DNA, 13 bp, D. melanogaster
gccagcaagtgca

SEQ ID NO: 627402 - DNA, 13 bp, D. melanogaster
gccagcaatgaaa

SEQ ID NO: 627403 - DNA, 13 bp, D. melanogaster
gccagcaattgca

SEQ ID NO: 627404 - DNA, 13 bp, D. melanogaster
gccagcaatttcc

SEQ ID NO: 627405 - DNA, 13 bp, D. melanogaster
gccagcaatttgc

SEQ ID NO: 627406 - DNA, 14 bp, D. melanogaster
gccagcaatttgca

SEQ ID NO: 627407 - DNA, 13 bp, D. melanogaster
gccagcacaaaaa

SEQ ID NO: 627408 - DNA, 13 bp, D. melanogaster
gccagcacttttt

SEQ ID NO: 627409 - DNA, 13 bp, D. melanogaster
gccagcagaccca

SEQ ID NO: 627410 - DNA, 13 bp, D. melanogaster
gccagcagatcca

SEQ ID NO: 627411 - DNA, 13 bp, D. melanogaster
gccagcagcaaat

SEQ ID NO: 627412 - DNA, 13 bp, D. melanogaster
gccagcagcaaca

SEQ ID NO: 627413 - DNA, 14 bp, D. melanogaster
gccagcagcaacaa

SEQ ID NO: 627414 - DNA, 14 bp, D. melanogaster
gccagcagcaacat

SEQ ID NO: 627415 - DNA, 13 bp, D. melanogaster
gccagcagcaatg

SEQ ID NO: 627416 - DNA, 13 bp, D. melanogaster
gccagcagcagac

SEQ ID NO: 627417 - DNA, 14 bp, D. melanogaster
gccagcagcagcaa

SEQ ID NO: 627418 - DNA, 13 bp, D. melanogaster
gccagcagcagct

SEQ ID NO: 627419 - DNA, 13 bp, D. melanogaster
gccagcagcattt

SEQ ID NO: 627420 - DNA, 13 bp, D. melanogaster
gccagcagccaaa

SEQ ID NO: 627421 - DNA, 13 bp, D. melanogaster
gccagcagccagc

SEQ ID NO: 627422 - DNA, 14 bp, D. melanogaster
gccagcagcggagc

SEQ ID NO: 627423 - DNA, 13 bp, D. melanogaster
gccagcagctgca

SEQ ID NO: 627424 - DNA, 13 bp, D. melanogaster
gccagcagctgct

SEQ ID NO: 627425 - DNA, 13 bp, D. melanogaster
gccagcagctgtt

SEQ ID NO: 627426 - DNA, 13 bp, D. melanogaster
gccagcaggcagc

SEQ ID NO: 627427 - DNA, 13 bp, D. melanogaster
gccagcatttcct

SEQ ID NO: 627428 - DNA, 13 bp, D. melanogaster
gccagcattttct

SEQ ID NO: 627429 - DNA, 13 bp, D. melanogaster
gccagccaaaaaa

SEQ ID NO: 627430 - DNA, 13 bp, D. melanogaster
gccagccaaaaac

SEQ ID NO: 627431 - DNA, 13 bp, D. melanogaster
gccagccaaaaag

SEQ ID NO: 627432 - DNA, 13 bp, D. melanogaster
gccagccaaaagt

SEQ ID NO: 627433 - DNA, 14 bp, D. melanogaster
gccagccaaccagc

SEQ ID NO: 627434 - DNA, 14 bp, D. melanogaster
gccagccaactcga

SEQ ID NO: 627435 - DNA, 13 bp, D. melanogaster
gccagccaagcca

SEQ ID NO: 627436 - DNA, 13 bp, D. melanogaster
gccagccaatttg

SEQ ID NO: 627437 - DNA, 13 bp, D. melanogaster
gccagccacaaaa

SEQ ID NO: 627438 - DNA, 13 bp, D. melanogaster
gccagccacatgc

SEQ ID NO: 627439 - DNA, 13 bp, D. melanogaster
gccagccagcaaa

SEQ ID NO: 627440 - DNA, 13 bp, D. melanogaster
gccagccagcaag

SEQ ID NO: 627441 - DNA, 13 bp, D. melanogaster
gccagccagcagc

SEQ ID NO: 627442 - DNA, 13 bp, D. melanogaster
gccagccagccaa

SEQ ID NO: 627443 - DNA, 14 bp, D. melanogaster
gccagccagccaac

SEQ ID NO: 627444 - DNA, 14 bp, D. melanogaster
gccagccagccagc

SEQ ID NO: 627445 - DNA, 13 bp, D. melanogaster
gccagccagccat

SEQ ID NO: 627446 - DNA, 14 bp, D. melanogaster
gccagccagccatc

SEQ ID NO: 627447 - DNA, 13 bp, D. melanogaster
gccagccagccgc

SEQ ID NO: 627448 - DNA, 13 bp, D. melanogaster
gccagccagccgg

SEQ ID NO: 627449 - DNA, 13 bp, D. melanogaster
gccagccagcgag

SEQ ID NO: 627450 - DNA, 13 bp, D. melanogaster
gccagccagtcag

SEQ ID NO: 627451 - DNA, 14 bp, D. melanogaster
gccagccagtcagc

SEQ ID NO: 627452 - DNA, 13 bp, D. melanogaster
gccagccagttgg

SEQ ID NO: 627453 - DNA, 13 bp, D. melanogaster
gccagccataaat

SEQ ID NO: 627454 - DNA, 13 bp, D. melanogaster
gccagccatttgc

SEQ ID NO: 627455 - DNA, 13 bp, D. melanogaster
gccagccattttg

SEQ ID NO: 627456 - DNA, 13 bp, D. melanogaster
gccagcccagcca

SEQ ID NO: 627457 - DNA, 13 bp, D. melanogaster
gccagccgatttc

SEQ ID NO: 627458 - DNA, 13 bp, D. melanogaster
gccagccgcaaaa

SEQ ID NO: 627459 - DNA, 13 bp, D. melanogaster
gccagccttcagc

SEQ ID NO: 627460 - DNA, 13 bp, D. melanogaster
gccagccttcttg

SEQ ID NO: 627461 - DNA, 13 bp, D. melanogaster
gccagcgaaaaaa

SEQ ID NO: 627462 - DNA, 13 bp, D. melanogaster
gccagcgaaaagt

SEQ ID NO: 627463 - DNA, 13 bp, D. melanogaster
gccagcgaaaata

SEQ ID NO: 627464 - DNA, 13 bp, D. melanogaster
gccagcgaaacga

SEQ ID NO: 627465 - DNA, 13 bp, D. melanogaster
gccagcgaaataa

SEQ ID NO: 627466 - DNA, 13 bp, D. melanogaster
gccagcgaaatat

SEQ ID NO: 627467 - DNA, 13 bp, D. melanogaster
gccagcgaaatgc

SEQ ID NO: 627468 - DNA, 13 bp, D. melanogaster
gccagcgacaaca

SEQ ID NO: 627469 - DNA, 13 bp, D. melanogaster
gccagcgatttgc

SEQ ID NO: 627470 - DNA, 13 bp, D. melanogaster
gccagcgattttt

SEQ ID NO: 627471 - DNA, 13 bp, D. melanogaster
gccagcgccaaag

SEQ ID NO: 627472 - DNA, 13 bp, D. melanogaster
gccagcggaagtg

SEQ ID NO: 627473 - DNA, 14 bp, D. melanogaster
gccagcggaagtga

SEQ ID NO: 627474 - DNA, 13 bp, D. melanogaster
gccagcggcaaaa

SEQ ID NO: 627475 - DNA, 13 bp, D. melanogaster
gccagcggcagca

SEQ ID NO: 627476 - DNA, 14 bp, D. melanogaster
gccagcggccagcg

SEQ ID NO: 627477 - DNA, 13 bp, D. melanogaster
gccagctaaaaaa

SEQ ID NO: 627478 - DNA, 13 bp, D. melanogaster
gccagctacaaat

SEQ ID NO: 627479 - DNA, 13 bp, D. melanogaster
gccagctagccag

SEQ ID NO: 627480 - DNA, 13 bp, D. melanogaster
gccagctgaaaag

SEQ ID NO: 627481 - DNA, 13 bp, D. melanogaster
gccagctgacaaa

SEQ ID NO: 627482 - DNA, 13 bp, D. melanogaster
gccagctgcaatt

SEQ ID NO: 627483 - DNA, 13 bp, D. melanogaster
gccagctgcagct

SEQ ID NO: 627484 - DNA, 13 bp, D. melanogaster
gccagctgcagtt

SEQ ID NO: 627485 - DNA, 13 bp, D. melanogaster
gccagctgctgct

SEQ ID NO: 627486 - DNA, 13 bp, D. melanogaster
gccagctggaaat

SEQ ID NO: 627487 - DNA, 13 bp, D. melanogaster
gccagctggcaaa

SEQ ID NO: 627488 - DNA, 13 bp, D. melanogaster
gccagctggccaa

SEQ ID NO: 627489 - DNA, 13 bp, D. melanogaster
gccagctggcttt

SEQ ID NO: 627490 - DNA, 13 bp, D. melanogaster
gccagctgtaaat

SEQ ID NO: 627491 - DNA, 13 bp, D. melanogaster
gccagctgttgcc

SEQ ID NO: 627492 - DNA, 13 bp, D. melanogaster
gccagctgttggc

SEQ ID NO: 627493 - DNA, 13 bp, D. melanogaster
gccagcttgccag

SEQ ID NO: 627494 - DNA, 13 bp, D. melanogaster
gccagcttgtttg

SEQ ID NO: 627495 - DNA, 13 bp, D. melanogaster
gccaggaaaagcg

SEQ ID NO: 627496 - DNA, 13 bp, D. melanogaster
gccaggaagaagg

SEQ ID NO: 627497 - DNA, 13 bp, D. melanogaster
gccaggacaatgc

SEQ ID NO: 627498 - DNA, 13 bp, D. melanogaster
gccaggacacaca

SEQ ID NO: 627499 - DNA, 13 bp, D. melanogaster
gccaggacatggc

SEQ ID NO: 627500 - DNA, 13 bp, D. melanogaster
gccaggacattcg

SEQ ID NO: 627501 - DNA, 13 bp, D. melanogaster
gccaggaccaaaa

SEQ ID NO: 627502 - DNA, 13 bp, D. melanogaster
gccaggacctggt

SEQ ID NO: 627503 - DNA, 13 bp, D. melanogaster
gccaggacgaagg

SEQ ID NO: 627504 - DNA, 14 bp, D. melanogaster
gccaggacgaagga

SEQ ID NO: 627505 - DNA, 13 bp, D. melanogaster
gccaggagcagca

SEQ ID NO: 627506 - DNA, 13 bp, D. melanogaster
gccaggagcagcg

SEQ ID NO: 627507 - DNA, 14 bp, D. melanogaster
gccaggagcagcgg

SEQ ID NO: 627508 - DNA, 13 bp, D. melanogaster
gccaggagcagga

SEQ ID NO: 627509 - DNA, 14 bp, D. melanogaster
gccaggagccagga

SEQ ID NO: 627510 - DNA, 14 bp, D. melanogaster
gccaggagcggcag

SEQ ID NO: 627511 - DNA, 13 bp, D. melanogaster
gccaggatgccag

SEQ ID NO: 627512 - DNA, 13 bp, D. melanogaster
gccaggcacaaaa

SEQ ID NO: 627513 - DNA, 13 bp, D. melanogaster
gccaggcagcaaa

SEQ ID NO: 627514 - DNA, 13 bp, D. melanogaster
gccaggcagctct

SEQ ID NO: 627515 - DNA, 13 bp, D. melanogaster
gccaggccaacaa

SEQ ID NO: 627516 - DNA, 13 bp, D. melanogaster
gccaggccagcca

SEQ ID NO: 627517 - DNA, 13 bp, D. melanogaster
gccaggccaggcc

SEQ ID NO: 627518 - DNA, 13 bp, D. melanogaster
gccaggccataaa

SEQ ID NO: 627519 - DNA, 13 bp, D. melanogaster
gccaggcgatttt

SEQ ID NO: 627520 - DNA, 13 bp, D. melanogaster
gccagggcaaaaa

SEQ ID NO: 627521 - DNA, 13 bp, D. melanogaster
gccagggcaaaca

SEQ ID NO: 627522 - DNA, 13 bp, D. melanogaster
gccagggggaaat

SEQ ID NO: 627523 - DNA, 13 bp, D. melanogaster
gccagggttgcca

SEQ ID NO: 627524 - DNA, 13 bp, D. melanogaster
gccagtatacacg

SEQ ID NO: 627525 - DNA, 13 bp, D. melanogaster
gccagtcagccaa

SEQ ID NO: 627526 - DNA, 13 bp, D. melanogaster
gccagtcagccag

SEQ ID NO: 627527 - DNA, 14 bp, D. melanogaster
gccagtcagccagc

SEQ ID NO: 627528 - DNA, 14 bp, D. melanogaster
gccagtcagccagt

SEQ ID NO: 627529 - DNA, 14 bp, D. melanogaster
gccagtctactgtg

SEQ ID NO: 627530 - DNA, 13 bp, D. melanogaster
gccagtctgcaca

SEQ ID NO: 627531 - DNA, 14 bp, D. melanogaster
gccagtgaccatca

SEQ ID NO: 627532 - DNA, 13 bp, D. melanogaster
gccagtgcagaaa

SEQ ID NO: 627533 - DNA, 13 bp, D. melanogaster
gccagtggaaaat

SEQ ID NO: 627534 - DNA, 13 bp, D. melanogaster
gccagtggaggtt

SEQ ID NO: 627535 - DNA, 13 bp, D. melanogaster
gccagtggcagtg

SEQ ID NO: 627536 - DNA, 13 bp, D. melanogaster
gccagtggcattg

SEQ ID NO: 627537 - DNA, 13 bp, D. melanogaster
gccagtgggtggg

SEQ ID NO: 627538 - DNA, 13 bp, D. melanogaster
gccagtgtgacca

SEQ ID NO: 627539 - DNA, 13 bp, D. melanogaster
gccagtgtgagtg

SEQ ID NO: 627540 - DNA, 13 bp, D. melanogaster
gccagtgtgtata

SEQ ID NO: 627541 - DNA, 13 bp, D. melanogaster
gccagttaacgca

SEQ ID NO: 627542 - DNA, 13 bp, D. melanogaster
gccagttaagaga

SEQ ID NO: 627543 - DNA, 13 bp, D. melanogaster
gccagttaagtcc

SEQ ID NO: 627544 - DNA, 14 bp, D. melanogaster
gccagttcgactcg

SEQ ID NO: 627545 - DNA, 13 bp, D. melanogaster
gccagttgattct

SEQ ID NO: 627546 - DNA, 13 bp, D. melanogaster
gccagttgcaagt

SEQ ID NO: 627547 - DNA, 13 bp, D. melanogaster
gccagttgcattt

SEQ ID NO: 627548 - DNA, 14 bp, D. melanogaster
gccagttgccagtt

SEQ ID NO: 627549 - DNA, 13 bp, D. melanogaster
gccagttggaaat

SEQ ID NO: 627550 - DNA, 13 bp, D. melanogaster
gccagttggcagc

SEQ ID NO: 627551 - DNA, 13 bp, D. melanogaster
gccagttggcagt

SEQ ID NO: 627552 - DNA, 13 bp, D. melanogaster
gccagttggccaa

SEQ ID NO: 627553 - DNA, 13 bp, D. melanogaster
gccagttggccag

SEQ ID NO: 627554 - DNA, 13 bp, D. melanogaster
gccagtttgtttt

SEQ ID NO: 627555 - DNA, 13 bp, D. melanogaster
gccagttttgatt

SEQ ID NO: 627556 - DNA, 13 bp, D. melanogaster
gccagttttgttt

SEQ ID NO: 627557 - DNA, 13 bp, D. melanogaster
gccataaaaaata

SEQ ID NO: 627558 - DNA, 14 bp, D. melanogaster
gccataaaaacaaa

SEQ ID NO: 627559 - DNA, 13 bp, D. melanogaster
gccataaaaatcg

SEQ ID NO: 627560 - DNA, 13 bp, D. melanogaster
gccataaaaatga

SEQ ID NO: 627561 - DNA, 14 bp, D. melanogaster
gccataaaagccaa

SEQ ID NO: 627562 - DNA, 13 bp, D. melanogaster
gccataaaagcga

SEQ ID NO: 627563 - DNA, 13 bp, D. melanogaster
gccataaaagtgc

SEQ ID NO: 627564 - DNA, 13 bp, D. melanogaster
gccataaaagttt

SEQ ID NO: 627565 - DNA, 13 bp, D. melanogaster
gccataaaatcaa

SEQ ID NO: 627566 - DNA, 13 bp, D. melanogaster
gccataaaatgca

SEQ ID NO: 627567 - DNA, 13 bp, D. melanogaster
gccataaaatggc

SEQ ID NO: 627568 - DNA, 13 bp, D. melanogaster
gccataaacaaaa

SEQ ID NO: 627569 - DNA, 13 bp, D. melanogaster
gccataaacaaat

SEQ ID NO: 627570 - DNA, 13 bp, D. melanogaster
gccataaacaatt

SEQ ID NO: 627571 - DNA, 13 bp, D. melanogaster
gccataaacacca

SEQ ID NO: 627572 - DNA, 13 bp, D. melanogaster
gccataaacataa

SEQ ID NO: 627573 - DNA, 13 bp, D. melanogaster
gccataaagcagc

SEQ ID NO: 627574 - DNA, 13 bp, D. melanogaster
gccataaagccat

SEQ ID NO: 627575 - DNA, 13 bp, D. melanogaster
gccataaatatag

SEQ ID NO: 627576 - DNA, 13 bp, D. melanogaster
gccataaatattt

SEQ ID NO: 627577 - DNA, 13 bp, D. melanogaster
gccataaatcttg

SEQ ID NO: 627578 - DNA, 13 bp, D. melanogaster
gccataaatgaaa

SEQ ID NO: 627579 - DNA, 13 bp, D. melanogaster
gccataaatgtca

SEQ ID NO: 627580 - DNA, 13 bp, D. melanogaster
gccataaatgttt

SEQ ID NO: 627581 - DNA, 13 bp, D. melanogaster
gccataaattaaa

SEQ ID NO: 627582 - DNA, 14 bp, D. melanogaster
gccataaattaaat

SEQ ID NO: 627583 - DNA, 13 bp, D. melanogaster
gccataaatttaa

SEQ ID NO: 627584 - DNA, 13 bp, D. melanogaster
gccataacaattt

SEQ ID NO: 627585 - DNA, 13 bp, D. melanogaster
gccataagtccag

SEQ ID NO: 627586 - DNA, 13 bp, D. melanogaster
gccatacaaattg

SEQ ID NO: 627587 - DNA, 13 bp, D. melanogaster
gccatacgatttt

SEQ ID NO: 627588 - DNA, 14 bp, D. melanogaster
gccatacgattttt

SEQ ID NO: 627589 - DNA, 14 bp, D. melanogaster
gccatagccatagc

SEQ ID NO: 627590 - DNA, 13 bp, D. melanogaster
gccatataaaata

SEQ ID NO: 627591 - DNA, 13 bp, D. melanogaster
gccatataaatat

SEQ ID NO: 627592 - DNA, 14 bp, D. melanogaster
gccatatacatata

SEQ ID NO: 627593 - DNA, 13 bp, D. melanogaster
gccatataccata

SEQ ID NO: 627594 - DNA, 13 bp, D. melanogaster
gccatatatgtat

SEQ ID NO: 627595 - DNA, 14 bp, D. melanogaster
gccatattgggtta

SEQ ID NO: 627596 - DNA, 13 bp, D. melanogaster
gccatatttcatt

SEQ ID NO: 627597 - DNA, 13 bp, D. melanogaster
gccatcaaaaatg

SEQ ID NO: 627598 - DNA, 13 bp, D. melanogaster
gccatcaaaacaa

SEQ ID NO: 627599 - DNA, 13 bp, D. melanogaster
gccatcaaacggc

SEQ ID NO: 627600 - DNA, 13 bp, D. melanogaster
gccatcaaatatt

SEQ ID NO: 627601 - DNA, 13 bp, D. melanogaster
gccatcaaatgaa

SEQ ID NO: 627602 - DNA, 13 bp, D. melanogaster
gccatcaaatggc

SEQ ID NO: 627603 - DNA, 13 bp, D. melanogaster
gccatcaaattga

SEQ ID NO: 627604 - DNA, 13 bp, D. melanogaster
gccatcaatcaac

SEQ ID NO: 627605 - DNA, 13 bp, D. melanogaster
gccatcaccatcg

SEQ ID NO: 627606 - DNA, 13 bp, D. melanogaster
gccatcagcaaca

SEQ ID NO: 627607 - DNA, 14 bp, D. melanogaster
gccatcagccatca

SEQ ID NO: 627608 - DNA, 13 bp, D. melanogaster
gccatcatcatcg

SEQ ID NO: 627609 - DNA, 14 bp, D. melanogaster
gccatcatcatcgt

SEQ ID NO: 627610 - DNA, 13 bp, D. melanogaster
gccatcatcgtca

SEQ ID NO: 627611 - DNA, 13 bp, D. melanogaster
gccatccagccag

SEQ ID NO: 627612 - DNA, 14 bp, D. melanogaster
gccatccagccagc

SEQ ID NO: 627613 - DNA, 13 bp, D. melanogaster
gccatccagccat

SEQ ID NO: 627614 - DNA, 13 bp, D. melanogaster
gccatccgccatc

SEQ ID NO: 627615 - DNA, 13 bp, D. melanogaster
gccatccgctggc

SEQ ID NO: 627616 - DNA, 13 bp, D. melanogaster
gccatccgtccag

SEQ ID NO: 627617 - DNA, 13 bp, D. melanogaster
gccatcgaaagga

SEQ ID NO: 627618 - DNA, 13 bp, D. melanogaster
gccatcgaagttg

SEQ ID NO: 627619 - DNA, 13 bp, D. melanogaster
gccatcgacatcg

SEQ ID NO: 627620 - DNA, 13 bp, D. melanogaster
gccatcgattttg

SEQ ID NO: 627621 - DNA, 13 bp, D. melanogaster
gccatcgccatcg

SEQ ID NO: 627622 - DNA, 14 bp, D. melanogaster
gccatcgccatcgt

SEQ ID NO: 627623 - DNA, 13 bp, D. melanogaster
gccatcgccatct

SEQ ID NO: 627624 - DNA, 13 bp, D. melanogaster
gccatcggagctg

SEQ ID NO: 627625 - DNA, 13 bp, D. melanogaster
gccatcggtatgt

SEQ ID NO: 627626 - DNA, 14 bp, D. melanogaster
gccatctccgattt

SEQ ID NO: 627627 - DNA, 13 bp, D. melanogaster
gccatctcgctct

SEQ ID NO: 627628 - DNA, 14 bp, D. melanogaster
gccatctcgctctg

SEQ ID NO: 627629 - DNA, 13 bp, D. melanogaster
gccatctcgtctg

SEQ ID NO: 627630 - DNA, 13 bp, D. melanogaster
gccatctctgtcg

SEQ ID NO: 627631 - DNA, 13 bp, D. melanogaster
gccatctctgtct

SEQ ID NO: 627632 - DNA, 14 bp, D. melanogaster
gccatctctttcgc

SEQ ID NO: 627633 - DNA, 13 bp, D. melanogaster
gccatctctttct

SEQ ID NO: 627634 - DNA, 13 bp, D. melanogaster
gccatcttgcggc

SEQ ID NO: 627635 - DNA, 13 bp, D. melanogaster
gccatcttttttc

SEQ ID NO: 627636 - DNA, 13 bp, D. melanogaster
gccatgaaaatgc

SEQ ID NO: 627637 - DNA, 13 bp, D. melanogaster
gccatgaaattga

SEQ ID NO: 627638 - DNA, 14 bp, D. melanogaster
gccatgcaaacgaa

SEQ ID NO: 627639 - DNA, 13 bp, D. melanogaster
gccatgcaaatga

SEQ ID NO: 627640 - DNA, 13 bp, D. melanogaster
gccatgcaatttt

SEQ ID NO: 627641 - DNA, 13 bp, D. melanogaster
gccatgcagacgc

SEQ ID NO: 627642 - DNA, 13 bp, D. melanogaster
gccatgcatataa

SEQ ID NO: 627643 - DNA, 14 bp, D. melanogaster
gccatgccacgccc

SEQ ID NO: 627644 - DNA, 13 bp, D. melanogaster
gccatgcccactc

SEQ ID NO: 627645 - DNA, 14 bp, D. melanogaster
gccatgcgatagtt

SEQ ID NO: 627646 - DNA, 13 bp, D. melanogaster
gccatggaaaatg

SEQ ID NO: 627647 - DNA, 14 bp, D. melanogaster
gccatggaaagtgc

SEQ ID NO: 627648 - DNA, 13 bp, D. melanogaster
gccatggaaatgg

SEQ ID NO: 627649 - DNA, 13 bp, D. melanogaster
gccatggcaaatt

SEQ ID NO: 627650 - DNA, 13 bp, D. melanogaster
gccatggcaacaa

SEQ ID NO: 627651 - DNA, 13 bp, D. melanogaster
gccatggccaaaa

SEQ ID NO: 627652 - DNA, 13 bp, D. melanogaster
gccatggccataa

SEQ ID NO: 627653 - DNA, 13 bp, D. melanogaster
gccatggcccaaa

SEQ ID NO: 627654 - DNA, 13 bp, D. melanogaster
gccatggttaagt

SEQ ID NO: 627655 - DNA, 13 bp, D. melanogaster
gccatgtaaatgg

SEQ ID NO: 627656 - DNA, 13 bp, D. melanogaster
gccatgtccgtat

SEQ ID NO: 627657 - DNA, 13 bp, D. melanogaster
gccatgtccgtct

SEQ ID NO: 627658 - DNA, 13 bp, D. melanogaster
gccatgtcctggc

SEQ ID NO: 627659 - DNA, 13 bp, D. melanogaster
gccatgttgctgc

SEQ ID NO: 627660 - DNA, 13 bp, D. melanogaster
gccatgttggaca

SEQ ID NO: 627661 - DNA, 13 bp, D. melanogaster
gccattaaaaatt

SEQ ID NO: 627662 - DNA, 13 bp, D. melanogaster
gccattaaaacaa

SEQ ID NO: 627663 - DNA, 13 bp, D. melanogaster
gccattaaaagtt

SEQ ID NO: 627664 - DNA, 13 bp, D. melanogaster
gccattaaaattg

SEQ ID NO: 627665 - DNA, 13 bp, D. melanogaster
gccattaaaattt

SEQ ID NO: 627666 - DNA, 13 bp, D. melanogaster
gccattaaagcca

SEQ ID NO: 627667 - DNA, 13 bp, D. melanogaster
gccattaaataaa

SEQ ID NO: 627668 - DNA, 13 bp, D. melanogaster
gccattaaatatg

SEQ ID NO: 627669 - DNA, 13 bp, D. melanogaster
gccattaaatatt

SEQ ID NO: 627670 - DNA, 13 bp, D. melanogaster
gccattaatttaa

SEQ ID NO: 627671 - DNA, 13 bp, D. melanogaster
gccattaatttgc

SEQ ID NO: 627672 - DNA, 13 bp, D. melanogaster
gccattatttatt

SEQ ID NO: 627673 - DNA, 14 bp, D. melanogaster
gccattcacctaat

SEQ ID NO: 627674 - DNA, 13 bp, D. melanogaster
gccattcagatag

SEQ ID NO: 627675 - DNA, 13 bp, D. melanogaster
gccattcaggaat

SEQ ID NO: 627676 - DNA, 13 bp, D. melanogaster
gccattcatgcca

SEQ ID NO: 627677 - DNA, 13 bp, D. melanogaster
gccattcattggg

SEQ ID NO: 627678 - DNA, 13 bp, D. melanogaster
gccattcgccatt

SEQ ID NO: 627679 - DNA, 13 bp, D. melanogaster
gccattcggtggc

SEQ ID NO: 627680 - DNA, 13 bp, D. melanogaster
gccattctctgcg

SEQ ID NO: 627681 - DNA, 13 bp, D. melanogaster
gccattgaaatgc

SEQ ID NO: 627682 - DNA, 13 bp, D. melanogaster
gccattgaatgca

SEQ ID NO: 627683 - DNA, 13 bp, D. melanogaster
gccattgccaaaa

SEQ ID NO: 627684 - DNA, 13 bp, D. melanogaster
gccattgccgttg

SEQ ID NO: 627685 - DNA, 13 bp, D. melanogaster
gccattgcctttg

SEQ ID NO: 627686 - DNA, 13 bp, D. melanogaster
gccattggcaatt

SEQ ID NO: 627687 - DNA, 13 bp, D. melanogaster
gccattggcattt

SEQ ID NO: 627688 - DNA, 13 bp, D. melanogaster
gccattggccatt

SEQ ID NO: 627689 - DNA, 14 bp, D. melanogaster
gccattggccattg

SEQ ID NO: 627690 - DNA, 13 bp, D. melanogaster
gccattgtcattg

SEQ ID NO: 627691 - DNA, 13 bp, D. melanogaster
gccattgtcctgc

SEQ ID NO: 627692 - DNA, 13 bp, D. melanogaster
gccattgtctttg

SEQ ID NO: 627693 - DNA, 13 bp, D. melanogaster
gccattgttgctg

SEQ ID NO: 627694 - DNA, 13 bp, D. melanogaster
gccattgttgttg

SEQ ID NO: 627695 - DNA, 13 bp, D. melanogaster
gccattgtttggc

SEQ ID NO: 627696 - DNA, 13 bp, D. melanogaster
gccattgttttgc

SEQ ID NO: 627697 - DNA, 13 bp, D. melanogaster
gccatttaaatat

SEQ ID NO: 627698 - DNA, 13 bp, D. melanogaster
gccatttaatgag

SEQ ID NO: 627699 - DNA, 13 bp, D. melanogaster
gccatttaatggc

SEQ ID NO: 627700 - DNA, 13 bp, D. melanogaster
gccatttaattgt

SEQ ID NO: 627701 - DNA, 13 bp, D. melanogaster
gccatttacattt

SEQ ID NO: 627702 - DNA, 13 bp, D. melanogaster
gccatttcctttc

SEQ ID NO: 627703 - DNA, 13 bp, D. melanogaster
gccatttcggacc

SEQ ID NO: 627704 - DNA, 13 bp, D. melanogaster
gccatttctgaca

SEQ ID NO: 627705 - DNA, 13 bp, D. melanogaster
gccatttgactcg

SEQ ID NO: 627706 - DNA, 14 bp, D. melanogaster
gccatttgactcga

SEQ ID NO: 627707 - DNA, 13 bp, D. melanogaster
gccatttgatggc

SEQ ID NO: 627708 - DNA, 13 bp, D. melanogaster
gccatttgcaatt

SEQ ID NO: 627709 - DNA, 13 bp, D. melanogaster
gccatttgcataa

SEQ ID NO: 627710 - DNA, 13 bp, D. melanogaster
gccatttgcatac

SEQ ID NO: 627711 - DNA, 13 bp, D. melanogaster
gccatttgcatat

SEQ ID NO: 627712 - DNA, 13 bp, D. melanogaster
gccatttgcatgg

SEQ ID NO: 627713 - DNA, 14 bp, D. melanogaster
gccatttgcatttt

SEQ ID NO: 627714 - DNA, 14 bp, D. melanogaster
gccatttgccattt

SEQ ID NO: 627715 - DNA, 13 bp, D. melanogaster
gccatttgccttt

SEQ ID NO: 627716 - DNA, 13 bp, D. melanogaster
gccatttggcatt

SEQ ID NO: 627717 - DNA, 13 bp, D. melanogaster
gccatttggccat

SEQ ID NO: 627718 - DNA, 13 bp, D. melanogaster
gccatttggctgc

SEQ ID NO: 627719 - DNA, 14 bp, D. melanogaster
gccatttggcttaa

SEQ ID NO: 627720 - DNA, 13 bp, D. melanogaster
gccatttgttgtg

SEQ ID NO: 627721 - DNA, 13 bp, D. melanogaster
gccatttgttgtt

SEQ ID NO: 627722 - DNA, 13 bp, D. melanogaster
gccatttgtttgg

SEQ ID NO: 627723 - DNA, 13 bp, D. melanogaster
gccattttaaaaa

SEQ ID NO: 627724 - DNA, 13 bp, D. melanogaster
gccattttaaatg

SEQ ID NO: 627725 - DNA, 13 bp, D. melanogaster
gccattttataat

SEQ ID NO: 627726 - DNA, 14 bp, D. melanogaster
gccattttccattt

SEQ ID NO: 627727 - DNA, 13 bp, D. melanogaster
gccattttcctgg

SEQ ID NO: 627728 - DNA, 13 bp, D. melanogaster
gccattttgattt

SEQ ID NO: 627729 - DNA, 13 bp, D. melanogaster
gccattttgcaaa

SEQ ID NO: 627730 - DNA, 13 bp, D. melanogaster
gccattttgccat

SEQ ID NO: 627731 - DNA, 13 bp, D. melanogaster
gccattttgctgg

SEQ ID NO: 627732 - DNA, 13 bp, D. melanogaster
gccattttgctgt

SEQ ID NO: 627733 - DNA, 13 bp, D. melanogaster
gccattttgtgcg

SEQ ID NO: 627734 - DNA, 13 bp, D. melanogaster
gccattttgtgtg

SEQ ID NO: 627735 - DNA, 13 bp, D. melanogaster
gccatttttattg

SEQ ID NO: 627736 - DNA, 13 bp, D. melanogaster
gccatttttggct

SEQ ID NO: 627737 - DNA, 13 bp, D. melanogaster
gccattttttgta

SEQ ID NO: 627738 - DNA, 13 bp, D. melanogaster
gcccaaaaaataa

SEQ ID NO: 627739 - DNA, 13 bp, D. melanogaster
gcccaaaaaccag

SEQ ID NO: 627740 - DNA, 13 bp, D. melanogaster
gcccaaaaaccga

SEQ ID NO: 627741 - DNA, 13 bp, D. melanogaster
gcccaaaaagcaa

SEQ ID NO: 627742 - DNA, 13 bp, D. melanogaster
gcccaaaaaggag

SEQ ID NO: 627743 - DNA, 13 bp, D. melanogaster
gcccaaaaataaa

SEQ ID NO: 627744 - DNA, 13 bp, D. melanogaster
gcccaaaaatttc

SEQ ID NO: 627745 - DNA, 13 bp, D. melanogaster
gcccaaaagccaa

SEQ ID NO: 627746 - DNA, 13 bp, D. melanogaster
gcccaaaagcttt

SEQ ID NO: 627747 - DNA, 13 bp, D. melanogaster
gcccaaaaggaaa

SEQ ID NO: 627748 - DNA, 13 bp, D. melanogaster
gcccaaaatgctg

SEQ ID NO: 627749 - DNA, 13 bp, D. melanogaster
gcccaaacaaaat

SEQ ID NO: 627750 - DNA, 13 bp, D. melanogaster
gcccaaacatttt

SEQ ID NO: 627751 - DNA, 14 bp, D. melanogaster
gcccaaactatggc

SEQ ID NO: 627752 - DNA, 13 bp, D. melanogaster
gcccaaactggtg

SEQ ID NO: 627753 - DNA, 13 bp, D. melanogaster
gcccaaagcccaa

SEQ ID NO: 627754 - DNA, 13 bp, D. melanogaster
gcccaacaaagag

SEQ ID NO: 627755 - DNA, 13 bp, D. melanogaster
gcccaactaatta

SEQ ID NO: 627756 - DNA, 14 bp, D. melanogaster
gcccaagacacccg

SEQ ID NO: 627757 - DNA, 13 bp, D. melanogaster
gcccaagccaaag

SEQ ID NO: 627758 - DNA, 13 bp, D. melanogaster
gcccaaggagacc

SEQ ID NO: 627759 - DNA, 13 bp, D. melanogaster
gcccaagtaaagc

SEQ ID NO: 627760 - DNA, 13 bp, D. melanogaster
gcccaagtcttgg

SEQ ID NO: 627761 - DNA, 13 bp, D. melanogaster
gcccaagtgggcg

SEQ ID NO: 627762 - DNA, 13 bp, D. melanogaster
gcccaataagcca

SEQ ID NO: 627763 - DNA, 13 bp, D. melanogaster
gcccaatgaatgg

SEQ ID NO: 627764 - DNA, 13 bp, D. melanogaster
gcccaattttccc

SEQ ID NO: 627765 - DNA, 13 bp, D. melanogaster
gcccacaaaaagt

SEQ ID NO: 627766 - DNA, 13 bp, D. melanogaster
gcccacaaaaata

SEQ ID NO: 627767 - DNA, 14 bp, D. melanogaster
gcccacaaaaatac

SEQ ID NO: 627768 - DNA, 13 bp, D. melanogaster
gcccacaaaatgc

SEQ ID NO: 627769 - DNA, 13 bp, D. melanogaster
gcccacaaaccgc

SEQ ID NO: 627770 - DNA, 13 bp, D. melanogaster
gcccacaattttg

SEQ ID NO: 627771 - DNA, 13 bp, D. melanogaster
gcccacacagata

SEQ ID NO: 627772 - DNA, 13 bp, D. melanogaster
gcccacagacatc

SEQ ID NO: 627773 - DNA, 13 bp, D. melanogaster
gcccacagggaat

SEQ ID NO: 627774 - DNA, 13 bp, D. melanogaster
gcccacagttctt

SEQ ID NO: 627775 - DNA, 13 bp, D. melanogaster
gcccacatttgtg

SEQ ID NO: 627776 - DNA, 14 bp, D. melanogaster
gcccaccaaggagg

SEQ ID NO: 627777 - DNA, 13 bp, D. melanogaster
gcccaccaccact

SEQ ID NO: 627778 - DNA, 14 bp, D. melanogaster
gcccaccacccact

SEQ ID NO: 627779 - DNA, 13 bp, D. melanogaster
gcccaccataaca

SEQ ID NO: 627780 - DNA, 13 bp, D. melanogaster
gcccaccgactga

SEQ ID NO: 627781 - DNA, 13 bp, D. melanogaster
gcccactcacaca

SEQ ID NO: 627782 - DNA, 13 bp, D. melanogaster
gcccactcccact

SEQ ID NO: 627783 - DNA, 13 bp, D. melanogaster
gcccactgcccac

SEQ ID NO: 627784 - DNA, 13 bp, D. melanogaster
gcccactgtgcac

SEQ ID NO: 627785 - DNA, 13 bp, D. melanogaster
gcccactgtgcca

SEQ ID NO: 627786 - DNA, 13 bp, D. melanogaster
gcccactgtgcgc

SEQ ID NO: 627787 - DNA, 13 bp, D. melanogaster
gcccactgtgcgg

SEQ ID NO: 627788 - DNA, 13 bp, D. melanogaster
gcccactttcacc

SEQ ID NO: 627789 - DNA, 13 bp, D. melanogaster
gcccactttccat

SEQ ID NO: 627790 - DNA, 13 bp, D. melanogaster
gcccacttttcca

SEQ ID NO: 627791 - DNA, 14 bp, D. melanogaster
gcccacttttccaa

SEQ ID NO: 627792 - DNA, 13 bp, D. melanogaster
gcccacttttccc

SEQ ID NO: 627793 - DNA, 13 bp, D. melanogaster
gcccacttttccg

SEQ ID NO: 627794 - DNA, 13 bp, D. melanogaster
gcccagcagcaac

SEQ ID NO: 627795 - DNA, 13 bp, D. melanogaster
gcccagccacctg

SEQ ID NO: 627796 - DNA, 13 bp, D. melanogaster
gcccaggaaacct

SEQ ID NO: 627797 - DNA, 14 bp, D. melanogaster
gcccagtgccgaaa

SEQ ID NO: 627798 - DNA, 13 bp, D. melanogaster
gcccagttgccca

SEQ ID NO: 627799 - DNA, 13 bp, D. melanogaster
gcccataaatatt

SEQ ID NO: 627800 - DNA, 13 bp, D. melanogaster
gcccataacctgt

SEQ ID NO: 627801 - DNA, 13 bp, D. melanogaster
gcccataatgctg

SEQ ID NO: 627802 - DNA, 13 bp, D. melanogaster
gcccatatcaaca

SEQ ID NO: 627803 - DNA, 13 bp, D. melanogaster
gcccatcaaattc

SEQ ID NO: 627804 - DNA, 13 bp, D. melanogaster
gcccatccatcca

SEQ ID NO: 627805 - DNA, 13 bp, D. melanogaster
gcccatcctttaa

SEQ ID NO: 627806 - DNA, 14 bp, D. melanogaster
gcccatcgcccatc

SEQ ID NO: 627807 - DNA, 13 bp, D. melanogaster
gcccatctgaatc

SEQ ID NO: 627808 - DNA, 13 bp, D. melanogaster
gcccattcccatt

SEQ ID NO: 627809 - DNA, 13 bp, D. melanogaster
gcccattcgcaca

SEQ ID NO: 627810 - DNA, 13 bp, D. melanogaster
gcccattgaaatc

SEQ ID NO: 627811 - DNA, 13 bp, D. melanogaster
gcccattgcccat

SEQ ID NO: 627812 - DNA, 13 bp, D. melanogaster
gcccatttgtttg

SEQ ID NO: 627813 - DNA, 13 bp, D. melanogaster
gcccattttcccc

SEQ ID NO: 627814 - DNA, 13 bp, D. melanogaster
gccccaaaaaaga

SEQ ID NO: 627815 - DNA, 13 bp, D. melanogaster
gccccaaaaagca

SEQ ID NO: 627816 - DNA, 13 bp, D. melanogaster
gccccaaaaagta

SEQ ID NO: 627817 - DNA, 13 bp, D. melanogaster
gccccaaccactc

SEQ ID NO: 627818 - DNA, 13 bp, D. melanogaster
gccccaccagcga

SEQ ID NO: 627819 - DNA, 13 bp, D. melanogaster
gccccactccatc

SEQ ID NO: 627820 - DNA, 13 bp, D. melanogaster
gccccactgtgcc

SEQ ID NO: 627821 - DNA, 13 bp, D. melanogaster
gccccagcaacaa

SEQ ID NO: 627822 - DNA, 13 bp, D. melanogaster
gcccccaaaaaag

SEQ ID NO: 627823 - DNA, 13 bp, D. melanogaster
gcccccaaaaagc

SEQ ID NO: 627824 - DNA, 14 bp, D. melanogaster
gcccccgaaattct

SEQ ID NO: 627825 - DNA, 13 bp, D. melanogaster
gccccctcaaaaa

SEQ ID NO: 627826 - DNA, 13 bp, D. melanogaster
gcccccttttcga

SEQ ID NO: 627827 - DNA, 13 bp, D. melanogaster
gccccgaaaaaaa

SEQ ID NO: 627828 - DNA, 13 bp, D. melanogaster
gccccgcccactg

SEQ ID NO: 627829 - DNA, 14 bp, D. melanogaster
gccccgtcagcagg

SEQ ID NO: 627830 - DNA, 13 bp, D. melanogaster
gccccttttccat

SEQ ID NO: 627831 - DNA, 13 bp, D. melanogaster
gccccttttcgcc

SEQ ID NO: 627832 - DNA, 13 bp, D. melanogaster
gccccttttggcc

SEQ ID NO: 627833 - DNA, 13 bp, D. melanogaster
gcccgaaaacacg

SEQ ID NO: 627834 - DNA, 13 bp, D. melanogaster
gcccgaaaagaaa

SEQ ID NO: 627835 - DNA, 13 bp, D. melanogaster
gcccgaaagtatg

SEQ ID NO: 627836 - DNA, 13 bp, D. melanogaster
gcccgaaatgaaa

SEQ ID NO: 627837 - DNA, 14 bp, D. melanogaster
gcccgccactcgca

SEQ ID NO: 627838 - DNA, 13 bp, D. melanogaster
gcccggaaaattc

SEQ ID NO: 627839 - DNA, 13 bp, D. melanogaster
gcccgtcggcagc

SEQ ID NO: 627840 - DNA, 14 bp, D. melanogaster
gcccgtcggcagct

SEQ ID NO: 627841 - DNA, 13 bp, D. melanogaster
gcccgtgatttgg

SEQ ID NO: 627842 - DNA, 13 bp, D. melanogaster
gcccgtttgtttg

SEQ ID NO: 627843 - DNA, 13 bp, D. melanogaster
gcccgttttgcca

SEQ ID NO: 627844 - DNA, 13 bp, D. melanogaster
gccctaaaaccgc

SEQ ID NO: 627845 - DNA, 14 bp, D. melanogaster
gccctaaaaccgcc

SEQ ID NO: 627846 - DNA, 14 bp, D. melanogaster
gccctaataagttt

SEQ ID NO: 627847 - DNA, 13 bp, D. melanogaster
gccctagtggctt

SEQ ID NO: 627848 - DNA, 13 bp, D. melanogaster
gccctattcctga

SEQ ID NO: 627849 - DNA, 13 bp, D. melanogaster
gccctgcaattga

SEQ ID NO: 627850 - DNA, 14 bp, D. melanogaster
gccctgcgcgctgc

SEQ ID NO: 627851 - DNA, 13 bp, D. melanogaster
gcccttaagaaca

SEQ ID NO: 627852 - DNA, 13 bp, D. melanogaster
gcccttaagtact

SEQ ID NO: 627853 - DNA, 13 bp, D. melanogaster
gccctttcaaatg

SEQ ID NO: 627854 - DNA, 14 bp, D. melanogaster
gcccttttctttaa

SEQ ID NO: 627855 - DNA, 13 bp, D. melanogaster
gccgaaaaagttt

SEQ ID NO: 627856 - DNA, 14 bp, D. melanogaster
gccgaaaaataaaa

SEQ ID NO: 627857 - DNA, 13 bp, D. melanogaster
gccgaaaacaaag

SEQ ID NO: 627858 - DNA, 14 bp, D. melanogaster
gccgaaaaccgaaa

SEQ ID NO: 627859 - DNA, 13 bp, D. melanogaster
gccgaaaacgaaa

SEQ ID NO: 627860 - DNA, 13 bp, D. melanogaster
gccgaaaagaccc

SEQ ID NO: 627861 - DNA, 13 bp, D. melanogaster
gccgaaaagcaaa

SEQ ID NO: 627862 - DNA, 13 bp, D. melanogaster
gccgaaaagtaaa

SEQ ID NO: 627863 - DNA, 13 bp, D. melanogaster
gccgaaaatgcaa

SEQ ID NO: 627864 - DNA, 13 bp, D. melanogaster
gccgaaaccgaaa

SEQ ID NO: 627865 - DNA, 13 bp, D. melanogaster
gccgaaactaaaa

SEQ ID NO: 627866 - DNA, 13 bp, D. melanogaster
gccgaaagagagg

SEQ ID NO: 627867 - DNA, 13 bp, D. melanogaster
gccgaaaggaaaa

SEQ ID NO: 627868 - DNA, 13 bp, D. melanogaster
gccgaaagtgaaa

SEQ ID NO: 627869 - DNA, 13 bp, D. melanogaster
gccgaaataaaaa

SEQ ID NO: 627870 - DNA, 13 bp, D. melanogaster
gccgaaataaatt

SEQ ID NO: 627871 - DNA, 13 bp, D. melanogaster
gccgaacaacaaa

SEQ ID NO: 627872 - DNA, 13 bp, D. melanogaster
gccgaagaagaag

SEQ ID NO: 627873 - DNA, 13 bp, D. melanogaster
gccgaattcaaag

SEQ ID NO: 627874 - DNA, 13 bp, D. melanogaster
gccgacagtttga

SEQ ID NO: 627875 - DNA, 13 bp, D. melanogaster
gccgacgacgacg

SEQ ID NO: 627876 - DNA, 13 bp, D. melanogaster
gccgacgacttca

SEQ ID NO: 627877 - DNA, 13 bp, D. melanogaster
gccgacgcctgct

SEQ ID NO: 627878 - DNA, 13 bp, D. melanogaster
gccgacgtcgacg

SEQ ID NO: 627879 - DNA, 13 bp, D. melanogaster
gccgacgtcgctg

SEQ ID NO: 627880 - DNA, 14 bp, D. melanogaster
gccgacgtcgctgc

SEQ ID NO: 627881 - DNA, 13 bp, D. melanogaster
gccgactgcgacg

SEQ ID NO: 627882 - DNA, 14 bp, D. melanogaster
gccgactgcgctgc

SEQ ID NO: 627883 - DNA, 13 bp, D. melanogaster
gccgagaaaaatt

SEQ ID NO: 627884 - DNA, 13 bp, D. melanogaster
gccgagatttatg

SEQ ID NO: 627885 - DNA, 13 bp, D. melanogaster
gccgagcaaacaa

SEQ ID NO: 627886 - DNA, 13 bp, D. melanogaster
gccgagcaagatg

SEQ ID NO: 627887 - DNA, 13 bp, D. melanogaster
gccgagcagcaaa

SEQ ID NO: 627888 - DNA, 13 bp, D. melanogaster
gccgagctctgga

SEQ ID NO: 627889 - DNA, 13 bp, D. melanogaster
gccgaggaaaagc

SEQ ID NO: 627890 - DNA, 13 bp, D. melanogaster
gccgagggataca

SEQ ID NO: 627891 - DNA, 13 bp, D. melanogaster
gccgagtcgatct

SEQ ID NO: 627892 - DNA, 13 bp, D. melanogaster
gccgagtgccgag

SEQ ID NO: 627893 - DNA, 13 bp, D. melanogaster
gccgatccgatcc

SEQ ID NO: 627894 - DNA, 13 bp, D. melanogaster
gccgatgacgagg

SEQ ID NO: 627895 - DNA, 13 bp, D. melanogaster
gccgatgacgatg

SEQ ID NO: 627896 - DNA, 13 bp, D. melanogaster
gccgatggcatta

SEQ ID NO: 627897 - DNA, 13 bp, D. melanogaster
gccgatttccaag

SEQ ID NO: 627898 - DNA, 13 bp, D. melanogaster
gccgcaaaaagtg

SEQ ID NO: 627899 - DNA, 13 bp, D. melanogaster
gccgcaaaacttt

SEQ ID NO: 627900 - DNA, 13 bp, D. melanogaster
gccgcaaaagtgc

SEQ ID NO: 627901 - DNA, 13 bp, D. melanogaster
gccgcaaaatgaa

SEQ ID NO: 627902 - DNA, 13 bp, D. melanogaster
gccgcaaacaaac

SEQ ID NO: 627903 - DNA, 13 bp, D. melanogaster
gccgcaaactttt

SEQ ID NO: 627904 - DNA, 13 bp, D. melanogaster
gccgcaaagtatg

SEQ ID NO: 627905 - DNA, 13 bp, D. melanogaster
gccgcaacagcaa

SEQ ID NO: 627906 - DNA, 13 bp, D. melanogaster
gccgcaagatggc

SEQ ID NO: 627907 - DNA, 13 bp, D. melanogaster
gccgcaatggaat

SEQ ID NO: 627908 - DNA, 13 bp, D. melanogaster
gccgcacaaaaag

SEQ ID NO: 627909 - DNA, 13 bp, D. melanogaster
gccgcacaaaatg

SEQ ID NO: 627910 - DNA, 13 bp, D. melanogaster
gccgcacaaacgt

SEQ ID NO: 627911 - DNA, 13 bp, D. melanogaster
gccgcacaaattg

SEQ ID NO: 627912 - DNA, 13 bp, D. melanogaster
gccgcacagtggg

SEQ ID NO: 627913 - DNA, 13 bp, D. melanogaster
gccgcagacaaac

SEQ ID NO: 627914 - DNA, 13 bp, D. melanogaster
gccgcagcaacaa

SEQ ID NO: 627915 - DNA, 13 bp, D. melanogaster
gccgcagcaacag

SEQ ID NO: 627916 - DNA, 13 bp, D. melanogaster
gccgcagcagctg

SEQ ID NO: 627917 - DNA, 13 bp, D. melanogaster
gccgcagccgcag

SEQ ID NO: 627918 - DNA, 13 bp, D. melanogaster
gccgcagcgctcg

SEQ ID NO: 627919 - DNA, 14 bp, D. melanogaster
gccgcagcgctcga

SEQ ID NO: 627920 - DNA, 13 bp, D. melanogaster
gccgcaggacatt

SEQ ID NO: 627921 - DNA, 13 bp, D. melanogaster
gccgcagtcgacg

SEQ ID NO: 627922 - DNA, 13 bp, D. melanogaster
gccgcagtcgcag

SEQ ID NO: 627923 - DNA, 13 bp, D. melanogaster
gccgcagtctact

SEQ ID NO: 627924 - DNA, 13 bp, D. melanogaster
gccgcagttgcag

SEQ ID NO: 627925 - DNA, 13 bp, D. melanogaster
gccgcataaattt

SEQ ID NO: 627926 - DNA, 13 bp, D. melanogaster
gccgcatgcagaa

SEQ ID NO: 627927 - DNA, 13 bp, D. melanogaster
gccgcattaaaat

SEQ ID NO: 627928 - DNA, 13 bp, D. melanogaster
gccgcatttgcat

SEQ ID NO: 627929 - DNA, 13 bp, D. melanogaster
gccgcattttgtg

SEQ ID NO: 627930 - DNA, 13 bp, D. melanogaster
gccgccaaaaaaa

SEQ ID NO: 627931 - DNA, 13 bp, D. melanogaster
gccgccaaaccgg

SEQ ID NO: 627932 - DNA, 13 bp, D. melanogaster
gccgccattttgg

SEQ ID NO: 627933 - DNA, 13 bp, D. melanogaster
gccgccattttgt

SEQ ID NO: 627934 - DNA, 13 bp, D. melanogaster
gccgccccctttt

SEQ ID NO: 627935 - DNA, 13 bp, D. melanogaster
gccgccccttttg

SEQ ID NO: 627936 - DNA, 13 bp, D. melanogaster
gccgccgtcgaca

SEQ ID NO: 627937 - DNA, 13 bp, D. melanogaster
gccgccgtcgctg

SEQ ID NO: 627938 - DNA, 13 bp, D. melanogaster
gccgccgttgccg

SEQ ID NO: 627939 - DNA, 13 bp, D. melanogaster
gccgcctgtccag

SEQ ID NO: 627940 - DNA, 13 bp, D. melanogaster
gccgcctttgttg

SEQ ID NO: 627941 - DNA, 13 bp, D. melanogaster
gccgccttttgtt

SEQ ID NO: 627942 - DNA, 13 bp, D. melanogaster
gccgcgaatgcgt

SEQ ID NO: 627943 - DNA, 13 bp, D. melanogaster
gccgcgctctctg

SEQ ID NO: 627944 - DNA, 13 bp, D. melanogaster
gccgcgctgttgt

SEQ ID NO: 627945 - DNA, 13 bp, D. melanogaster
gccgctattgcta

SEQ ID NO: 627946 - DNA, 13 bp, D. melanogaster
gccgctcaagata

SEQ ID NO: 627947 - DNA, 13 bp, D. melanogaster
gccgctcgatttc

SEQ ID NO: 627948 - DNA, 14 bp, D. melanogaster
gccgctgccactgc

SEQ ID NO: 627949 - DNA, 13 bp, D. melanogaster
gccgctgccgacg

SEQ ID NO: 627950 - DNA, 13 bp, D. melanogaster
gccgctgccgctg

SEQ ID NO: 627951 - DNA, 13 bp, D. melanogaster
gccgctgccgttg

SEQ ID NO: 627952 - DNA, 13 bp, D. melanogaster
gccgctgcctttt

SEQ ID NO: 627953 - DNA, 13 bp, D. melanogaster
gccgctgcgctgc

SEQ ID NO: 627954 - DNA, 13 bp, D. melanogaster
gccgctgctgatg

SEQ ID NO: 627955 - DNA, 13 bp, D. melanogaster
gccgctgctgcat

SEQ ID NO: 627956 - DNA, 14 bp, D. melanogaster
gccgctgctgctgt

SEQ ID NO: 627957 - DNA, 13 bp, D. melanogaster
gccgctgctgctt

SEQ ID NO: 627958 - DNA, 14 bp, D. melanogaster
gccgctgctgttgt

SEQ ID NO: 627959 - DNA, 14 bp, D. melanogaster
gccgctgcttctgc

SEQ ID NO: 627960 - DNA, 13 bp, D. melanogaster
gccgctggcattt

SEQ ID NO: 627961 - DNA, 13 bp, D. melanogaster
gccgctgtcgacg

SEQ ID NO: 627962 - DNA, 13 bp, D. melanogaster
gccgctgtcgctg

SEQ ID NO: 627963 - DNA, 13 bp, D. melanogaster
gccgctgttgttg

SEQ ID NO: 627964 - DNA, 14 bp, D. melanogaster
gccgctgttgttgc

SEQ ID NO: 627965 - DNA, 13 bp, D. melanogaster
gccgcttctgcca

SEQ ID NO: 627966 - DNA, 14 bp, D. melanogaster
gccgcttctgccat

SEQ ID NO: 627967 - DNA, 13 bp, D. melanogaster
gccgcttctgctg

SEQ ID NO: 627968 - DNA, 13 bp, D. melanogaster
gccgcttcttctt

SEQ ID NO: 627969 - DNA, 13 bp, D. melanogaster
gccgctttatctg

SEQ ID NO: 627970 - DNA, 15 bp, D. melanogaster
gccgctttatctggc

SEQ ID NO: 627971 - DNA, 13 bp, D. melanogaster
gccgctttgtttg

SEQ ID NO: 627972 - DNA, 13 bp, D. melanogaster
gccggaaaagcga

SEQ ID NO: 627973 - DNA, 13 bp, D. melanogaster
gccggaaaagcgg

SEQ ID NO: 627974 - DNA, 13 bp, D. melanogaster
gccggaaaagtgc

SEQ ID NO: 627975 - DNA, 13 bp, D. melanogaster
gccggaaacggaa

SEQ ID NO: 627976 - DNA, 14 bp, D. melanogaster
gccggaaacggaag

SEQ ID NO: 627977 - DNA, 13 bp, D. melanogaster
gccggaaatctgt

SEQ ID NO: 627978 - DNA, 13 bp, D. melanogaster
gccggaataaccc

SEQ ID NO: 627979 - DNA, 13 bp, D. melanogaster
gccggagagcagc

SEQ ID NO: 627980 - DNA, 13 bp, D. melanogaster
gccggatgcggtg

SEQ ID NO: 627981 - DNA, 13 bp, D. melanogaster
gccggcaaaagtt

SEQ ID NO: 627982 - DNA, 13 bp, D. melanogaster
gccggcaaacaaa

SEQ ID NO: 627983 - DNA, 13 bp, D. melanogaster
gccggcaaataaa

SEQ ID NO: 627984 - DNA, 13 bp, D. melanogaster
gccggcaaatgaa

SEQ ID NO: 627985 - DNA, 13 bp, D. melanogaster
gccggcagaggca

SEQ ID NO: 627986 - DNA, 13 bp, D. melanogaster
gccggcagcgacg

SEQ ID NO: 627987 - DNA, 14 bp, D. melanogaster
gccggcagcgacgt

SEQ ID NO: 627988 - DNA, 13 bp, D. melanogaster
gccggcgaaagag

SEQ ID NO: 627989 - DNA, 13 bp, D. melanogaster
gccggcgtcgcag

SEQ ID NO: 627990 - DNA, 13 bp, D. melanogaster
gccgggccaacaa

SEQ ID NO: 627991 - DNA, 13 bp, D. melanogaster
gccggtaaccacc

SEQ ID NO: 627992 - DNA, 13 bp, D. melanogaster
gccggtttcccgt

SEQ ID NO: 627993 - DNA, 13 bp, D. melanogaster
gccgtaatgtcgc

SEQ ID NO: 627994 - DNA, 13 bp, D. melanogaster
gccgtaccgccgc

SEQ ID NO: 627995 - DNA, 13 bp, D. melanogaster
gccgtatactgcc

SEQ ID NO: 627996 - DNA, 13 bp, D. melanogaster
gccgtcatcatca

SEQ ID NO: 627997 - DNA, 13 bp, D. melanogaster
gccgtcgacagcg

SEQ ID NO: 627998 - DNA, 13 bp, D. melanogaster
gccgtcgacgtcg

SEQ ID NO: 627999 - DNA, 13 bp, D. melanogaster
gccgtcgccgtcg

SEQ ID NO: 628000 - DNA, 13 bp, D. melanogaster
gccgtctccacgg

SEQ ID NO: 628001 - DNA, 14 bp, D. melanogaster
gccgtctcgctcgc

SEQ ID NO: 628002 - DNA, 13 bp, D. melanogaster
gccgtctcgctct

SEQ ID NO: 628003 - DNA, 13 bp, D. melanogaster
gccgtctctctct

SEQ ID NO: 628004 - DNA, 14 bp, D. melanogaster
gccgtctctttcgc

SEQ ID NO: 628005 - DNA, 13 bp, D. melanogaster
gccgtctctttct

SEQ ID NO: 628006 - DNA, 13 bp, D. melanogaster
gccgtctgcaaaa

SEQ ID NO: 628007 - DNA, 14 bp, D. melanogaster
gccgtgctaattgc

SEQ ID NO: 628008 - DNA, 13 bp, D. melanogaster
gccgtggagtatg

SEQ ID NO: 628009 - DNA, 13 bp, D. melanogaster
gccgtggccaaaa

SEQ ID NO: 628010 - DNA, 14 bp, D. melanogaster
gccgtggccaacaa

SEQ ID NO: 628011 - DNA, 13 bp, D. melanogaster
gccgttgccattg

SEQ ID NO: 628012 - DNA, 14 bp, D. melanogaster
gccgttgccattgc

SEQ ID NO: 628013 - DNA, 14 bp, D. melanogaster
gccgttgccgttgc

SEQ ID NO: 628014 - DNA, 13 bp, D. melanogaster
gccgttgtcgttg

SEQ ID NO: 628015 - DNA, 13 bp, D. melanogaster
gccgtttgccgtt

SEQ ID NO: 628016 - DNA, 13 bp, D. melanogaster
gccgtttgtttgc

SEQ ID NO: 628017 - DNA, 14 bp, D. melanogaster
gcctaaaagtatgc

SEQ ID NO: 628018 - DNA, 14 bp, D. melanogaster
gcctaagtctttcg

SEQ ID NO: 628019 - DNA, 14 bp, D. melanogaster
gcctaagtcttttg

SEQ ID NO: 628020 - DNA, 13 bp, D. melanogaster
gcctaataaaatt

SEQ ID NO: 628021 - DNA, 13 bp, D. melanogaster
gcctaataaacaa

SEQ ID NO: 628022 - DNA, 13 bp, D. melanogaster
gcctaattaaaaa

SEQ ID NO: 628023 - DNA, 13 bp, D. melanogaster
gcctaatttatgt

SEQ ID NO: 628024 - DNA, 13 bp, D. melanogaster
gcctacataattt

SEQ ID NO: 628025 - DNA, 13 bp, D. melanogaster
gcctacttttggg

SEQ ID NO: 628026 - DNA, 13 bp, D. melanogaster
gcctagatcacaa

SEQ ID NO: 628027 - DNA, 13 bp, D. melanogaster
gcctagggcaaac

SEQ ID NO: 628028 - DNA, 13 bp, D. melanogaster
gcctatatatata

SEQ ID NO: 628029 - DNA, 13 bp, D. melanogaster
gcctatcactatg

SEQ ID NO: 628030 - DNA, 13 bp, D. melanogaster
gcctatctttatg

SEQ ID NO: 628031 - DNA, 13 bp, D. melanogaster
gcctcaaagtgaa

SEQ ID NO: 628032 - DNA, 13 bp, D. melanogaster
gcctcaagatatg

SEQ ID NO: 628033 - DNA, 13 bp, D. melanogaster
gcctcaagtgctt

SEQ ID NO: 628034 - DNA, 14 bp, D. melanogaster
gcctcacatcctgc

SEQ ID NO: 628035 - DNA, 13 bp, D. melanogaster
gcctcagcaagga

SEQ ID NO: 628036 - DNA, 13 bp, D. melanogaster
gcctcagcctcag

SEQ ID NO: 628037 - DNA, 13 bp, D. melanogaster
gcctcagttatct

SEQ ID NO: 628038 - DNA, 13 bp, D. melanogaster
gcctcatcatcat

SEQ ID NO: 628039 - DNA, 14 bp, D. melanogaster
gcctcatcatcatc

SEQ ID NO: 628040 - DNA, 13 bp, D. melanogaster
gcctccatgagct

SEQ ID NO: 628041 - DNA, 13 bp, D. melanogaster
gcctccgaaaaag

SEQ ID NO: 628042 - DNA, 13 bp, D. melanogaster
gcctcctaaaata

SEQ ID NO: 628043 - DNA, 13 bp, D. melanogaster
gcctcctcattga

SEQ ID NO: 628044 - DNA, 14 bp, D. melanogaster
gcctcctccagttt

SEQ ID NO: 628045 - DNA, 13 bp, D. melanogaster
gcctccttggtgg

SEQ ID NO: 628046 - DNA, 13 bp, D. melanogaster
gcctcctttacca

SEQ ID NO: 628047 - DNA, 13 bp, D. melanogaster
gcctctaaagcca

SEQ ID NO: 628048 - DNA, 13 bp, D. melanogaster
gcctctacttcat

SEQ ID NO: 628049 - DNA, 13 bp, D. melanogaster
gcctctcattctg

SEQ ID NO: 628050 - DNA, 13 bp, D. melanogaster
gcctctctctgcg

SEQ ID NO: 628051 - DNA, 13 bp, D. melanogaster
gcctctgccgacg

SEQ ID NO: 628052 - DNA, 13 bp, D. melanogaster
gcctctgccgcag

SEQ ID NO: 628053 - DNA, 13 bp, D. melanogaster
gcctctgccgccg

SEQ ID NO: 628054 - DNA, 13 bp, D. melanogaster
gcctctgccggcg

SEQ ID NO: 628055 - DNA, 13 bp, D. melanogaster
gcctctgtagttt

SEQ ID NO: 628056 - DNA, 13 bp, D. melanogaster
gcctctgtgtgcg

SEQ ID NO: 628057 - DNA, 14 bp, D. melanogaster
gcctctgtgtgtgt

SEQ ID NO: 628058 - DNA, 13 bp, D. melanogaster
gcctctgtttcca

SEQ ID NO: 628059 - DNA, 13 bp, D. melanogaster
gcctcttcgcttt

SEQ ID NO: 628060 - DNA, 14 bp, D. melanogaster
gcctcttcgctttg

SEQ ID NO: 628061 - DNA, 14 bp, D. melanogaster
gcctgaaaacaaaa

SEQ ID NO: 628062 - DNA, 13 bp, D. melanogaster
gcctgaaaacagt

SEQ ID NO: 628063 - DNA, 14 bp, D. melanogaster
gcctgaaagtatgc

SEQ ID NO: 628064 - DNA, 13 bp, D. melanogaster
gcctgacctaagc

SEQ ID NO: 628065 - DNA, 13 bp, D. melanogaster
gcctgactgcctg

SEQ ID NO: 628066 - DNA, 13 bp, D. melanogaster
gcctgagttggca

SEQ ID NO: 628067 - DNA, 13 bp, D. melanogaster
gcctgatggtgtc

SEQ ID NO: 628068 - DNA, 14 bp, D. melanogaster
gcctgcagaacagc

SEQ ID NO: 628069 - DNA, 13 bp, D. melanogaster
gcctgcagttctt

SEQ ID NO: 628070 - DNA, 13 bp, D. melanogaster
gcctgcattgttt

SEQ ID NO: 628071 - DNA, 13 bp, D. melanogaster
gcctgcattttat

SEQ ID NO: 628072 - DNA, 14 bp, D. melanogaster
gcctgccacgcccc

SEQ ID NO: 628073 - DNA, 13 bp, D. melanogaster
gcctgccagcgct

SEQ ID NO: 628074 - DNA, 14 bp, D. melanogaster
gcctgccagcgcta

SEQ ID NO: 628075 - DNA, 13 bp, D. melanogaster
gcctgccgcctgc

SEQ ID NO: 628076 - DNA, 14 bp, D. melanogaster
gcctgcctgcctgc

SEQ ID NO: 628077 - DNA, 13 bp, D. melanogaster
gcctgcctggctg

SEQ ID NO: 628078 - DNA, 13 bp, D. melanogaster
gcctgctcgcaaa

SEQ ID NO: 628079 - DNA, 13 bp, D. melanogaster
gcctgctgcctgc

SEQ ID NO: 628080 - DNA, 15 bp, D. melanogaster
gcctgctgcctgctg

SEQ ID NO: 628081 - DNA, 13 bp, D. melanogaster
gcctgctgcgaga

SEQ ID NO: 628082 - DNA, 13 bp, D. melanogaster
gcctgctgcgcaa

SEQ ID NO: 628083 - DNA, 13 bp, D. melanogaster
gcctgctgtctgc

SEQ ID NO: 628084 - DNA, 13 bp, D. melanogaster
gcctgcttgcaaa

SEQ ID NO: 628085 - DNA, 13 bp, D. melanogaster
gcctggaaagaga

SEQ ID NO: 628086 - DNA, 14 bp, D. melanogaster
gcctggagctctgg

SEQ ID NO: 628087 - DNA, 13 bp, D. melanogaster
gcctggcaaattg

SEQ ID NO: 628088 - DNA, 13 bp, D. melanogaster
gcctggccaaaag

SEQ ID NO: 628089 - DNA, 13 bp, D. melanogaster
gcctggcccaaaa

SEQ ID NO: 628090 - DNA, 13 bp, D. melanogaster
gcctggctgactg

SEQ ID NO: 628091 - DNA, 13 bp, D. melanogaster
gcctggctgcctg

SEQ ID NO: 628092 - DNA, 13 bp, D. melanogaster
gcctggctggctg

SEQ ID NO: 628093 - DNA, 13 bp, D. melanogaster
gcctggtcttttt

SEQ ID NO: 628094 - DNA, 13 bp, D. melanogaster
gcctgtatgtgtg

SEQ ID NO: 628095 - DNA, 14 bp, D. melanogaster
gcctgtatttcttt

SEQ ID NO: 628096 - DNA, 13 bp, D. melanogaster
gcctgtccgtccg

SEQ ID NO: 628097 - DNA, 13 bp, D. melanogaster
gcctgtgaaattg

SEQ ID NO: 628098 - DNA, 13 bp, D. melanogaster
gcctgtgcctgtg

SEQ ID NO: 628099 - DNA, 13 bp, D. melanogaster
gcctgtgtctgtg

SEQ ID NO: 628100 - DNA, 13 bp, D. melanogaster
gcctgtgtgcgtg

SEQ ID NO: 628101 - DNA, 13 bp, D. melanogaster
gcctgtgtgtgcg

SEQ ID NO: 628102 - DNA, 13 bp, D. melanogaster
gcctgtgtgtgtt

SEQ ID NO: 628103 - DNA, 13 bp, D. melanogaster
gcctgtgtttgtg

SEQ ID NO: 628104 - DNA, 14 bp, D. melanogaster
gcctgttgattgat

SEQ ID NO: 628105 - DNA, 13 bp, D. melanogaster
gcctgttggtgtg

SEQ ID NO: 628106 - DNA, 13 bp, D. melanogaster
gcctgtttgcctt

SEQ ID NO: 628107 - DNA, 14 bp, D. melanogaster
gcctgttttggcat

SEQ ID NO: 628108 - DNA, 13 bp, D. melanogaster
gccttaaaacttt

SEQ ID NO: 628109 - DNA, 13 bp, D. melanogaster
gccttaaaatcaa

SEQ ID NO: 628110 - DNA, 13 bp, D. melanogaster
gccttaaagaaga

SEQ ID NO: 628111 - DNA, 13 bp, D. melanogaster
gccttaaagtatg

SEQ ID NO: 628112 - DNA, 14 bp, D. melanogaster
gccttaataaataa

SEQ ID NO: 628113 - DNA, 13 bp, D. melanogaster
gccttactaattg

SEQ ID NO: 628114 - DNA, 13 bp, D. melanogaster
gccttatacattt

SEQ ID NO: 628115 - DNA, 13 bp, D. melanogaster
gccttattcaatt

SEQ ID NO: 628116 - DNA, 13 bp, D. melanogaster
gccttattgacaa

SEQ ID NO: 628117 - DNA, 13 bp, D. melanogaster
gccttcaaagtgc

SEQ ID NO: 628118 - DNA, 14 bp, D. melanogaster
gccttcatccagtt

SEQ ID NO: 628119 - DNA, 13 bp, D. melanogaster
gccttcgccttcg

SEQ ID NO: 628120 - DNA, 13 bp, D. melanogaster
gccttctctgcca

SEQ ID NO: 628121 - DNA, 13 bp, D. melanogaster
gccttcttgctgg

SEQ ID NO: 628122 - DNA, 13 bp, D. melanogaster
gccttgaatgttt

SEQ ID NO: 628123 - DNA, 13 bp, D. melanogaster
gccttgatctcca

SEQ ID NO: 628124 - DNA, 13 bp, D. melanogaster
gccttgatttatg

SEQ ID NO: 628125 - DNA, 13 bp, D. melanogaster
gccttgcgtgaaa

SEQ ID NO: 628126 - DNA, 13 bp, D. melanogaster
gccttgctttgct

SEQ ID NO: 628127 - DNA, 13 bp, D. melanogaster
gccttggaactgg

SEQ ID NO: 628128 - DNA, 13 bp, D. melanogaster
gccttggcaatgc

SEQ ID NO: 628129 - DNA, 13 bp, D. melanogaster
gccttggccaaaa

SEQ ID NO: 628130 - DNA, 13 bp, D. melanogaster
gccttgttcagct

SEQ ID NO: 628131 - DNA, 13 bp, D. melanogaster
gccttgttgaatt

SEQ ID NO: 628132 - DNA, 13 bp, D. melanogaster
gccttgttggcca

SEQ ID NO: 628133 - DNA, 13 bp, D. melanogaster
gcctttcccttca

SEQ ID NO: 628134 - DNA, 13 bp, D. melanogaster
gcctttgatttgc

SEQ ID NO: 628135 - DNA, 13 bp, D. melanogaster
gcctttgcagccg

SEQ ID NO: 628136 - DNA, 13 bp, D. melanogaster
gcctttgccattg

SEQ ID NO: 628137 - DNA, 14 bp, D. melanogaster
gcctttgccattgc

SEQ ID NO: 628138 - DNA, 13 bp, D. melanogaster
gcctttgcctttt

SEQ ID NO: 628139 - DNA, 13 bp, D. melanogaster
gcctttgcttttg

SEQ ID NO: 628140 - DNA, 14 bp, D. melanogaster
gcctttgcttttgc

SEQ ID NO: 628141 - DNA, 13 bp, D. melanogaster
gcctttgtcagtt

SEQ ID NO: 628142 - DNA, 13 bp, D. melanogaster
gcctttgtgtgcg

SEQ ID NO: 628143 - DNA, 13 bp, D. melanogaster
gcctttgtgtgtt

SEQ ID NO: 628144 - DNA, 13 bp, D. melanogaster
gcctttgttagcc

SEQ ID NO: 628145 - DNA, 13 bp, D. melanogaster
gcctttgttgcgg

SEQ ID NO: 628146 - DNA, 13 bp, D. melanogaster
gcctttgttggcc

SEQ ID NO: 628147 - DNA, 13 bp, D. melanogaster
gcctttgtttatt

SEQ ID NO: 628148 - DNA, 13 bp, D. melanogaster
gcctttgtttgcc

SEQ ID NO: 628149 - DNA, 13 bp, D. melanogaster
gccttttgccttt

SEQ ID NO: 628150 - DNA, 13 bp, D. melanogaster
gccttttgctttc

SEQ ID NO: 628151 - DNA, 14 bp, D. melanogaster
gccttttggccaaa

SEQ ID NO: 628152 - DNA, 13 bp, D. melanogaster
gccttttggccat

SEQ ID NO: 628153 - DNA, 13 bp, D. melanogaster
gccttttggcccg

SEQ ID NO: 628154 - DNA, 13 bp, D. melanogaster
gccttttgggcca

SEQ ID NO: 628155 - DNA, 13 bp, D. melanogaster
gccttttgtctgc

SEQ ID NO: 628156 - DNA, 13 bp, D. melanogaster
gccttttgtttat

SEQ ID NO: 628157 - DNA, 13 bp, D. melanogaster
gcctttttccagg

SEQ ID NO: 628158 - DNA, 13 bp, D. melanogaster
gcctttttccatt

SEQ ID NO: 628159 - DNA, 13 bp, D. melanogaster
gcgaaaaaagtgt

SEQ ID NO: 628160 - DNA, 13 bp, D. melanogaster
gcgaaaaaatgtt

SEQ ID NO: 628161 - DNA, 13 bp, D. melanogaster
gcgaaaaaattca

SEQ ID NO: 628162 - DNA, 13 bp, D. melanogaster
gcgaaaaacaagt

SEQ ID NO: 628163 - DNA, 13 bp, D. melanogaster
gcgaaaaagtgaa

SEQ ID NO: 628164 - DNA, 13 bp, D. melanogaster
gcgaaaaagtttt

SEQ ID NO: 628165 - DNA, 14 bp, D. melanogaster
gcgaaaaatcaaaa

SEQ ID NO: 628166 - DNA, 13 bp, D. melanogaster
gcgaaaaattgac

SEQ ID NO: 628167 - DNA, 13 bp, D. melanogaster
gcgaaaacttttc

SEQ ID NO: 628168 - DNA, 13 bp, D. melanogaster
gcgaaaacttttg

SEQ ID NO: 628169 - DNA, 13 bp, D. melanogaster
gcgaaaagcgaaa

SEQ ID NO: 628170 - DNA, 13 bp, D. melanogaster
gcgaaaaggacga

SEQ ID NO: 628171 - DNA, 13 bp, D. melanogaster
gcgaaaagtaaaa

SEQ ID NO: 628172 - DNA, 13 bp, D. melanogaster
gcgaaaagtcaaa

SEQ ID NO: 628173 - DNA, 13 bp, D. melanogaster
gcgaaaagtgaaa

SEQ ID NO: 628174 - DNA, 13 bp, D. melanogaster
gcgaaaagtgcaa

SEQ ID NO: 628175 - DNA, 13 bp, D. melanogaster
gcgaaaagtgggc

SEQ ID NO: 628176 - DNA, 13 bp, D. melanogaster
gcgaaaagtttgt

SEQ ID NO: 628177 - DNA, 13 bp, D. melanogaster
gcgaaaagttttc

SEQ ID NO: 628178 - DNA, 13 bp, D. melanogaster
gcgaaaatatatt

SEQ ID NO: 628179 - DNA, 13 bp, D. melanogaster
gcgaaaatcaatt

SEQ ID NO: 628180 - DNA, 13 bp, D. melanogaster
gcgaaaatcgaaa

SEQ ID NO: 628181 - DNA, 13 bp, D. melanogaster
gcgaaaatgaaaa

SEQ ID NO: 628182 - DNA, 14 bp, D. melanogaster
gcgaaaatgaaaat

SEQ ID NO: 628183 - DNA, 13 bp, D. melanogaster
gcgaaaatggaaa

SEQ ID NO: 628184 - DNA, 13 bp, D. melanogaster
gcgaaaatggcaa

SEQ ID NO: 628185 - DNA, 13 bp, D. melanogaster
gcgaaaatgttgc

SEQ ID NO: 628186 - DNA, 13 bp, D. melanogaster
gcgaaaattattt

SEQ ID NO: 628187 - DNA, 13 bp, D. melanogaster
gcgaaaattgaaa

SEQ ID NO: 628188 - DNA, 13 bp, D. melanogaster
gcgaaacaaaagc

SEQ ID NO: 628189 - DNA, 13 bp, D. melanogaster
gcgaaacaataat

SEQ ID NO: 628190 - DNA, 13 bp, D. melanogaster
gcgaaaccaattt

SEQ ID NO: 628191 - DNA, 13 bp, D. melanogaster
gcgaaacgaaaac

SEQ ID NO: 628192 - DNA, 13 bp, D. melanogaster
gcgaaacgaaacg

SEQ ID NO: 628193 - DNA, 13 bp, D. melanogaster
gcgaaacgcactg

SEQ ID NO: 628194 - DNA, 14 bp, D. melanogaster
gcgaaacgcactgt

SEQ ID NO: 628195 - DNA, 13 bp, D. melanogaster
gcgaaacttttgc

SEQ ID NO: 628196 - DNA, 13 bp, D. melanogaster
gcgaaagacttca

SEQ ID NO: 628197 - DNA, 13 bp, D. melanogaster
gcgaaagagacag

SEQ ID NO: 628198 - DNA, 13 bp, D. melanogaster
gcgaaagagacgg

SEQ ID NO: 628199 - DNA, 14 bp, D. melanogaster
gcgaaagagacggc

SEQ ID NO: 628200 - DNA, 13 bp, D. melanogaster
gcgaaagagagcg

SEQ ID NO: 628201 - DNA, 13 bp, D. melanogaster
gcgaaagagaggc

SEQ ID NO: 628202 - DNA, 14 bp, D. melanogaster
gcgaaagagagggc

SEQ ID NO: 628203 - DNA, 13 bp, D. melanogaster
gcgaaagagatag

SEQ ID NO: 628204 - DNA, 13 bp, D. melanogaster
gcgaaagagatgg

SEQ ID NO: 628205 - DNA, 13 bp, D. melanogaster
gcgaaagagcgag

SEQ ID NO: 628206 - DNA, 13 bp, D. melanogaster
gcgaaagcaaaac

SEQ ID NO: 628207 - DNA, 14 bp, D. melanogaster
gcgaaagcactggc

SEQ ID NO: 628208 - DNA, 13 bp, D. melanogaster
gcgaaagcgaaag

SEQ ID NO: 628209 - DNA, 13 bp, D. melanogaster
gcgaaaggaaaac

SEQ ID NO: 628210 - DNA, 13 bp, D. melanogaster
gcgaaaggagcag

SEQ ID NO: 628211 - DNA, 13 bp, D. melanogaster
gcgaaaggcgaaa

SEQ ID NO: 628212 - DNA, 13 bp, D. melanogaster
gcgaaagtaataa

SEQ ID NO: 628213 - DNA, 13 bp, D. melanogaster
gcgaaagtgaaaa

SEQ ID NO: 628214 - DNA, 13 bp, D. melanogaster
gcgaaataaaaat

SEQ ID NO: 628215 - DNA, 14 bp, D. melanogaster
gcgaaataaataaa

SEQ ID NO: 628216 - DNA, 13 bp, D. melanogaster
gcgaaataataat

SEQ ID NO: 628217 - DNA, 13 bp, D. melanogaster
gcgaaataatttt

SEQ ID NO: 628218 - DNA, 14 bp, D. melanogaster
gcgaaataccagtg

SEQ ID NO: 628219 - DNA, 13 bp, D. melanogaster
gcgaaatatgcaa

SEQ ID NO: 628220 - DNA, 13 bp, D. melanogaster
gcgaaatatttta

SEQ ID NO: 628221 - DNA, 13 bp, D. melanogaster
gcgaaatattttg

SEQ ID NO: 628222 - DNA, 13 bp, D. melanogaster
gcgaaatcaaaag

SEQ ID NO: 628223 - DNA, 13 bp, D. melanogaster
gcgaaatcaaatt

SEQ ID NO: 628224 - DNA, 13 bp, D. melanogaster
gcgaaatccaaat

SEQ ID NO: 628225 - DNA, 13 bp, D. melanogaster
gcgaaatgaaaaa

SEQ ID NO: 628226 - DNA, 14 bp, D. melanogaster
gcgaaatgaaaaca

SEQ ID NO: 628227 - DNA, 13 bp, D. melanogaster
gcgaaatgaaaag

SEQ ID NO: 628228 - DNA, 13 bp, D. melanogaster
gcgaaatgaattg

SEQ ID NO: 628229 - DNA, 13 bp, D. melanogaster
gcgaaatgcaaat

SEQ ID NO: 628230 - DNA, 14 bp, D. melanogaster
gcgaaatgcaaatg

SEQ ID NO: 628231 - DNA, 13 bp, D. melanogaster
gcgaaatgcgaaa

SEQ ID NO: 628232 - DNA, 13 bp, D. melanogaster
gcgaaatggaaaa

SEQ ID NO: 628233 - DNA, 13 bp, D. melanogaster
gcgaaatggccaa

SEQ ID NO: 628234 - DNA, 13 bp, D. melanogaster
gcgaaatgggaaa

SEQ ID NO: 628235 - DNA, 13 bp, D. melanogaster
gcgaaatgtgaaa

SEQ ID NO: 628236 - DNA, 13 bp, D. melanogaster
gcgaaatgtgcaa

SEQ ID NO: 628237 - DNA, 13 bp, D. melanogaster
gcgaaatgttttt

SEQ ID NO: 628238 - DNA, 13 bp, D. melanogaster
gcgaaattagttt

SEQ ID NO: 628239 - DNA, 13 bp, D. melanogaster
gcgaaattcaaaa

SEQ ID NO: 628240 - DNA, 13 bp, D. melanogaster
gcgaaattcaatt

SEQ ID NO: 628241 - DNA, 13 bp, D. melanogaster
gcgaaattgaaat

SEQ ID NO: 628242 - DNA, 13 bp, D. melanogaster
gcgaaattgaatt

SEQ ID NO: 628243 - DNA, 13 bp, D. melanogaster
gcgaaattgcatt

SEQ ID NO: 628244 - DNA, 13 bp, D. melanogaster
gcgaaatttaata

SEQ ID NO: 628245 - DNA, 13 bp, D. melanogaster
gcgaaatttatta

SEQ ID NO: 628246 - DNA, 13 bp, D. melanogaster
gcgaaccaacaga

SEQ ID NO: 628247 - DNA, 13 bp, D. melanogaster
gcgaacgagagag

SEQ ID NO: 628248 - DNA, 13 bp, D. melanogaster
gcgaacgcgaaat

SEQ ID NO: 628249 - DNA, 13 bp, D. melanogaster
gcgaacgcttagc

SEQ ID NO: 628250 - DNA, 14 bp, D. melanogaster
gcgaacgcttagca

SEQ ID NO: 628251 - DNA, 13 bp, D. melanogaster
gcgaactgaatct

SEQ ID NO: 628252 - DNA, 13 bp, D. melanogaster
gcgaactgcaaac

SEQ ID NO: 628253 - DNA, 14 bp, D. melanogaster
gcgaactgcagaat

SEQ ID NO: 628254 - DNA, 13 bp, D. melanogaster
gcgaactgcatct

SEQ ID NO: 628255 - DNA, 13 bp, D. melanogaster
gcgaactgggcag

SEQ ID NO: 628256 - DNA, 13 bp, D. melanogaster
gcgaagaagaagc

SEQ ID NO: 628257 - DNA, 13 bp, D. melanogaster
gcgaagaagcgga

SEQ ID NO: 628258 - DNA, 13 bp, D. melanogaster
gcgaagcgaagcg

SEQ ID NO: 628259 - DNA, 13 bp, D. melanogaster
gcgaaggaaaagc

SEQ ID NO: 628260 - DNA, 13 bp, D. melanogaster
gcgaaggaagtgg

SEQ ID NO: 628261 - DNA, 13 bp, D. melanogaster
gcgaaggaatctg

SEQ ID NO: 628262 - DNA, 13 bp, D. melanogaster
gcgaaggcgaagg

SEQ ID NO: 628263 - DNA, 13 bp, D. melanogaster
gcgaaggggcgtg

SEQ ID NO: 628264 - DNA, 13 bp, D. melanogaster
gcgaagtaatcag

SEQ ID NO: 628265 - DNA, 13 bp, D. melanogaster
gcgaagtgaagtg

SEQ ID NO: 628266 - DNA, 13 bp, D. melanogaster
gcgaagttacaac

SEQ ID NO: 628267 - DNA, 13 bp, D. melanogaster
gcgaataaaaaat

SEQ ID NO: 628268 - DNA, 13 bp, D. melanogaster
gcgaataaataaa

SEQ ID NO: 628269 - DNA, 13 bp, D. melanogaster
gcgaataaattta

SEQ ID NO: 628270 - DNA, 13 bp, D. melanogaster
gcgaatacgaata

SEQ ID NO: 628271 - DNA, 13 bp, D. melanogaster
gcgaatccgaatc

SEQ ID NO: 628272 - DNA, 13 bp, D. melanogaster
gcgaatcgaatcg

SEQ ID NO: 628273 - DNA, 13 bp, D. melanogaster
gcgaatcgagccg

SEQ ID NO: 628274 - DNA, 13 bp, D. melanogaster
gcgaatcgcctga

SEQ ID NO: 628275 - DNA, 13 bp, D. melanogaster
gcgaatgaatgaa

SEQ ID NO: 628276 - DNA, 13 bp, D. melanogaster
gcgaatgcaactg

SEQ ID NO: 628277 - DNA, 13 bp, D. melanogaster
gcgaatgcaatga

SEQ ID NO: 628278 - DNA, 13 bp, D. melanogaster
gcgaatgcatttg

SEQ ID NO: 628279 - DNA, 13 bp, D. melanogaster
gcgaatgccagaa

SEQ ID NO: 628280 - DNA, 13 bp, D. melanogaster
gcgaatgcgaatt

SEQ ID NO: 628281 - DNA, 13 bp, D. melanogaster
gcgaatgcgagtg

SEQ ID NO: 628282 - DNA, 14 bp, D. melanogaster
gcgaatgcggctgc

SEQ ID NO: 628283 - DNA, 13 bp, D. melanogaster
gcgaatgcgtcgc

SEQ ID NO: 628284 - DNA, 14 bp, D. melanogaster
gcgaatgcgtcgcg

SEQ ID NO: 628285 - DNA, 13 bp, D. melanogaster
gcgaatggaaaat

SEQ ID NO: 628286 - DNA, 14 bp, D. melanogaster
gcgaatgggaatgg

SEQ ID NO: 628287 - DNA, 14 bp, D. melanogaster
gcgaatgtgctagt

SEQ ID NO: 628288 - DNA, 13 bp, D. melanogaster
gcgaattcaattt

SEQ ID NO: 628289 - DNA, 13 bp, D. melanogaster
gcgaattctgctc

SEQ ID NO: 628290 - DNA, 13 bp, D. melanogaster
gcgaattcttcag

SEQ ID NO: 628291 - DNA, 13 bp, D. melanogaster
gcgaatttaaaat

SEQ ID NO: 628292 - DNA, 14 bp, D. melanogaster
gcgaatttatttat

SEQ ID NO: 628293 - DNA, 13 bp, D. melanogaster
gcgaatttcaatt

SEQ ID NO: 628294 - DNA, 13 bp, D. melanogaster
gcgaatttgtctg

SEQ ID NO: 628295 - DNA, 13 bp, D. melanogaster
gcgaatttgtttg

SEQ ID NO: 628296 - DNA, 13 bp, D. melanogaster
gcgaatttttaaa

SEQ ID NO: 628297 - DNA, 13 bp, D. melanogaster
gcgacaaatattt

SEQ ID NO: 628298 - DNA, 14 bp, D. melanogaster
gcgacaacaacaat

SEQ ID NO: 628299 - DNA, 13 bp, D. melanogaster
gcgacaacaacac

SEQ ID NO: 628300 - DNA, 14 bp, D. melanogaster
gcgacaacaacagc

SEQ ID NO: 628301 - DNA, 13 bp, D. melanogaster
gcgacaacagcaa

SEQ ID NO: 628302 - DNA, 14 bp, D. melanogaster
gcgacaacagcaac

SEQ ID NO: 628303 - DNA, 13 bp, D. melanogaster
gcgacaacagcag

SEQ ID NO: 628304 - DNA, 14 bp, D. melanogaster
gcgacaacagcagc

SEQ ID NO: 628305 - DNA, 13 bp, D. melanogaster
gcgacaacataca

SEQ ID NO: 628306 - DNA, 13 bp, D. melanogaster
gcgacaacgatac

SEQ ID NO: 628307 - DNA, 13 bp, D. melanogaster
gcgacaataacaa

SEQ ID NO: 628308 - DNA, 13 bp, D. melanogaster
gcgacagagacag

SEQ ID NO: 628309 - DNA, 13 bp, D. melanogaster
gcgacagagagag

SEQ ID NO: 628310 - DNA, 14 bp, D. melanogaster
gcgacagcagcagc

SEQ ID NO: 628311 - DNA, 13 bp, D. melanogaster
gcgacagccaaat

SEQ ID NO: 628312 - DNA, 13 bp, D. melanogaster
gcgacaggcgaca

SEQ ID NO: 628313 - DNA, 13 bp, D. melanogaster
gcgacagtttgtt

SEQ ID NO: 628314 - DNA, 14 bp, D. melanogaster
gcgacatatacata

SEQ ID NO: 628315 - DNA, 13 bp, D. melanogaster
gcgaccaacggca

SEQ ID NO: 628316 - DNA, 13 bp, D. melanogaster
gcgaccacgccct

SEQ ID NO: 628317 - DNA, 13 bp, D. melanogaster
gcgacccacaaaa

SEQ ID NO: 628318 - DNA, 13 bp, D. melanogaster
gcgacctctgttg

SEQ ID NO: 628319 - DNA, 13 bp, D. melanogaster
gcgacgacgacaa

SEQ ID NO: 628320 - DNA, 13 bp, D. melanogaster
gcgacgcaaaaca

SEQ ID NO: 628321 - DNA, 13 bp, D. melanogaster
gcgacgcattcgc

SEQ ID NO: 628322 - DNA, 14 bp, D. melanogaster
gcgacgccgactgc

SEQ ID NO: 628323 - DNA, 13 bp, D. melanogaster
gcgacgccggcag

SEQ ID NO: 628324 - DNA, 13 bp, D. melanogaster
gcgacggcggcag

SEQ ID NO: 628325 - DNA, 13 bp, D. melanogaster
gcgacgtcgacgt

SEQ ID NO: 628326 - DNA, 14 bp, D. melanogaster
gcgacgtcggcaga

SEQ ID NO: 628327 - DNA, 13 bp, D. melanogaster
gcgacgttttctg

SEQ ID NO: 628328 - DNA, 13 bp, D. melanogaster
gcgactaaagagt

SEQ ID NO: 628329 - DNA, 13 bp, D. melanogaster
gcgactatttgta

SEQ ID NO: 628330 - DNA, 14 bp, D. melanogaster
gcgactgcaactgc

SEQ ID NO: 628331 - DNA, 13 bp, D. melanogaster
gcgactgcgactg

SEQ ID NO: 628332 - DNA, 13 bp, D. melanogaster
gcgactgcgccgc

SEQ ID NO: 628333 - DNA, 13 bp, D. melanogaster
gcgactgcgctgc

SEQ ID NO: 628334 - DNA, 13 bp, D. melanogaster
gcgactgtgactg

SEQ ID NO: 628335 - DNA, 13 bp, D. melanogaster
gcgactttaatgc

SEQ ID NO: 628336 - DNA, 13 bp, D. melanogaster
gcgagaaaaaatg

SEQ ID NO: 628337 - DNA, 14 bp, D. melanogaster
gcgagaaaaaatgc

SEQ ID NO: 628338 - DNA, 13 bp, D. melanogaster
gcgagaagagcac

SEQ ID NO: 628339 - DNA, 13 bp, D. melanogaster
gcgagagagagcg

SEQ ID NO: 628340 - DNA, 13 bp, D. melanogaster
gcgagagagatgg

SEQ ID NO: 628341 - DNA, 13 bp, D. melanogaster
gcgagagagcgaa

SEQ ID NO: 628342 - DNA, 13 bp, D. melanogaster
gcgagagagcgag

SEQ ID NO: 628343 - DNA, 14 bp, D. melanogaster
gcgagagagcgaga

SEQ ID NO: 628344 - DNA, 13 bp, D. melanogaster
gcgagagcgagag

SEQ ID NO: 628345 - DNA, 14 bp, D. melanogaster
gcgagagcgagagc

SEQ ID NO: 628346 - DNA, 13 bp, D. melanogaster
gcgagagcttcaa

SEQ ID NO: 628347 - DNA, 13 bp, D. melanogaster
gcgagagtgagag

SEQ ID NO: 628348 - DNA, 13 bp, D. melanogaster
gcgagatgatcac

SEQ ID NO: 628349 - DNA, 13 bp, D. melanogaster
gcgagattgccgc

SEQ ID NO: 628350 - DNA, 13 bp, D. melanogaster
gcgagcaaacaaa

SEQ ID NO: 628351 - DNA, 13 bp, D. melanogaster
gcgagcacaaatt

SEQ ID NO: 628352 - DNA, 13 bp, D. melanogaster
gcgagcagcagca

SEQ ID NO: 628353 - DNA, 13 bp, D. melanogaster
gcgagcagctttg

SEQ ID NO: 628354 - DNA, 13 bp, D. melanogaster
gcgagcagtttgc

SEQ ID NO: 628355 - DNA, 13 bp, D. melanogaster
gcgagcataaaaa

SEQ ID NO: 628356 - DNA, 13 bp, D. melanogaster
gcgagcatgacga

SEQ ID NO: 628357 - DNA, 13 bp, D. melanogaster
gcgagcgaaagag

SEQ ID NO: 628358 - DNA, 13 bp, D. melanogaster
gcgagcgagagag

SEQ ID NO: 628359 - DNA, 14 bp, D. melanogaster
gcgagcgagagagc

SEQ ID NO: 628360 - DNA, 13 bp, D. melanogaster
gcgagcgagagcg

SEQ ID NO: 628361 - DNA, 14 bp, D. melanogaster
gcgagcgagagggc

SEQ ID NO: 628362 - DNA, 13 bp, D. melanogaster
gcgagcgagcgag

SEQ ID NO: 628363 - DNA, 14 bp, D. melanogaster
gcgagcgagcgaga

SEQ ID NO: 628364 - DNA, 13 bp, D. melanogaster
gcgagcgagtgag

SEQ ID NO: 628365 - DNA, 13 bp, D. melanogaster
gcgagcgggatgg

SEQ ID NO: 628366 - DNA, 13 bp, D. melanogaster
gcgagcgtgtgtg

SEQ ID NO: 628367 - DNA, 13 bp, D. melanogaster
gcgagcttaacac

SEQ ID NO: 628368 - DNA, 13 bp, D. melanogaster
gcgaggaaatcga

SEQ ID NO: 628369 - DNA, 13 bp, D. melanogaster
gcgaggacgaaag

SEQ ID NO: 628370 - DNA, 14 bp, D. melanogaster
gcgaggcgaggcga

SEQ ID NO: 628371 - DNA, 13 bp, D. melanogaster
gcgaggctcattc

SEQ ID NO: 628372 - DNA, 13 bp, D. melanogaster
gcgaggggcaaaa

SEQ ID NO: 628373 - DNA, 13 bp, D. melanogaster
gcgagtatctgtg

SEQ ID NO: 628374 - DNA, 13 bp, D. melanogaster
gcgagtccctcaa

SEQ ID NO: 628375 - DNA, 13 bp, D. melanogaster
gcgagtgagaggg

SEQ ID NO: 628376 - DNA, 13 bp, D. melanogaster
gcgagtgagtgag

SEQ ID NO: 628377 - DNA, 13 bp, D. melanogaster
gcgagtgcaaaag

SEQ ID NO: 628378 - DNA, 13 bp, D. melanogaster
gcgagtgcaacaa

SEQ ID NO: 628379 - DNA, 13 bp, D. melanogaster
gcgagtgccgaga

SEQ ID NO: 628380 - DNA, 13 bp, D. melanogaster
gcgagtgcgaatg

SEQ ID NO: 628381 - DNA, 13 bp, D. melanogaster
gcgagtgcgagtg

SEQ ID NO: 628382 - DNA, 14 bp, D. melanogaster
gcgagtgcgagtgc

SEQ ID NO: 628383 - DNA, 13 bp, D. melanogaster
gcgagtgcgtgtg

SEQ ID NO: 628384 - DNA, 13 bp, D. melanogaster
gcgagtggcgggc

SEQ ID NO: 628385 - DNA, 13 bp, D. melanogaster
gcgagtgggcgtg

SEQ ID NO: 628386 - DNA, 14 bp, D. melanogaster
gcgagtgggcgtgg

SEQ ID NO: 628387 - DNA, 13 bp, D. melanogaster
gcgagtgggtggt

SEQ ID NO: 628388 - DNA, 13 bp, D. melanogaster
gcgagtgtacatt

SEQ ID NO: 628389 - DNA, 13 bp, D. melanogaster
gcgagtgtgagtg

SEQ ID NO: 628390 - DNA, 13 bp, D. melanogaster
gcgagtgtgcgag

SEQ ID NO: 628391 - DNA, 13 bp, D. melanogaster
gcgagtgtgggtg

SEQ ID NO: 628392 - DNA, 13 bp, D. melanogaster
gcgagtgtgtgag

SEQ ID NO: 628393 - DNA, 14 bp, D. melanogaster
gcgagtgtgtgagt

SEQ ID NO: 628394 - DNA, 14 bp, D. melanogaster
gcgagtgtgtgcga

SEQ ID NO: 628395 - DNA, 14 bp, D. melanogaster
gcgagtgtgtgttt

SEQ ID NO: 628396 - DNA, 13 bp, D. melanogaster
gcgagtgtgtttg

SEQ ID NO: 628397 - DNA, 14 bp, D. melanogaster
gcgagtgtgtttgt

SEQ ID NO: 628398 - DNA, 13 bp, D. melanogaster
gcgagtttccctg

SEQ ID NO: 628399 - DNA, 13 bp, D. melanogaster
gcgataaatgcaa

SEQ ID NO: 628400 - DNA, 13 bp, D. melanogaster
gcgataaatttga

SEQ ID NO: 628401 - DNA, 13 bp, D. melanogaster
gcgataacgataa

SEQ ID NO: 628402 - DNA, 13 bp, D. melanogaster
gcgataatttggt

SEQ ID NO: 628403 - DNA, 13 bp, D. melanogaster
gcgatatatatat

SEQ ID NO: 628404 - DNA, 14 bp, D. melanogaster
gcgatatatatata

SEQ ID NO: 628405 - DNA, 13 bp, D. melanogaster
gcgatatatatgt

SEQ ID NO: 628406 - DNA, 13 bp, D. melanogaster
gcgatatgcaaat

SEQ ID NO: 628407 - DNA, 13 bp, D. melanogaster
gcgatattgtttt

SEQ ID NO: 628408 - DNA, 13 bp, D. melanogaster
gcgatatttttgg

SEQ ID NO: 628409 - DNA, 13 bp, D. melanogaster
gcgatctgaggac

SEQ ID NO: 628410 - DNA, 13 bp, D. melanogaster
gcgatctgcgatc

SEQ ID NO: 628411 - DNA, 13 bp, D. melanogaster
gcgatgaatcaat

SEQ ID NO: 628412 - DNA, 13 bp, D. melanogaster
gcgatgacgacga

SEQ ID NO: 628413 - DNA, 13 bp, D. melanogaster
gcgatgacgatga

SEQ ID NO: 628414 - DNA, 14 bp, D. melanogaster
gcgatgatgatgat

SEQ ID NO: 628415 - DNA, 13 bp, D. melanogaster
gcgatgcagcaaa

SEQ ID NO: 628416 - DNA, 13 bp, D. melanogaster
gcgatggcaaatt

SEQ ID NO: 628417 - DNA, 13 bp, D. melanogaster
gcgatggcaacaa

SEQ ID NO: 628418 - DNA, 14 bp, D. melanogaster
gcgatggcgatggc

SEQ ID NO: 628419 - DNA, 13 bp, D. melanogaster
gcgatggcttgaa

SEQ ID NO: 628420 - DNA, 13 bp, D. melanogaster
gcgatggtgatgg

SEQ ID NO: 628421 - DNA, 13 bp, D. melanogaster
gcgatgttctgga

SEQ ID NO: 628422 - DNA, 13 bp, D. melanogaster
gcgattaccattt

SEQ ID NO: 628423 - DNA, 13 bp, D. melanogaster
gcgattccaagta

SEQ ID NO: 628424 - DNA, 18 bp, D. melanogaster
gcgattccagagctcggc

SEQ ID NO: 628425 - DNA, 13 bp, D. melanogaster
gcgattgcaattg

SEQ ID NO: 628426 - DNA, 13 bp, D. melanogaster
gcgattgcataag

SEQ ID NO: 628427 - DNA, 13 bp, D. melanogaster
gcgattgcgcaat

SEQ ID NO: 628428 - DNA, 13 bp, D. melanogaster
gcgattgtgattg

SEQ ID NO: 628429 - DNA, 13 bp, D. melanogaster
gcgattgtgtgaa

SEQ ID NO: 628430 - DNA, 13 bp, D. melanogaster
gcgattgtgtgtg

SEQ ID NO: 628431 - DNA, 13 bp, D. melanogaster
gcgatttgcattt

SEQ ID NO: 628432 - DNA, 13 bp, D. melanogaster
gcgatttgtgggc

SEQ ID NO: 628433 - DNA, 13 bp, D. melanogaster
gcgatttgttttc

SEQ ID NO: 628434 - DNA, 13 bp, D. melanogaster
gcgattttaacaa

SEQ ID NO: 628435 - DNA, 13 bp, D. melanogaster
gcgattttattta

SEQ ID NO: 628436 - DNA, 13 bp, D. melanogaster
gcgattttccagc

SEQ ID NO: 628437 - DNA, 13 bp, D. melanogaster
gcgattttcttgg

SEQ ID NO: 628438 - DNA, 13 bp, D. melanogaster
gcgcaaaaacagt

SEQ ID NO: 628439 - DNA, 13 bp, D. melanogaster
gcgcaaaaatgaa

SEQ ID NO: 628440 - DNA, 13 bp, D. melanogaster
gcgcaaaagtcaa

SEQ ID NO: 628441 - DNA, 13 bp, D. melanogaster
gcgcaaaagttgc

SEQ ID NO: 628442 - DNA, 13 bp, D. melanogaster
gcgcaaaataaaa

SEQ ID NO: 628443 - DNA, 13 bp, D. melanogaster
gcgcaaaattaaa

SEQ ID NO: 628444 - DNA, 13 bp, D. melanogaster
gcgcaaacaaaag

SEQ ID NO: 628445 - DNA, 13 bp, D. melanogaster
gcgcaaacatata

SEQ ID NO: 628446 - DNA, 13 bp, D. melanogaster
gcgcaaagtgaaa

SEQ ID NO: 628447 - DNA, 13 bp, D. melanogaster
gcgcaaattgaaa

SEQ ID NO: 628448 - DNA, 13 bp, D. melanogaster
gcgcaacaaattg

SEQ ID NO: 628449 - DNA, 13 bp, D. melanogaster
gcgcaacaacaac

SEQ ID NO: 628450 - DNA, 13 bp, D. melanogaster
gcgcaagccctat

SEQ ID NO: 628451 - DNA, 13 bp, D. melanogaster
gcgcacaaaaatt

SEQ ID NO: 628452 - DNA, 14 bp, D. melanogaster
gcgcacaaaaattg

SEQ ID NO: 628453 - DNA, 13 bp, D. melanogaster
gcgcacaacaaaa

SEQ ID NO: 628454 - DNA, 13 bp, D. melanogaster
gcgcacaattaaa

SEQ ID NO: 628455 - DNA, 14 bp, D. melanogaster
gcgcacacacacac

SEQ ID NO: 628456 - DNA, 13 bp, D. melanogaster
gcgcacacacacc

SEQ ID NO: 628457 - DNA, 13 bp, D. melanogaster
gcgcacacacacg

SEQ ID NO: 628458 - DNA, 13 bp, D. melanogaster
gcgcacacagaca

SEQ ID NO: 628459 - DNA, 13 bp, D. melanogaster
gcgcacagtgggc

SEQ ID NO: 628460 - DNA, 13 bp, D. melanogaster
gcgcacccgaatc

SEQ ID NO: 628461 - DNA, 13 bp, D. melanogaster
gcgcacgcacaca

SEQ ID NO: 628462 - DNA, 14 bp, D. melanogaster
gcgcactcacacac

SEQ ID NO: 628463 - DNA, 13 bp, D. melanogaster
gcgcagcaacaac

SEQ ID NO: 628464 - DNA, 13 bp, D. melanogaster
gcgcagcagcaac

SEQ ID NO: 628465 - DNA, 14 bp, D. melanogaster
gcgcagcagcaaca

SEQ ID NO: 628466 - DNA, 13 bp, D. melanogaster
gcgcagcagcagc

SEQ ID NO: 628467 - DNA, 14 bp, D. melanogaster
gcgcagcagcagca

SEQ ID NO: 628468 - DNA, 13 bp, D. melanogaster
gcgcagcaggaaa

SEQ ID NO: 628469 - DNA, 13 bp, D. melanogaster
gcgcagcattcgt

SEQ ID NO: 628470 - DNA, 14 bp, D. melanogaster
gcgcagcattcgtt

SEQ ID NO: 628471 - DNA, 13 bp, D. melanogaster
gcgcagcttgaaa

SEQ ID NO: 628472 - DNA, 13 bp, D. melanogaster
gcgcaggaaaaga

SEQ ID NO: 628473 - DNA, 13 bp, D. melanogaster
gcgcaggcacatt

SEQ ID NO: 628474 - DNA, 13 bp, D. melanogaster
gcgcaggcgcaac

SEQ ID NO: 628475 - DNA, 13 bp, D. melanogaster
gcgcaggcgcagc

SEQ ID NO: 628476 - DNA, 13 bp, D. melanogaster
gcgcaggtgaaaa

SEQ ID NO: 628477 - DNA, 14 bp, D. melanogaster
gcgcagtcgacgtc

SEQ ID NO: 628478 - DNA, 13 bp, D. melanogaster
gcgcagtcgcagc

SEQ ID NO: 628479 - DNA, 14 bp, D. melanogaster
gcgcagtcggcgtc

SEQ ID NO: 628480 - DNA, 13 bp, D. melanogaster
gcgcataaaatat

SEQ ID NO: 628481 - DNA, 13 bp, D. melanogaster
gcgcataaataaa

SEQ ID NO: 628482 - DNA, 13 bp, D. melanogaster
gcgcataaatatt

SEQ ID NO: 628483 - DNA, 13 bp, D. melanogaster
gcgcataaatttt

SEQ ID NO: 628484 - DNA, 13 bp, D. melanogaster
gcgcataattaaa

SEQ ID NO: 628485 - DNA, 13 bp, D. melanogaster
gcgcatcagaaaa

SEQ ID NO: 628486 - DNA, 13 bp, D. melanogaster
gcgcatgcaaatg

SEQ ID NO: 628487 - DNA, 13 bp, D. melanogaster
gcgcatgcgcaga

SEQ ID NO: 628488 - DNA, 13 bp, D. melanogaster
gcgcatgcgcagc

SEQ ID NO: 628489 - DNA, 14 bp, D. melanogaster
gcgcatgcgcagca

SEQ ID NO: 628490 - DNA, 13 bp, D. melanogaster
gcgcattttccgc

SEQ ID NO: 628491 - DNA, 13 bp, D. melanogaster
gcgccaaaaaata

SEQ ID NO: 628492 - DNA, 13 bp, D. melanogaster
gcgccaaaaagtt

SEQ ID NO: 628493 - DNA, 13 bp, D. melanogaster
gcgccaaaaatga

SEQ ID NO: 628494 - DNA, 13 bp, D. melanogaster
gcgccaaacgacc

SEQ ID NO: 628495 - DNA, 13 bp, D. melanogaster
gcgccaaagaaaa

SEQ ID NO: 628496 - DNA, 13 bp, D. melanogaster
gcgccaaatgaaa

SEQ ID NO: 628497 - DNA, 13 bp, D. melanogaster
gcgccaacttttg

SEQ ID NO: 628498 - DNA, 13 bp, D. melanogaster
gcgccaagtgagc

SEQ ID NO: 628499 - DNA, 13 bp, D. melanogaster
gcgccacctagcg

SEQ ID NO: 628500 - DNA, 14 bp, D. melanogaster
gcgccacgcccact

SEQ ID NO: 628501 - DNA, 14 bp, D. melanogaster
gcgccacgccccct

SEQ ID NO: 628502 - DNA, 13 bp, D. melanogaster
gcgccactccgca

SEQ ID NO: 628503 - DNA, 13 bp, D. melanogaster
gcgccagcagcag

SEQ ID NO: 628504 - DNA, 13 bp, D. melanogaster
gcgccagttgcga

SEQ ID NO: 628505 - DNA, 13 bp, D. melanogaster
gcgccatctagcg

SEQ ID NO: 628506 - DNA, 13 bp, D. melanogaster
gcgccatctatga

SEQ ID NO: 628507 - DNA, 13 bp, D. melanogaster
gcgccatctgttg

SEQ ID NO: 628508 - DNA, 13 bp, D. melanogaster
gcgccatttgact

SEQ ID NO: 628509 - DNA, 13 bp, D. melanogaster
gcgccgcaaagta

SEQ ID NO: 628510 - DNA, 13 bp, D. melanogaster
gcgccgcaaattc

SEQ ID NO: 628511 - DNA, 13 bp, D. melanogaster
gcgccgccgtcga

SEQ ID NO: 628512 - DNA, 13 bp, D. melanogaster
gcgcctaattaac

SEQ ID NO: 628513 - DNA, 13 bp, D. melanogaster
gcgcctgcaccaa

SEQ ID NO: 628514 - DNA, 13 bp, D. melanogaster
gcgccttgcagcc

SEQ ID NO: 628515 - DNA, 13 bp, D. melanogaster
gcgccttttgttg

SEQ ID NO: 628516 - DNA, 13 bp, D. melanogaster
gcgcctttttggc

SEQ ID NO: 628517 - DNA, 13 bp, D. melanogaster
gcgcgaaagagag

SEQ ID NO: 628518 - DNA, 13 bp, D. melanogaster
gcgcgccaaaaaa

SEQ ID NO: 628519 - DNA, 13 bp, D. melanogaster
gcgcgctctttct

SEQ ID NO: 628520 - DNA, 13 bp, D. melanogaster
gcgcggttttatt

SEQ ID NO: 628521 - DNA, 13 bp, D. melanogaster
gcgcgtgccaagc

SEQ ID NO: 628522 - DNA, 13 bp, D. melanogaster
gcgctacagcgaa

SEQ ID NO: 628523 - DNA, 14 bp, D. melanogaster
gcgctagaaaaaca

SEQ ID NO: 628524 - DNA, 13 bp, D. melanogaster
gcgctcacacaca

SEQ ID NO: 628525 - DNA, 14 bp, D. melanogaster
gcgctcactcagaa

SEQ ID NO: 628526 - DNA, 13 bp, D. melanogaster
gcgctcagcaaag

SEQ ID NO: 628527 - DNA, 13 bp, D. melanogaster
gcgctccagtgat

SEQ ID NO: 628528 - DNA, 13 bp, D. melanogaster
gcgctctctcgct

SEQ ID NO: 628529 - DNA, 13 bp, D. melanogaster
gcgctctttcttg

SEQ ID NO: 628530 - DNA, 14 bp, D. melanogaster
gcgctgagcaactt

SEQ ID NO: 628531 - DNA, 13 bp, D. melanogaster
gcgctgagcgaca

SEQ ID NO: 628532 - DNA, 13 bp, D. melanogaster
gcgctgatcgtcg

SEQ ID NO: 628533 - DNA, 13 bp, D. melanogaster
gcgctgcaaagta

SEQ ID NO: 628534 - DNA, 14 bp, D. melanogaster
gcgctgcaatcgtt

SEQ ID NO: 628535 - DNA, 14 bp, D. melanogaster
gcgctgccaaagat

SEQ ID NO: 628536 - DNA, 13 bp, D. melanogaster
gcgctgcgaaaac

SEQ ID NO: 628537 - DNA, 13 bp, D. melanogaster
gcgctgcgagagg

SEQ ID NO: 628538 - DNA, 13 bp, D. melanogaster
gcgctgcgcaagc

SEQ ID NO: 628539 - DNA, 13 bp, D. melanogaster
gcgctgcggcaga

SEQ ID NO: 628540 - DNA, 14 bp, D. melanogaster
gcgctgcgtctatg

SEQ ID NO: 628541 - DNA, 14 bp, D. melanogaster
gcgctgcgtctttg

SEQ ID NO: 628542 - DNA, 13 bp, D. melanogaster
gcgctgctgctgc

SEQ ID NO: 628543 - DNA, 14 bp, D. melanogaster
gcgctgctgctgct

SEQ ID NO: 628544 - DNA, 13 bp, D. melanogaster
gcgctggaaaatg

SEQ ID NO: 628545 - DNA, 13 bp, D. melanogaster
gcgctggccagcc

SEQ ID NO: 628546 - DNA, 13 bp, D. melanogaster
gcgctgttatgtt

SEQ ID NO: 628547 - DNA, 13 bp, D. melanogaster
gcgcttgtgtgtg

SEQ ID NO: 628548 - DNA, 13 bp, D. melanogaster
gcgctttattttt

SEQ ID NO: 628549 - DNA, 13 bp, D. melanogaster
gcgcttttatttg

SEQ ID NO: 628550 - DNA, 13 bp, D. melanogaster
gcggaaaaatcaa

SEQ ID NO: 628551 - DNA, 13 bp, D. melanogaster
gcggaaaagcaaa

SEQ ID NO: 628552 - DNA, 13 bp, D. melanogaster
gcggaaaagcaga

SEQ ID NO: 628553 - DNA, 13 bp, D. melanogaster
gcggaaaagccaa

SEQ ID NO: 628554 - DNA, 13 bp, D. melanogaster
gcggaaaagcgaa

SEQ ID NO: 628555 - DNA, 13 bp, D. melanogaster
gcggaaaagcgag

SEQ ID NO: 628556 - DNA, 13 bp, D. melanogaster
gcggaaaagcgga

SEQ ID NO: 628557 - DNA, 13 bp, D. melanogaster
gcggaaaagcggt

SEQ ID NO: 628558 - DNA, 13 bp, D. melanogaster
gcggaaaagtcgg

SEQ ID NO: 628559 - DNA, 13 bp, D. melanogaster
gcggaaaagtggg

SEQ ID NO: 628560 - DNA, 13 bp, D. melanogaster
gcggaaaagtgtg

SEQ ID NO: 628561 - DNA, 13 bp, D. melanogaster
gcggaaaatcatc

SEQ ID NO: 628562 - DNA, 13 bp, D. melanogaster
gcggaaaatgaaa

SEQ ID NO: 628563 - DNA, 13 bp, D. melanogaster
gcggaaaatgcca

SEQ ID NO: 628564 - DNA, 13 bp, D. melanogaster
gcggaaaatgcgc

SEQ ID NO: 628565 - DNA, 13 bp, D. melanogaster
gcggaaaatgcgg

SEQ ID NO: 628566 - DNA, 13 bp, D. melanogaster
gcggaaaatgctt

SEQ ID NO: 628567 - DNA, 13 bp, D. melanogaster
gcggaaaatggaa

SEQ ID NO: 628568 - DNA, 14 bp, D. melanogaster
gcggaaaatggaaa

SEQ ID NO: 628569 - DNA, 13 bp, D. melanogaster
gcggaaaatggag

SEQ ID NO: 628570 - DNA, 13 bp, D. melanogaster
gcggaaaatggga

SEQ ID NO: 628571 - DNA, 13 bp, D. melanogaster
gcggaaaatgtgg

SEQ ID NO: 628572 - DNA, 13 bp, D. melanogaster
gcggaaaatgttg

SEQ ID NO: 628573 - DNA, 13 bp, D. melanogaster
gcggaaaattgtg

SEQ ID NO: 628574 - DNA, 14 bp, D. melanogaster
gcggaaacggaaat

SEQ ID NO: 628575 - DNA, 13 bp, D. melanogaster
gcggaaacggaag

SEQ ID NO: 628576 - DNA, 13 bp, D. melanogaster
gcggaaacggatg

SEQ ID NO: 628577 - DNA, 13 bp, D. melanogaster
gcggaaagagagc

SEQ ID NO: 628578 - DNA, 13 bp, D. melanogaster
gcggaaagcggaa

SEQ ID NO: 628579 - DNA, 13 bp, D. melanogaster
gcggaaagtggaa

SEQ ID NO: 628580 - DNA, 13 bp, D. melanogaster
gcggaagcggaaa

SEQ ID NO: 628581 - DNA, 14 bp, D. melanogaster
gcggaagcggaaat

SEQ ID NO: 628582 - DNA, 13 bp, D. melanogaster
gcggaagtgggcg

SEQ ID NO: 628583 - DNA, 13 bp, D. melanogaster
gcggacaaacaaa

SEQ ID NO: 628584 - DNA, 13 bp, D. melanogaster
gcggacatcgggc

SEQ ID NO: 628585 - DNA, 13 bp, D. melanogaster
gcggacggacgga

SEQ ID NO: 628586 - DNA, 13 bp, D. melanogaster
gcggagagagagc

SEQ ID NO: 628587 - DNA, 13 bp, D. melanogaster
gcggagagtagaa

SEQ ID NO: 628588 - DNA, 13 bp, D. melanogaster
gcggagcagagca

SEQ ID NO: 628589 - DNA, 13 bp, D. melanogaster
gcggaggagcagc

SEQ ID NO: 628590 - DNA, 13 bp, D. melanogaster
gcggaggagttac

SEQ ID NO: 628591 - DNA, 13 bp, D. melanogaster
gcggaggctaccg

SEQ ID NO: 628592 - DNA, 13 bp, D. melanogaster
gcggagtggagtg

SEQ ID NO: 628593 - DNA, 13 bp, D. melanogaster
gcggagttcgaca

SEQ ID NO: 628594 - DNA, 13 bp, D. melanogaster
gcggagttttggg

SEQ ID NO: 628595 - DNA, 14 bp, D. melanogaster
gcggatgaacgaga

SEQ ID NO: 628596 - DNA, 14 bp, D. melanogaster
gcggatgagattgc

SEQ ID NO: 628597 - DNA, 13 bp, D. melanogaster
gcggatgagtaat

SEQ ID NO: 628598 - DNA, 13 bp, D. melanogaster
gcggatgcgaatg

SEQ ID NO: 628599 - DNA, 14 bp, D. melanogaster
gcggatgcgaatgc

SEQ ID NO: 628600 - DNA, 13 bp, D. melanogaster
gcggatggatgga

SEQ ID NO: 628601 - DNA, 13 bp, D. melanogaster
gcggatggccagt

SEQ ID NO: 628602 - DNA, 13 bp, D. melanogaster
gcggatggcggat

SEQ ID NO: 628603 - DNA, 13 bp, D. melanogaster
gcggatgtagtag

SEQ ID NO: 628604 - DNA, 14 bp, D. melanogaster
gcggatgtcaggaa

SEQ ID NO: 628605 - DNA, 13 bp, D. melanogaster
gcggatgtgacgg

SEQ ID NO: 628606 - DNA, 13 bp, D. melanogaster
gcggatgttaatg

SEQ ID NO: 628607 - DNA, 13 bp, D. melanogaster
gcggattcggatt

SEQ ID NO: 628608 - DNA, 14 bp, D. melanogaster
gcggattcggattc

SEQ ID NO: 628609 - DNA, 13 bp, D. melanogaster
gcggattgcggat

SEQ ID NO: 628610 - DNA, 13 bp, D. melanogaster
gcggatttgctgc

SEQ ID NO: 628611 - DNA, 13 bp, D. melanogaster
gcggcaaaaaatt

SEQ ID NO: 628612 - DNA, 13 bp, D. melanogaster
gcggcaaaaacaa

SEQ ID NO: 628613 - DNA, 13 bp, D. melanogaster
gcggcaaaaagtt

SEQ ID NO: 628614 - DNA, 13 bp, D. melanogaster
gcggcaaaactgc

SEQ ID NO: 628615 - DNA, 13 bp, D. melanogaster
gcggcaaaagaaa

SEQ ID NO: 628616 - DNA, 13 bp, D. melanogaster
gcggcaaaagttt

SEQ ID NO: 628617 - DNA, 13 bp, D. melanogaster
gcggcaaacaaaa

SEQ ID NO: 628618 - DNA, 13 bp, D. melanogaster
gcggcaaagtttt

SEQ ID NO: 628619 - DNA, 13 bp, D. melanogaster
gcggcaaatgaaa

SEQ ID NO: 628620 - DNA, 13 bp, D. melanogaster
gcggcaaatggaa

SEQ ID NO: 628621 - DNA, 13 bp, D. melanogaster
gcggcaacaaagc

SEQ ID NO: 628622 - DNA, 13 bp, D. melanogaster
gcggcaacaaatg

SEQ ID NO: 628623 - DNA, 13 bp, D. melanogaster
gcggcaacaacaa

SEQ ID NO: 628624 - DNA, 14 bp, D. melanogaster
gcggcaacaacaac

SEQ ID NO: 628625 - DNA, 14 bp, D. melanogaster
gcggcaacaacaag

SEQ ID NO: 628626 - DNA, 13 bp, D. melanogaster
gcggcaacaacat

SEQ ID NO: 628627 - DNA, 13 bp, D. melanogaster
gcggcaacaataa

SEQ ID NO: 628628 - DNA, 13 bp, D. melanogaster
gcggcaacagcaa

SEQ ID NO: 628629 - DNA, 14 bp, D. melanogaster
gcggcaacagcagc

SEQ ID NO: 628630 - DNA, 13 bp, D. melanogaster
gcggcaacatttt

SEQ ID NO: 628631 - DNA, 13 bp, D. melanogaster
gcggcaacttaat

SEQ ID NO: 628632 - DNA, 13 bp, D. melanogaster
gcggcaacttgaa

SEQ ID NO: 628633 - DNA, 13 bp, D. melanogaster
gcggcaagcggca

SEQ ID NO: 628634 - DNA, 13 bp, D. melanogaster
gcggcaataaaaa

SEQ ID NO: 628635 - DNA, 13 bp, D. melanogaster
gcggcaataacaa

SEQ ID NO: 628636 - DNA, 13 bp, D. melanogaster
gcggcaatggcaa

SEQ ID NO: 628637 - DNA, 13 bp, D. melanogaster
gcggcaattaaaa

SEQ ID NO: 628638 - DNA, 13 bp, D. melanogaster
gcggcaattcatt

SEQ ID NO: 628639 - DNA, 13 bp, D. melanogaster
gcggcacccgcga

SEQ ID NO: 628640 - DNA, 13 bp, D. melanogaster
gcggcactcgcaa

SEQ ID NO: 628641 - DNA, 14 bp, D. melanogaster
gcggcactcgcaat

SEQ ID NO: 628642 - DNA, 13 bp, D. melanogaster
gcggcagacttta

SEQ ID NO: 628643 - DNA, 13 bp, D. melanogaster
gcggcagaggcac

SEQ ID NO: 628644 - DNA, 13 bp, D. melanogaster
gcggcagcaaaag

SEQ ID NO: 628645 - DNA, 14 bp, D. melanogaster
gcggcagcaacaaa

SEQ ID NO: 628646 - DNA, 13 bp, D. melanogaster
gcggcagcaacag

SEQ ID NO: 628647 - DNA, 14 bp, D. melanogaster
gcggcagcagcaga

SEQ ID NO: 628648 - DNA, 13 bp, D. melanogaster
gcggcagcagcgg

SEQ ID NO: 628649 - DNA, 13 bp, D. melanogaster
gcggcagcagctc

SEQ ID NO: 628650 - DNA, 14 bp, D. melanogaster
gcggcagcaggagc

SEQ ID NO: 628651 - DNA, 13 bp, D. melanogaster
gcggcagcgagtg

SEQ ID NO: 628652 - DNA, 14 bp, D. melanogaster
gcggcagcgagtgc

SEQ ID NO: 628653 - DNA, 13 bp, D. melanogaster
gcggcagctgttc

SEQ ID NO: 628654 - DNA, 13 bp, D. melanogaster
gcggcaggacgaa

SEQ ID NO: 628655 - DNA, 14 bp, D. melanogaster
gcggcagtacgagt

SEQ ID NO: 628656 - DNA, 13 bp, D. melanogaster
gcggcagtcagtc

SEQ ID NO: 628657 - DNA, 14 bp, D. melanogaster
gcggcagtcagtcg

SEQ ID NO: 628658 - DNA, 13 bp, D. melanogaster
gcggcagtggcag

SEQ ID NO: 628659 - DNA, 13 bp, D. melanogaster
gcggcagttgcag

SEQ ID NO: 628660 - DNA, 13 bp, D. melanogaster
gcggcatcattat

SEQ ID NO: 628661 - DNA, 13 bp, D. melanogaster
gcggccaaaagca

SEQ ID NO: 628662 - DNA, 13 bp, D. melanogaster
gcggccaaaagga

SEQ ID NO: 628663 - DNA, 13 bp, D. melanogaster
gcggccaaaagtt

SEQ ID NO: 628664 - DNA, 13 bp, D. melanogaster
gcggccaaatgaa

SEQ ID NO: 628665 - DNA, 13 bp, D. melanogaster
gcggccacgccca

SEQ ID NO: 628666 - DNA, 13 bp, D. melanogaster
gcggccataaaaa

SEQ ID NO: 628667 - DNA, 13 bp, D. melanogaster
gcggccataaaac

SEQ ID NO: 628668 - DNA, 13 bp, D. melanogaster
gcggcctgcctct

SEQ ID NO: 628669 - DNA, 13 bp, D. melanogaster
gcggcgaactgca

SEQ ID NO: 628670 - DNA, 13 bp, D. melanogaster
gcggcgacaacaa

SEQ ID NO: 628671 - DNA, 13 bp, D. melanogaster
gcggcgcagcagg

SEQ ID NO: 628672 - DNA, 15 bp, D. melanogaster
gcggcgcagcaggcg

SEQ ID NO: 628673 - DNA, 13 bp, D. melanogaster
gcggcgcagtcgc

SEQ ID NO: 628674 - DNA, 13 bp, D. melanogaster
gcggcggaaaaaa

SEQ ID NO: 628675 - DNA, 13 bp, D. melanogaster
gcggcggcaacaa

SEQ ID NO: 628676 - DNA, 13 bp, D. melanogaster
gcggcggcagcag

SEQ ID NO: 628677 - DNA, 13 bp, D. melanogaster
gcggcggcagcga

SEQ ID NO: 628678 - DNA, 13 bp, D. melanogaster
gcggcggcagctg

SEQ ID NO: 628679 - DNA, 13 bp, D. melanogaster
gcggcgtatacgc

SEQ ID NO: 628680 - DNA, 13 bp, D. melanogaster
gcggcgtatgatt

SEQ ID NO: 628681 - DNA, 13 bp, D. melanogaster
gcggcgtgtgaaa

SEQ ID NO: 628682 - DNA, 13 bp, D. melanogaster
gcggcgtgtgtgt

SEQ ID NO: 628683 - DNA, 13 bp, D. melanogaster
gcggctgcagttg

SEQ ID NO: 628684 - DNA, 13 bp, D. melanogaster
gcggctgccaaag

SEQ ID NO: 628685 - DNA, 14 bp, D. melanogaster
gcggctgccacgcc

SEQ ID NO: 628686 - DNA, 13 bp, D. melanogaster
gcggctgcggatg

SEQ ID NO: 628687 - DNA, 13 bp, D. melanogaster
gcggctgcggctg

SEQ ID NO: 628688 - DNA, 13 bp, D. melanogaster
gcggctgctgcat

SEQ ID NO: 628689 - DNA, 13 bp, D. melanogaster
gcggctgctgctg

SEQ ID NO: 628690 - DNA, 14 bp, D. melanogaster
gcggctgctgctgc

SEQ ID NO: 628691 - DNA, 13 bp, D. melanogaster
gcggctggaaaaa

SEQ ID NO: 628692 - DNA, 14 bp, D. melanogaster
gcggctgttgctgc

SEQ ID NO: 628693 - DNA, 13 bp, D. melanogaster
gcggcttaaatgc

SEQ ID NO: 628694 - DNA, 13 bp, D. melanogaster
gcggctttaattg

SEQ ID NO: 628695 - DNA, 13 bp, D. melanogaster
gcggcttttggcc

SEQ ID NO: 628696 - DNA, 13 bp, D. melanogaster
gcgggaaaaacaa

SEQ ID NO: 628697 - DNA, 13 bp, D. melanogaster
gcgggaaaagcgg

SEQ ID NO: 628698 - DNA, 13 bp, D. melanogaster
gcgggaaaattaa

SEQ ID NO: 628699 - DNA, 18 bp, D. melanogaster
gcgggaaaccgctgcttg

SEQ ID NO: 628700 - DNA, 14 bp, D. melanogaster
gcgggaccaaagcc

SEQ ID NO: 628701 - DNA, 13 bp, D. melanogaster
gcgggactttgcc

SEQ ID NO: 628702 - DNA, 13 bp, D. melanogaster
gcgggcaataaaa

SEQ ID NO: 628703 - DNA, 13 bp, D. melanogaster
gcgggcgggaaaa

SEQ ID NO: 628704 - DNA, 13 bp, D. melanogaster
gcgggctgcagtt

SEQ ID NO: 628705 - DNA, 13 bp, D. melanogaster
gcggggaaatggg

SEQ ID NO: 628706 - DNA, 13 bp, D. melanogaster
gcggggaaattcc

SEQ ID NO: 628707 - DNA, 14 bp, D. melanogaster
gcgggggcgtggca

SEQ ID NO: 628708 - DNA, 13 bp, D. melanogaster
gcgggtgcagccg

SEQ ID NO: 628709 - DNA, 13 bp, D. melanogaster
gcgggtggaaaag

SEQ ID NO: 628710 - DNA, 13 bp, D. melanogaster
gcggtaaattgcg

SEQ ID NO: 628711 - DNA, 13 bp, D. melanogaster
gcggtccattcca

SEQ ID NO: 628712 - DNA, 13 bp, D. melanogaster
gcggtgcagccgg

SEQ ID NO: 628713 - DNA, 13 bp, D. melanogaster
gcggtggacattg

SEQ ID NO: 628714 - DNA, 13 bp, D. melanogaster
gcggtggcaaaaa

SEQ ID NO: 628715 - DNA, 13 bp, D. melanogaster
gcggtgggcggca

SEQ ID NO: 628716 - DNA, 13 bp, D. melanogaster
gcggttgcagttg

SEQ ID NO: 628717 - DNA, 13 bp, D. melanogaster
gcggttttattta

SEQ ID NO: 628718 - DNA, 13 bp, D. melanogaster
gcgtaaataaata

SEQ ID NO: 628719 - DNA, 13 bp, D. melanogaster
gcgtagttttcct

SEQ ID NO: 628720 - DNA, 13 bp, D. melanogaster
gcgtataaataaa

SEQ ID NO: 628721 - DNA, 13 bp, D. melanogaster
gcgtatacgcaac

SEQ ID NO: 628722 - DNA, 13 bp, D. melanogaster
gcgtatacgcaat

SEQ ID NO: 628723 - DNA, 14 bp, D. melanogaster
gcgtatacgcaatg

SEQ ID NO: 628724 - DNA, 13 bp, D. melanogaster
gcgtatacgcgat

SEQ ID NO: 628725 - DNA, 14 bp, D. melanogaster
gcgtatacgcgatg

SEQ ID NO: 628726 - DNA, 13 bp, D. melanogaster
gcgtatacgtaac

SEQ ID NO: 628727 - DNA, 13 bp, D. melanogaster
gcgtatacgtaat

SEQ ID NO: 628728 - DNA, 13 bp, D. melanogaster
gcgtatacgtgat

SEQ ID NO: 628729 - DNA, 13 bp, D. melanogaster
gcgtatacttaat

SEQ ID NO: 628730 - DNA, 14 bp, D. melanogaster
gcgtatacttaata

SEQ ID NO: 628731 - DNA, 13 bp, D. melanogaster
gcgtatacttgat

SEQ ID NO: 628732 - DNA, 14 bp, D. melanogaster
gcgtatacttgata

SEQ ID NO: 628733 - DNA, 13 bp, D. melanogaster
gcgtatatatata

SEQ ID NO: 628734 - DNA, 13 bp, D. melanogaster
gcgtatctgtatc

SEQ ID NO: 628735 - DNA, 13 bp, D. melanogaster
gcgtatgagcaat

SEQ ID NO: 628736 - DNA, 13 bp, D. melanogaster
gcgtatgagcgat

SEQ ID NO: 628737 - DNA, 13 bp, D. melanogaster
gcgtatgagtaat

SEQ ID NO: 628738 - DNA, 13 bp, D. melanogaster
gcgtatgagtgat

SEQ ID NO: 628739 - DNA, 14 bp, D. melanogaster
gcgtatgagtgata

SEQ ID NO: 628740 - DNA, 13 bp, D. melanogaster
gcgtatgatgaat

SEQ ID NO: 628741 - DNA, 13 bp, D. melanogaster
gcgtatgattgat

SEQ ID NO: 628742 - DNA, 13 bp, D. melanogaster
gcgtatgcgcaat

SEQ ID NO: 628743 - DNA, 13 bp, D. melanogaster
gcgtatgcgtaat

SEQ ID NO: 628744 - DNA, 14 bp, D. melanogaster
gcgtatgcgtaatg

SEQ ID NO: 628745 - DNA, 13 bp, D. melanogaster
gcgtatgcgtgat

SEQ ID NO: 628746 - DNA, 13 bp, D. melanogaster
gcgtatgcgttat

SEQ ID NO: 628747 - DNA, 13 bp, D. melanogaster
gcgtatgcttgat

SEQ ID NO: 628748 - DNA, 13 bp, D. melanogaster
gcgtatgtgcaat

SEQ ID NO: 628749 - DNA, 13 bp, D. melanogaster
gcgtatgtgtaat

SEQ ID NO: 628750 - DNA, 14 bp, D. melanogaster
gcgtatgtgtgcgt

SEQ ID NO: 628751 - DNA, 17 bp, D. melanogaster
gcgtcacaattgcacaa

SEQ ID NO: 628752 - DNA, 13 bp, D. melanogaster
gcgtccaaattct

SEQ ID NO: 628753 - DNA, 13 bp, D. melanogaster
gcgtccgcaatat

SEQ ID NO: 628754 - DNA, 14 bp, D. melanogaster
gcgtcgacgtcgac

SEQ ID NO: 628755 - DNA, 13 bp, D. melanogaster
gcgtcgacgtcgg

SEQ ID NO: 628756 - DNA, 13 bp, D. melanogaster
gcgtcgcagtcgc

SEQ ID NO: 628757 - DNA, 13 bp, D. melanogaster
gcgtcgctgccgc

SEQ ID NO: 628758 - DNA, 13 bp, D. melanogaster
gcgtcggcagcga

SEQ ID NO: 628759 - DNA, 13 bp, D. melanogaster
gcgtcgttgagtt

SEQ ID NO: 628760 - DNA, 14 bp, D. melanogaster
gcgtctcacagcgc

SEQ ID NO: 628761 - DNA, 13 bp, D. melanogaster
gcgtctctttcgc

SEQ ID NO: 628762 - DNA, 13 bp, D. melanogaster
gcgtctgcgacat

SEQ ID NO: 628763 - DNA, 13 bp, D. melanogaster
gcgtctgtgtgcg

SEQ ID NO: 628764 - DNA, 13 bp, D. melanogaster
gcgtctgtgtggg

SEQ ID NO: 628765 - DNA, 13 bp, D. melanogaster
gcgtctgtgtttg

SEQ ID NO: 628766 - DNA, 13 bp, D. melanogaster
gcgtgaaatcgct

SEQ ID NO: 628767 - DNA, 13 bp, D. melanogaster
gcgtgatttctca

SEQ ID NO: 628768 - DNA, 13 bp, D. melanogaster
gcgtgcataaaca

SEQ ID NO: 628769 - DNA, 13 bp, D. melanogaster
gcgtgcatgtgtg

SEQ ID NO: 628770 - DNA, 13 bp, D. melanogaster
gcgtgccaagcag

SEQ ID NO: 628771 - DNA, 13 bp, D. melanogaster
gcgtgccaccccc

SEQ ID NO: 628772 - DNA, 13 bp, D. melanogaster
gcgtgcgagcgag

SEQ ID NO: 628773 - DNA, 13 bp, D. melanogaster
gcgtgcgtatgtg

SEQ ID NO: 628774 - DNA, 13 bp, D. melanogaster
gcgtgctcctttc

SEQ ID NO: 628775 - DNA, 13 bp, D. melanogaster
gcgtgcttgtgtg

SEQ ID NO: 628776 - DNA, 13 bp, D. melanogaster
gcgtggaaaagtg

SEQ ID NO: 628777 - DNA, 14 bp, D. melanogaster
gcgtggcaaaaagt

SEQ ID NO: 628778 - DNA, 13 bp, D. melanogaster
gcgtggcaaaaat

SEQ ID NO: 628779 - DNA, 13 bp, D. melanogaster
gcgtggcaaaatg

SEQ ID NO: 628780 - DNA, 13 bp, D. melanogaster
gcgtggcaagtgg

SEQ ID NO: 628781 - DNA, 13 bp, D. melanogaster
gcgtggcagcatg

SEQ ID NO: 628782 - DNA, 13 bp, D. melanogaster
gcgtggcaggcgg

SEQ ID NO: 628783 - DNA, 14 bp, D. melanogaster
gcgtggcaggggca

SEQ ID NO: 628784 - DNA, 13 bp, D. melanogaster
gcgtggcagtggc

SEQ ID NO: 628785 - DNA, 14 bp, D. melanogaster
gcgtgggaatgctg

SEQ ID NO: 628786 - DNA, 14 bp, D. melanogaster
gcgtgggcgtggca

SEQ ID NO: 628787 - DNA, 13 bp, D. melanogaster
gcgtgtatatata

SEQ ID NO: 628788 - DNA, 13 bp, D. melanogaster
gcgtgtatgtgtg

SEQ ID NO: 628789 - DNA, 14 bp, D. melanogaster
gcgtgtatgtgtgt

SEQ ID NO: 628790 - DNA, 13 bp, D. melanogaster
gcgtgtctgtgtg

SEQ ID NO: 628791 - DNA, 13 bp, D. melanogaster
gcgtgtgagtgtg

SEQ ID NO: 628792 - DNA, 13 bp, D. melanogaster
gcgtgtgcatgtg

SEQ ID NO: 628793 - DNA, 13 bp, D. melanogaster
gcgtgtggctatc

SEQ ID NO: 628794 - DNA, 14 bp, D. melanogaster
gcgtgtgtatgtgt

SEQ ID NO: 628795 - DNA, 13 bp, D. melanogaster
gcgtgtgtgcgag

SEQ ID NO: 628796 - DNA, 13 bp, D. melanogaster
gcgtgtgtgtatc

SEQ ID NO: 628797 - DNA, 14 bp, D. melanogaster
gcgtgtgtgtatgt

SEQ ID NO: 628798 - DNA, 13 bp, D. melanogaster
gcgtgtgtgtctg

SEQ ID NO: 628799 - DNA, 14 bp, D. melanogaster
gcgtgtgtgtgagc

SEQ ID NO: 628800 - DNA, 14 bp, D. melanogaster
gcgtgtgtgtgagt

SEQ ID NO: 628801 - DNA, 14 bp, D. melanogaster
gcgtgtgtgtgtct

SEQ ID NO: 628802 - DNA, 13 bp, D. melanogaster
gcgttaggcaaca

SEQ ID NO: 628803 - DNA, 13 bp, D. melanogaster
gcgttatcaagaa

SEQ ID NO: 628804 - DNA, 13 bp, D. melanogaster
gcgttatttgttt

SEQ ID NO: 628805 - DNA, 13 bp, D. melanogaster
gcgttcataactt

SEQ ID NO: 628806 - DNA, 13 bp, D. melanogaster
gcgttccacaatc

SEQ ID NO: 628807 - DNA, 13 bp, D. melanogaster
gcgttcgcagaac

SEQ ID NO: 628808 - DNA, 13 bp, D. melanogaster
gcgttcgcatttc

SEQ ID NO: 628809 - DNA, 14 bp, D. melanogaster
gcgttctcgtctct

SEQ ID NO: 628810 - DNA, 13 bp, D. melanogaster
gcgttgaaaagag

SEQ ID NO: 628811 - DNA, 13 bp, D. melanogaster
gcgttgaatttaa

SEQ ID NO: 628812 - DNA, 13 bp, D. melanogaster
gcgttgatttatg

SEQ ID NO: 628813 - DNA, 13 bp, D. melanogaster
gcgttgcgttgcg

SEQ ID NO: 628814 - DNA, 14 bp, D. melanogaster
gcgttgcgttgcgt

SEQ ID NO: 628815 - DNA, 13 bp, D. melanogaster
gcgttggccagcg

SEQ ID NO: 628816 - DNA, 13 bp, D. melanogaster
gcgttggccagtt

SEQ ID NO: 628817 - DNA, 13 bp, D. melanogaster
gcgttggccatgt

SEQ ID NO: 628818 - DNA, 13 bp, D. melanogaster
gcgttgggcgcca

SEQ ID NO: 628819 - DNA, 13 bp, D. melanogaster
gcgttggtaactg

SEQ ID NO: 628820 - DNA, 13 bp, D. melanogaster
gcgttggtgtgcg

SEQ ID NO: 628821 - DNA, 14 bp, D. melanogaster
gcgtttaattaaaa

SEQ ID NO: 628822 - DNA, 13 bp, D. melanogaster
gcgtttaattgaa

SEQ ID NO: 628823 - DNA, 13 bp, D. melanogaster
gcgtttatttatt

SEQ ID NO: 628824 - DNA, 13 bp, D. melanogaster
gcgtttccgacta

SEQ ID NO: 628825 - DNA, 13 bp, D. melanogaster
gcgtttgcatttg

SEQ ID NO: 628826 - DNA, 13 bp, D. melanogaster
gcgtttgggattg

SEQ ID NO: 628827 - DNA, 13 bp, D. melanogaster
gcgtttgtgaaaa

SEQ ID NO: 628828 - DNA, 13 bp, D. melanogaster
gcgtttgtttgtc

SEQ ID NO: 628829 - DNA, 13 bp, D. melanogaster
gcgttttattatt

SEQ ID NO: 628830 - DNA, 13 bp, D. melanogaster
gcgttttatttgc

SEQ ID NO: 628831 - DNA, 13 bp, D. melanogaster
gcgttttggcatt

SEQ ID NO: 628832 - DNA, 13 bp, D. melanogaster
gcgttttgtttat

SEQ ID NO: 628833 - DNA, 13 bp, D. melanogaster
gcgtttttgcatt

SEQ ID NO: 628834 - DNA, 13 bp, D. melanogaster
gctaaaaaaaagt

SEQ ID NO: 628835 - DNA, 13 bp, D. melanogaster
gctaaaaaataat

SEQ ID NO: 628836 - DNA, 13 bp, D. melanogaster
gctaaaaaatgaa

SEQ ID NO: 628837 - DNA, 13 bp, D. melanogaster
gctaaaaacaaca

SEQ ID NO: 628838 - DNA, 14 bp, D. melanogaster
gctaaaaataaaat

SEQ ID NO: 628839 - DNA, 14 bp, D. melanogaster
gctaaaaataaaca

SEQ ID NO: 628840 - DNA, 13 bp, D. melanogaster
gctaaaaataaag

SEQ ID NO: 628841 - DNA, 13 bp, D. melanogaster
gctaaaaataaat

SEQ ID NO: 628842 - DNA, 14 bp, D. melanogaster
gctaaaaatatata

SEQ ID NO: 628843 - DNA, 13 bp, D. melanogaster
gctaaaaatatgt

SEQ ID NO: 628844 - DNA, 14 bp, D. melanogaster
gctaaaacagttgc

SEQ ID NO: 628845 - DNA, 13 bp, D. melanogaster
gctaaaactaaat

SEQ ID NO: 628846 - DNA, 13 bp, D. melanogaster
gctaaaagcaaaa

SEQ ID NO: 628847 - DNA, 13 bp, D. melanogaster
gctaaaagcaaat

SEQ ID NO: 628848 - DNA, 13 bp, D. melanogaster
gctaaaagcattt

SEQ ID NO: 628849 - DNA, 13 bp, D. melanogaster
gctaaaagccaaa

SEQ ID NO: 628850 - DNA, 13 bp, D. melanogaster
gctaaaagctttt

SEQ ID NO: 628851 - DNA, 14 bp, D. melanogaster
gctaaaataaaaac

SEQ ID NO: 628852 - DNA, 13 bp, D. melanogaster
gctaaaataaaga

SEQ ID NO: 628853 - DNA, 13 bp, D. melanogaster
gctaaaataacaa

SEQ ID NO: 628854 - DNA, 13 bp, D. melanogaster
gctaaaatcaaaa

SEQ ID NO: 628855 - DNA, 13 bp, D. melanogaster
gctaaaatgaaaa

SEQ ID NO: 628856 - DNA, 13 bp, D. melanogaster
gctaaaattaaaa

SEQ ID NO: 628857 - DNA, 13 bp, D. melanogaster
gctaaacaaaaat

SEQ ID NO: 628858 - DNA, 13 bp, D. melanogaster
gctaaacaacaaa

SEQ ID NO: 628859 - DNA, 13 bp, D. melanogaster
gctaaacaatttg

SEQ ID NO: 628860 - DNA, 13 bp, D. melanogaster
gctaaacaggaaa

SEQ ID NO: 628861 - DNA, 14 bp, D. melanogaster
gctaaacaggaaaa

SEQ ID NO: 628862 - DNA, 13 bp, D. melanogaster
gctaaacatttat

SEQ ID NO: 628863 - DNA, 13 bp, D. melanogaster
gctaaacattttc

SEQ ID NO: 628864 - DNA, 13 bp, D. melanogaster
gctaaactggaga

SEQ ID NO: 628865 - DNA, 13 bp, D. melanogaster
gctaaagctgaac

SEQ ID NO: 628866 - DNA, 13 bp, D. melanogaster
gctaaaggaaaag

SEQ ID NO: 628867 - DNA, 13 bp, D. melanogaster
gctaaagtttctt

SEQ ID NO: 628868 - DNA, 13 bp, D. melanogaster
gctaaagtttttt

SEQ ID NO: 628869 - DNA, 13 bp, D. melanogaster
gctaaataaataa

SEQ ID NO: 628870 - DNA, 14 bp, D. melanogaster
gctaaataaataat

SEQ ID NO: 628871 - DNA, 13 bp, D. melanogaster
gctaaataaatca

SEQ ID NO: 628872 - DNA, 13 bp, D. melanogaster
gctaaatataaat

SEQ ID NO: 628873 - DNA, 13 bp, D. melanogaster
gctaaatgaaaaa

SEQ ID NO: 628874 - DNA, 13 bp, D. melanogaster
gctaaatgaaata

SEQ ID NO: 628875 - DNA, 13 bp, D. melanogaster
gctaaatgaaatt

SEQ ID NO: 628876 - DNA, 13 bp, D. melanogaster
gctaaatggtttt

SEQ ID NO: 628877 - DNA, 13 bp, D. melanogaster
gctaaattattta

SEQ ID NO: 628878 - DNA, 13 bp, D. melanogaster
gctaaattcaaaa

SEQ ID NO: 628879 - DNA, 13 bp, D. melanogaster
gctaaatttagtt

SEQ ID NO: 628880 - DNA, 14 bp, D. melanogaster
gctaacacacacac

SEQ ID NO: 628881 - DNA, 13 bp, D. melanogaster
gctaaccaaaaaa

SEQ ID NO: 628882 - DNA, 13 bp, D. melanogaster
gctaacgaaattg

SEQ ID NO: 628883 - DNA, 14 bp, D. melanogaster
gctaacgaaattgg

SEQ ID NO: 628884 - DNA, 13 bp, D. melanogaster
gctaactaactaa

SEQ ID NO: 628885 - DNA, 13 bp, D. melanogaster
gctaagcagatgg

SEQ ID NO: 628886 - DNA, 14 bp, D. melanogaster
gctaagcccaaaac

SEQ ID NO: 628887 - DNA, 13 bp, D. melanogaster
gctaagcgttcgc

SEQ ID NO: 628888 - DNA, 14 bp, D. melanogaster
gctaagcgttcgct

SEQ ID NO: 628889 - DNA, 13 bp, D. melanogaster
gctaagctaagct

SEQ ID NO: 628890 - DNA, 13 bp, D. melanogaster
gctaagtcaaaac

SEQ ID NO: 628891 - DNA, 13 bp, D. melanogaster
gctaagtgcattt

SEQ ID NO: 628892 - DNA, 13 bp, D. melanogaster
gctaataaaaacc

SEQ ID NO: 628893 - DNA, 13 bp, D. melanogaster
gctaataaaacaa

SEQ ID NO: 628894 - DNA, 13 bp, D. melanogaster
gctaataaaatat

SEQ ID NO: 628895 - DNA, 13 bp, D. melanogaster
gctaataaaatga

SEQ ID NO: 628896 - DNA, 13 bp, D. melanogaster
gctaataaatatt

SEQ ID NO: 628897 - DNA, 13 bp, D. melanogaster
gctaataaattaa

SEQ ID NO: 628898 - DNA, 13 bp, D. melanogaster
gctaataattttt

SEQ ID NO: 628899 - DNA, 13 bp, D. melanogaster
gctaatataaagt

SEQ ID NO: 628900 - DNA, 13 bp, D. melanogaster
gctaatcagaaat

SEQ ID NO: 628901 - DNA, 13 bp, D. melanogaster
gctaatcgccatc

SEQ ID NO: 628902 - DNA, 13 bp, D. melanogaster
gctaatgagtgcc

SEQ ID NO: 628903 - DNA, 13 bp, D. melanogaster
gctaatgcaaatt

SEQ ID NO: 628904 - DNA, 14 bp, D. melanogaster
gctaatgctaatgc

SEQ ID NO: 628905 - DNA, 13 bp, D. melanogaster
gctaatggcattt

SEQ ID NO: 628906 - DNA, 13 bp, D. melanogaster
gctaattaaaagt

SEQ ID NO: 628907 - DNA, 13 bp, D. melanogaster
gctaattaaattc

SEQ ID NO: 628908 - DNA, 13 bp, D. melanogaster
gctaattatgcaa

SEQ ID NO: 628909 - DNA, 13 bp, D. melanogaster
gctaattattatt

SEQ ID NO: 628910 - DNA, 13 bp, D. melanogaster
gctaattgaaaac

SEQ ID NO: 628911 - DNA, 13 bp, D. melanogaster
gctaattgaaatc

SEQ ID NO: 628912 - DNA, 13 bp, D. melanogaster
gctaattgatttc

SEQ ID NO: 628913 - DNA, 13 bp, D. melanogaster
gctaattgccaaa

SEQ ID NO: 628914 - DNA, 13 bp, D. melanogaster
gctaattgctgtt

SEQ ID NO: 628915 - DNA, 13 bp, D. melanogaster
gctaattggaaaa

SEQ ID NO: 628916 - DNA, 13 bp, D. melanogaster
gctaattggattt

SEQ ID NO: 628917 - DNA, 13 bp, D. melanogaster
gctaattggcaga

SEQ ID NO: 628918 - DNA, 13 bp, D. melanogaster
gctaattgttttt

SEQ ID NO: 628919 - DNA, 13 bp, D. melanogaster
gctaatttaatta

SEQ ID NO: 628920 - DNA, 14 bp, D. melanogaster
gctaatttaattaa

SEQ ID NO: 628921 - DNA, 13 bp, D. melanogaster
gctaatttcgtta

SEQ ID NO: 628922 - DNA, 13 bp, D. melanogaster
gctaatttgcaat

SEQ ID NO: 628923 - DNA, 13 bp, D. melanogaster
gctacaaaatatt

SEQ ID NO: 628924 - DNA, 13 bp, D. melanogaster
gctacaaaatctt

SEQ ID NO: 628925 - DNA, 13 bp, D. melanogaster
gctacaaaatgca

SEQ ID NO: 628926 - DNA, 13 bp, D. melanogaster
gctacaaagagcg

SEQ ID NO: 628927 - DNA, 13 bp, D. melanogaster
gctacaaatcaga

SEQ ID NO: 628928 - DNA, 13 bp, D. melanogaster
gctacaacaacaa

SEQ ID NO: 628929 - DNA, 13 bp, D. melanogaster
gctacaagttgaa

SEQ ID NO: 628930 - DNA, 14 bp, D. melanogaster
gctacaatggtttc

SEQ ID NO: 628931 - DNA, 13 bp, D. melanogaster
gctacagatacag

SEQ ID NO: 628932 - DNA, 14 bp, D. melanogaster
gctacagcgaacag

SEQ ID NO: 628933 - DNA, 14 bp, D. melanogaster
gctacagctacagc

SEQ ID NO: 628934 - DNA, 13 bp, D. melanogaster
gctacatttttga

SEQ ID NO: 628935 - DNA, 13 bp, D. melanogaster
gctacgacagcaa

SEQ ID NO: 628936 - DNA, 13 bp, D. melanogaster
gctacgctcatgt

SEQ ID NO: 628937 - DNA, 13 bp, D. melanogaster
gctactcgaagag

SEQ ID NO: 628938 - DNA, 13 bp, D. melanogaster
gctactgctgttg

SEQ ID NO: 628939 - DNA, 15 bp, D. melanogaster
gctactgctgttgct

SEQ ID NO: 628940 - DNA, 13 bp, D. melanogaster
gctactttcagtc

SEQ ID NO: 628941 - DNA, 13 bp, D. melanogaster
gctacttttaaat

SEQ ID NO: 628942 - DNA, 13 bp, D. melanogaster
gctagaaaaacaa

SEQ ID NO: 628943 - DNA, 13 bp, D. melanogaster
gctagaatttcaa

SEQ ID NO: 628944 - DNA, 13 bp, D. melanogaster
gctagaggtcaat

SEQ ID NO: 628945 - DNA, 13 bp, D. melanogaster
gctagcaacagtt

SEQ ID NO: 628946 - DNA, 13 bp, D. melanogaster
gctagcgaaagaa

SEQ ID NO: 628947 - DNA, 13 bp, D. melanogaster
gctagcttataag

SEQ ID NO: 628948 - DNA, 13 bp, D. melanogaster
gctagtggaagtg

SEQ ID NO: 628949 - DNA, 13 bp, D. melanogaster
gctagttttccca

SEQ ID NO: 628950 - DNA, 13 bp, D. melanogaster
gctataaaaataa

SEQ ID NO: 628951 - DNA, 13 bp, D. melanogaster
gctataaaagatg

SEQ ID NO: 628952 - DNA, 13 bp, D. melanogaster
gctataaacctta

SEQ ID NO: 628953 - DNA, 14 bp, D. melanogaster
gctataaataaaat

SEQ ID NO: 628954 - DNA, 14 bp, D. melanogaster
gctataacagaggc

SEQ ID NO: 628955 - DNA, 13 bp, D. melanogaster
gctataaccacat

SEQ ID NO: 628956 - DNA, 13 bp, D. melanogaster
gctataatggaaa

SEQ ID NO: 628957 - DNA, 13 bp, D. melanogaster
gctatacaaaatt

SEQ ID NO: 628958 - DNA, 13 bp, D. melanogaster
gctatacatatat

SEQ ID NO: 628959 - DNA, 14 bp, D. melanogaster
gctatagtcaagtt

SEQ ID NO: 628960 - DNA, 13 bp, D. melanogaster
gctatatactata

SEQ ID NO: 628961 - DNA, 13 bp, D. melanogaster
gctatatagtata

SEQ ID NO: 628962 - DNA, 13 bp, D. melanogaster
gctatatatacat

SEQ ID NO: 628963 - DNA, 13 bp, D. melanogaster
gctatatatatgt

SEQ ID NO: 628964 - DNA, 13 bp, D. melanogaster
gctatatctttag

SEQ ID NO: 628965 - DNA, 14 bp, D. melanogaster
gctatatgctatat

SEQ ID NO: 628966 - DNA, 13 bp, D. melanogaster
gctatatgtacat

SEQ ID NO: 628967 - DNA, 13 bp, D. melanogaster
gctatcagatacc

SEQ ID NO: 628968 - DNA, 13 bp, D. melanogaster
gctatcccaaaac

SEQ ID NO: 628969 - DNA, 13 bp, D. melanogaster
gctatctctttcg

SEQ ID NO: 628970 - DNA, 13 bp, D. melanogaster
gctatctgaatgg

SEQ ID NO: 628971 - DNA, 13 bp, D. melanogaster
gctatgaaaaaat

SEQ ID NO: 628972 - DNA, 14 bp, D. melanogaster
gctatgcagctttc

SEQ ID NO: 628973 - DNA, 13 bp, D. melanogaster
gctatgctaatac

SEQ ID NO: 628974 - DNA, 13 bp, D. melanogaster
gctatgtatgtat

SEQ ID NO: 628975 - DNA, 13 bp, D. melanogaster
gctatgtctgcgt

SEQ ID NO: 628976 - DNA, 14 bp, D. melanogaster
gctatgtgtgtgtg

SEQ ID NO: 628977 - DNA, 13 bp, D. melanogaster
gctatgtttattg

SEQ ID NO: 628978 - DNA, 13 bp, D. melanogaster
gctattaaaaaat

SEQ ID NO: 628979 - DNA, 13 bp, D. melanogaster
gctattattattg

SEQ ID NO: 628980 - DNA, 13 bp, D. melanogaster
gctattattttta

SEQ ID NO: 628981 - DNA, 13 bp, D. melanogaster
gctattctacaaa

SEQ ID NO: 628982 - DNA, 13 bp, D. melanogaster
gctattgagaaaa

SEQ ID NO: 628983 - DNA, 13 bp, D. melanogaster
gctattgctgctg

SEQ ID NO: 628984 - DNA, 13 bp, D. melanogaster
gctatttattatt

SEQ ID NO: 628985 - DNA, 13 bp, D. melanogaster
gctatttattctt

SEQ ID NO: 628986 - DNA, 13 bp, D. melanogaster
gctatttctttgg

SEQ ID NO: 628987 - DNA, 13 bp, D. melanogaster
gctatttgctttt

SEQ ID NO: 628988 - DNA, 13 bp, D. melanogaster
gctatttgtgttt

SEQ ID NO: 628989 - DNA, 13 bp, D. melanogaster
gctattttaaata

SEQ ID NO: 628990 - DNA, 13 bp, D. melanogaster
gctatttttgtta

SEQ ID NO: 628991 - DNA, 14 bp, D. melanogaster
gctcaaaaactaca

SEQ ID NO: 628992 - DNA, 13 bp, D. melanogaster
gctcaaaaatcaa

SEQ ID NO: 628993 - DNA, 13 bp, D. melanogaster
gctcaaaaatgca

SEQ ID NO: 628994 - DNA, 13 bp, D. melanogaster
gctcaaaactcaa

SEQ ID NO: 628995 - DNA, 14 bp, D. melanogaster
gctcaaaagtatgc

SEQ ID NO: 628996 - DNA, 13 bp, D. melanogaster
gctcaaaataaaa

SEQ ID NO: 628997 - DNA, 13 bp, D. melanogaster
gctcaaaatattt

SEQ ID NO: 628998 - DNA, 13 bp, D. melanogaster
gctcaaacaaaaa

SEQ ID NO: 628999 - DNA, 13 bp, D. melanogaster
gctcaaacatttt

SEQ ID NO: 629000 - DNA, 13 bp, D. melanogaster
gctcaaagtgaaa

SEQ ID NO: 629001 - DNA, 13 bp, D. melanogaster
gctcaaataaaaa

SEQ ID NO: 629002 - DNA, 13 bp, D. melanogaster
gctcaaattattt

SEQ ID NO: 629003 - DNA, 13 bp, D. melanogaster
gctcaaattgaaa

SEQ ID NO: 629004 - DNA, 13 bp, D. melanogaster
gctcaacaaatgc

SEQ ID NO: 629005 - DNA, 14 bp, D. melanogaster
gctcaacaaatgcc

SEQ ID NO: 629006 - DNA, 13 bp, D. melanogaster
gctcaacacggcc

SEQ ID NO: 629007 - DNA, 13 bp, D. melanogaster
gctcaacatttat

SEQ ID NO: 629008 - DNA, 13 bp, D. melanogaster
gctcaactcaact

SEQ ID NO: 629009 - DNA, 13 bp, D. melanogaster
gctcaagctcaag

SEQ ID NO: 629010 - DNA, 13 bp, D. melanogaster
gctcaattaaaaa

SEQ ID NO: 629011 - DNA, 13 bp, D. melanogaster
gctcaattgaaaa

SEQ ID NO: 629012 - DNA, 13 bp, D. melanogaster
gctcacacacaca

SEQ ID NO: 629013 - DNA, 14 bp, D. melanogaster
gctcacacacacac

SEQ ID NO: 629014 - DNA, 13 bp, D. melanogaster
gctcacacgcaca

SEQ ID NO: 629015 - DNA, 13 bp, D. melanogaster
gctcaccaacaca

SEQ ID NO: 629016 - DNA, 13 bp, D. melanogaster
gctcaccgaagtc

SEQ ID NO: 629017 - DNA, 13 bp, D. melanogaster
gctcaccttcagc

SEQ ID NO: 629018 - DNA, 13 bp, D. melanogaster
gctcacgcacaca

SEQ ID NO: 629019 - DNA, 13 bp, D. melanogaster
gctcacgcagcac

SEQ ID NO: 629020 - DNA, 13 bp, D. melanogaster
gctcactaatctg

SEQ ID NO: 629021 - DNA, 16 bp, D. melanogaster
gctcactacaacaagc

SEQ ID NO: 629022 - DNA, 13 bp, D. melanogaster
gctcactcccgct

SEQ ID NO: 629023 - DNA, 13 bp, D. melanogaster
gctcagcaaataa

SEQ ID NO: 629024 - DNA, 13 bp, D. melanogaster
gctcagcacgatg

SEQ ID NO: 629025 - DNA, 13 bp, D. melanogaster
gctcagccaaaaa

SEQ ID NO: 629026 - DNA, 13 bp, D. melanogaster
gctcagccaaggg

SEQ ID NO: 629027 - DNA, 13 bp, D. melanogaster
gctcagctcaact

SEQ ID NO: 629028 - DNA, 14 bp, D. melanogaster
gctcagctcagctc

SEQ ID NO: 629029 - DNA, 13 bp, D. melanogaster
gctcagtcagtca

SEQ ID NO: 629030 - DNA, 13 bp, D. melanogaster
gctcagttcagtt

SEQ ID NO: 629031 - DNA, 13 bp, D. melanogaster
gctcataaataat

SEQ ID NO: 629032 - DNA, 13 bp, D. melanogaster
gctcataaatatt

SEQ ID NO: 629033 - DNA, 14 bp, D. melanogaster
gctcataaattgtt

SEQ ID NO: 629034 - DNA, 13 bp, D. melanogaster
gctcatacatgtg

SEQ ID NO: 629035 - DNA, 13 bp, D. melanogaster
gctcatacgcacc

SEQ ID NO: 629036 - DNA, 13 bp, D. melanogaster
gctcatacgccac

SEQ ID NO: 629037 - DNA, 13 bp, D. melanogaster
gctcatatatgta

SEQ ID NO: 629038 - DNA, 13 bp, D. melanogaster
gctcatcatcatc

SEQ ID NO: 629039 - DNA, 14 bp, D. melanogaster
gctcatcatcatca

SEQ ID NO: 629040 - DNA, 13 bp, D. melanogaster
gctcatcctcatc

SEQ ID NO: 629041 - DNA, 13 bp, D. melanogaster
gctcatctttaag

SEQ ID NO: 629042 - DNA, 13 bp, D. melanogaster
gctcatggaggca

SEQ ID NO: 629043 - DNA, 13 bp, D. melanogaster
gctcattaattat

SEQ ID NO: 629044 - DNA, 13 bp, D. melanogaster
gctcattacttat

SEQ ID NO: 629045 - DNA, 13 bp, D. melanogaster
gctcattagcatt

SEQ ID NO: 629046 - DNA, 13 bp, D. melanogaster
gctcatttatttt

SEQ ID NO: 629047 - DNA, 13 bp, D. melanogaster
gctcatttgcatg

SEQ ID NO: 629048 - DNA, 14 bp, D. melanogaster
gctcatttgcatgc

SEQ ID NO: 629049 - DNA, 13 bp, D. melanogaster
gctcatttgtttg

SEQ ID NO: 629050 - DNA, 13 bp, D. melanogaster
gctccaaaaaaaa

SEQ ID NO: 629051 - DNA, 14 bp, D. melanogaster
gctccaaaaaaaaa

SEQ ID NO: 629052 - DNA, 13 bp, D. melanogaster
gctccaactccaa

SEQ ID NO: 629053 - DNA, 13 bp, D. melanogaster
gctccaagaagaa

SEQ ID NO: 629054 - DNA, 13 bp, D. melanogaster
gctccaagctcca

SEQ ID NO: 629055 - DNA, 13 bp, D. melanogaster
gctccacacacac

SEQ ID NO: 629056 - DNA, 13 bp, D. melanogaster
gctccacagctcc

SEQ ID NO: 629057 - DNA, 13 bp, D. melanogaster
gctccaccctcga

SEQ ID NO: 629058 - DNA, 14 bp, D. melanogaster
gctccactccactc

SEQ ID NO: 629059 - DNA, 13 bp, D. melanogaster
gctccagcaaagg

SEQ ID NO: 629060 - DNA, 13 bp, D. melanogaster
gctccagctccac

SEQ ID NO: 629061 - DNA, 13 bp, D. melanogaster
gctccagctccat

SEQ ID NO: 629062 - DNA, 14 bp, D. melanogaster
gctccagctccatc

SEQ ID NO: 629063 - DNA, 13 bp, D. melanogaster
gctccagctcctt

SEQ ID NO: 629064 - DNA, 13 bp, D. melanogaster
gctccatctccat

SEQ ID NO: 629065 - DNA, 14 bp, D. melanogaster
gctccatctccatc

SEQ ID NO: 629066 - DNA, 13 bp, D. melanogaster
gctccatgctcca

SEQ ID NO: 629067 - DNA, 14 bp, D. melanogaster
gctccattccattc

SEQ ID NO: 629068 - DNA, 13 bp, D. melanogaster
gctccatttccat

SEQ ID NO: 629069 - DNA, 13 bp, D. melanogaster
gctcccaactccg

SEQ ID NO: 629070 - DNA, 13 bp, D. melanogaster
gctcccagttccc

SEQ ID NO: 629071 - DNA, 13 bp, D. melanogaster
gctccctcgctgc

SEQ ID NO: 629072 - DNA, 14 bp, D. melanogaster
gctccctcgctgca

SEQ ID NO: 629073 - DNA, 14 bp, D. melanogaster
gctccgctgctggc

SEQ ID NO: 629074 - DNA, 13 bp, D. melanogaster
gctccgtctctgt

SEQ ID NO: 629075 - DNA, 13 bp, D. melanogaster
gctcctactgctg

SEQ ID NO: 629076 - DNA, 13 bp, D. melanogaster
gctcctcctgacc

SEQ ID NO: 629077 - DNA, 14 bp, D. melanogaster
gctcctgctcctgg

SEQ ID NO: 629078 - DNA, 14 bp, D. melanogaster
gctcctgctcctgt

SEQ ID NO: 629079 - DNA, 13 bp, D. melanogaster
gctcctgctctcc

SEQ ID NO: 629080 - DNA, 13 bp, D. melanogaster
gctcctgctgatg

SEQ ID NO: 629081 - DNA, 14 bp, D. melanogaster
gctcctgctgccgc

SEQ ID NO: 629082 - DNA, 13 bp, D. melanogaster
gctcctgctgcct

SEQ ID NO: 629083 - DNA, 13 bp, D. melanogaster
gctcctgctgctg

SEQ ID NO: 629084 - DNA, 14 bp, D. melanogaster
gctcctgttcctgc

SEQ ID NO: 629085 - DNA, 13 bp, D. melanogaster
gctcctgttttcc

SEQ ID NO: 629086 - DNA, 13 bp, D. melanogaster
gctccttctgctg

SEQ ID NO: 629087 - DNA, 13 bp, D. melanogaster
gctccttgctcct

SEQ ID NO: 629088 - DNA, 13 bp, D. melanogaster
gctcctttatcat

SEQ ID NO: 629089 - DNA, 13 bp, D. melanogaster
gctcctttcattt

SEQ ID NO: 629090 - DNA, 13 bp, D. melanogaster
gctcctttcgaat

SEQ ID NO: 629091 - DNA, 13 bp, D. melanogaster
gctcctttggcca

SEQ ID NO: 629092 - DNA, 13 bp, D. melanogaster
gctcctttggctc

SEQ ID NO: 629093 - DNA, 13 bp, D. melanogaster
gctccttttgcca

SEQ ID NO: 629094 - DNA, 13 bp, D. melanogaster
gctccttttgctc

SEQ ID NO: 629095 - DNA, 13 bp, D. melanogaster
gctccttttttat

SEQ ID NO: 629096 - DNA, 13 bp, D. melanogaster
gctcgaaaaaagg

SEQ ID NO: 629097 - DNA, 13 bp, D. melanogaster
gctcgaaaaatat

SEQ ID NO: 629098 - DNA, 13 bp, D. melanogaster
gctcgaaaacttt

SEQ ID NO: 629099 - DNA, 14 bp, D. melanogaster
gctcgaaaatatca

SEQ ID NO: 629100 - DNA, 14 bp, D. melanogaster
gctcgaaattttaa

SEQ ID NO: 629101 - DNA, 13 bp, D. melanogaster
gctcgaaggacca

SEQ ID NO: 629102 - DNA, 13 bp, D. melanogaster
gctcgaattaatt

SEQ ID NO: 629103 - DNA, 13 bp, D. melanogaster
gctcgacaggagc

SEQ ID NO: 629104 - DNA, 13 bp, D. melanogaster
gctcgaccaagtt

SEQ ID NO: 629105 - DNA, 13 bp, D. melanogaster
gctcgacgcaaca

SEQ ID NO: 629106 - DNA, 13 bp, D. melanogaster
gctcgatcaccga

SEQ ID NO: 629107 - DNA, 13 bp, D. melanogaster
gctcgatttgttt

SEQ ID NO: 629108 - DNA, 13 bp, D. melanogaster
gctcgcaaaaaaa

SEQ ID NO: 629109 - DNA, 13 bp, D. melanogaster
gctcgccaaaagt

SEQ ID NO: 629110 - DNA, 13 bp, D. melanogaster
gctcgctctccac

SEQ ID NO: 629111 - DNA, 14 bp, D. melanogaster
gctcgctctccact

SEQ ID NO: 629112 - DNA, 13 bp, D. melanogaster
gctcgctgaataa

SEQ ID NO: 629113 - DNA, 13 bp, D. melanogaster
gctcgctggctgc

SEQ ID NO: 629114 - DNA, 13 bp, D. melanogaster
gctcggcatgggc

SEQ ID NO: 629115 - DNA, 13 bp, D. melanogaster
gctcggcgctttt

SEQ ID NO: 629116 - DNA, 13 bp, D. melanogaster
gctcggctaaaag

SEQ ID NO: 629117 - DNA, 13 bp, D. melanogaster
gctcggctcggct

SEQ ID NO: 629118 - DNA, 14 bp, D. melanogaster
gctcggctcggctc

SEQ ID NO: 629119 - DNA, 13 bp, D. melanogaster
gctcggctctgga

SEQ ID NO: 629120 - DNA, 13 bp, D. melanogaster
gctcggttcggtt

SEQ ID NO: 629121 - DNA, 13 bp, D. melanogaster
gctcggtttggtt

SEQ ID NO: 629122 - DNA, 14 bp, D. melanogaster
gctcgtaccaagca

SEQ ID NO: 629123 - DNA, 13 bp, D. melanogaster
gctcgtcttgttc

SEQ ID NO: 629124 - DNA, 13 bp, D. melanogaster
gctcgtttacttt

SEQ ID NO: 629125 - DNA, 13 bp, D. melanogaster
gctctaattaatt

SEQ ID NO: 629126 - DNA, 13 bp, D. melanogaster
gctctaattgaat

SEQ ID NO: 629127 - DNA, 13 bp, D. melanogaster
gctctacacactc

SEQ ID NO: 629128 - DNA, 13 bp, D. melanogaster
gctctactttatt

SEQ ID NO: 629129 - DNA, 13 bp, D. melanogaster
gctctagaggtgg

SEQ ID NO: 629130 - DNA, 13 bp, D. melanogaster
gctctcaaactgt

SEQ ID NO: 629131 - DNA, 13 bp, D. melanogaster
gctctcactctct

SEQ ID NO: 629132 - DNA, 13 bp, D. melanogaster
gctctcagctctc

SEQ ID NO: 629133 - DNA, 13 bp, D. melanogaster
gctctcccaaaaa

SEQ ID NO: 629134 - DNA, 13 bp, D. melanogaster
gctctcccgctct

SEQ ID NO: 629135 - DNA, 13 bp, D. melanogaster
gctctccgctctc

SEQ ID NO: 629136 - DNA, 14 bp, D. melanogaster
gctctcctcctcga

SEQ ID NO: 629137 - DNA, 14 bp, D. melanogaster
gctctcgctcgcac

SEQ ID NO: 629138 - DNA, 13 bp, D. melanogaster
gctctctcactct

SEQ ID NO: 629139 - DNA, 13 bp, D. melanogaster
gctctctcgctct

SEQ ID NO: 629140 - DNA, 14 bp, D. melanogaster
gctctctcgctctc

SEQ ID NO: 629141 - DNA, 13 bp, D. melanogaster
gctctctctccgc

SEQ ID NO: 629142 - DNA, 13 bp, D. melanogaster
gctctctgactgg

SEQ ID NO: 629143 - DNA, 13 bp, D. melanogaster
gctctctgcagag

SEQ ID NO: 629144 - DNA, 14 bp, D. melanogaster
gctctctttccgct

SEQ ID NO: 629145 - DNA, 13 bp, D. melanogaster
gctctctttctgc

SEQ ID NO: 629146 - DNA, 13 bp, D. melanogaster
gctctgaaacaag

SEQ ID NO: 629147 - DNA, 13 bp, D. melanogaster
gctctgaagctat

SEQ ID NO: 629148 - DNA, 13 bp, D. melanogaster
gctctgaaggcca

SEQ ID NO: 629149 - DNA, 16 bp, D. melanogaster
gctctgcaggaagcta

SEQ ID NO: 629150 - DNA, 13 bp, D. melanogaster
gctctgcctcgtc

SEQ ID NO: 629151 - DNA, 13 bp, D. melanogaster
gctctgctctgcg

SEQ ID NO: 629152 - DNA, 13 bp, D. melanogaster
gctctgctctgtt

SEQ ID NO: 629153 - DNA, 13 bp, D. melanogaster
gctctggcaattt

SEQ ID NO: 629154 - DNA, 13 bp, D. melanogaster
gctctggcatttt

SEQ ID NO: 629155 - DNA, 13 bp, D. melanogaster
gctctgtgtgtgt

SEQ ID NO: 629156 - DNA, 13 bp, D. melanogaster
gctctgtttgaat

SEQ ID NO: 629157 - DNA, 13 bp, D. melanogaster
gctcttaattgtt

SEQ ID NO: 629158 - DNA, 13 bp, D. melanogaster
gctcttacttata

SEQ ID NO: 629159 - DNA, 13 bp, D. melanogaster
gctcttctcgcgg

SEQ ID NO: 629160 - DNA, 14 bp, D. melanogaster
gctcttctgccgct

SEQ ID NO: 629161 - DNA, 13 bp, D. melanogaster
gctcttgaacaaa

SEQ ID NO: 629162 - DNA, 13 bp, D. melanogaster
gctcttgctcttg

SEQ ID NO: 629163 - DNA, 14 bp, D. melanogaster
gctcttggccaaaa

SEQ ID NO: 629164 - DNA, 13 bp, D. melanogaster
gctcttggccaga

SEQ ID NO: 629165 - DNA, 13 bp, D. melanogaster
gctcttggccatt

SEQ ID NO: 629166 - DNA, 13 bp, D. melanogaster
gctcttggtcagc

SEQ ID NO: 629167 - DNA, 13 bp, D. melanogaster
gctctttgaattt

SEQ ID NO: 629168 - DNA, 13 bp, D. melanogaster
gctctttgataac

SEQ ID NO: 629169 - DNA, 13 bp, D. melanogaster
gctctttggcttt

SEQ ID NO: 629170 - DNA, 13 bp, D. melanogaster
gctcttttattgc

SEQ ID NO: 629171 - DNA, 13 bp, D. melanogaster
gctcttttggcat

SEQ ID NO: 629172 - DNA, 13 bp, D. melanogaster
gctcttttggctc

SEQ ID NO: 629173 - DNA, 13 bp, D. melanogaster
gctgaaaaaaaag

SEQ ID NO: 629174 - DNA, 13 bp, D. melanogaster
gctgaaaaacaaa

SEQ ID NO: 629175 - DNA, 13 bp, D. melanogaster
gctgaaaaactga

SEQ ID NO: 629176 - DNA, 13 bp, D. melanogaster
gctgaaaaataaa

SEQ ID NO: 629177 - DNA, 14 bp, D. melanogaster
gctgaaaaataaaa

SEQ ID NO: 629178 - DNA, 13 bp, D. melanogaster
gctgaaaaatgca

SEQ ID NO: 629179 - DNA, 13 bp, D. melanogaster
gctgaaaaatgtt

SEQ ID NO: 629180 - DNA, 13 bp, D. melanogaster
gctgaaaacagaa

SEQ ID NO: 629181 - DNA, 13 bp, D. melanogaster
gctgaaaactgaa

SEQ ID NO: 629182 - DNA, 14 bp, D. melanogaster
gctgaaaactgaaa

SEQ ID NO: 629183 - DNA, 13 bp, D. melanogaster
gctgaaaactttt

SEQ ID NO: 629184 - DNA, 13 bp, D. melanogaster
gctgaaaaggaaa

SEQ ID NO: 629185 - DNA, 13 bp, D. melanogaster
gctgaaaagtaaa

SEQ ID NO: 629186 - DNA, 13 bp, D. melanogaster
gctgaaaagtatg

SEQ ID NO: 629187 - DNA, 13 bp, D. melanogaster
gctgaaaagtgtg

SEQ ID NO: 629188 - DNA, 13 bp, D. melanogaster
gctgaaaatccgt

SEQ ID NO: 629189 - DNA, 13 bp, D. melanogaster
gctgaaaatgaaa

SEQ ID NO: 629190 - DNA, 13 bp, D. melanogaster
gctgaaaatgcaa

SEQ ID NO: 629191 - DNA, 13 bp, D. melanogaster
gctgaaaattaag

SEQ ID NO: 629192 - DNA, 13 bp, D. melanogaster
gctgaaaattatt

SEQ ID NO: 629193 - DNA, 13 bp, D. melanogaster
gctgaaaattcga

SEQ ID NO: 629194 - DNA, 14 bp, D. melanogaster
gctgaaaattcgaa

SEQ ID NO: 629195 - DNA, 13 bp, D. melanogaster
gctgaaaattgag

SEQ ID NO: 629196 - DNA, 13 bp, D. melanogaster
gctgaaaattgcg

SEQ ID NO: 629197 - DNA, 13 bp, D. melanogaster
gctgaaaatttgt

SEQ ID NO: 629198 - DNA, 13 bp, D. melanogaster
gctgaaacaatta

SEQ ID NO: 629199 - DNA, 13 bp, D. melanogaster
gctgaaactatca

SEQ ID NO: 629200 - DNA, 14 bp, D. melanogaster
gctgaaacttaaaa

SEQ ID NO: 629201 - DNA, 13 bp, D. melanogaster
gctgaaagctttt

SEQ ID NO: 629202 - DNA, 13 bp, D. melanogaster
gctgaaagtgaaa

SEQ ID NO: 629203 - DNA, 13 bp, D. melanogaster
gctgaaataaaaa

SEQ ID NO: 629204 - DNA, 13 bp, D. melanogaster
gctgaaataaata

SEQ ID NO: 629205 - DNA, 13 bp, D. melanogaster
gctgaaataatta

SEQ ID NO: 629206 - DNA, 13 bp, D. melanogaster
gctgaaatcaaaa

SEQ ID NO: 629207 - DNA, 13 bp, D. melanogaster
gctgaaatcgaaa

SEQ ID NO: 629208 - DNA, 13 bp, D. melanogaster
gctgaaatgctga

SEQ ID NO: 629209 - DNA, 13 bp, D. melanogaster
gctgaaattgaaa

SEQ ID NO: 629210 - DNA, 13 bp, D. melanogaster
gctgaaattgttt

SEQ ID NO: 629211 - DNA, 13 bp, D. melanogaster
gctgaaatttatt

SEQ ID NO: 629212 - DNA, 13 bp, D. melanogaster
gctgaaatttcaa

SEQ ID NO: 629213 - DNA, 13 bp, D. melanogaster
gctgaactgaact

SEQ ID NO: 629214 - DNA, 13 bp, D. melanogaster
gctgaactgttgc

SEQ ID NO: 629215 - DNA, 13 bp, D. melanogaster
gctgaagcggaga

SEQ ID NO: 629216 - DNA, 13 bp, D. melanogaster
gctgaagctgcag

SEQ ID NO: 629217 - DNA, 13 bp, D. melanogaster
gctgaagctggag

SEQ ID NO: 629218 - DNA, 13 bp, D. melanogaster
gctgaaggctggc

SEQ ID NO: 629219 - DNA, 13 bp, D. melanogaster
gctgaataatgtc

SEQ ID NO: 629220 - DNA, 13 bp, D. melanogaster
gctgaatctcaac

SEQ ID NO: 629221 - DNA, 13 bp, D. melanogaster
gctgaatgaaatt

SEQ ID NO: 629222 - DNA, 13 bp, D. melanogaster
gctgaatgaatgg

SEQ ID NO: 629223 - DNA, 13 bp, D. melanogaster
gctgaatgatgtc

SEQ ID NO: 629224 - DNA, 13 bp, D. melanogaster
gctgaatgcaaat

SEQ ID NO: 629225 - DNA, 13 bp, D. melanogaster
gctgaatggaaaa

SEQ ID NO: 629226 - DNA, 14 bp, D. melanogaster
gctgaatgtctgcc

SEQ ID NO: 629227 - DNA, 13 bp, D. melanogaster
gctgaattccagg

SEQ ID NO: 629228 - DNA, 13 bp, D. melanogaster
gctgaattgagag

SEQ ID NO: 629229 - DNA, 13 bp, D. melanogaster
gctgaatttgaat

SEQ ID NO: 629230 - DNA, 13 bp, D. melanogaster
gctgaattttaca

SEQ ID NO: 629231 - DNA, 13 bp, D. melanogaster
gctgacaaaaagc

SEQ ID NO: 629232 - DNA, 13 bp, D. melanogaster
gctgacaaattgc

SEQ ID NO: 629233 - DNA, 13 bp, D. melanogaster
gctgacaattaaa

SEQ ID NO: 629234 - DNA, 13 bp, D. melanogaster
gctgacagaacca

SEQ ID NO: 629235 - DNA, 13 bp, D. melanogaster
gctgacatttatt

SEQ ID NO: 629236 - DNA, 13 bp, D. melanogaster
gctgacattttgt

SEQ ID NO: 629237 - DNA, 13 bp, D. melanogaster
gctgaccaagagc

SEQ ID NO: 629238 - DNA, 13 bp, D. melanogaster
gctgaccatttac

SEQ ID NO: 629239 - DNA, 13 bp, D. melanogaster
gctgaccgactgg

SEQ ID NO: 629240 - DNA, 13 bp, D. melanogaster
gctgacgatgatg

SEQ ID NO: 629241 - DNA, 13 bp, D. melanogaster
gctgacgctgggc

SEQ ID NO: 629242 - DNA, 13 bp, D. melanogaster
gctgacgcttatc

SEQ ID NO: 629243 - DNA, 13 bp, D. melanogaster
gctgacgtggaat

SEQ ID NO: 629244 - DNA, 14 bp, D. melanogaster
gctgactgactgac

SEQ ID NO: 629245 - DNA, 13 bp, D. melanogaster
gctgagaactgga

SEQ ID NO: 629246 - DNA, 13 bp, D. melanogaster
gctgagaagtgtg

SEQ ID NO: 629247 - DNA, 13 bp, D. melanogaster
gctgagagctgag

SEQ ID NO: 629248 - DNA, 14 bp, D. melanogaster
gctgagagctgaga

SEQ ID NO: 629249 - DNA, 13 bp, D. melanogaster
gctgagatccaaa

SEQ ID NO: 629250 - DNA, 13 bp, D. melanogaster
gctgagatgtaca

SEQ ID NO: 629251 - DNA, 13 bp, D. melanogaster
gctgagcaaacaa

SEQ ID NO: 629252 - DNA, 13 bp, D. melanogaster
gctgagctgagct

SEQ ID NO: 629253 - DNA, 14 bp, D. melanogaster
gctgagctgagctg

SEQ ID NO: 629254 - DNA, 13 bp, D. melanogaster
gctgagctggatt

SEQ ID NO: 629255 - DNA, 13 bp, D. melanogaster
gctgagctggcaa

SEQ ID NO: 629256 - DNA, 13 bp, D. melanogaster
gctgagctttcgc

SEQ ID NO: 629257 - DNA, 13 bp, D. melanogaster
gctgaggaaaagc

SEQ ID NO: 629258 - DNA, 13 bp, D. melanogaster
gctgaggaatatc

SEQ ID NO: 629259 - DNA, 13 bp, D. melanogaster
gctgaggacgtgc

SEQ ID NO: 629260 - DNA, 13 bp, D. melanogaster
gctgaggcggaat

SEQ ID NO: 629261 - DNA, 13 bp, D. melanogaster
gctgagtatatgg

SEQ ID NO: 629262 - DNA, 13 bp, D. melanogaster
gctgagtgagttg

SEQ ID NO: 629263 - DNA, 14 bp, D. melanogaster
gctgagttgagttg

SEQ ID NO: 629264 - DNA, 13 bp, D. melanogaster
gctgagtttatat

SEQ ID NO: 629265 - DNA, 13 bp, D. melanogaster
gctgataaaggtg

SEQ ID NO: 629266 - DNA, 13 bp, D. melanogaster
gctgataagataa

SEQ ID NO: 629267 - DNA, 13 bp, D. melanogaster
gctgataagcaaa

SEQ ID NO: 629268 - DNA, 13 bp, D. melanogaster
gctgataaggaaa

SEQ ID NO: 629269 - DNA, 13 bp, D. melanogaster
gctgatattgcaa

SEQ ID NO: 629270 - DNA, 13 bp, D. melanogaster
gctgatcatcacg

SEQ ID NO: 629271 - DNA, 13 bp, D. melanogaster
gctgatcctaaac

SEQ ID NO: 629272 - DNA, 13 bp, D. melanogaster
gctgatcgtcgtc

SEQ ID NO: 629273 - DNA, 13 bp, D. melanogaster
gctgatctatatc

SEQ ID NO: 629274 - DNA, 13 bp, D. melanogaster
gctgatgacgatg

SEQ ID NO: 629275 - DNA, 14 bp, D. melanogaster
gctgatgatgatgc

SEQ ID NO: 629276 - DNA, 13 bp, D. melanogaster
gctgatgatgatt

SEQ ID NO: 629277 - DNA, 13 bp, D. melanogaster
gctgatgccgctg

SEQ ID NO: 629278 - DNA, 13 bp, D. melanogaster
gctgatgctgatg

SEQ ID NO: 629279 - DNA, 14 bp, D. melanogaster
gctgatgctgctgc

SEQ ID NO: 629280 - DNA, 13 bp, D. melanogaster
gctgatgctgttg

SEQ ID NO: 629281 - DNA, 13 bp, D. melanogaster
gctgatggcggtt

SEQ ID NO: 629282 - DNA, 13 bp, D. melanogaster
gctgatggctgat

SEQ ID NO: 629283 - DNA, 13 bp, D. melanogaster
gctgatggtgatg

SEQ ID NO: 629284 - DNA, 13 bp, D. melanogaster
gctgatgtggctg

SEQ ID NO: 629285 - DNA, 13 bp, D. melanogaster
gctgatgttgctg

SEQ ID NO: 629286 - DNA, 13 bp, D. melanogaster
gctgattaaattt

SEQ ID NO: 629287 - DNA, 13 bp, D. melanogaster
gctgattattttg

SEQ ID NO: 629288 - DNA, 13 bp, D. melanogaster
gctgattgatttg

SEQ ID NO: 629289 - DNA, 13 bp, D. melanogaster
gctgattgcattt

SEQ ID NO: 629290 - DNA, 13 bp, D. melanogaster
gctgattgttgtt

SEQ ID NO: 629291 - DNA, 14 bp, D. melanogaster
gctgatttggcctg

SEQ ID NO: 629292 - DNA, 13 bp, D. melanogaster
gctgattttgttt

SEQ ID NO: 629293 - DNA, 13 bp, D. melanogaster
gctgatttttatt

SEQ ID NO: 629294 - DNA, 13 bp, D. melanogaster
gctgcaaaaaaaa

SEQ ID NO: 629295 - DNA, 14 bp, D. melanogaster
gctgcaaaaaaaaa

SEQ ID NO: 629296 - DNA, 13 bp, D. melanogaster
gctgcaaaaaaca

SEQ ID NO: 629297 - DNA, 13 bp, D. melanogaster
gctgcaaaaaagt

SEQ ID NO: 629298 - DNA, 13 bp, D. melanogaster
gctgcaaaaagaa

SEQ ID NO: 629299 - DNA, 13 bp, D. melanogaster
gctgcaaaaagga

SEQ ID NO: 629300 - DNA, 13 bp, D. melanogaster
gctgcaaaaataa

SEQ ID NO: 629301 - DNA, 13 bp, D. melanogaster
gctgcaaaacaaa

SEQ ID NO: 629302 - DNA, 13 bp, D. melanogaster
gctgcaaaagttt

SEQ ID NO: 629303 - DNA, 13 bp, D. melanogaster
gctgcaaaatatt

SEQ ID NO: 629304 - DNA, 13 bp, D. melanogaster
gctgcaaaatcag

SEQ ID NO: 629305 - DNA, 13 bp, D. melanogaster
gctgcaaacaaaa

SEQ ID NO: 629306 - DNA, 13 bp, D. melanogaster
gctgcaaacaaat

SEQ ID NO: 629307 - DNA, 13 bp, D. melanogaster
gctgcaaacaatt

SEQ ID NO: 629308 - DNA, 13 bp, D. melanogaster
gctgcaaacagct

SEQ ID NO: 629309 - DNA, 13 bp, D. melanogaster
gctgcaaactgaa

SEQ ID NO: 629310 - DNA, 13 bp, D. melanogaster
gctgcaaactgca

SEQ ID NO: 629311 - DNA, 13 bp, D. melanogaster
gctgcaaactttt

SEQ ID NO: 629312 - DNA, 13 bp, D. melanogaster
gctgcaaagtatg

SEQ ID NO: 629313 - DNA, 13 bp, D. melanogaster
gctgcaaagtgca

SEQ ID NO: 629314 - DNA, 13 bp, D. melanogaster
gctgcaaatattt

SEQ ID NO: 629315 - DNA, 13 bp, D. melanogaster
gctgcaaatcaaa

SEQ ID NO: 629316 - DNA, 13 bp, D. melanogaster
gctgcaaatgatg

SEQ ID NO: 629317 - DNA, 13 bp, D. melanogaster
gctgcaaatgcaa

SEQ ID NO: 629318 - DNA, 13 bp, D. melanogaster
gctgcaaatgcca

SEQ ID NO: 629319 - DNA, 13 bp, D. melanogaster
gctgcaaattatt

SEQ ID NO: 629320 - DNA, 13 bp, D. melanogaster
gctgcaaattgca

SEQ ID NO: 629321 - DNA, 13 bp, D. melanogaster
gctgcaaatttgt

SEQ ID NO: 629322 - DNA, 14 bp, D. melanogaster
gctgcaacaaaatt

SEQ ID NO: 629323 - DNA, 14 bp, D. melanogaster
gctgcaacaacaac

SEQ ID NO: 629324 - DNA, 13 bp, D. melanogaster
gctgcaacaactt

SEQ ID NO: 629325 - DNA, 13 bp, D. melanogaster
gctgcaacagcaa

SEQ ID NO: 629326 - DNA, 14 bp, D. melanogaster
gctgcaacagcaac

SEQ ID NO: 629327 - DNA, 13 bp, D. melanogaster
gctgcaaccgcaa

SEQ ID NO: 629328 - DNA, 13 bp, D. melanogaster
gctgcaaccggaa

SEQ ID NO: 629329 - DNA, 13 bp, D. melanogaster
gctgcaactgcaa

SEQ ID NO: 629330 - DNA, 14 bp, D. melanogaster
gctgcaactgcaac

SEQ ID NO: 629331 - DNA, 13 bp, D. melanogaster
gctgcaactgctg

SEQ ID NO: 629332 - DNA, 13 bp, D. melanogaster
gctgcaagacgac

SEQ ID NO: 629333 - DNA, 13 bp, D. melanogaster
gctgcaagccaaa

SEQ ID NO: 629334 - DNA, 13 bp, D. melanogaster
gctgcaagtgaaa

SEQ ID NO: 629335 - DNA, 13 bp, D. melanogaster
gctgcaataaatt

SEQ ID NO: 629336 - DNA, 13 bp, D. melanogaster
gctgcaatatttt

SEQ ID NO: 629337 - DNA, 13 bp, D. melanogaster
gctgcaatggcaa

SEQ ID NO: 629338 - DNA, 13 bp, D. melanogaster
gctgcaatggtta

SEQ ID NO: 629339 - DNA, 13 bp, D. melanogaster
gctgcaatgtctg

SEQ ID NO: 629340 - DNA, 13 bp, D. melanogaster
gctgcaattgaaa

SEQ ID NO: 629341 - DNA, 13 bp, D. melanogaster
gctgcaattgcag

SEQ ID NO: 629342 - DNA, 13 bp, D. melanogaster
gctgcaattgctg

SEQ ID NO: 629343 - DNA, 13 bp, D. melanogaster
gctgcaattgttg

SEQ ID NO: 629344 - DNA, 14 bp, D. melanogaster
gctgcaattgttgc

SEQ ID NO: 629345 - DNA, 13 bp, D. melanogaster
gctgcaatttaaa

SEQ ID NO: 629346 - DNA, 13 bp, D. melanogaster
gctgcaatttatg

SEQ ID NO: 629347 - DNA, 13 bp, D. melanogaster
gctgcaatttatt

SEQ ID NO: 629348 - DNA, 13 bp, D. melanogaster
gctgcaatttgtt

SEQ ID NO: 629349 - DNA, 13 bp, D. melanogaster
gctgcaattttcg

SEQ ID NO: 629350 - DNA, 13 bp, D. melanogaster
gctgcacaaattt

SEQ ID NO: 629351 - DNA, 13 bp, D. melanogaster
gctgcacaatttt

SEQ ID NO: 629352 - DNA, 14 bp, D. melanogaster
gctgcacacacaca

SEQ ID NO: 629353 - DNA, 13 bp, D. melanogaster
gctgcacacagct

SEQ ID NO: 629354 - DNA, 13 bp, D. melanogaster
gctgcacagtggg

SEQ ID NO: 629355 - DNA, 13 bp, D. melanogaster
gctgcaccgacga

SEQ ID NO: 629356 - DNA, 14 bp, D. melanogaster
gctgcaccgacgaa

SEQ ID NO: 629357 - DNA, 13 bp, D. melanogaster
gctgcactgaaaa

SEQ ID NO: 629358 - DNA, 13 bp, D. melanogaster
gctgcactgcaaa

SEQ ID NO: 629359 - DNA, 14 bp, D. melanogaster
gctgcactgcatcc

SEQ ID NO: 629360 - DNA, 13 bp, D. melanogaster
gctgcactgccag

SEQ ID NO: 629361 - DNA, 13 bp, D. melanogaster
gctgcactgcgag

SEQ ID NO: 629362 - DNA, 13 bp, D. melanogaster
gctgcactgggaa

SEQ ID NO: 629363 - DNA, 13 bp, D. melanogaster
gctgcacttgccc

SEQ ID NO: 629364 - DNA, 13 bp, D. melanogaster
gctgcacttgctc

SEQ ID NO: 629365 - DNA, 13 bp, D. melanogaster
gctgcacttgtcg

SEQ ID NO: 629366 - DNA, 13 bp, D. melanogaster
gctgcacttgttt

SEQ ID NO: 629367 - DNA, 13 bp, D. melanogaster
gctgcactttaaa

SEQ ID NO: 629368 - DNA, 13 bp, D. melanogaster
gctgcactttgca

SEQ ID NO: 629369 - DNA, 13 bp, D. melanogaster
gctgcactttggc

SEQ ID NO: 629370 - DNA, 13 bp, D. melanogaster
gctgcagaaaaac

SEQ ID NO: 629371 - DNA, 13 bp, D. melanogaster
gctgcagaaaaat

SEQ ID NO: 629372 - DNA, 13 bp, D. melanogaster
gctgcagagaact

SEQ ID NO: 629373 - DNA, 13 bp, D. melanogaster
gctgcagatgcag

SEQ ID NO: 629374 - DNA, 14 bp, D. melanogaster
gctgcagatgcaga

SEQ ID NO: 629375 - DNA, 13 bp, D. melanogaster
gctgcagatgctg

SEQ ID NO: 629376 - DNA, 13 bp, D. melanogaster
gctgcagcaacaa

SEQ ID NO: 629377 - DNA, 14 bp, D. melanogaster
gctgcagcaacaac

SEQ ID NO: 629378 - DNA, 14 bp, D. melanogaster
gctgcagcagcaac

SEQ ID NO: 629379 - DNA, 14 bp, D. melanogaster
gctgcagcagctgc

SEQ ID NO: 629380 - DNA, 13 bp, D. melanogaster
gctgcagcagttg

SEQ ID NO: 629381 - DNA, 13 bp, D. melanogaster
gctgcagcatttt

SEQ ID NO: 629382 - DNA, 14 bp, D. melanogaster
gctgcagctgcaac

SEQ ID NO: 629383 - DNA, 13 bp, D. melanogaster
gctgcagctgctg

SEQ ID NO: 629384 - DNA, 13 bp, D. melanogaster
gctgcagctgtgt

SEQ ID NO: 629385 - DNA, 13 bp, D. melanogaster
gctgcagcttttg

SEQ ID NO: 629386 - DNA, 14 bp, D. melanogaster
gctgcaggagctgc

SEQ ID NO: 629387 - DNA, 13 bp, D. melanogaster
gctgcaggatgca

SEQ ID NO: 629388 - DNA, 13 bp, D. melanogaster
gctgcagtccgtg

SEQ ID NO: 629389 - DNA, 14 bp, D. melanogaster
gctgcagtccgtgc

SEQ ID NO: 629390 - DNA, 13 bp, D. melanogaster
gctgcagtgcagc

SEQ ID NO: 629391 - DNA, 13 bp, D. melanogaster
gctgcagtgcatc

SEQ ID NO: 629392 - DNA, 13 bp, D. melanogaster
gctgcagtggcag

SEQ ID NO: 629393 - DNA, 13 bp, D. melanogaster
gctgcagtggctc

SEQ ID NO: 629394 - DNA, 13 bp, D. melanogaster
gctgcagtggctg

SEQ ID NO: 629395 - DNA, 14 bp, D. melanogaster
gctgcagtggctgc

SEQ ID NO: 629396 - DNA, 14 bp, D. melanogaster
gctgcagttctctg

SEQ ID NO: 629397 - DNA, 13 bp, D. melanogaster
gctgcagttgcac

SEQ ID NO: 629398 - DNA, 13 bp, D. melanogaster
gctgcagttgcag

SEQ ID NO: 629399 - DNA, 14 bp, D. melanogaster
gctgcagttgcagt

SEQ ID NO: 629400 - DNA, 13 bp, D. melanogaster
gctgcagttgcat

SEQ ID NO: 629401 - DNA, 13 bp, D. melanogaster
gctgcagttgctc

SEQ ID NO: 629402 - DNA, 13 bp, D. melanogaster
gctgcagttggcc

SEQ ID NO: 629403 - DNA, 13 bp, D. melanogaster
gctgcagttgttg

SEQ ID NO: 629404 - DNA, 14 bp, D. melanogaster
gctgcagttgttgc

SEQ ID NO: 629405 - DNA, 14 bp, D. melanogaster
gctgcagttgttgt

SEQ ID NO: 629406 - DNA, 14 bp, D. melanogaster
gctgcataaatatt

SEQ ID NO: 629407 - DNA, 13 bp, D. melanogaster
gctgcataaatta

SEQ ID NO: 629408 - DNA, 13 bp, D. melanogaster
gctgcatatattt

SEQ ID NO: 629409 - DNA, 13 bp, D. melanogaster
gctgcatatttat

SEQ ID NO: 629410 - DNA, 13 bp, D. melanogaster
gctgcatccatag

SEQ ID NO: 629411 - DNA, 13 bp, D. melanogaster
gctgcatcggcaa

SEQ ID NO: 629412 - DNA, 13 bp, D. melanogaster
gctgcatgcaaca

SEQ ID NO: 629413 - DNA, 13 bp, D. melanogaster
gctgcatgctgca

SEQ ID NO: 629414 - DNA, 14 bp, D. melanogaster
gctgcattgttttg

SEQ ID NO: 629415 - DNA, 13 bp, D. melanogaster
gctgcatttcatt

SEQ ID NO: 629416 - DNA, 13 bp, D. melanogaster
gctgcatttcttt

SEQ ID NO: 629417 - DNA, 14 bp, D. melanogaster
gctgcatttgcatt

SEQ ID NO: 629418 - DNA, 13 bp, D. melanogaster
gctgcattttcat

SEQ ID NO: 629419 - DNA, 13 bp, D. melanogaster
gctgcattttcca

SEQ ID NO: 629420 - DNA, 13 bp, D. melanogaster
gctgcattttcct

SEQ ID NO: 629421 - DNA, 13 bp, D. melanogaster
gctgcatttttaa

SEQ ID NO: 629422 - DNA, 13 bp, D. melanogaster
gctgcatttttgc

SEQ ID NO: 629423 - DNA, 13 bp, D. melanogaster
gctgccaaaaaaa

SEQ ID NO: 629424 - DNA, 13 bp, D. melanogaster
gctgccaaaaagt

SEQ ID NO: 629425 - DNA, 13 bp, D. melanogaster
gctgccaaaagtg

SEQ ID NO: 629426 - DNA, 13 bp, D. melanogaster
gctgccaaaatgt

SEQ ID NO: 629427 - DNA, 15 bp, D. melanogaster
gctgccaaagataaa

SEQ ID NO: 629428 - DNA, 13 bp, D. melanogaster
gctgccaaagtgc

SEQ ID NO: 629429 - DNA, 13 bp, D. melanogaster
gctgccaaatcaa

SEQ ID NO: 629430 - DNA, 13 bp, D. melanogaster
gctgccaaattgt

SEQ ID NO: 629431 - DNA, 13 bp, D. melanogaster
gctgccaacgact

SEQ ID NO: 629432 - DNA, 13 bp, D. melanogaster
gctgccaactttt

SEQ ID NO: 629433 - DNA, 13 bp, D. melanogaster
gctgccaagtgga

SEQ ID NO: 629434 - DNA, 13 bp, D. melanogaster
gctgccaatgcca

SEQ ID NO: 629435 - DNA, 13 bp, D. melanogaster
gctgccaatttgc

SEQ ID NO: 629436 - DNA, 13 bp, D. melanogaster
gctgccaatttgg

SEQ ID NO: 629437 - DNA, 13 bp, D. melanogaster
gctgccacaaaaa

SEQ ID NO: 629438 - DNA, 13 bp, D. melanogaster
gctgccacaaatt

SEQ ID NO: 629439 - DNA, 13 bp, D. melanogaster
gctgccacacacc

SEQ ID NO: 629440 - DNA, 13 bp, D. melanogaster
gctgccacattct

SEQ ID NO: 629441 - DNA, 13 bp, D. melanogaster
gctgccacgcccc

SEQ ID NO: 629442 - DNA, 14 bp, D. melanogaster
gctgccacgccccc

SEQ ID NO: 629443 - DNA, 13 bp, D. melanogaster
gctgccactgaca

SEQ ID NO: 629444 - DNA, 14 bp, D. melanogaster
gctgccactgccac

SEQ ID NO: 629445 - DNA, 13 bp, D. melanogaster
gctgccacttctg

SEQ ID NO: 629446 - DNA, 13 bp, D. melanogaster
gctgccacttgaa

SEQ ID NO: 629447 - DNA, 13 bp, D. melanogaster
gctgccactttgc

SEQ ID NO: 629448 - DNA, 13 bp, D. melanogaster
gctgccacttttc

SEQ ID NO: 629449 - DNA, 13 bp, D. melanogaster
gctgccacttttg

SEQ ID NO: 629450 - DNA, 13 bp, D. melanogaster
gctgccagacctg

SEQ ID NO: 629451 - DNA, 13 bp, D. melanogaster
gctgccagccaaa

SEQ ID NO: 629452 - DNA, 13 bp, D. melanogaster
gctgccagccagc

SEQ ID NO: 629453 - DNA, 13 bp, D. melanogaster
gctgccagctgcc

SEQ ID NO: 629454 - DNA, 13 bp, D. melanogaster
gctgccagctgtt

SEQ ID NO: 629455 - DNA, 13 bp, D. melanogaster
gctgccagttggc

SEQ ID NO: 629456 - DNA, 13 bp, D. melanogaster
gctgccagttttt

SEQ ID NO: 629457 - DNA, 13 bp, D. melanogaster
gctgccatcaaat

SEQ ID NO: 629458 - DNA, 13 bp, D. melanogaster
gctgccatggaaa

SEQ ID NO: 629459 - DNA, 14 bp, D. melanogaster
gctgccatggaaag

SEQ ID NO: 629460 - DNA, 13 bp, D. melanogaster
gctgccatggcaa

SEQ ID NO: 629461 - DNA, 13 bp, D. melanogaster
gctgccattgcca

SEQ ID NO: 629462 - DNA, 13 bp, D. melanogaster
gctgccattgctg

SEQ ID NO: 629463 - DNA, 13 bp, D. melanogaster
gctgccatttgca

SEQ ID NO: 629464 - DNA, 13 bp, D. melanogaster
gctgccatttgcc

SEQ ID NO: 629465 - DNA, 13 bp, D. melanogaster
gctgccattttcc

SEQ ID NO: 629466 - DNA, 13 bp, D. melanogaster
gctgccccattcc

SEQ ID NO: 629467 - DNA, 13 bp, D. melanogaster
gctgcccgagatg

SEQ ID NO: 629468 - DNA, 13 bp, D. melanogaster
gctgccgaatcag

SEQ ID NO: 629469 - DNA, 13 bp, D. melanogaster
gctgccgcaatgg

SEQ ID NO: 629470 - DNA, 14 bp, D. melanogaster
gctgccgcaatgga

SEQ ID NO: 629471 - DNA, 13 bp, D. melanogaster
gctgccgcagttg

SEQ ID NO: 629472 - DNA, 13 bp, D. melanogaster
gctgccgccgcct

SEQ ID NO: 629473 - DNA, 13 bp, D. melanogaster
gctgccgccgctg

SEQ ID NO: 629474 - DNA, 13 bp, D. melanogaster
gctgccgccgttg

SEQ ID NO: 629475 - DNA, 13 bp, D. melanogaster
gctgccgctgaca

SEQ ID NO: 629476 - DNA, 13 bp, D. melanogaster
gctgccgctgatg

SEQ ID NO: 629477 - DNA, 13 bp, D. melanogaster
gctgccgctgccg

SEQ ID NO: 629478 - DNA, 13 bp, D. melanogaster
gctgccgctgcct

SEQ ID NO: 629479 - DNA, 13 bp, D. melanogaster
gctgccgctgctg

SEQ ID NO: 629480 - DNA, 13 bp, D. melanogaster
gctgccgctgttg

SEQ ID NO: 629481 - DNA, 13 bp, D. melanogaster
gctgccgctgttt

SEQ ID NO: 629482 - DNA, 13 bp, D. melanogaster
gctgccgcttctg

SEQ ID NO: 629483 - DNA, 13 bp, D. melanogaster
gctgccgcttttg

SEQ ID NO: 629484 - DNA, 13 bp, D. melanogaster
gctgccgcttttt

SEQ ID NO: 629485 - DNA, 13 bp, D. melanogaster
gctgccggtcttc

SEQ ID NO: 629486 - DNA, 13 bp, D. melanogaster
gctgccgtgtatc

SEQ ID NO: 629487 - DNA, 14 bp, D. melanogaster
gctgcctctgccgc

SEQ ID NO: 629488 - DNA, 13 bp, D. melanogaster
gctgcctctgttg

SEQ ID NO: 629489 - DNA, 13 bp, D. melanogaster
gctgcctgccatt

SEQ ID NO: 629490 - DNA, 13 bp, D. melanogaster
gctgcctgcgtgc

SEQ ID NO: 629491 - DNA, 13 bp, D. melanogaster
gctgcctgctgcc

SEQ ID NO: 629492 - DNA, 14 bp, D. melanogaster
gctgcctgctgcct

SEQ ID NO: 629493 - DNA, 13 bp, D. melanogaster
gctgcctgctgct

SEQ ID NO: 629494 - DNA, 14 bp, D. melanogaster
gctgcctggctggc

SEQ ID NO: 629495 - DNA, 13 bp, D. melanogaster
gctgcctgtttct

SEQ ID NO: 629496 - DNA, 13 bp, D. melanogaster
gctgcctgttttt

SEQ ID NO: 629497 - DNA, 13 bp, D. melanogaster
gctgccttcaact

SEQ ID NO: 629498 - DNA, 13 bp, D. melanogaster
gctgccttccctt

SEQ ID NO: 629499 - DNA, 13 bp, D. melanogaster
gctgccttcttag

SEQ ID NO: 629500 - DNA, 14 bp, D. melanogaster
gctgcctttccagc

SEQ ID NO: 629501 - DNA, 13 bp, D. melanogaster
gctgcctttggcc

SEQ ID NO: 629502 - DNA, 13 bp, D. melanogaster
gctgcctttgtgt

SEQ ID NO: 629503 - DNA, 13 bp, D. melanogaster
gctgccttttgct

SEQ ID NO: 629504 - DNA, 13 bp, D. melanogaster
gctgcgacgctgc

SEQ ID NO: 629505 - DNA, 14 bp, D. melanogaster
gctgcgactgcgac

SEQ ID NO: 629506 - DNA, 13 bp, D. melanogaster
gctgcgactgcgc

SEQ ID NO: 629507 - DNA, 15 bp, D. melanogaster
gctgcgagaggagcg

SEQ ID NO: 629508 - DNA, 13 bp, D. melanogaster
gctgcgaggatac

SEQ ID NO: 629509 - DNA, 14 bp, D. melanogaster
gctgcgcagcagga

SEQ ID NO: 629510 - DNA, 13 bp, D. melanogaster
gctgcgcatgcgc

SEQ ID NO: 629511 - DNA, 14 bp, D. melanogaster
gctgcgcatgcgca

SEQ ID NO: 629512 - DNA, 13 bp, D. melanogaster
gctgcgcctgcgc

SEQ ID NO: 629513 - DNA, 13 bp, D. melanogaster
gctgcgctgcaat

SEQ ID NO: 629514 - DNA, 15 bp, D. melanogaster
gctgcgctgccaaag

SEQ ID NO: 629515 - DNA, 13 bp, D. melanogaster
gctgcgctgctgc

SEQ ID NO: 629516 - DNA, 14 bp, D. melanogaster
gctgcggaaacaaa

SEQ ID NO: 629517 - DNA, 13 bp, D. melanogaster
gctgcggaacttt

SEQ ID NO: 629518 - DNA, 13 bp, D. melanogaster
gctgcggacaagt

SEQ ID NO: 629519 - DNA, 13 bp, D. melanogaster
gctgcggcagcaa

SEQ ID NO: 629520 - DNA, 13 bp, D. melanogaster
gctgcggctgatg

SEQ ID NO: 629521 - DNA, 14 bp, D. melanogaster
gctgcggctgctgc

SEQ ID NO: 629522 - DNA, 14 bp, D. melanogaster
gctgcggctgctgt

SEQ ID NO: 629523 - DNA, 13 bp, D. melanogaster
gctgcggcttctg

SEQ ID NO: 629524 - DNA, 13 bp, D. melanogaster
gctgcggttgctg

SEQ ID NO: 629525 - DNA, 13 bp, D. melanogaster
gctgcgtatgcgt

SEQ ID NO: 629526 - DNA, 13 bp, D. melanogaster
gctgcgtctgtgt

SEQ ID NO: 629527 - DNA, 13 bp, D. melanogaster
gctgcgtctttgt

SEQ ID NO: 629528 - DNA, 13 bp, D. melanogaster
gctgcgtgtgttt

SEQ ID NO: 629529 - DNA, 13 bp, D. melanogaster
gctgcgttatccg

SEQ ID NO: 629530 - DNA, 13 bp, D. melanogaster
gctgcgttcggct

SEQ ID NO: 629531 - DNA, 13 bp, D. melanogaster
gctgcgtttgcca

SEQ ID NO: 629532 - DNA, 13 bp, D. melanogaster
gctgcgttttatc

SEQ ID NO: 629533 - DNA, 13 bp, D. melanogaster
gctgctaatattg

SEQ ID NO: 629534 - DNA, 13 bp, D. melanogaster
gctgctactgctg

SEQ ID NO: 629535 - DNA, 14 bp, D. melanogaster
gctgctactgctgc

SEQ ID NO: 629536 - DNA, 13 bp, D. melanogaster
gctgctagctgct

SEQ ID NO: 629537 - DNA, 13 bp, D. melanogaster
gctgctcaaaatg

SEQ ID NO: 629538 - DNA, 13 bp, D. melanogaster
gctgctcagcttg

SEQ ID NO: 629539 - DNA, 13 bp, D. melanogaster
gctgctcataaat

SEQ ID NO: 629540 - DNA, 14 bp, D. melanogaster
gctgctcataaatt

SEQ ID NO: 629541 - DNA, 13 bp, D. melanogaster
gctgctcatttgc

SEQ ID NO: 629542 - DNA, 13 bp, D. melanogaster
gctgctcatttgg

SEQ ID NO: 629543 - DNA, 13 bp, D. melanogaster
gctgctcattttg

SEQ ID NO: 629544 - DNA, 13 bp, D. melanogaster
gctgctccacttt

SEQ ID NO: 629545 - DNA, 13 bp, D. melanogaster
gctgctccagctc

SEQ ID NO: 629546 - DNA, 13 bp, D. melanogaster
gctgctcccgctg

SEQ ID NO: 629547 - DNA, 13 bp, D. melanogaster
gctgctcctccat

SEQ ID NO: 629548 - DNA, 13 bp, D. melanogaster
gctgctcctccgc

SEQ ID NO: 629549 - DNA, 13 bp, D. melanogaster
gctgctcctgcag

SEQ ID NO: 629550 - DNA, 13 bp, D. melanogaster
gctgctcctgcgg

SEQ ID NO: 629551 - DNA, 14 bp, D. melanogaster
gctgctcctgctgc

SEQ ID NO: 629552 - DNA, 13 bp, D. melanogaster
gctgctcctggct

SEQ ID NO: 629553 - DNA, 14 bp, D. melanogaster
gctgctccttctgc

SEQ ID NO: 629554 - DNA, 13 bp, D. melanogaster
gctgctccttttt

SEQ ID NO: 629555 - DNA, 13 bp, D. melanogaster
gctgctcggctgc

SEQ ID NO: 629556 - DNA, 13 bp, D. melanogaster
gctgctctgctct

SEQ ID NO: 629557 - DNA, 13 bp, D. melanogaster
gctgctcttctgc

SEQ ID NO: 629558 - DNA, 13 bp, D. melanogaster
gctgctcttgttg

SEQ ID NO: 629559 - DNA, 13 bp, D. melanogaster
gctgctgaattat

SEQ ID NO: 629560 - DNA, 13 bp, D. melanogaster
gctgctgagaact

SEQ ID NO: 629561 - DNA, 13 bp, D. melanogaster
gctgctgatgatg

SEQ ID NO: 629562 - DNA, 13 bp, D. melanogaster
gctgctgatgccg

SEQ ID NO: 629563 - DNA, 13 bp, D. melanogaster
gctgctgatgctg

SEQ ID NO: 629564 - DNA, 13 bp, D. melanogaster
gctgctgattgtc

SEQ ID NO: 629565 - DNA, 14 bp, D. melanogaster
gctgctgattgtca

SEQ ID NO: 629566 - DNA, 13 bp, D. melanogaster
gctgctgatttgg

SEQ ID NO: 629567 - DNA, 13 bp, D. melanogaster
gctgctgattttc

SEQ ID NO: 629568 - DNA, 13 bp, D. melanogaster
gctgctgcaacaa

SEQ ID NO: 629569 - DNA, 13 bp, D. melanogaster
gctgctgcaacat

SEQ ID NO: 629570 - DNA, 13 bp, D. melanogaster
gctgctgcaactg

SEQ ID NO: 629571 - DNA, 13 bp, D. melanogaster
gctgctgcaactt

SEQ ID NO: 629572 - DNA, 13 bp, D. melanogaster
gctgctgcaagtg

SEQ ID NO: 629573 - DNA, 13 bp, D. melanogaster
gctgctgcacaaa

SEQ ID NO: 629574 - DNA, 13 bp, D. melanogaster
gctgctgcagcaa

SEQ ID NO: 629575 - DNA, 13 bp, D. melanogaster
gctgctgcagcat

SEQ ID NO: 629576 - DNA, 13 bp, D. melanogaster
gctgctgcagcgc

SEQ ID NO: 629577 - DNA, 14 bp, D. melanogaster
gctgctgcagctgc

SEQ ID NO: 629578 - DNA, 13 bp, D. melanogaster
gctgctgcagctt

SEQ ID NO: 629579 - DNA, 13 bp, D. melanogaster
gctgctgcagtcg

SEQ ID NO: 629580 - DNA, 13 bp, D. melanogaster
gctgctgcagtgg

SEQ ID NO: 629581 - DNA, 14 bp, D. melanogaster
gctgctgcagtgga

SEQ ID NO: 629582 - DNA, 14 bp, D. melanogaster
gctgctgcagtggc

SEQ ID NO: 629583 - DNA, 13 bp, D. melanogaster
gctgctgcatctg

SEQ ID NO: 629584 - DNA, 13 bp, D. melanogaster
gctgctgcatctt

SEQ ID NO: 629585 - DNA, 13 bp, D. melanogaster
gctgctgccaaaa

SEQ ID NO: 629586 - DNA, 13 bp, D. melanogaster
gctgctgccaatt

SEQ ID NO: 629587 - DNA, 13 bp, D. melanogaster
gctgctgccacag

SEQ ID NO: 629588 - DNA, 15 bp, D. melanogaster
gctgctgccacgccc

SEQ ID NO: 629589 - DNA, 13 bp, D. melanogaster
gctgctgccgatg

SEQ ID NO: 629590 - DNA, 13 bp, D. melanogaster
gctgctgccgctg

SEQ ID NO: 629591 - DNA, 14 bp, D. melanogaster
gctgctgccgctga

SEQ ID NO: 629592 - DNA, 14 bp, D. melanogaster
gctgctgccgctgt

SEQ ID NO: 629593 - DNA, 13 bp, D. melanogaster
gctgctgccgctt

SEQ ID NO: 629594 - DNA, 13 bp, D. melanogaster
gctgctgcctgct

SEQ ID NO: 629595 - DNA, 13 bp, D. melanogaster
gctgctgcctttc

SEQ ID NO: 629596 - DNA, 13 bp, D. melanogaster
gctgctgcctttg

SEQ ID NO: 629597 - DNA, 13 bp, D. melanogaster
gctgctgcgactg

SEQ ID NO: 629598 - DNA, 14 bp, D. melanogaster
gctgctgcgactgc

SEQ ID NO: 629599 - DNA, 13 bp, D. melanogaster
gctgctgcgattt

SEQ ID NO: 629600 - DNA, 13 bp, D. melanogaster
gctgctgcggcag

SEQ ID NO: 629601 - DNA, 13 bp, D. melanogaster
gctgctgcggcgg

SEQ ID NO: 629602 - DNA, 13 bp, D. melanogaster
gctgctgcggctg

SEQ ID NO: 629603 - DNA, 13 bp, D. melanogaster
gctgctgcggttg

SEQ ID NO: 629604 - DNA, 13 bp, D. melanogaster
gctgctgctactt

SEQ ID NO: 629605 - DNA, 13 bp, D. melanogaster
gctgctgctcatt

SEQ ID NO: 629606 - DNA, 13 bp, D. melanogaster
gctgctgctccag

SEQ ID NO: 629607 - DNA, 13 bp, D. melanogaster
gctgctgctcctc

SEQ ID NO: 629608 - DNA, 13 bp, D. melanogaster
gctgctgctctgc

SEQ ID NO: 629609 - DNA, 13 bp, D. melanogaster
gctgctgctcttc

SEQ ID NO: 629610 - DNA, 13 bp, D. melanogaster
gctgctgctcttg

SEQ ID NO: 629611 - DNA, 14 bp, D. melanogaster
gctgctgctgatgc

SEQ ID NO: 629612 - DNA, 14 bp, D. melanogaster
gctgctgctgatgg

SEQ ID NO: 629613 - DNA, 13 bp, D. melanogaster
gctgctgctgcaa

SEQ ID NO: 629614 - DNA, 14 bp, D. melanogaster
gctgctgctgcaac

SEQ ID NO: 629615 - DNA, 14 bp, D. melanogaster
gctgctgctgcaat

SEQ ID NO: 629616 - DNA, 13 bp, D. melanogaster
gctgctgctgcag

SEQ ID NO: 629617 - DNA, 14 bp, D. melanogaster
gctgctgctgcagt

SEQ ID NO: 629618 - DNA, 14 bp, D. melanogaster
gctgctgctgcatg

SEQ ID NO: 629619 - DNA, 13 bp, D. melanogaster
gctgctgctgcca

SEQ ID NO: 629620 - DNA, 14 bp, D. melanogaster
gctgctgctgccaa

SEQ ID NO: 629621 - DNA, 14 bp, D. melanogaster
gctgctgctgccac

SEQ ID NO: 629622 - DNA, 14 bp, D. melanogaster
gctgctgctgccga

SEQ ID NO: 629623 - DNA, 13 bp, D. melanogaster
gctgctgctgcct

SEQ ID NO: 629624 - DNA, 14 bp, D. melanogaster
gctgctgctgcctg

SEQ ID NO: 629625 - DNA, 13 bp, D. melanogaster
gctgctgctgcga

SEQ ID NO: 629626 - DNA, 14 bp, D. melanogaster
gctgctgctgcgac

SEQ ID NO: 629627 - DNA, 14 bp, D. melanogaster
gctgctgctgcgat

SEQ ID NO: 629628 - DNA, 14 bp, D. melanogaster
gctgctgctgcgct

SEQ ID NO: 629629 - DNA, 13 bp, D. melanogaster
gctgctgctgcgg

SEQ ID NO: 629630 - DNA, 13 bp, D. melanogaster
gctgctgctgcgt

SEQ ID NO: 629631 - DNA, 14 bp, D. melanogaster
gctgctgctgcgtg

SEQ ID NO: 629632 - DNA, 14 bp, D. melanogaster
gctgctgctgcgtt

SEQ ID NO: 629633 - DNA, 14 bp, D. melanogaster
gctgctgctgctaa

SEQ ID NO: 629634 - DNA, 14 bp, D. melanogaster
gctgctgctgctat

SEQ ID NO: 629635 - DNA, 14 bp, D. melanogaster
gctgctgctgctcg

SEQ ID NO: 629636 - DNA, 14 bp, D. melanogaster
gctgctgctgctct

SEQ ID NO: 629637 - DNA, 16 bp, D. melanogaster
gctgctgctgctgcca

SEQ ID NO: 629638 - DNA, 16 bp, D. melanogaster
gctgctgctgctgttc

SEQ ID NO: 629639 - DNA, 13 bp, D. melanogaster
gctgctgctgctt

SEQ ID NO: 629640 - DNA, 14 bp, D. melanogaster
gctgctgctgcttc

SEQ ID NO: 629641 - DNA, 14 bp, D. melanogaster
gctgctgctgcttt

SEQ ID NO: 629642 - DNA, 13 bp, D. melanogaster
gctgctgctggct

SEQ ID NO: 629643 - DNA, 14 bp, D. melanogaster
gctgctgctggctg

SEQ ID NO: 629644 - DNA, 13 bp, D. melanogaster
gctgctgctgggt

SEQ ID NO: 629645 - DNA, 14 bp, D. melanogaster
gctgctgctggtgg

SEQ ID NO: 629646 - DNA, 13 bp, D. melanogaster
gctgctgctgtca

SEQ ID NO: 629647 - DNA, 13 bp, D. melanogaster
gctgctgctgtcg

SEQ ID NO: 629648 - DNA, 14 bp, D. melanogaster
gctgctgctgtggc

SEQ ID NO: 629649 - DNA, 13 bp, D. melanogaster
gctgctgctgtgt

SEQ ID NO: 629650 - DNA, 13 bp, D. melanogaster
gctgctgctgtta

SEQ ID NO: 629651 - DNA, 14 bp, D. melanogaster
gctgctgctgttga

SEQ ID NO: 629652 - DNA, 14 bp, D. melanogaster
gctgctgctgttgt

SEQ ID NO: 629653 - DNA, 13 bp, D. melanogaster
gctgctgctgttt

SEQ ID NO: 629654 - DNA, 14 bp, D. melanogaster
gctgctgcttcttc

SEQ ID NO: 629655 - DNA, 13 bp, D. melanogaster
gctgctgcttgct

SEQ ID NO: 629656 - DNA, 13 bp, D. melanogaster
gctgctgcttgtg

SEQ ID NO: 629657 - DNA, 13 bp, D. melanogaster
gctgctgctttcc

SEQ ID NO: 629658 - DNA, 13 bp, D. melanogaster
gctgctgctttgc

SEQ ID NO: 629659 - DNA, 13 bp, D. melanogaster
gctgctgcttttt

SEQ ID NO: 629660 - DNA, 13 bp, D. melanogaster
gctgctggaaaaa

SEQ ID NO: 629661 - DNA, 13 bp, D. melanogaster
gctgctggaaaat

SEQ ID NO: 629662 - DNA, 13 bp, D. melanogaster
gctgctggagctg

SEQ ID NO: 629663 - DNA, 13 bp, D. melanogaster
gctgctggcaaaa

SEQ ID NO: 629664 - DNA, 13 bp, D. melanogaster
gctgctggcaatt

SEQ ID NO: 629665 - DNA, 13 bp, D. melanogaster
gctgctggcattg

SEQ ID NO: 629666 - DNA, 14 bp, D. melanogaster
gctgctggccaaaa

SEQ ID NO: 629667 - DNA, 13 bp, D. melanogaster
gctgctggctgct

SEQ ID NO: 629668 - DNA, 14 bp, D. melanogaster
gctgctggctgctg

SEQ ID NO: 629669 - DNA, 13 bp, D. melanogaster
gctgctggctggc

SEQ ID NO: 629670 - DNA, 13 bp, D. melanogaster
gctgctggctgtt

SEQ ID NO: 629671 - DNA, 13 bp, D. melanogaster
gctgctgggaaat

SEQ ID NO: 629672 - DNA, 13 bp, D. melanogaster
gctgctggtgctg

SEQ ID NO: 629673 - DNA, 14 bp, D. melanogaster
gctgctggtgctgc

SEQ ID NO: 629674 - DNA, 13 bp, D. melanogaster
gctgctggtggtg

SEQ ID NO: 629675 - DNA, 14 bp, D. melanogaster
gctgctggtggtgc

SEQ ID NO: 629676 - DNA, 13 bp, D. melanogaster
gctgctggttttg

SEQ ID NO: 629677 - DNA, 13 bp, D. melanogaster
gctgctgtagctg

SEQ ID NO: 629678 - DNA, 13 bp, D. melanogaster
gctgctgtcattg

SEQ ID NO: 629679 - DNA, 13 bp, D. melanogaster
gctgctgtcgctg

SEQ ID NO: 629680 - DNA, 13 bp, D. melanogaster
gctgctgtcgtcg

SEQ ID NO: 629681 - DNA, 13 bp, D. melanogaster
gctgctgtcgttg

SEQ ID NO: 629682 - DNA, 13 bp, D. melanogaster
gctgctgtctatt

SEQ ID NO: 629683 - DNA, 13 bp, D. melanogaster
gctgctgtgcaaa

SEQ ID NO: 629684 - DNA, 13 bp, D. melanogaster
gctgctgtgctgc

SEQ ID NO: 629685 - DNA, 14 bp, D. melanogaster
gctgctgtggctgc

SEQ ID NO: 629686 - DNA, 13 bp, D. melanogaster
gctgctgttattt

SEQ ID NO: 629687 - DNA, 13 bp, D. melanogaster
gctgctgttgaaa

SEQ ID NO: 629688 - DNA, 13 bp, D. melanogaster
gctgctgttgcaa

SEQ ID NO: 629689 - DNA, 13 bp, D. melanogaster
gctgctgttgcac

SEQ ID NO: 629690 - DNA, 13 bp, D. melanogaster
gctgctgttgcag

SEQ ID NO: 629691 - DNA, 14 bp, D. melanogaster
gctgctgttgcagc

SEQ ID NO: 629692 - DNA, 13 bp, D. melanogaster
gctgctgttgcca

SEQ ID NO: 629693 - DNA, 13 bp, D. melanogaster
gctgctgttgcct

SEQ ID NO: 629694 - DNA, 13 bp, D. melanogaster
gctgctgttgcgg

SEQ ID NO: 629695 - DNA, 13 bp, D. melanogaster
gctgctgttgcta

SEQ ID NO: 629696 - DNA, 13 bp, D. melanogaster
gctgctgttgctc

SEQ ID NO: 629697 - DNA, 14 bp, D. melanogaster
gctgctgttgctgt

SEQ ID NO: 629698 - DNA, 13 bp, D. melanogaster
gctgctgttgctt

SEQ ID NO: 629699 - DNA, 13 bp, D. melanogaster
gctgctgttggtg

SEQ ID NO: 629700 - DNA, 13 bp, D. melanogaster
gctgctgttgtcg

SEQ ID NO: 629701 - DNA, 13 bp, D. melanogaster
gctgctgttgtgc

SEQ ID NO: 629702 - DNA, 13 bp, D. melanogaster
gctgctgttgttg

SEQ ID NO: 629703 - DNA, 14 bp, D. melanogaster
gctgctgttgttgc

SEQ ID NO: 629704 - DNA, 15 bp, D. melanogaster
gctgctgttgttgct

SEQ ID NO: 629705 - DNA, 13 bp, D. melanogaster
gctgctgtttatc

SEQ ID NO: 629706 - DNA, 14 bp, D. melanogaster
gctgctgtttctgc

SEQ ID NO: 629707 - DNA, 13 bp, D. melanogaster
gctgctgtttggc

SEQ ID NO: 629708 - DNA, 13 bp, D. melanogaster
gctgcttcctttt

SEQ ID NO: 629709 - DNA, 13 bp, D. melanogaster
gctgcttctgccg

SEQ ID NO: 629710 - DNA, 13 bp, D. melanogaster
gctgcttctgctc

SEQ ID NO: 629711 - DNA, 14 bp, D. melanogaster
gctgcttctgctgc

SEQ ID NO: 629712 - DNA, 13 bp, D. melanogaster
gctgcttctgctt

SEQ ID NO: 629713 - DNA, 13 bp, D. melanogaster
gctgcttcttctg

SEQ ID NO: 629714 - DNA, 14 bp, D. melanogaster
gctgcttcttcttg

SEQ ID NO: 629715 - DNA, 13 bp, D. melanogaster
gctgcttgctgca

SEQ ID NO: 629716 - DNA, 13 bp, D. melanogaster
gctgcttgtgttg

SEQ ID NO: 629717 - DNA, 13 bp, D. melanogaster
gctgctttaattt

SEQ ID NO: 629718 - DNA, 13 bp, D. melanogaster
gctgctttatggc

SEQ ID NO: 629719 - DNA, 13 bp, D. melanogaster
gctgctttcgaga

SEQ ID NO: 629720 - DNA, 13 bp, D. melanogaster
gctgctttcgctt

SEQ ID NO: 629721 - DNA, 13 bp, D. melanogaster
gctgctttgattt

SEQ ID NO: 629722 - DNA, 13 bp, D. melanogaster
gctgctttgcata

SEQ ID NO: 629723 - DNA, 13 bp, D. melanogaster
gctgctttgcatt

SEQ ID NO: 629724 - DNA, 13 bp, D. melanogaster
gctgctttgctgc

SEQ ID NO: 629725 - DNA, 13 bp, D. melanogaster
gctgctttggctg

SEQ ID NO: 629726 - DNA, 13 bp, D. melanogaster
gctgcttttgtgg

SEQ ID NO: 629727 - DNA, 13 bp, D. melanogaster
gctgctttttgcg

SEQ ID NO: 629728 - DNA, 13 bp, D. melanogaster
gctgctttttggg

SEQ ID NO: 629729 - DNA, 13 bp, D. melanogaster
gctgcttttttgg

SEQ ID NO: 629730 - DNA, 13 bp, D. melanogaster
gctggaaaaaaaa

SEQ ID NO: 629731 - DNA, 13 bp, D. melanogaster
gctggaaaaacaa

SEQ ID NO: 629732 - DNA, 13 bp, D. melanogaster
gctggaaaaacag

SEQ ID NO: 629733 - DNA, 13 bp, D. melanogaster
gctggaaaaacta

SEQ ID NO: 629734 - DNA, 13 bp, D. melanogaster
gctggaaaaatgc

SEQ ID NO: 629735 - DNA, 13 bp, D. melanogaster
gctggaaaactca

SEQ ID NO: 629736 - DNA, 13 bp, D. melanogaster
gctggaaaactgg

SEQ ID NO: 629737 - DNA, 13 bp, D. melanogaster
gctggaaaacttt

SEQ ID NO: 629738 - DNA, 14 bp, D. melanogaster
gctggaaaactttg

SEQ ID NO: 629739 - DNA, 13 bp, D. melanogaster
gctggaaaagcag

SEQ ID NO: 629740 - DNA, 13 bp, D. melanogaster
gctggaaaagcca

SEQ ID NO: 629741 - DNA, 13 bp, D. melanogaster
gctggaaaagcga

SEQ ID NO: 629742 - DNA, 13 bp, D. melanogaster
gctggaaaagcgg

SEQ ID NO: 629743 - DNA, 13 bp, D. melanogaster
gctggaaaagtgg

SEQ ID NO: 629744 - DNA, 13 bp, D. melanogaster
gctggaaaagttg

SEQ ID NO: 629745 - DNA, 13 bp, D. melanogaster
gctggaaaataaa

SEQ ID NO: 629746 - DNA, 13 bp, D. melanogaster
gctggaaaatatg

SEQ ID NO: 629747 - DNA, 13 bp, D. melanogaster
gctggaaaatcaa

SEQ ID NO: 629748 - DNA, 14 bp, D. melanogaster
gctggaaaatcaaa

SEQ ID NO: 629749 - DNA, 13 bp, D. melanogaster
gctggaaaatctt

SEQ ID NO: 629750 - DNA, 13 bp, D. melanogaster
gctggaaaatgag

SEQ ID NO: 629751 - DNA, 13 bp, D. melanogaster
gctggaaaatgca

SEQ ID NO: 629752 - DNA, 13 bp, D. melanogaster
gctggaaaatgcg

SEQ ID NO: 629753 - DNA, 13 bp, D. melanogaster
gctggaaaatggg

SEQ ID NO: 629754 - DNA, 13 bp, D. melanogaster
gctggaaaatgtg

SEQ ID NO: 629755 - DNA, 13 bp, D. melanogaster
gctggaaagaaag

SEQ ID NO: 629756 - DNA, 13 bp, D. melanogaster
gctggaaaggcag

SEQ ID NO: 629757 - DNA, 14 bp, D. melanogaster
gctggaaaggcagc

SEQ ID NO: 629758 - DNA, 13 bp, D. melanogaster
gctggaaatttca

SEQ ID NO: 629759 - DNA, 13 bp, D. melanogaster
gctggaacaaaaa

SEQ ID NO: 629760 - DNA, 13 bp, D. melanogaster
gctggaactgaaa

SEQ ID NO: 629761 - DNA, 13 bp, D. melanogaster
gctggaatcgttt

SEQ ID NO: 629762 - DNA, 13 bp, D. melanogaster
gctggaattgcaa

SEQ ID NO: 629763 - DNA, 13 bp, D. melanogaster
gctggagatggag

SEQ ID NO: 629764 - DNA, 14 bp, D. melanogaster
gctggagatggaga

SEQ ID NO: 629765 - DNA, 13 bp, D. melanogaster
gctggagcagctg

SEQ ID NO: 629766 - DNA, 14 bp, D. melanogaster
gctggagcaggagc

SEQ ID NO: 629767 - DNA, 13 bp, D. melanogaster
gctggagctgaag

SEQ ID NO: 629768 - DNA, 13 bp, D. melanogaster
gctggagctggaa

SEQ ID NO: 629769 - DNA, 13 bp, D. melanogaster
gctggaggagcag

SEQ ID NO: 629770 - DNA, 14 bp, D. melanogaster
gctggaggagcagg

SEQ ID NO: 629771 - DNA, 13 bp, D. melanogaster
gctggaggagctg

SEQ ID NO: 629772 - DNA, 13 bp, D. melanogaster
gctggaggttttc

SEQ ID NO: 629773 - DNA, 13 bp, D. melanogaster
gctggatggatgg

SEQ ID NO: 629774 - DNA, 13 bp, D. melanogaster
gctggatttgtta

SEQ ID NO: 629775 - DNA, 13 bp, D. melanogaster
gctggcaaaacaa

SEQ ID NO: 629776 - DNA, 13 bp, D. melanogaster
gctggcaaaactt

SEQ ID NO: 629777 - DNA, 13 bp, D. melanogaster
gctggcaaaagga

SEQ ID NO: 629778 - DNA, 13 bp, D. melanogaster
gctggcaaaagtt

SEQ ID NO: 629779 - DNA, 13 bp, D. melanogaster
gctggcaaaatat

SEQ ID NO: 629780 - DNA, 13 bp, D. melanogaster
gctggcaaaatgc

SEQ ID NO: 629781 - DNA, 13 bp, D. melanogaster
gctggcaaaatta

SEQ ID NO: 629782 - DNA, 13 bp, D. melanogaster
gctggcaaacaaa

SEQ ID NO: 629783 - DNA, 13 bp, D. melanogaster
gctggcaaagaaa

SEQ ID NO: 629784 - DNA, 13 bp, D. melanogaster
gctggcaaaggca

SEQ ID NO: 629785 - DNA, 13 bp, D. melanogaster
gctggcaaagttt

SEQ ID NO: 629786 - DNA, 13 bp, D. melanogaster
gctggcaaatcaa

SEQ ID NO: 629787 - DNA, 13 bp, D. melanogaster
gctggcaaatgca

SEQ ID NO: 629788 - DNA, 13 bp, D. melanogaster
gctggcaaatgtg

SEQ ID NO: 629789 - DNA, 13 bp, D. melanogaster
gctggcaacaacc

SEQ ID NO: 629790 - DNA, 13 bp, D. melanogaster
gctggcaactttt

SEQ ID NO: 629791 - DNA, 13 bp, D. melanogaster
gctggcaataaaa

SEQ ID NO: 629792 - DNA, 13 bp, D. melanogaster
gctggcaatcaaa

SEQ ID NO: 629793 - DNA, 13 bp, D. melanogaster
gctggcaatttgt

SEQ ID NO: 629794 - DNA, 13 bp, D. melanogaster
gctggcagccaaa

SEQ ID NO: 629795 - DNA, 13 bp, D. melanogaster
gctggcaggacat

SEQ ID NO: 629796 - DNA, 13 bp, D. melanogaster
gctggcagtgcag

SEQ ID NO: 629797 - DNA, 13 bp, D. melanogaster
gctggcattaaaa

SEQ ID NO: 629798 - DNA, 13 bp, D. melanogaster
gctggcattgccc

SEQ ID NO: 629799 - DNA, 13 bp, D. melanogaster
gctggcattgttg

SEQ ID NO: 629800 - DNA, 13 bp, D. melanogaster
gctggcatttaaa

SEQ ID NO: 629801 - DNA, 14 bp, D. melanogaster
gctggccaaaaaaa

SEQ ID NO: 629802 - DNA, 14 bp, D. melanogaster
gctggccaaaaact

SEQ ID NO: 629803 - DNA, 13 bp, D. melanogaster
gctggccaaaaag

SEQ ID NO: 629804 - DNA, 13 bp, D. melanogaster
gctggccaaaaga

SEQ ID NO: 629805 - DNA, 13 bp, D. melanogaster
gctggccaaaata

SEQ ID NO: 629806 - DNA, 13 bp, D. melanogaster
gctggccaaacaa

SEQ ID NO: 629807 - DNA, 13 bp, D. melanogaster
gctggccaaagtt

SEQ ID NO: 629808 - DNA, 13 bp, D. melanogaster
gctggccaaatga

SEQ ID NO: 629809 - DNA, 13 bp, D. melanogaster
gctggccaacaaa

SEQ ID NO: 629810 - DNA, 13 bp, D. melanogaster
gctggccaagaaa

SEQ ID NO: 629811 - DNA, 13 bp, D. melanogaster
gctggccaagttg

SEQ ID NO: 629812 - DNA, 13 bp, D. melanogaster
gctggccaatttg

SEQ ID NO: 629813 - DNA, 13 bp, D. melanogaster
gctggccacaaat

SEQ ID NO: 629814 - DNA, 13 bp, D. melanogaster
gctggccagccga

SEQ ID NO: 629815 - DNA, 13 bp, D. melanogaster
gctggccagcgct

SEQ ID NO: 629816 - DNA, 13 bp, D. melanogaster
gctggccaggatt

SEQ ID NO: 629817 - DNA, 13 bp, D. melanogaster
gctggccataaaa

SEQ ID NO: 629818 - DNA, 13 bp, D. melanogaster
gctggccataaag

SEQ ID NO: 629819 - DNA, 13 bp, D. melanogaster
gctggccataaat

SEQ ID NO: 629820 - DNA, 13 bp, D. melanogaster
gctggccataatt

SEQ ID NO: 629821 - DNA, 13 bp, D. melanogaster
gctggccatatat

SEQ ID NO: 629822 - DNA, 14 bp, D. melanogaster
gctggccatatatg

SEQ ID NO: 629823 - DNA, 13 bp, D. melanogaster
gctggccattaaa

SEQ ID NO: 629824 - DNA, 13 bp, D. melanogaster
gctggccattata

SEQ ID NO: 629825 - DNA, 13 bp, D. melanogaster
gctggccatttgc

SEQ ID NO: 629826 - DNA, 13 bp, D. melanogaster
gctggcccaaaaa

SEQ ID NO: 629827 - DNA, 13 bp, D. melanogaster
gctggccgcaaga

SEQ ID NO: 629828 - DNA, 13 bp, D. melanogaster
gctggccgctggc

SEQ ID NO: 629829 - DNA, 13 bp, D. melanogaster
gctggcctttctc

SEQ ID NO: 629830 - DNA, 13 bp, D. melanogaster
gctggcgaaaaaa

SEQ ID NO: 629831 - DNA, 13 bp, D. melanogaster
gctggcgaaaaag

SEQ ID NO: 629832 - DNA, 13 bp, D. melanogaster
gctggcggccaaa

SEQ ID NO: 629833 - DNA, 13 bp, D. melanogaster
gctggcgtcgctg

SEQ ID NO: 629834 - DNA, 13 bp, D. melanogaster
gctggctaacaaa

SEQ ID NO: 629835 - DNA, 13 bp, D. melanogaster
gctggctaattaa

SEQ ID NO: 629836 - DNA, 13 bp, D. melanogaster
gctggctgactga

SEQ ID NO: 629837 - DNA, 13 bp, D. melanogaster
gctggctgcaaat

SEQ ID NO: 629838 - DNA, 13 bp, D. melanogaster
gctggctgcataa

SEQ ID NO: 629839 - DNA, 13 bp, D. melanogaster
gctggctgccaaa

SEQ ID NO: 629840 - DNA, 13 bp, D. melanogaster
gctggctgccatt

SEQ ID NO: 629841 - DNA, 13 bp, D. melanogaster
gctggctgctctt

SEQ ID NO: 629842 - DNA, 13 bp, D. melanogaster
gctggctgctggc

SEQ ID NO: 629843 - DNA, 14 bp, D. melanogaster
gctggctgctggct

SEQ ID NO: 629844 - DNA, 13 bp, D. melanogaster
gctggctgctgtt

SEQ ID NO: 629845 - DNA, 13 bp, D. melanogaster
gctggctgcttgg

SEQ ID NO: 629846 - DNA, 13 bp, D. melanogaster
gctggctggaaaa

SEQ ID NO: 629847 - DNA, 13 bp, D. melanogaster
gctggctggatgg

SEQ ID NO: 629848 - DNA, 13 bp, D. melanogaster
gctggctggcaaa

SEQ ID NO: 629849 - DNA, 13 bp, D. melanogaster
gctggctggcaac

SEQ ID NO: 629850 - DNA, 13 bp, D. melanogaster
gctggctggcaat

SEQ ID NO: 629851 - DNA, 13 bp, D. melanogaster
gctggctggcatt

SEQ ID NO: 629852 - DNA, 14 bp, D. melanogaster
gctggctggctagc

SEQ ID NO: 629853 - DNA, 13 bp, D. melanogaster
gctggctggctat

SEQ ID NO: 629854 - DNA, 13 bp, D. melanogaster
gctggctggctgc

SEQ ID NO: 629855 - DNA, 14 bp, D. melanogaster
gctggctggctgga

SEQ ID NO: 629856 - DNA, 13 bp, D. melanogaster
gctggctggctgt

SEQ ID NO: 629857 - DNA, 13 bp, D. melanogaster
gctggctggcttt

SEQ ID NO: 629858 - DNA, 13 bp, D. melanogaster
gctggctgttttt

SEQ ID NO: 629859 - DNA, 14 bp, D. melanogaster
gctggctttaattg

SEQ ID NO: 629860 - DNA, 14 bp, D. melanogaster
gctggctttgattt

SEQ ID NO: 629861 - DNA, 13 bp, D. melanogaster
gctggcttttcca

SEQ ID NO: 629862 - DNA, 13 bp, D. melanogaster
gctggcttttggc

SEQ ID NO: 629863 - DNA, 13 bp, D. melanogaster
gctgggaaaaagg

SEQ ID NO: 629864 - DNA, 13 bp, D. melanogaster
gctgggaaaacaa

SEQ ID NO: 629865 - DNA, 14 bp, D. melanogaster
gctgggaaaacttt

SEQ ID NO: 629866 - DNA, 13 bp, D. melanogaster
gctgggaaaatgg

SEQ ID NO: 629867 - DNA, 13 bp, D. melanogaster
gctgggaaatcaa

SEQ ID NO: 629868 - DNA, 13 bp, D. melanogaster
gctgggaaatggg

SEQ ID NO: 629869 - DNA, 14 bp, D. melanogaster
gctgggaaatggga

SEQ ID NO: 629870 - DNA, 13 bp, D. melanogaster
gctgggaaatgtg

SEQ ID NO: 629871 - DNA, 13 bp, D. melanogaster
gctgggaatgcca

SEQ ID NO: 629872 - DNA, 13 bp, D. melanogaster
gctgggaatggga

SEQ ID NO: 629873 - DNA, 13 bp, D. melanogaster
gctgggagctgga

SEQ ID NO: 629874 - DNA, 13 bp, D. melanogaster
gctgggattatat

SEQ ID NO: 629875 - DNA, 14 bp, D. melanogaster
gctgggattatatt

SEQ ID NO: 629876 - DNA, 13 bp, D. melanogaster
gctgggcaaacaa

SEQ ID NO: 629877 - DNA, 14 bp, D. melanogaster
gctgggcaaacaaa

SEQ ID NO: 629878 - DNA, 13 bp, D. melanogaster
gctgggcaaatat

SEQ ID NO: 629879 - DNA, 13 bp, D. melanogaster
gctgggcaataaa

SEQ ID NO: 629880 - DNA, 13 bp, D. melanogaster
gctgggcaattaa

SEQ ID NO: 629881 - DNA, 13 bp, D. melanogaster
gctgggcaatttt

SEQ ID NO: 629882 - DNA, 13 bp, D. melanogaster
gctgggccaaaaa

SEQ ID NO: 629883 - DNA, 13 bp, D. melanogaster
gctgggcgaaaaa

SEQ ID NO: 629884 - DNA, 13 bp, D. melanogaster
gctgggctggctg

SEQ ID NO: 629885 - DNA, 13 bp, D. melanogaster
gctgggggaaaaa

SEQ ID NO: 629886 - DNA, 13 bp, D. melanogaster
gctgggggaaaat

SEQ ID NO: 629887 - DNA, 13 bp, D. melanogaster
gctggtaaaaaaa

SEQ ID NO: 629888 - DNA, 14 bp, D. melanogaster
gctggtaaaaaaaa

SEQ ID NO: 629889 - DNA, 13 bp, D. melanogaster
gctggtaaacaaa

SEQ ID NO: 629890 - DNA, 13 bp, D. melanogaster
gctggtgaaaaaa

SEQ ID NO: 629891 - DNA, 13 bp, D. melanogaster
gctggtgaaaaca

SEQ ID NO: 629892 - DNA, 13 bp, D. melanogaster
gctggtgagctgg

SEQ ID NO: 629893 - DNA, 13 bp, D. melanogaster
gctggtgatggtg

SEQ ID NO: 629894 - DNA, 13 bp, D. melanogaster
gctggtgcaaaaa

SEQ ID NO: 629895 - DNA, 13 bp, D. melanogaster
gctggtgctgctg

SEQ ID NO: 629896 - DNA, 14 bp, D. melanogaster
gctggtgctggtgc

SEQ ID NO: 629897 - DNA, 13 bp, D. melanogaster
gctggtggaaaaa

SEQ ID NO: 629898 - DNA, 13 bp, D. melanogaster
gctggtggatgtg

SEQ ID NO: 629899 - DNA, 13 bp, D. melanogaster
gctggtggggcag

SEQ ID NO: 629900 - DNA, 13 bp, D. melanogaster
gctggtggtgatt

SEQ ID NO: 629901 - DNA, 13 bp, D. melanogaster
gctggtggtgctg

SEQ ID NO: 629902 - DNA, 13 bp, D. melanogaster
gctggtgtcactg

SEQ ID NO: 629903 - DNA, 13 bp, D. melanogaster
gctggtgtcgcac

SEQ ID NO: 629904 - DNA, 13 bp, D. melanogaster
gctggtgtgcgtg

SEQ ID NO: 629905 - DNA, 13 bp, D. melanogaster
gctggtgttagtg

SEQ ID NO: 629906 - DNA, 14 bp, D. melanogaster
gctggtgttgctgc

SEQ ID NO: 629907 - DNA, 13 bp, D. melanogaster
gctggttgagaaa

SEQ ID NO: 629908 - DNA, 13 bp, D. melanogaster
gctggttggctgg

SEQ ID NO: 629909 - DNA, 13 bp, D. melanogaster
gctggtttttgca

SEQ ID NO: 629910 - DNA, 13 bp, D. melanogaster
gctgtaaaatatt

SEQ ID NO: 629911 - DNA, 13 bp, D. melanogaster
gctgtaaacaatt

SEQ ID NO: 629912 - DNA, 13 bp, D. melanogaster
gctgtaattcgac

SEQ ID NO: 629913 - DNA, 13 bp, D. melanogaster
gctgtagctgtat

SEQ ID NO: 629914 - DNA, 13 bp, D. melanogaster
gctgtagctgttg

SEQ ID NO: 629915 - DNA, 13 bp, D. melanogaster
gctgtagttgttt

SEQ ID NO: 629916 - DNA, 13 bp, D. melanogaster
gctgtatgtgtgt

SEQ ID NO: 629917 - DNA, 13 bp, D. melanogaster
gctgtcaatcaaa

SEQ ID NO: 629918 - DNA, 13 bp, D. melanogaster
gctgtcaattaaa

SEQ ID NO: 629919 - DNA, 13 bp, D. melanogaster
gctgtcacaagag

SEQ ID NO: 629920 - DNA, 13 bp, D. melanogaster
gctgtcacactgg

SEQ ID NO: 629921 - DNA, 13 bp, D. melanogaster
gctgtcaccattt

SEQ ID NO: 629922 - DNA, 13 bp, D. melanogaster
gctgtcagttggc

SEQ ID NO: 629923 - DNA, 13 bp, D. melanogaster
gctgtcctttctc

SEQ ID NO: 629924 - DNA, 13 bp, D. melanogaster
gctgtcgtcgctg

SEQ ID NO: 629925 - DNA, 13 bp, D. melanogaster
gctgtcgtcgtcg

SEQ ID NO: 629926 - DNA, 13 bp, D. melanogaster
gctgtcgttgttg

SEQ ID NO: 629927 - DNA, 13 bp, D. melanogaster
gctgtctctttct

SEQ ID NO: 629928 - DNA, 13 bp, D. melanogaster
gctgtcttaacag

SEQ ID NO: 629929 - DNA, 13 bp, D. melanogaster
gctgtgaaaattg

SEQ ID NO: 629930 - DNA, 13 bp, D. melanogaster
gctgtgagctgtg

SEQ ID NO: 629931 - DNA, 13 bp, D. melanogaster
gctgtgagtgtgt

SEQ ID NO: 629932 - DNA, 13 bp, D. melanogaster
gctgtgattgcca

SEQ ID NO: 629933 - DNA, 13 bp, D. melanogaster
gctgtgcagttgt

SEQ ID NO: 629934 - DNA, 13 bp, D. melanogaster
gctgtgccagctg

SEQ ID NO: 629935 - DNA, 14 bp, D. melanogaster
gctgtgccagctgt

SEQ ID NO: 629936 - DNA, 13 bp, D. melanogaster
gctgtgcgtgtat

SEQ ID NO: 629937 - DNA, 13 bp, D. melanogaster
gctgtggcaatac

SEQ ID NO: 629938 - DNA, 13 bp, D. melanogaster
gctgtggcaattt

SEQ ID NO: 629939 - DNA, 14 bp, D. melanogaster
gctgtggcagtggc

SEQ ID NO: 629940 - DNA, 13 bp, D. melanogaster
gctgtggctgtgg

SEQ ID NO: 629941 - DNA, 14 bp, D. melanogaster
gctgtggctgtggc

SEQ ID NO: 629942 - DNA, 13 bp, D. melanogaster
gctgtggggcaac

SEQ ID NO: 629943 - DNA, 13 bp, D. melanogaster
gctgtggtcaatg

SEQ ID NO: 629944 - DNA, 13 bp, D. melanogaster
gctgtgtacttat

SEQ ID NO: 629945 - DNA, 13 bp, D. melanogaster
gctgtgtgattgc

SEQ ID NO: 629946 - DNA, 13 bp, D. melanogaster
gctgtgtgcagct

SEQ ID NO: 629947 - DNA, 13 bp, D. melanogaster
gctgtgtgcgtgc

SEQ ID NO: 629948 - DNA, 14 bp, D. melanogaster
gctgtgtgcgtgcg

SEQ ID NO: 629949 - DNA, 13 bp, D. melanogaster
gctgtgttggcca

SEQ ID NO: 629950 - DNA, 13 bp, D. melanogaster
gctgtgttgttgc

SEQ ID NO: 629951 - DNA, 13 bp, D. melanogaster
gctgtgtttgtgc

SEQ ID NO: 629952 - DNA, 13 bp, D. melanogaster
gctgttaattgcc

SEQ ID NO: 629953 - DNA, 13 bp, D. melanogaster
gctgttaattttt

SEQ ID NO: 629954 - DNA, 13 bp, D. melanogaster
gctgttacagttt

SEQ ID NO: 629955 - DNA, 14 bp, D. melanogaster
gctgttacagtttt

SEQ ID NO: 629956 - DNA, 13 bp, D. melanogaster
gctgttactgctg

SEQ ID NO: 629957 - DNA, 13 bp, D. melanogaster
gctgttcaagatg

SEQ ID NO: 629958 - DNA, 13 bp, D. melanogaster
gctgttcccgccg

SEQ ID NO: 629959 - DNA, 13 bp, D. melanogaster
gctgttcggaatg

SEQ ID NO: 629960 - DNA, 14 bp, D. melanogaster
gctgttctgcaggc

SEQ ID NO: 629961 - DNA, 13 bp, D. melanogaster
gctgttgaaaatg

SEQ ID NO: 629962 - DNA, 14 bp, D. melanogaster
gctgttgaaaatga

SEQ ID NO: 629963 - DNA, 13 bp, D. melanogaster
gctgttgaaccaa

SEQ ID NO: 629964 - DNA, 13 bp, D. melanogaster
gctgttgatgatg

SEQ ID NO: 629965 - DNA, 13 bp, D. melanogaster
gctgttgattttg

SEQ ID NO: 629966 - DNA, 13 bp, D. melanogaster
gctgttgcaactg

SEQ ID NO: 629967 - DNA, 13 bp, D. melanogaster
gctgttgcagttg

SEQ ID NO: 629968 - DNA, 13 bp, D. melanogaster
gctgttgcatgtt

SEQ ID NO: 629969 - DNA, 13 bp, D. melanogaster
gctgttgcatttg

SEQ ID NO: 629970 - DNA, 13 bp, D. melanogaster
gctgttgccactg

SEQ ID NO: 629971 - DNA, 13 bp, D. melanogaster
gctgttgcggctg

SEQ ID NO: 629972 - DNA, 13 bp, D. melanogaster
gctgttgctactg

SEQ ID NO: 629973 - DNA, 14 bp, D. melanogaster
gctgttgctactgc

SEQ ID NO: 629974 - DNA, 13 bp, D. melanogaster
gctgttgctgcct

SEQ ID NO: 629975 - DNA, 14 bp, D. melanogaster
gctgttgctgctgt

SEQ ID NO: 629976 - DNA, 13 bp, D. melanogaster
gctgttgctgctt

SEQ ID NO: 629977 - DNA, 13 bp, D. melanogaster
gctgttgctggcg

SEQ ID NO: 629978 - DNA, 15 bp, D. melanogaster
gctgttgctggcgtt

SEQ ID NO: 629979 - DNA, 13 bp, D. melanogaster
gctgttgctgtcg

SEQ ID NO: 629980 - DNA, 13 bp, D. melanogaster
gctgttgctgtgg

SEQ ID NO: 629981 - DNA, 13 bp, D. melanogaster
gctgttgctgttg

SEQ ID NO: 629982 - DNA, 13 bp, D. melanogaster
gctgttgcttctg

SEQ ID NO: 629983 - DNA, 14 bp, D. melanogaster
gctgttggctgttg

SEQ ID NO: 629984 - DNA, 13 bp, D. melanogaster
gctgttgtcatgt

SEQ ID NO: 629985 - DNA, 13 bp, D. melanogaster
gctgttgtcgctg

SEQ ID NO: 629986 - DNA, 13 bp, D. melanogaster
gctgttgttattt

SEQ ID NO: 629987 - DNA, 13 bp, D. melanogaster
gctgttgttgcaa

SEQ ID NO: 629988 - DNA, 13 bp, D. melanogaster
gctgttgttgccg

SEQ ID NO: 629989 - DNA, 14 bp, D. melanogaster
gctgttgttgccgc

SEQ ID NO: 629990 - DNA, 13 bp, D. melanogaster
gctgttgttgcta

SEQ ID NO: 629991 - DNA, 14 bp, D. melanogaster
gctgttgttgctat

SEQ ID NO: 629992 - DNA, 13 bp, D. melanogaster
gctgttgttgctg

SEQ ID NO: 629993 - DNA, 14 bp, D. melanogaster
gctgttgttgctgc

SEQ ID NO: 629994 - DNA, 14 bp, D. melanogaster
gctgttgttgctgg

SEQ ID NO: 629995 - DNA, 13 bp, D. melanogaster
gctgttgttgctt

SEQ ID NO: 629996 - DNA, 14 bp, D. melanogaster
gctgttgttgtcgc

SEQ ID NO: 629997 - DNA, 13 bp, D. melanogaster
gctgtttcacttt

SEQ ID NO: 629998 - DNA, 13 bp, D. melanogaster
gctgtttctgctg

SEQ ID NO: 629999 - DNA, 13 bp, D. melanogaster
gctgtttctgctt

SEQ ID NO: 630000 - DNA, 13 bp, D. melanogaster
gctgtttgaaaaa

SEQ ID NO: 630001 - DNA, 13 bp, D. melanogaster
gctgtttgctggc

SEQ ID NO: 630002 - DNA, 13 bp, D. melanogaster
gctgtttgctgtt

SEQ ID NO: 630003 - DNA, 13 bp, D. melanogaster
gctgtttgtgtgc

SEQ ID NO: 630004 - DNA, 13 bp, D. melanogaster
gctgtttgtttta

SEQ ID NO: 630005 - DNA, 13 bp, D. melanogaster
gctgttttccgat

SEQ ID NO: 630006 - DNA, 13 bp, D. melanogaster
gctgttttcgctg

SEQ ID NO: 630007 - DNA, 13 bp, D. melanogaster
gctgttttttatg

SEQ ID NO: 630008 - DNA, 13 bp, D. melanogaster
gcttaaaaaagaa

SEQ ID NO: 630009 - DNA, 13 bp, D. melanogaster
gcttaaaaacatt

SEQ ID NO: 630010 - DNA, 13 bp, D. melanogaster
gcttaaaaatatt

SEQ ID NO: 630011 - DNA, 13 bp, D. melanogaster
gcttaaaaatgaa

SEQ ID NO: 630012 - DNA, 13 bp, D. melanogaster
gcttaaaactaaa

SEQ ID NO: 630013 - DNA, 13 bp, D. melanogaster
gcttaaaacttaa

SEQ ID NO: 630014 - DNA, 13 bp, D. melanogaster
gcttaaaaggatt

SEQ ID NO: 630015 - DNA, 13 bp, D. melanogaster
gcttaaaataaaa

SEQ ID NO: 630016 - DNA, 13 bp, D. melanogaster
gcttaaaatgcaa

SEQ ID NO: 630017 - DNA, 14 bp, D. melanogaster
gcttaaaattaaat

SEQ ID NO: 630018 - DNA, 13 bp, D. melanogaster
gcttaaaattatt

SEQ ID NO: 630019 - DNA, 13 bp, D. melanogaster
gcttaaacaataa

SEQ ID NO: 630020 - DNA, 13 bp, D. melanogaster
gcttaaactttaa

SEQ ID NO: 630021 - DNA, 13 bp, D. melanogaster
gcttaaagaatat

SEQ ID NO: 630022 - DNA, 13 bp, D. melanogaster
gcttaaagcattt

SEQ ID NO: 630023 - DNA, 13 bp, D. melanogaster
gcttaaagccaaa

SEQ ID NO: 630024 - DNA, 13 bp, D. melanogaster
gcttaaaggaatc

SEQ ID NO: 630025 - DNA, 13 bp, D. melanogaster
gcttaaaggagct

SEQ ID NO: 630026 - DNA, 13 bp, D. melanogaster
gcttaaagtgcaa

SEQ ID NO: 630027 - DNA, 13 bp, D. melanogaster
gcttaaagtttta

SEQ ID NO: 630028 - DNA, 13 bp, D. melanogaster
gcttaaataaact

SEQ ID NO: 630029 - DNA, 13 bp, D. melanogaster
gcttaaatagatt

SEQ ID NO: 630030 - DNA, 13 bp, D. melanogaster
gcttaaatagttc

SEQ ID NO: 630031 - DNA, 14 bp, D. melanogaster
gcttaaatatataa

SEQ ID NO: 630032 - DNA, 13 bp, D. melanogaster
gcttaaatatgca

SEQ ID NO: 630033 - DNA, 13 bp, D. melanogaster
gcttaaatattta

SEQ ID NO: 630034 - DNA, 13 bp, D. melanogaster
gcttaaatatttg

SEQ ID NO: 630035 - DNA, 14 bp, D. melanogaster
gcttaaatatttta

SEQ ID NO: 630036 - DNA, 13 bp, D. melanogaster
gcttaaatggaaa

SEQ ID NO: 630037 - DNA, 13 bp, D. melanogaster
gcttaaatgttta

SEQ ID NO: 630038 - DNA, 13 bp, D. melanogaster
gcttaaattaaac

SEQ ID NO: 630039 - DNA, 13 bp, D. melanogaster
gcttaaattaaat

SEQ ID NO: 630040 - DNA, 13 bp, D. melanogaster
gcttaaattgttt

SEQ ID NO: 630041 - DNA, 13 bp, D. melanogaster
gcttaaatttgaa

SEQ ID NO: 630042 - DNA, 13 bp, D. melanogaster
gcttaaattttaa

SEQ ID NO: 630043 - DNA, 13 bp, D. melanogaster
gcttaacgcaaaa

SEQ ID NO: 630044 - DNA, 13 bp, D. melanogaster
gcttaactttcaa

SEQ ID NO: 630045 - DNA, 13 bp, D. melanogaster
gcttaagctgaca

SEQ ID NO: 630046 - DNA, 13 bp, D. melanogaster
gcttaagctttaa

SEQ ID NO: 630047 - DNA, 13 bp, D. melanogaster
gcttaagtaattt

SEQ ID NO: 630048 - DNA, 13 bp, D. melanogaster
gcttaagtatttt

SEQ ID NO: 630049 - DNA, 13 bp, D. melanogaster
gcttaataaaaac

SEQ ID NO: 630050 - DNA, 13 bp, D. melanogaster
gcttaataatttt

SEQ ID NO: 630051 - DNA, 13 bp, D. melanogaster
gcttaatagtttt

SEQ ID NO: 630052 - DNA, 13 bp, D. melanogaster
gcttaatattacg

SEQ ID NO: 630053 - DNA, 13 bp, D. melanogaster
gcttaatctcaac

SEQ ID NO: 630054 - DNA, 13 bp, D. melanogaster
gcttaattaatgc

SEQ ID NO: 630055 - DNA, 13 bp, D. melanogaster
gcttaattatttt

SEQ ID NO: 630056 - DNA, 13 bp, D. melanogaster
gcttaattctaac

SEQ ID NO: 630057 - DNA, 13 bp, D. melanogaster
gcttaattgaatg

SEQ ID NO: 630058 - DNA, 13 bp, D. melanogaster
gcttaatttaatt

SEQ ID NO: 630059 - DNA, 13 bp, D. melanogaster
gcttaatttatga

SEQ ID NO: 630060 - DNA, 13 bp, D. melanogaster
gcttaatttgaat

SEQ ID NO: 630061 - DNA, 13 bp, D. melanogaster
gcttaattttaaa

SEQ ID NO: 630062 - DNA, 14 bp, D. melanogaster
gcttaattttactt

SEQ ID NO: 630063 - DNA, 13 bp, D. melanogaster
gcttagaaattgc

SEQ ID NO: 630064 - DNA, 13 bp, D. melanogaster
gcttagctcaata

SEQ ID NO: 630065 - DNA, 15 bp, D. melanogaster
gcttagctcaatatg

SEQ ID NO: 630066 - DNA, 13 bp, D. melanogaster
gcttagttttcaa

SEQ ID NO: 630067 - DNA, 13 bp, D. melanogaster
gcttagtttttat

SEQ ID NO: 630068 - DNA, 13 bp, D. melanogaster
gcttataaaaata

SEQ ID NO: 630069 - DNA, 13 bp, D. melanogaster
gcttataataata

SEQ ID NO: 630070 - DNA, 13 bp, D. melanogaster
gcttatacacgaa

SEQ ID NO: 630071 - DNA, 13 bp, D. melanogaster
gcttatatgtatg

SEQ ID NO: 630072 - DNA, 13 bp, D. melanogaster
gcttatcaaattt

SEQ ID NO: 630073 - DNA, 13 bp, D. melanogaster
gcttatcagaaaa

SEQ ID NO: 630074 - DNA, 13 bp, D. melanogaster
gcttatcgatttt

SEQ ID NO: 630075 - DNA, 13 bp, D. melanogaster
gcttatcgctgca

SEQ ID NO: 630076 - DNA, 14 bp, D. melanogaster
gcttatcgctgcat

SEQ ID NO: 630077 - DNA, 13 bp, D. melanogaster
gcttatgcaattt

SEQ ID NO: 630078 - DNA, 13 bp, D. melanogaster
gcttattaaattt

SEQ ID NO: 630079 - DNA, 13 bp, D. melanogaster
gcttattagtgaa

SEQ ID NO: 630080 - DNA, 13 bp, D. melanogaster
gcttattatttat

SEQ ID NO: 630081 - DNA, 13 bp, D. melanogaster
gcttatttaattt

SEQ ID NO: 630082 - DNA, 13 bp, D. melanogaster
gcttatttatatt

SEQ ID NO: 630083 - DNA, 13 bp, D. melanogaster
gcttatttatgta

SEQ ID NO: 630084 - DNA, 13 bp, D. melanogaster
gcttatttgcttt

SEQ ID NO: 630085 - DNA, 14 bp, D. melanogaster
gcttatttttcaca

SEQ ID NO: 630086 - DNA, 13 bp, D. melanogaster
gcttcaaaaaaaa

SEQ ID NO: 630087 - DNA, 14 bp, D. melanogaster
gcttcaaaaaaaaa

SEQ ID NO: 630088 - DNA, 13 bp, D. melanogaster
gcttcaacttcaa

SEQ ID NO: 630089 - DNA, 13 bp, D. melanogaster
gcttcaagaagct

SEQ ID NO: 630090 - DNA, 13 bp, D. melanogaster
gcttcaagaagtt

SEQ ID NO: 630091 - DNA, 14 bp, D. melanogaster
gcttcaagaagttt

SEQ ID NO: 630092 - DNA, 13 bp, D. melanogaster
gcttcaagaatgt

SEQ ID NO: 630093 - DNA, 13 bp, D. melanogaster
gcttcaatgtgcc

SEQ ID NO: 630094 - DNA, 13 bp, D. melanogaster
gcttcaattaatt

SEQ ID NO: 630095 - DNA, 13 bp, D. melanogaster
gcttcaatttgaa

SEQ ID NO: 630096 - DNA, 13 bp, D. melanogaster
gcttcagcttctg

SEQ ID NO: 630097 - DNA, 13 bp, D. melanogaster
gcttcagttcagt

SEQ ID NO: 630098 - DNA, 13 bp, D. melanogaster
gcttcagtttcag

SEQ ID NO: 630099 - DNA, 14 bp, D. melanogaster
gcttcagtttcagt

SEQ ID NO: 630100 - DNA, 13 bp, D. melanogaster
gcttcatttgttg

SEQ ID NO: 630101 - DNA, 13 bp, D. melanogaster
gcttccagagcaa

SEQ ID NO: 630102 - DNA, 13 bp, D. melanogaster
gcttccagtactg

SEQ ID NO: 630103 - DNA, 13 bp, D. melanogaster
gcttccataatcc

SEQ ID NO: 630104 - DNA, 13 bp, D. melanogaster
gcttccgtcatta

SEQ ID NO: 630105 - DNA, 13 bp, D. melanogaster
gcttccgtttccg

SEQ ID NO: 630106 - DNA, 14 bp, D. melanogaster
gcttccgtttccgc

SEQ ID NO: 630107 - DNA, 13 bp, D. melanogaster
gcttcctgcagag

SEQ ID NO: 630108 - DNA, 14 bp, D. melanogaster
gcttcctgcagagc

SEQ ID NO: 630109 - DNA, 14 bp, D. melanogaster
gcttccttacaaaa

SEQ ID NO: 630110 - DNA, 13 bp, D. melanogaster
gcttcctttggct

SEQ ID NO: 630111 - DNA, 14 bp, D. melanogaster
gcttcctttgtagc

SEQ ID NO: 630112 - DNA, 13 bp, D. melanogaster
gcttccttttgcc

SEQ ID NO: 630113 - DNA, 13 bp, D. melanogaster
gcttcgactttat

SEQ ID NO: 630114 - DNA, 13 bp, D. melanogaster
gcttcgaggaact

SEQ ID NO: 630115 - DNA, 13 bp, D. melanogaster
gcttcgatgccac

SEQ ID NO: 630116 - DNA, 13 bp, D. melanogaster
gcttcgattcgat

SEQ ID NO: 630117 - DNA, 13 bp, D. melanogaster
gcttcgatttcaa

SEQ ID NO: 630118 - DNA, 13 bp, D. melanogaster
gcttcggcagcaa

SEQ ID NO: 630119 - DNA, 13 bp, D. melanogaster
gcttcggcggtga

SEQ ID NO: 630120 - DNA, 13 bp, D. melanogaster
gcttcggctttgg

SEQ ID NO: 630121 - DNA, 13 bp, D. melanogaster
gcttcgtcatttt

SEQ ID NO: 630122 - DNA, 13 bp, D. melanogaster
gcttcgtgctctt

SEQ ID NO: 630123 - DNA, 14 bp, D. melanogaster
gcttctaatgcgtt

SEQ ID NO: 630124 - DNA, 13 bp, D. melanogaster
gcttctcctccac

SEQ ID NO: 630125 - DNA, 13 bp, D. melanogaster
gcttctgcctctg

SEQ ID NO: 630126 - DNA, 13 bp, D. melanogaster
gcttctgctacaa

SEQ ID NO: 630127 - DNA, 13 bp, D. melanogaster
gcttctgctgcag

SEQ ID NO: 630128 - DNA, 13 bp, D. melanogaster
gcttctgctgctc

SEQ ID NO: 630129 - DNA, 14 bp, D. melanogaster
gcttctgctgctgg

SEQ ID NO: 630130 - DNA, 13 bp, D. melanogaster
gcttctggcttct

SEQ ID NO: 630131 - DNA, 13 bp, D. melanogaster
gcttctgtttctg

SEQ ID NO: 630132 - DNA, 13 bp, D. melanogaster
gcttctgtttgcc

SEQ ID NO: 630133 - DNA, 13 bp, D. melanogaster
gcttcttaaggaa

SEQ ID NO: 630134 - DNA, 13 bp, D. melanogaster
gcttcttattgtg

SEQ ID NO: 630135 - DNA, 13 bp, D. melanogaster
gcttcttctgctt

SEQ ID NO: 630136 - DNA, 13 bp, D. melanogaster
gcttcttcttcgc

SEQ ID NO: 630137 - DNA, 14 bp, D. melanogaster
gcttcttcttctgc

SEQ ID NO: 630138 - DNA, 13 bp, D. melanogaster
gcttcttggcttt

SEQ ID NO: 630139 - DNA, 14 bp, D. melanogaster
gcttctttaaacaa

SEQ ID NO: 630140 - DNA, 14 bp, D. melanogaster
gcttctttgcctct

SEQ ID NO: 630141 - DNA, 13 bp, D. melanogaster
gcttctttttacc

SEQ ID NO: 630142 - DNA, 13 bp, D. melanogaster
gcttgaaaaatgc

SEQ ID NO: 630143 - DNA, 13 bp, D. melanogaster
gcttgaaaggggc

SEQ ID NO: 630144 - DNA, 13 bp, D. melanogaster
gcttgaacctaag

SEQ ID NO: 630145 - DNA, 13 bp, D. melanogaster
gcttgaggccata

SEQ ID NO: 630146 - DNA, 13 bp, D. melanogaster
gcttgattatttt

SEQ ID NO: 630147 - DNA, 13 bp, D. melanogaster
gcttgattgtgaa

SEQ ID NO: 630148 - DNA, 13 bp, D. melanogaster
gcttgatttatgt

SEQ ID NO: 630149 - DNA, 13 bp, D. melanogaster
gcttgcaaaggga

SEQ ID NO: 630150 - DNA, 13 bp, D. melanogaster
gcttgcatttcaa

SEQ ID NO: 630151 - DNA, 13 bp, D. melanogaster
gcttgccaaaaaa

SEQ ID NO: 630152 - DNA, 13 bp, D. melanogaster
gcttgccatatat

SEQ ID NO: 630153 - DNA, 13 bp, D. melanogaster
gcttgccattttc

SEQ ID NO: 630154 - DNA, 13 bp, D. melanogaster
gcttgccgactgg

SEQ ID NO: 630155 - DNA, 13 bp, D. melanogaster
gcttgctcaaata

SEQ ID NO: 630156 - DNA, 13 bp, D. melanogaster
gcttgctgatttt

SEQ ID NO: 630157 - DNA, 13 bp, D. melanogaster
gcttgctgctgct

SEQ ID NO: 630158 - DNA, 13 bp, D. melanogaster
gcttgctggccct

SEQ ID NO: 630159 - DNA, 13 bp, D. melanogaster
gcttgcttgtgtg

SEQ ID NO: 630160 - DNA, 13 bp, D. melanogaster
gcttgctttttat

SEQ ID NO: 630161 - DNA, 14 bp, D. melanogaster
gcttggaaaatgtg

SEQ ID NO: 630162 - DNA, 13 bp, D. melanogaster
gcttggactacca

SEQ ID NO: 630163 - DNA, 13 bp, D. melanogaster
gcttggagaaggg

SEQ ID NO: 630164 - DNA, 13 bp, D. melanogaster
gcttggagatgca

SEQ ID NO: 630165 - DNA, 13 bp, D. melanogaster
gcttggatttcat

SEQ ID NO: 630166 - DNA, 13 bp, D. melanogaster
gcttggctgcaag

SEQ ID NO: 630167 - DNA, 13 bp, D. melanogaster
gcttggctgcatt

SEQ ID NO: 630168 - DNA, 13 bp, D. melanogaster
gcttggcttttgt

SEQ ID NO: 630169 - DNA, 13 bp, D. melanogaster
gcttgggcttggg

SEQ ID NO: 630170 - DNA, 14 bp, D. melanogaster
gcttgggcttgggc

SEQ ID NO: 630171 - DNA, 13 bp, D. melanogaster
gcttggtttgaaa

SEQ ID NO: 630172 - DNA, 13 bp, D. melanogaster
gcttggttttata

SEQ ID NO: 630173 - DNA, 13 bp, D. melanogaster
gcttgtagcccaa

SEQ ID NO: 630174 - DNA, 13 bp, D. melanogaster
gcttgtatttctt

SEQ ID NO: 630175 - DNA, 13 bp, D. melanogaster
gcttgtcaacaat

SEQ ID NO: 630176 - DNA, 13 bp, D. melanogaster
gcttgtccattca

SEQ ID NO: 630177 - DNA, 13 bp, D. melanogaster
gcttgtgaaattt

SEQ ID NO: 630178 - DNA, 14 bp, D. melanogaster
gcttgtgaaatttt

SEQ ID NO: 630179 - DNA, 13 bp, D. melanogaster
gcttgtgtctgtg

SEQ ID NO: 630180 - DNA, 13 bp, D. melanogaster
gcttgtgtgcgtg

SEQ ID NO: 630181 - DNA, 14 bp, D. melanogaster
gcttgtgtgcgtgt

SEQ ID NO: 630182 - DNA, 14 bp, D. melanogaster
gcttgtttgtttat

SEQ ID NO: 630183 - DNA, 14 bp, D. melanogaster
gctttaaaaatatt

SEQ ID NO: 630184 - DNA, 13 bp, D. melanogaster
gctttaaaatgcc

SEQ ID NO: 630185 - DNA, 13 bp, D. melanogaster
gctttaaaattgt

SEQ ID NO: 630186 - DNA, 13 bp, D. melanogaster
gctttaaaattta

SEQ ID NO: 630187 - DNA, 13 bp, D. melanogaster
gctttaaagtgaa

SEQ ID NO: 630188 - DNA, 13 bp, D. melanogaster
gctttaaataata

SEQ ID NO: 630189 - DNA, 13 bp, D. melanogaster
gctttaaatgaat

SEQ ID NO: 630190 - DNA, 13 bp, D. melanogaster
gctttaaatggta

SEQ ID NO: 630191 - DNA, 13 bp, D. melanogaster
gctttaaattaaa

SEQ ID NO: 630192 - DNA, 13 bp, D. melanogaster
gctttaaattatg

SEQ ID NO: 630193 - DNA, 13 bp, D. melanogaster
gctttaaatttta

SEQ ID NO: 630194 - DNA, 13 bp, D. melanogaster
gctttaactacgt

SEQ ID NO: 630195 - DNA, 13 bp, D. melanogaster
gctttaagccaag

SEQ ID NO: 630196 - DNA, 13 bp, D. melanogaster
gctttaagtttaa

SEQ ID NO: 630197 - DNA, 13 bp, D. melanogaster
gctttaagttttt

SEQ ID NO: 630198 - DNA, 13 bp, D. melanogaster
gctttaataataa

SEQ ID NO: 630199 - DNA, 14 bp, D. melanogaster
gctttaatatttta

SEQ ID NO: 630200 - DNA, 13 bp, D. melanogaster
gctttaatcaatt

SEQ ID NO: 630201 - DNA, 13 bp, D. melanogaster
gctttaatgtttt

SEQ ID NO: 630202 - DNA, 14 bp, D. melanogaster
gctttaattaaaaa

SEQ ID NO: 630203 - DNA, 13 bp, D. melanogaster
gctttaattgaat

SEQ ID NO: 630204 - DNA, 13 bp, D. melanogaster
gctttaattgcca

SEQ ID NO: 630205 - DNA, 13 bp, D. melanogaster
gctttaatttaaa

SEQ ID NO: 630206 - DNA, 13 bp, D. melanogaster
gctttaatttatt

SEQ ID NO: 630207 - DNA, 13 bp, D. melanogaster
gctttaatttctt

SEQ ID NO: 630208 - DNA, 13 bp, D. melanogaster
gctttaatttgaa

SEQ ID NO: 630209 - DNA, 13 bp, D. melanogaster
gctttacacattt

SEQ ID NO: 630210 - DNA, 13 bp, D. melanogaster
gctttacatattt

SEQ ID NO: 630211 - DNA, 13 bp, D. melanogaster
gctttacatttta

SEQ ID NO: 630212 - DNA, 13 bp, D. melanogaster
gctttacgggcca

SEQ ID NO: 630213 - DNA, 13 bp, D. melanogaster
gctttacttgggc

SEQ ID NO: 630214 - DNA, 13 bp, D. melanogaster
gctttagctttgg

SEQ ID NO: 630215 - DNA, 14 bp, D. melanogaster
gctttagctttggc

SEQ ID NO: 630216 - DNA, 13 bp, D. melanogaster
gctttagcttttt

SEQ ID NO: 630217 - DNA, 13 bp, D. melanogaster
gctttagggcgtt

SEQ ID NO: 630218 - DNA, 13 bp, D. melanogaster
gctttagttttat

SEQ ID NO: 630219 - DNA, 13 bp, D. melanogaster
gctttattagcct

SEQ ID NO: 630220 - DNA, 13 bp, D. melanogaster
gctttattgcttt

SEQ ID NO: 630221 - DNA, 13 bp, D. melanogaster
gctttatttgatt

SEQ ID NO: 630222 - DNA, 13 bp, D. melanogaster
gctttatttgcat

SEQ ID NO: 630223 - DNA, 13 bp, D. melanogaster
gctttatttgctt

SEQ ID NO: 630224 - DNA, 13 bp, D. melanogaster
gctttattttcat

SEQ ID NO: 630225 - DNA, 13 bp, D. melanogaster
gctttcaaaatgc

SEQ ID NO: 630226 - DNA, 13 bp, D. melanogaster
gctttcaaattta

SEQ ID NO: 630227 - DNA, 13 bp, D. melanogaster
gctttcaataaaa

SEQ ID NO: 630228 - DNA, 13 bp, D. melanogaster
gctttcaatttcg

SEQ ID NO: 630229 - DNA, 13 bp, D. melanogaster
gctttcaatttgt

SEQ ID NO: 630230 - DNA, 13 bp, D. melanogaster
gctttcagctttc

SEQ ID NO: 630231 - DNA, 14 bp, D. melanogaster
gctttcagctttca

SEQ ID NO: 630232 - DNA, 13 bp, D. melanogaster
gctttcagttttc

SEQ ID NO: 630233 - DNA, 13 bp, D. melanogaster
gctttcattcagc

SEQ ID NO: 630234 - DNA, 13 bp, D. melanogaster
gctttcattgaaa

SEQ ID NO: 630235 - DNA, 13 bp, D. melanogaster
gctttcatttaaa

SEQ ID NO: 630236 - DNA, 13 bp, D. melanogaster
gctttccatttcg

SEQ ID NO: 630237 - DNA, 13 bp, D. melanogaster
gctttccctagtt

SEQ ID NO: 630238 - DNA, 13 bp, D. melanogaster
gctttccgctttc

SEQ ID NO: 630239 - DNA, 13 bp, D. melanogaster
gctttccttggat

SEQ ID NO: 630240 - DNA, 13 bp, D. melanogaster
gctttcgagaaaa

SEQ ID NO: 630241 - DNA, 14 bp, D. melanogaster
gctttcgctgacca

SEQ ID NO: 630242 - DNA, 13 bp, D. melanogaster
gctttcggaaagt

SEQ ID NO: 630243 - DNA, 13 bp, D. melanogaster
gctttcgggagtg

SEQ ID NO: 630244 - DNA, 13 bp, D. melanogaster
gctttcgggtggc

SEQ ID NO: 630245 - DNA, 13 bp, D. melanogaster
gctttcgtccttt

SEQ ID NO: 630246 - DNA, 13 bp, D. melanogaster
gctttcgttctct

SEQ ID NO: 630247 - DNA, 13 bp, D. melanogaster
gctttcgttttga

SEQ ID NO: 630248 - DNA, 13 bp, D. melanogaster
gctttctgcttct

SEQ ID NO: 630249 - DNA, 13 bp, D. melanogaster
gctttctggcttt

SEQ ID NO: 630250 - DNA, 13 bp, D. melanogaster
gctttcttctgcc

SEQ ID NO: 630251 - DNA, 13 bp, D. melanogaster
gctttcttttcat

SEQ ID NO: 630252 - DNA, 13 bp, D. melanogaster
gctttgaaatttt

SEQ ID NO: 630253 - DNA, 13 bp, D. melanogaster
gctttgaactcca

SEQ ID NO: 630254 - DNA, 13 bp, D. melanogaster
gctttgaatattt

SEQ ID NO: 630255 - DNA, 13 bp, D. melanogaster
gctttgaatttgc

SEQ ID NO: 630256 - DNA, 13 bp, D. melanogaster
gctttgattggtg

SEQ ID NO: 630257 - DNA, 13 bp, D. melanogaster
gctttgatttcgc

SEQ ID NO: 630258 - DNA, 13 bp, D. melanogaster
gctttgatttctt

SEQ ID NO: 630259 - DNA, 13 bp, D. melanogaster
gctttgatttgat

SEQ ID NO: 630260 - DNA, 13 bp, D. melanogaster
gctttgattttaa

SEQ ID NO: 630261 - DNA, 13 bp, D. melanogaster
gctttgatttttg

SEQ ID NO: 630262 - DNA, 13 bp, D. melanogaster
gctttgcaaaaaa

SEQ ID NO: 630263 - DNA, 13 bp, D. melanogaster
gctttgcaaatta

SEQ ID NO: 630264 - DNA, 14 bp, D. melanogaster
gctttgcaaattag

SEQ ID NO: 630265 - DNA, 13 bp, D. melanogaster
gctttgcatgcca

SEQ ID NO: 630266 - DNA, 13 bp, D. melanogaster
gctttgcattgct

SEQ ID NO: 630267 - DNA, 13 bp, D. melanogaster
gctttgcctttga

SEQ ID NO: 630268 - DNA, 13 bp, D. melanogaster
gctttgcctttgt

SEQ ID NO: 630269 - DNA, 13 bp, D. melanogaster
gctttgcgtttat

SEQ ID NO: 630270 - DNA, 13 bp, D. melanogaster
gctttgcttttgc

SEQ ID NO: 630271 - DNA, 13 bp, D. melanogaster
gctttggaaaatt

SEQ ID NO: 630272 - DNA, 14 bp, D. melanogaster
gctttggaatcatt

SEQ ID NO: 630273 - DNA, 13 bp, D. melanogaster
gctttggcaaatg

SEQ ID NO: 630274 - DNA, 13 bp, D. melanogaster
gctttggccaaat

SEQ ID NO: 630275 - DNA, 13 bp, D. melanogaster
gctttggccaggc

SEQ ID NO: 630276 - DNA, 13 bp, D. melanogaster
gctttggcgctgg

SEQ ID NO: 630277 - DNA, 14 bp, D. melanogaster
gctttggctaatta

SEQ ID NO: 630278 - DNA, 13 bp, D. melanogaster
gctttggcttcgg

SEQ ID NO: 630279 - DNA, 13 bp, D. melanogaster
gctttggctttcg

SEQ ID NO: 630280 - DNA, 13 bp, D. melanogaster
gctttggctttgc

SEQ ID NO: 630281 - DNA, 13 bp, D. melanogaster
gctttggctttgg

SEQ ID NO: 630282 - DNA, 13 bp, D. melanogaster
gctttggctttta

SEQ ID NO: 630283 - DNA, 13 bp, D. melanogaster
gctttggcttttg

SEQ ID NO: 630284 - DNA, 13 bp, D. melanogaster
gctttgggccaga

SEQ ID NO: 630285 - DNA, 13 bp, D. melanogaster
gctttgtaaatga

SEQ ID NO: 630286 - DNA, 13 bp, D. melanogaster
gctttgtatttta

SEQ ID NO: 630287 - DNA, 13 bp, D. melanogaster
gctttgttgactt

SEQ ID NO: 630288 - DNA, 14 bp, D. melanogaster
gctttgttgacttc

SEQ ID NO: 630289 - DNA, 13 bp, D. melanogaster
gctttgttgattt

SEQ ID NO: 630290 - DNA, 13 bp, D. melanogaster
gctttgtttgcca

SEQ ID NO: 630291 - DNA, 13 bp, D. melanogaster
gctttgtttggcc

SEQ ID NO: 630292 - DNA, 13 bp, D. melanogaster
gctttgtttgtgc

SEQ ID NO: 630293 - DNA, 14 bp, D. melanogaster
gctttgtttgttta

SEQ ID NO: 630294 - DNA, 13 bp, D. melanogaster
gctttgttttaaa

SEQ ID NO: 630295 - DNA, 13 bp, D. melanogaster
gctttgttttcaa

SEQ ID NO: 630296 - DNA, 13 bp, D. melanogaster
gcttttaaaaaat

SEQ ID NO: 630297 - DNA, 13 bp, D. melanogaster
gcttttaaaatga

SEQ ID NO: 630298 - DNA, 14 bp, D. melanogaster
gcttttaaataaaa

SEQ ID NO: 630299 - DNA, 13 bp, D. melanogaster
gcttttaaattta

SEQ ID NO: 630300 - DNA, 13 bp, D. melanogaster
gcttttaacattt

SEQ ID NO: 630301 - DNA, 13 bp, D. melanogaster
gcttttaagctgg

SEQ ID NO: 630302 - DNA, 13 bp, D. melanogaster
gcttttaatgcaa

SEQ ID NO: 630303 - DNA, 13 bp, D. melanogaster
gcttttaattgaa

SEQ ID NO: 630304 - DNA, 14 bp, D. melanogaster
gcttttaattgaaa

SEQ ID NO: 630305 - DNA, 13 bp, D. melanogaster
gcttttaattgat

SEQ ID NO: 630306 - DNA, 13 bp, D. melanogaster
gcttttagtttta

SEQ ID NO: 630307 - DNA, 13 bp, D. melanogaster
gcttttatatatt

SEQ ID NO: 630308 - DNA, 13 bp, D. melanogaster
gcttttattaatt

SEQ ID NO: 630309 - DNA, 13 bp, D. melanogaster
gcttttattatcg

SEQ ID NO: 630310 - DNA, 14 bp, D. melanogaster
gcttttattatcgt

SEQ ID NO: 630311 - DNA, 13 bp, D. melanogaster
gcttttattgcat

SEQ ID NO: 630312 - DNA, 13 bp, D. melanogaster
gcttttatttcgc

SEQ ID NO: 630313 - DNA, 13 bp, D. melanogaster
gcttttcaatatt

SEQ ID NO: 630314 - DNA, 14 bp, D. melanogaster
gcttttcaatattg

SEQ ID NO: 630315 - DNA, 13 bp, D. melanogaster
gcttttcaattaa

SEQ ID NO: 630316 - DNA, 13 bp, D. melanogaster
gcttttcaatttt

SEQ ID NO: 630317 - DNA, 14 bp, D. melanogaster
gcttttcacttttc

SEQ ID NO: 630318 - DNA, 13 bp, D. melanogaster
gcttttcagcttt

SEQ ID NO: 630319 - DNA, 14 bp, D. melanogaster
gcttttcatttggc

SEQ ID NO: 630320 - DNA, 13 bp, D. melanogaster
gcttttcatttta

SEQ ID NO: 630321 - DNA, 13 bp, D. melanogaster
gcttttcattttg

SEQ ID NO: 630322 - DNA, 13 bp, D. melanogaster
gcttttccaaaaa

SEQ ID NO: 630323 - DNA, 13 bp, D. melanogaster
gcttttccaactg

SEQ ID NO: 630324 - DNA, 13 bp, D. melanogaster
gcttttccacact

SEQ ID NO: 630325 - DNA, 14 bp, D. melanogaster
gcttttccacccac

SEQ ID NO: 630326 - DNA, 13 bp, D. melanogaster
gcttttccacctt

SEQ ID NO: 630327 - DNA, 13 bp, D. melanogaster
gcttttccactgc

SEQ ID NO: 630328 - DNA, 14 bp, D. melanogaster
gcttttccactttt

SEQ ID NO: 630329 - DNA, 13 bp, D. melanogaster
gcttttccagcag

SEQ ID NO: 630330 - DNA, 13 bp, D. melanogaster
gcttttccagctc

SEQ ID NO: 630331 - DNA, 13 bp, D. melanogaster
gcttttccagctt

SEQ ID NO: 630332 - DNA, 13 bp, D. melanogaster
gcttttcccattc

SEQ ID NO: 630333 - DNA, 13 bp, D. melanogaster
gcttttcccgcct

SEQ ID NO: 630334 - DNA, 13 bp, D. melanogaster
gcttttcccgctc

SEQ ID NO: 630335 - DNA, 14 bp, D. melanogaster
gcttttcccgcttt

SEQ ID NO: 630336 - DNA, 13 bp, D. melanogaster
gcttttccgcatt

SEQ ID NO: 630337 - DNA, 13 bp, D. melanogaster
gcttttccgctcc

SEQ ID NO: 630338 - DNA, 13 bp, D. melanogaster
gcttttcgccttt

SEQ ID NO: 630339 - DNA, 13 bp, D. melanogaster
gcttttcgctcgt

SEQ ID NO: 630340 - DNA, 13 bp, D. melanogaster
gcttttctgctgc

SEQ ID NO: 630341 - DNA, 13 bp, D. melanogaster
gcttttcttcatt

SEQ ID NO: 630342 - DNA, 13 bp, D. melanogaster
gcttttcttgctc

SEQ ID NO: 630343 - DNA, 13 bp, D. melanogaster
gcttttctttggc

SEQ ID NO: 630344 - DNA, 13 bp, D. melanogaster
gcttttgaaaaat

SEQ ID NO: 630345 - DNA, 13 bp, D. melanogaster
gcttttgaaataa

SEQ ID NO: 630346 - DNA, 13 bp, D. melanogaster
gcttttgaagttt

SEQ ID NO: 630347 - DNA, 13 bp, D. melanogaster
gcttttgatctgg

SEQ ID NO: 630348 - DNA, 14 bp, D. melanogaster
gcttttgatctggt

SEQ ID NO: 630349 - DNA, 13 bp, D. melanogaster
gcttttgattttg

SEQ ID NO: 630350 - DNA, 13 bp, D. melanogaster
gcttttgcaaatt

SEQ ID NO: 630351 - DNA, 13 bp, D. melanogaster
gcttttgcatttt

SEQ ID NO: 630352 - DNA, 13 bp, D. melanogaster
gcttttgcgactg

SEQ ID NO: 630353 - DNA, 13 bp, D. melanogaster
gcttttgctattg

SEQ ID NO: 630354 - DNA, 14 bp, D. melanogaster
gcttttgctgcttt

SEQ ID NO: 630355 - DNA, 13 bp, D. melanogaster
gcttttgctttcg

SEQ ID NO: 630356 - DNA, 13 bp, D. melanogaster
gcttttgctttgc

SEQ ID NO: 630357 - DNA, 14 bp, D. melanogaster
gcttttgctttggc

SEQ ID NO: 630358 - DNA, 14 bp, D. melanogaster
gcttttgcttttgc

SEQ ID NO: 630359 - DNA, 13 bp, D. melanogaster
gcttttggcattt

SEQ ID NO: 630360 - DNA, 14 bp, D. melanogaster
gcttttggccaaaa

SEQ ID NO: 630361 - DNA, 14 bp, D. melanogaster
gcttttggccaact

SEQ ID NO: 630362 - DNA, 14 bp, D. melanogaster
gcttttggccattt

SEQ ID NO: 630363 - DNA, 13 bp, D. melanogaster
gcttttggcctgg

SEQ ID NO: 630364 - DNA, 13 bp, D. melanogaster
gcttttggctctg

SEQ ID NO: 630365 - DNA, 13 bp, D. melanogaster
gcttttggcttta

SEQ ID NO: 630366 - DNA, 13 bp, D. melanogaster
gcttttgggccaa

SEQ ID NO: 630367 - DNA, 13 bp, D. melanogaster
gcttttggggcga

SEQ ID NO: 630368 - DNA, 13 bp, D. melanogaster
gcttttgggggct

SEQ ID NO: 630369 - DNA, 13 bp, D. melanogaster
gcttttgggtggc

SEQ ID NO: 630370 - DNA, 13 bp, D. melanogaster
gcttttggtattt

SEQ ID NO: 630371 - DNA, 13 bp, D. melanogaster
gcttttgtaattg

SEQ ID NO: 630372 - DNA, 13 bp, D. melanogaster
gcttttgtcattt

SEQ ID NO: 630373 - DNA, 13 bp, D. melanogaster
gcttttgtcgctg

SEQ ID NO: 630374 - DNA, 13 bp, D. melanogaster
gcttttgtctctg

SEQ ID NO: 630375 - DNA, 13 bp, D. melanogaster
gcttttgtctgtc

SEQ ID NO: 630376 - DNA, 14 bp, D. melanogaster
gcttttgtctgtcg

SEQ ID NO: 630377 - DNA, 13 bp, D. melanogaster
gcttttgtgcaat

SEQ ID NO: 630378 - DNA, 13 bp, D. melanogaster
gcttttgtgcatt

SEQ ID NO: 630379 - DNA, 13 bp, D. melanogaster
gcttttgtggctt

SEQ ID NO: 630380 - DNA, 13 bp, D. melanogaster
gcttttgttaatt

SEQ ID NO: 630381 - DNA, 13 bp, D. melanogaster
gcttttgttgcca

SEQ ID NO: 630382 - DNA, 13 bp, D. melanogaster
gcttttgttggcc

SEQ ID NO: 630383 - DNA, 13 bp, D. melanogaster
gcttttgtttatg

SEQ ID NO: 630384 - DNA, 13 bp, D. melanogaster
gcttttgtttcga

SEQ ID NO: 630385 - DNA, 14 bp, D. melanogaster
gcttttgtttcgcc

SEQ ID NO: 630386 - DNA, 14 bp, D. melanogaster
gcttttgtttgtta

SEQ ID NO: 630387 - DNA, 13 bp, D. melanogaster
gctttttaaaaca

SEQ ID NO: 630388 - DNA, 13 bp, D. melanogaster
gctttttaatgaa

SEQ ID NO: 630389 - DNA, 13 bp, D. melanogaster
gctttttacattt

SEQ ID NO: 630390 - DNA, 13 bp, D. melanogaster
gctttttatagcc

SEQ ID NO: 630391 - DNA, 13 bp, D. melanogaster
gctttttatggcc

SEQ ID NO: 630392 - DNA, 13 bp, D. melanogaster
gctttttgacatt

SEQ ID NO: 630393 - DNA, 13 bp, D. melanogaster
gctttttgctggc

SEQ ID NO: 630394 - DNA, 13 bp, D. melanogaster
gctttttggattt

SEQ ID NO: 630395 - DNA, 13 bp, D. melanogaster
gctttttggccag

SEQ ID NO: 630396 - DNA, 13 bp, D. melanogaster
gctttttggcctg

SEQ ID NO: 630397 - DNA, 13 bp, D. melanogaster
gctttttgtcagc

SEQ ID NO: 630398 - DNA, 13 bp, D. melanogaster
gctttttgtggag

SEQ ID NO: 630399 - DNA, 14 bp, D. melanogaster
gctttttgtggaga

SEQ ID NO: 630400 - DNA, 13 bp, D. melanogaster
gctttttgttgcc

SEQ ID NO: 630401 - DNA, 13 bp, D. melanogaster
ggaaaaaacaatt

SEQ ID NO: 630402 - DNA, 13 bp, D. melanogaster
ggaaaaaactgaa

SEQ ID NO: 630403 - DNA, 14 bp, D. melanogaster
ggaaaaaactgaag

SEQ ID NO: 630404 - DNA, 13 bp, D. melanogaster
ggaaaaaagtttg

SEQ ID NO: 630405 - DNA, 13 bp, D. melanogaster
ggaaaaaatattc

SEQ ID NO: 630406 - DNA, 13 bp, D. melanogaster
ggaaaaaatccaa

SEQ ID NO: 630407 - DNA, 13 bp, D. melanogaster
ggaaaaaatcttt

SEQ ID NO: 630408 - DNA, 14 bp, D. melanogaster
ggaaaaaatcttta

SEQ ID NO: 630409 - DNA, 14 bp, D. melanogaster
ggaaaaaatgcaaa

SEQ ID NO: 630410 - DNA, 13 bp, D. melanogaster
ggaaaaaatggtt

SEQ ID NO: 630411 - DNA, 13 bp, D. melanogaster
ggaaaaaatgttg

SEQ ID NO: 630412 - DNA, 13 bp, D. melanogaster
ggaaaaaattcaa

SEQ ID NO: 630413 - DNA, 13 bp, D. melanogaster
ggaaaaacaaatg

SEQ ID NO: 630414 - DNA, 13 bp, D. melanogaster
ggaaaaacaatgc

SEQ ID NO: 630415 - DNA, 13 bp, D. melanogaster
ggaaaaacaatta

SEQ ID NO: 630416 - DNA, 13 bp, D. melanogaster
ggaaaaacaccga

SEQ ID NO: 630417 - DNA, 13 bp, D. melanogaster
ggaaaaacatcat

SEQ ID NO: 630418 - DNA, 13 bp, D. melanogaster
ggaaaaacccttt

SEQ ID NO: 630419 - DNA, 13 bp, D. melanogaster
ggaaaaacggatt

SEQ ID NO: 630420 - DNA, 13 bp, D. melanogaster
ggaaaaactagaa

SEQ ID NO: 630421 - DNA, 13 bp, D. melanogaster
ggaaaaactcaat

SEQ ID NO: 630422 - DNA, 13 bp, D. melanogaster
ggaaaaactgaaa

SEQ ID NO: 630423 - DNA, 13 bp, D. melanogaster
ggaaaaactgcac

SEQ ID NO: 630424 - DNA, 13 bp, D. melanogaster
ggaaaaactggca

SEQ ID NO: 630425 - DNA, 14 bp, D. melanogaster
ggaaaaacttcacc

SEQ ID NO: 630426 - DNA, 13 bp, D. melanogaster
ggaaaaactttta

SEQ ID NO: 630427 - DNA, 14 bp, D. melanogaster
ggaaaaacttttgc

SEQ ID NO: 630428 - DNA, 13 bp, D. melanogaster
ggaaaaagtgcaa

SEQ ID NO: 630429 - DNA, 13 bp, D. melanogaster
ggaaaaagtttta

SEQ ID NO: 630430 - DNA, 13 bp, D. melanogaster
ggaaaaagttttt

SEQ ID NO: 630431 - DNA, 13 bp, D. melanogaster
ggaaaaatcagtt

SEQ ID NO: 630432 - DNA, 13 bp, D. melanogaster
ggaaaaatcgaat

SEQ ID NO: 630433 - DNA, 13 bp, D. melanogaster
ggaaaaatcgagt

SEQ ID NO: 630434 - DNA, 13 bp, D. melanogaster
ggaaaaatcggaa

SEQ ID NO: 630435 - DNA, 13 bp, D. melanogaster
ggaaaaatctgag

SEQ ID NO: 630436 - DNA, 14 bp, D. melanogaster
ggaaaaatctgagt

SEQ ID NO: 630437 - DNA, 13 bp, D. melanogaster
ggaaaaatgcaaa

SEQ ID NO: 630438 - DNA, 13 bp, D. melanogaster
ggaaaaatgctgg

SEQ ID NO: 630439 - DNA, 13 bp, D. melanogaster
ggaaaaatgtgaa

SEQ ID NO: 630440 - DNA, 13 bp, D. melanogaster
ggaaaaattcaat

SEQ ID NO: 630441 - DNA, 13 bp, D. melanogaster
ggaaaaattcgaa

SEQ ID NO: 630442 - DNA, 13 bp, D. melanogaster
ggaaaaattgcaa

SEQ ID NO: 630443 - DNA, 14 bp, D. melanogaster
ggaaaacaaaaagt

SEQ ID NO: 630444 - DNA, 14 bp, D. melanogaster
ggaaaacaaaatgt

SEQ ID NO: 630445 - DNA, 13 bp, D. melanogaster
ggaaaacaaacta

SEQ ID NO: 630446 - DNA, 13 bp, D. melanogaster
ggaaaacaatgca

SEQ ID NO: 630447 - DNA, 13 bp, D. melanogaster
ggaaaacaattta

SEQ ID NO: 630448 - DNA, 13 bp, D. melanogaster
ggaaaacaatttt

SEQ ID NO: 630449 - DNA, 13 bp, D. melanogaster
ggaaaacacacac

SEQ ID NO: 630450 - DNA, 13 bp, D. melanogaster
ggaaaacactttc

SEQ ID NO: 630451 - DNA, 13 bp, D. melanogaster
ggaaaacactttt

SEQ ID NO: 630452 - DNA, 13 bp, D. melanogaster
ggaaaacataaat

SEQ ID NO: 630453 - DNA, 13 bp, D. melanogaster
ggaaaacatcaaa

SEQ ID NO: 630454 - DNA, 13 bp, D. melanogaster
ggaaaacatgaaa

SEQ ID NO: 630455 - DNA, 13 bp, D. melanogaster
ggaaaacattaaa

SEQ ID NO: 630456 - DNA, 13 bp, D. melanogaster
ggaaaacattgaa

SEQ ID NO: 630457 - DNA, 13 bp, D. melanogaster
ggaaaacattgtt

SEQ ID NO: 630458 - DNA, 13 bp, D. melanogaster
ggaaaacatttaa

SEQ ID NO: 630459 - DNA, 14 bp, D. melanogaster
ggaaaacatttaaa

SEQ ID NO: 630460 - DNA, 13 bp, D. melanogaster
ggaaaacatttcg

SEQ ID NO: 630461 - DNA, 13 bp, D. melanogaster
ggaaaaccaaagc

SEQ ID NO: 630462 - DNA, 13 bp, D. melanogaster
ggaaaaccaaatg

SEQ ID NO: 630463 - DNA, 13 bp, D. melanogaster
ggaaaaccaatta

SEQ ID NO: 630464 - DNA, 13 bp, D. melanogaster
ggaaaaccagttt

SEQ ID NO: 630465 - DNA, 13 bp, D. melanogaster
ggaaaacccattt

SEQ ID NO: 630466 - DNA, 13 bp, D. melanogaster
ggaaaaccccaat

SEQ ID NO: 630467 - DNA, 13 bp, D. melanogaster
ggaaaaccctttt

SEQ ID NO: 630468 - DNA, 13 bp, D. melanogaster
ggaaaaccgagga

SEQ ID NO: 630469 - DNA, 13 bp, D. melanogaster
ggaaaacgaaact

SEQ ID NO: 630470 - DNA, 13 bp, D. melanogaster
ggaaaacgaaata

SEQ ID NO: 630471 - DNA, 13 bp, D. melanogaster
ggaaaacgaaatg

SEQ ID NO: 630472 - DNA, 13 bp, D. melanogaster
ggaaaacgaacat

SEQ ID NO: 630473 - DNA, 13 bp, D. melanogaster
ggaaaacgacaag

SEQ ID NO: 630474 - DNA, 14 bp, D. melanogaster
ggaaaacggaaaat

SEQ ID NO: 630475 - DNA, 13 bp, D. melanogaster
ggaaaacggaatg

SEQ ID NO: 630476 - DNA, 13 bp, D. melanogaster
ggaaaactaaaca

SEQ ID NO: 630477 - DNA, 13 bp, D. melanogaster
ggaaaactacacg

SEQ ID NO: 630478 - DNA, 13 bp, D. melanogaster
ggaaaactatttt

SEQ ID NO: 630479 - DNA, 13 bp, D. melanogaster
ggaaaactcaaaa

SEQ ID NO: 630480 - DNA, 13 bp, D. melanogaster
ggaaaactcatta

SEQ ID NO: 630481 - DNA, 13 bp, D. melanogaster
ggaaaactcattt

SEQ ID NO: 630482 - DNA, 13 bp, D. melanogaster
ggaaaactctggc

SEQ ID NO: 630483 - DNA, 13 bp, D. melanogaster
ggaaaactgaaaa

SEQ ID NO: 630484 - DNA, 14 bp, D. melanogaster
ggaaaactgaaaac

SEQ ID NO: 630485 - DNA, 13 bp, D. melanogaster
ggaaaactgctgc

SEQ ID NO: 630486 - DNA, 13 bp, D. melanogaster
ggaaaactgggaa

SEQ ID NO: 630487 - DNA, 13 bp, D. melanogaster
ggaaaactggttt

SEQ ID NO: 630488 - DNA, 13 bp, D. melanogaster
ggaaaactgttcg

SEQ ID NO: 630489 - DNA, 13 bp, D. melanogaster
ggaaaactgtttg

SEQ ID NO: 630490 - DNA, 13 bp, D. melanogaster
ggaaaacttaaaa

SEQ ID NO: 630491 - DNA, 13 bp, D. melanogaster
ggaaaacttaata

SEQ ID NO: 630492 - DNA, 13 bp, D. melanogaster
ggaaaacttgaaa

SEQ ID NO: 630493 - DNA, 13 bp, D. melanogaster
ggaaaactttaac

SEQ ID NO: 630494 - DNA, 13 bp, D. melanogaster
ggaaaactttatt

SEQ ID NO: 630495 - DNA, 13 bp, D. melanogaster
ggaaaactttcac

SEQ ID NO: 630496 - DNA, 13 bp, D. melanogaster
ggaaaactttgca

SEQ ID NO: 630497 - DNA, 14 bp, D. melanogaster
ggaaaacttttaaa

SEQ ID NO: 630498 - DNA, 14 bp, D. melanogaster
ggaaaacttttcaa

SEQ ID NO: 630499 - DNA, 14 bp, D. melanogaster
ggaaaacttttgcc

SEQ ID NO: 630500 - DNA, 13 bp, D. melanogaster
ggaaaacttttta

SEQ ID NO: 630501 - DNA, 14 bp, D. melanogaster
ggaaaactttttgc

SEQ ID NO: 630502 - DNA, 13 bp, D. melanogaster
ggaaaagaacaat

SEQ ID NO: 630503 - DNA, 14 bp, D. melanogaster
ggaaaagagatggc

SEQ ID NO: 630504 - DNA, 13 bp, D. melanogaster
ggaaaagcaacag

SEQ ID NO: 630505 - DNA, 13 bp, D. melanogaster
ggaaaagcacttg

SEQ ID NO: 630506 - DNA, 13 bp, D. melanogaster
ggaaaagcagcag

SEQ ID NO: 630507 - DNA, 13 bp, D. melanogaster
ggaaaagcatttt

SEQ ID NO: 630508 - DNA, 13 bp, D. melanogaster
ggaaaagccagaa

SEQ ID NO: 630509 - DNA, 14 bp, D. melanogaster
ggaaaagccagaag

SEQ ID NO: 630510 - DNA, 13 bp, D. melanogaster
ggaaaagccagag

SEQ ID NO: 630511 - DNA, 13 bp, D. melanogaster
ggaaaagccggaa

SEQ ID NO: 630512 - DNA, 13 bp, D. melanogaster
ggaaaagcgaaca

SEQ ID NO: 630513 - DNA, 13 bp, D. melanogaster
ggaaaagcgatgg

SEQ ID NO: 630514 - DNA, 13 bp, D. melanogaster
ggaaaagcgcagc

SEQ ID NO: 630515 - DNA, 13 bp, D. melanogaster
ggaaaagcgcagg

SEQ ID NO: 630516 - DNA, 13 bp, D. melanogaster
ggaaaagcggcag

SEQ ID NO: 630517 - DNA, 13 bp, D. melanogaster
ggaaaagcggcgg

SEQ ID NO: 630518 - DNA, 13 bp, D. melanogaster
ggaaaagcgggcg

SEQ ID NO: 630519 - DNA, 13 bp, D. melanogaster
ggaaaagcgggtg

SEQ ID NO: 630520 - DNA, 13 bp, D. melanogaster
ggaaaagcggtgg

SEQ ID NO: 630521 - DNA, 13 bp, D. melanogaster
ggaaaagcggttg

SEQ ID NO: 630522 - DNA, 13 bp, D. melanogaster
ggaaaagcgttgg

SEQ ID NO: 630523 - DNA, 13 bp, D. melanogaster
ggaaaagctgaaa

SEQ ID NO: 630524 - DNA, 14 bp, D. melanogaster
ggaaaagctgaaaa

SEQ ID NO: 630525 - DNA, 13 bp, D. melanogaster
ggaaaagctggaa

SEQ ID NO: 630526 - DNA, 14 bp, D. melanogaster
ggaaaagctggaaa

SEQ ID NO: 630527 - DNA, 13 bp, D. melanogaster
ggaaaagctggga

SEQ ID NO: 630528 - DNA, 14 bp, D. melanogaster
ggaaaagcttcaaa

SEQ ID NO: 630529 - DNA, 13 bp, D. melanogaster
ggaaaaggcacaa

SEQ ID NO: 630530 - DNA, 13 bp, D. melanogaster
ggaaaaggccaaa

SEQ ID NO: 630531 - DNA, 13 bp, D. melanogaster
ggaaaaggtgcat

SEQ ID NO: 630532 - DNA, 13 bp, D. melanogaster
ggaaaagtatgag

SEQ ID NO: 630533 - DNA, 13 bp, D. melanogaster
ggaaaagtatttt

SEQ ID NO: 630534 - DNA, 13 bp, D. melanogaster
ggaaaagtcggga

SEQ ID NO: 630535 - DNA, 13 bp, D. melanogaster
ggaaaagtgcaaa

SEQ ID NO: 630536 - DNA, 13 bp, D. melanogaster
ggaaaagtgcagc

SEQ ID NO: 630537 - DNA, 13 bp, D. melanogaster
ggaaaagtgcagg

SEQ ID NO: 630538 - DNA, 13 bp, D. melanogaster
ggaaaagtgcatt

SEQ ID NO: 630539 - DNA, 13 bp, D. melanogaster
ggaaaagtgcggg

SEQ ID NO: 630540 - DNA, 13 bp, D. melanogaster
ggaaaagtgctgg

SEQ ID NO: 630541 - DNA, 13 bp, D. melanogaster
ggaaaagtggcaa

SEQ ID NO: 630542 - DNA, 13 bp, D. melanogaster
ggaaaagtgggcg

SEQ ID NO: 630543 - DNA, 14 bp, D. melanogaster
ggaaaagtgggcgg

SEQ ID NO: 630544 - DNA, 13 bp, D. melanogaster
ggaaaagtgggtg

SEQ ID NO: 630545 - DNA, 13 bp, D. melanogaster
ggaaaagtggtgg

SEQ ID NO: 630546 - DNA, 13 bp, D. melanogaster
ggaaaagtgtgtg

SEQ ID NO: 630547 - DNA, 13 bp, D. melanogaster
ggaaaagtgtttt

SEQ ID NO: 630548 - DNA, 13 bp, D. melanogaster
ggaaaagttgcca

SEQ ID NO: 630549 - DNA, 13 bp, D. melanogaster
ggaaaagttgctc

SEQ ID NO: 630550 - DNA, 13 bp, D. melanogaster
ggaaaagtttaaa

SEQ ID NO: 630551 - DNA, 13 bp, D. melanogaster
ggaaaagtttcga

SEQ ID NO: 630552 - DNA, 13 bp, D. melanogaster
ggaaaagtttgca

SEQ ID NO: 630553 - DNA, 13 bp, D. melanogaster
ggaaaagtttgct

SEQ ID NO: 630554 - DNA, 13 bp, D. melanogaster
ggaaaagtttttg

SEQ ID NO: 630555 - DNA, 13 bp, D. melanogaster
ggaaaagtttttt

SEQ ID NO: 630556 - DNA, 13 bp, D. melanogaster
ggaaaataaatca

SEQ ID NO: 630557 - DNA, 13 bp, D. melanogaster
ggaaaataaattt

SEQ ID NO: 630558 - DNA, 13 bp, D. melanogaster
ggaaaataataca

SEQ ID NO: 630559 - DNA, 13 bp, D. melanogaster
ggaaaataatgca

SEQ ID NO: 630560 - DNA, 13 bp, D. melanogaster
ggaaaataattca

SEQ ID NO: 630561 - DNA, 13 bp, D. melanogaster
ggaaaataattta

SEQ ID NO: 630562 - DNA, 13 bp, D. melanogaster
ggaaaatacaatt

SEQ ID NO: 630563 - DNA, 13 bp, D. melanogaster
ggaaaatagttga

SEQ ID NO: 630564 - DNA, 13 bp, D. melanogaster
ggaaaatagttgc

SEQ ID NO: 630565 - DNA, 13 bp, D. melanogaster
ggaaaatatatgg

SEQ ID NO: 630566 - DNA, 13 bp, D. melanogaster
ggaaaatattaca

SEQ ID NO: 630567 - DNA, 14 bp, D. melanogaster
ggaaaatattcaaa

SEQ ID NO: 630568 - DNA, 13 bp, D. melanogaster
ggaaaatattcca

SEQ ID NO: 630569 - DNA, 13 bp, D. melanogaster
ggaaaatattgaa

SEQ ID NO: 630570 - DNA, 13 bp, D. melanogaster
ggaaaatatttat

SEQ ID NO: 630571 - DNA, 13 bp, D. melanogaster
ggaaaatcaaaca

SEQ ID NO: 630572 - DNA, 13 bp, D. melanogaster
ggaaaatcaaagc

SEQ ID NO: 630573 - DNA, 13 bp, D. melanogaster
ggaaaatcaaatt

SEQ ID NO: 630574 - DNA, 13 bp, D. melanogaster
ggaaaatcaacaa

SEQ ID NO: 630575 - DNA, 13 bp, D. melanogaster
ggaaaatcaagtt

SEQ ID NO: 630576 - DNA, 13 bp, D. melanogaster
ggaaaatcaataa

SEQ ID NO: 630577 - DNA, 13 bp, D. melanogaster
ggaaaatcaatca

SEQ ID NO: 630578 - DNA, 13 bp, D. melanogaster
ggaaaatcaattt

SEQ ID NO: 630579 - DNA, 13 bp, D. melanogaster
ggaaaatcacatt

SEQ ID NO: 630580 - DNA, 14 bp, D. melanogaster
ggaaaatcaggaaa

SEQ ID NO: 630581 - DNA, 13 bp, D. melanogaster
ggaaaatcatttg

SEQ ID NO: 630582 - DNA, 13 bp, D. melanogaster
ggaaaatcatttt

SEQ ID NO: 630583 - DNA, 13 bp, D. melanogaster
ggaaaatccaaaa

SEQ ID NO: 630584 - DNA, 13 bp, D. melanogaster
ggaaaatccactt

SEQ ID NO: 630585 - DNA, 14 bp, D. melanogaster
ggaaaatcgaaaaa

SEQ ID NO: 630586 - DNA, 13 bp, D. melanogaster
ggaaaatcgaaat

SEQ ID NO: 630587 - DNA, 14 bp, D. melanogaster
ggaaaatcgaaatt

SEQ ID NO: 630588 - DNA, 13 bp, D. melanogaster
ggaaaatcgagaa

SEQ ID NO: 630589 - DNA, 14 bp, D. melanogaster
ggaaaatcgaggaa

SEQ ID NO: 630590 - DNA, 13 bp, D. melanogaster
ggaaaatcgcaaa

SEQ ID NO: 630591 - DNA, 13 bp, D. melanogaster
ggaaaatcgctgg

SEQ ID NO: 630592 - DNA, 13 bp, D. melanogaster
ggaaaatcggaaa

SEQ ID NO: 630593 - DNA, 14 bp, D. melanogaster
ggaaaatcgggaaa

SEQ ID NO: 630594 - DNA, 13 bp, D. melanogaster
ggaaaatcgggga

SEQ ID NO: 630595 - DNA, 14 bp, D. melanogaster
ggaaaatcggggaa

SEQ ID NO: 630596 - DNA, 13 bp, D. melanogaster
ggaaaatcggtgg

SEQ ID NO: 630597 - DNA, 13 bp, D. melanogaster
ggaaaatcgtttt

SEQ ID NO: 630598 - DNA, 13 bp, D. melanogaster
ggaaaatctgttt

SEQ ID NO: 630599 - DNA, 13 bp, D. melanogaster
ggaaaatctttta

SEQ ID NO: 630600 - DNA, 13 bp, D. melanogaster
ggaaaatcttttc

SEQ ID NO: 630601 - DNA, 13 bp, D. melanogaster
ggaaaatgacaaa

SEQ ID NO: 630602 - DNA, 13 bp, D. melanogaster
ggaaaatgagtgg

SEQ ID NO: 630603 - DNA, 13 bp, D. melanogaster
ggaaaatgatgaa

SEQ ID NO: 630604 - DNA, 14 bp, D. melanogaster
ggaaaatgcaaaaa

SEQ ID NO: 630605 - DNA, 14 bp, D. melanogaster
ggaaaatgcaaatt

SEQ ID NO: 630606 - DNA, 14 bp, D. melanogaster
ggaaaatgcaattt

SEQ ID NO: 630607 - DNA, 13 bp, D. melanogaster
ggaaaatgcagaa

SEQ ID NO: 630608 - DNA, 13 bp, D. melanogaster
ggaaaatgcagca

SEQ ID NO: 630609 - DNA, 13 bp, D. melanogaster
ggaaaatgcagcg

SEQ ID NO: 630610 - DNA, 13 bp, D. melanogaster
ggaaaatgcattt

SEQ ID NO: 630611 - DNA, 14 bp, D. melanogaster
ggaaaatgcatttt

SEQ ID NO: 630612 - DNA, 13 bp, D. melanogaster
ggaaaatgcccaa

SEQ ID NO: 630613 - DNA, 13 bp, D. melanogaster
ggaaaatgccgaa

SEQ ID NO: 630614 - DNA, 13 bp, D. melanogaster
ggaaaatgcgaaa

SEQ ID NO: 630615 - DNA, 13 bp, D. melanogaster
ggaaaatgcgatg

SEQ ID NO: 630616 - DNA, 13 bp, D. melanogaster
ggaaaatgcgggg

SEQ ID NO: 630617 - DNA, 13 bp, D. melanogaster
ggaaaatgctgaa

SEQ ID NO: 630618 - DNA, 13 bp, D. melanogaster
ggaaaatgctgca

SEQ ID NO: 630619 - DNA, 13 bp, D. melanogaster
ggaaaatgctgga

SEQ ID NO: 630620 - DNA, 13 bp, D. melanogaster
ggaaaatgctggc

SEQ ID NO: 630621 - DNA, 13 bp, D. melanogaster
ggaaaatgcttaa

SEQ ID NO: 630622 - DNA, 14 bp, D. melanogaster
ggaaaatggaaatg

SEQ ID NO: 630623 - DNA, 13 bp, D. melanogaster
ggaaaatggaatg

SEQ ID NO: 630624 - DNA, 13 bp, D. melanogaster
ggaaaatggatgg

SEQ ID NO: 630625 - DNA, 13 bp, D. melanogaster
ggaaaatggcaca

SEQ ID NO: 630626 - DNA, 13 bp, D. melanogaster
ggaaaatggccaa

SEQ ID NO: 630627 - DNA, 13 bp, D. melanogaster
ggaaaatggccag

SEQ ID NO: 630628 - DNA, 13 bp, D. melanogaster
ggaaaatggctga

SEQ ID NO: 630629 - DNA, 13 bp, D. melanogaster
ggaaaatgggcaa

SEQ ID NO: 630630 - DNA, 13 bp, D. melanogaster
ggaaaatgggcag

SEQ ID NO: 630631 - DNA, 13 bp, D. melanogaster
ggaaaatgggtgg

SEQ ID NO: 630632 - DNA, 13 bp, D. melanogaster
ggaaaatggtgga

SEQ ID NO: 630633 - DNA, 13 bp, D. melanogaster
ggaaaatggttaa

SEQ ID NO: 630634 - DNA, 13 bp, D. melanogaster
ggaaaatgtaaat

SEQ ID NO: 630635 - DNA, 13 bp, D. melanogaster
ggaaaatgtatat

SEQ ID NO: 630636 - DNA, 13 bp, D. melanogaster
ggaaaatgtatgc

SEQ ID NO: 630637 - DNA, 13 bp, D. melanogaster
ggaaaatgtcaaa

SEQ ID NO: 630638 - DNA, 13 bp, D. melanogaster
ggaaaatgtgaaa

SEQ ID NO: 630639 - DNA, 13 bp, D. melanogaster
ggaaaatgtgaat

SEQ ID NO: 630640 - DNA, 13 bp, D. melanogaster
ggaaaatgtgcaa

SEQ ID NO: 630641 - DNA, 13 bp, D. melanogaster
ggaaaatgtgcag

SEQ ID NO: 630642 - DNA, 14 bp, D. melanogaster
ggaaaatgtggaaa

SEQ ID NO: 630643 - DNA, 13 bp, D. melanogaster
ggaaaatgtgtgc

SEQ ID NO: 630644 - DNA, 13 bp, D. melanogaster
ggaaaatgttaat

SEQ ID NO: 630645 - DNA, 13 bp, D. melanogaster
ggaaaatgttcca

SEQ ID NO: 630646 - DNA, 13 bp, D. melanogaster
ggaaaatgttggg

SEQ ID NO: 630647 - DNA, 13 bp, D. melanogaster
ggaaaatgtttca

SEQ ID NO: 630648 - DNA, 13 bp, D. melanogaster
ggaaaatgtttgc

SEQ ID NO: 630649 - DNA, 13 bp, D. melanogaster
ggaaaatgtttgg

SEQ ID NO: 630650 - DNA, 13 bp, D. melanogaster
ggaaaattaattt

SEQ ID NO: 630651 - DNA, 13 bp, D. melanogaster
ggaaaattcaaat

SEQ ID NO: 630652 - DNA, 14 bp, D. melanogaster
ggaaaattcaaatt

SEQ ID NO: 630653 - DNA, 13 bp, D. melanogaster
ggaaaattcagca

SEQ ID NO: 630654 - DNA, 13 bp, D. melanogaster
ggaaaattcgttt

SEQ ID NO: 630655 - DNA, 13 bp, D. melanogaster
ggaaaattctatt

SEQ ID NO: 630656 - DNA, 13 bp, D. melanogaster
ggaaaattgcaaa

SEQ ID NO: 630657 - DNA, 13 bp, D. melanogaster
ggaaaattgcatt

SEQ ID NO: 630658 - DNA, 14 bp, D. melanogaster
ggaaaattgcattt

SEQ ID NO: 630659 - DNA, 13 bp, D. melanogaster
ggaaaattgccaa

SEQ ID NO: 630660 - DNA, 14 bp, D. melanogaster
ggaaaattgtaatg

SEQ ID NO: 630661 - DNA, 13 bp, D. melanogaster
ggaaaattgttca

SEQ ID NO: 630662 - DNA, 13 bp, D. melanogaster
ggaaaattgttgc

SEQ ID NO: 630663 - DNA, 13 bp, D. melanogaster
ggaaaatttcatt

SEQ ID NO: 630664 - DNA, 13 bp, D. melanogaster
ggaaaatttgcaa

SEQ ID NO: 630665 - DNA, 13 bp, D. melanogaster
ggaaacaaaaact

SEQ ID NO: 630666 - DNA, 13 bp, D. melanogaster
ggaaacaaaaagt

SEQ ID NO: 630667 - DNA, 13 bp, D. melanogaster
ggaaacaaaatga

SEQ ID NO: 630668 - DNA, 13 bp, D. melanogaster
ggaaacaaatcaa

SEQ ID NO: 630669 - DNA, 13 bp, D. melanogaster
ggaaacaactgca

SEQ ID NO: 630670 - DNA, 13 bp, D. melanogaster
ggaaacaagagtt

SEQ ID NO: 630671 - DNA, 13 bp, D. melanogaster
ggaaacaagccga

SEQ ID NO: 630672 - DNA, 13 bp, D. melanogaster
ggaaacaataaat

SEQ ID NO: 630673 - DNA, 13 bp, D. melanogaster
ggaaacaatcttt

SEQ ID NO: 630674 - DNA, 13 bp, D. melanogaster
ggaaacaattgca

SEQ ID NO: 630675 - DNA, 14 bp, D. melanogaster
ggaaacagaggccg

SEQ ID NO: 630676 - DNA, 13 bp, D. melanogaster
ggaaacagttgtt

SEQ ID NO: 630677 - DNA, 13 bp, D. melanogaster
ggaaacattgcat

SEQ ID NO: 630678 - DNA, 13 bp, D. melanogaster
ggaaacatttaaa

SEQ ID NO: 630679 - DNA, 13 bp, D. melanogaster
ggaaacattttaa

SEQ ID NO: 630680 - DNA, 13 bp, D. melanogaster
ggaaaccaacagg

SEQ ID NO: 630681 - DNA, 13 bp, D. melanogaster
ggaaaccgaaaac

SEQ ID NO: 630682 - DNA, 13 bp, D. melanogaster
ggaaaccgcagag

SEQ ID NO: 630683 - DNA, 13 bp, D. melanogaster
ggaaaccgcatcg

SEQ ID NO: 630684 - DNA, 13 bp, D. melanogaster
ggaaaccgctgct

SEQ ID NO: 630685 - DNA, 13 bp, D. melanogaster
ggaaacgctttct

SEQ ID NO: 630686 - DNA, 13 bp, D. melanogaster
ggaaacggaaaat

SEQ ID NO: 630687 - DNA, 13 bp, D. melanogaster
ggaaacggaaaca

SEQ ID NO: 630688 - DNA, 13 bp, D. melanogaster
ggaaacggaaacc

SEQ ID NO: 630689 - DNA, 14 bp, D. melanogaster
ggaaacggaaacgc

SEQ ID NO: 630690 - DNA, 13 bp, D. melanogaster
ggaaacggaagta

SEQ ID NO: 630691 - DNA, 13 bp, D. melanogaster
ggaaactaataaa

SEQ ID NO: 630692 - DNA, 14 bp, D. melanogaster
ggaaactcgactat

SEQ ID NO: 630693 - DNA, 14 bp, D. melanogaster
ggaaactcttgaaa

SEQ ID NO: 630694 - DNA, 13 bp, D. melanogaster
ggaaactgaaaac

SEQ ID NO: 630695 - DNA, 13 bp, D. melanogaster
ggaaactgcagag

SEQ ID NO: 630696 - DNA, 13 bp, D. melanogaster
ggaaactggccaa

SEQ ID NO: 630697 - DNA, 13 bp, D. melanogaster
ggaaactgggaaa

SEQ ID NO: 630698 - DNA, 14 bp, D. melanogaster
ggaaacttttaaca

SEQ ID NO: 630699 - DNA, 13 bp, D. melanogaster
ggaaacttttaag

SEQ ID NO: 630700 - DNA, 13 bp, D. melanogaster
ggaaacttttcca

SEQ ID NO: 630701 - DNA, 13 bp, D. melanogaster
ggaaacttttcgc

SEQ ID NO: 630702 - DNA, 13 bp, D. melanogaster
ggaaactttttaa

SEQ ID NO: 630703 - DNA, 14 bp, D. melanogaster
ggaaagaaaattat

SEQ ID NO: 630704 - DNA, 13 bp, D. melanogaster
ggaaagaaaattc

SEQ ID NO: 630705 - DNA, 14 bp, D. melanogaster
ggaaagagagcaat

SEQ ID NO: 630706 - DNA, 13 bp, D. melanogaster
ggaaagcaattaa

SEQ ID NO: 630707 - DNA, 13 bp, D. melanogaster
ggaaagcagcagc

SEQ ID NO: 630708 - DNA, 13 bp, D. melanogaster
ggaaagcattttc

SEQ ID NO: 630709 - DNA, 14 bp, D. melanogaster
ggaaagctgctaga

SEQ ID NO: 630710 - DNA, 14 bp, D. melanogaster
ggaaagctgggaaa

SEQ ID NO: 630711 - DNA, 13 bp, D. melanogaster
ggaaaggaaaatc

SEQ ID NO: 630712 - DNA, 13 bp, D. melanogaster
ggaaaggcaacaa

SEQ ID NO: 630713 - DNA, 13 bp, D. melanogaster
ggaaaggcagcca

SEQ ID NO: 630714 - DNA, 14 bp, D. melanogaster
ggaaaggcagccaa

SEQ ID NO: 630715 - DNA, 14 bp, D. melanogaster
ggaaagggtggcgc

SEQ ID NO: 630716 - DNA, 13 bp, D. melanogaster
ggaaagtaaccaa

SEQ ID NO: 630717 - DNA, 13 bp, D. melanogaster
ggaaagtagccaa

SEQ ID NO: 630718 - DNA, 13 bp, D. melanogaster
ggaaagtatgcta

SEQ ID NO: 630719 - DNA, 14 bp, D. melanogaster
ggaaagtggaaagt

SEQ ID NO: 630720 - DNA, 13 bp, D. melanogaster
ggaaagtttcatt

SEQ ID NO: 630721 - DNA, 14 bp, D. melanogaster
ggaaagtttgcgaa

SEQ ID NO: 630722 - DNA, 13 bp, D. melanogaster
ggaaagttttaaa

SEQ ID NO: 630723 - DNA, 13 bp, D. melanogaster
ggaaagttttgac

SEQ ID NO: 630724 - DNA, 13 bp, D. melanogaster
ggaaataaaagcc

SEQ ID NO: 630725 - DNA, 14 bp, D. melanogaster
ggaaataaagttat

SEQ ID NO: 630726 - DNA, 13 bp, D. melanogaster
ggaaataaatgca

SEQ ID NO: 630727 - DNA, 13 bp, D. melanogaster
ggaaataattacc

SEQ ID NO: 630728 - DNA, 13 bp, D. melanogaster
ggaaataattgaa

SEQ ID NO: 630729 - DNA, 13 bp, D. melanogaster
ggaaatacaaatt

SEQ ID NO: 630730 - DNA, 13 bp, D. melanogaster
ggaaatacatata

SEQ ID NO: 630731 - DNA, 13 bp, D. melanogaster
ggaaatacgaaaa

SEQ ID NO: 630732 - DNA, 13 bp, D. melanogaster
ggaaatataaatt

SEQ ID NO: 630733 - DNA, 13 bp, D. melanogaster
ggaaatatatttc

SEQ ID NO: 630734 - DNA, 13 bp, D. melanogaster
ggaaatatgttta

SEQ ID NO: 630735 - DNA, 13 bp, D. melanogaster
ggaaatattgaaa

SEQ ID NO: 630736 - DNA, 13 bp, D. melanogaster
ggaaatatttaaa

SEQ ID NO: 630737 - DNA, 13 bp, D. melanogaster
ggaaatatttaat

SEQ ID NO: 630738 - DNA, 13 bp, D. melanogaster
ggaaatatttgta

SEQ ID NO: 630739 - DNA, 13 bp, D. melanogaster
ggaaatatttgtt

SEQ ID NO: 630740 - DNA, 13 bp, D. melanogaster
ggaaatattttgc

SEQ ID NO: 630741 - DNA, 13 bp, D. melanogaster
ggaaatatttttc

SEQ ID NO: 630742 - DNA, 13 bp, D. melanogaster
ggaaatcaaaaat

SEQ ID NO: 630743 - DNA, 13 bp, D. melanogaster
ggaaatcaaatca

SEQ ID NO: 630744 - DNA, 13 bp, D. melanogaster
ggaaatcaaattg

SEQ ID NO: 630745 - DNA, 13 bp, D. melanogaster
ggaaatcaaattt

SEQ ID NO: 630746 - DNA, 13 bp, D. melanogaster
ggaaatcaacttt

SEQ ID NO: 630747 - DNA, 13 bp, D. melanogaster
ggaaatcaagaca

SEQ ID NO: 630748 - DNA, 13 bp, D. melanogaster
ggaaatcaataaa

SEQ ID NO: 630749 - DNA, 13 bp, D. melanogaster
ggaaatcaattag

SEQ ID NO: 630750 - DNA, 13 bp, D. melanogaster
ggaaatcaatttt

SEQ ID NO: 630751 - DNA, 13 bp, D. melanogaster
ggaaatcataaaa

SEQ ID NO: 630752 - DNA, 13 bp, D. melanogaster
ggaaatcgaggaa

SEQ ID NO: 630753 - DNA, 13 bp, D. melanogaster
ggaaatcgattga

SEQ ID NO: 630754 - DNA, 14 bp, D. melanogaster
ggaaatcgattgat

SEQ ID NO: 630755 - DNA, 13 bp, D. melanogaster
ggaaatcggaaaa

SEQ ID NO: 630756 - DNA, 13 bp, D. melanogaster
ggaaatcgggaaa

SEQ ID NO: 630757 - DNA, 13 bp, D. melanogaster
ggaaatcggggaa

SEQ ID NO: 630758 - DNA, 13 bp, D. melanogaster
ggaaatctggact

SEQ ID NO: 630759 - DNA, 13 bp, D. melanogaster
ggaaatcttcaca

SEQ ID NO: 630760 - DNA, 13 bp, D. melanogaster
ggaaatgaaaacc

SEQ ID NO: 630761 - DNA, 13 bp, D. melanogaster
ggaaatgaaaatc

SEQ ID NO: 630762 - DNA, 13 bp, D. melanogaster
ggaaatgaaaatg

SEQ ID NO: 630763 - DNA, 14 bp, D. melanogaster
ggaaatgaaaatgg

SEQ ID NO: 630764 - DNA, 13 bp, D. melanogaster
ggaaatgaaatca

SEQ ID NO: 630765 - DNA, 14 bp, D. melanogaster
ggaaatgaatataa

SEQ ID NO: 630766 - DNA, 13 bp, D. melanogaster
ggaaatgaattag

SEQ ID NO: 630767 - DNA, 13 bp, D. melanogaster
ggaaatgaattta

SEQ ID NO: 630768 - DNA, 13 bp, D. melanogaster
ggaaatgattttt

SEQ ID NO: 630769 - DNA, 13 bp, D. melanogaster
ggaaatgcaaaat

SEQ ID NO: 630770 - DNA, 13 bp, D. melanogaster
ggaaatgcaaaca

SEQ ID NO: 630771 - DNA, 13 bp, D. melanogaster
ggaaatgcaaatc

SEQ ID NO: 630772 - DNA, 14 bp, D. melanogaster
ggaaatgcaaatgc

SEQ ID NO: 630773 - DNA, 13 bp, D. melanogaster
ggaaatgcaaatt

SEQ ID NO: 630774 - DNA, 13 bp, D. melanogaster
ggaaatgcaactg

SEQ ID NO: 630775 - DNA, 13 bp, D. melanogaster
ggaaatgcacaaa

SEQ ID NO: 630776 - DNA, 13 bp, D. melanogaster
ggaaatgcaggaa

SEQ ID NO: 630777 - DNA, 13 bp, D. melanogaster
ggaaatgcatttc

SEQ ID NO: 630778 - DNA, 13 bp, D. melanogaster
ggaaatgcgaaat

SEQ ID NO: 630779 - DNA, 14 bp, D. melanogaster
ggaaatgcgaacgc

SEQ ID NO: 630780 - DNA, 14 bp, D. melanogaster
ggaaatgcggaaaa

SEQ ID NO: 630781 - DNA, 13 bp, D. melanogaster
ggaaatgctgcta

SEQ ID NO: 630782 - DNA, 14 bp, D. melanogaster
ggaaatgctggcca

SEQ ID NO: 630783 - DNA, 13 bp, D. melanogaster
ggaaatggaaaac

SEQ ID NO: 630784 - DNA, 14 bp, D. melanogaster
ggaaatggaaaagc

SEQ ID NO: 630785 - DNA, 13 bp, D. melanogaster
ggaaatggaaaat

SEQ ID NO: 630786 - DNA, 13 bp, D. melanogaster
ggaaatggaaacg

SEQ ID NO: 630787 - DNA, 14 bp, D. melanogaster
ggaaatggaaacgg

SEQ ID NO: 630788 - DNA, 13 bp, D. melanogaster
ggaaatggaaatg

SEQ ID NO: 630789 - DNA, 14 bp, D. melanogaster
ggaaatggaaatga

SEQ ID NO: 630790 - DNA, 14 bp, D. melanogaster
ggaaatggaaatgg

SEQ ID NO: 630791 - DNA, 14 bp, D. melanogaster
ggaaatggaaatgt

SEQ ID NO: 630792 - DNA, 13 bp, D. melanogaster
ggaaatggaatga

SEQ ID NO: 630793 - DNA, 13 bp, D. melanogaster
ggaaatggagatg

SEQ ID NO: 630794 - DNA, 14 bp, D. melanogaster
ggaaatggagatgg

SEQ ID NO: 630795 - DNA, 13 bp, D. melanogaster
ggaaatggagttt

SEQ ID NO: 630796 - DNA, 14 bp, D. melanogaster
ggaaatggatgtgg

SEQ ID NO: 630797 - DNA, 13 bp, D. melanogaster
ggaaatggcaaca

SEQ ID NO: 630798 - DNA, 13 bp, D. melanogaster
ggaaatggcaatg

SEQ ID NO: 630799 - DNA, 13 bp, D. melanogaster
ggaaatggctatg

SEQ ID NO: 630800 - DNA, 14 bp, D. melanogaster
ggaaatgggaaaac

SEQ ID NO: 630801 - DNA, 14 bp, D. melanogaster
ggaaatgggaaatg

SEQ ID NO: 630802 - DNA, 13 bp, D. melanogaster
ggaaatgggaacg

SEQ ID NO: 630803 - DNA, 14 bp, D. melanogaster
ggaaatgggaatgc

SEQ ID NO: 630804 - DNA, 13 bp, D. melanogaster
ggaaatgggattg

SEQ ID NO: 630805 - DNA, 13 bp, D. melanogaster
ggaaatgggattt

SEQ ID NO: 630806 - DNA, 13 bp, D. melanogaster
ggaaatgggcaaa

SEQ ID NO: 630807 - DNA, 13 bp, D. melanogaster
ggaaatggggatg

SEQ ID NO: 630808 - DNA, 13 bp, D. melanogaster
ggaaatgggtagc

SEQ ID NO: 630809 - DNA, 13 bp, D. melanogaster
ggaaatggtggaa

SEQ ID NO: 630810 - DNA, 13 bp, D. melanogaster
ggaaatgtaagaa

SEQ ID NO: 630811 - DNA, 13 bp, D. melanogaster
ggaaatgtatatt

SEQ ID NO: 630812 - DNA, 13 bp, D. melanogaster
ggaaatgtgaaaa

SEQ ID NO: 630813 - DNA, 14 bp, D. melanogaster
ggaaatgtgaaaat

SEQ ID NO: 630814 - DNA, 13 bp, D. melanogaster
ggaaatgtggaaa

SEQ ID NO: 630815 - DNA, 14 bp, D. melanogaster
ggaaatgtggaaat

SEQ ID NO: 630816 - DNA, 13 bp, D. melanogaster
ggaaatgtgggaa

SEQ ID NO: 630817 - DNA, 13 bp, D. melanogaster
ggaaatgtgggtg

SEQ ID NO: 630818 - DNA, 13 bp, D. melanogaster
ggaaatgtgtgaa

SEQ ID NO: 630819 - DNA, 13 bp, D. melanogaster
ggaaatgtgtttt

SEQ ID NO: 630820 - DNA, 13 bp, D. melanogaster
ggaaatgttttgc

SEQ ID NO: 630821 - DNA, 13 bp, D. melanogaster
ggaaattaaatta

SEQ ID NO: 630822 - DNA, 13 bp, D. melanogaster
ggaaattaatcaa

SEQ ID NO: 630823 - DNA, 13 bp, D. melanogaster
ggaaattaattgc

SEQ ID NO: 630824 - DNA, 13 bp, D. melanogaster
ggaaattaatttt

SEQ ID NO: 630825 - DNA, 13 bp, D. melanogaster
ggaaattacattt

SEQ ID NO: 630826 - DNA, 14 bp, D. melanogaster
ggaaattaccaaaa

SEQ ID NO: 630827 - DNA, 13 bp, D. melanogaster
ggaaattatgcaa

SEQ ID NO: 630828 - DNA, 14 bp, D. melanogaster
ggaaattatgcaaa

SEQ ID NO: 630829 - DNA, 13 bp, D. melanogaster
ggaaattattgtt

SEQ ID NO: 630830 - DNA, 13 bp, D. melanogaster
ggaaattcaaaaa

SEQ ID NO: 630831 - DNA, 13 bp, D. melanogaster
ggaaattcaaaat

SEQ ID NO: 630832 - DNA, 14 bp, D. melanogaster
ggaaattcaaactg

SEQ ID NO: 630833 - DNA, 13 bp, D. melanogaster
ggaaattcaaagt

SEQ ID NO: 630834 - DNA, 13 bp, D. melanogaster
ggaaattcaaatg

SEQ ID NO: 630835 - DNA, 13 bp, D. melanogaster
ggaaattcaaatt

SEQ ID NO: 630836 - DNA, 13 bp, D. melanogaster
ggaaattcaataa

SEQ ID NO: 630837 - DNA, 13 bp, D. melanogaster
ggaaattcaattt

SEQ ID NO: 630838 - DNA, 13 bp, D. melanogaster
ggaaattccccga

SEQ ID NO: 630839 - DNA, 13 bp, D. melanogaster
ggaaattcgaaaa

SEQ ID NO: 630840 - DNA, 14 bp, D. melanogaster
ggaaattcgaaaaa

SEQ ID NO: 630841 - DNA, 14 bp, D. melanogaster
ggaaattctatttt

SEQ ID NO: 630842 - DNA, 13 bp, D. melanogaster
ggaaattgaaaat

SEQ ID NO: 630843 - DNA, 14 bp, D. melanogaster
ggaaattgaaaatg

SEQ ID NO: 630844 - DNA, 14 bp, D. melanogaster
ggaaattgaaaatt

SEQ ID NO: 630845 - DNA, 13 bp, D. melanogaster
ggaaattgattga

SEQ ID NO: 630846 - DNA, 13 bp, D. melanogaster
ggaaattgcacaa

SEQ ID NO: 630847 - DNA, 13 bp, D. melanogaster
ggaaattgcattt

SEQ ID NO: 630848 - DNA, 13 bp, D. melanogaster
ggaaattgctgaa

SEQ ID NO: 630849 - DNA, 13 bp, D. melanogaster
ggaaattggaaaa

SEQ ID NO: 630850 - DNA, 13 bp, D. melanogaster
ggaaattggaaat

SEQ ID NO: 630851 - DNA, 13 bp, D. melanogaster
ggaaattggaatt

SEQ ID NO: 630852 - DNA, 13 bp, D. melanogaster
ggaaattggcaaa

SEQ ID NO: 630853 - DNA, 13 bp, D. melanogaster
ggaaattggggaa

SEQ ID NO: 630854 - DNA, 14 bp, D. melanogaster
ggaaattggggaaa

SEQ ID NO: 630855 - DNA, 13 bp, D. melanogaster
ggaaattgtaaat

SEQ ID NO: 630856 - DNA, 13 bp, D. melanogaster
ggaaattgtcaaa

SEQ ID NO: 630857 - DNA, 13 bp, D. melanogaster
ggaaattgttgaa

SEQ ID NO: 630858 - DNA, 13 bp, D. melanogaster
ggaaattgttgtt

SEQ ID NO: 630859 - DNA, 13 bp, D. melanogaster
ggaaattgttttc

SEQ ID NO: 630860 - DNA, 13 bp, D. melanogaster
ggaaatttaaata

SEQ ID NO: 630861 - DNA, 13 bp, D. melanogaster
ggaaatttaatta

SEQ ID NO: 630862 - DNA, 14 bp, D. melanogaster
ggaaatttaattac

SEQ ID NO: 630863 - DNA, 13 bp, D. melanogaster
ggaaatttatgtg

SEQ ID NO: 630864 - DNA, 13 bp, D. melanogaster
ggaaatttattgg

SEQ ID NO: 630865 - DNA, 13 bp, D. melanogaster
ggaaatttcaaat

SEQ ID NO: 630866 - DNA, 13 bp, D. melanogaster
ggaaatttcaaca

SEQ ID NO: 630867 - DNA, 13 bp, D. melanogaster
ggaaatttccatt

SEQ ID NO: 630868 - DNA, 13 bp, D. melanogaster
ggaaatttgcata

SEQ ID NO: 630869 - DNA, 13 bp, D. melanogaster
ggaaatttggata

SEQ ID NO: 630870 - DNA, 13 bp, D. melanogaster
ggaaattttcaat

SEQ ID NO: 630871 - DNA, 13 bp, D. melanogaster
ggaaatttttatt

SEQ ID NO: 630872 - DNA, 13 bp, D. melanogaster
ggaaatttttctt

SEQ ID NO: 630873 - DNA, 13 bp, D. melanogaster
ggaacaaaatcat

SEQ ID NO: 630874 - DNA, 13 bp, D. melanogaster
ggaacacacacat

SEQ ID NO: 630875 - DNA, 14 bp, D. melanogaster
ggaacacacacata

SEQ ID NO: 630876 - DNA, 13 bp, D. melanogaster
ggaacacgaatgc

SEQ ID NO: 630877 - DNA, 13 bp, D. melanogaster
ggaacagaaacag

SEQ ID NO: 630878 - DNA, 14 bp, D. melanogaster
ggaacaggaacagg

SEQ ID NO: 630879 - DNA, 13 bp, D. melanogaster
ggaacatacatat

SEQ ID NO: 630880 - DNA, 13 bp, D. melanogaster
ggaacatggagaa

SEQ ID NO: 630881 - DNA, 13 bp, D. melanogaster
ggaacattttttt

SEQ ID NO: 630882 - DNA, 13 bp, D. melanogaster
ggaaccaaaagta

SEQ ID NO: 630883 - DNA, 13 bp, D. melanogaster
ggaacctcaaaag

SEQ ID NO: 630884 - DNA, 13 bp, D. melanogaster
ggaacgaaacgaa

SEQ ID NO: 630885 - DNA, 14 bp, D. melanogaster
ggaacggaacggaa

SEQ ID NO: 630886 - DNA, 13 bp, D. melanogaster
ggaacggctgctg

SEQ ID NO: 630887 - DNA, 13 bp, D. melanogaster
ggaacgggaatgg

SEQ ID NO: 630888 - DNA, 13 bp, D. melanogaster
ggaacgtgcatct

SEQ ID NO: 630889 - DNA, 13 bp, D. melanogaster
ggaactatctgcc

SEQ ID NO: 630890 - DNA, 13 bp, D. melanogaster
ggaactcagagaa

SEQ ID NO: 630891 - DNA, 13 bp, D. melanogaster
ggaactccaacaa

SEQ ID NO: 630892 - DNA, 14 bp, D. melanogaster
ggaactccaacaac

SEQ ID NO: 630893 - DNA, 13 bp, D. melanogaster
ggaactccagctg

SEQ ID NO: 630894 - DNA, 13 bp, D. melanogaster
ggaactgcagctg

SEQ ID NO: 630895 - DNA, 14 bp, D. melanogaster
ggaactgcagctgt

SEQ ID NO: 630896 - DNA, 15 bp, D. melanogaster
ggaactgcatctgca

SEQ ID NO: 630897 - DNA, 13 bp, D. melanogaster
ggaactggaaact

SEQ ID NO: 630898 - DNA, 13 bp, D. melanogaster
ggaactggaactg

SEQ ID NO: 630899 - DNA, 14 bp, D. melanogaster
ggaactgggaactg

SEQ ID NO: 630900 - DNA, 13 bp, D. melanogaster
ggaactgggttag

SEQ ID NO: 630901 - DNA, 13 bp, D. melanogaster
ggaactgtgtgac

SEQ ID NO: 630902 - DNA, 13 bp, D. melanogaster
ggaacttaaggag

SEQ ID NO: 630903 - DNA, 13 bp, D. melanogaster
ggaacttgaaagg

SEQ ID NO: 630904 - DNA, 13 bp, D. melanogaster
ggaacttgactat

SEQ ID NO: 630905 - DNA, 13 bp, D. melanogaster
ggaacttggaact

SEQ ID NO: 630906 - DNA, 13 bp, D. melanogaster
ggaacttggccaa

SEQ ID NO: 630907 - DNA, 14 bp, D. melanogaster
ggaactttgtcttt

SEQ ID NO: 630908 - DNA, 13 bp, D. melanogaster
ggaactttttctg

SEQ ID NO: 630909 - DNA, 13 bp, D. melanogaster
ggaactttttttt

SEQ ID NO: 630910 - DNA, 13 bp, D. melanogaster
ggaagaaaattat

SEQ ID NO: 630911 - DNA, 13 bp, D. melanogaster
ggaagaactgttg

SEQ ID NO: 630912 - DNA, 13 bp, D. melanogaster
ggaagaagactgg

SEQ ID NO: 630913 - DNA, 13 bp, D. melanogaster
ggaagaagcagca

SEQ ID NO: 630914 - DNA, 14 bp, D. melanogaster
ggaagaagccatca

SEQ ID NO: 630915 - DNA, 13 bp, D. melanogaster
ggaagaagctgat

SEQ ID NO: 630916 - DNA, 13 bp, D. melanogaster
ggaagaagggcat

SEQ ID NO: 630917 - DNA, 13 bp, D. melanogaster
ggaagacaacaag

SEQ ID NO: 630918 - DNA, 13 bp, D. melanogaster
ggaagacattaaa

SEQ ID NO: 630919 - DNA, 13 bp, D. melanogaster
ggaagatcaaaca

SEQ ID NO: 630920 - DNA, 13 bp, D. melanogaster
ggaagccaaagga

SEQ ID NO: 630921 - DNA, 13 bp, D. melanogaster
ggaagcccgaaaa

SEQ ID NO: 630922 - DNA, 13 bp, D. melanogaster
ggaagcctaagag

SEQ ID NO: 630923 - DNA, 13 bp, D. melanogaster
ggaagcgccactc

SEQ ID NO: 630924 - DNA, 13 bp, D. melanogaster
ggaagcggaaatg

SEQ ID NO: 630925 - DNA, 13 bp, D. melanogaster
ggaagcggaagtg

SEQ ID NO: 630926 - DNA, 13 bp, D. melanogaster
ggaagctggaaat

SEQ ID NO: 630927 - DNA, 13 bp, D. melanogaster
ggaaggaggagcc

SEQ ID NO: 630928 - DNA, 13 bp, D. melanogaster
ggaagggagtgcg

SEQ ID NO: 630929 - DNA, 13 bp, D. melanogaster
ggaagtagatgtc

SEQ ID NO: 630930 - DNA, 15 bp, D. melanogaster
ggaagtatccaagct

SEQ ID NO: 630931 - DNA, 13 bp, D. melanogaster
ggaagtcccaaag

SEQ ID NO: 630932 - DNA, 13 bp, D. melanogaster
ggaagtcgcctgc

SEQ ID NO: 630933 - DNA, 13 bp, D. melanogaster
ggaagtggaaaat

SEQ ID NO: 630934 - DNA, 14 bp, D. melanogaster
ggaagtggaaatgg

SEQ ID NO: 630935 - DNA, 13 bp, D. melanogaster
ggaagtggaagcg

SEQ ID NO: 630936 - DNA, 13 bp, D. melanogaster
ggaagtggaagtg

SEQ ID NO: 630937 - DNA, 13 bp, D. melanogaster
ggaagtggcagtg

SEQ ID NO: 630938 - DNA, 13 bp, D. melanogaster
ggaagtgggctgg

SEQ ID NO: 630939 - DNA, 13 bp, D. melanogaster
ggaagttggccct

SEQ ID NO: 630940 - DNA, 13 bp, D. melanogaster
ggaataaatttgc

SEQ ID NO: 630941 - DNA, 13 bp, D. melanogaster
ggaataacttttt

SEQ ID NO: 630942 - DNA, 14 bp, D. melanogaster
ggaataatatattt

SEQ ID NO: 630943 - DNA, 14 bp, D. melanogaster
ggaatacaaataat

SEQ ID NO: 630944 - DNA, 13 bp, D. melanogaster
ggaatacatatat

SEQ ID NO: 630945 - DNA, 13 bp, D. melanogaster
ggaatacattttg

SEQ ID NO: 630946 - DNA, 13 bp, D. melanogaster
ggaataccaaatt

SEQ ID NO: 630947 - DNA, 13 bp, D. melanogaster
ggaatacccaaga

SEQ ID NO: 630948 - DNA, 13 bp, D. melanogaster
ggaatacggaata

SEQ ID NO: 630949 - DNA, 13 bp, D. melanogaster
ggaataggaatag

SEQ ID NO: 630950 - DNA, 14 bp, D. melanogaster
ggaatatacatata

SEQ ID NO: 630951 - DNA, 14 bp, D. melanogaster
ggaatatatgtata

SEQ ID NO: 630952 - DNA, 13 bp, D. melanogaster
ggaatatcgatag

SEQ ID NO: 630953 - DNA, 13 bp, D. melanogaster
ggaatatggaaat

SEQ ID NO: 630954 - DNA, 14 bp, D. melanogaster
ggaatatggaatat

SEQ ID NO: 630955 - DNA, 13 bp, D. melanogaster
ggaatatgggaaa

SEQ ID NO: 630956 - DNA, 13 bp, D. melanogaster
ggaatatttaaaa

SEQ ID NO: 630957 - DNA, 13 bp, D. melanogaster
ggaatatttataa

SEQ ID NO: 630958 - DNA, 13 bp, D. melanogaster
ggaatatttggaa

SEQ ID NO: 630959 - DNA, 13 bp, D. melanogaster
ggaatatttttga

SEQ ID NO: 630960 - DNA, 13 bp, D. melanogaster
ggaatcaataaaa

SEQ ID NO: 630961 - DNA, 14 bp, D. melanogaster
ggaatcaataaaaa

SEQ ID NO: 630962 - DNA, 13 bp, D. melanogaster
ggaatcacaaagg

SEQ ID NO: 630963 - DNA, 13 bp, D. melanogaster
ggaatcaccaaag

SEQ ID NO: 630964 - DNA, 13 bp, D. melanogaster
ggaatcagaatca

SEQ ID NO: 630965 - DNA, 13 bp, D. melanogaster
ggaatccgaatcc

SEQ ID NO: 630966 - DNA, 14 bp, D. melanogaster
ggaatcgaaatcgg

SEQ ID NO: 630967 - DNA, 13 bp, D. melanogaster
ggaatcgaatcga

SEQ ID NO: 630968 - DNA, 14 bp, D. melanogaster
ggaatcgctttggt

SEQ ID NO: 630969 - DNA, 13 bp, D. melanogaster
ggaatcggaaaat

SEQ ID NO: 630970 - DNA, 13 bp, D. melanogaster
ggaatcggaatca

SEQ ID NO: 630971 - DNA, 13 bp, D. melanogaster
ggaatcggaatct

SEQ ID NO: 630972 - DNA, 13 bp, D. melanogaster
ggaatcggaattg

SEQ ID NO: 630973 - DNA, 13 bp, D. melanogaster
ggaatcggggaat

SEQ ID NO: 630974 - DNA, 13 bp, D. melanogaster
ggaatcgtttgcc

SEQ ID NO: 630975 - DNA, 13 bp, D. melanogaster
ggaatctatctca

SEQ ID NO: 630976 - DNA, 13 bp, D. melanogaster
ggaatctggaatc

SEQ ID NO: 630977 - DNA, 13 bp, D. melanogaster
ggaatgaaaatga

SEQ ID NO: 630978 - DNA, 13 bp, D. melanogaster
ggaatgaaaatgg

SEQ ID NO: 630979 - DNA, 13 bp, D. melanogaster
ggaatgaaatgaa

SEQ ID NO: 630980 - DNA, 13 bp, D. melanogaster
ggaatgagaatgg

SEQ ID NO: 630981 - DNA, 13 bp, D. melanogaster
ggaatgcaaatgg

SEQ ID NO: 630982 - DNA, 13 bp, D. melanogaster
ggaatgcagttcg

SEQ ID NO: 630983 - DNA, 13 bp, D. melanogaster
ggaatgcgaatgg

SEQ ID NO: 630984 - DNA, 13 bp, D. melanogaster
ggaatgctgagca

SEQ ID NO: 630985 - DNA, 13 bp, D. melanogaster
ggaatggaaaaca

SEQ ID NO: 630986 - DNA, 13 bp, D. melanogaster
ggaatggaaaacg

SEQ ID NO: 630987 - DNA, 13 bp, D. melanogaster
ggaatggaaaatg

SEQ ID NO: 630988 - DNA, 13 bp, D. melanogaster
ggaatggaaatga

SEQ ID NO: 630989 - DNA, 14 bp, D. melanogaster
ggaatggaacggaa

SEQ ID NO: 630990 - DNA, 13 bp, D. melanogaster
ggaatggaatgga

SEQ ID NO: 630991 - DNA, 14 bp, D. melanogaster
ggaatggaatggag

SEQ ID NO: 630992 - DNA, 13 bp, D. melanogaster
ggaatggaatggt

SEQ ID NO: 630993 - DNA, 13 bp, D. melanogaster
ggaatggagaatg

SEQ ID NO: 630994 - DNA, 13 bp, D. melanogaster
ggaatggagtgga

SEQ ID NO: 630995 - DNA, 13 bp, D. melanogaster
ggaatggatggat

SEQ ID NO: 630996 - DNA, 13 bp, D. melanogaster
ggaatgggaaatg

SEQ ID NO: 630997 - DNA, 13 bp, D. melanogaster
ggaatgggaatcg

SEQ ID NO: 630998 - DNA, 13 bp, D. melanogaster
ggaatgggaatgc

SEQ ID NO: 630999 - DNA, 13 bp, D. melanogaster
ggaatgggaatgg

SEQ ID NO: 631000 - DNA, 13 bp, D. melanogaster
ggaatgggaattg

SEQ ID NO: 631001 - DNA, 13 bp, D. melanogaster
ggaatgggactgg

SEQ ID NO: 631002 - DNA, 13 bp, D. melanogaster
ggaatgggatgga

SEQ ID NO: 631003 - DNA, 14 bp, D. melanogaster
ggaatgggattggg

SEQ ID NO: 631004 - DNA, 13 bp, D. melanogaster
ggaatgggcatgg

SEQ ID NO: 631005 - DNA, 13 bp, D. melanogaster
ggaatggggaatg

SEQ ID NO: 631006 - DNA, 13 bp, D. melanogaster
ggaatggggattt

SEQ ID NO: 631007 - DNA, 13 bp, D. melanogaster
ggaatggtaatgg

SEQ ID NO: 631008 - DNA, 13 bp, D. melanogaster
ggaatgtgaatgg

SEQ ID NO: 631009 - DNA, 13 bp, D. melanogaster
ggaatgtggctgg

SEQ ID NO: 631010 - DNA, 13 bp, D. melanogaster
ggaattaaagcaa

SEQ ID NO: 631011 - DNA, 13 bp, D. melanogaster
ggaattaaatttt

SEQ ID NO: 631012 - DNA, 13 bp, D. melanogaster
ggaattactaggt

SEQ ID NO: 631013 - DNA, 13 bp, D. melanogaster
ggaattatctatt

SEQ ID NO: 631014 - DNA, 14 bp, D. melanogaster
ggaattcaaaattt

SEQ ID NO: 631015 - DNA, 13 bp, D. melanogaster
ggaattcaaatga

SEQ ID NO: 631016 - DNA, 14 bp, D. melanogaster
ggaattccaaatca

SEQ ID NO: 631017 - DNA, 13 bp, D. melanogaster
ggaattccggtgg

SEQ ID NO: 631018 - DNA, 13 bp, D. melanogaster
ggaattcgctttg

SEQ ID NO: 631019 - DNA, 14 bp, D. melanogaster
ggaattgagcttct

SEQ ID NO: 631020 - DNA, 13 bp, D. melanogaster
ggaattgcaaatg

SEQ ID NO: 631021 - DNA, 13 bp, D. melanogaster
ggaattggaatcg

SEQ ID NO: 631022 - DNA, 14 bp, D. melanogaster
ggaattggaatcgg

SEQ ID NO: 631023 - DNA, 13 bp, D. melanogaster
ggaattggaattg

SEQ ID NO: 631024 - DNA, 14 bp, D. melanogaster
ggaattggaattgg

SEQ ID NO: 631025 - DNA, 13 bp, D. melanogaster
ggaattggattgg

SEQ ID NO: 631026 - DNA, 13 bp, D. melanogaster
ggaattggcaaat

SEQ ID NO: 631027 - DNA, 13 bp, D. melanogaster
ggaattgggaatg

SEQ ID NO: 631028 - DNA, 14 bp, D. melanogaster
ggaattgggattgg

SEQ ID NO: 631029 - DNA, 14 bp, D. melanogaster
ggaattgtcgtttc

SEQ ID NO: 631030 - DNA, 13 bp, D. melanogaster
ggaattgttttca

SEQ ID NO: 631031 - DNA, 13 bp, D. melanogaster
ggaatttaataaa

SEQ ID NO: 631032 - DNA, 13 bp, D. melanogaster
ggaatttaataat

SEQ ID NO: 631033 - DNA, 13 bp, D. melanogaster
ggaatttaattaa

SEQ ID NO: 631034 - DNA, 13 bp, D. melanogaster
ggaatttaattta

SEQ ID NO: 631035 - DNA, 13 bp, D. melanogaster
ggaatttatataa

SEQ ID NO: 631036 - DNA, 13 bp, D. melanogaster
ggaatttatgttg

SEQ ID NO: 631037 - DNA, 13 bp, D. melanogaster
ggaatttatttat

SEQ ID NO: 631038 - DNA, 13 bp, D. melanogaster
ggaatttcaattt

SEQ ID NO: 631039 - DNA, 13 bp, D. melanogaster
ggaatttccattt

SEQ ID NO: 631040 - DNA, 14 bp, D. melanogaster
ggaatttccttttt

SEQ ID NO: 631041 - DNA, 13 bp, D. melanogaster
ggaatttctggaa

SEQ ID NO: 631042 - DNA, 13 bp, D. melanogaster
ggaatttcttatc

SEQ ID NO: 631043 - DNA, 13 bp, D. melanogaster
ggaatttcttttt

SEQ ID NO: 631044 - DNA, 13 bp, D. melanogaster
ggaatttgttttg

SEQ ID NO: 631045 - DNA, 13 bp, D. melanogaster
ggaattttataaa

SEQ ID NO: 631046 - DNA, 13 bp, D. melanogaster
ggaattttcaatt

SEQ ID NO: 631047 - DNA, 13 bp, D. melanogaster
ggaattttcgctg

SEQ ID NO: 631048 - DNA, 13 bp, D. melanogaster
ggaattttgcaat

SEQ ID NO: 631049 - DNA, 13 bp, D. melanogaster
ggaattttgccgg

SEQ ID NO: 631050 - DNA, 14 bp, D. melanogaster
ggaattttgtcaaa

SEQ ID NO: 631051 - DNA, 13 bp, D. melanogaster
ggaatttttatga

SEQ ID NO: 631052 - DNA, 13 bp, D. melanogaster
ggaatttttcttt

SEQ ID NO: 631053 - DNA, 14 bp, D. melanogaster
ggaatttttcttta

SEQ ID NO: 631054 - DNA, 13 bp, D. melanogaster
ggacaaaaaatta

SEQ ID NO: 631055 - DNA, 13 bp, D. melanogaster
ggacaaaaggaca

SEQ ID NO: 631056 - DNA, 13 bp, D. melanogaster
ggacaaacaaaat

SEQ ID NO: 631057 - DNA, 13 bp, D. melanogaster
ggacaaacaaatg

SEQ ID NO: 631058 - DNA, 13 bp, D. melanogaster
ggacaaacggacg

SEQ ID NO: 631059 - DNA, 13 bp, D. melanogaster
ggacaaaggacac

SEQ ID NO: 631060 - DNA, 13 bp, D. melanogaster
ggacaacaacaac

SEQ ID NO: 631061 - DNA, 13 bp, D. melanogaster
ggacaacaacaag

SEQ ID NO: 631062 - DNA, 13 bp, D. melanogaster
ggacaacggacag

SEQ ID NO: 631063 - DNA, 13 bp, D. melanogaster
ggacaagcgaatg

SEQ ID NO: 631064 - DNA, 13 bp, D. melanogaster
ggacaagcggaca

SEQ ID NO: 631065 - DNA, 13 bp, D. melanogaster
ggacaaggacaag

SEQ ID NO: 631066 - DNA, 13 bp, D. melanogaster
ggacaaggatggg

SEQ ID NO: 631067 - DNA, 13 bp, D. melanogaster
ggacaagtttttg

SEQ ID NO: 631068 - DNA, 13 bp, D. melanogaster
ggacaatattttt

SEQ ID NO: 631069 - DNA, 13 bp, D. melanogaster
ggacaatggacaa

SEQ ID NO: 631070 - DNA, 13 bp, D. melanogaster
ggacacaaatgca

SEQ ID NO: 631071 - DNA, 13 bp, D. melanogaster
ggacacacaaaca

SEQ ID NO: 631072 - DNA, 13 bp, D. melanogaster
ggacaccaggaag

SEQ ID NO: 631073 - DNA, 13 bp, D. melanogaster
ggacacgcccaca

SEQ ID NO: 631074 - DNA, 13 bp, D. melanogaster
ggacacgccgaca

SEQ ID NO: 631075 - DNA, 13 bp, D. melanogaster
ggacacggacaca

SEQ ID NO: 631076 - DNA, 13 bp, D. melanogaster
ggacacggacacg

SEQ ID NO: 631077 - DNA, 13 bp, D. melanogaster
ggacacggatacg

SEQ ID NO: 631078 - DNA, 14 bp, D. melanogaster
ggacactcaaccgg

SEQ ID NO: 631079 - DNA, 13 bp, D. melanogaster
ggacagacacctg

SEQ ID NO: 631080 - DNA, 13 bp, D. melanogaster
ggacagacggaca

SEQ ID NO: 631081 - DNA, 14 bp, D. melanogaster
ggacagacggacag

SEQ ID NO: 631082 - DNA, 13 bp, D. melanogaster
ggacagatggacg

SEQ ID NO: 631083 - DNA, 13 bp, D. melanogaster
ggacagccccgag

SEQ ID NO: 631084 - DNA, 13 bp, D. melanogaster
ggacagcctctgt

SEQ ID NO: 631085 - DNA, 13 bp, D. melanogaster
ggacaggacagga

SEQ ID NO: 631086 - DNA, 14 bp, D. melanogaster
ggacaggacaggac

SEQ ID NO: 631087 - DNA, 13 bp, D. melanogaster
ggacaggcagaca

SEQ ID NO: 631088 - DNA, 13 bp, D. melanogaster
ggacaggcggaca

SEQ ID NO: 631089 - DNA, 13 bp, D. melanogaster
ggacagggccaga

SEQ ID NO: 631090 - DNA, 13 bp, D. melanogaster
ggacagtgaacaa

SEQ ID NO: 631091 - DNA, 13 bp, D. melanogaster
ggacatcagcttc

SEQ ID NO: 631092 - DNA, 13 bp, D. melanogaster
ggacatcatttgt

SEQ ID NO: 631093 - DNA, 13 bp, D. melanogaster
ggacatgaccaga

SEQ ID NO: 631094 - DNA, 13 bp, D. melanogaster
ggacatgcgcaga

SEQ ID NO: 631095 - DNA, 13 bp, D. melanogaster
ggacatgctggat

SEQ ID NO: 631096 - DNA, 13 bp, D. melanogaster
ggacatggacaca

SEQ ID NO: 631097 - DNA, 14 bp, D. melanogaster
ggacatggacatgg

SEQ ID NO: 631098 - DNA, 13 bp, D. melanogaster
ggacatggccaga

SEQ ID NO: 631099 - DNA, 14 bp, D. melanogaster
ggacatggccagat

SEQ ID NO: 631100 - DNA, 13 bp, D. melanogaster
ggacattatcaaa

SEQ ID NO: 631101 - DNA, 13 bp, D. melanogaster
ggacattcaaaaa

SEQ ID NO: 631102 - DNA, 14 bp, D. melanogaster
ggacattgccggtc

SEQ ID NO: 631103 - DNA, 13 bp, D. melanogaster
ggacattggacat

SEQ ID NO: 631104 - DNA, 13 bp, D. melanogaster
ggaccaaggacca

SEQ ID NO: 631105 - DNA, 13 bp, D. melanogaster
ggaccaaggacga

SEQ ID NO: 631106 - DNA, 13 bp, D. melanogaster
ggaccaatggtat

SEQ ID NO: 631107 - DNA, 13 bp, D. melanogaster
ggaccaattaaag

SEQ ID NO: 631108 - DNA, 13 bp, D. melanogaster
ggaccaattgtgt

SEQ ID NO: 631109 - DNA, 13 bp, D. melanogaster
ggaccacgcccac

SEQ ID NO: 631110 - DNA, 14 bp, D. melanogaster
ggaccacgcccact

SEQ ID NO: 631111 - DNA, 13 bp, D. melanogaster
ggaccatcttcct

SEQ ID NO: 631112 - DNA, 13 bp, D. melanogaster
ggaccgaaaatcc

SEQ ID NO: 631113 - DNA, 15 bp, D. melanogaster
ggacctgtaggtgac

SEQ ID NO: 631114 - DNA, 13 bp, D. melanogaster
ggacgaaaggacg

SEQ ID NO: 631115 - DNA, 13 bp, D. melanogaster
ggacgaacaggac

SEQ ID NO: 631116 - DNA, 13 bp, D. melanogaster
ggacgaagaatca

SEQ ID NO: 631117 - DNA, 13 bp, D. melanogaster
ggacgaaggacaa

SEQ ID NO: 631118 - DNA, 13 bp, D. melanogaster
ggacgaaggacga

SEQ ID NO: 631119 - DNA, 14 bp, D. melanogaster
ggacgaaggacgag

SEQ ID NO: 631120 - DNA, 13 bp, D. melanogaster
ggacgaaggactc

SEQ ID NO: 631121 - DNA, 13 bp, D. melanogaster
ggacgaccaaatt

SEQ ID NO: 631122 - DNA, 13 bp, D. melanogaster
ggacgacgatcag

SEQ ID NO: 631123 - DNA, 13 bp, D. melanogaster
ggacgagccaaag

SEQ ID NO: 631124 - DNA, 13 bp, D. melanogaster
ggacgaggacgag

SEQ ID NO: 631125 - DNA, 13 bp, D. melanogaster
ggacgcagatctt

SEQ ID NO: 631126 - DNA, 13 bp, D. melanogaster
ggacgcaggacac

SEQ ID NO: 631127 - DNA, 13 bp, D. melanogaster
ggacgcaggacga

SEQ ID NO: 631128 - DNA, 13 bp, D. melanogaster
ggacgcaggacgc

SEQ ID NO: 631129 - DNA, 14 bp, D. melanogaster
ggacgcaggacgca

SEQ ID NO: 631130 - DNA, 13 bp, D. melanogaster
ggacgcaggactc

SEQ ID NO: 631131 - DNA, 14 bp, D. melanogaster
ggacggacggacgg

SEQ ID NO: 631132 - DNA, 13 bp, D. melanogaster
ggacgtgccgctg

SEQ ID NO: 631133 - DNA, 13 bp, D. melanogaster
ggacgtggacgtg

SEQ ID NO: 631134 - DNA, 14 bp, D. melanogaster
ggacgtggacgtgg

SEQ ID NO: 631135 - DNA, 13 bp, D. melanogaster
ggacgtggatgtg

SEQ ID NO: 631136 - DNA, 14 bp, D. melanogaster
ggacgtggatgtgg

SEQ ID NO: 631137 - DNA, 13 bp, D. melanogaster
ggacgtgggcaaa

SEQ ID NO: 631138 - DNA, 13 bp, D. melanogaster
ggactaacgaaat

SEQ ID NO: 631139 - DNA, 13 bp, D. melanogaster
ggactacggacta

SEQ ID NO: 631140 - DNA, 14 bp, D. melanogaster
ggactacggactac

SEQ ID NO: 631141 - DNA, 13 bp, D. melanogaster
ggactcaaagaaa

SEQ ID NO: 631142 - DNA, 13 bp, D. melanogaster
ggactccaaacag

SEQ ID NO: 631143 - DNA, 14 bp, D. melanogaster
ggactccaaacagg

SEQ ID NO: 631144 - DNA, 13 bp, D. melanogaster
ggactccagcctc

SEQ ID NO: 631145 - DNA, 13 bp, D. melanogaster
ggactccggactc

SEQ ID NO: 631146 - DNA, 13 bp, D. melanogaster
ggactcgaactcg

SEQ ID NO: 631147 - DNA, 13 bp, D. melanogaster
ggactcggactcg

SEQ ID NO: 631148 - DNA, 13 bp, D. melanogaster
ggactcggacttg

SEQ ID NO: 631149 - DNA, 14 bp, D. melanogaster
ggactcggattcgg

SEQ ID NO: 631150 - DNA, 13 bp, D. melanogaster
ggactcgggaaac

SEQ ID NO: 631151 - DNA, 13 bp, D. melanogaster
ggactgggaaaag

SEQ ID NO: 631152 - DNA, 14 bp, D. melanogaster
ggactgggactggg

SEQ ID NO: 631153 - DNA, 13 bp, D. melanogaster
ggacttggacttg

SEQ ID NO: 631154 - DNA, 14 bp, D. melanogaster
ggacttggacttgg

SEQ ID NO: 631155 - DNA, 13 bp, D. melanogaster
ggacttggccaaa

SEQ ID NO: 631156 - DNA, 13 bp, D. melanogaster
ggacttgtgttct

SEQ ID NO: 631157 - DNA, 13 bp, D. melanogaster
ggacttgttcgaa

SEQ ID NO: 631158 - DNA, 13 bp, D. melanogaster
ggacttgtttgag

SEQ ID NO: 631159 - DNA, 13 bp, D. melanogaster
ggactttaaagcc

SEQ ID NO: 631160 - DNA, 13 bp, D. melanogaster
ggactttaagttt

SEQ ID NO: 631161 - DNA, 13 bp, D. melanogaster
ggactttacattt

SEQ ID NO: 631162 - DNA, 13 bp, D. melanogaster
ggactttgccttt

SEQ ID NO: 631163 - DNA, 13 bp, D. melanogaster
ggagaaaaaacta

SEQ ID NO: 631164 - DNA, 13 bp, D. melanogaster
ggagaaaaacaat

SEQ ID NO: 631165 - DNA, 14 bp, D. melanogaster
ggagaaaaacaata

SEQ ID NO: 631166 - DNA, 13 bp, D. melanogaster
ggagaaaaccccg

SEQ ID NO: 631167 - DNA, 13 bp, D. melanogaster
ggagaaaatgcaa

SEQ ID NO: 631168 - DNA, 13 bp, D. melanogaster
ggagaaaatgttt

SEQ ID NO: 631169 - DNA, 13 bp, D. melanogaster
ggagaaaattatg

SEQ ID NO: 631170 - DNA, 13 bp, D. melanogaster
ggagaaacatcga

SEQ ID NO: 631171 - DNA, 13 bp, D. melanogaster
ggagaaaggctga

SEQ ID NO: 631172 - DNA, 13 bp, D. melanogaster
ggagaaatagttt

SEQ ID NO: 631173 - DNA, 13 bp, D. melanogaster
ggagaacttaaag

SEQ ID NO: 631174 - DNA, 13 bp, D. melanogaster
ggagaagaggccc

SEQ ID NO: 631175 - DNA, 13 bp, D. melanogaster
ggagaagagtttc

SEQ ID NO: 631176 - DNA, 13 bp, D. melanogaster
ggagaagggagtc

SEQ ID NO: 631177 - DNA, 13 bp, D. melanogaster
ggagaagtcgaac

SEQ ID NO: 631178 - DNA, 13 bp, D. melanogaster
ggagaatatggag

SEQ ID NO: 631179 - DNA, 13 bp, D. melanogaster
ggagaatcagaaa

SEQ ID NO: 631180 - DNA, 13 bp, D. melanogaster
ggagaatcagcag

SEQ ID NO: 631181 - DNA, 13 bp, D. melanogaster
ggagaatcggaga

SEQ ID NO: 631182 - DNA, 13 bp, D. melanogaster
ggagaattataat

SEQ ID NO: 631183 - DNA, 13 bp, D. melanogaster
ggagaatttcaat

SEQ ID NO: 631184 - DNA, 13 bp, D. melanogaster
ggagacaaattca

SEQ ID NO: 631185 - DNA, 13 bp, D. melanogaster
ggagacctagaga

SEQ ID NO: 631186 - DNA, 13 bp, D. melanogaster
ggagacggagacg

SEQ ID NO: 631187 - DNA, 13 bp, D. melanogaster
ggagactccagct

SEQ ID NO: 631188 - DNA, 13 bp, D. melanogaster
ggagagaaattaa

SEQ ID NO: 631189 - DNA, 13 bp, D. melanogaster
ggagagcaggagc

SEQ ID NO: 631190 - DNA, 13 bp, D. melanogaster
ggagagcattgct

SEQ ID NO: 631191 - DNA, 14 bp, D. melanogaster
ggagagcattgctc

SEQ ID NO: 631192 - DNA, 13 bp, D. melanogaster
ggagagcgctaca

SEQ ID NO: 631193 - DNA, 13 bp, D. melanogaster
ggagagtaaatat

SEQ ID NO: 631194 - DNA, 13 bp, D. melanogaster
ggagatatttgga

SEQ ID NO: 631195 - DNA, 13 bp, D. melanogaster
ggagatcctcttc

SEQ ID NO: 631196 - DNA, 13 bp, D. melanogaster
ggagatcgaaaaa

SEQ ID NO: 631197 - DNA, 13 bp, D. melanogaster
ggagatctccaca

SEQ ID NO: 631198 - DNA, 13 bp, D. melanogaster
ggagatctccacg

SEQ ID NO: 631199 - DNA, 13 bp, D. melanogaster
ggagatgcacgtt

SEQ ID NO: 631200 - DNA, 13 bp, D. melanogaster
ggagatgcagatg

SEQ ID NO: 631201 - DNA, 13 bp, D. melanogaster
ggagatggagacg

SEQ ID NO: 631202 - DNA, 13 bp, D. melanogaster
ggagatggagatg

SEQ ID NO: 631203 - DNA, 13 bp, D. melanogaster
ggagatggcgatg

SEQ ID NO: 631204 - DNA, 14 bp, D. melanogaster
ggagatggcgatgg

SEQ ID NO: 631205 - DNA, 13 bp, D. melanogaster
ggagatgggaatg

SEQ ID NO: 631206 - DNA, 14 bp, D. melanogaster
ggagcaacaaaaac

SEQ ID NO: 631207 - DNA, 14 bp, D. melanogaster
ggagcaacaacaac

SEQ ID NO: 631208 - DNA, 13 bp, D. melanogaster
ggagcaacaacag

SEQ ID NO: 631209 - DNA, 13 bp, D. melanogaster
ggagcaacaataa

SEQ ID NO: 631210 - DNA, 13 bp, D. melanogaster
ggagcaaggagca

SEQ ID NO: 631211 - DNA, 13 bp, D. melanogaster
ggagcaataaaaa

SEQ ID NO: 631212 - DNA, 13 bp, D. melanogaster
ggagcaatgccac

SEQ ID NO: 631213 - DNA, 14 bp, D. melanogaster
ggagcacacacaca

SEQ ID NO: 631214 - DNA, 13 bp, D. melanogaster
ggagcacgccaat

SEQ ID NO: 631215 - DNA, 13 bp, D. melanogaster
ggagcacggagca

SEQ ID NO: 631216 - DNA, 13 bp, D. melanogaster
ggagcagaagcag

SEQ ID NO: 631217 - DNA, 14 bp, D. melanogaster
ggagcagaaggagc

SEQ ID NO: 631218 - DNA, 14 bp, D. melanogaster
ggagcagagcagag

SEQ ID NO: 631219 - DNA, 13 bp, D. melanogaster
ggagcagcaagga

SEQ ID NO: 631220 - DNA, 13 bp, D. melanogaster
ggagcagcagcat

SEQ ID NO: 631221 - DNA, 13 bp, D. melanogaster
ggagcagcagctc

SEQ ID NO: 631222 - DNA, 13 bp, D. melanogaster
ggagcagcaggat

SEQ ID NO: 631223 - DNA, 13 bp, D. melanogaster
ggagcagcaggtg

SEQ ID NO: 631224 - DNA, 13 bp, D. melanogaster
ggagcagcagtag

SEQ ID NO: 631225 - DNA, 13 bp, D. melanogaster
ggagcagccacct

SEQ ID NO: 631226 - DNA, 13 bp, D. melanogaster
ggagcagccagga

SEQ ID NO: 631227 - DNA, 13 bp, D. melanogaster
ggagcagctgaaa

SEQ ID NO: 631228 - DNA, 13 bp, D. melanogaster
ggagcagctgcaa

SEQ ID NO: 631229 - DNA, 13 bp, D. melanogaster
ggagcaggaaatg

SEQ ID NO: 631230 - DNA, 14 bp, D. melanogaster
ggagcaggaacagg

SEQ ID NO: 631231 - DNA, 13 bp, D. melanogaster
ggagcaggagcat

SEQ ID NO: 631232 - DNA, 13 bp, D. melanogaster
ggagcaggagctg

SEQ ID NO: 631233 - DNA, 14 bp, D. melanogaster
ggagcaggagctgg

SEQ ID NO: 631234 - DNA, 13 bp, D. melanogaster
ggagcaggcagcg

SEQ ID NO: 631235 - DNA, 13 bp, D. melanogaster
ggagcagggagca

SEQ ID NO: 631236 - DNA, 14 bp, D. melanogaster
ggagcagtgcatta

SEQ ID NO: 631237 - DNA, 13 bp, D. melanogaster
ggagcagtggagc

SEQ ID NO: 631238 - DNA, 13 bp, D. melanogaster
ggagcattggagc

SEQ ID NO: 631239 - DNA, 13 bp, D. melanogaster
ggagcattttatg

SEQ ID NO: 631240 - DNA, 13 bp, D. melanogaster
ggagccatcgaaa

SEQ ID NO: 631241 - DNA, 14 bp, D. melanogaster
ggagcccagggtgc

SEQ ID NO: 631242 - DNA, 13 bp, D. melanogaster
ggagccggagcag

SEQ ID NO: 631243 - DNA, 13 bp, D. melanogaster
ggagccttttgtg

SEQ ID NO: 631244 - DNA, 13 bp, D. melanogaster
ggagcgagcgaga

SEQ ID NO: 631245 - DNA, 13 bp, D. melanogaster
ggagcgagcggaa

SEQ ID NO: 631246 - DNA, 13 bp, D. melanogaster
ggagcgccaggag

SEQ ID NO: 631247 - DNA, 13 bp, D. melanogaster
ggagcgcctgcac

SEQ ID NO: 631248 - DNA, 13 bp, D. melanogaster
ggagcggagtgga

SEQ ID NO: 631249 - DNA, 13 bp, D. melanogaster
ggagcggcagttg

SEQ ID NO: 631250 - DNA, 13 bp, D. melanogaster
ggagcggtactat

SEQ ID NO: 631251 - DNA, 14 bp, D. melanogaster
ggagctctggttcg

SEQ ID NO: 631252 - DNA, 13 bp, D. melanogaster
ggagctgaagctg

SEQ ID NO: 631253 - DNA, 13 bp, D. melanogaster
ggagctggaaaag

SEQ ID NO: 631254 - DNA, 14 bp, D. melanogaster
ggagctggagatgg

SEQ ID NO: 631255 - DNA, 13 bp, D. melanogaster
ggagctggagcag

SEQ ID NO: 631256 - DNA, 13 bp, D. melanogaster
ggagctggagctc

SEQ ID NO: 631257 - DNA, 13 bp, D. melanogaster
ggagctggagctg

SEQ ID NO: 631258 - DNA, 13 bp, D. melanogaster
ggagctggaggag

SEQ ID NO: 631259 - DNA, 14 bp, D. melanogaster
ggagctggaggagc

SEQ ID NO: 631260 - DNA, 13 bp, D. melanogaster
ggagctggagttg

SEQ ID NO: 631261 - DNA, 14 bp, D. melanogaster
ggagctggagttgg

SEQ ID NO: 631262 - DNA, 13 bp, D. melanogaster
ggagctggagttt

SEQ ID NO: 631263 - DNA, 13 bp, D. melanogaster
ggagctggccaaa

SEQ ID NO: 631264 - DNA, 13 bp, D. melanogaster
ggagctgggagct

SEQ ID NO: 631265 - DNA, 13 bp, D. melanogaster
ggagctgtggagc

SEQ ID NO: 631266 - DNA, 14 bp, D. melanogaster
ggagctgtggagct

SEQ ID NO: 631267 - DNA, 13 bp, D. melanogaster
ggagcttggagct

SEQ ID NO: 631268 - DNA, 13 bp, D. melanogaster
ggaggaaaactac

SEQ ID NO: 631269 - DNA, 13 bp, D. melanogaster
ggaggagacacca

SEQ ID NO: 631270 - DNA, 13 bp, D. melanogaster
ggaggagcagcaa

SEQ ID NO: 631271 - DNA, 13 bp, D. melanogaster
ggaggagcagctg

SEQ ID NO: 631272 - DNA, 13 bp, D. melanogaster
ggaggagcaggac

SEQ ID NO: 631273 - DNA, 13 bp, D. melanogaster
ggaggagcattcc

SEQ ID NO: 631274 - DNA, 13 bp, D. melanogaster
ggaggagccgcac

SEQ ID NO: 631275 - DNA, 13 bp, D. melanogaster
ggaggagctggag

SEQ ID NO: 631276 - DNA, 15 bp, D. melanogaster
ggaggagctggagga

SEQ ID NO: 631277 - DNA, 13 bp, D. melanogaster
ggaggaggagctg

SEQ ID NO: 631278 - DNA, 13 bp, D. melanogaster
ggaggaggcattt

SEQ ID NO: 631279 - DNA, 13 bp, D. melanogaster
ggaggagttacca

SEQ ID NO: 631280 - DNA, 13 bp, D. melanogaster
ggaggagtttgaa

SEQ ID NO: 631281 - DNA, 13 bp, D. melanogaster
ggaggatgaggat

SEQ ID NO: 631282 - DNA, 13 bp, D. melanogaster
ggaggatgtcacc

SEQ ID NO: 631283 - DNA, 13 bp, D. melanogaster
ggaggcacccatt

SEQ ID NO: 631284 - DNA, 13 bp, D. melanogaster
ggaggcccaagac

SEQ ID NO: 631285 - DNA, 13 bp, D. melanogaster
ggaggcctctact

SEQ ID NO: 631286 - DNA, 13 bp, D. melanogaster
ggaggcgtggcac

SEQ ID NO: 631287 - DNA, 13 bp, D. melanogaster
ggaggcgtggcag

SEQ ID NO: 631288 - DNA, 14 bp, D. melanogaster
ggaggcgtggcagg

SEQ ID NO: 631289 - DNA, 13 bp, D. melanogaster
ggaggcgtggccg

SEQ ID NO: 631290 - DNA, 13 bp, D. melanogaster
ggaggcgtggctg

SEQ ID NO: 631291 - DNA, 13 bp, D. melanogaster
ggaggcttgtttt

SEQ ID NO: 631292 - DNA, 14 bp, D. melanogaster
ggaggctttgaaca

SEQ ID NO: 631293 - DNA, 14 bp, D. melanogaster
ggaggggcgtggcc

SEQ ID NO: 631294 - DNA, 13 bp, D. melanogaster
ggaggtgtggccg

SEQ ID NO: 631295 - DNA, 13 bp, D. melanogaster
ggaggtttgagtg

SEQ ID NO: 631296 - DNA, 13 bp, D. melanogaster
ggagtacaaaaaa

SEQ ID NO: 631297 - DNA, 13 bp, D. melanogaster
ggagtaggagcag

SEQ ID NO: 631298 - DNA, 13 bp, D. melanogaster
ggagtatgcagta

SEQ ID NO: 631299 - DNA, 13 bp, D. melanogaster
ggagtatggcatg

SEQ ID NO: 631300 - DNA, 13 bp, D. melanogaster
ggagtcacccggt

SEQ ID NO: 631301 - DNA, 13 bp, D. melanogaster
ggagtccacaata

SEQ ID NO: 631302 - DNA, 15 bp, D. melanogaster
ggagtccacaatacg

SEQ ID NO: 631303 - DNA, 13 bp, D. melanogaster
ggagtccccactg

SEQ ID NO: 631304 - DNA, 13 bp, D. melanogaster
ggagtccggagtc

SEQ ID NO: 631305 - DNA, 13 bp, D. melanogaster
ggagtcgagtcga

SEQ ID NO: 631306 - DNA, 13 bp, D. melanogaster
ggagtcgagtgga

SEQ ID NO: 631307 - DNA, 13 bp, D. melanogaster
ggagtcggagtcg

SEQ ID NO: 631308 - DNA, 13 bp, D. melanogaster
ggagtctttgtgt

SEQ ID NO: 631309 - DNA, 13 bp, D. melanogaster
ggagtgaagtgga

SEQ ID NO: 631310 - DNA, 13 bp, D. melanogaster
ggagtgagccgaa

SEQ ID NO: 631311 - DNA, 13 bp, D. melanogaster
ggagtgagcgaga

SEQ ID NO: 631312 - DNA, 14 bp, D. melanogaster
ggagtgagcggaaa

SEQ ID NO: 631313 - DNA, 13 bp, D. melanogaster
ggagtgccgtggc

SEQ ID NO: 631314 - DNA, 13 bp, D. melanogaster
ggagtgcgacctg

SEQ ID NO: 631315 - DNA, 13 bp, D. melanogaster
ggagtggagtggc

SEQ ID NO: 631316 - DNA, 13 bp, D. melanogaster
ggagtggcagtgg

SEQ ID NO: 631317 - DNA, 13 bp, D. melanogaster
ggagtggcataat

SEQ ID NO: 631318 - DNA, 13 bp, D. melanogaster
ggagtgggcggaa

SEQ ID NO: 631319 - DNA, 14 bp, D. melanogaster
ggagtgggcgtggc

SEQ ID NO: 631320 - DNA, 14 bp, D. melanogaster
ggagtgttgaaaat

SEQ ID NO: 631321 - DNA, 14 bp, D. melanogaster
ggagttaccgaata

SEQ ID NO: 631322 - DNA, 13 bp, D. melanogaster
ggagttcaatgag

SEQ ID NO: 631323 - DNA, 13 bp, D. melanogaster
ggagttgaagttg

SEQ ID NO: 631324 - DNA, 13 bp, D. melanogaster
ggagttgctgctg

SEQ ID NO: 631325 - DNA, 13 bp, D. melanogaster
ggagttggagatg

SEQ ID NO: 631326 - DNA, 13 bp, D. melanogaster
ggagttggagctg

SEQ ID NO: 631327 - DNA, 13 bp, D. melanogaster
ggagttggagttg

SEQ ID NO: 631328 - DNA, 13 bp, D. melanogaster
ggagttggagttt

SEQ ID NO: 631329 - DNA, 13 bp, D. melanogaster
ggagttggccaaa

SEQ ID NO: 631330 - DNA, 13 bp, D. melanogaster
ggagttggccaag

SEQ ID NO: 631331 - DNA, 13 bp, D. melanogaster
ggagttgtataga

SEQ ID NO: 631332 - DNA, 13 bp, D. melanogaster
ggagtttctggag

SEQ ID NO: 631333 - DNA, 13 bp, D. melanogaster
ggagtttggagtt

SEQ ID NO: 631334 - DNA, 13 bp, D. melanogaster
ggagtttggtgct

SEQ ID NO: 631335 - DNA, 13 bp, D. melanogaster
ggagttttaagca

SEQ ID NO: 631336 - DNA, 14 bp, D. melanogaster
ggagttttggggct

SEQ ID NO: 631337 - DNA, 13 bp, D. melanogaster
ggataaaaaatac

SEQ ID NO: 631338 - DNA, 13 bp, D. melanogaster
ggataaaatttct

SEQ ID NO: 631339 - DNA, 13 bp, D. melanogaster
ggataaacaaaca

SEQ ID NO: 631340 - DNA, 13 bp, D. melanogaster
ggataaataatta

SEQ ID NO: 631341 - DNA, 13 bp, D. melanogaster
ggataaattggag

SEQ ID NO: 631342 - DNA, 13 bp, D. melanogaster
ggataaccataat

SEQ ID NO: 631343 - DNA, 13 bp, D. melanogaster
ggataaccgaatt

SEQ ID NO: 631344 - DNA, 13 bp, D. melanogaster
ggataaggataag

SEQ ID NO: 631345 - DNA, 14 bp, D. melanogaster
ggataaggataagg

SEQ ID NO: 631346 - DNA, 14 bp, D. melanogaster
ggataatacaaaaa

SEQ ID NO: 631347 - DNA, 13 bp, D. melanogaster
ggataatgtggaa

SEQ ID NO: 631348 - DNA, 13 bp, D. melanogaster
ggatacaaggata

SEQ ID NO: 631349 - DNA, 13 bp, D. melanogaster
ggatacaatattt

SEQ ID NO: 631350 - DNA, 13 bp, D. melanogaster
ggatacagataca

SEQ ID NO: 631351 - DNA, 13 bp, D. melanogaster
ggatacagatacg

SEQ ID NO: 631352 - DNA, 13 bp, D. melanogaster
ggatacaggatac

SEQ ID NO: 631353 - DNA, 13 bp, D. melanogaster
ggatacattttta

SEQ ID NO: 631354 - DNA, 13 bp, D. melanogaster
ggatacggaaatg

SEQ ID NO: 631355 - DNA, 13 bp, D. melanogaster
ggatacggataca

SEQ ID NO: 631356 - DNA, 13 bp, D. melanogaster
ggatacggatacg

SEQ ID NO: 631357 - DNA, 14 bp, D. melanogaster
ggatacggatacgg

SEQ ID NO: 631358 - DNA, 13 bp, D. melanogaster
ggatacttttact

SEQ ID NO: 631359 - DNA, 13 bp, D. melanogaster
ggatagaaaatta

SEQ ID NO: 631360 - DNA, 13 bp, D. melanogaster
ggatagccgacaa

SEQ ID NO: 631361 - DNA, 13 bp, D. melanogaster
ggatagctggata

SEQ ID NO: 631362 - DNA, 13 bp, D. melanogaster
ggataggaaattt

SEQ ID NO: 631363 - DNA, 13 bp, D. melanogaster
ggataggatagga

SEQ ID NO: 631364 - DNA, 13 bp, D. melanogaster
ggatagggatagg

SEQ ID NO: 631365 - DNA, 13 bp, D. melanogaster
ggatatacataca

SEQ ID NO: 631366 - DNA, 14 bp, D. melanogaster
ggatatacatacat

SEQ ID NO: 631367 - DNA, 13 bp, D. melanogaster
ggatatatacata

SEQ ID NO: 631368 - DNA, 14 bp, D. melanogaster
ggatatatacatat

SEQ ID NO: 631369 - DNA, 13 bp, D. melanogaster
ggatatatataca

SEQ ID NO: 631370 - DNA, 13 bp, D. melanogaster
ggatatatatatt

SEQ ID NO: 631371 - DNA, 14 bp, D. melanogaster
ggatatatatattt

SEQ ID NO: 631372 - DNA, 13 bp, D. melanogaster
ggatatatatgta

SEQ ID NO: 631373 - DNA, 13 bp, D. melanogaster
ggatatcgaaagt

SEQ ID NO: 631374 - DNA, 14 bp, D. melanogaster
ggatatcgaaagtg

SEQ ID NO: 631375 - DNA, 13 bp, D. melanogaster
ggatatctggata

SEQ ID NO: 631376 - DNA, 13 bp, D. melanogaster
ggatatgccaaat

SEQ ID NO: 631377 - DNA, 13 bp, D. melanogaster
ggatatggatata

SEQ ID NO: 631378 - DNA, 14 bp, D. melanogaster
ggatatggatatgg

SEQ ID NO: 631379 - DNA, 13 bp, D. melanogaster
ggatatggatatt

SEQ ID NO: 631380 - DNA, 13 bp, D. melanogaster
ggatatggatgga

SEQ ID NO: 631381 - DNA, 13 bp, D. melanogaster
ggatatggatgtg

SEQ ID NO: 631382 - DNA, 13 bp, D. melanogaster
ggatattatttat

SEQ ID NO: 631383 - DNA, 13 bp, D. melanogaster
ggatattgtaata

SEQ ID NO: 631384 - DNA, 13 bp, D. melanogaster
ggatatttaaaaa

SEQ ID NO: 631385 - DNA, 13 bp, D. melanogaster
ggatatttataaa

SEQ ID NO: 631386 - DNA, 13 bp, D. melanogaster
ggatatttattta

SEQ ID NO: 631387 - DNA, 13 bp, D. melanogaster
ggatatttcaaag

SEQ ID NO: 631388 - DNA, 13 bp, D. melanogaster
ggatatttttgaa

SEQ ID NO: 631389 - DNA, 13 bp, D. melanogaster
ggatatttttgtg

SEQ ID NO: 631390 - DNA, 13 bp, D. melanogaster
ggatcaaataaca

SEQ ID NO: 631391 - DNA, 13 bp, D. melanogaster
ggatcaatagccg

SEQ ID NO: 631392 - DNA, 13 bp, D. melanogaster
ggatcacaattac

SEQ ID NO: 631393 - DNA, 13 bp, D. melanogaster
ggatcacctgttc

SEQ ID NO: 631394 - DNA, 13 bp, D. melanogaster
ggatcagcaggca

SEQ ID NO: 631395 - DNA, 13 bp, D. melanogaster
ggatcaggagcag

SEQ ID NO: 631396 - DNA, 13 bp, D. melanogaster
ggatcagttattg

SEQ ID NO: 631397 - DNA, 13 bp, D. melanogaster
ggatcataattat

SEQ ID NO: 631398 - DNA, 13 bp, D. melanogaster
ggatcatcatgga

SEQ ID NO: 631399 - DNA, 13 bp, D. melanogaster
ggatccaggatcc

SEQ ID NO: 631400 - DNA, 13 bp, D. melanogaster
ggatccgaaacag

SEQ ID NO: 631401 - DNA, 13 bp, D. melanogaster
ggatcctggatcc

SEQ ID NO: 631402 - DNA, 13 bp, D. melanogaster
ggatcggaatcgg

SEQ ID NO: 631403 - DNA, 13 bp, D. melanogaster
ggatcggatcgga

SEQ ID NO: 631404 - DNA, 14 bp, D. melanogaster
ggatcggatcggat

SEQ ID NO: 631405 - DNA, 14 bp, D. melanogaster
ggatcggattggat

SEQ ID NO: 631406 - DNA, 13 bp, D. melanogaster
ggatcgggaatcg

SEQ ID NO: 631407 - DNA, 13 bp, D. melanogaster
ggatcgggatcgg

SEQ ID NO: 631408 - DNA, 13 bp, D. melanogaster
ggatcgtatcgga

SEQ ID NO: 631409 - DNA, 13 bp, D. melanogaster
ggatctcgacttg

SEQ ID NO: 631410 - DNA, 13 bp, D. melanogaster
ggatctggaagat

SEQ ID NO: 631411 - DNA, 13 bp, D. melanogaster
ggatctggatctg

SEQ ID NO: 631412 - DNA, 13 bp, D. melanogaster
ggatctgttgcat

SEQ ID NO: 631413 - DNA, 13 bp, D. melanogaster
ggatcttttgccc

SEQ ID NO: 631414 - DNA, 15 bp, D. melanogaster
ggatgagaattgtca

SEQ ID NO: 631415 - DNA, 13 bp, D. melanogaster
ggatgagattaaa

SEQ ID NO: 631416 - DNA, 13 bp, D. melanogaster
ggatgagctgata

SEQ ID NO: 631417 - DNA, 13 bp, D. melanogaster
ggatgaggacatg

SEQ ID NO: 631418 - DNA, 13 bp, D. melanogaster
ggatgaggatgag

SEQ ID NO: 631419 - DNA, 13 bp, D. melanogaster
ggatgaggatgtg

SEQ ID NO: 631420 - DNA, 14 bp, D. melanogaster
ggatgaggatgtgg

SEQ ID NO: 631421 - DNA, 13 bp, D. melanogaster
ggatgataaatct

SEQ ID NO: 631422 - DNA, 13 bp, D. melanogaster
ggatgatatggat

SEQ ID NO: 631423 - DNA, 13 bp, D. melanogaster
ggatgatattata

SEQ ID NO: 631424 - DNA, 14 bp, D. melanogaster
ggatgatgatgatc

SEQ ID NO: 631425 - DNA, 13 bp, D. melanogaster
ggatgcaaaaaaa

SEQ ID NO: 631426 - DNA, 14 bp, D. melanogaster
ggatgcaaaaggat

SEQ ID NO: 631427 - DNA, 13 bp, D. melanogaster
ggatgcagataca

SEQ ID NO: 631428 - DNA, 13 bp, D. melanogaster
ggatgcagatgca

SEQ ID NO: 631429 - DNA, 14 bp, D. melanogaster
ggatgcagatgcag

SEQ ID NO: 631430 - DNA, 14 bp, D. melanogaster
ggatgcagtgcagc

SEQ ID NO: 631431 - DNA, 13 bp, D. melanogaster
ggatgccaagaaa

SEQ ID NO: 631432 - DNA, 13 bp, D. melanogaster
ggatgccaggatg

SEQ ID NO: 631433 - DNA, 14 bp, D. melanogaster
ggatgccaggatgc

SEQ ID NO: 631434 - DNA, 13 bp, D. melanogaster
ggatgcccagcgt

SEQ ID NO: 631435 - DNA, 13 bp, D. melanogaster
ggatgccgggatg

SEQ ID NO: 631436 - DNA, 13 bp, D. melanogaster
ggatgcggatgag

SEQ ID NO: 631437 - DNA, 14 bp, D. melanogaster
ggatgcggatgcga

SEQ ID NO: 631438 - DNA, 13 bp, D. melanogaster
ggatgcggatgct

SEQ ID NO: 631439 - DNA, 13 bp, D. melanogaster
ggatgcggatggg

SEQ ID NO: 631440 - DNA, 14 bp, D. melanogaster
ggatgcggatgggg

SEQ ID NO: 631441 - DNA, 13 bp, D. melanogaster
ggatgcggatgtg

SEQ ID NO: 631442 - DNA, 13 bp, D. melanogaster
ggatgcgttgccc

SEQ ID NO: 631443 - DNA, 13 bp, D. melanogaster
ggatgctgctgct

SEQ ID NO: 631444 - DNA, 14 bp, D. melanogaster
ggatgctgctgctg

SEQ ID NO: 631445 - DNA, 13 bp, D. melanogaster
ggatgctgggatg

SEQ ID NO: 631446 - DNA, 14 bp, D. melanogaster
ggatgctgggatgc

SEQ ID NO: 631447 - DNA, 13 bp, D. melanogaster
ggatgcttggatg

SEQ ID NO: 631448 - DNA, 13 bp, D. melanogaster
ggatggagatgga

SEQ ID NO: 631449 - DNA, 13 bp, D. melanogaster
ggatggatgaatg

SEQ ID NO: 631450 - DNA, 13 bp, D. melanogaster
ggatggatgcctg

SEQ ID NO: 631451 - DNA, 14 bp, D. melanogaster
ggatggatggatga

SEQ ID NO: 631452 - DNA, 14 bp, D. melanogaster
ggatggatggatgg

SEQ ID NO: 631453 - DNA, 13 bp, D. melanogaster
ggatggatggctg

SEQ ID NO: 631454 - DNA, 13 bp, D. melanogaster
ggatggattgcaa

SEQ ID NO: 631455 - DNA, 14 bp, D. melanogaster
ggatggcaggatgg

SEQ ID NO: 631456 - DNA, 13 bp, D. melanogaster
ggatggcatggga

SEQ ID NO: 631457 - DNA, 13 bp, D. melanogaster
ggatggccagttg

SEQ ID NO: 631458 - DNA, 13 bp, D. melanogaster
ggatggcgatggc

SEQ ID NO: 631459 - DNA, 13 bp, D. melanogaster
ggatggcggatgg

SEQ ID NO: 631460 - DNA, 13 bp, D. melanogaster
ggatggctggatg

SEQ ID NO: 631461 - DNA, 13 bp, D. melanogaster
ggatggctggctg

SEQ ID NO: 631462 - DNA, 13 bp, D. melanogaster
ggatggctggttg

SEQ ID NO: 631463 - DNA, 13 bp, D. melanogaster
ggatgggatggat

SEQ ID NO: 631464 - DNA, 14 bp, D. melanogaster
ggatgggatgggat

SEQ ID NO: 631465 - DNA, 13 bp, D. melanogaster
ggatggggcagga

SEQ ID NO: 631466 - DNA, 13 bp, D. melanogaster
ggatggggttcta

SEQ ID NO: 631467 - DNA, 13 bp, D. melanogaster
ggatggttggctg

SEQ ID NO: 631468 - DNA, 13 bp, D. melanogaster
ggatgtacacttt

SEQ ID NO: 631469 - DNA, 14 bp, D. melanogaster
ggatgtgaatgtgg

SEQ ID NO: 631470 - DNA, 13 bp, D. melanogaster
ggatgtgaggcca

SEQ ID NO: 631471 - DNA, 13 bp, D. melanogaster
ggatgtgcatgtg

SEQ ID NO: 631472 - DNA, 13 bp, D. melanogaster
ggatgtgccagga

SEQ ID NO: 631473 - DNA, 13 bp, D. melanogaster
ggatgtggaaatg

SEQ ID NO: 631474 - DNA, 13 bp, D. melanogaster
ggatgtggaagtg

SEQ ID NO: 631475 - DNA, 14 bp, D. melanogaster
ggatgtggaagtgg

SEQ ID NO: 631476 - DNA, 14 bp, D. melanogaster
ggatgtggacgatg

SEQ ID NO: 631477 - DNA, 13 bp, D. melanogaster
ggatgtggacgtg

SEQ ID NO: 631478 - DNA, 13 bp, D. melanogaster
ggatgtggagcag

SEQ ID NO: 631479 - DNA, 13 bp, D. melanogaster
ggatgtggatctg

SEQ ID NO: 631480 - DNA, 13 bp, D. melanogaster
ggatgtggatgag

SEQ ID NO: 631481 - DNA, 14 bp, D. melanogaster
ggatgtggatgagg

SEQ ID NO: 631482 - DNA, 13 bp, D. melanogaster
ggatgtggatgca

SEQ ID NO: 631483 - DNA, 13 bp, D. melanogaster
ggatgtggatgcc

SEQ ID NO: 631484 - DNA, 13 bp, D. melanogaster
ggatgtggatgcg

SEQ ID NO: 631485 - DNA, 14 bp, D. melanogaster
ggatgtggatgcgg

SEQ ID NO: 631486 - DNA, 13 bp, D. melanogaster
ggatgtggatgga

SEQ ID NO: 631487 - DNA, 13 bp, D. melanogaster
ggatgtggatgta

SEQ ID NO: 631488 - DNA, 13 bp, D. melanogaster
ggatgtggatgtg

SEQ ID NO: 631489 - DNA, 13 bp, D. melanogaster
ggatgtggatttg

SEQ ID NO: 631490 - DNA, 13 bp, D. melanogaster
ggatgtgggcgtg

SEQ ID NO: 631491 - DNA, 13 bp, D. melanogaster
ggatgtgtatgtg

SEQ ID NO: 631492 - DNA, 13 bp, D. melanogaster
ggatgttaatgtt

SEQ ID NO: 631493 - DNA, 13 bp, D. melanogaster
ggatgttgctgct

SEQ ID NO: 631494 - DNA, 13 bp, D. melanogaster
ggatgttgttgct

SEQ ID NO: 631495 - DNA, 13 bp, D. melanogaster
ggattatcaattc

SEQ ID NO: 631496 - DNA, 13 bp, D. melanogaster
ggattatggaagc

SEQ ID NO: 631497 - DNA, 13 bp, D. melanogaster
ggattattattat

SEQ ID NO: 631498 - DNA, 13 bp, D. melanogaster
ggattattgcatt

SEQ ID NO: 631499 - DNA, 13 bp, D. melanogaster
ggattcagattca

SEQ ID NO: 631500 - DNA, 13 bp, D. melanogaster
ggattcagattcg

SEQ ID NO: 631501 - DNA, 13 bp, D. melanogaster
ggattcaggactc

SEQ ID NO: 631502 - DNA, 13 bp, D. melanogaster
ggattcaggattc

SEQ ID NO: 631503 - DNA, 14 bp, D. melanogaster
ggattcattatttt

SEQ ID NO: 631504 - DNA, 13 bp, D. melanogaster
ggattccatcaaa

SEQ ID NO: 631505 - DNA, 13 bp, D. melanogaster
ggattccatcaga

SEQ ID NO: 631506 - DNA, 13 bp, D. melanogaster
ggattccggattc

SEQ ID NO: 631507 - DNA, 13 bp, D. melanogaster
ggattcctggcca

SEQ ID NO: 631508 - DNA, 13 bp, D. melanogaster
ggattcctttaag

SEQ ID NO: 631509 - DNA, 13 bp, D. melanogaster
ggattcgcattcg

SEQ ID NO: 631510 - DNA, 13 bp, D. melanogaster
ggattcggaatcg

SEQ ID NO: 631511 - DNA, 13 bp, D. melanogaster
ggattcggaatgg

SEQ ID NO: 631512 - DNA, 13 bp, D. melanogaster
ggattcggattca

SEQ ID NO: 631513 - DNA, 14 bp, D. melanogaster
ggattcggattcag

SEQ ID NO: 631514 - DNA, 13 bp, D. melanogaster
ggattcggattcc

SEQ ID NO: 631515 - DNA, 14 bp, D. melanogaster
ggattcggattcga

SEQ ID NO: 631516 - DNA, 13 bp, D. melanogaster
ggattcggattgg

SEQ ID NO: 631517 - DNA, 14 bp, D. melanogaster
ggattcggattggg

SEQ ID NO: 631518 - DNA, 14 bp, D. melanogaster
ggattcggatttgg

SEQ ID NO: 631519 - DNA, 13 bp, D. melanogaster
ggattgaggagaa

SEQ ID NO: 631520 - DNA, 13 bp, D. melanogaster
ggattgattgatt

SEQ ID NO: 631521 - DNA, 13 bp, D. melanogaster
ggattgattggca

SEQ ID NO: 631522 - DNA, 13 bp, D. melanogaster
ggattgcaatgca

SEQ ID NO: 631523 - DNA, 13 bp, D. melanogaster
ggattgcagaatg

SEQ ID NO: 631524 - DNA, 13 bp, D. melanogaster
ggattgcggattg

SEQ ID NO: 631525 - DNA, 13 bp, D. melanogaster
ggattgctggatt

SEQ ID NO: 631526 - DNA, 13 bp, D. melanogaster
ggattggaatggg

SEQ ID NO: 631527 - DNA, 13 bp, D. melanogaster
ggattggaattgg

SEQ ID NO: 631528 - DNA, 13 bp, D. melanogaster
ggattggatagaa

SEQ ID NO: 631529 - DNA, 13 bp, D. melanogaster
ggattggatcgga

SEQ ID NO: 631530 - DNA, 13 bp, D. melanogaster
ggattggattgga

SEQ ID NO: 631531 - DNA, 14 bp, D. melanogaster
ggattggattggat

SEQ ID NO: 631532 - DNA, 13 bp, D. melanogaster
ggattggattggc

SEQ ID NO: 631533 - DNA, 13 bp, D. melanogaster
ggattggatttgg

SEQ ID NO: 631534 - DNA, 14 bp, D. melanogaster
ggattgggaatggg

SEQ ID NO: 631535 - DNA, 13 bp, D. melanogaster
ggattgggatgat

SEQ ID NO: 631536 - DNA, 13 bp, D. melanogaster
ggattgggattgc

SEQ ID NO: 631537 - DNA, 13 bp, D. melanogaster
ggattgggattgg

SEQ ID NO: 631538 - DNA, 13 bp, D. melanogaster
ggattgggattgt

SEQ ID NO: 631539 - DNA, 13 bp, D. melanogaster
ggattgggatttg

SEQ ID NO: 631540 - DNA, 14 bp, D. melanogaster
ggattgggatttgg

SEQ ID NO: 631541 - DNA, 13 bp, D. melanogaster
ggattgggcttgg

SEQ ID NO: 631542 - DNA, 13 bp, D. melanogaster
ggattggggagtc

SEQ ID NO: 631543 - DNA, 13 bp, D. melanogaster
ggattggggattg

SEQ ID NO: 631544 - DNA, 14 bp, D. melanogaster
ggatttaaaaattt

SEQ ID NO: 631545 - DNA, 13 bp, D. melanogaster
ggatttaataaag

SEQ ID NO: 631546 - DNA, 13 bp, D. melanogaster
ggatttatcaaaa

SEQ ID NO: 631547 - DNA, 13 bp, D. melanogaster
ggatttcaagcta

SEQ ID NO: 631548 - DNA, 13 bp, D. melanogaster
ggatttcatcaaa

SEQ ID NO: 631549 - DNA, 13 bp, D. melanogaster
ggatttcattaag

SEQ ID NO: 631550 - DNA, 13 bp, D. melanogaster
ggatttccaagtt

SEQ ID NO: 631551 - DNA, 13 bp, D. melanogaster
ggatttcggattt

SEQ ID NO: 631552 - DNA, 13 bp, D. melanogaster
ggatttgcctaag

SEQ ID NO: 631553 - DNA, 13 bp, D. melanogaster
ggatttggatgtg

SEQ ID NO: 631554 - DNA, 13 bp, D. melanogaster
ggatttggattcg

SEQ ID NO: 631555 - DNA, 14 bp, D. melanogaster
ggatttggatttga

SEQ ID NO: 631556 - DNA, 14 bp, D. melanogaster
ggatttggatttgg

SEQ ID NO: 631557 - DNA, 13 bp, D. melanogaster
ggatttggatttt

SEQ ID NO: 631558 - DNA, 13 bp, D. melanogaster
ggatttggcctaa

SEQ ID NO: 631559 - DNA, 13 bp, D. melanogaster
ggatttggctttg

SEQ ID NO: 631560 - DNA, 13 bp, D. melanogaster
ggatttgggattt

SEQ ID NO: 631561 - DNA, 14 bp, D. melanogaster
ggatttggtcggaa

SEQ ID NO: 631562 - DNA, 13 bp, D. melanogaster
ggatttgtatggg

SEQ ID NO: 631563 - DNA, 13 bp, D. melanogaster
ggattttaattcc

SEQ ID NO: 631564 - DNA, 13 bp, D. melanogaster
ggattttatatat

SEQ ID NO: 631565 - DNA, 13 bp, D. melanogaster
ggattttcaaaaa

SEQ ID NO: 631566 - DNA, 13 bp, D. melanogaster
ggattttcgattt

SEQ ID NO: 631567 - DNA, 13 bp, D. melanogaster
ggattttctaatt

SEQ ID NO: 631568 - DNA, 13 bp, D. melanogaster
ggattttctgaaa

SEQ ID NO: 631569 - DNA, 13 bp, D. melanogaster
ggattttgaaaaa

SEQ ID NO: 631570 - DNA, 13 bp, D. melanogaster
ggattttgatctt

SEQ ID NO: 631571 - DNA, 13 bp, D. melanogaster
ggattttgccaaa

SEQ ID NO: 631572 - DNA, 13 bp, D. melanogaster
ggattttggattg

SEQ ID NO: 631573 - DNA, 13 bp, D. melanogaster
ggattttggattt

SEQ ID NO: 631574 - DNA, 13 bp, D. melanogaster
ggattttgtaaaa

SEQ ID NO: 631575 - DNA, 13 bp, D. melanogaster
ggattttgtgagt

SEQ ID NO: 631576 - DNA, 13 bp, D. melanogaster
ggatttttaaata

SEQ ID NO: 631577 - DNA, 14 bp, D. melanogaster
ggatttttcttggg

SEQ ID NO: 631578 - DNA, 13 bp, D. melanogaster
ggatttttggatt

SEQ ID NO: 631579 - DNA, 13 bp, D. melanogaster
ggattttttcaat

SEQ ID NO: 631580 - DNA, 13 bp, D. melanogaster
ggcaaaaaaaact

SEQ ID NO: 631581 - DNA, 13 bp, D. melanogaster
ggcaaaaaacttt

SEQ ID NO: 631582 - DNA, 13 bp, D. melanogaster
ggcaaaaacaatt

SEQ ID NO: 631583 - DNA, 13 bp, D. melanogaster
ggcaaaaagcaac

SEQ ID NO: 631584 - DNA, 13 bp, D. melanogaster
ggcaaaaagcaga

SEQ ID NO: 631585 - DNA, 13 bp, D. melanogaster
ggcaaaaagcgaa

SEQ ID NO: 631586 - DNA, 13 bp, D. melanogaster
ggcaaaaaggaca

SEQ ID NO: 631587 - DNA, 13 bp, D. melanogaster
ggcaaaaagggac

SEQ ID NO: 631588 - DNA, 13 bp, D. melanogaster
ggcaaaaagtgtt

SEQ ID NO: 631589 - DNA, 13 bp, D. melanogaster
ggcaaaaagtttt

SEQ ID NO: 631590 - DNA, 14 bp, D. melanogaster
ggcaaaaagttttt

SEQ ID NO: 631591 - DNA, 13 bp, D. melanogaster
ggcaaaaatatat

SEQ ID NO: 631592 - DNA, 13 bp, D. melanogaster
ggcaaaaatattg

SEQ ID NO: 631593 - DNA, 13 bp, D. melanogaster
ggcaaaaatcaaa

SEQ ID NO: 631594 - DNA, 13 bp, D. melanogaster
ggcaaaaatgaaa

SEQ ID NO: 631595 - DNA, 13 bp, D. melanogaster
ggcaaaaatgcag

SEQ ID NO: 631596 - DNA, 13 bp, D. melanogaster
ggcaaaaatgtgc

SEQ ID NO: 631597 - DNA, 13 bp, D. melanogaster
ggcaaaaatgttt

SEQ ID NO: 631598 - DNA, 13 bp, D. melanogaster
ggcaaaacatttt

SEQ ID NO: 631599 - DNA, 13 bp, D. melanogaster
ggcaaaacgcaaa

SEQ ID NO: 631600 - DNA, 13 bp, D. melanogaster
ggcaaaacggaaa

SEQ ID NO: 631601 - DNA, 13 bp, D. melanogaster
ggcaaaacgtttt

SEQ ID NO: 631602 - DNA, 13 bp, D. melanogaster
ggcaaaagaaatt

SEQ ID NO: 631603 - DNA, 13 bp, D. melanogaster
ggcaaaagccaaa

SEQ ID NO: 631604 - DNA, 13 bp, D. melanogaster
ggcaaaagccaag

SEQ ID NO: 631605 - DNA, 13 bp, D. melanogaster
ggcaaaagcgaaa

SEQ ID NO: 631606 - DNA, 13 bp, D. melanogaster
ggcaaaaggaagc

SEQ ID NO: 631607 - DNA, 13 bp, D. melanogaster
ggcaaaaggactc

SEQ ID NO: 631608 - DNA, 13 bp, D. melanogaster
ggcaaaaggagca

SEQ ID NO: 631609 - DNA, 13 bp, D. melanogaster
ggcaaaaggcaaa

SEQ ID NO: 631610 - DNA, 13 bp, D. melanogaster
ggcaaaaggcgaa

SEQ ID NO: 631611 - DNA, 13 bp, D. melanogaster
ggcaaaagtaaaa

SEQ ID NO: 631612 - DNA, 13 bp, D. melanogaster
ggcaaaagttcaa

SEQ ID NO: 631613 - DNA, 13 bp, D. melanogaster
ggcaaaagttttg

SEQ ID NO: 631614 - DNA, 14 bp, D. melanogaster
ggcaaaagttttgc

SEQ ID NO: 631615 - DNA, 13 bp, D. melanogaster
ggcaaaataataa

SEQ ID NO: 631616 - DNA, 14 bp, D. melanogaster
ggcaaaatagtttt

SEQ ID NO: 631617 - DNA, 13 bp, D. melanogaster
ggcaaaatcaaca

SEQ ID NO: 631618 - DNA, 13 bp, D. melanogaster
ggcaaaatgcaaa

SEQ ID NO: 631619 - DNA, 14 bp, D. melanogaster
ggcaaaatggcaaa

SEQ ID NO: 631620 - DNA, 13 bp, D. melanogaster
ggcaaaatgttgc

SEQ ID NO: 631621 - DNA, 13 bp, D. melanogaster
ggcaaaattattt

SEQ ID NO: 631622 - DNA, 13 bp, D. melanogaster
ggcaaacaaacag

SEQ ID NO: 631623 - DNA, 13 bp, D. melanogaster
ggcaaacaaagca

SEQ ID NO: 631624 - DNA, 13 bp, D. melanogaster
ggcaaacaaagga

SEQ ID NO: 631625 - DNA, 13 bp, D. melanogaster
ggcaaacaaaggc

SEQ ID NO: 631626 - DNA, 14 bp, D. melanogaster
ggcaaacaaatcaa

SEQ ID NO: 631627 - DNA, 13 bp, D. melanogaster
ggcaaacaaatgc

SEQ ID NO: 631628 - DNA, 13 bp, D. melanogaster
ggcaaacaaattg

SEQ ID NO: 631629 - DNA, 13 bp, D. melanogaster
ggcaaacaaattt

SEQ ID NO: 631630 - DNA, 14 bp, D. melanogaster
ggcaaacaaattta

SEQ ID NO: 631631 - DNA, 13 bp, D. melanogaster
ggcaaacaacagc

SEQ ID NO: 631632 - DNA, 13 bp, D. melanogaster
ggcaaacaagcaa

SEQ ID NO: 631633 - DNA, 13 bp, D. melanogaster
ggcaaacaatgcc

SEQ ID NO: 631634 - DNA, 14 bp, D. melanogaster
ggcaaacaatttgc

SEQ ID NO: 631635 - DNA, 13 bp, D. melanogaster
ggcaaacacaaat

SEQ ID NO: 631636 - DNA, 13 bp, D. melanogaster
ggcaaacacaaca

SEQ ID NO: 631637 - DNA, 13 bp, D. melanogaster
ggcaaacacacac

SEQ ID NO: 631638 - DNA, 13 bp, D. melanogaster
ggcaaacagaaat

SEQ ID NO: 631639 - DNA, 13 bp, D. melanogaster
ggcaaacagaagc

SEQ ID NO: 631640 - DNA, 13 bp, D. melanogaster
ggcaaacagacag

SEQ ID NO: 631641 - DNA, 13 bp, D. melanogaster
ggcaaacagcaaa

SEQ ID NO: 631642 - DNA, 13 bp, D. melanogaster
ggcaaacagcgaa

SEQ ID NO: 631643 - DNA, 13 bp, D. melanogaster
ggcaaacaggcaa

SEQ ID NO: 631644 - DNA, 13 bp, D. melanogaster
ggcaaacatttgt

SEQ ID NO: 631645 - DNA, 13 bp, D. melanogaster
ggcaaacattttg

SEQ ID NO: 631646 - DNA, 14 bp, D. melanogaster
ggcaaacattttga

SEQ ID NO: 631647 - DNA, 13 bp, D. melanogaster
ggcaaacattttt

SEQ ID NO: 631648 - DNA, 13 bp, D. melanogaster
ggcaaaccaaaca

SEQ ID NO: 631649 - DNA, 13 bp, D. melanogaster
ggcaaacgaaata

SEQ ID NO: 631650 - DNA, 13 bp, D. melanogaster
ggcaaacgataaa

SEQ ID NO: 631651 - DNA, 13 bp, D. melanogaster
ggcaaacgcggat

SEQ ID NO: 631652 - DNA, 13 bp, D. melanogaster
ggcaaacggaaaa

SEQ ID NO: 631653 - DNA, 13 bp, D. melanogaster
ggcaaacggcaaa

SEQ ID NO: 631654 - DNA, 14 bp, D. melanogaster
ggcaaacggcaaac

SEQ ID NO: 631655 - DNA, 13 bp, D. melanogaster
ggcaaacgtaaaa

SEQ ID NO: 631656 - DNA, 13 bp, D. melanogaster
ggcaaactggcaa

SEQ ID NO: 631657 - DNA, 13 bp, D. melanogaster
ggcaaacttgttt

SEQ ID NO: 631658 - DNA, 13 bp, D. melanogaster
ggcaaacttttgc

SEQ ID NO: 631659 - DNA, 13 bp, D. melanogaster
ggcaaactttttg

SEQ ID NO: 631660 - DNA, 13 bp, D. melanogaster
ggcaaagaaaact

SEQ ID NO: 631661 - DNA, 13 bp, D. melanogaster
ggcaaagaaaagc

SEQ ID NO: 631662 - DNA, 13 bp, D. melanogaster
ggcaaagacaaag

SEQ ID NO: 631663 - DNA, 13 bp, D. melanogaster
ggcaaagcagaga

SEQ ID NO: 631664 - DNA, 13 bp, D. melanogaster
ggcaaagccaaag

SEQ ID NO: 631665 - DNA, 14 bp, D. melanogaster
ggcaaagccaaata

SEQ ID NO: 631666 - DNA, 13 bp, D. melanogaster
ggcaaagccataa

SEQ ID NO: 631667 - DNA, 13 bp, D. melanogaster
ggcaaaggaaatg

SEQ ID NO: 631668 - DNA, 13 bp, D. melanogaster
ggcaaaggcaaag

SEQ ID NO: 631669 - DNA, 14 bp, D. melanogaster
ggcaaaggcaaagg

SEQ ID NO: 631670 - DNA, 13 bp, D. melanogaster
ggcaaaggcaatg

SEQ ID NO: 631671 - DNA, 13 bp, D. melanogaster
ggcaaaggcagca

SEQ ID NO: 631672 - DNA, 13 bp, D. melanogaster
ggcaaagtgaaaa

SEQ ID NO: 631673 - DNA, 13 bp, D. melanogaster
ggcaaagtggaaa

SEQ ID NO: 631674 - DNA, 13 bp, D. melanogaster
ggcaaagtgggtg

SEQ ID NO: 631675 - DNA, 13 bp, D. melanogaster
ggcaaagttcaaa

SEQ ID NO: 631676 - DNA, 13 bp, D. melanogaster
ggcaaagtttaaa

SEQ ID NO: 631677 - DNA, 13 bp, D. melanogaster
ggcaaagttttcc

SEQ ID NO: 631678 - DNA, 13 bp, D. melanogaster
ggcaaataaaaat

SEQ ID NO: 631679 - DNA, 13 bp, D. melanogaster
ggcaaataaaaga

SEQ ID NO: 631680 - DNA, 13 bp, D. melanogaster
ggcaaataaaata

SEQ ID NO: 631681 - DNA, 13 bp, D. melanogaster
ggcaaataattaa

SEQ ID NO: 631682 - DNA, 13 bp, D. melanogaster
ggcaaataattat

SEQ ID NO: 631683 - DNA, 13 bp, D. melanogaster
ggcaaatacaaat

SEQ ID NO: 631684 - DNA, 13 bp, D. melanogaster
ggcaaatacaatt

SEQ ID NO: 631685 - DNA, 13 bp, D. melanogaster
ggcaaatacattt

SEQ ID NO: 631686 - DNA, 13 bp, D. melanogaster
ggcaaatagaaaa

SEQ ID NO: 631687 - DNA, 13 bp, D. melanogaster
ggcaaatagtttt

SEQ ID NO: 631688 - DNA, 14 bp, D. melanogaster
ggcaaatatttaat

SEQ ID NO: 631689 - DNA, 13 bp, D. melanogaster
ggcaaatatttgc

SEQ ID NO: 631690 - DNA, 13 bp, D. melanogaster
ggcaaatattttg

SEQ ID NO: 631691 - DNA, 13 bp, D. melanogaster
ggcaaatcaaaat

SEQ ID NO: 631692 - DNA, 13 bp, D. melanogaster
ggcaaatcaaagc

SEQ ID NO: 631693 - DNA, 13 bp, D. melanogaster
ggcaaatcaattt

SEQ ID NO: 631694 - DNA, 14 bp, D. melanogaster
ggcaaatcccattt

SEQ ID NO: 631695 - DNA, 13 bp, D. melanogaster
ggcaaatcgactt

SEQ ID NO: 631696 - DNA, 13 bp, D. melanogaster
ggcaaatcgattt

SEQ ID NO: 631697 - DNA, 13 bp, D. melanogaster
ggcaaatgaaaaa

SEQ ID NO: 631698 - DNA, 13 bp, D. melanogaster
ggcaaatgaaaag

SEQ ID NO: 631699 - DNA, 14 bp, D. melanogaster
ggcaaatgaaaagc

SEQ ID NO: 631700 - DNA, 14 bp, D. melanogaster
ggcaaatgaaaatg

SEQ ID NO: 631701 - DNA, 13 bp, D. melanogaster
ggcaaatgattaa

SEQ ID NO: 631702 - DNA, 13 bp, D. melanogaster
ggcaaatgcaaat

SEQ ID NO: 631703 - DNA, 14 bp, D. melanogaster
ggcaaatgcaaatg

SEQ ID NO: 631704 - DNA, 13 bp, D. melanogaster
ggcaaatgccaaa

SEQ ID NO: 631705 - DNA, 13 bp, D. melanogaster
ggcaaatgctcaa

SEQ ID NO: 631706 - DNA, 13 bp, D. melanogaster
ggcaaatggaaaa

SEQ ID NO: 631707 - DNA, 13 bp, D. melanogaster
ggcaaatggaaag

SEQ ID NO: 631708 - DNA, 13 bp, D. melanogaster
ggcaaatggcaaa

SEQ ID NO: 631709 - DNA, 13 bp, D. melanogaster
ggcaaatggcagc

SEQ ID NO: 631710 - DNA, 13 bp, D. melanogaster
ggcaaatggcgaa

SEQ ID NO: 631711 - DNA, 13 bp, D. melanogaster
ggcaaatgtaaat

SEQ ID NO: 631712 - DNA, 13 bp, D. melanogaster
ggcaaatgtaatt

SEQ ID NO: 631713 - DNA, 13 bp, D. melanogaster
ggcaaatgtggat

SEQ ID NO: 631714 - DNA, 13 bp, D. melanogaster
ggcaaatgttttc

SEQ ID NO: 631715 - DNA, 13 bp, D. melanogaster
ggcaaatgttttt

SEQ ID NO: 631716 - DNA, 13 bp, D. melanogaster
ggcaaattaaatt

SEQ ID NO: 631717 - DNA, 14 bp, D. melanogaster
ggcaaattaattaa

SEQ ID NO: 631718 - DNA, 13 bp, D. melanogaster
ggcaaattaattt

SEQ ID NO: 631719 - DNA, 13 bp, D. melanogaster
ggcaaattgaaaa

SEQ ID NO: 631720 - DNA, 13 bp, D. melanogaster
ggcaaattgaaag

SEQ ID NO: 631721 - DNA, 13 bp, D. melanogaster
ggcaaattgaaat

SEQ ID NO: 631722 - DNA, 13 bp, D. melanogaster
ggcaaattgaatt

SEQ ID NO: 631723 - DNA, 13 bp, D. melanogaster
ggcaaattgagtt

SEQ ID NO: 631724 - DNA, 13 bp, D. melanogaster
ggcaaattgcaaa

SEQ ID NO: 631725 - DNA, 13 bp, D. melanogaster
ggcaaatttaaaa

SEQ ID NO: 631726 - DNA, 13 bp, D. melanogaster
ggcaaattttcgg

SEQ ID NO: 631727 - DNA, 13 bp, D. melanogaster
ggcaacaaaaagc

SEQ ID NO: 631728 - DNA, 13 bp, D. melanogaster
ggcaacaaaatgg

SEQ ID NO: 631729 - DNA, 13 bp, D. melanogaster
ggcaacaaacttg

SEQ ID NO: 631730 - DNA, 13 bp, D. melanogaster
ggcaacaaagcaa

SEQ ID NO: 631731 - DNA, 13 bp, D. melanogaster
ggcaacaaagttg

SEQ ID NO: 631732 - DNA, 13 bp, D. melanogaster
ggcaacaaatgtg

SEQ ID NO: 631733 - DNA, 13 bp, D. melanogaster
ggcaacaaattga

SEQ ID NO: 631734 - DNA, 14 bp, D. melanogaster
ggcaacaaatttat

SEQ ID NO: 631735 - DNA, 14 bp, D. melanogaster
ggcaacaacaaaag

SEQ ID NO: 631736 - DNA, 13 bp, D. melanogaster
ggcaacaacaaag

SEQ ID NO: 631737 - DNA, 14 bp, D. melanogaster
ggcaacaacaaagg

SEQ ID NO: 631738 - DNA, 13 bp, D. melanogaster
ggcaacaacaaat

SEQ ID NO: 631739 - DNA, 13 bp, D. melanogaster
ggcaacaacaaca

SEQ ID NO: 631740 - DNA, 14 bp, D. melanogaster
ggcaacaacaacag

SEQ ID NO: 631741 - DNA, 14 bp, D. melanogaster
ggcaacaacaactg

SEQ ID NO: 631742 - DNA, 13 bp, D. melanogaster
ggcaacaacaagc

SEQ ID NO: 631743 - DNA, 13 bp, D. melanogaster
ggcaacaacaagt

SEQ ID NO: 631744 - DNA, 14 bp, D. melanogaster
ggcaacaacaagtc

SEQ ID NO: 631745 - DNA, 13 bp, D. melanogaster
ggcaacaacaata

SEQ ID NO: 631746 - DNA, 14 bp, D. melanogaster
ggcaacaacaataa

SEQ ID NO: 631747 - DNA, 14 bp, D. melanogaster
ggcaacaacaatgc

SEQ ID NO: 631748 - DNA, 13 bp, D. melanogaster
ggcaacaacaatt

SEQ ID NO: 631749 - DNA, 14 bp, D. melanogaster
ggcaacaacaattg

SEQ ID NO: 631750 - DNA, 14 bp, D. melanogaster
ggcaacaacagcag

SEQ ID NO: 631751 - DNA, 13 bp, D. melanogaster
ggcaacaagaaat

SEQ ID NO: 631752 - DNA, 13 bp, D. melanogaster
ggcaacaagaaca

SEQ ID NO: 631753 - DNA, 13 bp, D. melanogaster
ggcaacaataaaa

SEQ ID NO: 631754 - DNA, 14 bp, D. melanogaster
ggcaacaataaaaa

SEQ ID NO: 631755 - DNA, 13 bp, D. melanogaster
ggcaacaataaca

SEQ ID NO: 631756 - DNA, 14 bp, D. melanogaster
ggcaacaataacaa

SEQ ID NO: 631757 - DNA, 13 bp, D. melanogaster
ggcaacaatgcaa

SEQ ID NO: 631758 - DNA, 13 bp, D. melanogaster
ggcaacaatgttg

SEQ ID NO: 631759 - DNA, 13 bp, D. melanogaster
ggcaacaattgca

SEQ ID NO: 631760 - DNA, 13 bp, D. melanogaster
ggcaacaatttaa

SEQ ID NO: 631761 - DNA, 13 bp, D. melanogaster
ggcaacaatttat

SEQ ID NO: 631762 - DNA, 13 bp, D. melanogaster
ggcaacaatttcg

SEQ ID NO: 631763 - DNA, 13 bp, D. melanogaster
ggcaacaatttga

SEQ ID NO: 631764 - DNA, 13 bp, D. melanogaster
ggcaacacacaaa

SEQ ID NO: 631765 - DNA, 13 bp, D. melanogaster
ggcaacacacaca

SEQ ID NO: 631766 - DNA, 13 bp, D. melanogaster
ggcaacaccaaca

SEQ ID NO: 631767 - DNA, 13 bp, D. melanogaster
ggcaacacttttg

SEQ ID NO: 631768 - DNA, 14 bp, D. melanogaster
ggcaacagaacagc

SEQ ID NO: 631769 - DNA, 13 bp, D. melanogaster
ggcaacagcaaaa

SEQ ID NO: 631770 - DNA, 13 bp, D. melanogaster
ggcaacagcaaca

SEQ ID NO: 631771 - DNA, 14 bp, D. melanogaster
ggcaacagcaacaa

SEQ ID NO: 631772 - DNA, 13 bp, D. melanogaster
ggcaacagcagca

SEQ ID NO: 631773 - DNA, 14 bp, D. melanogaster
ggcaacagcagcaa

SEQ ID NO: 631774 - DNA, 14 bp, D. melanogaster
ggcaacagcagcag

SEQ ID NO: 631775 - DNA, 13 bp, D. melanogaster
ggcaacagctgcc

SEQ ID NO: 631776 - DNA, 13 bp, D. melanogaster
ggcaacagcttga

SEQ ID NO: 631777 - DNA, 13 bp, D. melanogaster
ggcaacaggaaaa

SEQ ID NO: 631778 - DNA, 13 bp, D. melanogaster
ggcaacatcaaca

SEQ ID NO: 631779 - DNA, 13 bp, D. melanogaster
ggcaacatggcaa

SEQ ID NO: 631780 - DNA, 13 bp, D. melanogaster
ggcaacatgttgc

SEQ ID NO: 631781 - DNA, 13 bp, D. melanogaster
ggcaacattttaa

SEQ ID NO: 631782 - DNA, 13 bp, D. melanogaster
ggcaacccaaaat

SEQ ID NO: 631783 - DNA, 13 bp, D. melanogaster
ggcaaccgaaaat

SEQ ID NO: 631784 - DNA, 13 bp, D. melanogaster
ggcaaccggcaac

SEQ ID NO: 631785 - DNA, 13 bp, D. melanogaster
ggcaacgaactcg

SEQ ID NO: 631786 - DNA, 13 bp, D. melanogaster
ggcaacgacaaca

SEQ ID NO: 631787 - DNA, 13 bp, D. melanogaster
ggcaacggcaaaa

SEQ ID NO: 631788 - DNA, 13 bp, D. melanogaster
ggcaacggcaaca

SEQ ID NO: 631789 - DNA, 14 bp, D. melanogaster
ggcaacggcaacag

SEQ ID NO: 631790 - DNA, 13 bp, D. melanogaster
ggcaacggggcgt

SEQ ID NO: 631791 - DNA, 13 bp, D. melanogaster
ggcaactaatgag

SEQ ID NO: 631792 - DNA, 14 bp, D. melanogaster
ggcaactaatgagg

SEQ ID NO: 631793 - DNA, 13 bp, D. melanogaster
ggcaactatttct

SEQ ID NO: 631794 - DNA, 13 bp, D. melanogaster
ggcaactgagtat

SEQ ID NO: 631795 - DNA, 13 bp, D. melanogaster
ggcaactgcaact

SEQ ID NO: 631796 - DNA, 13 bp, D. melanogaster
ggcaactgccaac

SEQ ID NO: 631797 - DNA, 13 bp, D. melanogaster
ggcaactggaaca

SEQ ID NO: 631798 - DNA, 13 bp, D. melanogaster
ggcaactggcaac

SEQ ID NO: 631799 - DNA, 14 bp, D. melanogaster
ggcaacttgaatat

SEQ ID NO: 631800 - DNA, 13 bp, D. melanogaster
ggcaacttggcaa

SEQ ID NO: 631801 - DNA, 13 bp, D. melanogaster
ggcaagaatgcca

SEQ ID NO: 631802 - DNA, 14 bp, D. melanogaster
ggcaagacttcctt

SEQ ID NO: 631803 - DNA, 13 bp, D. melanogaster
ggcaagagcaaca

SEQ ID NO: 631804 - DNA, 13 bp, D. melanogaster
ggcaagatttctt

SEQ ID NO: 631805 - DNA, 13 bp, D. melanogaster
ggcaagcaaacaa

SEQ ID NO: 631806 - DNA, 13 bp, D. melanogaster
ggcaagcatttca

SEQ ID NO: 631807 - DNA, 14 bp, D. melanogaster
ggcaagcatttcat

SEQ ID NO: 631808 - DNA, 13 bp, D. melanogaster
ggcaagcggcaaa

SEQ ID NO: 631809 - DNA, 13 bp, D. melanogaster
ggcaaggaaaaac

SEQ ID NO: 631810 - DNA, 13 bp, D. melanogaster
ggcaaggaaccat

SEQ ID NO: 631811 - DNA, 13 bp, D. melanogaster
ggcaaggaactgc

SEQ ID NO: 631812 - DNA, 13 bp, D. melanogaster
ggcaaggacatgg

SEQ ID NO: 631813 - DNA, 14 bp, D. melanogaster
ggcaaggtttatgt

SEQ ID NO: 631814 - DNA, 13 bp, D. melanogaster
ggcaagtgcaaaa

SEQ ID NO: 631815 - DNA, 13 bp, D. melanogaster
ggcaagtggaaaa

SEQ ID NO: 631816 - DNA, 13 bp, D. melanogaster
ggcaagtggcaaa

SEQ ID NO: 631817 - DNA, 13 bp, D. melanogaster
ggcaagttcaagt

SEQ ID NO: 631818 - DNA, 14 bp, D. melanogaster
ggcaagttgacaaa

SEQ ID NO: 631819 - DNA, 13 bp, D. melanogaster
ggcaagttggcaa

SEQ ID NO: 631820 - DNA, 13 bp, D. melanogaster
ggcaataaaaaat

SEQ ID NO: 631821 - DNA, 14 bp, D. melanogaster
ggcaataaaaacaa

SEQ ID NO: 631822 - DNA, 14 bp, D. melanogaster
ggcaataaaataaa

SEQ ID NO: 631823 - DNA, 13 bp, D. melanogaster
ggcaataaaatac

SEQ ID NO: 631824 - DNA, 14 bp, D. melanogaster
ggcaataaaatact

SEQ ID NO: 631825 - DNA, 13 bp, D. melanogaster
ggcaataaaatga

SEQ ID NO: 631826 - DNA, 13 bp, D. melanogaster
ggcaataaaatgt

SEQ ID NO: 631827 - DNA, 13 bp, D. melanogaster
ggcaataaacaaa

SEQ ID NO: 631828 - DNA, 14 bp, D. melanogaster
ggcaataaagttta

SEQ ID NO: 631829 - DNA, 13 bp, D. melanogaster
ggcaataaataaa

SEQ ID NO: 631830 - DNA, 13 bp, D. melanogaster
ggcaataaatcaa

SEQ ID NO: 631831 - DNA, 14 bp, D. melanogaster
ggcaataaatcaaa

SEQ ID NO: 631832 - DNA, 13 bp, D. melanogaster
ggcaataaatgca

SEQ ID NO: 631833 - DNA, 13 bp, D. melanogaster
ggcaataaattta

SEQ ID NO: 631834 - DNA, 13 bp, D. melanogaster
ggcaataacaaaa

SEQ ID NO: 631835 - DNA, 13 bp, D. melanogaster
ggcaataacaaca

SEQ ID NO: 631836 - DNA, 14 bp, D. melanogaster
ggcaataacaacaa

SEQ ID NO: 631837 - DNA, 13 bp, D. melanogaster
ggcaataagagtg

SEQ ID NO: 631838 - DNA, 13 bp, D. melanogaster
ggcaatagcaaca

SEQ ID NO: 631839 - DNA, 13 bp, D. melanogaster
ggcaatagcaata

SEQ ID NO: 631840 - DNA, 13 bp, D. melanogaster
ggcaatatgcaaa

SEQ ID NO: 631841 - DNA, 13 bp, D. melanogaster
ggcaatcaaaaaa

SEQ ID NO: 631842 - DNA, 13 bp, D. melanogaster
ggcaatcaaaagt

SEQ ID NO: 631843 - DNA, 13 bp, D. melanogaster
ggcaatcaaaata

SEQ ID NO: 631844 - DNA, 13 bp, D. melanogaster
ggcaatcaaatta

SEQ ID NO: 631845 - DNA, 15 bp, D. melanogaster
ggcaatcaaattggt

SEQ ID NO: 631846 - DNA, 13 bp, D. melanogaster
ggcaatcaaattt

SEQ ID NO: 631847 - DNA, 13 bp, D. melanogaster
ggcaatcaatcaa

SEQ ID NO: 631848 - DNA, 13 bp, D. melanogaster
ggcaatcaattaa

SEQ ID NO: 631849 - DNA, 13 bp, D. melanogaster
ggcaatcagcaaa

SEQ ID NO: 631850 - DNA, 13 bp, D. melanogaster
ggcaatcgaaaaa

SEQ ID NO: 631851 - DNA, 13 bp, D. melanogaster
ggcaatcgaaaat

SEQ ID NO: 631852 - DNA, 13 bp, D. melanogaster
ggcaatctaaata

SEQ ID NO: 631853 - DNA, 13 bp, D. melanogaster
ggcaatgaaaact

SEQ ID NO: 631854 - DNA, 14 bp, D. melanogaster
ggcaatgaaaactc

SEQ ID NO: 631855 - DNA, 13 bp, D. melanogaster
ggcaatgaaaatg

SEQ ID NO: 631856 - DNA, 13 bp, D. melanogaster
ggcaatgcaaatc

SEQ ID NO: 631857 - DNA, 13 bp, D. melanogaster
ggcaatgccagaa

SEQ ID NO: 631858 - DNA, 13 bp, D. melanogaster
ggcaatgcgaaaa

SEQ ID NO: 631859 - DNA, 13 bp, D. melanogaster
ggcaatggaaaat

SEQ ID NO: 631860 - DNA, 13 bp, D. melanogaster
ggcaatggcaatg

SEQ ID NO: 631861 - DNA, 14 bp, D. melanogaster
ggcaatggcaatgg

SEQ ID NO: 631862 - DNA, 13 bp, D. melanogaster
ggcaatggcaatt

SEQ ID NO: 631863 - DNA, 13 bp, D. melanogaster
ggcaatggcagcc

SEQ ID NO: 631864 - DNA, 13 bp, D. melanogaster
ggcaatgggcaat

SEQ ID NO: 631865 - DNA, 14 bp, D. melanogaster
ggcaatgggcaatg

SEQ ID NO: 631866 - DNA, 13 bp, D. melanogaster
ggcaatgtggcaa

SEQ ID NO: 631867 - DNA, 13 bp, D. melanogaster
ggcaatgttgttg

SEQ ID NO: 631868 - DNA, 13 bp, D. melanogaster
ggcaattaaaact

SEQ ID NO: 631869 - DNA, 13 bp, D. melanogaster
ggcaattaaataa

SEQ ID NO: 631870 - DNA, 13 bp, D. melanogaster
ggcaattaaattc

SEQ ID NO: 631871 - DNA, 13 bp, D. melanogaster
ggcaattaacttt

SEQ ID NO: 631872 - DNA, 13 bp, D. melanogaster
ggcaattaagcca

SEQ ID NO: 631873 - DNA, 13 bp, D. melanogaster
ggcaattaatcaa

SEQ ID NO: 631874 - DNA, 13 bp, D. melanogaster
ggcaattaattag

SEQ ID NO: 631875 - DNA, 13 bp, D. melanogaster
ggcaattaatttg

SEQ ID NO: 631876 - DNA, 13 bp, D. melanogaster
ggcaattacaaat

SEQ ID NO: 631877 - DNA, 13 bp, D. melanogaster
ggcaattagcatt

SEQ ID NO: 631878 - DNA, 13 bp, D. melanogaster
ggcaattattttg

SEQ ID NO: 631879 - DNA, 13 bp, D. melanogaster
ggcaattgaaaat

SEQ ID NO: 631880 - DNA, 13 bp, D. melanogaster
ggcaattgcaatt

SEQ ID NO: 631881 - DNA, 13 bp, D. melanogaster
ggcaattgcagtt

SEQ ID NO: 631882 - DNA, 13 bp, D. melanogaster
ggcaattgcattt

SEQ ID NO: 631883 - DNA, 14 bp, D. melanogaster
ggcaatttaattaa

SEQ ID NO: 631884 - DNA, 13 bp, D. melanogaster
ggcaatttattaa

SEQ ID NO: 631885 - DNA, 13 bp, D. melanogaster
ggcaatttggcaa

SEQ ID NO: 631886 - DNA, 13 bp, D. melanogaster
ggcaatttgtggc

SEQ ID NO: 631887 - DNA, 13 bp, D. melanogaster
ggcaatttgttgg

SEQ ID NO: 631888 - DNA, 13 bp, D. melanogaster
ggcacaaaaaatg

SEQ ID NO: 631889 - DNA, 13 bp, D. melanogaster
ggcacaaaaaccg

SEQ ID NO: 631890 - DNA, 13 bp, D. melanogaster
ggcacaaaatgtt

SEQ ID NO: 631891 - DNA, 13 bp, D. melanogaster
ggcacaaaggatg

SEQ ID NO: 631892 - DNA, 13 bp, D. melanogaster
ggcacaaataaaa

SEQ ID NO: 631893 - DNA, 13 bp, D. melanogaster
ggcacaaatgaaa

SEQ ID NO: 631894 - DNA, 13 bp, D. melanogaster
ggcacaaattaat

SEQ ID NO: 631895 - DNA, 13 bp, D. melanogaster
ggcacaaattttg

SEQ ID NO: 631896 - DNA, 13 bp, D. melanogaster
ggcacaacaacaa

SEQ ID NO: 631897 - DNA, 13 bp, D. melanogaster
ggcacaattacca

SEQ ID NO: 631898 - DNA, 13 bp, D. melanogaster
ggcacacaaaagg

SEQ ID NO: 631899 - DNA, 13 bp, D. melanogaster
ggcacacacacat

SEQ ID NO: 631900 - DNA, 13 bp, D. melanogaster
ggcacacatacac

SEQ ID NO: 631901 - DNA, 13 bp, D. melanogaster
ggcacaccaagga

SEQ ID NO: 631902 - DNA, 13 bp, D. melanogaster
ggcacacgatttt

SEQ ID NO: 631903 - DNA, 13 bp, D. melanogaster
ggcacagatacag

SEQ ID NO: 631904 - DNA, 13 bp, D. melanogaster
ggcacagcgataa

SEQ ID NO: 631905 - DNA, 13 bp, D. melanogaster
ggcacaggcacag

SEQ ID NO: 631906 - DNA, 13 bp, D. melanogaster
ggcacagtgggac

SEQ ID NO: 631907 - DNA, 13 bp, D. melanogaster
ggcacagtgggtc

SEQ ID NO: 631908 - DNA, 13 bp, D. melanogaster
ggcacataattaa

SEQ ID NO: 631909 - DNA, 13 bp, D. melanogaster
ggcacatatttgt

SEQ ID NO: 631910 - DNA, 13 bp, D. melanogaster
ggcacatcacaaa

SEQ ID NO: 631911 - DNA, 13 bp, D. melanogaster
ggcaccaaggaca

SEQ ID NO: 631912 - DNA, 13 bp, D. melanogaster
ggcaccagtcacg

SEQ ID NO: 631913 - DNA, 13 bp, D. melanogaster
ggcacccaaaaaa

SEQ ID NO: 631914 - DNA, 13 bp, D. melanogaster
ggcacccaatcca

SEQ ID NO: 631915 - DNA, 13 bp, D. melanogaster
ggcacccacacac

SEQ ID NO: 631916 - DNA, 13 bp, D. melanogaster
ggcaccccgtttt

SEQ ID NO: 631917 - DNA, 13 bp, D. melanogaster
ggcacgaacagcc

SEQ ID NO: 631918 - DNA, 13 bp, D. melanogaster
ggcacgcacacac

SEQ ID NO: 631919 - DNA, 14 bp, D. melanogaster
ggcacgcacacaca

SEQ ID NO: 631920 - DNA, 13 bp, D. melanogaster
ggcacgcccactt

SEQ ID NO: 631921 - DNA, 14 bp, D. melanogaster
ggcacgcccacttt

SEQ ID NO: 631922 - DNA, 13 bp, D. melanogaster
ggcacggttgaca

SEQ ID NO: 631923 - DNA, 13 bp, D. melanogaster
ggcactcaaaaaa

SEQ ID NO: 631924 - DNA, 13 bp, D. melanogaster
ggcactccactaa

SEQ ID NO: 631925 - DNA, 13 bp, D. melanogaster
ggcactgaaaaaa

SEQ ID NO: 631926 - DNA, 13 bp, D. melanogaster
ggcactgagaaaa

SEQ ID NO: 631927 - DNA, 14 bp, D. melanogaster
ggcactgagagaaa

SEQ ID NO: 631928 - DNA, 13 bp, D. melanogaster
ggcactgccactg

SEQ ID NO: 631929 - DNA, 13 bp, D. melanogaster
ggcactggaaaaa

SEQ ID NO: 631930 - DNA, 14 bp, D. melanogaster
ggcactggcactgg

SEQ ID NO: 631931 - DNA, 14 bp, D. melanogaster
ggcactgggcacgg

SEQ ID NO: 631932 - DNA, 13 bp, D. melanogaster
ggcacttacatac

SEQ ID NO: 631933 - DNA, 13 bp, D. melanogaster
ggcacttctagtc

SEQ ID NO: 631934 - DNA, 13 bp, D. melanogaster
ggcacttggcatt

SEQ ID NO: 631935 - DNA, 13 bp, D. melanogaster
ggcacttgtgttt

SEQ ID NO: 631936 - DNA, 13 bp, D. melanogaster
ggcactttgattg

SEQ ID NO: 631937 - DNA, 13 bp, D. melanogaster
ggcacttttttac

SEQ ID NO: 631938 - DNA, 13 bp, D. melanogaster
ggcagaaaattgt

SEQ ID NO: 631939 - DNA, 13 bp, D. melanogaster
ggcagaaacaaca

SEQ ID NO: 631940 - DNA, 13 bp, D. melanogaster
ggcagaagaagca

SEQ ID NO: 631941 - DNA, 14 bp, D. melanogaster
ggcagaagagcagc

SEQ ID NO: 631942 - DNA, 13 bp, D. melanogaster
ggcagaagcagca

SEQ ID NO: 631943 - DNA, 14 bp, D. melanogaster
ggcagaagcagcag

SEQ ID NO: 631944 - DNA, 13 bp, D. melanogaster
ggcagaaggaagt

SEQ ID NO: 631945 - DNA, 13 bp, D. melanogaster
ggcagaaggcaga

SEQ ID NO: 631946 - DNA, 14 bp, D. melanogaster
ggcagaatcgtttc

SEQ ID NO: 631947 - DNA, 13 bp, D. melanogaster
ggcagacaagcag

SEQ ID NO: 631948 - DNA, 13 bp, D. melanogaster
ggcagacagacaa

SEQ ID NO: 631949 - DNA, 13 bp, D. melanogaster
ggcagacagacag

SEQ ID NO: 631950 - DNA, 13 bp, D. melanogaster
ggcagacagagac

SEQ ID NO: 631951 - DNA, 13 bp, D. melanogaster
ggcagagagtcaa

SEQ ID NO: 631952 - DNA, 13 bp, D. melanogaster
ggcagagcaaaca

SEQ ID NO: 631953 - DNA, 13 bp, D. melanogaster
ggcagagcagagc

SEQ ID NO: 631954 - DNA, 13 bp, D. melanogaster
ggcagaggcacga

SEQ ID NO: 631955 - DNA, 14 bp, D. melanogaster
ggcagaggcagcga

SEQ ID NO: 631956 - DNA, 13 bp, D. melanogaster
ggcagagtgccaa

SEQ ID NO: 631957 - DNA, 13 bp, D. melanogaster
ggcagatccgaaa

SEQ ID NO: 631958 - DNA, 13 bp, D. melanogaster
ggcagcaaaaaca

SEQ ID NO: 631959 - DNA, 14 bp, D. melanogaster
ggcagcaaaaacaa

SEQ ID NO: 631960 - DNA, 13 bp, D. melanogaster
ggcagcaaaagaa

SEQ ID NO: 631961 - DNA, 13 bp, D. melanogaster
ggcagcaaaagca

SEQ ID NO: 631962 - DNA, 13 bp, D. melanogaster
ggcagcaaacttt

SEQ ID NO: 631963 - DNA, 13 bp, D. melanogaster
ggcagcaaataaa

SEQ ID NO: 631964 - DNA, 13 bp, D. melanogaster
ggcagcaaatcaa

SEQ ID NO: 631965 - DNA, 13 bp, D. melanogaster
ggcagcaaatgaa

SEQ ID NO: 631966 - DNA, 13 bp, D. melanogaster
ggcagcaaatgca

SEQ ID NO: 631967 - DNA, 14 bp, D. melanogaster
ggcagcaacaaaaa

SEQ ID NO: 631968 - DNA, 13 bp, D. melanogaster
ggcagcaacaaat

SEQ ID NO: 631969 - DNA, 14 bp, D. melanogaster
ggcagcaacaacaa

SEQ ID NO: 631970 - DNA, 14 bp, D. melanogaster
ggcagcaacaacag

SEQ ID NO: 631971 - DNA, 13 bp, D. melanogaster
ggcagcaacaagt

SEQ ID NO: 631972 - DNA, 14 bp, D. melanogaster
ggcagcaacaataa

SEQ ID NO: 631973 - DNA, 13 bp, D. melanogaster
ggcagcaacaatt

SEQ ID NO: 631974 - DNA, 13 bp, D. melanogaster
ggcagcaacagaa

SEQ ID NO: 631975 - DNA, 14 bp, D. melanogaster
ggcagcaacagcaa

SEQ ID NO: 631976 - DNA, 15 bp, D. melanogaster
ggcagcaacagcaac

SEQ ID NO: 631977 - DNA, 13 bp, D. melanogaster
ggcagcaacatgt

SEQ ID NO: 631978 - DNA, 13 bp, D. melanogaster
ggcagcaagaaaa

SEQ ID NO: 631979 - DNA, 13 bp, D. melanogaster
ggcagcaattcgc

SEQ ID NO: 631980 - DNA, 13 bp, D. melanogaster
ggcagcacaaaaa

SEQ ID NO: 631981 - DNA, 13 bp, D. melanogaster
ggcagcagcaaaa

SEQ ID NO: 631982 - DNA, 13 bp, D. melanogaster
ggcagcagcaaag

SEQ ID NO: 631983 - DNA, 14 bp, D. melanogaster
ggcagcagcaacaa

SEQ ID NO: 631984 - DNA, 14 bp, D. melanogaster
ggcagcagcaacag

SEQ ID NO: 631985 - DNA, 14 bp, D. melanogaster
ggcagcagcaacat

SEQ ID NO: 631986 - DNA, 13 bp, D. melanogaster
ggcagcagcaata

SEQ ID NO: 631987 - DNA, 14 bp, D. melanogaster
ggcagcagcagaag

SEQ ID NO: 631988 - DNA, 14 bp, D. melanogaster
ggcagcagcagcaa

SEQ ID NO: 631989 - DNA, 14 bp, D. melanogaster
ggcagcagcagcat

SEQ ID NO: 631990 - DNA, 13 bp, D. melanogaster
ggcagcagcagcc

SEQ ID NO: 631991 - DNA, 14 bp, D. melanogaster
ggcagcagcagccg

SEQ ID NO: 631992 - DNA, 13 bp, D. melanogaster
ggcagcagcagcg

SEQ ID NO: 631993 - DNA, 14 bp, D. melanogaster
ggcagcagcagcgg

SEQ ID NO: 631994 - DNA, 13 bp, D. melanogaster
ggcagcagcagtt

SEQ ID NO: 631995 - DNA, 13 bp, D. melanogaster
ggcagcagcataa

SEQ ID NO: 631996 - DNA, 13 bp, D. melanogaster
ggcagcagcatca

SEQ ID NO: 631997 - DNA, 13 bp, D. melanogaster
ggcagcagccaca

SEQ ID NO: 631998 - DNA, 13 bp, D. melanogaster
ggcagcagcgaaa

SEQ ID NO: 631999 - DNA, 13 bp, D. melanogaster
ggcagcagcggca

SEQ ID NO: 632000 - DNA, 14 bp, D. melanogaster
ggcagcagcggcaa

SEQ ID NO: 632001 - DNA, 13 bp, D. melanogaster
ggcagcagctgca

SEQ ID NO: 632002 - DNA, 13 bp, D. melanogaster
ggcagcagcttag

SEQ ID NO: 632003 - DNA, 13 bp, D. melanogaster
ggcagcaggaaaa

SEQ ID NO: 632004 - DNA, 13 bp, D. melanogaster
ggcagcaggacga

SEQ ID NO: 632005 - DNA, 13 bp, D. melanogaster
ggcagcaggcaac

SEQ ID NO: 632006 - DNA, 14 bp, D. melanogaster
ggcagcagtggagt

SEQ ID NO: 632007 - DNA, 13 bp, D. melanogaster
ggcagcagttgca

SEQ ID NO: 632008 - DNA, 13 bp, D. melanogaster
ggcagcatcagca

SEQ ID NO: 632009 - DNA, 13 bp, D. melanogaster
ggcagccaaaaaa

SEQ ID NO: 632010 - DNA, 13 bp, D. melanogaster
ggcagccaaaaat

SEQ ID NO: 632011 - DNA, 13 bp, D. melanogaster
ggcagccaaaagt

SEQ ID NO: 632012 - DNA, 13 bp, D. melanogaster
ggcagccaaaatg

SEQ ID NO: 632013 - DNA, 13 bp, D. melanogaster
ggcagccaaacaa

SEQ ID NO: 632014 - DNA, 13 bp, D. melanogaster
ggcagccaaatga

SEQ ID NO: 632015 - DNA, 13 bp, D. melanogaster
ggcagccaagaag

SEQ ID NO: 632016 - DNA, 13 bp, D. melanogaster
ggcagccaagcgc

SEQ ID NO: 632017 - DNA, 13 bp, D. melanogaster
ggcagccacaaaa

SEQ ID NO: 632018 - DNA, 13 bp, D. melanogaster
ggcagccataaaa

SEQ ID NO: 632019 - DNA, 13 bp, D. melanogaster
ggcagccattttg

SEQ ID NO: 632020 - DNA, 13 bp, D. melanogaster
ggcagccattttt

SEQ ID NO: 632021 - DNA, 13 bp, D. melanogaster
ggcagccgcaaaa

SEQ ID NO: 632022 - DNA, 13 bp, D. melanogaster
ggcagccgcaaat

SEQ ID NO: 632023 - DNA, 13 bp, D. melanogaster
ggcagccgcagca

SEQ ID NO: 632024 - DNA, 13 bp, D. melanogaster
ggcagcgaaggaa

SEQ ID NO: 632025 - DNA, 14 bp, D. melanogaster
ggcagcgacgccga

SEQ ID NO: 632026 - DNA, 13 bp, D. melanogaster
ggcagcgacgtcg

SEQ ID NO: 632027 - DNA, 13 bp, D. melanogaster
ggcagcgcagtcg

SEQ ID NO: 632028 - DNA, 14 bp, D. melanogaster
ggcagcgcagtcgg

SEQ ID NO: 632029 - DNA, 13 bp, D. melanogaster
ggcagcgctacaa

SEQ ID NO: 632030 - DNA, 13 bp, D. melanogaster
ggcagcggaaatg

SEQ ID NO: 632031 - DNA, 13 bp, D. melanogaster
ggcagcggcaaat

SEQ ID NO: 632032 - DNA, 14 bp, D. melanogaster
ggcagcggcagagg

SEQ ID NO: 632033 - DNA, 14 bp, D. melanogaster
ggcagcggcagcaa

SEQ ID NO: 632034 - DNA, 13 bp, D. melanogaster
ggcagcggcagcg

SEQ ID NO: 632035 - DNA, 14 bp, D. melanogaster
ggcagcggcgcagc

SEQ ID NO: 632036 - DNA, 13 bp, D. melanogaster
ggcagcgggaaaa

SEQ ID NO: 632037 - DNA, 13 bp, D. melanogaster
ggcagctaaaaaa

SEQ ID NO: 632038 - DNA, 13 bp, D. melanogaster
ggcagctaatgaa

SEQ ID NO: 632039 - DNA, 14 bp, D. melanogaster
ggcagctaatgaaa

SEQ ID NO: 632040 - DNA, 13 bp, D. melanogaster
ggcagctaattaa

SEQ ID NO: 632041 - DNA, 14 bp, D. melanogaster
ggcagctcctgcag

SEQ ID NO: 632042 - DNA, 13 bp, D. melanogaster
ggcagctctgcgt

SEQ ID NO: 632043 - DNA, 13 bp, D. melanogaster
ggcagctgcaaaa

SEQ ID NO: 632044 - DNA, 13 bp, D. melanogaster
ggcagctgcaact

SEQ ID NO: 632045 - DNA, 13 bp, D. melanogaster
ggcagctgcattg

SEQ ID NO: 632046 - DNA, 13 bp, D. melanogaster
ggcagctgccaaa

SEQ ID NO: 632047 - DNA, 13 bp, D. melanogaster
ggcagctgctgct

SEQ ID NO: 632048 - DNA, 13 bp, D. melanogaster
ggcagctgcttct

SEQ ID NO: 632049 - DNA, 13 bp, D. melanogaster
ggcagctggaaaa

SEQ ID NO: 632050 - DNA, 13 bp, D. melanogaster
ggcagctggcaaa

SEQ ID NO: 632051 - DNA, 13 bp, D. melanogaster
ggcagctggcagc

SEQ ID NO: 632052 - DNA, 13 bp, D. melanogaster
ggcagctggctaa

SEQ ID NO: 632053 - DNA, 13 bp, D. melanogaster
ggcagctgggaaa

SEQ ID NO: 632054 - DNA, 13 bp, D. melanogaster
ggcagctggtgca

SEQ ID NO: 632055 - DNA, 13 bp, D. melanogaster
ggcagcttgttgg

SEQ ID NO: 632056 - DNA, 13 bp, D. melanogaster
ggcaggaaaagcg

SEQ ID NO: 632057 - DNA, 13 bp, D. melanogaster
ggcaggaaaataa

SEQ ID NO: 632058 - DNA, 13 bp, D. melanogaster
ggcaggaaaatgc

SEQ ID NO: 632059 - DNA, 13 bp, D. melanogaster
ggcaggaaaattg

SEQ ID NO: 632060 - DNA, 13 bp, D. melanogaster
ggcaggacaacaa

SEQ ID NO: 632061 - DNA, 14 bp, D. melanogaster
ggcaggacgaagga

SEQ ID NO: 632062 - DNA, 13 bp, D. melanogaster
ggcaggagcaaca

SEQ ID NO: 632063 - DNA, 13 bp, D. melanogaster
ggcaggagcagaa

SEQ ID NO: 632064 - DNA, 13 bp, D. melanogaster
ggcaggagcagga

SEQ ID NO: 632065 - DNA, 13 bp, D. melanogaster
ggcaggcaaaaaa

SEQ ID NO: 632066 - DNA, 13 bp, D. melanogaster
ggcaggcaaacaa

SEQ ID NO: 632067 - DNA, 13 bp, D. melanogaster
ggcaggcaaataa

SEQ ID NO: 632068 - DNA, 13 bp, D. melanogaster
ggcaggcagcaaa
